United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 6

SEQ ID NO: 219710 - RNA, 22 nt, Human
aauugcuuaucuuguugaauag

SEQ ID NO: 219711 - RNA, 22 nt, Human
uauuuuacaugauccagaguug

SEQ ID NO: 219712 - RNA, 22 nt, Human
gcugggcuugguuucccugcuu

SEQ ID NO: 219713 - RNA, 22 nt, Human
cucucugggcccaguuggcacc

SEQ ID NO: 219714 - RNA, 20 nt, Human
auguaaaauuauaaggcuga

SEQ ID NO: 219715 - RNA, 22 nt, Human
agucagaauucgaucccagguc

SEQ ID NO: 219716 - RNA, 22 nt, Human
uacuuacagaaggaagcaauug

SEQ ID NO: 219717 - RNA, 22 nt, Human
guguccugggggacuucagguu

SEQ ID NO: 219718 - RNA, 22 nt, Human
aaagugcaguaacuugcccaag

SEQ ID NO: 219719 - RNA, 22 nt, Human
gagccuuugaagcccucagaga

SEQ ID NO: 219720 - RNA, 22 nt, Human
uccaggccaauguagcaggccc

SEQ ID NO: 219721 - RNA, 22 nt, Human
gaccuuuagugucauguuauau

SEQ ID NO: 219722 - RNA, 22 nt, Human
cucuguacaggagacaucucua

SEQ ID NO: 219723 - RNA, 22 nt, Human
agaggggaggcgaaccagaguc

SEQ ID NO: 219724 - RNA, 22 nt, Human
cagggcugucuccaaaggcccc

SEQ ID NO: 219725 - RNA, 22 nt, Human
augaaguucucaauaaucaugu

SEQ ID NO: 219726 - RNA, 22 nt, Human
aggcagauuuucuuuacucagu

SEQ ID NO: 219727 - RNA, 23 nt, Human
aaaaucuucugccuaugaagaaa

SEQ ID NO: 219728 - RNA, 22 nt, Human
cugggcucuggggucccggugc

SEQ ID NO: 219729 - RNA, 19 nt, Human
cagagccucagagcuagaa

SEQ ID NO: 219730 - RNA, 22 nt, Human
ccuggcacacgguggcauucaa

SEQ ID NO: 219731 - RNA, 22 nt, Human
ucauguuucucuuacagcagcu

SEQ ID NO: 219732 - RNA, 22 nt, Human
acaggcugacuuccugccaugu

SEQ ID NO: 219733 - RNA, 23 nt, Human
uacugucuucuauuaaguaagga

SEQ ID NO: 219734 - RNA, 22 nt, Human
cuucuguggauguuggaugcau

SEQ ID NO: 219735 - RNA, 22 nt, Human
auggagacugcgucugccaucc

SEQ ID NO: 219736 - RNA, 22 nt, Human
ggcuguggggaccaacaggacu

SEQ ID NO: 219737 - RNA, 22 nt, Human
ggccaaggcucuugagggcuga

SEQ ID NO: 219738 - RNA, 22 nt, Human
agaagcagggcagggaaaagca

SEQ ID NO: 219739 - RNA, 22 nt, Human
aagaauuaucugaaagcugugu

SEQ ID NO: 219740 - RNA, 22 nt, Human
acaggccuuaggagagaugggg

SEQ ID NO: 219741 - RNA, 22 nt, Human
ggccuugaucucucuaacugcu

SEQ ID NO: 219742 - RNA, 22 nt, Human
guguuugugagcuaggugacau

SEQ ID NO: 219743 - RNA, 22 nt, Human
ugacccauggucugaucauagg

SEQ ID NO: 219744 - RNA, 22 nt, Human
uuccuucucagcccucgaggau

SEQ ID NO: 219745 - RNA, 22 nt, Human
uguguccuaugaaagaggguua

SEQ ID NO: 219746 - RNA, 22 nt, Human
uuccucagcacaaagccaagau

SEQ ID NO: 219747 - RNA, 22 nt, Human
gaguguggugaacaggagcacc

SEQ ID NO: 219748 - RNA, 22 nt, Human
uguguucagaauuugcugcuuu

SEQ ID NO: 219749 - RNA, 22 nt, Human
gggcuucugcucuuuuggugcu

SEQ ID NO: 219750 - RNA, 22 nt, Human
aaaucucaaaggcuuagcaucu

SEQ ID NO: 219751 - RNA, 22 nt, Human
uaaaaguauacuuucaaaggag

SEQ ID NO: 219752 - RNA, 18 nt, Human
acauuuaggagagucaau

SEQ ID NO: 219753 - RNA, 18 nt, Human
uggguggcuagggaguuu

SEQ ID NO: 219754 - RNA, 22 nt, Human
uugggaagaggccccuggauuc

SEQ ID NO: 219755 - RNA, 22 nt, Human
ugcaaacaccacagagacaauu

SEQ ID NO: 219756 - RNA, 22 nt, Human
cacuuuauaaaauuggugugag

SEQ ID NO: 219757 - RNA, 22 nt, Human
acguucaaugucagucaacuuu

SEQ ID NO: 219758 - RNA, 22 nt, Human
ggccuucacgugaccuggcgug

SEQ ID NO: 219759 - RNA, 22 nt, Human
aaggugucaaacuagaagaugu

SEQ ID NO: 219760 - RNA, 22 nt, Human
aaacaacaugguggguguguag

SEQ ID NO: 219761 - RNA, 22 nt, Human
uaacaguacauccuuuucucuu

SEQ ID NO: 219762 - RNA, 22 nt, Human
gagcugaaggagaaagcagggg

SEQ ID NO: 219763 - RNA, 22 nt, Human
aacuggauuuaggaacagagaa

SEQ ID NO: 219764 - RNA, 22 nt, Human
uagccaguuucuuuaacagcaa

SEQ ID NO: 219765 - RNA, 22 nt, Human
ucugcacccugugguccucuag

SEQ ID NO: 219766 - RNA, 22 nt, Human
uaggcugggagccugaggcuag

SEQ ID NO: 219767 - RNA, 18 nt, Human
uggugaaggguggaggag

SEQ ID NO: 219768 - RNA, 20 nt, Human
agcugaggcaccugagguua

SEQ ID NO: 219769 - RNA, 19 nt, Human
ucccaguggggagaggugu

SEQ ID NO: 219770 - RNA, 22 nt, Human
aaaguguugggaagaaagugca

SEQ ID NO: 219771 - RNA, 22 nt, Human
acagugcugaucuagacugacc

SEQ ID NO: 219772 - RNA, 21 nt, Human
ccuucucuugcuucagcuuca

SEQ ID NO: 219773 - RNA, 22 nt, Human
gugucccaggccucuggaauua

SEQ ID NO: 219774 - RNA, 22 nt, Human
aacuucuaaucuguacaguuuu

SEQ ID NO: 219775 - RNA, 22 nt, Human
uuccaucugcuagguaaaugaa

SEQ ID NO: 219776 - RNA, 22 nt, Human
uccaggaggaggaaggcugcca

SEQ ID NO: 219777 - RNA, 22 nt, Human
auagucuuacuuuucucugcua

SEQ ID NO: 219778 - RNA, 22 nt, Human
ccaaggccacaaacagccuggc

SEQ ID NO: 219779 - RNA, 22 nt, Human
uggaaacugggaguuaaaugua

SEQ ID NO: 219780 - RNA, 22 nt, Human
acucuggcgggcgggcgagcca

SEQ ID NO: 219781 - RNA, 22 nt, Human
acaggcuugcacuaggguggca

SEQ ID NO: 219782 - RNA, 22 nt, Human
ucaggcagucugacuccggagg

SEQ ID NO: 219783 - RNA, 22 nt, Human
ggccugugcugucagcccuagu

SEQ ID NO: 219784 - RNA, 17 nt, Human
gcuaggagagggaggag

SEQ ID NO: 219785 - RNA, 22 nt, Human
ccuggcucugccguaaccacca

SEQ ID NO: 219786 - RNA, 23 nt, Human
guaaugaugggaauuuacuuaga

SEQ ID NO: 219787 - RNA, 22 nt, Human
agaaagggaugagguagcugcu

SEQ ID NO: 219788 - RNA, 22 nt, Human
auuguauuauaauuaggccaaa

SEQ ID NO: 219789 - RNA, 22 nt, Human
gcaguuuuauuaugauggaaau

SEQ ID NO: 219790 - RNA, 23 nt, Human
uuaugcaagcuuccuggucucag

SEQ ID NO: 219791 - RNA, 22 nt, Human
acagcugcacacugaacuuggu

SEQ ID NO: 219792 - RNA, 22 nt, Human
gcagcuggauuucaagagggag

SEQ ID NO: 219793 - RNA, 22 nt, Human
cugugcucugagcgugggguug

SEQ ID NO: 219794 - RNA, 20 nt, Human
gcacagagaugagcaaagua

SEQ ID NO: 219795 - RNA, 22 nt, Human
acagagcuuaggaugacuccca

SEQ ID NO: 219796 - RNA, 22 nt, Human
ccagcaccuugaucuuggaguu

SEQ ID NO: 219797 - RNA, 21 nt, Human
aguguuaauggaaauuauauu

SEQ ID NO: 219798 - RNA, 22 nt, Human
ucugggcugucuacagguuggc

SEQ ID NO: 219799 - RNA, 19 nt, Human
uacaagcuuuuuuggcagg

SEQ ID NO: 219800 - RNA, 22 nt, Human
ccugggcaacauagugagaccc

SEQ ID NO: 219801 - RNA, 22 nt, Human
caguuaccaucuucagugauga

SEQ ID NO: 219802 - RNA, 22 nt, Human
cccaccucucagagagccuugc

SEQ ID NO: 219803 - RNA, 22 nt, Human
aaucuaagggaaauuggagaug

SEQ ID NO: 219804 - RNA, 18 nt, Human
gcucagcuaugggagguu

SEQ ID NO: 219805 - RNA, 22 nt, Human
uugcaaaugugaauaauuacac

SEQ ID NO: 219806 - RNA, 22 nt, Human
aagggcagcuuaaauugguagc

SEQ ID NO: 219807 - RNA, 22 nt, Human
ugcugagacaacaggaaacaag

SEQ ID NO: 219808 - RNA, 22 nt, Human
ucugcugcugaccaacacugug

SEQ ID NO: 219809 - RNA, 22 nt, Human
gcagggcaucccugagcgggug

SEQ ID NO: 219810 - RNA, 23 nt, Human
gagcagagcgggcggggguccug

SEQ ID NO: 219811 - RNA, 22 nt, Human
ccucuggccagagaaaggccag

SEQ ID NO: 219812 - RNA, 22 nt, Human
cagagagagcaggaaaccuccg

SEQ ID NO: 219813 - RNA, 22 nt, Human
ucacacagcagccccggguguu

SEQ ID NO: 219814 - RNA, 22 nt, Human
agccagcacggauuucccagga

SEQ ID NO: 219815 - RNA, 22 nt, Human
uuucacagugcucuguaaguau

SEQ ID NO: 219816 - RNA, 22 nt, Human
auccacuuggcugguuguucua

SEQ ID NO: 219817 - RNA, 22 nt, Human
acugucaagagauucaaauuca

SEQ ID NO: 219818 - RNA, 22 nt, Human
aagacgcacccuuugagggcac

SEQ ID NO: 219819 - RNA, 22 nt, Human
cugucuucccgaggcccuggag

SEQ ID NO: 219820 - RNA, 22 nt, Human
ucccagaguauuagcaauugcu

SEQ ID NO: 219821 - RNA, 22 nt, Human
uccugagcacagagacaaggaa

SEQ ID NO: 219822 - RNA, 23 nt, Human
uaauucacauauacauugcuuca

SEQ ID NO: 219823 - RNA, 22 nt, Human
agcugcaaagaucugucaguca

SEQ ID NO: 219824 - RNA, 22 nt, Human
acuuccuguauuuauccauagc

SEQ ID NO: 219825 - RNA, 22 nt, Human
ucagcuuuggucacauugaguu

SEQ ID NO: 219826 - RNA, 22 nt, Human
auuacaagaugcauccauauuu

SEQ ID NO: 219827 - RNA, 22 nt, Human
auuucuguuauaccuuucucag

SEQ ID NO: 219828 - RNA, 22 nt, Human
cugggagcuagcucugagcuga

SEQ ID NO: 219829 - RNA, 22 nt, Human
cuacauguagguuuccuuaauu

SEQ ID NO: 219830 - RNA, 21 nt, Human
agcauucaaaagaugccauaa

SEQ ID NO: 219831 - RNA, 22 nt, Human
aagagaaggauucugagccugg

SEQ ID NO: 219832 - RNA, 22 nt, Human
gagaaaggcauuccuaugcaaa

SEQ ID NO: 219833 - RNA, 22 nt, Human
aggaagaaccuaagaaagucuc

SEQ ID NO: 219834 - RNA, 23 nt, Human
ggcacucggccgugaacucgugc

SEQ ID NO: 219835 - RNA, 22 nt, Human
cagcucuuuuuugcagcagcug

SEQ ID NO: 219836 - RNA, 22 nt, Human
ugcugagguuguggagugcauu

SEQ ID NO: 219837 - RNA, 21 nt, Human
ggcacugcugggccaucugcu

SEQ ID NO: 219838 - RNA, 21 nt, Human
aauucccagaaacagcacaag

SEQ ID NO: 219839 - RNA, 22 nt, Human
auuccucauuauuuacugagga

SEQ ID NO: 219840 - RNA, 22 nt, Human
ccucaaauugucaaauaagaau

SEQ ID NO: 219841 - RNA, 22 nt, Human
uauauuaaaugaccaguuuuaa

SEQ ID NO: 219842 - RNA, 22 nt, Human
ggaaggcuccacccaaggcgag

SEQ ID NO: 219843 - RNA, 22 nt, Human
uuucagacugcugugugaaacu

SEQ ID NO: 219844 - RNA, 22 nt, Human
uaaauguaccuucugccuuacu

SEQ ID NO: 219845 - RNA, 22 nt, Human
ucagaagucacuuaggaaaggg

SEQ ID NO: 219846 - RNA, 22 nt, Human
ucagguagugguuaaguucugu

SEQ ID NO: 219847 - RNA, 22 nt, Human
gcccucaguggauucuuauugu

SEQ ID NO: 219848 - RNA, 22 nt, Human
cacaaaugguuguagacauuaa

SEQ ID NO: 219849 - RNA, 22 nt, Human
uuguuaaaaauagauuuccagg

SEQ ID NO: 219850 - RNA, 22 nt, Human
agauggcaggcccugugggggu

SEQ ID NO: 219851 - RNA, 22 nt, Human
cucuugggugggcagugggccu

SEQ ID NO: 219852 - RNA, 22 nt, Human
aggcugccagaagccuucagga

SEQ ID NO: 219853 - RNA, 22 nt, Human
cagaggcccagugagagggcug

SEQ ID NO: 219854 - RNA, 22 nt, Human
uagcugggagugucugaugggu

SEQ ID NO: 219855 - RNA, 22 nt, Human
auuaguguggacccuaauuuaa

SEQ ID NO: 219856 - RNA, 18 nt, Human
acacacacaccuguguau

SEQ ID NO: 219857 - RNA, 21 nt, Human
aggaaaggaaguccccagggu

SEQ ID NO: 219858 - RNA, 19 nt, Human
ccuagagcaguaccuggua

SEQ ID NO: 219859 - RNA, 22 nt, Human
ucuggaagacagugagcccgcu

SEQ ID NO: 219860 - RNA, 22 nt, Human
ugagacuuaagaggucauguug

SEQ ID NO: 219861 - RNA, 22 nt, Human
aaguaguuaggaacauucucuc

SEQ ID NO: 219862 - RNA, 22 nt, Human
agaggcaagauuaucagggcau

SEQ ID NO: 219863 - RNA, 22 nt, Human
aaauuagaccaguucaggucca

SEQ ID NO: 219864 - RNA, 22 nt, Human
uuuauaugguugacuaugaguu

SEQ ID NO: 219865 - RNA, 22 nt, Human
uauuugcaacauaaaacucuga

SEQ ID NO: 219866 - RNA, 22 nt, Human
gucugggcaccuggccugggaa

SEQ ID NO: 219867 - RNA, 22 nt, Human
auguuacagagaaaguggaagc

SEQ ID NO: 219868 - RNA, 22 nt, Human
uucucucugagagcaucuggaa

SEQ ID NO: 219869 - RNA, 22 nt, Human
cucuccagaauuauuacuauua

SEQ ID NO: 219870 - RNA, 23 nt, Human
uccuccugagugagagugccagc

SEQ ID NO: 219871 - RNA, 22 nt, Human
gacugagaaacaguacauuacc

SEQ ID NO: 219872 - RNA, 22 nt, Human
uagcuguguagacacucagagc

SEQ ID NO: 219873 - RNA, 21 nt, Human
gauccacugaccuggggaucc

SEQ ID NO: 219874 - RNA, 22 nt, Human
aggaauguggccuagggaggag

SEQ ID NO: 219875 - RNA, 23 nt, Human
ucaggauauugugugccaaggug

SEQ ID NO: 219876 - RNA, 22 nt, Human
auuguuaugaaaauaagauguu

SEQ ID NO: 219877 - RNA, 22 nt, Human
ugucuuuaguugcuuagauuug

SEQ ID NO: 219878 - RNA, 22 nt, Human
ugcccuggcuccucccacgcug

SEQ ID NO: 219879 - RNA, 23 nt, Human
ugucacauuuaguuggcauuguu

SEQ ID NO: 219880 - RNA, 22 nt, Human
agacauagaaaaucauuaggaa

SEQ ID NO: 219881 - RNA, 22 nt, Human
gcuucucucaggagcaucagcc

SEQ ID NO: 219882 - RNA, 22 nt, Human
agagaauacaaagaagauaugu

SEQ ID NO: 219883 - RNA, 22 nt, Human
gagcacagaacuaaaugcuggu

SEQ ID NO: 219884 - RNA, 22 nt, Human
uggcacaggaauuuagaugcag

SEQ ID NO: 219885 - RNA, 22 nt, Human
ucaggagacuggcagugcccac

SEQ ID NO: 219886 - RNA, 22 nt, Human
cauuaaaauaucucaugguguu

SEQ ID NO: 219887 - RNA, 22 nt, Human
agcugggagcugaaggcugauu

SEQ ID NO: 219888 - RNA, 22 nt, Human
uggguccuugcugauugcugag

SEQ ID NO: 219889 - RNA, 22 nt, Human
caggagaagucucuagggggug

SEQ ID NO: 219890 - RNA, 21 nt, Human
ggcacagccugaaaugccuca

SEQ ID NO: 219891 - RNA, 22 nt, Human
cagcucaguuucaauaccaggu

SEQ ID NO: 219892 - RNA, 22 nt, Human
uuugaucagcaagauaaauaga

SEQ ID NO: 219893 - RNA, 21 nt, Human
agauuacaggugugauccacc

SEQ ID NO: 219894 - RNA, 22 nt, Human
acuguauugguuuucuauugcu

SEQ ID NO: 219895 - RNA, 22 nt, Human
caguuggugaugaggcuaguag

SEQ ID NO: 219896 - RNA, 22 nt, Human
gaggcuggaggucaaagaugaa

SEQ ID NO: 219897 - RNA, 22 nt, Human
ucgggcucgcucuccuagcgga

SEQ ID NO: 219898 - RNA, 22 nt, Human
agcugcaaaggcacacuugggc

SEQ ID NO: 219899 - RNA, 22 nt, Human
agcaggcuccaggcuggccauc

SEQ ID NO: 219900 - RNA, 22 nt, Human
gcagagcuccccaagacaccaa

SEQ ID NO: 219901 - RNA, 22 nt, Human
acuguacacagugguguacugu

SEQ ID NO: 219902 - RNA, 22 nt, Human
gguguccuugcuccuucagcuu

SEQ ID NO: 219903 - RNA, 22 nt, Human
gaaggaggucugauacaauaug

SEQ ID NO: 219904 - RNA, 22 nt, Human
agcuguuuguacuuagauagua

SEQ ID NO: 219905 - RNA, 22 nt, Human
cacaguuauauguucacaagga

SEQ ID NO: 219906 - RNA, 22 nt, Human
aguggcagacagagacaguacc

SEQ ID NO: 219907 - RNA, 22 nt, Human
cuuuggaacacaugggcauggu

SEQ ID NO: 219908 - RNA, 22 nt, Human
auuaagacuauugauauuuaca

SEQ ID NO: 219909 - RNA, 22 nt, Human
ccuuagaaggcugaauaauucu

SEQ ID NO: 219910 - RNA, 22 nt, Human
acucuguagauguggaaaugcg

SEQ ID NO: 219911 - RNA, 22 nt, Human
aauugcaacagguagacuuuuc

SEQ ID NO: 219912 - RNA, 22 nt, Human
cacugagcaugagugggcugug

SEQ ID NO: 219913 - RNA, 22 nt, Human
uugcucuguccagccagcaggu

SEQ ID NO: 219914 - RNA, 21 nt, Human
agugaaauugcaucagaggga

SEQ ID NO: 219915 - RNA, 16 nt, Human
gugcaaaagugaggag

SEQ ID NO: 219916 - RNA, 22 nt, Human
caugagcugcugggagccuguc

SEQ ID NO: 219917 - RNA, 22 nt, Human
ggcauccaguucugaucaacaa

SEQ ID NO: 219918 - RNA, 22 nt, Human
uuauauacugugguaguacugu

SEQ ID NO: 219919 - RNA, 22 nt, Human
acaacaggguaaggcaggccau

SEQ ID NO: 219920 - RNA, 22 nt, Human
ucccucagaugagcuccuagca

SEQ ID NO: 219921 - RNA, 22 nt, Human
ccauuuggaggucauuaggaca

SEQ ID NO: 219922 - RNA, 23 nt, Human
uguuccagauacgccuuuuccuc

SEQ ID NO: 219923 - RNA, 22 nt, Human
ucaaaauuuuauuucucaagga

SEQ ID NO: 219924 - RNA, 22 nt, Human
ucuggcucuccagugcucuuag

SEQ ID NO: 219925 - RNA, 22 nt, Human
ccagcugcccaagaggcauccu

SEQ ID NO: 219926 - RNA, 22 nt, Human
uuugaaagcaggugugggaggg

SEQ ID NO: 219927 - RNA, 22 nt, Human
cagaauuuagaaaacaacauaa

SEQ ID NO: 219928 - RNA, 22 nt, Human
auauugagauaagaacugacau

SEQ ID NO: 219929 - RNA, 22 nt, Human
gaggugaguggggucuccaggg

SEQ ID NO: 219930 - RNA, 22 nt, Human
agaaggccuaacuugggggcaa

SEQ ID NO: 219931 - RNA, 22 nt, Human
uuggcacacaguaagcccuaag

SEQ ID NO: 219932 - RNA, 22 nt, Human
cuggggcuggugaggcaggcuc

SEQ ID NO: 219933 - RNA, 22 nt, Human
cauuccaaguauauacaugaua

SEQ ID NO: 219934 - RNA, 22 nt, Human
cuuuaugguaaguauagaugac

SEQ ID NO: 219935 - RNA, 22 nt, Human
ccaggcagaaugaaaccccugu

SEQ ID NO: 219936 - RNA, 19 nt, Human
aggaaagguggccuuagca

SEQ ID NO: 219937 - RNA, 22 nt, Human
gaagguuuucaggagccuaguc

SEQ ID NO: 219938 - RNA, 22 nt, Human
uguucauuccggggagggcuaa

SEQ ID NO: 219939 - RNA, 22 nt, Human
uguccuuuuccccaaauucacu

SEQ ID NO: 219940 - RNA, 22 nt, Human
ggcaaaaaccauaauuacuuuu

SEQ ID NO: 219941 - RNA, 22 nt, Human
aaugucaaucucagagaacaca

SEQ ID NO: 219942 - RNA, 22 nt, Human
aaugcaaauucuagggcccuau

SEQ ID NO: 219943 - RNA, 22 nt, Human
uggaagggagugacagucagag

SEQ ID NO: 219944 - RNA, 22 nt, Human
ucugccagcccugugagucuug

SEQ ID NO: 219945 - RNA, 22 nt, Human
gggcaguugauggaggucugga

SEQ ID NO: 219946 - RNA, 22 nt, Human
caggcagcucaaccuugggagc

SEQ ID NO: 219947 - RNA, 22 nt, Human
caccucaugucaucaguaaaau

SEQ ID NO: 219948 - RNA, 22 nt, Human
ugcauuaagugucugcauaugg

SEQ ID NO: 219949 - RNA, 22 nt, Human
cagaaauucccauuucagauuc

SEQ ID NO: 219950 - RNA, 22 nt, Human
cuuuguaucuaaauaucuugaa

SEQ ID NO: 219951 - RNA, 22 nt, Human
guuauuuuaucucugagagguu

SEQ ID NO: 219952 - RNA, 20 nt, Human
uaaacaguauuuacuaggag

SEQ ID NO: 219953 - RNA, 22 nt, Human
agcuccugccaacacugauggg

SEQ ID NO: 219954 - RNA, 22 nt, Human
guaauuacauuaggguaaauaa

SEQ ID NO: 219955 - RNA, 22 nt, Human
aguaggguguugcuauaacaag

SEQ ID NO: 219956 - RNA, 22 nt, Human
cauuugcugaggccuucagagg

SEQ ID NO: 219957 - RNA, 22 nt, Human
aguugcugauucugucugugau

SEQ ID NO: 219958 - RNA, 22 nt, Human
gucugcccugcagacaugccuc

SEQ ID NO: 219959 - RNA, 22 nt, Human
augaggcagauguugcaugagg

SEQ ID NO: 219960 - RNA, 22 nt, Human
aauugcuuguuucuuuaacuga

SEQ ID NO: 219961 - RNA, 22 nt, Human
acuuucuccagaaaaccaagga

SEQ ID NO: 219962 - RNA, 22 nt, Human
ccaagcaaauaaucacccacua

SEQ ID NO: 219963 - RNA, 21 nt, Human
uuacaugguuuaucauaugga

SEQ ID NO: 219964 - RNA, 22 nt, Human
uuccuggggugaagauauuuuu

SEQ ID NO: 219965 - RNA, 22 nt, Human
uacgugcaaggucccugccccu

SEQ ID NO: 219966 - RNA, 22 nt, Human
aucugguuuuggcugugucccu

SEQ ID NO: 219967 - RNA, 22 nt, Human
gucuggcuuugcucagaugcug

SEQ ID NO: 219968 - RNA, 22 nt, Human
aagugcaugguauggucuccau

SEQ ID NO: 219969 - RNA, 22 nt, Human
cagggcugcuggccgugcccuc

SEQ ID NO: 219970 - RNA, 22 nt, Human
gaugcugauuuuacuguuuucu

SEQ ID NO: 219971 - RNA, 22 nt, Human
gcccugggcucccugcuccaca

SEQ ID NO: 219972 - RNA, 22 nt, Human
ggccagcuccuuggcagugccu

SEQ ID NO: 219973 - RNA, 22 nt, Human
ucugaaggugcuagagaaagcu

SEQ ID NO: 219974 - RNA, 22 nt, Human
uuugcaaaccggagcucugcaa

SEQ ID NO: 219975 - RNA, 22 nt, Human
cucaggauucucgacacucaca

SEQ ID NO: 219976 - RNA, 22 nt, Human
uuuagcuauggauaacaaccac

SEQ ID NO: 219977 - RNA, 22 nt, Human
acacccagauuaugcacacaaa

SEQ ID NO: 219978 - RNA, 22 nt, Human
cuggcuuccucaggagcagugg

SEQ ID NO: 219979 - RNA, 22 nt, Human
ugcuagggauacaguggugaau

SEQ ID NO: 219980 - RNA, 22 nt, Human
gaaggaggucugcauucuacag

SEQ ID NO: 219981 - RNA, 23 nt, Human
acuagaaaaugacuuucucccug

SEQ ID NO: 219982 - RNA, 22 nt, Human
cuagagaagagguuaagcauga

SEQ ID NO: 219983 - RNA, 22 nt, Human
cagcuuggcgaauguagguaug

SEQ ID NO: 219984 - RNA, 22 nt, Human
gucacuguauccagguuccagc

SEQ ID NO: 219985 - RNA, 22 nt, Human
auguccagccaaccacuggauu

SEQ ID NO: 219986 - RNA, 18 nt, Human
aggucuguggucaccagg

SEQ ID NO: 219987 - RNA, 22 nt, Human
ucuucauuuuacaggcagaccu

SEQ ID NO: 219988 - RNA, 22 nt, Human
agcuggguacagccugugccua

SEQ ID NO: 219989 - RNA, 22 nt, Human
uccauucuuuugcugucuuccu

SEQ ID NO: 219990 - RNA, 22 nt, Human
auuucuagguagagaagcuuag

SEQ ID NO: 219991 - RNA, 22 nt, Human
aaaguuaguaaaaugggauaua

SEQ ID NO: 219992 - RNA, 19 nt, Human
ugagaggcuuaaggcagcu

SEQ ID NO: 219993 - RNA, 20 nt, Human
cccuggacuccugagcaaac

SEQ ID NO: 219994 - RNA, 22 nt, Human
gaaauauuacaguggaggggau

SEQ ID NO: 219995 - RNA, 22 nt, Human
ccugcagguugcagaggcggaa

SEQ ID NO: 219996 - RNA, 22 nt, Human
cugggcugauuuagucacguuu

SEQ ID NO: 219997 - RNA, 22 nt, Human
cucaggaggccauucucaaggu

SEQ ID NO: 219998 - RNA, 22 nt, Human
agucacauuugggggugucaaa

SEQ ID NO: 219999 - RNA, 22 nt, Human
aggcuccagccaaugggucugu

SEQ ID NO: 220000 - RNA, 22 nt, Human
gccaggaaagggaauucccuga

SEQ ID NO: 220001 - RNA, 22 nt, Human
acauuucucagguaagucauuu

SEQ ID NO: 220002 - RNA, 22 nt, Human
ggagccagagucugcaguguaa

SEQ ID NO: 220003 - RNA, 19 nt, Human
gacaauuagagaucacuca

SEQ ID NO: 220004 - RNA, 22 nt, Human
aagcacagauaaaacaggauuc

SEQ ID NO: 220005 - RNA, 22 nt, Human
agguggcuguggcuucccuugu

SEQ ID NO: 220006 - RNA, 19 nt, Human
uggcugggcgugccuccgu

SEQ ID NO: 220007 - RNA, 22 nt, Human
gagcaguguuuguggaccugga

SEQ ID NO: 220008 - RNA, 22 nt, Human
ugaaagguuauuuaggucugcu

SEQ ID NO: 220009 - RNA, 22 nt, Human
uuuggaaugcccauggacuggu

SEQ ID NO: 220010 - RNA, 22 nt, Human
ucugacaugagggcuguggaga

SEQ ID NO: 220011 - RNA, 22 nt, Human
uuuuugcugauaagcagaauuc

SEQ ID NO: 220012 - RNA, 22 nt, Human
aagcagaguuagcuugucaccu

SEQ ID NO: 220013 - RNA, 22 nt, Human
gugcugaguagaaugaaugccu

SEQ ID NO: 220014 - RNA, 22 nt, Human
cugccuguuccugaucauucua

SEQ ID NO: 220015 - RNA, 21 nt, Human
cucugguccugucuggcaggc

SEQ ID NO: 220016 - RNA, 22 nt, Human
gcaaggcagcgcggaguagcua

SEQ ID NO: 220017 - RNA, 22 nt, Human
gauguaaaaacuccuuucgaaa

SEQ ID NO: 220018 - RNA, 22 nt, Human
agccaugggcucccaguccuuu

SEQ ID NO: 220019 - RNA, 22 nt, Human
cugggaggcggagguuguagug

SEQ ID NO: 220020 - RNA, 22 nt, Human
cagcucugccacuuccuagcua

SEQ ID NO: 220021 - RNA, 18 nt, Human
aggccucugugugcccag

SEQ ID NO: 220022 - RNA, 22 nt, Human
uuaaaaucgcuguugcuucugu

SEQ ID NO: 220023 - RNA, 22 nt, Human
augaugaaaugauagguuuguu

SEQ ID NO: 220024 - RNA, 22 nt, Human
aagaguaaaugucuaauuagga

SEQ ID NO: 220025 - RNA, 22 nt, Human
auguaauuuauguuauccauaa

SEQ ID NO: 220026 - RNA, 22 nt, Human
cucugcccagugcccacaggag

SEQ ID NO: 220027 - RNA, 22 nt, Human
uucagagcaucucuaaagccag

SEQ ID NO: 220028 - RNA, 22 nt, Human
cugccaggcagggagauggcug

SEQ ID NO: 220029 - RNA, 22 nt, Human
cacaccagauggcagcguggga

SEQ ID NO: 220030 - RNA, 22 nt, Human
auuugcuuaucuccacaguugu

SEQ ID NO: 220031 - RNA, 22 nt, Human
ucugggagagucacaggcauug

SEQ ID NO: 220032 - RNA, 22 nt, Human
aggccagggccagauuagccac

SEQ ID NO: 220033 - RNA, 22 nt, Human
gacagaugagggaguauucuca

SEQ ID NO: 220034 - RNA, 22 nt, Human
caggcagaugcugacaagaguu

SEQ ID NO: 220035 - RNA, 22 nt, Human
uaggcuccugaggacuccaugc

SEQ ID NO: 220036 - RNA, 22 nt, Human
ugcugaggcccaggagcacuuu

SEQ ID NO: 220037 - RNA, 22 nt, Human
aaagcuggcuuuuacaggggcu

SEQ ID NO: 220038 - RNA, 22 nt, Human
augaacagcauugaaauccagc

SEQ ID NO: 220039 - RNA, 22 nt, Human
uggcagugucuuaucaggagug

SEQ ID NO: 220040 - RNA, 22 nt, Human
aauuauacaugaaggcauuaua

SEQ ID NO: 220041 - RNA, 22 nt, Human
gccagagugccaucagugccau

SEQ ID NO: 220042 - RNA, 22 nt, Human
uuuauagucgucucaguaauaa

SEQ ID NO: 220043 - RNA, 22 nt, Human
acacuuuaagcauuucacacug

SEQ ID NO: 220044 - RNA, 22 nt, Human
ugagccguggucucugagggug

SEQ ID NO: 220045 - RNA, 22 nt, Human
cuggcuccaucuuugcuuccug

SEQ ID NO: 220046 - RNA, 22 nt, Human
cucuagcugaggucacugcuau

SEQ ID NO: 220047 - RNA, 22 nt, Human
ggccagcugcucagugucucug

SEQ ID NO: 220048 - RNA, 22 nt, Human
aacaguuuaugagauaugcuau

SEQ ID NO: 220049 - RNA, 22 nt, Human
ugagucagugacaugaacuugu

SEQ ID NO: 220050 - RNA, 22 nt, Human
aacugcaauuacuuuugcgcca

SEQ ID NO: 220051 - RNA, 22 nt, Human
gcagggaagaucuuggagcugc

SEQ ID NO: 220052 - RNA, 22 nt, Human
cagcucuacguuucuaugaauc

SEQ ID NO: 220053 - RNA, 20 nt, Human
agugaguuaucagcuacagu

SEQ ID NO: 220054 - RNA, 22 nt, Human
aggcugucucaccucaggaggg

SEQ ID NO: 220055 - RNA, 20 nt, Human
caguggcuucuguggaauau

SEQ ID NO: 220056 - RNA, 22 nt, Human
ccuagggauacagcagaguaca

SEQ ID NO: 220057 - RNA, 22 nt, Human
cagugagguagacagcuuuuuc

SEQ ID NO: 220058 - RNA, 19 nt, Human
cagaaauagcgaaguguaa

SEQ ID NO: 220059 - RNA, 22 nt, Human
auuuuguuuccuuuggaguaga

SEQ ID NO: 220060 - RNA, 22 nt, Human
guacaugugcacaaugugcagg

SEQ ID NO: 220061 - RNA, 22 nt, Human
uccacagacuauuaagugaucu

SEQ ID NO: 220062 - RNA, 22 nt, Human
cugcccugggaguaccuguccu

SEQ ID NO: 220063 - RNA, 22 nt, Human
cagcuggaggagcagcuuccag

SEQ ID NO: 220064 - RNA, 22 nt, Human
aagaguuagcucaauaacuuga

SEQ ID NO: 220065 - RNA, 22 nt, Human
gagggcagugaauuuugaagcu

SEQ ID NO: 220066 - RNA, 22 nt, Human
aggucauuuuugccuucuauuu

SEQ ID NO: 220067 - RNA, 21 nt, Human
cccaagggaggcaggauaagg

SEQ ID NO: 220068 - RNA, 21 nt, Human
ugcuaagugucacaugucugc

SEQ ID NO: 220069 - RNA, 22 nt, Human
aaaauguucaagcaugcugguu

SEQ ID NO: 220070 - RNA, 22 nt, Human
aggcucagccccugggaggaga

SEQ ID NO: 220071 - RNA, 22 nt, Human
gaggcagcgggucaggaccgug

SEQ ID NO: 220072 - RNA, 22 nt, Human
agaagggccagcuggacaccug

SEQ ID NO: 220073 - RNA, 22 nt, Human
gaaggcugaguggguacggagg

SEQ ID NO: 220074 - RNA, 20 nt, Human
agagugcuggacugaggagc

SEQ ID NO: 220075 - RNA, 22 nt, Human
uccaggcagucauuaaucucua

SEQ ID NO: 220076 - RNA, 22 nt, Human
agcugauacauuucuuguagcc

SEQ ID NO: 220077 - RNA, 22 nt, Human
ugagaucucugccuauauggau

SEQ ID NO: 220078 - RNA, 22 nt, Human
acaaauagagauucaaauaaag

SEQ ID NO: 220079 - RNA, 22 nt, Human
caggggcugagaaggaacgucc

SEQ ID NO: 220080 - RNA, 22 nt, Human
auuuugaugcuaucuaaugaau

SEQ ID NO: 220081 - RNA, 22 nt, Human
aggaauguauugaccuguugca

SEQ ID NO: 220082 - RNA, 22 nt, Human
gguguccuuagaaagcagaccu

SEQ ID NO: 220083 - RNA, 22 nt, Human
gcugcaggcauuuuccugggca

SEQ ID NO: 220084 - RNA, 23 nt, Human
ugcuggcuuuuaucuggucccua

SEQ ID NO: 220085 - RNA, 22 nt, Human
gugcaccccggggcccugcucc

SEQ ID NO: 220086 - RNA, 22 nt, Human
cucugcccccagcuggugcuug

SEQ ID NO: 220087 - RNA, 22 nt, Human
cucccaguguuguuuucugaug

SEQ ID NO: 220088 - RNA, 22 nt, Human
acuuucaugguaguuguauucu

SEQ ID NO: 220089 - RNA, 22 nt, Human
ucaaguauuuauuucugcuggc

SEQ ID NO: 220090 - RNA, 22 nt, Human
aagcacagugggcagagcagcc

SEQ ID NO: 220091 - RNA, 22 nt, Human
auuuugaaauacuugaaggaaa

SEQ ID NO: 220092 - RNA, 18 nt, Human
uccaaagcugcugguuuu

SEQ ID NO: 220093 - RNA, 22 nt, Human
agugcugacucugggcacagug

SEQ ID NO: 220094 - RNA, 22 nt, Human
agccacaggaaacagagacagc

SEQ ID NO: 220095 - RNA, 22 nt, Human
ugcacacacgcggcacaucugu

SEQ ID NO: 220096 - RNA, 22 nt, Human
uuugggcaauucagugggaccu

SEQ ID NO: 220097 - RNA, 22 nt, Human
uuaauuaagagauacugcagua

SEQ ID NO: 220098 - RNA, 20 nt, Human
uuuuuccuucucuacaggca

SEQ ID NO: 220099 - RNA, 22 nt, Human
aggcaggaggaucauggaugca

SEQ ID NO: 220100 - RNA, 22 nt, Human
agggucagggagugaguauuua

SEQ ID NO: 220101 - RNA, 22 nt, Human
aggugccaccucuggugcuguc

SEQ ID NO: 220102 - RNA, 22 nt, Human
cuggcagggugggcuuugcuuu

SEQ ID NO: 220103 - RNA, 20 nt, Human
ugggccuguggcagaagucu

SEQ ID NO: 220104 - RNA, 22 nt, Human
ucugaaagcuagaaaaugcucu

SEQ ID NO: 220105 - RNA, 22 nt, Human
gaugaggcauaaacacagucac

SEQ ID NO: 220106 - RNA, 22 nt, Human
ugcaaagaagccuuugccuucu

SEQ ID NO: 220107 - RNA, 23 nt, Human
aggaaacugaaggggcccucuau

SEQ ID NO: 220108 - RNA, 22 nt, Human
cagaaacugcuuguggucaucu

SEQ ID NO: 220109 - RNA, 22 nt, Human
uccuccaagcagaggcccugaa

SEQ ID NO: 220110 - RNA, 23 nt, Human
agcuccuguaagguggucgucac

SEQ ID NO: 220111 - RNA, 22 nt, Human
auuaucuugauaaaauggcagu

SEQ ID NO: 220112 - RNA, 22 nt, Human
cuuucuagacuguccagaugau

SEQ ID NO: 220113 - RNA, 20 nt, Human
ggccugagcauggcuggcag

SEQ ID NO: 220114 - RNA, 22 nt, Human
agcaugcaguaaagcccauguc

SEQ ID NO: 220115 - RNA, 22 nt, Human
agcugugugaccuagggcaagc

SEQ ID NO: 220116 - RNA, 22 nt, Human
caaggcuucacguccccagugc

SEQ ID NO: 220117 - RNA, 22 nt, Human
augucuguucauuauuaacugc

SEQ ID NO: 220118 - RNA, 22 nt, Human
gggagcugagcucugagccacg

SEQ ID NO: 220119 - RNA, 22 nt, Human
aauuccacagaugucuaucugu

SEQ ID NO: 220120 - RNA, 22 nt, Human
uugaaugaagucccuuuuuacu

SEQ ID NO: 220121 - RNA, 22 nt, Human
uguaaagauccuuagcaacauc

SEQ ID NO: 220122 - RNA, 21 nt, Human
cgcagagcgaacuugcggcgc

SEQ ID NO: 220123 - RNA, 22 nt, Human
ccugugucuuugccucaggguc

SEQ ID NO: 220124 - RNA, 22 nt, Human
guccugugugacuucccaaaug

SEQ ID NO: 220125 - RNA, 22 nt, Human
ugugcugcucucagugacagcc

SEQ ID NO: 220126 - RNA, 18 nt, Human
cuaucccuggagcuuggg

SEQ ID NO: 220127 - RNA, 22 nt, Human
uuuggaauggaauagagauugc

SEQ ID NO: 220128 - RNA, 22 nt, Human
aaagcagaacugagagagcugg

SEQ ID NO: 220129 - RNA, 22 nt, Human
uuuauuuggcaucucugccaag

SEQ ID NO: 220130 - RNA, 22 nt, Human
gcugcucuuuucagagaugaga

SEQ ID NO: 220131 - RNA, 22 nt, Human
ucugggaaaguaaauguaaagg

SEQ ID NO: 220132 - RNA, 17 nt, Human
uguuuucugcuaccuuu

SEQ ID NO: 220133 - RNA, 22 nt, Human
aaaucccagauaguaauguauu

SEQ ID NO: 220134 - RNA, 19 nt, Human
gaggaggcuucagcuuucu

SEQ ID NO: 220135 - RNA, 22 nt, Human
uuuuuagaguguuaccaguaua

SEQ ID NO: 220136 - RNA, 22 nt, Human
uuuauucuauaggcauuaagca

SEQ ID NO: 220137 - RNA, 22 nt, Human
agggagcugacuggcugccauu

SEQ ID NO: 220138 - RNA, 22 nt, Human
ggagcacaccgggagcuugccu

SEQ ID NO: 220139 - RNA, 22 nt, Human
guggaaaugcccccaaauagug

SEQ ID NO: 220140 - RNA, 22 nt, Human
gcuugucugcugagccaccugu

SEQ ID NO: 220141 - RNA, 21 nt, Human
ccaggucuugguccuuggacu

SEQ ID NO: 220142 - RNA, 22 nt, Human
aaagugcacuagaauccagauu

SEQ ID NO: 220143 - RNA, 22 nt, Human
uccaucuggaugguauguguaa

SEQ ID NO: 220144 - RNA, 22 nt, Human
ggcuccaggaaccuccucuccu

SEQ ID NO: 220145 - RNA, 22 nt, Human
aucuccagaggagucauggucu

SEQ ID NO: 220146 - RNA, 22 nt, Human
ggaaaagacagaauucuagaau

SEQ ID NO: 220147 - RNA, 22 nt, Human
ggaacagacugacuucuugaau

SEQ ID NO: 220148 - RNA, 22 nt, Human
aacuguugucauauggucuuaa

SEQ ID NO: 220149 - RNA, 22 nt, Human
ucgccauggaaguccuugcgga

SEQ ID NO: 220150 - RNA, 22 nt, Human
gcaggcuccaacuggaggaguu

SEQ ID NO: 220151 - RNA, 22 nt, Human
ccacugccaugggcuaggcaug

SEQ ID NO: 220152 - RNA, 20 nt, Human
acauuuuggcauacucucaa

SEQ ID NO: 220153 - RNA, 22 nt, Human
uagcuuuaccauagaagaguau

SEQ ID NO: 220154 - RNA, 20 nt, Human
accugggauuagauacccaa

SEQ ID NO: 220155 - RNA, 22 nt, Human
ucucugcucaggcaccagcccu

SEQ ID NO: 220156 - RNA, 22 nt, Human
aaggaccugauuuugagcaucu

SEQ ID NO: 220157 - RNA, 22 nt, Human
uucuuuggcugccagucuggag

SEQ ID NO: 220158 - RNA, 22 nt, Human
ucugugcagaaucaaggagcuu

SEQ ID NO: 220159 - RNA, 22 nt, Human
aaauuucuggaagugucagagu

SEQ ID NO: 220160 - RNA, 22 nt, Human
uuggcuucaaugucagagacag

SEQ ID NO: 220161 - RNA, 22 nt, Human
uggcuucaaagguagcauacaa

SEQ ID NO: 220162 - RNA, 22 nt, Human
cuccuacauaacccagcgaacu

SEQ ID NO: 220163 - RNA, 22 nt, Human
gcuuggcuugggcucagaggcc

SEQ ID NO: 220164 - RNA, 21 nt, Human
ucuggguguaaaucuuauuug

SEQ ID NO: 220165 - RNA, 22 nt, Human
aagagagggacuuauuaaaguc

SEQ ID NO: 220166 - RNA, 22 nt, Human
uauacacauguguguauucaua

SEQ ID NO: 220167 - RNA, 22 nt, Human
auuuugauguaucuuuguagcu

SEQ ID NO: 220168 - RNA, 22 nt, Human
ggaggagcacuucugagcucag

SEQ ID NO: 220169 - RNA, 22 nt, Human
aagaaaaucaguucuggucagu

SEQ ID NO: 220170 - RNA, 22 nt, Human
caggcucccacuuggcuuaaag

SEQ ID NO: 220171 - RNA, 22 nt, Human
uccuggagcuuccuucauggua

SEQ ID NO: 220172 - RNA, 22 nt, Human
gcaccugcuggaaucagucugu

SEQ ID NO: 220173 - RNA, 22 nt, Human
cugauguucauuucuuuuguac

SEQ ID NO: 220174 - RNA, 22 nt, Human
uagcagcacauggugguuuuau

SEQ ID NO: 220175 - RNA, 22 nt, Human
aaucuguaacauucaauaaaga

SEQ ID NO: 220176 - RNA, 22 nt, Human
uggcagagacuccuccugggag

SEQ ID NO: 220177 - RNA, 22 nt, Human
uccaggcaucccccaggacaga

SEQ ID NO: 220178 - RNA, 22 nt, Human
uacaagcuggcgcaguuaagau

SEQ ID NO: 220179 - RNA, 22 nt, Human
aagugaguucagcauucacucg

SEQ ID NO: 220180 - RNA, 22 nt, Human
gcacaugguaggcauuugaugu

SEQ ID NO: 220181 - RNA, 22 nt, Human
caggugcugcagggcuggcguc

SEQ ID NO: 220182 - RNA, 22 nt, Human
gguguugggcucacugguccuu

SEQ ID NO: 220183 - RNA, 22 nt, Human
acagugucaucaguuucucaac

SEQ ID NO: 220184 - RNA, 22 nt, Human
auguaucacagcaauguaguca

SEQ ID NO: 220185 - RNA, 22 nt, Human
uaguauuuauaaucaugcuuaa

SEQ ID NO: 220186 - RNA, 22 nt, Human
uauucagugacaggguauuaug

SEQ ID NO: 220187 - RNA, 22 nt, Human
gugagcaaagguuaaacauuua

SEQ ID NO: 220188 - RNA, 22 nt, Human
auuagaaaccaagaggcaggcu

SEQ ID NO: 220189 - RNA, 22 nt, Human
ucugcaacauuccucuccccac

SEQ ID NO: 220190 - RNA, 22 nt, Human
auguguccuuauaagaagaaga

SEQ ID NO: 220191 - RNA, 22 nt, Human
agaggcugucucauauuuugua

SEQ ID NO: 220192 - RNA, 22 nt, Human
gggcucugccuggcugggagua

SEQ ID NO: 220193 - RNA, 22 nt, Human
uacaaacuguuauuauuauugu

SEQ ID NO: 220194 - RNA, 22 nt, Human
gcugggcucaccaggccacuag

SEQ ID NO: 220195 - RNA, 22 nt, Human
gggaaggacauucugggcucag

SEQ ID NO: 220196 - RNA, 22 nt, Human
gaucaauacuauuaagaucaua

SEQ ID NO: 220197 - RNA, 22 nt, Human
caugucuuuguuaugcucacca

SEQ ID NO: 220198 - RNA, 17 nt, Human
ccaggagagaugcuugu

SEQ ID NO: 220199 - RNA, 22 nt, Human
ugcauuggucuuaaucuucagg

SEQ ID NO: 220200 - RNA, 22 nt, Human
aaaauagauucuaggaugucuu

SEQ ID NO: 220201 - RNA, 22 nt, Human
ucucuguaaaauguggaugaua

SEQ ID NO: 220202 - RNA, 22 nt, Human
ucauggcuuuuauuauguugag

SEQ ID NO: 220203 - RNA, 22 nt, Human
ucuccucuauuucuguauguau

SEQ ID NO: 220204 - RNA, 22 nt, Human
caauguuuucaacugacaagua

SEQ ID NO: 220205 - RNA, 22 nt, Human
uuccugagaacauggcagcuua

SEQ ID NO: 220206 - RNA, 17 nt, Human
agggggaaccugggagg

SEQ ID NO: 220207 - RNA, 22 nt, Human
aaagaacagauguguggugcau

SEQ ID NO: 220208 - RNA, 22 nt, Human
uguguauagaugcaugcauaua

SEQ ID NO: 220209 - RNA, 22 nt, Human
cugggggucgcgccucugggca

SEQ ID NO: 220210 - RNA, 22 nt, Human
uugaaucuggguacuuguaaua

SEQ ID NO: 220211 - RNA, 22 nt, Human
auacauguaacugcauuguaau

SEQ ID NO: 220212 - RNA, 22 nt, Human
uuacacuuaggguuugucagag

SEQ ID NO: 220213 - RNA, 22 nt, Human
ccucaggcuugugagccuucag

SEQ ID NO: 220214 - RNA, 22 nt, Human
cccuggccuacaggcccagaga

SEQ ID NO: 220215 - RNA, 22 nt, Human
ccagagguccccugccaggagg

SEQ ID NO: 220216 - RNA, 22 nt, Human
acagauuuuaaauuuguaguug

SEQ ID NO: 220217 - RNA, 22 nt, Human
aggucaccauggcaugcuccac

SEQ ID NO: 220218 - RNA, 22 nt, Human
ugggaagcugcauuuuaacaag

SEQ ID NO: 220219 - RNA, 22 nt, Human
ccagagccggcucccucagcuu

SEQ ID NO: 220220 - RNA, 22 nt, Human
uuuuaucugcuucauuaguuga

SEQ ID NO: 220221 - RNA, 22 nt, Human
uguuucuuauccaaguggucug

SEQ ID NO: 220222 - RNA, 22 nt, Human
cagcuucuguuuauugugugcc

SEQ ID NO: 220223 - RNA, 20 nt, Human
acaguggguggggagcacug

SEQ ID NO: 220224 - RNA, 22 nt, Human
ugaaacaggaaguaaacagaca

SEQ ID NO: 220225 - RNA, 22 nt, Human
gauuaaaaauaacccaugcuga

SEQ ID NO: 220226 - RNA, 22 nt, Human
ugucccucauugacgcugugcc

SEQ ID NO: 220227 - RNA, 22 nt, Human
uuccucuguaugcuuugcugcu

SEQ ID NO: 220228 - RNA, 22 nt, Human
uuugucaucccuuuugaaacug

SEQ ID NO: 220229 - RNA, 22 nt, Human
cugaggaggcuaauuugaggau

SEQ ID NO: 220230 - RNA, 22 nt, Human
aggcagaaaauagucauccaaa

SEQ ID NO: 220231 - RNA, 22 nt, Human
aggacauguuuguaucuuccuu

SEQ ID NO: 220232 - RNA, 22 nt, Human
auaaucuuucuuuuccagauag

SEQ ID NO: 220233 - RNA, 22 nt, Human
ggcucugcagagggcccagcuu

SEQ ID NO: 220234 - RNA, 22 nt, Human
aagcccuggaacuuuccuagcc

SEQ ID NO: 220235 - RNA, 22 nt, Human
ggcacagcaggagcuaugugaa

SEQ ID NO: 220236 - RNA, 22 nt, Human
gcugggcuccacccucaacugu

SEQ ID NO: 220237 - RNA, 22 nt, Human
ucagagcccugcuccuccccaa

SEQ ID NO: 220238 - RNA, 22 nt, Human
uuguuacuguucuacauacagu

SEQ ID NO: 220239 - RNA, 22 nt, Human
aagggcugcuguagaagcagag

SEQ ID NO: 220240 - RNA, 22 nt, Human
cagcucugugcaggccugggga

SEQ ID NO: 220241 - RNA, 22 nt, Human
cugccucuugacagaucguggc

SEQ ID NO: 220242 - RNA, 22 nt, Human
ucuuuacaucacaauuguaugg

SEQ ID NO: 220243 - RNA, 22 nt, Human
uacugagcugguccacugaggu

SEQ ID NO: 220244 - RNA, 22 nt, Human
ucaggcucccugcugggcucug

SEQ ID NO: 220245 - RNA, 22 nt, Human
uggaccucacugucugcuggua

SEQ ID NO: 220246 - RNA, 22 nt, Human
cagagcagggguuucccagguu

SEQ ID NO: 220247 - RNA, 22 nt, Human
aggcagagagcaguggccgucu

SEQ ID NO: 220248 - RNA, 22 nt, Human
cagggacaugacuggucucugu

SEQ ID NO: 220249 - RNA, 22 nt, Human
ggguguccagggcgugucugga

SEQ ID NO: 220250 - RNA, 22 nt, Human
aaagcuuuucaguauguucaug

SEQ ID NO: 220251 - RNA, 22 nt, Human
agugugaguuacaaagugugaa

SEQ ID NO: 220252 - RNA, 22 nt, Human
gagagggcucuguguggguacu

SEQ ID NO: 220253 - RNA, 20 nt, Human
gcugcucgcugcagucacuc

SEQ ID NO: 220254 - RNA, 22 nt, Human
cagaaucuacacccucagaaau

SEQ ID NO: 220255 - RNA, 22 nt, Human
uaaguuuuaagcaaucugauaa

SEQ ID NO: 220256 - RNA, 18 nt, Human
cugacuccuuugcugcca

SEQ ID NO: 220257 - RNA, 22 nt, Human
auauuuaacuggucccaauaua

SEQ ID NO: 220258 - RNA, 22 nt, Human
gaugaugggauccagcaaugua

SEQ ID NO: 220259 - RNA, 22 nt, Human
agugcgugggcaggcauggaag

SEQ ID NO: 220260 - RNA, 23 nt, Human
aacaccaaggcucagagagauaa

SEQ ID NO: 220261 - RNA, 22 nt, Human
uggucuggaacuccuggcuuca

SEQ ID NO: 220262 - RNA, 19 nt, Human
aaacacagauuucuuacca

SEQ ID NO: 220263 - RNA, 22 nt, Human
caggaaagagcugccaggcagg

SEQ ID NO: 220264 - RNA, 22 nt, Human
ucccagccuuccagucugguuu

SEQ ID NO: 220265 - RNA, 22 nt, Human
ugcaggugcuacaagaacucac

SEQ ID NO: 220266 - RNA, 22 nt, Human
uucuuuggugggagauugaggu

SEQ ID NO: 220267 - RNA, 22 nt, Human
gaugauuuuugccagugugaug

SEQ ID NO: 220268 - RNA, 22 nt, Human
augaaaguaccuguaauauguu

SEQ ID NO: 220269 - RNA, 22 nt, Human
cccuuccuugauuuuaacugga

SEQ ID NO: 220270 - RNA, 17 nt, Human
agguggguggaucaccu

SEQ ID NO: 220271 - RNA, 22 nt, Human
gcucucccgcagccuggugggc

SEQ ID NO: 220272 - RNA, 22 nt, Human
auuucuagacuuagaacucuua

SEQ ID NO: 220273 - RNA, 22 nt, Human
caaauguuugguggcauuuugu

SEQ ID NO: 220274 - RNA, 22 nt, Human
auuguacauaaaauguaugucu

SEQ ID NO: 220275 - RNA, 22 nt, Human
caggcucccugccagggccggc

SEQ ID NO: 220276 - RNA, 22 nt, Human
acuguacacauucgucaagacu

SEQ ID NO: 220277 - RNA, 22 nt, Human
cagcaggagcagucagacuccu

SEQ ID NO: 220278 - RNA, 23 nt, Human
uggccugcagaguuucugcuggg

SEQ ID NO: 220279 - RNA, 22 nt, Human
uugcuuuaaaauggcuaagucu

SEQ ID NO: 220280 - RNA, 22 nt, Human
ucaggcuuugaagucuagcugg

SEQ ID NO: 220281 - RNA, 22 nt, Human
caggcuuuuucugcuguccucu

SEQ ID NO: 220282 - RNA, 22 nt, Human
aaggugguuugauuaucccacu

SEQ ID NO: 220283 - RNA, 22 nt, Human
cugggcagguauacaaaaaaug

SEQ ID NO: 220284 - RNA, 22 nt, Human
acugcccuguaacugccaggua

SEQ ID NO: 220285 - RNA, 22 nt, Human
ccacaucuuuuuuccugaacag

SEQ ID NO: 220286 - RNA, 22 nt, Human
ucugaaaauguugacuuuguuu

SEQ ID NO: 220287 - RNA, 22 nt, Human
uuucucucugacugggagcuga

SEQ ID NO: 220288 - RNA, 22 nt, Human
gagacauucuuaggaacaaugu

SEQ ID NO: 220289 - RNA, 22 nt, Human
caggucuggcaucagcugugug

SEQ ID NO: 220290 - RNA, 22 nt, Human
cagaaagcaguugucaaugggc

SEQ ID NO: 220291 - RNA, 22 nt, Human
caucagaauuacuuggggagcu

SEQ ID NO: 220292 - RNA, 22 nt, Human
gguuucucuagggcugaccagu

SEQ ID NO: 220293 - RNA, 22 nt, Human
ccaggccuucugaggacacucu

SEQ ID NO: 220294 - RNA, 22 nt, Human
auggaaaucagguucauccaag

SEQ ID NO: 220295 - RNA, 22 nt, Human
ucucuggguccuggcaagcuca

SEQ ID NO: 220296 - RNA, 22 nt, Human
agcagucaguccugaaugaagg

SEQ ID NO: 220297 - RNA, 22 nt, Human
augaggcagcugacagcuguuc

SEQ ID NO: 220298 - RNA, 22 nt, Human
ggaaggggagcuggaaagggua

SEQ ID NO: 220299 - RNA, 22 nt, Human
gucucagaccacccucuuuggc

SEQ ID NO: 220300 - RNA, 22 nt, Human
uauucaugggaggucacaacuu

SEQ ID NO: 220301 - RNA, 22 nt, Human
ucuguucauuugccucggcucu

SEQ ID NO: 220302 - RNA, 22 nt, Human
cugggcucaccuguggcuggca

SEQ ID NO: 220303 - RNA, 22 nt, Human
gcucugagcugucuugcagguc

SEQ ID NO: 220304 - RNA, 22 nt, Human
aggcagggugaugauaaugauu

SEQ ID NO: 220305 - RNA, 22 nt, Human
cagugacguaaacugcaugugc

SEQ ID NO: 220306 - RNA, 22 nt, Human
cacaggagauugaucuauuggu

SEQ ID NO: 220307 - RNA, 22 nt, Human
guuacacagcuaagcuucuccu

SEQ ID NO: 220308 - RNA, 22 nt, Human
aguaggcagaaguggcauucgg

SEQ ID NO: 220309 - RNA, 22 nt, Human
cuucaggauuaauuuggggccu

SEQ ID NO: 220310 - RNA, 22 nt, Human
uuuauauuucccaggauuggcc

SEQ ID NO: 220311 - RNA, 22 nt, Human
agaugaguagguagcauuagua

SEQ ID NO: 220312 - RNA, 22 nt, Human
aguguggaccuucacacagaga

SEQ ID NO: 220313 - RNA, 22 nt, Human
aacuuuguguguuuaauauggc

SEQ ID NO: 220314 - RNA, 22 nt, Human
aaaggcuucggaucagaaggua

SEQ ID NO: 220315 - RNA, 22 nt, Human
gcuccaggccccagcguuccgc

SEQ ID NO: 220316 - RNA, 22 nt, Human
ugagcuggcacuuuuccuggga

SEQ ID NO: 220317 - RNA, 22 nt, Human
uguaacaguagauaaggucuug

SEQ ID NO: 220318 - RNA, 22 nt, Human
agaggaggcagcuuaacucagu

SEQ ID NO: 220319 - RNA, 22 nt, Human
uuccaggcucccuuggaggugu

SEQ ID NO: 220320 - RNA, 22 nt, Human
guguccuuuuaugugacugguu

SEQ ID NO: 220321 - RNA, 22 nt, Human
uucccagaccuguaggaucaga

SEQ ID NO: 220322 - RNA, 22 nt, Human
uuacuuuccagcucuagcuuca

SEQ ID NO: 220323 - RNA, 22 nt, Human
caacaaguggguacuuuacagg

SEQ ID NO: 220324 - RNA, 22 nt, Human
aggcucucucugccagccgugc

SEQ ID NO: 220325 - RNA, 22 nt, Human
uaaucucuuuaugagaagaagg

SEQ ID NO: 220326 - RNA, 18 nt, Human
aacaugcauuagaacugc

SEQ ID NO: 220327 - RNA, 22 nt, Human
cagacccugggccacagaggag

SEQ ID NO: 220328 - RNA, 22 nt, Human
cuggccagaagcaccuuuggcg

SEQ ID NO: 220329 - RNA, 22 nt, Human
cacagccuccuucagagagcau

SEQ ID NO: 220330 - RNA, 22 nt, Human
uuuguaaaagcccaagcuguag

SEQ ID NO: 220331 - RNA, 22 nt, Human
ugcuucucucuaggaagacgcu

SEQ ID NO: 220332 - RNA, 20 nt, Human
ucguuuauuugaaauugcuc

SEQ ID NO: 220333 - RNA, 22 nt, Human
gaagccagcaguggagaaagga

SEQ ID NO: 220334 - RNA, 18 nt, Human
augaucuuagcaaauauu

SEQ ID NO: 220335 - RNA, 22 nt, Human
aggggagacuggaaucuaacau

SEQ ID NO: 220336 - RNA, 22 nt, Human
guuauaaaggugauaaugguca

SEQ ID NO: 220337 - RNA, 22 nt, Human
uguaaaauaauucuccauguuu

SEQ ID NO: 220338 - RNA, 22 nt, Human
uuggcucauuaaagaugauaau

SEQ ID NO: 220339 - RNA, 22 nt, Human
agguagggcuaggcugcgucug

SEQ ID NO: 220340 - RNA, 22 nt, Human
ugcuggaguggcacuguguggc

SEQ ID NO: 220341 - RNA, 22 nt, Human
cagucucucuccuugcaggcgu

SEQ ID NO: 220342 - RNA, 21 nt, Human
ggaugccacgaagcaccagga

SEQ ID NO: 220343 - RNA, 22 nt, Human
cugugcccucuuugcuggccuu

SEQ ID NO: 220344 - RNA, 22 nt, Human
uacuuagagcgauaauuuauac

SEQ ID NO: 220345 - RNA, 22 nt, Human
agccucugcuuaugcaaaggua

SEQ ID NO: 220346 - RNA, 20 nt, Human
cagaugggacguggaggagu

SEQ ID NO: 220347 - RNA, 22 nt, Human
ccugccagcaucuucagccccu

SEQ ID NO: 220348 - RNA, 22 nt, Human
accccagcucugagccacacca

SEQ ID NO: 220349 - RNA, 22 nt, Human
aaaugcuuauuagugucacaaa

SEQ ID NO: 220350 - RNA, 22 nt, Human
acccaggcagcaggagcuaaag

SEQ ID NO: 220351 - RNA, 22 nt, Human
auauacacauguguauacauuu

SEQ ID NO: 220352 - RNA, 22 nt, Human
uaaauuagggacuuuaguuaau

SEQ ID NO: 220353 - RNA, 22 nt, Human
uccccacaucucugcaucaggc

SEQ ID NO: 220354 - RNA, 22 nt, Human
uuuuaauccucuugguaucuua

SEQ ID NO: 220355 - RNA, 22 nt, Human
gaugcauuacaaaagugauuau

SEQ ID NO: 220356 - RNA, 22 nt, Human
ucaggaaacuacaguugaacua

SEQ ID NO: 220357 - RNA, 20 nt, Human
gagauggacagaugaagggg

SEQ ID NO: 220358 - RNA, 22 nt, Human
augcuuuauguucuggcauuuu

SEQ ID NO: 220359 - RNA, 20 nt, Human
cugcuguguuauuguagaac

SEQ ID NO: 220360 - RNA, 22 nt, Human
aauaagauugacacaaguaccu

SEQ ID NO: 220361 - RNA, 22 nt, Human
gggaccuggucuagcacugagc

SEQ ID NO: 220362 - RNA, 22 nt, Human
uaugagcagacagugguuuuac

SEQ ID NO: 220363 - RNA, 22 nt, Human
agaagaaacugucggggauauu

SEQ ID NO: 220364 - RNA, 22 nt, Human
auugcuuuagaaagaaaaauau

SEQ ID NO: 220365 - RNA, 22 nt, Human
aggacagaaucuauauucaguu

SEQ ID NO: 220366 - RNA, 22 nt, Human
aaugggaaaagaguaugauuua

SEQ ID NO: 220367 - RNA, 22 nt, Human
agcaaggccgagaggaugcuau

SEQ ID NO: 220368 - RNA, 18 nt, Human
gaauaucuagcacauagu

SEQ ID NO: 220369 - RNA, 22 nt, Human
aauauguucaaaauagaucacu

SEQ ID NO: 220370 - RNA, 20 nt, Human
ugcauuaaguggcauugagc

SEQ ID NO: 220371 - RNA, 22 nt, Human
gaggagcugcagggggagucua

SEQ ID NO: 220372 - RNA, 22 nt, Human
ggccugugcaagacagcacccc

SEQ ID NO: 220373 - RNA, 22 nt, Human
cagcuaauccucucuauccaag

SEQ ID NO: 220374 - RNA, 22 nt, Human
uaacugaacagccuaauucuuu

SEQ ID NO: 220375 - RNA, 22 nt, Human
gcuuucugaagcaguguuucuc

SEQ ID NO: 220376 - RNA, 22 nt, Human
aauauaugugguauugaccagc

SEQ ID NO: 220377 - RNA, 22 nt, Human
uguacuugaacuugacuguaga

SEQ ID NO: 220378 - RNA, 22 nt, Human
caggccugagacaucugagaua

SEQ ID NO: 220379 - RNA, 22 nt, Human
aggagguguugauagaagguuu

SEQ ID NO: 220380 - RNA, 22 nt, Human
aaacacugaaaauuuuggucau

SEQ ID NO: 220381 - RNA, 22 nt, Human
uacagucagagugccuuucuaa

SEQ ID NO: 220382 - RNA, 22 nt, Human
ugugugcaugcuuggggcagca

SEQ ID NO: 220383 - RNA, 22 nt, Human
acucugccuuggugucacaaga

SEQ ID NO: 220384 - RNA, 22 nt, Human
uuagaaccaggaacucuaauau

SEQ ID NO: 220385 - RNA, 22 nt, Human
uccaggcaugucugaguccuuc

SEQ ID NO: 220386 - RNA, 22 nt, Human
ggaauugguuucaagggaaagu

SEQ ID NO: 220387 - RNA, 22 nt, Human
gacagcaggaugugaggggaug

SEQ ID NO: 220388 - RNA, 22 nt, Human
acagcuguggccacuugcaucc

SEQ ID NO: 220389 - RNA, 22 nt, Human
ugcacaguucgccuucuccaag

SEQ ID NO: 220390 - RNA, 22 nt, Human
ugaugaaaauaugauucugagg

SEQ ID NO: 220391 - RNA, 22 nt, Human
caaaguuaugaaugauaagauu

SEQ ID NO: 220392 - RNA, 22 nt, Human
ugcacagagggaggcauaaaau

SEQ ID NO: 220393 - RNA, 22 nt, Human
cugaaggauuagagagcacuua

SEQ ID NO: 220394 - RNA, 22 nt, Human
agaauacaauuguucaguaaua

SEQ ID NO: 220395 - RNA, 22 nt, Human
caggugucaaaauacuaagugg

SEQ ID NO: 220396 - RNA, 22 nt, Human
uggguggcacuucuggggucca

SEQ ID NO: 220397 - RNA, 22 nt, Human
uuuuacauugggaaaugccucu

SEQ ID NO: 220398 - RNA, 22 nt, Human
ggcaggcauggggucugccauu

SEQ ID NO: 220399 - RNA, 22 nt, Human
ucaggugugugguggaaggcag

SEQ ID NO: 220400 - RNA, 22 nt, Human
agaggauuguuacugauuagcu

SEQ ID NO: 220401 - RNA, 22 nt, Human
ucccuccugcaugaggcucggc

SEQ ID NO: 220402 - RNA, 22 nt, Human
cccagcuugcaaauggguugcu

SEQ ID NO: 220403 - RNA, 22 nt, Human
aggccagggucccacacucgca

SEQ ID NO: 220404 - RNA, 22 nt, Human
gcagccagguuugaggaccacu

SEQ ID NO: 220405 - RNA, 22 nt, Human
gguggcucguuuuucuugaaag

SEQ ID NO: 220406 - RNA, 21 nt, Human
aguaguuuagcacaggguuug

SEQ ID NO: 220407 - RNA, 21 nt, Human
cucuugucuuugcucaguagc

SEQ ID NO: 220408 - RNA, 22 nt, Human
gucugguccucuucacaguggc

SEQ ID NO: 220409 - RNA, 22 nt, Human
uccugggauacuaagaaauuuu

SEQ ID NO: 220410 - RNA, 22 nt, Human
uucuaucauacuugaauacauu

SEQ ID NO: 220411 - RNA, 22 nt, Human
ggcaggcugggugucauggagu

SEQ ID NO: 220412 - RNA, 22 nt, Human
agggcugacacaccuuauccuc

SEQ ID NO: 220413 - RNA, 22 nt, Human
gacccaggagagaggguugcau

SEQ ID NO: 220414 - RNA, 22 nt, Human
aguacaaaugcagccagaguag

SEQ ID NO: 220415 - RNA, 22 nt, Human
acagccuguguaccagcuggga

SEQ ID NO: 220416 - RNA, 22 nt, Human
cagggagggaggaaaauuugcu

SEQ ID NO: 220417 - RNA, 22 nt, Human
uuggauacagaugaaaggaagg

SEQ ID NO: 220418 - RNA, 22 nt, Human
uggcaguuauuaaucaagucuu

SEQ ID NO: 220419 - RNA, 22 nt, Human
ugucuuuugccaaagaucaguu

SEQ ID NO: 220420 - RNA, 22 nt, Human
cuggcauuuagacccacagcaa

SEQ ID NO: 220421 - RNA, 22 nt, Human
gcagggcaaugaucccgagagg

SEQ ID NO: 220422 - RNA, 22 nt, Human
acagacaguaaauaguguggcu

SEQ ID NO: 220423 - RNA, 22 nt, Human
gccugggagaugcguuguggcc

SEQ ID NO: 220424 - RNA, 19 nt, Human
auagggcacccuaaggagu

SEQ ID NO: 220425 - RNA, 22 nt, Human
ccugcuuugcugguaccaucag

SEQ ID NO: 220426 - RNA, 22 nt, Human
auucaaguacaguuuucuucuu

SEQ ID NO: 220427 - RNA, 18 nt, Human
ggaaaccacaggguucug

SEQ ID NO: 220428 - RNA, 19 nt, Human
uaaaaggauguggaaggau

SEQ ID NO: 220429 - RNA, 22 nt, Human
caggccuuugcagggagagaga

SEQ ID NO: 220430 - RNA, 22 nt, Human
cacaggccaguaagacuguguu

SEQ ID NO: 220431 - RNA, 22 nt, Human
gcagggcuguggacacuuuggu

SEQ ID NO: 220432 - RNA, 22 nt, Human
ucuuucggccauagcgaugauu

SEQ ID NO: 220433 - RNA, 22 nt, Human
gcuguagggcugagcuggaccg

SEQ ID NO: 220434 - RNA, 20 nt, Human
ucaggcaguggggaaaggca

SEQ ID NO: 220435 - RNA, 22 nt, Human
auuaugcauauacauuugacua

SEQ ID NO: 220436 - RNA, 22 nt, Human
gaggugucugaguggggaccug

SEQ ID NO: 220437 - RNA, 22 nt, Human
uggcagcagggaggccaguguu

SEQ ID NO: 220438 - RNA, 23 nt, Human
gcucaggcaucauucuuccuggc

SEQ ID NO: 220439 - RNA, 22 nt, Human
ccugagcuugauccuucugucu

SEQ ID NO: 220440 - RNA, 22 nt, Human
gccaggcccugggcacuucgug

SEQ ID NO: 220441 - RNA, 22 nt, Human
guuaucuucccuuugaugauuu

SEQ ID NO: 220442 - RNA, 22 nt, Human
gggacaugaagcaucggaggca

SEQ ID NO: 220443 - RNA, 22 nt, Human
gagaaaagcgaaggaccuggag

SEQ ID NO: 220444 - RNA, 22 nt, Human
cuggccagugacugcucacccg

SEQ ID NO: 220445 - RNA, 22 nt, Human
acagcaggcacacaaggauaga

SEQ ID NO: 220446 - RNA, 22 nt, Human
cuggacagaaaccaguccuggg

SEQ ID NO: 220447 - RNA, 22 nt, Human
cugcacacauauggcuucucuc

SEQ ID NO: 220448 - RNA, 22 nt, Human
uacacauccauguuuugacuuu

SEQ ID NO: 220449 - RNA, 22 nt, Human
aguccaggucucugagucacaa

SEQ ID NO: 220450 - RNA, 22 nt, Human
ugcagaagcugcaggucagugg

SEQ ID NO: 220451 - RNA, 22 nt, Human
uguggggcucccuggcagccug

SEQ ID NO: 220452 - RNA, 22 nt, Human
cugggccugccaccaucuuagg

SEQ ID NO: 220453 - RNA, 22 nt, Human
cacucccucuaguugcauucug

SEQ ID NO: 220454 - RNA, 22 nt, Human
aagcuguugcccugcucuuucu

SEQ ID NO: 220455 - RNA, 22 nt, Human
gggcugaguuccugccucacuc

SEQ ID NO: 220456 - RNA, 22 nt, Human
uugaaugaauaaaagaguaagg

SEQ ID NO: 220457 - RNA, 22 nt, Human
ucagcuuuccugcagcuaaggg

SEQ ID NO: 220458 - RNA, 22 nt, Human
gugagcuucugacagaugcacc

SEQ ID NO: 220459 - RNA, 23 nt, Human
cgcccagccucagugaccugggc

SEQ ID NO: 220460 - RNA, 22 nt, Human
uaugaaauugccauuuuuaugg

SEQ ID NO: 220461 - RNA, 22 nt, Human
acugagcaguagauuuucuguu

SEQ ID NO: 220462 - RNA, 22 nt, Human
uauacacugauauaaggaguaa

SEQ ID NO: 220463 - RNA, 22 nt, Human
gcagucagacaggaggagcucc

SEQ ID NO: 220464 - RNA, 22 nt, Human
ggaagaggaggagccaggcuuu

SEQ ID NO: 220465 - RNA, 22 nt, Human
acucaggagggaucagcuauca

SEQ ID NO: 220466 - RNA, 22 nt, Human
caaggcuagcaagcaguaguca

SEQ ID NO: 220467 - RNA, 21 nt, Human
auggugagauacugggugugg

SEQ ID NO: 220468 - RNA, 22 nt, Human
agcuggguggccucuccucggg

SEQ ID NO: 220469 - RNA, 22 nt, Human
aggcugggcuccgcccaacucc

SEQ ID NO: 220470 - RNA, 22 nt, Human
acagcagccagccacugugagc

SEQ ID NO: 220471 - RNA, 22 nt, Human
aguggcugcuaugaucaggaca

SEQ ID NO: 220472 - RNA, 22 nt, Human
augccaagcucuaucccugacc

SEQ ID NO: 220473 - RNA, 22 nt, Human
ugucccugguggaggcuggcag

SEQ ID NO: 220474 - RNA, 22 nt, Human
ucacaucuuuaggcuuacaggu

SEQ ID NO: 220475 - RNA, 22 nt, Human
ugauucaauuaucugaugcuuu

SEQ ID NO: 220476 - RNA, 22 nt, Human
acagauuuugguauuugcaaug

SEQ ID NO: 220477 - RNA, 22 nt, Human
cagggagaggccucuguugccc

SEQ ID NO: 220478 - RNA, 22 nt, Human
auacaaguugugauaauguaaa

SEQ ID NO: 220479 - RNA, 22 nt, Human
gaaaaggccacuccuaggagcu

SEQ ID NO: 220480 - RNA, 22 nt, Human
aguuuuaagaugcgcuucuguu

SEQ ID NO: 220481 - RNA, 22 nt, Human
ggcucugggcauagaaggaagc

SEQ ID NO: 220482 - RNA, 19 nt, Human
aaaagucuauucaauuaca

SEQ ID NO: 220483 - RNA, 22 nt, Human
ucaggcagcauuaaacuucagc

SEQ ID NO: 220484 - RNA, 22 nt, Human
ucuuguccuaagagcuggauuc

SEQ ID NO: 220485 - RNA, 22 nt, Human
cagcacucuggcuucguuaagu

SEQ ID NO: 220486 - RNA, 22 nt, Human
gggaauguaaucauggaaugcu

SEQ ID NO: 220487 - RNA, 22 nt, Human
agcagguggaaaauucuuauca

SEQ ID NO: 220488 - RNA, 22 nt, Human
agacuguagggauagaggucuu

SEQ ID NO: 220489 - RNA, 22 nt, Human
gcgcaggcccgggucagggccg

SEQ ID NO: 220490 - RNA, 18 nt, Human
gccagcccuccaaccucc

SEQ ID NO: 220491 - RNA, 22 nt, Human
auuuaacaagacagagaacugg

SEQ ID NO: 220492 - RNA, 22 nt, Human
ugaacaacugcaaaaaucucca

SEQ ID NO: 220493 - RNA, 22 nt, Human
agccuuagaggaaaacauuagu

SEQ ID NO: 220494 - RNA, 22 nt, Human
ucuuuaauauaaaggaaugaau

SEQ ID NO: 220495 - RNA, 22 nt, Human
agagaaaagccaucccagccaa

SEQ ID NO: 220496 - RNA, 22 nt, Human
aagaugauguuguguuuucacu

SEQ ID NO: 220497 - RNA, 22 nt, Human
cagggggcuguggcuguccagu

SEQ ID NO: 220498 - RNA, 22 nt, Human
ucugucauuucauucauaugaa

SEQ ID NO: 220499 - RNA, 22 nt, Human
uggggaaagacauucauacagu

SEQ ID NO: 220500 - RNA, 22 nt, Human
gaggccagaaugagucucuggg

SEQ ID NO: 220501 - RNA, 20 nt, Human
ggcugugcccuuccguggcc

SEQ ID NO: 220502 - RNA, 22 nt, Human
agcaggccucaugcaccagcua

SEQ ID NO: 220503 - RNA, 22 nt, Human
uaaucuaucaagcaacaaagug

SEQ ID NO: 220504 - RNA, 22 nt, Human
uagcaccuuagcauuucuagug

SEQ ID NO: 220505 - RNA, 22 nt, Human
uggccagugauuaaugacgcuu

SEQ ID NO: 220506 - RNA, 21 nt, Human
agcuggcuauaguuagugaug

SEQ ID NO: 220507 - RNA, 22 nt, Human
ggucccaggauugguugcgcag

SEQ ID NO: 220508 - RNA, 22 nt, Human
gaggacucugggcguguauggg

SEQ ID NO: 220509 - RNA, 22 nt, Human
gucuagaauggaugagcauuuu

SEQ ID NO: 220510 - RNA, 22 nt, Human
augcuuagguuaaauuuguaau

SEQ ID NO: 220511 - RNA, 22 nt, Human
gcuggaaggcuaggcucaguug

SEQ ID NO: 220512 - RNA, 22 nt, Human
uucagaauauuuguuuuacaug

SEQ ID NO: 220513 - RNA, 22 nt, Human
caggccagagcgcgugguuggg

SEQ ID NO: 220514 - RNA, 22 nt, Human
gggaggaggaauguuuugugua

SEQ ID NO: 220515 - RNA, 22 nt, Human
uggcuuggugagcagaguguag

SEQ ID NO: 220516 - RNA, 18 nt, Human
cagcagguagaguuuggu

SEQ ID NO: 220517 - RNA, 22 nt, Human
agucacagggggccccugcaac

SEQ ID NO: 220518 - RNA, 22 nt, Human
uguacaaagaguauagcuuuga

SEQ ID NO: 220519 - RNA, 22 nt, Human
cugcagaaauauggaugugaua

SEQ ID NO: 220520 - RNA, 22 nt, Human
aaagcugggcuggccaacccag

SEQ ID NO: 220521 - RNA, 22 nt, Human
ucuucuaguaggccaagaagcu

SEQ ID NO: 220522 - RNA, 22 nt, Human
ucaaucaaugguuuccaaauuu

SEQ ID NO: 220523 - RNA, 22 nt, Human
aacuuuggcaagucagacuucu

SEQ ID NO: 220524 - RNA, 22 nt, Human
acugugcagcugagugcuaauu

SEQ ID NO: 220525 - RNA, 22 nt, Human
agcaggugccagguguacccgc

SEQ ID NO: 220526 - RNA, 22 nt, Human
ugaggcagaaaauagcaguuca

SEQ ID NO: 220527 - RNA, 22 nt, Human
gguuauauaauucagugcuuuc

SEQ ID NO: 220528 - RNA, 22 nt, Human
uuagggacaaauuugcagaacc

SEQ ID NO: 220529 - RNA, 22 nt, Human
gccuuaggggucagacagagcu

SEQ ID NO: 220530 - RNA, 19 nt, Human
cuggguccuguucuuuuac

SEQ ID NO: 220531 - RNA, 22 nt, Human
auuucauacuaaggcucaaaaa

SEQ ID NO: 220532 - RNA, 22 nt, Human
gcugggcaggccucgugagggc

SEQ ID NO: 220533 - RNA, 23 nt, Human
guucauuuuauugucugauugcu

SEQ ID NO: 220534 - RNA, 22 nt, Human
gccugagggcuccuagcaggcu

SEQ ID NO: 220535 - RNA, 22 nt, Human
ucugggcuugguuagggcuguu

SEQ ID NO: 220536 - RNA, 22 nt, Human
uacuuuaaaaacugauaauuca

SEQ ID NO: 220537 - RNA, 18 nt, Human
uccagucccaaggccagc

SEQ ID NO: 220538 - RNA, 22 nt, Human
cagagccccccuucugaucaca

SEQ ID NO: 220539 - RNA, 22 nt, Human
accacccccuuggguguggaag

SEQ ID NO: 220540 - RNA, 22 nt, Human
uucaaauuaccacauuugcuua

SEQ ID NO: 220541 - RNA, 22 nt, Human
ccaggaagcauaauguaguggg

SEQ ID NO: 220542 - RNA, 22 nt, Human
uacacaccugccugcagacucu

SEQ ID NO: 220543 - RNA, 22 nt, Human
cauuacaaaguuauaaacaguu

SEQ ID NO: 220544 - RNA, 22 nt, Human
agcaggcccaagcuggggggaa

SEQ ID NO: 220545 - RNA, 22 nt, Human
gaaauaauacagugcucuucuc

SEQ ID NO: 220546 - RNA, 22 nt, Human
uugaaugaaauugcuguguuau

SEQ ID NO: 220547 - RNA, 22 nt, Human
aagucacugugaaaggugaagc

SEQ ID NO: 220548 - RNA, 23 nt, Human
cacugcagcguggucuggcagga

SEQ ID NO: 220549 - RNA, 22 nt, Human
uucuugcucaaugucuguuuaa

SEQ ID NO: 220550 - RNA, 22 nt, Human
ugagcaggggagagcgaaugug

SEQ ID NO: 220551 - RNA, 22 nt, Human
acugucacugacagaaucaaca

SEQ ID NO: 220552 - RNA, 22 nt, Human
uuauccaacaugacuuaugucc

SEQ ID NO: 220553 - RNA, 22 nt, Human
uuucuggguuuaugucacagcu

SEQ ID NO: 220554 - RNA, 22 nt, Human
acugagggugcacaggcaggca

SEQ ID NO: 220555 - RNA, 22 nt, Human
acucuggcccuccugcugccag

SEQ ID NO: 220556 - RNA, 22 nt, Human
gacccagcuuaagucacauguu

SEQ ID NO: 220557 - RNA, 22 nt, Human
uggcuggagagggucccaugag

SEQ ID NO: 220558 - RNA, 22 nt, Human
cuucugugaccaccagcagccc

SEQ ID NO: 220559 - RNA, 22 nt, Human
gacacagcuaauggcuuaggac

SEQ ID NO: 220560 - RNA, 22 nt, Human
agaggguagaagacaggguugc

SEQ ID NO: 220561 - RNA, 22 nt, Human
uuugcauuuguucaaguauuga

SEQ ID NO: 220562 - RNA, 22 nt, Human
gauaagcagcagccguuauagg

SEQ ID NO: 220563 - RNA, 22 nt, Human
ccagugcccagcugcccaggca

SEQ ID NO: 220564 - RNA, 22 nt, Human
agccagcugugggcucaggcgg

SEQ ID NO: 220565 - RNA, 22 nt, Human
cagggagcagcgcuggggccuc

SEQ ID NO: 220566 - RNA, 22 nt, Human
aaacaaacaauuaguugugugg

SEQ ID NO: 220567 - RNA, 22 nt, Human
aagggcuggccacauucugggu

SEQ ID NO: 220568 - RNA, 22 nt, Human
gaaucucauucuaacuaguagg

SEQ ID NO: 220569 - RNA, 22 nt, Human
uucuguaucuuucuucaagauu

SEQ ID NO: 220570 - RNA, 22 nt, Human
uccugugacggagcgccagagg

SEQ ID NO: 220571 - RNA, 22 nt, Human
acuguucaaguuuuaugcugga

SEQ ID NO: 220572 - RNA, 21 nt, Human
cuguccuggucuagaggcaca

SEQ ID NO: 220573 - RNA, 20 nt, Human
uggaccugucucuuuaggga

SEQ ID NO: 220574 - RNA, 19 nt, Human
ugcugcuguccuugcaggg

SEQ ID NO: 220575 - RNA, 22 nt, Human
uauuuacuuuuaaauugagaac

SEQ ID NO: 220576 - RNA, 22 nt, Human
aacagugaguugaugacugaau

SEQ ID NO: 220577 - RNA, 22 nt, Human
cuauuuuccgcagcaggaagua

SEQ ID NO: 220578 - RNA, 22 nt, Human
augcugaaccuuaacuuggagc

SEQ ID NO: 220579 - RNA, 22 nt, Human
acaauuucuuauaguucaauuc

SEQ ID NO: 220580 - RNA, 22 nt, Human
uuugagcagcagaugcacuuag

SEQ ID NO: 220581 - RNA, 22 nt, Human
ucaugugucugccaguguuuau

SEQ ID NO: 220582 - RNA, 21 nt, Human
agagaaagucauggcuguggc

SEQ ID NO: 220583 - RNA, 22 nt, Human
gagggcagagacagugauucac

SEQ ID NO: 220584 - RNA, 22 nt, Human
ugcagggcacacgcacgggugu

SEQ ID NO: 220585 - RNA, 22 nt, Human
uaggauaugugaaaucauauua

SEQ ID NO: 220586 - RNA, 22 nt, Human
acaggucagauaaaggcuggug

SEQ ID NO: 220587 - RNA, 22 nt, Human
gguccugggaagaugcucauga

SEQ ID NO: 220588 - RNA, 22 nt, Human
gcagggugugucucauacaguu

SEQ ID NO: 220589 - RNA, 22 nt, Human
gggcaaguccggugcccagagc

SEQ ID NO: 220590 - RNA, 22 nt, Human
gagagccaugguggagaugggg

SEQ ID NO: 220591 - RNA, 22 nt, Human
aaguucuuagacaagcuugugg

SEQ ID NO: 220592 - RNA, 22 nt, Human
gccuggagaggaagccggugga

SEQ ID NO: 220593 - RNA, 22 nt, Human
uuucaaaccuacuuguauguuu

SEQ ID NO: 220594 - RNA, 22 nt, Human
aggaaauguacaaaugaagaug

SEQ ID NO: 220595 - RNA, 22 nt, Human
ggucacuggucucugcuuccau

SEQ ID NO: 220596 - RNA, 22 nt, Human
ggucaaaguugaagaagggcau

SEQ ID NO: 220597 - RNA, 22 nt, Human
uggcucugucacugugagcuau

SEQ ID NO: 220598 - RNA, 22 nt, Human
gagcaguggucacagggaggga

SEQ ID NO: 220599 - RNA, 22 nt, Human
ugauuucucuuggcaauauguu

SEQ ID NO: 220600 - RNA, 22 nt, Human
cugagccaccggcagggacauc

SEQ ID NO: 220601 - RNA, 22 nt, Human
gagggcaagaguuggaaacggu

SEQ ID NO: 220602 - RNA, 22 nt, Human
uagcaucuguuucucuuuguga

SEQ ID NO: 220603 - RNA, 22 nt, Human
agcaguccuccaguguguuuua

SEQ ID NO: 220604 - RNA, 22 nt, Human
ucguccugugcaccugccugca

SEQ ID NO: 220605 - RNA, 22 nt, Human
uuauucuuggaucugagucucu

SEQ ID NO: 220606 - RNA, 22 nt, Human
ggagaggaaaugccagcacuuc

SEQ ID NO: 220607 - RNA, 22 nt, Human
ucauuuuuuuccgguaggaaua

SEQ ID NO: 220608 - RNA, 22 nt, Human
agcauacaggucugaaacagcu

SEQ ID NO: 220609 - RNA, 22 nt, Human
ccacagcugaaagcagaggcuc

SEQ ID NO: 220610 - RNA, 22 nt, Human
ugcuucaaguugaaauauucuu

SEQ ID NO: 220611 - RNA, 22 nt, Human
ggagcagggaauuacagcgcag

SEQ ID NO: 220612 - RNA, 22 nt, Human
uuucugaagggcagcagacucu

SEQ ID NO: 220613 - RNA, 22 nt, Human
ugcuggcaucuuaauguucugu

SEQ ID NO: 220614 - RNA, 22 nt, Human
caggauagaaaggccauggagu

SEQ ID NO: 220615 - RNA, 22 nt, Human
ggcuuccccuccagugcucugu

SEQ ID NO: 220616 - RNA, 22 nt, Human
guaaauauaaaugcuagcugcc

SEQ ID NO: 220617 - RNA, 22 nt, Human
aauguugacaguggugaucuca

SEQ ID NO: 220618 - RNA, 22 nt, Human
aggcucugggaagcagugaguu

SEQ ID NO: 220619 - RNA, 22 nt, Human
ggccucucuagcauccagccug

SEQ ID NO: 220620 - RNA, 22 nt, Human
ccaggagcaacuugaaggcaag

SEQ ID NO: 220621 - RNA, 22 nt, Human
cagugccaugucugagccccua

SEQ ID NO: 220622 - RNA, 22 nt, Human
uaaaacacauaaacucucuauu

SEQ ID NO: 220623 - RNA, 22 nt, Human
gcucucagaagagccaggcuac

SEQ ID NO: 220624 - RNA, 20 nt, Human
aggaagcugagauguagagg

SEQ ID NO: 220625 - RNA, 22 nt, Human
ggcagacuguaauaggagaauu

SEQ ID NO: 220626 - RNA, 23 nt, Human
ggcugugcagccugcggcaaaag

SEQ ID NO: 220627 - RNA, 22 nt, Human
gagcucagagccuauaguuggu

SEQ ID NO: 220628 - RNA, 22 nt, Human
cuccagcugaguaagaacacua

SEQ ID NO: 220629 - RNA, 22 nt, Human
ucagcuuucuauguugcuaaac

SEQ ID NO: 220630 - RNA, 22 nt, Human
gcugagaaucaagauggagagg

SEQ ID NO: 220631 - RNA, 22 nt, Human
uccaggaugcccgcuuuugcuu

SEQ ID NO: 220632 - RNA, 22 nt, Human
gaaaggugccccauaggcagga

SEQ ID NO: 220633 - RNA, 22 nt, Human
uggcccugcugggucagagcug

SEQ ID NO: 220634 - RNA, 22 nt, Human
caguggcugagaguggacacug

SEQ ID NO: 220635 - RNA, 22 nt, Human
acuugaaaccuuggcaaacaau

SEQ ID NO: 220636 - RNA, 20 nt, Human
ucaggagccuaggacaugau

SEQ ID NO: 220637 - RNA, 22 nt, Human
caagcagucagccugaagacug

SEQ ID NO: 220638 - RNA, 22 nt, Human
ccuccucuggugcugccaaccc

SEQ ID NO: 220639 - RNA, 22 nt, Human
aaggaagagucuagaacaggca

SEQ ID NO: 220640 - RNA, 22 nt, Human
aaacugacaaucucaguccuau

SEQ ID NO: 220641 - RNA, 22 nt, Human
acaccugggucagugugacagu

SEQ ID NO: 220642 - RNA, 22 nt, Human
acaauuuuaagccagagugggu

SEQ ID NO: 220643 - RNA, 22 nt, Human
uggguccacuucugcacugugg

SEQ ID NO: 220644 - RNA, 22 nt, Human
cagggcacaguuauggaggugg

SEQ ID NO: 220645 - RNA, 22 nt, Human
gggcucucuuuuuggccugccc

SEQ ID NO: 220646 - RNA, 22 nt, Human
cuccagugcgcaggacagcccc

SEQ ID NO: 220647 - RNA, 22 nt, Human
gccaguggguaguuggagcugg

SEQ ID NO: 220648 - RNA, 22 nt, Human
gaggcuguaaguguggagccua

SEQ ID NO: 220649 - RNA, 22 nt, Human
cagagcauugagggucugccaa

SEQ ID NO: 220650 - RNA, 22 nt, Human
cagcaugcuugggggagggagc

SEQ ID NO: 220651 - RNA, 22 nt, Human
gucagcaccucuuuggggagcu

SEQ ID NO: 220652 - RNA, 22 nt, Human
gcuccugugaaggcauuaggug

SEQ ID NO: 220653 - RNA, 22 nt, Human
uaacagagauagaaauguaaag

SEQ ID NO: 220654 - RNA, 22 nt, Human
gaaauagaucucugggaugcaa

SEQ ID NO: 220655 - RNA, 22 nt, Human
acaaaacaguguuccugccccu

SEQ ID NO: 220656 - RNA, 22 nt, Human
caugugcauccuuaaucucccu

SEQ ID NO: 220657 - RNA, 22 nt, Human
uagcuggguugaggucaucuac

SEQ ID NO: 220658 - RNA, 19 nt, Human
uguuuucaagugggauuau

SEQ ID NO: 220659 - RNA, 20 nt, Human
cuggcuggaaacuuagccuu

SEQ ID NO: 220660 - RNA, 22 nt, Human
gaaaauguuagcuucauaguca

SEQ ID NO: 220661 - RNA, 22 nt, Human
accuggcacagaguaugcucuc

SEQ ID NO: 220662 - RNA, 22 nt, Human
acacauuuuguuaaacccugug

SEQ ID NO: 220663 - RNA, 22 nt, Human
aacugucuuauuuauauuucug

SEQ ID NO: 220664 - RNA, 22 nt, Human
cugaggaaggaguuaggcaguu

SEQ ID NO: 220665 - RNA, 22 nt, Human
gggucuggacggcugcaggaag

SEQ ID NO: 220666 - RNA, 20 nt, Human
ccagcucugugguuagauac

SEQ ID NO: 220667 - RNA, 22 nt, Human
aggagggagcacuauaugggga

SEQ ID NO: 220668 - RNA, 22 nt, Human
uuuaacauguucaagaaacaua

SEQ ID NO: 220669 - RNA, 22 nt, Human
uagaaaagaauuuuauuugaua

SEQ ID NO: 220670 - RNA, 22 nt, Human
auacacagcuacauugaacaau

SEQ ID NO: 220671 - RNA, 22 nt, Human
cugggaaaacugugaccccugu

SEQ ID NO: 220672 - RNA, 22 nt, Human
cugcuuuauagggcuuccaugu

SEQ ID NO: 220673 - RNA, 22 nt, Human
cagucccacaagaucuccacaa

SEQ ID NO: 220674 - RNA, 22 nt, Human
gucagggcacagugacagcucc

SEQ ID NO: 220675 - RNA, 22 nt, Human
aguauaauuuacauuugguauu

SEQ ID NO: 220676 - RNA, 22 nt, Human
agacaacaugaucagcaguccu

SEQ ID NO: 220677 - RNA, 20 nt, Human
ucuucuguugccuuguucug

SEQ ID NO: 220678 - RNA, 19 nt, Human
ugagacagaagaugagccu

SEQ ID NO: 220679 - RNA, 22 nt, Human
agcagggcagguaaggaucaga

SEQ ID NO: 220680 - RNA, 22 nt, Human
uuuaaauguucaugauacugaa

SEQ ID NO: 220681 - RNA, 22 nt, Human
guuuacaacaucuuguccuuca

SEQ ID NO: 220682 - RNA, 22 nt, Human
agcagggcucuguggagggugg

SEQ ID NO: 220683 - RNA, 22 nt, Human
auacaucuuccuuuuaaaaugc

SEQ ID NO: 220684 - RNA, 17 nt, Human
auggcuuccauugacca

SEQ ID NO: 220685 - RNA, 22 nt, Human
cugagaaaggaccucaaacagg

SEQ ID NO: 220686 - RNA, 22 nt, Human
gcuccagggaacagaauguacu

SEQ ID NO: 220687 - RNA, 23 nt, Human
cagugugacgaggugaggcaggc

SEQ ID NO: 220688 - RNA, 22 nt, Human
cacaagcugggcaaguguauau

SEQ ID NO: 220689 - RNA, 22 nt, Human
uccagaggugaacacccaggca

SEQ ID NO: 220690 - RNA, 22 nt, Human
gcucaggccucggacacacaau

SEQ ID NO: 220691 - RNA, 22 nt, Human
gggguggauuccuacaggucca

SEQ ID NO: 220692 - RNA, 22 nt, Human
uugagggagcacagauucuuau

SEQ ID NO: 220693 - RNA, 22 nt, Human
accuccagcuuuuuagagacau

SEQ ID NO: 220694 - RNA, 23 nt, Human
aggaaugugcccacccaucuccu

SEQ ID NO: 220695 - RNA, 21 nt, Human
acagcaagccuuccuuucagg

SEQ ID NO: 220696 - RNA, 22 nt, Human
uguuccaauaaggaguugaaau

SEQ ID NO: 220697 - RNA, 22 nt, Human
aaagauuaaaucaaauugguca

SEQ ID NO: 220698 - RNA, 22 nt, Human
gcuaggagccgcugcacuaggu

SEQ ID NO: 220699 - RNA, 22 nt, Human
gcuaggagauugagcucugaag

SEQ ID NO: 220700 - RNA, 22 nt, Human
ucucccaguccucugugcuuac

SEQ ID NO: 220701 - RNA, 22 nt, Human
gcugcagagggucuuagagagg

SEQ ID NO: 220702 - RNA, 22 nt, Human
gaagaugggaaugaugaguggg

SEQ ID NO: 220703 - RNA, 22 nt, Human
aguguccuuguuauuacugcuc

SEQ ID NO: 220704 - RNA, 22 nt, Human
ccuuuuaagggagacuagagau

SEQ ID NO: 220705 - RNA, 22 nt, Human
agaagucuggaauuccugcagg

SEQ ID NO: 220706 - RNA, 22 nt, Human
uguuuucagucauauagcaggu

SEQ ID NO: 220707 - RNA, 22 nt, Human
accaaggagaaggugcaagcuu

SEQ ID NO: 220708 - RNA, 22 nt, Human
aggcauggauggauccagggcu

SEQ ID NO: 220709 - RNA, 19 nt, Human
ucccugaguuccagcccag

SEQ ID NO: 220710 - RNA, 22 nt, Human
uaagcucacuguaagaacugau

SEQ ID NO: 220711 - RNA, 22 nt, Human
gaaugaaucuguaagugacaag

SEQ ID NO: 220712 - RNA, 20 nt, Human
agaggccaguuaggagucua

SEQ ID NO: 220713 - RNA, 22 nt, Human
agaccaugggcucugaagagca

SEQ ID NO: 220714 - RNA, 22 nt, Human
agcaauuauuguauaagaacaa

SEQ ID NO: 220715 - RNA, 22 nt, Human
guggcaggaucacggcucacug

SEQ ID NO: 220716 - RNA, 22 nt, Human
uugcuuuauguguaugacuuga

SEQ ID NO: 220717 - RNA, 22 nt, Human
uacaaagugcuuuagaaaugaa

SEQ ID NO: 220718 - RNA, 22 nt, Human
uagaaaguacuaaauuuaacug

SEQ ID NO: 220719 - RNA, 22 nt, Human
cagagccaggucuugaacucag

SEQ ID NO: 220720 - RNA, 22 nt, Human
aguuaacucauuuuauaaugcc

SEQ ID NO: 220721 - RNA, 22 nt, Human
aggcuugccacuuguuagucua

SEQ ID NO: 220722 - RNA, 22 nt, Human
caccugguucuagugaaagucu

SEQ ID NO: 220723 - RNA, 22 nt, Human
agcacugugguggaagcaucaa

SEQ ID NO: 220724 - RNA, 22 nt, Human
aguaugcauauuucaaaguaag

SEQ ID NO: 220725 - RNA, 22 nt, Human
acauguguuaaaauucucacca

SEQ ID NO: 220726 - RNA, 22 nt, Human
uuuuggcuguagcuggaaaucu

SEQ ID NO: 220727 - RNA, 22 nt, Human
caguggaggccuugggaccuuu

SEQ ID NO: 220728 - RNA, 22 nt, Human
ccaggcacuggcuggguucuuu

SEQ ID NO: 220729 - RNA, 21 nt, Human
gcugcaucaaucuacccaggg

SEQ ID NO: 220730 - RNA, 22 nt, Human
auccuucuccagucguauuuuu

SEQ ID NO: 220731 - RNA, 22 nt, Human
agggcagccaugagccuucagg

SEQ ID NO: 220732 - RNA, 22 nt, Human
uccugugagacuuguccauuau

SEQ ID NO: 220733 - RNA, 22 nt, Human
agugaagaggaaguggggcaca

SEQ ID NO: 220734 - RNA, 22 nt, Human
gauaggaccagguaaccucuaa

SEQ ID NO: 220735 - RNA, 22 nt, Human
gcccugagacugagcauggguu

SEQ ID NO: 220736 - RNA, 22 nt, Human
uguuauugucgcugcacuggga

SEQ ID NO: 220737 - RNA, 22 nt, Human
ggagcugcacgcucugaagccu

SEQ ID NO: 220738 - RNA, 22 nt, Human
ucuuggcuuucuccuagggaug

SEQ ID NO: 220739 - RNA, 22 nt, Human
ugccagauuguggcauggcacu

SEQ ID NO: 220740 - RNA, 22 nt, Human
aagcagcagcaggauuaaagag

SEQ ID NO: 220741 - RNA, 23 nt, Human
uugcuugagcccaggaaguggag

SEQ ID NO: 220742 - RNA, 22 nt, Human
ugaaggcaacugagaaaaagca

SEQ ID NO: 220743 - RNA, 22 nt, Human
guguacagauaucucacguucu

SEQ ID NO: 220744 - RNA, 22 nt, Human
ggcucugcaaaaguagauacuu

SEQ ID NO: 220745 - RNA, 21 nt, Human
acaguuuauuagaguaagugc

SEQ ID NO: 220746 - RNA, 22 nt, Human
gcacccagcccagggcgugaug

SEQ ID NO: 220747 - RNA, 22 nt, Human
ggcuggcuccaccuagguagcu

SEQ ID NO: 220748 - RNA, 22 nt, Human
guaaaucauggucagaauaaau

SEQ ID NO: 220749 - RNA, 22 nt, Human
ccaaagucagugcucagucguc

SEQ ID NO: 220750 - RNA, 22 nt, Human
uggaaauacuugccauaaaacu

SEQ ID NO: 220751 - RNA, 23 nt, Human
acacagaagaagacccaaggaag

SEQ ID NO: 220752 - RNA, 20 nt, Human
aaagauacuuuuuguaaugg

SEQ ID NO: 220753 - RNA, 22 nt, Human
aaagccaguucuuuuauauugg

SEQ ID NO: 220754 - RNA, 22 nt, Human
cagucucugccacuucuaagcu

SEQ ID NO: 220755 - RNA, 22 nt, Human
acugcaggagacacagcugcug

SEQ ID NO: 220756 - RNA, 22 nt, Human
cagacagaaggcuccuugaggu

SEQ ID NO: 220757 - RNA, 22 nt, Human
ugaggcucagagaagugcuguu

SEQ ID NO: 220758 - RNA, 22 nt, Human
cagcacccucggaggcugccgu

SEQ ID NO: 220759 - RNA, 22 nt, Human
auacugaugaugugaagaaaca

SEQ ID NO: 220760 - RNA, 22 nt, Human
guuuauauucaacggaguaucu

SEQ ID NO: 220761 - RNA, 22 nt, Human
cuggcugguucccugcuccagg

SEQ ID NO: 220762 - RNA, 22 nt, Human
cucuggaagaugaccuggguaa

SEQ ID NO: 220763 - RNA, 22 nt, Human
ugccaggcccugcgggguccca

SEQ ID NO: 220764 - RNA, 22 nt, Human
uguccuuuacugauugcuucug

SEQ ID NO: 220765 - RNA, 22 nt, Human
uggcacagggcuuggucgcuca

SEQ ID NO: 220766 - RNA, 22 nt, Human
cagcaggaagguuuccccugca

SEQ ID NO: 220767 - RNA, 22 nt, Human
aggauuuaggagcuggcuaacg

SEQ ID NO: 220768 - RNA, 22 nt, Human
auuuacagccuugaaaacagca

SEQ ID NO: 220769 - RNA, 22 nt, Human
aaaaagagaaaugcucuagucc

SEQ ID NO: 220770 - RNA, 22 nt, Human
uucacugugaacucauauucag

SEQ ID NO: 220771 - RNA, 21 nt, Human
agcagguguaaaggaggaaau

SEQ ID NO: 220772 - RNA, 22 nt, Human
caucuuuguaacuuccacauaa

SEQ ID NO: 220773 - RNA, 22 nt, Human
uccugugcuguuaauagugaua

SEQ ID NO: 220774 - RNA, 22 nt, Human
ucauguuugcccuaagaaaaag

SEQ ID NO: 220775 - RNA, 22 nt, Human
ugcaaaacuucucagagccuuu

SEQ ID NO: 220776 - RNA, 20 nt, Human
aaaaugaugggcagggcagg

SEQ ID NO: 220777 - RNA, 18 nt, Human
ucugucuguacaaguauc

SEQ ID NO: 220778 - RNA, 22 nt, Human
cucccugguguccccuccagga

SEQ ID NO: 220779 - RNA, 22 nt, Human
auuccagauggcuucaaguaag

SEQ ID NO: 220780 - RNA, 22 nt, Human
gccugugaugcccccauaagua

SEQ ID NO: 220781 - RNA, 18 nt, Human
cccagcccaccauuucuc

SEQ ID NO: 220782 - RNA, 22 nt, Human
aggaggccuguguuugucugua

SEQ ID NO: 220783 - RNA, 23 nt, Human
ucucagaggauuccugggccuug

SEQ ID NO: 220784 - RNA, 22 nt, Human
cugaaacuccaugagaaauugc

SEQ ID NO: 220785 - RNA, 22 nt, Human
uauuuccagcaguaagaagaca

SEQ ID NO: 220786 - RNA, 22 nt, Human
aguggcuguccuggcucuaacu

SEQ ID NO: 220787 - RNA, 22 nt, Human
ggguggcacaggugcagagggu

SEQ ID NO: 220788 - RNA, 22 nt, Human
agagcuuuugggaauucaggua

SEQ ID NO: 220789 - RNA, 22 nt, Human
gucuuauuuaaggacaagaaga

SEQ ID NO: 220790 - RNA, 22 nt, Human
cuuagaacagugucugccagag

SEQ ID NO: 220791 - RNA, 22 nt, Human
gaaggcuggcuuucugagagca

SEQ ID NO: 220792 - RNA, 19 nt, Human
cugggcugaggucugccuu

SEQ ID NO: 220793 - RNA, 22 nt, Human
cuguccagaaagggggcaacaa

SEQ ID NO: 220794 - RNA, 22 nt, Human
gacccaggcccaaggcugccag

SEQ ID NO: 220795 - RNA, 22 nt, Human
gcugagguuuucugccugcuca

SEQ ID NO: 220796 - RNA, 22 nt, Human
auucucaauggcuacuuucaua

SEQ ID NO: 220797 - RNA, 22 nt, Human
acuuccaaagaagugauuacag

SEQ ID NO: 220798 - RNA, 22 nt, Human
auaccuguguauccacaagcgu

SEQ ID NO: 220799 - RNA, 22 nt, Human
aacaaaagccgaaguagguguc

SEQ ID NO: 220800 - RNA, 22 nt, Human
gguggcagucuuaagagaucuu

SEQ ID NO: 220801 - RNA, 22 nt, Human
aaagcugcugccaaucaggcuu

SEQ ID NO: 220802 - RNA, 22 nt, Human
agccuugcaugauuucauucau

SEQ ID NO: 220803 - RNA, 22 nt, Human
aaauauagugacacuuauaguc

SEQ ID NO: 220804 - RNA, 22 nt, Human
agcccagaggguagcagaagaa

SEQ ID NO: 220805 - RNA, 22 nt, Human
gucuguuaccuccaagaccauu

SEQ ID NO: 220806 - RNA, 17 nt, Human
aaggaaugucagaaguu

SEQ ID NO: 220807 - RNA, 22 nt, Human
cagcaagagaggcagggcaaau

SEQ ID NO: 220808 - RNA, 22 nt, Human
aaaagcaucucaaaggagcuuc

SEQ ID NO: 220809 - RNA, 22 nt, Human
ggcuguugacagacauagguuu

SEQ ID NO: 220810 - RNA, 22 nt, Human
ggucccagaauugguuagcaca

SEQ ID NO: 220811 - RNA, 22 nt, Human
uuucucugcugccugugucgau

SEQ ID NO: 220812 - RNA, 22 nt, Human
uccauugugauuauauacaaaa

SEQ ID NO: 220813 - RNA, 19 nt, Human
gcgaggaagucacuguggu

SEQ ID NO: 220814 - RNA, 22 nt, Human
ggcugaguugagaggauuacuu

SEQ ID NO: 220815 - RNA, 22 nt, Human
uagauauaagguccuuagaaca

SEQ ID NO: 220816 - RNA, 22 nt, Human
uaagaaacuaaugcaauaagag

SEQ ID NO: 220817 - RNA, 22 nt, Human
aaguuuuugguagagaaaagua

SEQ ID NO: 220818 - RNA, 22 nt, Human
aucuaaaguguuucaugaaaga

SEQ ID NO: 220819 - RNA, 22 nt, Human
cucagagggucuccuccagaau

SEQ ID NO: 220820 - RNA, 22 nt, Human
uucccuucuaguuuugagagac

SEQ ID NO: 220821 - RNA, 22 nt, Human
ugccuggccagacccuauagag

SEQ ID NO: 220822 - RNA, 22 nt, Human
cauaaaagccaccuauuuaaag

SEQ ID NO: 220823 - RNA, 22 nt, Human
aaacugucauuuuauauaguua

SEQ ID NO: 220824 - RNA, 22 nt, Human
uuccauaaucaccuuauucuuu

SEQ ID NO: 220825 - RNA, 22 nt, Human
aaaguuuuagaacuaggaagca

SEQ ID NO: 220826 - RNA, 22 nt, Human
aggaaagauggaaggaggauaa

SEQ ID NO: 220827 - RNA, 22 nt, Human
aggggauggagcuggaaggcag

SEQ ID NO: 220828 - RNA, 22 nt, Human
cagggucaggaggaucuggcuu

SEQ ID NO: 220829 - RNA, 22 nt, Human
aacaugugucuggcuagauugu

SEQ ID NO: 220830 - RNA, 22 nt, Human
uuggcuuccaggaucucagcag

SEQ ID NO: 220831 - RNA, 22 nt, Human
agaggccagguccagaguuugu

SEQ ID NO: 220832 - RNA, 18 nt, Human
ugcaaauggcuguuugau

SEQ ID NO: 220833 - RNA, 22 nt, Human
guguacauauugagucugcuga

SEQ ID NO: 220834 - RNA, 22 nt, Human
ccugaagaaaauuccacgagaa

SEQ ID NO: 220835 - RNA, 22 nt, Human
uggcccuguggcuucagaacag

SEQ ID NO: 220836 - RNA, 22 nt, Human
augguacagugcacugaaugga

SEQ ID NO: 220837 - RNA, 22 nt, Human
acaacauucuuaaauacacuga

SEQ ID NO: 220838 - RNA, 22 nt, Human
uccaaggagcagucuucaaccu

SEQ ID NO: 220839 - RNA, 22 nt, Human
gaaggcuucuccagggcuuacu

SEQ ID NO: 220840 - RNA, 22 nt, Human
ucccuccuggccgucaccgcug

SEQ ID NO: 220841 - RNA, 21 nt, Human
ucuggcaggaagacggauggg

SEQ ID NO: 220842 - RNA, 22 nt, Human
ucagagguggagauaguuggga

SEQ ID NO: 220843 - RNA, 22 nt, Human
agcuggcacagaccaggagauc

SEQ ID NO: 220844 - RNA, 22 nt, Human
ggcccagccuggcaacaaugac

SEQ ID NO: 220845 - RNA, 22 nt, Human
cucacauuccacuugugccaac

SEQ ID NO: 220846 - RNA, 22 nt, Human
ugacaauagcgauuuaucuugc

SEQ ID NO: 220847 - RNA, 22 nt, Human
ggcuuuuguuucagcucugcua

SEQ ID NO: 220848 - RNA, 22 nt, Human
agcugucucugguauuauguga

SEQ ID NO: 220849 - RNA, 22 nt, Human
aggugcuguuugucagcaguuu

SEQ ID NO: 220850 - RNA, 19 nt, Human
agggccugcagcucaagcu

SEQ ID NO: 220851 - RNA, 21 nt, Human
ugaaaucugaugggacaaaug

SEQ ID NO: 220852 - RNA, 22 nt, Human
aaugcacaaaggugucuauugc

SEQ ID NO: 220853 - RNA, 22 nt, Human
ggugcaggcgguggggcaagua

SEQ ID NO: 220854 - RNA, 22 nt, Human
cuucccuuuuuaugucuucagc

SEQ ID NO: 220855 - RNA, 22 nt, Human
gggcuccagcccgggaccaggu

SEQ ID NO: 220856 - RNA, 22 nt, Human
acuguaaagaaguaaguauggg

SEQ ID NO: 220857 - RNA, 22 nt, Human
auuauuggacacuucuucugca

SEQ ID NO: 220858 - RNA, 22 nt, Human
aggcaggcucaggcccaugcuu

SEQ ID NO: 220859 - RNA, 22 nt, Human
acuuugauaguuuaaucuagga

SEQ ID NO: 220860 - RNA, 22 nt, Human
cauuuguagcuauuuacuguau

SEQ ID NO: 220861 - RNA, 22 nt, Human
uucccucuccuacucaggaaag

SEQ ID NO: 220862 - RNA, 22 nt, Human
aaacugcaauuacuuuugcagc

SEQ ID NO: 220863 - RNA, 22 nt, Human
cucuuuuaauugucauaacaac

SEQ ID NO: 220864 - RNA, 19 nt, Human
cucagucuggcucugccug

SEQ ID NO: 220865 - RNA, 22 nt, Human
aggaaagggguagguguggacg

SEQ ID NO: 220866 - RNA, 22 nt, Human
ugucacagagcaacuauuucuu

SEQ ID NO: 220867 - RNA, 22 nt, Human
uacagugacagauagggauaga

SEQ ID NO: 220868 - RNA, 22 nt, Human
caguuucuucuauuuugaacua

SEQ ID NO: 220869 - RNA, 22 nt, Human
cugggucuaaaaauucucagau

SEQ ID NO: 220870 - RNA, 22 nt, Human
uuggauccaucucaggcauagg

SEQ ID NO: 220871 - RNA, 22 nt, Human
guguuacugggaggacggaggu

SEQ ID NO: 220872 - RNA, 22 nt, Human
caugcucugcagcagaccugug

SEQ ID NO: 220873 - RNA, 22 nt, Human
cugcagcuccugagcucagaga

SEQ ID NO: 220874 - RNA, 22 nt, Human
cuucuggaggacacuggcccca

SEQ ID NO: 220875 - RNA, 22 nt, Human
augaauguaaguggauuucuuu

SEQ ID NO: 220876 - RNA, 22 nt, Human
cuuuacugaagugaagaccugg

SEQ ID NO: 220877 - RNA, 22 nt, Human
aggagaaguaaggcuagaugau

SEQ ID NO: 220878 - RNA, 19 nt, Human
ccucaucuuggugugugca

SEQ ID NO: 220879 - RNA, 22 nt, Human
caccagcuuugcccacugccca

SEQ ID NO: 220880 - RNA, 19 nt, Human
caacugcccccucaaacau

SEQ ID NO: 220881 - RNA, 22 nt, Human
cacaugcuagaauaaaucucca

SEQ ID NO: 220882 - RNA, 20 nt, Human
acuuggaacucauuuuucuu

SEQ ID NO: 220883 - RNA, 22 nt, Human
uaaugguuuuuuggagacugcu

SEQ ID NO: 220884 - RNA, 22 nt, Human
agagcccugccaauggaugagg

SEQ ID NO: 220885 - RNA, 22 nt, Human
agguggcagagcuggcccagcg

SEQ ID NO: 220886 - RNA, 22 nt, Human
aguccugugcaaaugcaucuga

SEQ ID NO: 220887 - RNA, 22 nt, Human
uucaugugaauauauuugucuu

SEQ ID NO: 220888 - RNA, 22 nt, Human
cuggccaggccccuugcagggc

SEQ ID NO: 220889 - RNA, 21 nt, Human
aaaugaaugugguagugcaag

SEQ ID NO: 220890 - RNA, 22 nt, Human
gugagcagagaucgcgugauug

SEQ ID NO: 220891 - RNA, 21 nt, Human
agagaagggacucuuccaguc

SEQ ID NO: 220892 - RNA, 22 nt, Human
aguuauuacucuuuaacauauu

SEQ ID NO: 220893 - RNA, 21 nt, Human
uaauaauuccacuacagagua

SEQ ID NO: 220894 - RNA, 22 nt, Human
uaacucacuccaaaaaggcauu

SEQ ID NO: 220895 - RNA, 22 nt, Human
uggcagugaugcggcaggacau

SEQ ID NO: 220896 - RNA, 22 nt, Human
ugcuccaggugugccucucaug

SEQ ID NO: 220897 - RNA, 22 nt, Human
cugccaggacugacgucuucag

SEQ ID NO: 220898 - RNA, 22 nt, Human
ugagugaggcugggcagucccu

SEQ ID NO: 220899 - RNA, 19 nt, Human
gccuuggcauucucugcuu

SEQ ID NO: 220900 - RNA, 22 nt, Human
gccuccugaaaggaagagcucc

SEQ ID NO: 220901 - RNA, 22 nt, Human
aagggcaggaaaagauggaugu

SEQ ID NO: 220902 - RNA, 22 nt, Human
aggcaacugacagcauauccug

SEQ ID NO: 220903 - RNA, 22 nt, Human
cgcugggugcagugauuggcau

SEQ ID NO: 220904 - RNA, 22 nt, Human
gcccagagggaagaggugucau

SEQ ID NO: 220905 - RNA, 22 nt, Human
aaggggaauagaguggguugug

SEQ ID NO: 220906 - RNA, 22 nt, Human
agaagccucauccucucuagug

SEQ ID NO: 220907 - RNA, 22 nt, Human
uuacacuuuugacaaaccugag

SEQ ID NO: 220908 - RNA, 22 nt, Human
cccaggaggcagagguuggagc

SEQ ID NO: 220909 - RNA, 22 nt, Human
gucucagggcagcuggaggagg

SEQ ID NO: 220910 - RNA, 21 nt, Human
ucucuggcgguguuuggcucc

SEQ ID NO: 220911 - RNA, 22 nt, Human
agaggccaccagagguggugcc

SEQ ID NO: 220912 - RNA, 22 nt, Human
cccucacuucacgcucugcaga

SEQ ID NO: 220913 - RNA, 22 nt, Human
auccuucuaagagggacguaug

SEQ ID NO: 220914 - RNA, 22 nt, Human
ugacuucugggugagccagcau

SEQ ID NO: 220915 - RNA, 22 nt, Human
uguuaacagaggucauuuuggg

SEQ ID NO: 220916 - RNA, 22 nt, Human
acaggccuggugcugcugacag

SEQ ID NO: 220917 - RNA, 20 nt, Human
accaggcccggugucuccuc

SEQ ID NO: 220918 - RNA, 22 nt, Human
auuuaugacaaccaaagaguga

SEQ ID NO: 220919 - RNA, 22 nt, Human
uucaguauacauuaucuaauug

SEQ ID NO: 220920 - RNA, 22 nt, Human
ccaggaggcucugcccauccca

SEQ ID NO: 220921 - RNA, 22 nt, Human
gcugcuguuccuccaguggauc

SEQ ID NO: 220922 - RNA, 22 nt, Human
gaaguuccucguaggagucucu

SEQ ID NO: 220923 - RNA, 22 nt, Human
uugaaauaucaaguuauuagug

SEQ ID NO: 220924 - RNA, 22 nt, Human
aggcugggaaauguagucuucc

SEQ ID NO: 220925 - RNA, 22 nt, Human
ccuggggcucaagauggcgccg

SEQ ID NO: 220926 - RNA, 22 nt, Human
ucuuauuuuuuaaugacagaga

SEQ ID NO: 220927 - RNA, 22 nt, Human
ccagccucacuggcaucaccua

SEQ ID NO: 220928 - RNA, 22 nt, Human
gagagcaggaggcagcgggacg

SEQ ID NO: 220929 - RNA, 22 nt, Human
uuauagcagcaugauuuacaau

SEQ ID NO: 220930 - RNA, 22 nt, Human
auggacuuaagagucagaagcu

SEQ ID NO: 220931 - RNA, 22 nt, Human
uugcauggaggaacauggccca

SEQ ID NO: 220932 - RNA, 22 nt, Human
cugugaauuaaguauuguuauc

SEQ ID NO: 220933 - RNA, 22 nt, Human
uggccagcccuucagccaugcc

SEQ ID NO: 220934 - RNA, 22 nt, Human
cugguccuaaagcccuacucca

SEQ ID NO: 220935 - RNA, 22 nt, Human
uaucauaaguuaauuaaacagu

SEQ ID NO: 220936 - RNA, 22 nt, Human
caguuucuuuccauuguuaccu

SEQ ID NO: 220937 - RNA, 18 nt, Human
aagagcuucgcauauaca

SEQ ID NO: 220938 - RNA, 22 nt, Human
gaaaggagugcuuuccaggucu

SEQ ID NO: 220939 - RNA, 22 nt, Human
uuaggaauauuuucugaguagu

SEQ ID NO: 220940 - RNA, 20 nt, Human
ugguccucacaugccaucuu

SEQ ID NO: 220941 - RNA, 22 nt, Human
gccuggcucccucugcagcucc

SEQ ID NO: 220942 - RNA, 22 nt, Human
acaggcagguaauuuacauauu

SEQ ID NO: 220943 - RNA, 22 nt, Human
ugcaccaguuucucagagaauc

SEQ ID NO: 220944 - RNA, 22 nt, Human
ggucucugaacuuccacugcgc

SEQ ID NO: 220945 - RNA, 18 nt, Human
uucuuuaauucaguuuga

SEQ ID NO: 220946 - RNA, 22 nt, Human
aggcugcguuagccucacuccc

SEQ ID NO: 220947 - RNA, 22 nt, Human
cugggcucagcccaugcugucc

SEQ ID NO: 220948 - RNA, 22 nt, Human
agcaucuuuaggaagagaaaga

SEQ ID NO: 220949 - RNA, 22 nt, Human
ucagcccugaggacagaggcag

SEQ ID NO: 220950 - RNA, 22 nt, Human
uuauuuucagcuaggaaagcca

SEQ ID NO: 220951 - RNA, 18 nt, Human
uccagggcuuccuccucu

SEQ ID NO: 220952 - RNA, 17 nt, Human
cacaggugugguuugag

SEQ ID NO: 220953 - RNA, 22 nt, Human
uugcaaaagcaauugcaguuuu

SEQ ID NO: 220954 - RNA, 22 nt, Human
uuauugaaauggaagcuauaac

SEQ ID NO: 220955 - RNA, 22 nt, Human
uuacagagcucauuucuaaggg

SEQ ID NO: 220956 - RNA, 22 nt, Human
uuugcaaaugaagcucugagga

SEQ ID NO: 220957 - RNA, 21 nt, Human
aaagagcccgcugagagguuc

SEQ ID NO: 220958 - RNA, 22 nt, Human
uagcagcuuaaguaauuagaau

SEQ ID NO: 220959 - RNA, 22 nt, Human
caggucuccagcucagggucca

SEQ ID NO: 220960 - RNA, 22 nt, Human
uugcugaucugugaaucagcca

SEQ ID NO: 220961 - RNA, 19 nt, Human
agucugguggcgugcaugu

SEQ ID NO: 220962 - RNA, 22 nt, Human
agcuucccaggagaaucaggga

SEQ ID NO: 220963 - RNA, 22 nt, Human
gacaaaaguguuuugaacaagg

SEQ ID NO: 220964 - RNA, 22 nt, Human
agggagcucgaugccugagugu

SEQ ID NO: 220965 - RNA, 22 nt, Human
uagaacucuggucuucucaucc

SEQ ID NO: 220966 - RNA, 22 nt, Human
cagccccuggcgcacgccgagc

SEQ ID NO: 220967 - RNA, 22 nt, Human
aguuaaagaaagauaauucgcc

SEQ ID NO: 220968 - RNA, 22 nt, Human
uuuauuggaugggucagcucua

SEQ ID NO: 220969 - RNA, 22 nt, Human
uucucuggguuaggggaacuau

SEQ ID NO: 220970 - RNA, 22 nt, Human
acugccuugauucaugcugaug

SEQ ID NO: 220971 - RNA, 22 nt, Human
gguguccacucagcccguccug

SEQ ID NO: 220972 - RNA, 22 nt, Human
ugucuugacuuuagagccagga

SEQ ID NO: 220973 - RNA, 22 nt, Human
uucuucuucaagugcugcauuc

SEQ ID NO: 220974 - RNA, 19 nt, Human
aaggacacaacagagauag

SEQ ID NO: 220975 - RNA, 22 nt, Human
uguuagaaguuaaucacuaauu

SEQ ID NO: 220976 - RNA, 22 nt, Human
cucugggcaggacgccaggccu

SEQ ID NO: 220977 - RNA, 17 nt, Human
uggcccuagacuccagc

SEQ ID NO: 220978 - RNA, 22 nt, Human
gcugcuuuauaaucucggcaga

SEQ ID NO: 220979 - RNA, 22 nt, Human
uuaagaagguacucaaagaucu

SEQ ID NO: 220980 - RNA, 22 nt, Human
ugguccagacuuugaccucuca

SEQ ID NO: 220981 - RNA, 22 nt, Human
agaauuguaauaauaauagcau

SEQ ID NO: 220982 - RNA, 22 nt, Human
aggcaggcuagucgcuugagcc

SEQ ID NO: 220983 - RNA, 22 nt, Human
gcagagaaggauugaaaccaga

SEQ ID NO: 220984 - RNA, 20 nt, Human
gaagauggguagaggcacag

SEQ ID NO: 220985 - RNA, 22 nt, Human
gacccaggaagcuacuucuggu

SEQ ID NO: 220986 - RNA, 22 nt, Human
uugaaaacuuucuagaccaaga

SEQ ID NO: 220987 - RNA, 22 nt, Human
aagugagugguaaggagcaugg

SEQ ID NO: 220988 - RNA, 22 nt, Human
aguccuuugcugaacugucaca

SEQ ID NO: 220989 - RNA, 22 nt, Human
cugccuguggacacccuggagg

SEQ ID NO: 220990 - RNA, 22 nt, Human
ucugccagguggggagaggcca

SEQ ID NO: 220991 - RNA, 22 nt, Human
cuuguuaaauuauauaagcaga

SEQ ID NO: 220992 - RNA, 21 nt, Human
ggaaggcuaugguguauuuuu

SEQ ID NO: 220993 - RNA, 20 nt, Human
aaagagcccuuggagcaggc

SEQ ID NO: 220994 - RNA, 22 nt, Human
uuuccuaggagauugaucacau

SEQ ID NO: 220995 - RNA, 22 nt, Human
auucuaaagcuuguggagcuua

SEQ ID NO: 220996 - RNA, 22 nt, Human
cuguuacuguauuuaaucaucu

SEQ ID NO: 220997 - RNA, 22 nt, Human
ucaaaggguccuuaacaugaga

SEQ ID NO: 220998 - RNA, 22 nt, Human
uaccaccuccauccuccuuuca

SEQ ID NO: 220999 - RNA, 22 nt, Human
aggucugagcucagggccuggc

SEQ ID NO: 221000 - RNA, 17 nt, Human
gaagguuucucuuaggu

SEQ ID NO: 221001 - RNA, 22 nt, Human
uuagagaagaugaaccaucguu

SEQ ID NO: 221002 - RNA, 22 nt, Human
ugcucaguuaagcagaggaaau

SEQ ID NO: 221003 - RNA, 22 nt, Human
uucuguuuugcacagacuugaa

SEQ ID NO: 221004 - RNA, 22 nt, Human
aggccucaggaagguaaagaag

SEQ ID NO: 221005 - RNA, 22 nt, Human
ggugggugcagggggcuucuua

SEQ ID NO: 221006 - RNA, 22 nt, Human
cauuuuguaagucucucuuguu

SEQ ID NO: 221007 - RNA, 22 nt, Human
ugucuguggcaauuguggguaa

SEQ ID NO: 221008 - RNA, 18 nt, Human
aagccaggucaagauaag

SEQ ID NO: 221009 - RNA, 18 nt, Human
ucauuuguuuugcaugaa

SEQ ID NO: 221010 - RNA, 22 nt, Human
cuguccuccggccaccuacagu

SEQ ID NO: 221011 - RNA, 16 nt, Human
ugaggucuuauuagca

SEQ ID NO: 221012 - RNA, 22 nt, Human
uacagagugguuguccaacucu

SEQ ID NO: 221013 - RNA, 22 nt, Human
uaaggccaaacuauuauaguuc

SEQ ID NO: 221014 - RNA, 19 nt, Human
ggcaggcuggauagagagg

SEQ ID NO: 221015 - RNA, 22 nt, Human
ucaguuaagaggccacggcagu

SEQ ID NO: 221016 - RNA, 20 nt, Human
uugagcuuccaagucuuugu

SEQ ID NO: 221017 - RNA, 22 nt, Human
aacaugcucuuccuggcuaguc

SEQ ID NO: 221018 - RNA, 22 nt, Human
ccccagagagcaccaugaagcc

SEQ ID NO: 221019 - RNA, 22 nt, Human
acauuuaaccaaacuguuuaau

SEQ ID NO: 221020 - RNA, 22 nt, Human
ggccaggagaggagggcacuga

SEQ ID NO: 221021 - RNA, 22 nt, Human
gcagaugcagagauggcugggg

SEQ ID NO: 221022 - RNA, 22 nt, Human
agcugugguuagauagaguccu

SEQ ID NO: 221023 - RNA, 22 nt, Human
ccagcagguguagggcucaugg

SEQ ID NO: 221024 - RNA, 22 nt, Human
ccagccaugggccaccuagcug

SEQ ID NO: 221025 - RNA, 22 nt, Human
gaaucccuugcaaguuguugua

SEQ ID NO: 221026 - RNA, 22 nt, Human
cuggccacugguggucauaggc

SEQ ID NO: 221027 - RNA, 22 nt, Human
aggaagccuggaguccugccca

SEQ ID NO: 221028 - RNA, 22 nt, Human
uuagcuucuuacauuucauccu

SEQ ID NO: 221029 - RNA, 22 nt, Human
uucuuuauccuauuuguaggug

SEQ ID NO: 221030 - RNA, 22 nt, Human
uggcucagccuggcccuuucau

SEQ ID NO: 221031 - RNA, 22 nt, Human
gaggaaccacucugagaagcca

SEQ ID NO: 221032 - RNA, 22 nt, Human
uuuaaugugacaucuuuuagag

SEQ ID NO: 221033 - RNA, 22 nt, Human
ccucugggccagccuggacccu

SEQ ID NO: 221034 - RNA, 22 nt, Human
aagcaggaaggagcccagggca

SEQ ID NO: 221035 - RNA, 22 nt, Human
cagggccucauugucaguccug

SEQ ID NO: 221036 - RNA, 22 nt, Human
agucuucuguuuuucagcagcu

SEQ ID NO: 221037 - RNA, 22 nt, Human
ugugugggcgaagacagccuuu

SEQ ID NO: 221038 - RNA, 22 nt, Human
caggacauugauccauuggcac

SEQ ID NO: 221039 - RNA, 22 nt, Human
gaguccugcuuucaauucuuuu

SEQ ID NO: 221040 - RNA, 22 nt, Human
aggaacacaacuuccugagagc

SEQ ID NO: 221041 - RNA, 22 nt, Human
acaggauggagauaauagaaaa

SEQ ID NO: 221042 - RNA, 20 nt, Human
aacuagaaagcacccaugga

SEQ ID NO: 221043 - RNA, 22 nt, Human
ucaugcuuuguuaauguggcac

SEQ ID NO: 221044 - RNA, 22 nt, Human
gaugaaaaaagacgagcauaua

SEQ ID NO: 221045 - RNA, 22 nt, Human
uaaaguguggauaugauuagua

SEQ ID NO: 221046 - RNA, 22 nt, Human
gaggcagcagaacauggaagag

SEQ ID NO: 221047 - RNA, 22 nt, Human
gaaaggcugcaucucgccucag

SEQ ID NO: 221048 - RNA, 22 nt, Human
cccaaggacacgggcagggaca

SEQ ID NO: 221049 - RNA, 22 nt, Human
agaaacaucauuggaacacaag

SEQ ID NO: 221050 - RNA, 23 nt, Human
acagaugaaaguguggcucagag

SEQ ID NO: 221051 - RNA, 22 nt, Human
ccaggccugcauucccucucag

SEQ ID NO: 221052 - RNA, 22 nt, Human
ucuguucagaauuguaacacuc

SEQ ID NO: 221053 - RNA, 22 nt, Human
guagucugaacaguaauuuugu

SEQ ID NO: 221054 - RNA, 22 nt, Human
agauuuuaguuuggggaggugc

SEQ ID NO: 221055 - RNA, 22 nt, Human
accauucugucucuuuacaaau

SEQ ID NO: 221056 - RNA, 22 nt, Human
aaaaaauuaucauaguuccuga

SEQ ID NO: 221057 - RNA, 22 nt, Human
agucacacugguuguuuacagu

SEQ ID NO: 221058 - RNA, 22 nt, Human
uguuuacuccugauauauuuuu

SEQ ID NO: 221059 - RNA, 22 nt, Human
aucuagauuagguauaagagcu

SEQ ID NO: 221060 - RNA, 22 nt, Human
ugucagagcaaugagguucagc

SEQ ID NO: 221061 - RNA, 22 nt, Human
gacagucugggcacacaugaaa

SEQ ID NO: 221062 - RNA, 22 nt, Human
cccagagauguccugagugaua

SEQ ID NO: 221063 - RNA, 19 nt, Human
agcucaggcccaucguccc

SEQ ID NO: 221064 - RNA, 22 nt, Human
uggguccuggcuuugucagggu

SEQ ID NO: 221065 - RNA, 22 nt, Human
ggucuggauuucugcuucuuuc

SEQ ID NO: 221066 - RNA, 22 nt, Human
uuacacuucugaaagccuaggu

SEQ ID NO: 221067 - RNA, 22 nt, Human
caaaagcaaagucccugaaugu

SEQ ID NO: 221068 - RNA, 22 nt, Human
gauugagucugaggaugcugca

SEQ ID NO: 221069 - RNA, 22 nt, Human
ucaggaagcugaauuacaaaaa

SEQ ID NO: 221070 - RNA, 22 nt, Human
auugcugaaaguauuuuaugac

SEQ ID NO: 221071 - RNA, 22 nt, Human
ggcccucuuuuauccaucauaa

SEQ ID NO: 221072 - RNA, 22 nt, Human
cuggcagauaguaagugaucaa

SEQ ID NO: 221073 - RNA, 22 nt, Human
gaagccccaaacccucgccauc

SEQ ID NO: 221074 - RNA, 22 nt, Human
gagugcaggccugagcaccauc

SEQ ID NO: 221075 - RNA, 22 nt, Human
ucagcagagcgagaccaaguca

SEQ ID NO: 221076 - RNA, 22 nt, Human
cagcagaacaggcagggaagcu

SEQ ID NO: 221077 - RNA, 22 nt, Human
ugcccuggcucuccacuaguuu

SEQ ID NO: 221078 - RNA, 17 nt, Human
acagcaggcccggaggg

SEQ ID NO: 221079 - RNA, 22 nt, Human
uucugcaggagcccuaguguau

SEQ ID NO: 221080 - RNA, 22 nt, Human
gagggggcgaacagaagcaagg

SEQ ID NO: 221081 - RNA, 22 nt, Human
ccagagucaggagcucauguga

SEQ ID NO: 221082 - RNA, 22 nt, Human
gcuuggcuccuggcucacaggu

SEQ ID NO: 221083 - RNA, 22 nt, Human
uaucuagagccuggaagucuug

SEQ ID NO: 221084 - RNA, 22 nt, Human
acagcagcuaaccccugggcca

SEQ ID NO: 221085 - RNA, 23 nt, Human
gcccagggacugggaaucagugg

SEQ ID NO: 221086 - RNA, 22 nt, Human
ucaccagggcuccagccagccu

SEQ ID NO: 221087 - RNA, 22 nt, Human
gcauaguaggcugucaaaaaug

SEQ ID NO: 221088 - RNA, 22 nt, Human
uauucaugucggcugaaaaagc

SEQ ID NO: 221089 - RNA, 22 nt, Human
aggaaggguucuuugugaaaga

SEQ ID NO: 221090 - RNA, 22 nt, Human
uccauaaauuuuaugaacauau

SEQ ID NO: 221091 - RNA, 19 nt, Human
gcugcuggcucuggcugga

SEQ ID NO: 221092 - RNA, 22 nt, Human
uagcaccaauaugugcuuuuca

SEQ ID NO: 221093 - RNA, 22 nt, Human
caggagcagaggguggucagca

SEQ ID NO: 221094 - RNA, 22 nt, Human
uuaaugauuuggaacccuuuaa

SEQ ID NO: 221095 - RNA, 22 nt, Human
guggcauucucggcaccaucug

SEQ ID NO: 221096 - RNA, 20 nt, Human
aguuauaguaucuagccaug

SEQ ID NO: 221097 - RNA, 22 nt, Human
gagcagcagcugggccagguuc

SEQ ID NO: 221098 - RNA, 18 nt, Human
auaaagugcuaauaaugg

SEQ ID NO: 221099 - RNA, 22 nt, Human
aguguggacuuuuccuaggagg

SEQ ID NO: 221100 - RNA, 22 nt, Human
uggagagcaagucgcagacaug

SEQ ID NO: 221101 - RNA, 22 nt, Human
ugcaggcauuggugagagaagc

SEQ ID NO: 221102 - RNA, 22 nt, Human
ucagaggcucaucugccuugca

SEQ ID NO: 221103 - RNA, 22 nt, Human
gucugcugcagagcauggcuuu

SEQ ID NO: 221104 - RNA, 22 nt, Human
uucugcuuauucaaaugaucuu

SEQ ID NO: 221105 - RNA, 21 nt, Human
aguguccuuuuacugugaaua

SEQ ID NO: 221106 - RNA, 22 nt, Human
aggcaagcccccagugaggcuc

SEQ ID NO: 221107 - RNA, 22 nt, Human
uggcccaggggcucuugguguu

SEQ ID NO: 221108 - RNA, 22 nt, Human
auguguccugcugugucacaca

SEQ ID NO: 221109 - RNA, 22 nt, Human
uuacauguaaucuaaaauaauu

SEQ ID NO: 221110 - RNA, 22 nt, Human
ccucuggguaucuguggaagua

SEQ ID NO: 221111 - RNA, 19 nt, Human
uucucugugcuagacucug

SEQ ID NO: 221112 - RNA, 22 nt, Human
uuuacagucuauguugaauuaa

SEQ ID NO: 221113 - RNA, 22 nt, Human
ucuggcuugucucagggucuga

SEQ ID NO: 221114 - RNA, 22 nt, Human
gcacagagccugguaccgagaa

SEQ ID NO: 221115 - RNA, 22 nt, Human
ggccagcuucucugcugccugu

SEQ ID NO: 221116 - RNA, 22 nt, Human
ucauccaguaccauggaaggca

SEQ ID NO: 221117 - RNA, 22 nt, Human
aguggcuuauguuuagaaucau

SEQ ID NO: 221118 - RNA, 22 nt, Human
caggaggggguggaguuucgcc

SEQ ID NO: 221119 - RNA, 20 nt, Human
uaggcaauuaguagauaaca

SEQ ID NO: 221120 - RNA, 22 nt, Human
gcucaggccuggcuauccauug

SEQ ID NO: 221121 - RNA, 22 nt, Human
uuucauguacuuuuuugauaga

SEQ ID NO: 221122 - RNA, 21 nt, Human
ugucuuuaggaccuguuaaau

SEQ ID NO: 221123 - RNA, 22 nt, Human
aggcuuagaaaggguaagugac

SEQ ID NO: 221124 - RNA, 19 nt, Human
uucaggauugacccuacug

SEQ ID NO: 221125 - RNA, 23 nt, Human
uccaugagaugugggcuucuagu

SEQ ID NO: 221126 - RNA, 22 nt, Human
caucucuguguccccagagcuu

SEQ ID NO: 221127 - RNA, 22 nt, Human
gcagggcuugcagcagcuagac

SEQ ID NO: 221128 - RNA, 22 nt, Human
caugaacauuuguuuacaucug

SEQ ID NO: 221129 - RNA, 17 nt, Human
gcuggcugacccaugcc

SEQ ID NO: 221130 - RNA, 18 nt, Human
agaguccagggugaggug

SEQ ID NO: 221131 - RNA, 22 nt, Human
uagacauuuuaagacauauacc

SEQ ID NO: 221132 - RNA, 22 nt, Human
agugucugaugcacaguugucc

SEQ ID NO: 221133 - RNA, 22 nt, Human
aguggcuguucauuuuacacaa

SEQ ID NO: 221134 - RNA, 22 nt, Human
augaggaugggaagggagccaa

SEQ ID NO: 221135 - RNA, 22 nt, Human
caaagugcugagauuacaggua

SEQ ID NO: 221136 - RNA, 22 nt, Human
uuucagacaggacuucauaugu

SEQ ID NO: 221137 - RNA, 22 nt, Human
gccacaggaaagcacccuggag

SEQ ID NO: 221138 - RNA, 22 nt, Human
uggggccagagcugcagggagc

SEQ ID NO: 221139 - RNA, 22 nt, Human
uacuucugccuuagagaacacu

SEQ ID NO: 221140 - RNA, 22 nt, Human
aggagcugugaaugggaggggu

SEQ ID NO: 221141 - RNA, 22 nt, Human
uauuggucugcuuaaguggauu

SEQ ID NO: 221142 - RNA, 22 nt, Human
ggggcuguugaaguuaguugag

SEQ ID NO: 221143 - RNA, 22 nt, Human
gcugugcccagcuccagcucug

SEQ ID NO: 221144 - RNA, 22 nt, Human
auucaaauuaaguuaauucagc

SEQ ID NO: 221145 - RNA, 22 nt, Human
ucaggagcucaggcugauggaa

SEQ ID NO: 221146 - RNA, 19 nt, Human
caggaaugagguaauggcu

SEQ ID NO: 221147 - RNA, 22 nt, Human
acuuuugaggacuuuauuguau

SEQ ID NO: 221148 - RNA, 22 nt, Human
aagcaauuguccugucucuaca

SEQ ID NO: 221149 - RNA, 22 nt, Human
aggggcucaguuacuuuggcag

SEQ ID NO: 221150 - RNA, 22 nt, Human
uauauuguagcugaugacaaau

SEQ ID NO: 221151 - RNA, 22 nt, Human
ucauuuaucgcugccuuuuaaa

SEQ ID NO: 221152 - RNA, 22 nt, Human
cucaccccacuaccccuuggug

SEQ ID NO: 221153 - RNA, 22 nt, Human
aagaggagacuucagcaacuug

SEQ ID NO: 221154 - RNA, 22 nt, Human
gacacagagauaggccuguguu

SEQ ID NO: 221155 - RNA, 22 nt, Human
augauacaucuucaugucagug

SEQ ID NO: 221156 - RNA, 22 nt, Human
caugaaaauaacauuguuguga

SEQ ID NO: 221157 - RNA, 22 nt, Human
aagcaaaacgugcucuaggagg

SEQ ID NO: 221158 - RNA, 22 nt, Human
cauucauucacauuuugucuau

SEQ ID NO: 221159 - RNA, 22 nt, Human
cccaggcuccuacuguauucug

SEQ ID NO: 221160 - RNA, 22 nt, Human
accauuacaugauccuuaccca

SEQ ID NO: 221161 - RNA, 23 nt, Human
agcacagacuagaaaggucuuuc

SEQ ID NO: 221162 - RNA, 22 nt, Human
aaaugaguuugccucuagauag

SEQ ID NO: 221163 - RNA, 22 nt, Human
ccagcucuuuuggcugagugag

SEQ ID NO: 221164 - RNA, 22 nt, Human
uaggcagaaaggaaggcaaguu

SEQ ID NO: 221165 - RNA, 22 nt, Human
caguccugagccaaucaugaug

SEQ ID NO: 221166 - RNA, 22 nt, Human
uccugagcucccaugaacaggc

SEQ ID NO: 221167 - RNA, 22 nt, Human
ucauuuauaaggaugcaauuaa

SEQ ID NO: 221168 - RNA, 22 nt, Human
uaccaggaguuacaggcagcag

SEQ ID NO: 221169 - RNA, 22 nt, Human
ccuccaagcuucaucucaacca

SEQ ID NO: 221170 - RNA, 22 nt, Human
ugacaggcuaggaggcugaagg

SEQ ID NO: 221171 - RNA, 22 nt, Human
agcuuaucuuguuaguuucauu

SEQ ID NO: 221172 - RNA, 22 nt, Human
ccugcccacuccaggagcaacu

SEQ ID NO: 221173 - RNA, 22 nt, Human
auacacauuugcuagagauggg

SEQ ID NO: 221174 - RNA, 22 nt, Human
acucagagaaacagcagggugu

SEQ ID NO: 221175 - RNA, 22 nt, Human
gucccaggugggcuccaccucu

SEQ ID NO: 221176 - RNA, 22 nt, Human
acacgcauaaauacacagucua

SEQ ID NO: 221177 - RNA, 22 nt, Human
uaguauucagcuucucaggcaa

SEQ ID NO: 221178 - RNA, 22 nt, Human
aaucuucauuuugacaagauuc

SEQ ID NO: 221179 - RNA, 22 nt, Human
cccacuguguugcagucuagug

SEQ ID NO: 221180 - RNA, 22 nt, Human
auuugccuuacugaagaaggag

SEQ ID NO: 221181 - RNA, 22 nt, Human
gugcauuuauauuugccuuugg

SEQ ID NO: 221182 - RNA, 22 nt, Human
acacauuuauggaucgcagaaa

SEQ ID NO: 221183 - RNA, 22 nt, Human
augucaggacccuacugcauug

SEQ ID NO: 221184 - RNA, 22 nt, Human
ccagcacuccugucucaagucu

SEQ ID NO: 221185 - RNA, 22 nt, Human
aacauuuguguuugcuaaaaau

SEQ ID NO: 221186 - RNA, 22 nt, Human
ucuaaagaagaggguucugcgg

SEQ ID NO: 221187 - RNA, 22 nt, Human
gacauaaaauucaauaauuugu

SEQ ID NO: 221188 - RNA, 22 nt, Human
ggggggcagcuguccuggccau

SEQ ID NO: 221189 - RNA, 22 nt, Human
caucauuguuagggacucuaac

SEQ ID NO: 221190 - RNA, 22 nt, Human
ggcuuuauuuugcaugaaugcu

SEQ ID NO: 221191 - RNA, 22 nt, Human
uggauaaauagauacacuugca

SEQ ID NO: 221192 - RNA, 22 nt, Human
gucuucaauagagccucaauuu

SEQ ID NO: 221193 - RNA, 22 nt, Human
ccagugucuucagaguaaaucu

SEQ ID NO: 221194 - RNA, 22 nt, Human
gucaggcagccuggagauucag

SEQ ID NO: 221195 - RNA, 22 nt, Human
uuugcauuucuaaugagcuccg

SEQ ID NO: 221196 - RNA, 22 nt, Human
gccuccccaaagugcugacagc

SEQ ID NO: 221197 - RNA, 22 nt, Human
ccuggccacccagccuuggcca

SEQ ID NO: 221198 - RNA, 22 nt, Human
uuucuuauacuauauugucauc

SEQ ID NO: 221199 - RNA, 22 nt, Human
uucuguccacugcuggggccuc

SEQ ID NO: 221200 - RNA, 22 nt, Human
cagcagcagacauuugaucuuc

SEQ ID NO: 221201 - RNA, 22 nt, Human
uacagugcacauuucuuaggaa

SEQ ID NO: 221202 - RNA, 22 nt, Human
ucacacaucucagguguuuaau

SEQ ID NO: 221203 - RNA, 22 nt, Human
ggcugcuguuucagagacuguu

SEQ ID NO: 221204 - RNA, 22 nt, Human
auuuugugaacccucaagcaau

SEQ ID NO: 221205 - RNA, 22 nt, Human
gaggccaggggccuggagauga

SEQ ID NO: 221206 - RNA, 22 nt, Human
uucagcagugcagacacccagu

SEQ ID NO: 221207 - RNA, 22 nt, Human
uucuccaggggaggguucucca

SEQ ID NO: 221208 - RNA, 20 nt, Human
auucugcuuucugauagagc

SEQ ID NO: 221209 - RNA, 22 nt, Human
uggggcugugagacuacaggau

SEQ ID NO: 221210 - RNA, 22 nt, Human
ucuccucucuuaccugguacaa

SEQ ID NO: 221211 - RNA, 19 nt, Human
ccuggcugcugugggaugc

SEQ ID NO: 221212 - RNA, 22 nt, Human
aagccaguuagcacaucauugc

SEQ ID NO: 221213 - RNA, 22 nt, Human
gcaaagaaaugucagugagagg

SEQ ID NO: 221214 - RNA, 22 nt, Human
ucauuuacacuucacaaaugga

SEQ ID NO: 221215 - RNA, 22 nt, Human
aacauguaccuacaaucagaau

SEQ ID NO: 221216 - RNA, 22 nt, Human
aaagacagacggaaaccugagg

SEQ ID NO: 221217 - RNA, 22 nt, Human
ccuccacucuggccucucaggu

SEQ ID NO: 221218 - RNA, 22 nt, Human
ccugcugucucugggcaggcag

SEQ ID NO: 221219 - RNA, 22 nt, Human
acucagaguuuuacccagagac

SEQ ID NO: 221220 - RNA, 17 nt, Human
uguuuuuucccuguucu

SEQ ID NO: 221221 - RNA, 22 nt, Human
gcugaagguguguggagagagg

SEQ ID NO: 221222 - RNA, 22 nt, Human
ugucaaaaagcugggacaagca

SEQ ID NO: 221223 - RNA, 20 nt, Human
aggucucagagcaagagccc

SEQ ID NO: 221224 - RNA, 22 nt, Human
acuguauuuuggguguauuuuc

SEQ ID NO: 221225 - RNA, 18 nt, Human
uggagggcuugcugcagc

SEQ ID NO: 221226 - RNA, 22 nt, Human
ugggaacauuuugagcugagag

SEQ ID NO: 221227 - RNA, 22 nt, Human
auagaaucuuuguaaaacacuu

SEQ ID NO: 221228 - RNA, 22 nt, Human
ucaaaucaccaaacucacuggc

SEQ ID NO: 221229 - RNA, 22 nt, Human
uggaccugcuggaugggcaggu

SEQ ID NO: 221230 - RNA, 22 nt, Human
uucugaaagccaauucauugaa

SEQ ID NO: 221231 - RNA, 19 nt, Human
aggcucugagcuccuggag

SEQ ID NO: 221232 - RNA, 22 nt, Human
cacaaaguggguggaaaacuaa

SEQ ID NO: 221233 - RNA, 22 nt, Human
augauugaaaaugacauugcca

SEQ ID NO: 221234 - RNA, 22 nt, Human
aggcuucuugagccccacaggc

SEQ ID NO: 221235 - RNA, 22 nt, Human
agggagcccugaaccagagggu

SEQ ID NO: 221236 - RNA, 22 nt, Human
aggcacugguccauuuucugca

SEQ ID NO: 221237 - RNA, 22 nt, Human
acaugacagugcuuagcaaacu

SEQ ID NO: 221238 - RNA, 22 nt, Human
ggccucaggguugggcccauua

SEQ ID NO: 221239 - RNA, 22 nt, Human
agcaaacagugugcuaagaaau

SEQ ID NO: 221240 - RNA, 22 nt, Human
ccuccugggagagcacggaggg

SEQ ID NO: 221241 - RNA, 19 nt, Human
agacacacuuacguggaau

SEQ ID NO: 221242 - RNA, 22 nt, Human
cucuuuggggcuggaagccuag

SEQ ID NO: 221243 - RNA, 22 nt, Human
gcagcccaggagcaggcgaccc

SEQ ID NO: 221244 - RNA, 22 nt, Human
ccagugcacagccaggcaggug

SEQ ID NO: 221245 - RNA, 22 nt, Human
gggcugagcuaagcuggguuga

SEQ ID NO: 221246 - RNA, 22 nt, Human
aaguuuuaugggaagaugugca

SEQ ID NO: 221247 - RNA, 22 nt, Human
aaaguccuagcgauccacagaa

SEQ ID NO: 221248 - RNA, 19 nt, Human
ggcucagggcgcugccgcc

SEQ ID NO: 221249 - RNA, 22 nt, Human
aguccuuuuguuuugagaugag

SEQ ID NO: 221250 - RNA, 17 nt, Human
guguucacaaugacugu

SEQ ID NO: 221251 - RNA, 22 nt, Human
ccuccagccuuccugaagagcc

SEQ ID NO: 221252 - RNA, 22 nt, Human
uugaaacuuuucuuggagaaac

SEQ ID NO: 221253 - RNA, 22 nt, Human
aguguuugucccguuagaaaug

SEQ ID NO: 221254 - RNA, 22 nt, Human
agcagccagagaaugaugcagu

SEQ ID NO: 221255 - RNA, 22 nt, Human
cuaggcuggagugcaguggcau

SEQ ID NO: 221256 - RNA, 22 nt, Human
gcacacaugugaguguccuuuc

SEQ ID NO: 221257 - RNA, 22 nt, Human
gggagacaaaggugagguucuu

SEQ ID NO: 221258 - RNA, 22 nt, Human
aggaagagcccgggugacauaa

SEQ ID NO: 221259 - RNA, 22 nt, Human
uauguuauauuuugucaauugu

SEQ ID NO: 221260 - RNA, 22 nt, Human
ggcagcacugcagcuuguuggg

SEQ ID NO: 221261 - RNA, 22 nt, Human
ccugugccuuccuuaggcaccu

SEQ ID NO: 221262 - RNA, 22 nt, Human
aaagguuuugguaaggcuuuaa

SEQ ID NO: 221263 - RNA, 22 nt, Human
agccagagagccccagguucua

SEQ ID NO: 221264 - RNA, 22 nt, Human
caaagccaggcuuucuaaugua

SEQ ID NO: 221265 - RNA, 22 nt, Human
uccugggguuuuggccgcagcu

SEQ ID NO: 221266 - RNA, 20 nt, Human
cccuggccuguuucaugccc

SEQ ID NO: 221267 - RNA, 22 nt, Human
aguuuuauggcucaaccuaaua

SEQ ID NO: 221268 - RNA, 22 nt, Human
auguacaucuuuauaacaagcu

SEQ ID NO: 221269 - RNA, 22 nt, Human
augaguugaagcuacaagaggc

SEQ ID NO: 221270 - RNA, 22 nt, Human
uccauacuaacagcauuuauca

SEQ ID NO: 221271 - RNA, 22 nt, Human
aagauauagauggugguauaaa

SEQ ID NO: 221272 - RNA, 22 nt, Human
augagcucaggugugcaaaaua

SEQ ID NO: 221273 - RNA, 22 nt, Human
guugcucaggcaggaguacagu

SEQ ID NO: 221274 - RNA, 22 nt, Human
uaguagaauccaaaccaacagu

SEQ ID NO: 221275 - RNA, 22 nt, Human
gaggcaaggccgcacgucucag

SEQ ID NO: 221276 - RNA, 22 nt, Human
cuggaaagugcuuuucugagag

SEQ ID NO: 221277 - RNA, 22 nt, Human
ugcacagcugccuccucucugc

SEQ ID NO: 221278 - RNA, 23 nt, Human
ggcucacacggagugccuccacc

SEQ ID NO: 221279 - RNA, 22 nt, Human
uggcucagcgcggccuggucuu

SEQ ID NO: 221280 - RNA, 22 nt, Human
gcucagaguggccuggcuaggg

SEQ ID NO: 221281 - RNA, 22 nt, Human
ucccagccacagguguagcccu

SEQ ID NO: 221282 - RNA, 22 nt, Human
caaaggaaauacuaaucuggaa

SEQ ID NO: 221283 - RNA, 22 nt, Human
gccaggugagaggacugaggcu

SEQ ID NO: 221284 - RNA, 22 nt, Human
ucugucaugccacaggacuugg

SEQ ID NO: 221285 - RNA, 22 nt, Human
cacgcuuggcuuauacagagaa

SEQ ID NO: 221286 - RNA, 22 nt, Human
ucuccacagaagguuccaggcc

SEQ ID NO: 221287 - RNA, 22 nt, Human
ccagggcucaggcucccagugg

SEQ ID NO: 221288 - RNA, 21 nt, Human
ggacuuggaugguggcaguag

SEQ ID NO: 221289 - RNA, 22 nt, Human
caggguagggcaagggaaccug

SEQ ID NO: 221290 - RNA, 22 nt, Human
uuaaucacagcucugccaugag

SEQ ID NO: 221291 - RNA, 22 nt, Human
gugcauuaggcuggaauguuga

SEQ ID NO: 221292 - RNA, 22 nt, Human
acaggagcaacagacuaagaca

SEQ ID NO: 221293 - RNA, 22 nt, Human
auuuccugggucucacuccaga

SEQ ID NO: 221294 - RNA, 22 nt, Human
ucaggucuauagaagaggaggg

SEQ ID NO: 221295 - RNA, 23 nt, Human
gaaaucuagucauuuuuagucug

SEQ ID NO: 221296 - RNA, 17 nt, Human
ucauuuguugugacuag

SEQ ID NO: 221297 - RNA, 22 nt, Human
agacaugugguauaaucagggg

SEQ ID NO: 221298 - RNA, 22 nt, Human
cuagggaguggcagagcuggga

SEQ ID NO: 221299 - RNA, 22 nt, Human
uuccaggaggcauucuuaguuu

SEQ ID NO: 221300 - RNA, 19 nt, Human
ccugggccuccaucacccc

SEQ ID NO: 221301 - RNA, 22 nt, Human
ugcuccugcuggcccucgugcc

SEQ ID NO: 221302 - RNA, 22 nt, Human
acccaugaguguaucuuuaaaa

SEQ ID NO: 221303 - RNA, 22 nt, Human
agggccugucagcgguguccug

SEQ ID NO: 221304 - RNA, 20 nt, Human
cacaggaaagcuacucaguu

SEQ ID NO: 221305 - RNA, 22 nt, Human
agaagaacuuagcuuucuaucu

SEQ ID NO: 221306 - RNA, 22 nt, Human
ucaggcucaggaauguguuuau

SEQ ID NO: 221307 - RNA, 22 nt, Human
cuauucagccucuaagacaagu

SEQ ID NO: 221308 - RNA, 18 nt, Human
cacaggagaugaccugac

SEQ ID NO: 221309 - RNA, 22 nt, Human
aggguggccaccaaguauguca

SEQ ID NO: 221310 - RNA, 22 nt, Human
cuuucauccgcagaugagccuc

SEQ ID NO: 221311 - RNA, 22 nt, Human
cacaaaauaucaagcacuuuua

SEQ ID NO: 221312 - RNA, 22 nt, Human
cagauggccagaggcagcugca

SEQ ID NO: 221313 - RNA, 22 nt, Human
uuucucugggcacucuccaaac

SEQ ID NO: 221314 - RNA, 22 nt, Human
ccaggcucugucuggucagaag

SEQ ID NO: 221315 - RNA, 22 nt, Human
uggcacugccaaccugcuaggu

SEQ ID NO: 221316 - RNA, 22 nt, Human
gucuggaguaccauaaaaagga

SEQ ID NO: 221317 - RNA, 22 nt, Human
ucucagacauguaaucucuacc

SEQ ID NO: 221318 - RNA, 22 nt, Human
caaugugguggcagaugucagu

SEQ ID NO: 221319 - RNA, 22 nt, Human
aacugagggcccugcugaagca

SEQ ID NO: 221320 - RNA, 22 nt, Human
uaauuccaaguugagacaugca

SEQ ID NO: 221321 - RNA, 18 nt, Human
ggcugagguugacuagaa

SEQ ID NO: 221322 - RNA, 22 nt, Human
uucuucuuucccccugugguac

SEQ ID NO: 221323 - RNA, 22 nt, Human
gugccuggggguaauguaggau

SEQ ID NO: 221324 - RNA, 22 nt, Human
ccaggcucuguuccccgaggag

SEQ ID NO: 221325 - RNA, 22 nt, Human
uagcaagaggaaacaaggggcc

SEQ ID NO: 221326 - RNA, 22 nt, Human
uggcucagcgguggcagcagac

SEQ ID NO: 221327 - RNA, 22 nt, Human
ccucccugcuccucaacuggca

SEQ ID NO: 221328 - RNA, 22 nt, Human
gaucuuuucagaauuuaucagu

SEQ ID NO: 221329 - RNA, 22 nt, Human
gagagaagaaagccaugguccu

SEQ ID NO: 221330 - RNA, 22 nt, Human
ggcaggugcuugucgaaggccu

SEQ ID NO: 221331 - RNA, 22 nt, Human
gaggugucuagaucuaccagua

SEQ ID NO: 221332 - RNA, 21 nt, Human
ugaucauuuguguaaaggaga

SEQ ID NO: 221333 - RNA, 19 nt, Human
ccaggccucuggggccugu

SEQ ID NO: 221334 - RNA, 22 nt, Human
agucucaggcagaggaaggcua

SEQ ID NO: 221335 - RNA, 22 nt, Human
uucuucuucauuucugacgaug

SEQ ID NO: 221336 - RNA, 22 nt, Human
ugacccuuagugaacauuagaa

SEQ ID NO: 221337 - RNA, 22 nt, Human
caucacaucagugugaacaguu

SEQ ID NO: 221338 - RNA, 22 nt, Human
uauuuagaugcauuuggauugc

SEQ ID NO: 221339 - RNA, 22 nt, Human
uggcagagccuugccaaacucc

SEQ ID NO: 221340 - RNA, 22 nt, Human
ucaguguuuuuaaagcaauaua

SEQ ID NO: 221341 - RNA, 22 nt, Human
aacucagaauagggugcagggc

SEQ ID NO: 221342 - RNA, 22 nt, Human
aaggugcuguggacuugggagc

SEQ ID NO: 221343 - RNA, 19 nt, Human
agucacagaccuugucucc

SEQ ID NO: 221344 - RNA, 22 nt, Human
ugaggggcgcuggcagguuccu

SEQ ID NO: 221345 - RNA, 22 nt, Human
aacaggcacuaagcaugugggg

SEQ ID NO: 221346 - RNA, 22 nt, Human
agagauguagcaaagaaccaca

SEQ ID NO: 221347 - RNA, 21 nt, Human
aaaguguucagaccaguucug

SEQ ID NO: 221348 - RNA, 19 nt, Human
ucucugcagcgcgcccggc

SEQ ID NO: 221349 - RNA, 22 nt, Human
caagccaguuuguaguucucuc

SEQ ID NO: 221350 - RNA, 22 nt, Human
guguccugaucaauugagcugg

SEQ ID NO: 221351 - RNA, 22 nt, Human
ucugggaaugaauaagaccugu

SEQ ID NO: 221352 - RNA, 22 nt, Human
acaaucacacaugcaauuauac

SEQ ID NO: 221353 - RNA, 22 nt, Human
ugcuacuacuugucaacgguca

SEQ ID NO: 221354 - RNA, 22 nt, Human
ucccagaagugaaauuucuaga

SEQ ID NO: 221355 - RNA, 22 nt, Human
cuucugaggcagcuauucaguu

SEQ ID NO: 221356 - RNA, 22 nt, Human
uuuggugagcugcgagugagga

SEQ ID NO: 221357 - RNA, 22 nt, Human
cugccauguuaccugcacaggu

SEQ ID NO: 221358 - RNA, 18 nt, Human
aggccacacuccagaaca

SEQ ID NO: 221359 - RNA, 22 nt, Human
caugaauuauuuuucacaagau

SEQ ID NO: 221360 - RNA, 22 nt, Human
cugugggagggugagagaacca

SEQ ID NO: 221361 - RNA, 22 nt, Human
agccuaggucugggucuagcag

SEQ ID NO: 221362 - RNA, 22 nt, Human
cauuuauuaguuaguucgaugu

SEQ ID NO: 221363 - RNA, 23 nt, Human
acugagcauuaguauuuuuauaa

SEQ ID NO: 221364 - RNA, 22 nt, Human
aggcuguguucugguucuuagc

SEQ ID NO: 221365 - RNA, 22 nt, Human
augaggcauucacagaaggcac

SEQ ID NO: 221366 - RNA, 22 nt, Human
aggcugagugcuccccuagaug

SEQ ID NO: 221367 - RNA, 22 nt, Human
cagaggugcauacaggucauua

SEQ ID NO: 221368 - RNA, 22 nt, Human
ggaucaggcgccaugggaagug

SEQ ID NO: 221369 - RNA, 22 nt, Human
uugaaguuguaguucagugaag

SEQ ID NO: 221370 - RNA, 22 nt, Human
gugucuuuauuccucuauguuu

SEQ ID NO: 221371 - RNA, 22 nt, Human
ccuuccucauccauuucucuug

SEQ ID NO: 221372 - RNA, 22 nt, Human
cacuuucuguguugugcaaaaa

SEQ ID NO: 221373 - RNA, 17 nt, Human
ggaacaaauacuaugca

SEQ ID NO: 221374 - RNA, 22 nt, Human
caggcugggacugaccccugcu

SEQ ID NO: 221375 - RNA, 22 nt, Human
aucuuuaaagacaugugaacuu

SEQ ID NO: 221376 - RNA, 22 nt, Human
acaucccucagucagacuguaa

SEQ ID NO: 221377 - RNA, 22 nt, Human
ccagugcagucccccugaacug

SEQ ID NO: 221378 - RNA, 22 nt, Human
uugaggagucaggggcacggaa

SEQ ID NO: 221379 - RNA, 22 nt, Human
gagacucuugcuuuaauagccc

SEQ ID NO: 221380 - RNA, 22 nt, Human
cucaaauguuuccacuucugcu

SEQ ID NO: 221381 - RNA, 22 nt, Human
aaagguuuauuuaaucagggag

SEQ ID NO: 221382 - RNA, 22 nt, Human
ggcugcucugagaguggguuuu

SEQ ID NO: 221383 - RNA, 22 nt, Human
gacuccugccuccucuguuugc

SEQ ID NO: 221384 - RNA, 22 nt, Human
ucuucaaaaauacagguuuuca

SEQ ID NO: 221385 - RNA, 22 nt, Human
agaauccucuucaguaaauucu

SEQ ID NO: 221386 - RNA, 22 nt, Human
auauuaauuauuuacacaugag

SEQ ID NO: 221387 - RNA, 21 nt, Human
uacagaugaggagaccaaggc

SEQ ID NO: 221388 - RNA, 22 nt, Human
gcucuguaucuguggggcuucc

SEQ ID NO: 221389 - RNA, 22 nt, Human
gccuucccuggcuaggcaagca

SEQ ID NO: 221390 - RNA, 22 nt, Human
uucaggcauggaaacuggauua

SEQ ID NO: 221391 - RNA, 22 nt, Human
uaggagagcugaacuauugucu

SEQ ID NO: 221392 - RNA, 22 nt, Human
ugcucugggcucaauggcagcu

SEQ ID NO: 221393 - RNA, 23 nt, Human
aacugucuugcaagugugauacc

SEQ ID NO: 221394 - RNA, 20 nt, Human
cagcaacuuuggacugaguu

SEQ ID NO: 221395 - RNA, 22 nt, Human
agcaacuuuauuccacugggca

SEQ ID NO: 221396 - RNA, 22 nt, Human
agccucccuaugcaccuucagg

SEQ ID NO: 221397 - RNA, 22 nt, Human
gggagcugagcuggaagagaau

SEQ ID NO: 221398 - RNA, 22 nt, Human
ugccugacugcugccaccacua

SEQ ID NO: 221399 - RNA, 22 nt, Human
aggcucugugcagccugcaucu

SEQ ID NO: 221400 - RNA, 22 nt, Human
aaaagcaauugcaguucuugcc

SEQ ID NO: 221401 - RNA, 22 nt, Human
gaguccagugauguuccugguc

SEQ ID NO: 221402 - RNA, 22 nt, Human
cugacagguugguagcuuugga

SEQ ID NO: 221403 - RNA, 22 nt, Human
gaaaucaaacccuuuucugaua

SEQ ID NO: 221404 - RNA, 22 nt, Human
guggcaggagacuggaagaugg

SEQ ID NO: 221405 - RNA, 22 nt, Human
uggguggagaaguggaccugcu

SEQ ID NO: 221406 - RNA, 22 nt, Human
gcccagcaggggauggcagcuc

SEQ ID NO: 221407 - RNA, 22 nt, Human
uucuuucugggguccuucggcu

SEQ ID NO: 221408 - RNA, 22 nt, Human
aguccuggguccagcagguccu

SEQ ID NO: 221409 - RNA, 22 nt, Human
aggcacaggaacaggaaaagag

SEQ ID NO: 221410 - RNA, 22 nt, Human
ccagggaggguccuguggcuuc

SEQ ID NO: 221411 - RNA, 22 nt, Human
gaggagggagaauuaggcuuaa

SEQ ID NO: 221412 - RNA, 22 nt, Human
acaugugcagacagcaagcagg

SEQ ID NO: 221413 - RNA, 22 nt, Human
ucagaggagaugguuaccaggg

SEQ ID NO: 221414 - RNA, 22 nt, Human
ccuggaggggaccaggaccagg

SEQ ID NO: 221415 - RNA, 22 nt, Human
uuucuuguaagauguuuauuaa

SEQ ID NO: 221416 - RNA, 22 nt, Human
uuuguuagagugugggaggcug

SEQ ID NO: 221417 - RNA, 22 nt, Human
agaguggcccguuggccugaac

SEQ ID NO: 221418 - RNA, 22 nt, Human
gagggcagagucuaaugaugca

SEQ ID NO: 221419 - RNA, 22 nt, Human
uggccuugauaacuggggagag

SEQ ID NO: 221420 - RNA, 18 nt, Human
agggccagcugugaguag

SEQ ID NO: 221421 - RNA, 22 nt, Human
ccugagaggcccucucacuguc

SEQ ID NO: 221422 - RNA, 22 nt, Human
uggaagaaugcuccacagggaa

SEQ ID NO: 221423 - RNA, 22 nt, Human
cuggaggaaaacaacugcagac

SEQ ID NO: 221424 - RNA, 19 nt, Human
agaaguuagacauugcaau

SEQ ID NO: 221425 - RNA, 22 nt, Human
uuuuacagucagucaaacucag

SEQ ID NO: 221426 - RNA, 22 nt, Human
acagcauucccuuuggcugcuu

SEQ ID NO: 221427 - RNA, 22 nt, Human
uguuuaaucuucaggacagucu

SEQ ID NO: 221428 - RNA, 22 nt, Human
cuguacagauugcacacgggga

SEQ ID NO: 221429 - RNA, 17 nt, Human
gcacaaaucaauuacua

SEQ ID NO: 221430 - RNA, 22 nt, Human
uccuaggcaguuggugcuccau

SEQ ID NO: 221431 - RNA, 22 nt, Human
cucaggaggaggaaguucauug

SEQ ID NO: 221432 - RNA, 22 nt, Human
gcucaaaggccagguagcagca

SEQ ID NO: 221433 - RNA, 22 nt, Human
aaggcuggguuugggaugugau

SEQ ID NO: 221434 - RNA, 22 nt, Human
ugggugagccacaggaguuguc

SEQ ID NO: 221435 - RNA, 22 nt, Human
guggucagcagcagugggagug

SEQ ID NO: 221436 - RNA, 22 nt, Human
uuucuuguuucauggugucuca

SEQ ID NO: 221437 - RNA, 22 nt, Human
uggcugaggcacagcugccgcc

SEQ ID NO: 221438 - RNA, 22 nt, Human
guccccagaaaggugaggcagg

SEQ ID NO: 221439 - RNA, 22 nt, Human
aggacagcccuugagagcacau

SEQ ID NO: 221440 - RNA, 22 nt, Human
aguucuguggcugugcccugua

SEQ ID NO: 221441 - RNA, 22 nt, Human
aggggcagccucacaauccucu

SEQ ID NO: 221442 - RNA, 22 nt, Human
gcagagugaagcaguauggaaa

SEQ ID NO: 221443 - RNA, 22 nt, Human
uuguuuacuaagaaccugguca

SEQ ID NO: 221444 - RNA, 22 nt, Human
uguggcaggaagagcuucugag

SEQ ID NO: 221445 - RNA, 22 nt, Human
augccuuauuccaacaaucuag

SEQ ID NO: 221446 - RNA, 22 nt, Human
agugaaauggaugcugcuacug

SEQ ID NO: 221447 - RNA, 18 nt, Human
ugucucugaauuccagug

SEQ ID NO: 221448 - RNA, 22 nt, Human
aaugaccugggugucauuucau

SEQ ID NO: 221449 - RNA, 22 nt, Human
ugacccauuaaccacuuucccu

SEQ ID NO: 221450 - RNA, 22 nt, Human
ucaccgccuugcccggccgggc

SEQ ID NO: 221451 - RNA, 22 nt, Human
agaggcaaaaaucuauggcaac

SEQ ID NO: 221452 - RNA, 22 nt, Human
ggcaggugcgcauguugcauua

SEQ ID NO: 221453 - RNA, 22 nt, Human
ucagaggugcaagaaguucuga

SEQ ID NO: 221454 - RNA, 19 nt, Human
ggaagagaggaaaggugga

SEQ ID NO: 221455 - RNA, 22 nt, Human
acaucuuuuuucucuaauugug

SEQ ID NO: 221456 - RNA, 22 nt, Human
ggagccagagcacuggggagcc

SEQ ID NO: 221457 - RNA, 21 nt, Human
auggcucaggccaucaaugga

SEQ ID NO: 221458 - RNA, 22 nt, Human
uccaggcauaagccuugagugu

SEQ ID NO: 221459 - RNA, 22 nt, Human
caaguaacuugauuaagguaag

SEQ ID NO: 221460 - RNA, 22 nt, Human
agggccugugcugaguagacga

SEQ ID NO: 221461 - RNA, 22 nt, Human
uuuggacaaguuacugguuucc

SEQ ID NO: 221462 - RNA, 22 nt, Human
agaauuacauaaauacaugaau

SEQ ID NO: 221463 - RNA, 22 nt, Human
uacaacagacaggaauaagauu

SEQ ID NO: 221464 - RNA, 22 nt, Human
uccaggcucagucaagcacuuc

SEQ ID NO: 221465 - RNA, 19 nt, Human
auacacuaauauaaaccac

SEQ ID NO: 221466 - RNA, 22 nt, Human
ccugguuuguauuuuuaacacc

SEQ ID NO: 221467 - RNA, 22 nt, Human
uuguguggauaauauuacuuga

SEQ ID NO: 221468 - RNA, 22 nt, Human
uggcuccagcguccacguccug

SEQ ID NO: 221469 - RNA, 22 nt, Human
agucaguuaaacuuuguaaagu

SEQ ID NO: 221470 - RNA, 22 nt, Human
acagcagaggaaaagucugaua

SEQ ID NO: 221471 - RNA, 22 nt, Human
ugaagaaacgcagagagguagg

SEQ ID NO: 221472 - RNA, 22 nt, Human
cuggcacaguuaacauaugcua

SEQ ID NO: 221473 - RNA, 22 nt, Human
cacagggaggacaucaacagug

SEQ ID NO: 221474 - RNA, 22 nt, Human
uaggugucuaacaauaagugua

SEQ ID NO: 221475 - RNA, 22 nt, Human
aagggagaaagaaugaguuuag

SEQ ID NO: 221476 - RNA, 22 nt, Human
uucuguauuucaaugucuuuau

SEQ ID NO: 221477 - RNA, 22 nt, Human
ggcuucccaaggagccaggaug

SEQ ID NO: 221478 - RNA, 23 nt, Human
agcccagcagagaaccuaggucc

SEQ ID NO: 221479 - RNA, 20 nt, Human
ucccucaguccuggcuuugu

SEQ ID NO: 221480 - RNA, 22 nt, Human
uguauugaggauucauuuuugu

SEQ ID NO: 221481 - RNA, 22 nt, Human
uggacaugaccucgagcgagau

SEQ ID NO: 221482 - RNA, 21 nt, Human
uggcucugagccucauggcug

SEQ ID NO: 221483 - RNA, 22 nt, Human
agggcaugaagcaguggacagc

SEQ ID NO: 221484 - RNA, 21 nt, Human
ucaggcaggcgcagagggaag

SEQ ID NO: 221485 - RNA, 22 nt, Human
auuuccugaucuguaaaauagc

SEQ ID NO: 221486 - RNA, 22 nt, Human
auuucacaaagaacagaugcag

SEQ ID NO: 221487 - RNA, 22 nt, Human
ucucccuggagcccugaagcau

SEQ ID NO: 221488 - RNA, 22 nt, Human
auuacagaaagcaauauugagu

SEQ ID NO: 221489 - RNA, 18 nt, Human
ugaugcaagagugagcua

SEQ ID NO: 221490 - RNA, 22 nt, Human
acaguuuaugccucugagccug

SEQ ID NO: 221491 - RNA, 22 nt, Human
gaaggcuuaugugugacuuucg

SEQ ID NO: 221492 - RNA, 22 nt, Human
aggcaaauagauaguccauaca

SEQ ID NO: 221493 - RNA, 22 nt, Human
gagaaagcuucagaaauggccu

SEQ ID NO: 221494 - RNA, 22 nt, Human
gccuugccaaggggcagcagag

SEQ ID NO: 221495 - RNA, 22 nt, Human
caugaauuagcaauggugugca

SEQ ID NO: 221496 - RNA, 22 nt, Human
auuuccuaggguagaugucaca

SEQ ID NO: 221497 - RNA, 22 nt, Human
aacuaaaacugguuuguucucu

SEQ ID NO: 221498 - RNA, 20 nt, Human
uucucuagccuuccccuggg

SEQ ID NO: 221499 - RNA, 22 nt, Human
uguugacuugaaccaaaguguu

SEQ ID NO: 221500 - RNA, 22 nt, Human
gugcaaccucgucagagcaccu

SEQ ID NO: 221501 - RNA, 22 nt, Human
agaaagugccucccuugggagc

SEQ ID NO: 221502 - RNA, 22 nt, Human
ccauccugucuguggccucagg

SEQ ID NO: 221503 - RNA, 22 nt, Human
guacacagaugcuugagaaucu

SEQ ID NO: 221504 - RNA, 22 nt, Human
uaaagacaauaggaaaguuguu

SEQ ID NO: 221505 - RNA, 22 nt, Human
aaaaaugucauuauggaacuga

SEQ ID NO: 221506 - RNA, 22 nt, Human
acauguauacaauguguaauga

SEQ ID NO: 221507 - RNA, 22 nt, Human
caacuuuaauuugggugucaga

SEQ ID NO: 221508 - RNA, 22 nt, Human
uacugaaauacuaagaaguuaa

SEQ ID NO: 221509 - RNA, 22 nt, Human
gcugggcucuuaucaccuguac

SEQ ID NO: 221510 - RNA, 22 nt, Human
caaagagguuuugagggcagcu

SEQ ID NO: 221511 - RNA, 22 nt, Human
caggcacuggccagucagcaca

SEQ ID NO: 221512 - RNA, 20 nt, Human
gagcacaguaaugacugcua

SEQ ID NO: 221513 - RNA, 21 nt, Human
uggguggaagcgggaggccgc

SEQ ID NO: 221514 - RNA, 22 nt, Human
agaaagugaccuugaaaacugg

SEQ ID NO: 221515 - RNA, 22 nt, Human
gcauguaaucacucuaggaagg

SEQ ID NO: 221516 - RNA, 22 nt, Human
gccagccacaagggaggcuugu

SEQ ID NO: 221517 - RNA, 22 nt, Human
aucuuggacuacagaagagagg

SEQ ID NO: 221518 - RNA, 22 nt, Human
auauauuuugcggucacguggc

SEQ ID NO: 221519 - RNA, 22 nt, Human
cuggccugaggucggcuguagg

SEQ ID NO: 221520 - RNA, 22 nt, Human
ucuugaagucuuaugguuuaaa

SEQ ID NO: 221521 - RNA, 21 nt, Human
agcagcagggaagccucaucc

SEQ ID NO: 221522 - RNA, 22 nt, Human
guauaucagacacucauaugua

SEQ ID NO: 221523 - RNA, 22 nt, Human
gcuguguaucagaugccacggg

SEQ ID NO: 221524 - RNA, 22 nt, Human
cuguugucccugggagcucagc

SEQ ID NO: 221525 - RNA, 22 nt, Human
augcaggggcuguguuuugggu

SEQ ID NO: 221526 - RNA, 22 nt, Human
ccaugccuggacuccacucuca

SEQ ID NO: 221527 - RNA, 23 nt, Human
ccugacccugucucccucacaug

SEQ ID NO: 221528 - RNA, 22 nt, Human
gugccugguauguagguagcgg

SEQ ID NO: 221529 - RNA, 22 nt, Human
cuguaggcuuagcuagaaguga

SEQ ID NO: 221530 - RNA, 22 nt, Human
ucugaagagaaugcugcugaac

SEQ ID NO: 221531 - RNA, 22 nt, Human
guucucauaguggaaaauaggu

SEQ ID NO: 221532 - RNA, 22 nt, Human
gaugagguaagaauguaacacc

SEQ ID NO: 221533 - RNA, 20 nt, Human
ugacuucugggauuuguggu

SEQ ID NO: 221534 - RNA, 22 nt, Human
ggaaggcuugaguucccagguc

SEQ ID NO: 221535 - RNA, 22 nt, Human
auaaguuugucuuuguaaagau

SEQ ID NO: 221536 - RNA, 18 nt, Human
cugaggcuuagagagguu

SEQ ID NO: 221537 - RNA, 22 nt, Human
ucugugcaguucuugucuugac

SEQ ID NO: 221538 - RNA, 22 nt, Human
gucaggacucugacccgucccg

SEQ ID NO: 221539 - RNA, 22 nt, Human
uccuuaaauauuuacuguuaac

SEQ ID NO: 221540 - RNA, 22 nt, Human
gggcugacucaaccuugcaaag

SEQ ID NO: 221541 - RNA, 23 nt, Human
auuuuuagccucucugagcugag

SEQ ID NO: 221542 - RNA, 22 nt, Human
agcccagggaaccaggaagugg

SEQ ID NO: 221543 - RNA, 22 nt, Human
cauggaaugguugaaugacgaa

SEQ ID NO: 221544 - RNA, 22 nt, Human
gcagugacagacaacuguuuga

SEQ ID NO: 221545 - RNA, 22 nt, Human
aggcuuggagguucuguagcca

SEQ ID NO: 221546 - RNA, 22 nt, Human
aagagcauauuaauaguggaga

SEQ ID NO: 221547 - RNA, 22 nt, Human
aggcugccucugcaggaucccu

SEQ ID NO: 221548 - RNA, 22 nt, Human
uuuagagacacacuggcauuug

SEQ ID NO: 221549 - RNA, 22 nt, Human
cauuaagauuuuuuucuacugg

SEQ ID NO: 221550 - RNA, 22 nt, Human
ugagcagugaugcguuuuguuu

SEQ ID NO: 221551 - RNA, 22 nt, Human
aggccaguguggcuggagcaca

SEQ ID NO: 221552 - RNA, 22 nt, Human
ccuggaguuuuuugguugacuc

SEQ ID NO: 221553 - RNA, 22 nt, Human
uggaaagucucuuuugacugua

SEQ ID NO: 221554 - RNA, 22 nt, Human
acccugggucucaaucauccua

SEQ ID NO: 221555 - RNA, 22 nt, Human
ggagucugcucccagacaugau

SEQ ID NO: 221556 - RNA, 19 nt, Human
uuugggaagcccagagugu

SEQ ID NO: 221557 - RNA, 22 nt, Human
gcucacugccauucucuagaug

SEQ ID NO: 221558 - RNA, 22 nt, Human
gggugcagugguucacgccugu

SEQ ID NO: 221559 - RNA, 22 nt, Human
ugguagggacacuaugcagaaa

SEQ ID NO: 221560 - RNA, 22 nt, Human
uacugucuggcaauuaagaauc

SEQ ID NO: 221561 - RNA, 22 nt, Human
agaagcccagcauggaaccagc

SEQ ID NO: 221562 - RNA, 22 nt, Human
caaggccacguucugcaugcgg

SEQ ID NO: 221563 - RNA, 22 nt, Human
gcauggcaagaucaggagacca

SEQ ID NO: 221564 - RNA, 22 nt, Human
gaggccucaggaaugucgugug

SEQ ID NO: 221565 - RNA, 22 nt, Human
augaaggcuguguagauggaug

SEQ ID NO: 221566 - RNA, 22 nt, Human
gauuuucugagccuucaaauuu

SEQ ID NO: 221567 - RNA, 22 nt, Human
gaguggggaaagccaggacaga

SEQ ID NO: 221568 - RNA, 22 nt, Human
ucccagcagagccagcaagccg

SEQ ID NO: 221569 - RNA, 22 nt, Human
cugccugugucuauuccuuuuu

SEQ ID NO: 221570 - RNA, 22 nt, Human
cuggaagguucuuugugugccu

SEQ ID NO: 221571 - RNA, 22 nt, Human
guccuuggcauucugagucuug

SEQ ID NO: 221572 - RNA, 19 nt, Human
agauuuaccucauauaguu

SEQ ID NO: 221573 - RNA, 22 nt, Human
auggcuuugaaguucagcuuuu

SEQ ID NO: 221574 - RNA, 22 nt, Human
ugauuacacaccacagugcucc

SEQ ID NO: 221575 - RNA, 22 nt, Human
uuuaacauguaauugcugcuuu

SEQ ID NO: 221576 - RNA, 22 nt, Human
agcagguguauauaaggcugag

SEQ ID NO: 221577 - RNA, 22 nt, Human
caguagccuuauuuggaucauu

SEQ ID NO: 221578 - RNA, 22 nt, Human
aagggcauugaggcugagagac

SEQ ID NO: 221579 - RNA, 19 nt, Human
ugcuucagaaauagaaagc

SEQ ID NO: 221580 - RNA, 22 nt, Human
ugagugggaugaguuagaggug

SEQ ID NO: 221581 - RNA, 22 nt, Human
aagggcucuucuauuuauggcc

SEQ ID NO: 221582 - RNA, 22 nt, Human
gccacaggcuuaggagggaggu

SEQ ID NO: 221583 - RNA, 22 nt, Human
ggcuucauggaguucuacacca

SEQ ID NO: 221584 - RNA, 22 nt, Human
aggacacacccagcucacgggg

SEQ ID NO: 221585 - RNA, 22 nt, Human
ccuggcuuugaccuugcuguuu

SEQ ID NO: 221586 - RNA, 22 nt, Human
aaagagaaaaugaucuguacau

SEQ ID NO: 221587 - RNA, 22 nt, Human
cugggccucauccucagaguuu

SEQ ID NO: 221588 - RNA, 23 nt, Human
agcugagaauaaggagccguuug

SEQ ID NO: 221589 - RNA, 17 nt, Human
uggcaagaauggaaaug

SEQ ID NO: 221590 - RNA, 23 nt, Human
agguuaugauuauagagcgagga

SEQ ID NO: 221591 - RNA, 22 nt, Human
uuccauuuauucuuguccagau

SEQ ID NO: 221592 - RNA, 22 nt, Human
agcucaggcaacucugggcccc

SEQ ID NO: 221593 - RNA, 17 nt, Human
gaaaggaggcaacacug

SEQ ID NO: 221594 - RNA, 22 nt, Human
guuuuggagucaggcuuagaug

SEQ ID NO: 221595 - RNA, 22 nt, Human
guggccucugugcuccugccua

SEQ ID NO: 221596 - RNA, 22 nt, Human
aucagaaaaacauaauguuauu

SEQ ID NO: 221597 - RNA, 22 nt, Human
guaggcagugcuugauuuucca

SEQ ID NO: 221598 - RNA, 22 nt, Human
aauguacaaggguuccaguuuu

SEQ ID NO: 221599 - RNA, 22 nt, Human
gccagguucuggggagguacaa

SEQ ID NO: 221600 - RNA, 22 nt, Human
uggccagguugggcuuugcagc

SEQ ID NO: 221601 - RNA, 22 nt, Human
gaucauuuacuuguucuggacu

SEQ ID NO: 221602 - RNA, 23 nt, Human
uugaauuucucuugcaauauuua

SEQ ID NO: 221603 - RNA, 22 nt, Human
caaggcaggcaguucacuugag

SEQ ID NO: 221604 - RNA, 22 nt, Human
uacuauuuugacaugaaauuga

SEQ ID NO: 221605 - RNA, 22 nt, Human
ccuccuucuggggccuucugcu

SEQ ID NO: 221606 - RNA, 22 nt, Human
aggcucucacuauccuccuagc

SEQ ID NO: 221607 - RNA, 22 nt, Human
agaggacagguuuuccaugggc

SEQ ID NO: 221608 - RNA, 22 nt, Human
gguccucaaucccaacaaggca

SEQ ID NO: 221609 - RNA, 22 nt, Human
cccugaggcaaaggcuagaguu

SEQ ID NO: 221610 - RNA, 22 nt, Human
ugucuagacauuagcuucagcu

SEQ ID NO: 221611 - RNA, 22 nt, Human
ccuugaaaccacaucuuagaaa

SEQ ID NO: 221612 - RNA, 22 nt, Human
aggucacacaacugucagaggc

SEQ ID NO: 221613 - RNA, 22 nt, Human
ggccugugucugugccuguccu

SEQ ID NO: 221614 - RNA, 19 nt, Human
uccugcagguggcuugcag

SEQ ID NO: 221615 - RNA, 22 nt, Human
aacauuuguuuggcuucaauua

SEQ ID NO: 221616 - RNA, 22 nt, Human
ucuucagauaaagggagaguau

SEQ ID NO: 221617 - RNA, 22 nt, Human
ucagagagccucaggcacugcc

SEQ ID NO: 221618 - RNA, 22 nt, Human
gcugaggauugaagaguugcca

SEQ ID NO: 221619 - RNA, 22 nt, Human
cagcuauucucugaaaugaaua

SEQ ID NO: 221620 - RNA, 22 nt, Human
ugcaugugucgggccugugcua

SEQ ID NO: 221621 - RNA, 20 nt, Human
gcaggcagggaaugggggug

SEQ ID NO: 221622 - RNA, 22 nt, Human
ggcucugguugaccaugauggc

SEQ ID NO: 221623 - RNA, 22 nt, Human
auagacaaucccccauccuacc

SEQ ID NO: 221624 - RNA, 21 nt, Human
agauuugucccuucccauuua

SEQ ID NO: 221625 - RNA, 22 nt, Human
aaaugcuuuggugcugguacag

SEQ ID NO: 221626 - RNA, 22 nt, Human
gagggggcucugccaaccuguc

SEQ ID NO: 221627 - RNA, 20 nt, Human
uccagcccagguccugccug

SEQ ID NO: 221628 - RNA, 21 nt, Human
ccagcugucuguccuuaggca

SEQ ID NO: 221629 - RNA, 22 nt, Human
cugggcucccucaugugucugc

SEQ ID NO: 221630 - RNA, 22 nt, Human
uugagcaauuaggaaauaaaga

SEQ ID NO: 221631 - RNA, 17 nt, Human
gacagcugguuccuggc

SEQ ID NO: 221632 - RNA, 22 nt, Human
uauggaaacuaauucauuuuuc

SEQ ID NO: 221633 - RNA, 22 nt, Human
gcaagacaauggagcauaaacg

SEQ ID NO: 221634 - RNA, 22 nt, Human
cagcagccuggccccuccucgg

SEQ ID NO: 221635 - RNA, 22 nt, Human
uuuucuagggugcuaaaugaac

SEQ ID NO: 221636 - RNA, 22 nt, Human
agugcccuucaugaagcaagag

SEQ ID NO: 221637 - RNA, 22 nt, Human
uugugcaugacugugaauagcu

SEQ ID NO: 221638 - RNA, 22 nt, Human
auacagauguugaauguuauau

SEQ ID NO: 221639 - RNA, 22 nt, Human
aaaugcaaggccaugugaagga

SEQ ID NO: 221640 - RNA, 21 nt, Human
auucuagacaacacugaaauc

SEQ ID NO: 221641 - RNA, 22 nt, Human
caaugaaaaugaggacuccugu

SEQ ID NO: 221642 - RNA, 22 nt, Human
aggcacaguggcccuguuuggg

SEQ ID NO: 221643 - RNA, 22 nt, Human
uuugaaacucugaacauguuuc

SEQ ID NO: 221644 - RNA, 22 nt, Human
ccuuccagguuuuggcuccauu

SEQ ID NO: 221645 - RNA, 22 nt, Human
gagcaggaaggccagaaggguc

SEQ ID NO: 221646 - RNA, 22 nt, Human
ugucagugucuaugaagaauuu

SEQ ID NO: 221647 - RNA, 22 nt, Human
acugaggacagugaggagggcu

SEQ ID NO: 221648 - RNA, 22 nt, Human
uuuaagcaaguugacauagcau

SEQ ID NO: 221649 - RNA, 22 nt, Human
ugaauacaggaaaauauacuga

SEQ ID NO: 221650 - RNA, 22 nt, Human
gacuuuauuacuaacccuguga

SEQ ID NO: 221651 - RNA, 22 nt, Human
aaguuccucuucucugcaggga

SEQ ID NO: 221652 - RNA, 22 nt, Human
uucaugaaagacagcaacugug

SEQ ID NO: 221653 - RNA, 22 nt, Human
ugaaagcaugcuugccaagcuu

SEQ ID NO: 221654 - RNA, 22 nt, Human
uaaagacacccagggagggacu

SEQ ID NO: 221655 - RNA, 22 nt, Human
caucuuuaguagguucuggaga

SEQ ID NO: 221656 - RNA, 22 nt, Human
gagccaaggguugccauggaga

SEQ ID NO: 221657 - RNA, 22 nt, Human
aaaugcuacauacacaucaggg

SEQ ID NO: 221658 - RNA, 22 nt, Human
acaggcucuggggcaggauggc

SEQ ID NO: 221659 - RNA, 22 nt, Human
ggagauggcuggcagguagaug

SEQ ID NO: 221660 - RNA, 22 nt, Human
aggcaggagugacccugacagg

SEQ ID NO: 221661 - RNA, 20 nt, Human
auacaguaggugcucaauau

SEQ ID NO: 221662 - RNA, 22 nt, Human
ucuuuggaguguuaucaguaau

SEQ ID NO: 221663 - RNA, 20 nt, Human
aggcuggcacuccuggccag

SEQ ID NO: 221664 - RNA, 22 nt, Human
ugcagagucacccagauaauua

SEQ ID NO: 221665 - RNA, 22 nt, Human
uucaacuagaggugauuuugcc

SEQ ID NO: 221666 - RNA, 22 nt, Human
agagaccugaagagcuuccuca

SEQ ID NO: 221667 - RNA, 22 nt, Human
gcacugaaauuauaugcauuug

SEQ ID NO: 221668 - RNA, 22 nt, Human
ugaugaggagacuguggcuugg

SEQ ID NO: 221669 - RNA, 22 nt, Human
aaaggcuuguacagcagccuuc

SEQ ID NO: 221670 - RNA, 22 nt, Human
uccucggcugggccccaggcuu

SEQ ID NO: 221671 - RNA, 23 nt, Human
ugaaguucauucucacugaugua

SEQ ID NO: 221672 - RNA, 22 nt, Human
accaaggaagaaucuauuugag

SEQ ID NO: 221673 - RNA, 22 nt, Human
ugggaagguuagcaguuuguca

SEQ ID NO: 221674 - RNA, 22 nt, Human
augucauuuaaauguuuguaua

SEQ ID NO: 221675 - RNA, 22 nt, Human
ugcccaggcuggagugcagagg

SEQ ID NO: 221676 - RNA, 22 nt, Human
ucuuucugaugggaagggucaa

SEQ ID NO: 221677 - RNA, 22 nt, Human
uaguaaauuaaaauauugacuu

SEQ ID NO: 221678 - RNA, 22 nt, Human
acugucaugaucgaagauguca

SEQ ID NO: 221679 - RNA, 22 nt, Human
caggcauaucuacauuauccaa

SEQ ID NO: 221680 - RNA, 22 nt, Human
cagcaagacuucagggcuuggu

SEQ ID NO: 221681 - RNA, 22 nt, Human
gggggcaguaaggauauggaaa

SEQ ID NO: 221682 - RNA, 22 nt, Human
uggcaggguacaccuuaacacc

SEQ ID NO: 221683 - RNA, 23 nt, Human
cccaggaguuucacugcaaaggu

SEQ ID NO: 221684 - RNA, 17 nt, Human
agguuuaugguauuuga

SEQ ID NO: 221685 - RNA, 22 nt, Human
aagcagcacagcaaugacucua

SEQ ID NO: 221686 - RNA, 22 nt, Human
auuauccagcaccaaugucaga

SEQ ID NO: 221687 - RNA, 22 nt, Human
ugcuuauuaacauguauaucuc

SEQ ID NO: 221688 - RNA, 22 nt, Human
aggcuggagugcuggagugcug

SEQ ID NO: 221689 - RNA, 22 nt, Human
gcugcuaagcguuucuguucca

SEQ ID NO: 221690 - RNA, 22 nt, Human
ucugaaaugcaaauuugacuga

SEQ ID NO: 221691 - RNA, 22 nt, Human
gacauucuaaaaaauauggaag

SEQ ID NO: 221692 - RNA, 22 nt, Human
gagcagugccaaagaauuugcg

SEQ ID NO: 221693 - RNA, 22 nt, Human
aggcaggcacacuuccuccagg

SEQ ID NO: 221694 - RNA, 22 nt, Human
gggcaggggucaguggccccaa

SEQ ID NO: 221695 - RNA, 22 nt, Human
gaauacauccagagcagggcug

SEQ ID NO: 221696 - RNA, 22 nt, Human
uuuauuguuguuagucauaagu

SEQ ID NO: 221697 - RNA, 22 nt, Human
gcagagcauguccucaggacag

SEQ ID NO: 221698 - RNA, 22 nt, Human
gcuguucuguccccauggguaa

SEQ ID NO: 221699 - RNA, 22 nt, Human
uuucagaauagcaaagcaagcu

SEQ ID NO: 221700 - RNA, 22 nt, Human
agcaagaugaaggauucaagac

SEQ ID NO: 221701 - RNA, 22 nt, Human
uggcccgccggaagaagauguc

SEQ ID NO: 221702 - RNA, 22 nt, Human
agcaguggugugaggagggcuc

SEQ ID NO: 221703 - RNA, 22 nt, Human
uucugcugguaacuauguuuca

SEQ ID NO: 221704 - RNA, 22 nt, Human
caucuuuucagaagccauucug

SEQ ID NO: 221705 - RNA, 22 nt, Human
uagaucauggaguaaaauggaa

SEQ ID NO: 221706 - RNA, 22 nt, Human
uucucuagguuuuagaugaaga

SEQ ID NO: 221707 - RNA, 20 nt, Human
caggagggacauuucagcau

SEQ ID NO: 221708 - RNA, 22 nt, Human
aucagaagcuuguagucucucu

SEQ ID NO: 221709 - RNA, 22 nt, Human
ggcuccuucaaagcaccuggcu

SEQ ID NO: 221710 - RNA, 22 nt, Human
ggcaggugcucugugggccugg

SEQ ID NO: 221711 - RNA, 22 nt, Human
accacaggaauugcucuguggu

SEQ ID NO: 221712 - RNA, 22 nt, Human
cuggggugucucgucugccauu

SEQ ID NO: 221713 - RNA, 17 nt, Human
ugcucaaauacuuuuga

SEQ ID NO: 221714 - RNA, 22 nt, Human
aaggucugugaggcuguuuguc

SEQ ID NO: 221715 - RNA, 22 nt, Human
cucccagguuccgacgccucuu

SEQ ID NO: 221716 - RNA, 22 nt, Human
cucaaauagaacugaucuauaa

SEQ ID NO: 221717 - RNA, 22 nt, Human
uuccaggaacagaugaagguug

SEQ ID NO: 221718 - RNA, 22 nt, Human
gugccagagaugacaggccugc

SEQ ID NO: 221719 - RNA, 22 nt, Human
ugcauuaagaauuucugaggau

SEQ ID NO: 221720 - RNA, 22 nt, Human
ugguuccaguuuucaauagagc

SEQ ID NO: 221721 - RNA, 18 nt, Human
agaaggagcuaugggcag

SEQ ID NO: 221722 - RNA, 22 nt, Human
aagcaauagcaacaacuuuaca

SEQ ID NO: 221723 - RNA, 22 nt, Human
gagcuuuaagggauaaaaugau

SEQ ID NO: 221724 - RNA, 22 nt, Human
uugauauucugagaagcugaag

SEQ ID NO: 221725 - RNA, 22 nt, Human
agggcuccaaggaaguguagcu

SEQ ID NO: 221726 - RNA, 22 nt, Human
cagggcuccaugcagggacucc

SEQ ID NO: 221727 - RNA, 22 nt, Human
auguuuuauguuccacucaagg

SEQ ID NO: 221728 - RNA, 23 nt, Human
gggcagguuuuuauaggcuucag

SEQ ID NO: 221729 - RNA, 22 nt, Human
uucagcaacucaaaccuauuag

SEQ ID NO: 221730 - RNA, 22 nt, Human
aaggugguaauagugcaggauu

SEQ ID NO: 221731 - RNA, 22 nt, Human
ugcagagaaaacuccuggguac

SEQ ID NO: 221732 - RNA, 22 nt, Human
agcaggugucacuuucacucca

SEQ ID NO: 221733 - RNA, 22 nt, Human
cagagagggcggcccuggcuuc

SEQ ID NO: 221734 - RNA, 22 nt, Human
ggcaaacacaccucggugagaa

SEQ ID NO: 221735 - RNA, 22 nt, Human
uguugcuguaugaauaggaagg

SEQ ID NO: 221736 - RNA, 18 nt, Human
uuggcuucuuuccuuccu

SEQ ID NO: 221737 - RNA, 23 nt, Human
gccuggguuguaacuagugcauc

SEQ ID NO: 221738 - RNA, 22 nt, Human
ccaggagcuggagggugcagug

SEQ ID NO: 221739 - RNA, 22 nt, Human
uuacagaucaucaagguauaau

SEQ ID NO: 221740 - RNA, 22 nt, Human
acucuggccaggugcgguaugu

SEQ ID NO: 221741 - RNA, 22 nt, Human
gaggcccaaggacucugucccg

SEQ ID NO: 221742 - RNA, 22 nt, Human
caaugcaagcaagauggucaca

SEQ ID NO: 221743 - RNA, 22 nt, Human
cauggggagacaccuagggaaa

SEQ ID NO: 221744 - RNA, 22 nt, Human
acagaugagaagcugcauucaa

SEQ ID NO: 221745 - RNA, 22 nt, Human
auguggauuguaggaaacugau

SEQ ID NO: 221746 - RNA, 22 nt, Human
acauuugacauuuaguaucagc

SEQ ID NO: 221747 - RNA, 22 nt, Human
ucacuaaguuacauuuaguauu

SEQ ID NO: 221748 - RNA, 22 nt, Human
ccaaggagcucauauucuuguu

SEQ ID NO: 221749 - RNA, 18 nt, Human
gacaggugggugagacca

SEQ ID NO: 221750 - RNA, 20 nt, Human
uuuuaugucaccuuccuguc

SEQ ID NO: 221751 - RNA, 22 nt, Human
aacacugagaggggaguggcac

SEQ ID NO: 221752 - RNA, 22 nt, Human
acccucagaguaggcacugcug

SEQ ID NO: 221753 - RNA, 19 nt, Human
ucaaaggcuuuuaggagac

SEQ ID NO: 221754 - RNA, 22 nt, Human
ggguccugcgugggcccaggac

SEQ ID NO: 221755 - RNA, 22 nt, Human
aguacacacaguagaauagagu

SEQ ID NO: 221756 - RNA, 22 nt, Human
gccucugcaauuacauugugcc

SEQ ID NO: 221757 - RNA, 20 nt, Human
ugcagggcucugcuucucuc

SEQ ID NO: 221758 - RNA, 18 nt, Human
gugcaaugaauagcagag

SEQ ID NO: 221759 - RNA, 23 nt, Human
ccuggaguacuaaggggauggaa

SEQ ID NO: 221760 - RNA, 22 nt, Human
augaggcuaugaauggggagau

SEQ ID NO: 221761 - RNA, 22 nt, Human
cuuagaauaaaagggggcuaua

SEQ ID NO: 221762 - RNA, 22 nt, Human
auacaugacagcauagcauccu

SEQ ID NO: 221763 - RNA, 22 nt, Human
ucccucagaaauucucucugaa

SEQ ID NO: 221764 - RNA, 22 nt, Human
gcuucucggggagguuagccag

SEQ ID NO: 221765 - RNA, 22 nt, Human
guucugggucuggacacacaga

SEQ ID NO: 221766 - RNA, 22 nt, Human
gucuggcucccacucuuacaaa

SEQ ID NO: 221767 - RNA, 22 nt, Human
uuuccagggcucuguagaagaa

SEQ ID NO: 221768 - RNA, 22 nt, Human
cagacaggaaguucagaagaaa

SEQ ID NO: 221769 - RNA, 20 nt, Human
augugucuguaaacaacucu

SEQ ID NO: 221770 - RNA, 22 nt, Human
aaccauuugccauuaucuuaag

SEQ ID NO: 221771 - RNA, 22 nt, Human
cuguuuaucauguacauuucca

SEQ ID NO: 221772 - RNA, 22 nt, Human
ggggaggaguguacagguuuau

SEQ ID NO: 221773 - RNA, 22 nt, Human
cacugggagucguaagacacgg

SEQ ID NO: 221774 - RNA, 22 nt, Human
agcuccagccucuucuggaggu

SEQ ID NO: 221775 - RNA, 22 nt, Human
cucagauguagaaagauuguga

SEQ ID NO: 221776 - RNA, 22 nt, Human
cccagcagccagaaugaggagc

SEQ ID NO: 221777 - RNA, 22 nt, Human
aggacacacaaagagugagaac

SEQ ID NO: 221778 - RNA, 22 nt, Human
uagcaaaguuuuguggugauua

SEQ ID NO: 221779 - RNA, 22 nt, Human
uuuuauauugagugagaguucc

SEQ ID NO: 221780 - RNA, 22 nt, Human
ucuacuuuauaaguauauaagu

SEQ ID NO: 221781 - RNA, 22 nt, Human
augaggagaccaaggccugaug

SEQ ID NO: 221782 - RNA, 22 nt, Human
cugggcucuguguuucaguuuc

SEQ ID NO: 221783 - RNA, 22 nt, Human
ggaaggagggcggcaaugauga

SEQ ID NO: 221784 - RNA, 22 nt, Human
auccaugaagguacuucucagg

SEQ ID NO: 221785 - RNA, 22 nt, Human
gggagacccccaaugccagguc

SEQ ID NO: 221786 - RNA, 22 nt, Human
cccacucccugcacgccugccg

SEQ ID NO: 221787 - RNA, 20 nt, Human
cucugggcugcguugcaaac

SEQ ID NO: 221788 - RNA, 19 nt, Human
aggugcaggucacagggga

SEQ ID NO: 221789 - RNA, 22 nt, Human
uggaggcaguuuaagucugaga

SEQ ID NO: 221790 - RNA, 22 nt, Human
aaauacuggcaagugcuaauuc

SEQ ID NO: 221791 - RNA, 22 nt, Human
aucaggaugacaacugcugggu

SEQ ID NO: 221792 - RNA, 22 nt, Human
uccuuggaacauugauccaaac

SEQ ID NO: 221793 - RNA, 20 nt, Human
cacaggcuauaugagagcca

SEQ ID NO: 221794 - RNA, 18 nt, Human
cagagugggccaagagac

SEQ ID NO: 221795 - RNA, 22 nt, Human
caggccugugacaccgugucug

SEQ ID NO: 221796 - RNA, 22 nt, Human
ucaaaagaaacaccauguuccu

SEQ ID NO: 221797 - RNA, 22 nt, Human
auacaaauuuauagaugcauuu

SEQ ID NO: 221798 - RNA, 22 nt, Human
uggagcucuggaaguucuaagc

SEQ ID NO: 221799 - RNA, 22 nt, Human
gggagggguugcauguuugagu

SEQ ID NO: 221800 - RNA, 22 nt, Human
ugaggcucuuccuccccugcuc

SEQ ID NO: 221801 - RNA, 22 nt, Human
gaauguuuuucauuggugacuc

SEQ ID NO: 221802 - RNA, 22 nt, Human
ucccugggguuccuccagccac

SEQ ID NO: 221803 - RNA, 22 nt, Human
guauaucuucagaaauuauagg

SEQ ID NO: 221804 - RNA, 22 nt, Human
ccaggccagagugcaguggcac

SEQ ID NO: 221805 - RNA, 22 nt, Human
cugagggccuuggcuccugccc

SEQ ID NO: 221806 - RNA, 22 nt, Human
ugagaugcaggagaugggacug

SEQ ID NO: 221807 - RNA, 22 nt, Human
cccugccaggguccugacagac

SEQ ID NO: 221808 - RNA, 22 nt, Human
gauccacagcugcgguaggaga

SEQ ID NO: 221809 - RNA, 22 nt, Human
aucaggauucaccccagagcug

SEQ ID NO: 221810 - RNA, 18 nt, Human
aggggcagcuugugugga

SEQ ID NO: 221811 - RNA, 22 nt, Human
agucugcuuccuggagaacuca

SEQ ID NO: 221812 - RNA, 22 nt, Human
uaguccagaaacugagcuuaua

SEQ ID NO: 221813 - RNA, 22 nt, Human
ucagaaggaagaagucauggga

SEQ ID NO: 221814 - RNA, 21 nt, Human
aagcaggcuguaaucaugugg

SEQ ID NO: 221815 - RNA, 22 nt, Human
ucuccucccaggcucuuccagg

SEQ ID NO: 221816 - RNA, 22 nt, Human
ucaguaaauaacucagaugcuc

SEQ ID NO: 221817 - RNA, 22 nt, Human
aaagaaggaccuggaggaggau

SEQ ID NO: 221818 - RNA, 22 nt, Human
uguauacaggauuacucauagc

SEQ ID NO: 221819 - RNA, 22 nt, Human
uagagguguugacgccaaggua

SEQ ID NO: 221820 - RNA, 22 nt, Human
gccaggcuaagaaaggugugau

SEQ ID NO: 221821 - RNA, 22 nt, Human
gccagagccggcuucacaggau

SEQ ID NO: 221822 - RNA, 22 nt, Human
ucaggcugcaucuguaagggug

SEQ ID NO: 221823 - RNA, 22 nt, Human
acuguaaagagguguaucuuua

SEQ ID NO: 221824 - RNA, 22 nt, Human
aagucucuggcaaaugaucuug

SEQ ID NO: 221825 - RNA, 22 nt, Human
ucagggcaagucucagaagguu

SEQ ID NO: 221826 - RNA, 22 nt, Human
ggaccugcccuggcucagaugc

SEQ ID NO: 221827 - RNA, 22 nt, Human
cugugcaguggcagcguguggg

SEQ ID NO: 221828 - RNA, 22 nt, Human
uggaagggaaaguuuggggucc

SEQ ID NO: 221829 - RNA, 22 nt, Human
uggcaauuggcaauuucguaug

SEQ ID NO: 221830 - RNA, 22 nt, Human
gcucccagcaauugaggcagcc

SEQ ID NO: 221831 - RNA, 22 nt, Human
ugguaacuuucagcauggugac

SEQ ID NO: 221832 - RNA, 22 nt, Human
ccugccagugaagcugacgggc

SEQ ID NO: 221833 - RNA, 18 nt, Human
guucccagauggugcuga

SEQ ID NO: 221834 - RNA, 22 nt, Human
agucugucuaauauuauucagg

SEQ ID NO: 221835 - RNA, 22 nt, Human
auaugcuuccccuucuuuuugg

SEQ ID NO: 221836 - RNA, 22 nt, Human
cauuuuauccucugggaagcua

SEQ ID NO: 221837 - RNA, 22 nt, Human
ggcauauguagcguguguucug

SEQ ID NO: 221838 - RNA, 22 nt, Human
agcagcauuuaaggauccaagu

SEQ ID NO: 221839 - RNA, 21 nt, Human
gguguccugagggauagguag

SEQ ID NO: 221840 - RNA, 22 nt, Human
uauucauggggguccagguacc

SEQ ID NO: 221841 - RNA, 20 nt, Human
ggcaggaccccaguggcauc

SEQ ID NO: 221842 - RNA, 22 nt, Human
ugcagguggcagcggggcacca

SEQ ID NO: 221843 - RNA, 19 nt, Human
uuuggcucuggucagagag

SEQ ID NO: 221844 - RNA, 22 nt, Human
cacaggcuccggccuugcagcc

SEQ ID NO: 221845 - RNA, 22 nt, Human
acagagagcugugauugaguua

SEQ ID NO: 221846 - RNA, 22 nt, Human
gguaauaagaucuguuacaugg

SEQ ID NO: 221847 - RNA, 20 nt, Human
aggguggggacguucugacu

SEQ ID NO: 221848 - RNA, 21 nt, Human
ugcauaaagaaauacaaauac

SEQ ID NO: 221849 - RNA, 22 nt, Human
cacuguucuuuuuguaguccaa

SEQ ID NO: 221850 - RNA, 22 nt, Human
aaacuagagauggcagguggaa

SEQ ID NO: 221851 - RNA, 22 nt, Human
ugcagagaguuagggcccguau

SEQ ID NO: 221852 - RNA, 22 nt, Human
gggcaggagagggccaccugga

SEQ ID NO: 221853 - RNA, 22 nt, Human
ccugaggaccagcacccaucug

SEQ ID NO: 221854 - RNA, 22 nt, Human
gacaacaggcagacgucagaaa

SEQ ID NO: 221855 - RNA, 22 nt, Human
aggcagcuuucuggugcaccau

SEQ ID NO: 221856 - RNA, 22 nt, Human
agguccucugugccugcuggcg

SEQ ID NO: 221857 - RNA, 22 nt, Human
ggagggugcauuuuacccugug

SEQ ID NO: 221858 - RNA, 22 nt, Human
ugagaacaguuggaagcaguca

SEQ ID NO: 221859 - RNA, 22 nt, Human
augccaggccccacgcugggca

SEQ ID NO: 221860 - RNA, 20 nt, Human
ggguccaggacucugaauuu

SEQ ID NO: 221861 - RNA, 22 nt, Human
acugggccuugccauggcagcc

SEQ ID NO: 221862 - RNA, 22 nt, Human
gugcccugaugcaauugucuca

SEQ ID NO: 221863 - RNA, 22 nt, Human
ucagggcugcauacaggagaua

SEQ ID NO: 221864 - RNA, 22 nt, Human
ccacaucugguggccagugcua

SEQ ID NO: 221865 - RNA, 22 nt, Human
agcaacaguguauaucauaggc

SEQ ID NO: 221866 - RNA, 22 nt, Human
ucaucugaagauugcuguucaa

SEQ ID NO: 221867 - RNA, 21 nt, Human
gcuggcuuccugagggcugag

SEQ ID NO: 221868 - RNA, 22 nt, Human
uagaucuuguuacagauuuccu

SEQ ID NO: 221869 - RNA, 22 nt, Human
acccugggaacuggaaacugga

SEQ ID NO: 221870 - RNA, 22 nt, Human
uggaggcaguaacugagcaaca

SEQ ID NO: 221871 - RNA, 22 nt, Human
ccacagagcauuagauuucaga

SEQ ID NO: 221872 - RNA, 22 nt, Human
ugagcacauuucacaugacagg

SEQ ID NO: 221873 - RNA, 22 nt, Human
acuuuauuuccuauugcaucca

SEQ ID NO: 221874 - RNA, 22 nt, Human
cugugcaguccagcccuggaca

SEQ ID NO: 221875 - RNA, 23 nt, Human
cagucugcagcccacuugggcag

SEQ ID NO: 221876 - RNA, 22 nt, Human
ucugccugagggagcugaggaa

SEQ ID NO: 221877 - RNA, 22 nt, Human
ccagaauagaaugaaagaaggg

SEQ ID NO: 221878 - RNA, 22 nt, Human
uuccugaaugcuguugugcugu

SEQ ID NO: 221879 - RNA, 22 nt, Human
uggucaggauucucagcccuuc

SEQ ID NO: 221880 - RNA, 22 nt, Human
cacaugagugagaacaugcagu

SEQ ID NO: 221881 - RNA, 22 nt, Human
aaauaauuauagcgagucuauc

SEQ ID NO: 221882 - RNA, 22 nt, Human
gcuuuuggaccucugauguuuc

SEQ ID NO: 221883 - RNA, 22 nt, Human
guggggaguguucugugauugg

SEQ ID NO: 221884 - RNA, 22 nt, Human
uggcaggaaaaagggccagagg

SEQ ID NO: 221885 - RNA, 22 nt, Human
uggccuggcccugaggcccugu

SEQ ID NO: 221886 - RNA, 22 nt, Human
uuagaaguacauuuagaacaua

SEQ ID NO: 221887 - RNA, 20 nt, Human
uggaaguucuguugcauugg

SEQ ID NO: 221888 - RNA, 22 nt, Human
aggggaaggccagccuguagag

SEQ ID NO: 221889 - RNA, 22 nt, Human
uuuacuucauuuccagugagga

SEQ ID NO: 221890 - RNA, 22 nt, Human
aacagcagcaaguaagcagguc

SEQ ID NO: 221891 - RNA, 22 nt, Human
uggguccuugcuggcuucaaag

SEQ ID NO: 221892 - RNA, 22 nt, Human
gaggagcugagccacguccugg

SEQ ID NO: 221893 - RNA, 20 nt, Human
cuccugggacugcugguuau

SEQ ID NO: 221894 - RNA, 22 nt, Human
acauguuuggcucuaugcuaua

SEQ ID NO: 221895 - RNA, 22 nt, Human
cagagcagaaaccugggugauu

SEQ ID NO: 221896 - RNA, 22 nt, Human
agcucaggcucugcagggacua

SEQ ID NO: 221897 - RNA, 22 nt, Human
uacagcuuuagcaaauuaccua

SEQ ID NO: 221898 - RNA, 22 nt, Human
cucuggguggucucacugagug

SEQ ID NO: 221899 - RNA, 22 nt, Human
uguucauucgcuauugucuaug

SEQ ID NO: 221900 - RNA, 21 nt, Human
gauuugcagaaacuagacagg

SEQ ID NO: 221901 - RNA, 21 nt, Human
acagcugucuuagcuugggcu

SEQ ID NO: 221902 - RNA, 22 nt, Human
auaacuuauuagauuggagcug

SEQ ID NO: 221903 - RNA, 22 nt, Human
cacaggaagcugacugcuggca

SEQ ID NO: 221904 - RNA, 21 nt, Human
uuacuucugcuuguuauuguc

SEQ ID NO: 221905 - RNA, 22 nt, Human
uccuggaguugugcagugcaca

SEQ ID NO: 221906 - RNA, 22 nt, Human
gacagccaucagcacacgcugc

SEQ ID NO: 221907 - RNA, 22 nt, Human
uggcuucucugugugagggaga

SEQ ID NO: 221908 - RNA, 19 nt, Human
uuucccagucccaggagug

SEQ ID NO: 221909 - RNA, 22 nt, Human
cucugggugggcagcagaugga

SEQ ID NO: 221910 - RNA, 22 nt, Human
cccuggcucugccucagagccc

SEQ ID NO: 221911 - RNA, 22 nt, Human
ugcgcccagccaagucuggcac

SEQ ID NO: 221912 - RNA, 22 nt, Human
uagagcuugauuggauucaggg

SEQ ID NO: 221913 - RNA, 22 nt, Human
caacauucuuaucacuauaagc

SEQ ID NO: 221914 - RNA, 22 nt, Human
aucacgugguuugagaguacgc

SEQ ID NO: 221915 - RNA, 21 nt, Human
ggccuuccccugcagucuccg

SEQ ID NO: 221916 - RNA, 22 nt, Human
ggggacaguuaaagaccaagac

SEQ ID NO: 221917 - RNA, 22 nt, Human
aaaguuuggauccagcaaaaga

SEQ ID NO: 221918 - RNA, 22 nt, Human
cagggacccgcacagguagcau

SEQ ID NO: 221919 - RNA, 22 nt, Human
agccauuuugguaaugauaaca

SEQ ID NO: 221920 - RNA, 22 nt, Human
uuuuacaggugugagccaccau

SEQ ID NO: 221921 - RNA, 22 nt, Human
ugaggauggcagugugcucagc

SEQ ID NO: 221922 - RNA, 22 nt, Human
gcuggcugaggucuagcucuuu

SEQ ID NO: 221923 - RNA, 22 nt, Human
ugagggagcacacacugaagug

SEQ ID NO: 221924 - RNA, 22 nt, Human
agagggaacggaucccagcgcg

SEQ ID NO: 221925 - RNA, 22 nt, Human
gggcccuggacguggcggcaga

SEQ ID NO: 221926 - RNA, 22 nt, Human
acugaaggcuuaacucuuucau

SEQ ID NO: 221927 - RNA, 22 nt, Human
gccuggggggcaugucauaaua

SEQ ID NO: 221928 - RNA, 22 nt, Human
augcaaaagacuauuuguugcu

SEQ ID NO: 221929 - RNA, 22 nt, Human
aaaggccagguuggcugguauu

SEQ ID NO: 221930 - RNA, 22 nt, Human
ccagcccucgguagucccauag

SEQ ID NO: 221931 - RNA, 22 nt, Human
acugugcacccuggacaguguc

SEQ ID NO: 221932 - RNA, 22 nt, Human
caugcagugacucagacacagg

SEQ ID NO: 221933 - RNA, 22 nt, Human
gcagacagcauguugggcuauu

SEQ ID NO: 221934 - RNA, 22 nt, Human
agacaauuucaaaguaauauua

SEQ ID NO: 221935 - RNA, 23 nt, Human
uuagagaugauuaaaaaaucuug

SEQ ID NO: 221936 - RNA, 22 nt, Human
gcucagagaaagauuagucccu

SEQ ID NO: 221937 - RNA, 22 nt, Human
augaggcaggauuaagcuauca

SEQ ID NO: 221938 - RNA, 22 nt, Human
cagcaggcuguggaaauccugg

SEQ ID NO: 221939 - RNA, 22 nt, Human
cagagccaaaccucagggcccg

SEQ ID NO: 221940 - RNA, 22 nt, Human
cacacaucuuaucccaguuauu

SEQ ID NO: 221941 - RNA, 22 nt, Human
cauucggagguaguugagguua

SEQ ID NO: 221942 - RNA, 22 nt, Human
ccucugcacuucaccuuagcuc

SEQ ID NO: 221943 - RNA, 17 nt, Human
cugaggggagugcugug

SEQ ID NO: 221944 - RNA, 21 nt, Human
uuugcugaagauuuuaggcug

SEQ ID NO: 221945 - RNA, 22 nt, Human
ugcucccaaacgaccuacugug

SEQ ID NO: 221946 - RNA, 22 nt, Human
uauagaggccaccaacaugaaa

SEQ ID NO: 221947 - RNA, 20 nt, Human
agagugggugucacaggcug

SEQ ID NO: 221948 - RNA, 22 nt, Human
uacaguuaaaaaguucaauggu

SEQ ID NO: 221949 - RNA, 22 nt, Human
cucuuauuuuauggcauuugug

SEQ ID NO: 221950 - RNA, 22 nt, Human
acacauaugccauuacagcaaa

SEQ ID NO: 221951 - RNA, 20 nt, Human
aguuuagaggccaacaagcc

SEQ ID NO: 221952 - RNA, 22 nt, Human
ucucagaguaauucuuuaaggu

SEQ ID NO: 221953 - RNA, 22 nt, Human
agaguggcucugcugggcacag

SEQ ID NO: 221954 - RNA, 22 nt, Human
uagacuuugauauuguacaccc

SEQ ID NO: 221955 - RNA, 22 nt, Human
acauucuuggacuccacucuag

SEQ ID NO: 221956 - RNA, 22 nt, Human
uguuaaaaaugcagauuccuau

SEQ ID NO: 221957 - RNA, 22 nt, Human
agguuaaaaaggauucaguuaa

SEQ ID NO: 221958 - RNA, 22 nt, Human
uugcaaagagauaauccuaggc

SEQ ID NO: 221959 - RNA, 22 nt, Human
gagcaguucuccuugguagggg

SEQ ID NO: 221960 - RNA, 22 nt, Human
uuuaguguuugcguguacuccu

SEQ ID NO: 221961 - RNA, 22 nt, Human
ugcuggcucccaggagccgcug

SEQ ID NO: 221962 - RNA, 22 nt, Human
uuagugguaaggaugaaauuuc

SEQ ID NO: 221963 - RNA, 22 nt, Human
ggaccaggagcucagagcccuc

SEQ ID NO: 221964 - RNA, 22 nt, Human
ggaaucuuuuucauaagccuca

SEQ ID NO: 221965 - RNA, 22 nt, Human
cuccagugagugagcaggcgac

SEQ ID NO: 221966 - RNA, 22 nt, Human
gacacuuuauuaagcuguuguu

SEQ ID NO: 221967 - RNA, 22 nt, Human
gccacccccaaguagguggucu

SEQ ID NO: 221968 - RNA, 22 nt, Human
caguucucugugccucgcuggg

SEQ ID NO: 221969 - RNA, 19 nt, Human
aguggcugggcagaagcaa

SEQ ID NO: 221970 - RNA, 22 nt, Human
acauucaagaugcauucacuua

SEQ ID NO: 221971 - RNA, 22 nt, Human
accugcaguggccacuccuaau

SEQ ID NO: 221972 - RNA, 22 nt, Human
agcaaaguuaagguuucucuuu

SEQ ID NO: 221973 - RNA, 22 nt, Human
auuguauuagcacaauacaauu

SEQ ID NO: 221974 - RNA, 22 nt, Human
ugcagggauccuagcugaagag

SEQ ID NO: 221975 - RNA, 22 nt, Human
acacccagcugggccaccucca

SEQ ID NO: 221976 - RNA, 22 nt, Human
cacagcuggaaugggguaccug

SEQ ID NO: 221977 - RNA, 22 nt, Human
ugccuugaacauaguggacagu

SEQ ID NO: 221978 - RNA, 22 nt, Human
uccuggcagggucuaggucuag

SEQ ID NO: 221979 - RNA, 22 nt, Human
gaggagcaugggaaggcucugg

SEQ ID NO: 221980 - RNA, 22 nt, Human
cacacaguggaguauuacucag

SEQ ID NO: 221981 - RNA, 22 nt, Human
aagcuuuagagaugaguuccuu

SEQ ID NO: 221982 - RNA, 22 nt, Human
ucagacccaggugccaagcugu

SEQ ID NO: 221983 - RNA, 22 nt, Human
caggcucugcugcuacagcugu

SEQ ID NO: 221984 - RNA, 22 nt, Human
uggcagguggcacagccuggga

SEQ ID NO: 221985 - RNA, 22 nt, Human
cucagugugagugagaagugca

SEQ ID NO: 221986 - RNA, 22 nt, Human
gucuguacccacguccugcuag

SEQ ID NO: 221987 - RNA, 22 nt, Human
acccaggcuggcagaggcuccu

SEQ ID NO: 221988 - RNA, 22 nt, Human
ggcuuugcauuuugauggaggu

SEQ ID NO: 221989 - RNA, 21 nt, Human
ccuagccucuuacccagcuuu

SEQ ID NO: 221990 - RNA, 22 nt, Human
uuugaaaggaauuaggaugaca

SEQ ID NO: 221991 - RNA, 22 nt, Human
ggcuguggggccggguacagug

SEQ ID NO: 221992 - RNA, 22 nt, Human
gcacagaacagagaaauagcca

SEQ ID NO: 221993 - RNA, 22 nt, Human
auaucugguugguaauauaaca

SEQ ID NO: 221994 - RNA, 22 nt, Human
uaggagcuauaaugugaagucu

SEQ ID NO: 221995 - RNA, 22 nt, Human
cugcagggugacguugcccacc

SEQ ID NO: 221996 - RNA, 22 nt, Human
ucaguuaauggauucugucaga

SEQ ID NO: 221997 - RNA, 22 nt, Human
cuuucagaggggcguacacagc

SEQ ID NO: 221998 - RNA, 22 nt, Human
gccagucugcucccacaaguuc

SEQ ID NO: 221999 - RNA, 22 nt, Human
agagcuggagcagccccacugg

SEQ ID NO: 222000 - RNA, 22 nt, Human
uaucaaaaggaguugaaagggg

SEQ ID NO: 222001 - RNA, 18 nt, Human
cugaauuaucucaucauu

SEQ ID NO: 222002 - RNA, 22 nt, Human
cacuggaauguugaggagacaa

SEQ ID NO: 222003 - RNA, 22 nt, Human
agagugcagaggucaaagaaca

SEQ ID NO: 222004 - RNA, 22 nt, Human
aauugcuugaugacuaguaauu

SEQ ID NO: 222005 - RNA, 22 nt, Human
augcuuugauuugguuucucua

SEQ ID NO: 222006 - RNA, 22 nt, Human
aaugucacucuguuuccucugc

SEQ ID NO: 222007 - RNA, 22 nt, Human
ugaagacucagaagcuaagaua

SEQ ID NO: 222008 - RNA, 22 nt, Human
uugaagauucuuuuuguuagua

SEQ ID NO: 222009 - RNA, 22 nt, Human
uuucuucauagaccuugucuug

SEQ ID NO: 222010 - RNA, 22 nt, Human
ugcucccauguguggguacaga

SEQ ID NO: 222011 - RNA, 22 nt, Human
acagaagacagaguguucaucu

SEQ ID NO: 222012 - RNA, 22 nt, Human
aggacuaaggaacagcugauuc

SEQ ID NO: 222013 - RNA, 21 nt, Human
gggugcuguggucaugcagga

SEQ ID NO: 222014 - RNA, 22 nt, Human
uauuucucuucaaaauugaugu

SEQ ID NO: 222015 - RNA, 22 nt, Human
aaugaguuauuagguguaagug

SEQ ID NO: 222016 - RNA, 23 nt, Human
uugaggcaaacauguaaguagga

SEQ ID NO: 222017 - RNA, 22 nt, Human
ggcauggucuuugcuugcagga

SEQ ID NO: 222018 - RNA, 22 nt, Human
uaauuauaacaugcuuucuggc

SEQ ID NO: 222019 - RNA, 22 nt, Human
cuauugaggacauaaggacucu

SEQ ID NO: 222020 - RNA, 21 nt, Human
cagcagaagcaucuauggaag

SEQ ID NO: 222021 - RNA, 22 nt, Human
ggaccuggcaauuugcaucucu

SEQ ID NO: 222022 - RNA, 21 nt, Human
guacagggauaguagugucaa

SEQ ID NO: 222023 - RNA, 22 nt, Human
gucagaggaggcugaguaggaa

SEQ ID NO: 222024 - RNA, 22 nt, Human
cagacagguagggacagaacau

SEQ ID NO: 222025 - RNA, 20 nt, Human
aucaucuuuacaaugucagu

SEQ ID NO: 222026 - RNA, 22 nt, Human
ucagggaaucagacucugcagc

SEQ ID NO: 222027 - RNA, 22 nt, Human
gcaaggagacuguagggccaag

SEQ ID NO: 222028 - RNA, 22 nt, Human
gucagucauauuguacagauau

SEQ ID NO: 222029 - RNA, 22 nt, Human
accugagacuugggaugggaau

SEQ ID NO: 222030 - RNA, 20 nt, Human
cagccuccacucacucagcu

SEQ ID NO: 222031 - RNA, 22 nt, Human
uucuugaaggggauauaaauag

SEQ ID NO: 222032 - RNA, 22 nt, Human
ccaggggccugugaaggugccc

SEQ ID NO: 222033 - RNA, 22 nt, Human
aagaaagugaugagcuacagau

SEQ ID NO: 222034 - RNA, 23 nt, Human
ugcugcccgcuuggcacgcuccc

SEQ ID NO: 222035 - RNA, 22 nt, Human
cugguccuugacgcgugggagg

SEQ ID NO: 222036 - RNA, 22 nt, Human
agauucauuauuaaugugaucu

SEQ ID NO: 222037 - RNA, 22 nt, Human
aguggcaggaucucgguucacu

SEQ ID NO: 222038 - RNA, 22 nt, Human
ggcaggugcaccugagccaucu

SEQ ID NO: 222039 - RNA, 23 nt, Human
agcagcugugguuuaccuuagua

SEQ ID NO: 222040 - RNA, 22 nt, Human
ucuggaaguuagaggaggaaag

SEQ ID NO: 222041 - RNA, 22 nt, Human
ccugagcucaaagggugccugg

SEQ ID NO: 222042 - RNA, 22 nt, Human
agauguaccagguauuacagga

SEQ ID NO: 222043 - RNA, 22 nt, Human
cagccagaucaaacucagaugu

SEQ ID NO: 222044 - RNA, 22 nt, Human
ggccugugcacaugugcaggaa

SEQ ID NO: 222045 - RNA, 22 nt, Human
acagacaguaugguggggcuga

SEQ ID NO: 222046 - RNA, 22 nt, Human
aggaggcugguucaggccauau

SEQ ID NO: 222047 - RNA, 23 nt, Human
cuggggcucauugcaguagccau

SEQ ID NO: 222048 - RNA, 22 nt, Human
uccugagcaacacagcuaagug

SEQ ID NO: 222049 - RNA, 22 nt, Human
uauucuuguaccuuaaaugauu

SEQ ID NO: 222050 - RNA, 22 nt, Human
gggcacaguacuccaaucaacu

SEQ ID NO: 222051 - RNA, 22 nt, Human
acccaggagguggaggcugcag

SEQ ID NO: 222052 - RNA, 22 nt, Human
auuugcauaauagugauuugua

SEQ ID NO: 222053 - RNA, 23 nt, Human
uuugcaaauuuuccugacuacuc

SEQ ID NO: 222054 - RNA, 22 nt, Human
cagggacaggggagaaaagaug

SEQ ID NO: 222055 - RNA, 22 nt, Human
uccuuagcacccaccaaggacu

SEQ ID NO: 222056 - RNA, 22 nt, Human
caaguacaaaaugauauuuagu

SEQ ID NO: 222057 - RNA, 22 nt, Human
agcuucugcaucuuuucuuccc

SEQ ID NO: 222058 - RNA, 22 nt, Human
aaauuaacuaucacuuuuguga

SEQ ID NO: 222059 - RNA, 19 nt, Human
guacaacaaugcugagcau

SEQ ID NO: 222060 - RNA, 22 nt, Human
ccagccaguauauuccaaagcc

SEQ ID NO: 222061 - RNA, 22 nt, Human
uacaccauuuucugcaguguuu

SEQ ID NO: 222062 - RNA, 22 nt, Human
accuuucugcaaguucugggac

SEQ ID NO: 222063 - RNA, 22 nt, Human
caaggaaggagagaugaugggu

SEQ ID NO: 222064 - RNA, 22 nt, Human
aggaggugcuguuuguccugga

SEQ ID NO: 222065 - RNA, 22 nt, Human
gccaaaucacagggccaaaagc

SEQ ID NO: 222066 - RNA, 22 nt, Human
uaaacucuucuguagaaucaga

SEQ ID NO: 222067 - RNA, 22 nt, Human
caucucugguucagucucugug

SEQ ID NO: 222068 - RNA, 22 nt, Human
uggcucagucuggguugacuga

SEQ ID NO: 222069 - RNA, 22 nt, Human
ucacaucuuaguuugggacucu

SEQ ID NO: 222070 - RNA, 22 nt, Human
agucacaugaguuucucuuuau

SEQ ID NO: 222071 - RNA, 22 nt, Human
uuccaggaagauucaacaaaag

SEQ ID NO: 222072 - RNA, 22 nt, Human
aaacuuuaggaaggaauuuaca

SEQ ID NO: 222073 - RNA, 22 nt, Human
uucucagacuuccagcaccagc

SEQ ID NO: 222074 - RNA, 22 nt, Human
aagcccucagagccucuuugac

SEQ ID NO: 222075 - RNA, 21 nt, Human
aggggaaguagaguuuugauu

SEQ ID NO: 222076 - RNA, 22 nt, Human
acagcuuuucaauucugcugag

SEQ ID NO: 222077 - RNA, 22 nt, Human
ugagcagagacuucaagggcag

SEQ ID NO: 222078 - RNA, 22 nt, Human
ucucuggcacauaauaaggucu

SEQ ID NO: 222079 - RNA, 22 nt, Human
cugucccuucauuauucacuac

SEQ ID NO: 222080 - RNA, 22 nt, Human
agagcuaagaaacagaauugcu

SEQ ID NO: 222081 - RNA, 22 nt, Human
agccuacagagggcagguggag

SEQ ID NO: 222082 - RNA, 22 nt, Human
gccugcagggugaugggcugcc

SEQ ID NO: 222083 - RNA, 22 nt, Human
uggagcugauacagcuggcuuu

SEQ ID NO: 222084 - RNA, 22 nt, Human
acauacaucaaguaucacaaga

SEQ ID NO: 222085 - RNA, 22 nt, Human
uccuggcacccuuggguuggag

SEQ ID NO: 222086 - RNA, 18 nt, Human
aguuugaacaaggaagaa

SEQ ID NO: 222087 - RNA, 21 nt, Human
uaucaaggcacuuuuuaaaga

SEQ ID NO: 222088 - RNA, 22 nt, Human
ccagaggacuugggggcugaau

SEQ ID NO: 222089 - RNA, 22 nt, Human
uuuguaaaaggaggaagcaugg

SEQ ID NO: 222090 - RNA, 22 nt, Human
agauuccagaucccaaaaauga

SEQ ID NO: 222091 - RNA, 23 nt, Human
cuucagugugggacugcagcgug

SEQ ID NO: 222092 - RNA, 22 nt, Human
uugagaacuacuuuauuauucu

SEQ ID NO: 222093 - RNA, 18 nt, Human
ccuguggcucagcccaca

SEQ ID NO: 222094 - RNA, 22 nt, Human
ggcccagcugugcuuccagccc

SEQ ID NO: 222095 - RNA, 22 nt, Human
uacuacaaggccgaagcucuca

SEQ ID NO: 222096 - RNA, 22 nt, Human
uggcagcagcuaacuuaggcag

SEQ ID NO: 222097 - RNA, 22 nt, Human
agccagagauugagaugcaggc

SEQ ID NO: 222098 - RNA, 22 nt, Human
cuggcaccuccagcucauggcc

SEQ ID NO: 222099 - RNA, 22 nt, Human
agcagggccucuggcacugguc

SEQ ID NO: 222100 - RNA, 22 nt, Human
uaagcaguuuuucuuguauuaa

SEQ ID NO: 222101 - RNA, 14 nt, Human
gcaggcagaccacc

SEQ ID NO: 222102 - RNA, 22 nt, Human
gagaaagaugaagaguggcguu

SEQ ID NO: 222103 - RNA, 22 nt, Human
acuguggccggaacagugggac

SEQ ID NO: 222104 - RNA, 22 nt, Human
acacaugauuaaugccaagcau

SEQ ID NO: 222105 - RNA, 22 nt, Human
acagaugauuuuuaugaaaaca

SEQ ID NO: 222106 - RNA, 22 nt, Human
gcauuagauuugccuuugaagc

SEQ ID NO: 222107 - RNA, 22 nt, Human
uugaggaguggcgcuggacuua

SEQ ID NO: 222108 - RNA, 22 nt, Human
uaacaagauuuguaaaauugua

SEQ ID NO: 222109 - RNA, 22 nt, Human
ugugacccagacucaucuucuu

SEQ ID NO: 222110 - RNA, 22 nt, Human
aucuccaggaagugucauuuac

SEQ ID NO: 222111 - RNA, 22 nt, Human
gccucugcaucaucacuccagc

SEQ ID NO: 222112 - RNA, 22 nt, Human
uguauaaaccauggacagcuuu

SEQ ID NO: 222113 - RNA, 22 nt, Human
gaguuaaaaaugccuccaugga

SEQ ID NO: 222114 - RNA, 22 nt, Human
ccaggugggcgugucuucaccu

SEQ ID NO: 222115 - RNA, 22 nt, Human
agaguccauaugugggaggagu

SEQ ID NO: 222116 - RNA, 22 nt, Human
cagcucauuccucaaucuagga

SEQ ID NO: 222117 - RNA, 22 nt, Human
ucccugaguguauguggugaac

SEQ ID NO: 222118 - RNA, 22 nt, Human
uuuugucagugagaacagaguu

SEQ ID NO: 222119 - RNA, 22 nt, Human
cugcacaaugcaccaucaaguu

SEQ ID NO: 222120 - RNA, 22 nt, Human
augagcugggccauccagugau

SEQ ID NO: 222121 - RNA, 19 nt, Human
augcagagaauggcaguag

SEQ ID NO: 222122 - RNA, 20 nt, Human
caaggcuucuuugauggggu

SEQ ID NO: 222123 - RNA, 22 nt, Human
ggucagggcucuuccaguggcu

SEQ ID NO: 222124 - RNA, 22 nt, Human
cuuguccccagcagguugguuu

SEQ ID NO: 222125 - RNA, 22 nt, Human
ugaaaucaucugccaauaaguu

SEQ ID NO: 222126 - RNA, 22 nt, Human
uugaaaguaauaacuuuguuca

SEQ ID NO: 222127 - RNA, 22 nt, Human
cuggcaguuugccaggagcucg

SEQ ID NO: 222128 - RNA, 22 nt, Human
cugaggagcccccucucagcau

SEQ ID NO: 222129 - RNA, 22 nt, Human
gcugugcaaaucgauuuguugg

SEQ ID NO: 222130 - RNA, 22 nt, Human
aggccagaugucgggcuagaag

SEQ ID NO: 222131 - RNA, 22 nt, Human
agcaaagaaauggaggcucaga

SEQ ID NO: 222132 - RNA, 22 nt, Human
uggcagagugcggcauccccug

SEQ ID NO: 222133 - RNA, 22 nt, Human
aaacaggucugaaaauagcuac

SEQ ID NO: 222134 - RNA, 22 nt, Human
uuugacucuugucucuuguuag

SEQ ID NO: 222135 - RNA, 22 nt, Human
gagcacagaaucuucccaugca

SEQ ID NO: 222136 - RNA, 22 nt, Human
agugaaaucagguuuugacugc

SEQ ID NO: 222137 - RNA, 19 nt, Human
guccaugcuuagaggggcc

SEQ ID NO: 222138 - RNA, 21 nt, Human
ggugacacguggccccgcucu

SEQ ID NO: 222139 - RNA, 22 nt, Human
aucaguaaauauucauugugca

SEQ ID NO: 222140 - RNA, 22 nt, Human
uuagaacacugagaaagugaug

SEQ ID NO: 222141 - RNA, 22 nt, Human
uggcucuggagcuggcggcuga

SEQ ID NO: 222142 - RNA, 22 nt, Human
aaauagcugaaaguuccuagau

SEQ ID NO: 222143 - RNA, 22 nt, Human
aguuaaaucauuacugacagag

SEQ ID NO: 222144 - RNA, 22 nt, Human
cagccucuguggcugccacacc

SEQ ID NO: 222145 - RNA, 23 nt, Human
ucagaaguuugguuguaacaugg

SEQ ID NO: 222146 - RNA, 22 nt, Human
acuuccaaaacacagcauggca

SEQ ID NO: 222147 - RNA, 22 nt, Human
agauggcucuuugaaggggaau

SEQ ID NO: 222148 - RNA, 22 nt, Human
ccaggcuugaagggaagaaugg

SEQ ID NO: 222149 - RNA, 22 nt, Human
ccaggaagcugugagauuccaa

SEQ ID NO: 222150 - RNA, 23 nt, Human
agcuccagggaacaggcaguagg

SEQ ID NO: 222151 - RNA, 22 nt, Human
ccauaguacauaauacauuuua

SEQ ID NO: 222152 - RNA, 22 nt, Human
aacaaagaagacugguuauuuu

SEQ ID NO: 222153 - RNA, 22 nt, Human
agcaggcuaggaaccucacugc

SEQ ID NO: 222154 - RNA, 22 nt, Human
uccaccauguaacaagcucugu

SEQ ID NO: 222155 - RNA, 22 nt, Human
agcagccagagucugaacauua

SEQ ID NO: 222156 - RNA, 22 nt, Human
aggacagguguagugggcucug

SEQ ID NO: 222157 - RNA, 22 nt, Human
uuaauaggcuucuaacauagcu

SEQ ID NO: 222158 - RNA, 22 nt, Human
aucuagaaagccaggggccugc

SEQ ID NO: 222159 - RNA, 22 nt, Human
cugugcucuggcaucgcugcaa

SEQ ID NO: 222160 - RNA, 21 nt, Human
ugggacagugauggcuccucc

SEQ ID NO: 222161 - RNA, 23 nt, Human
uucauugauugcaaggagauugg

SEQ ID NO: 222162 - RNA, 22 nt, Human
gggagggaaggaccuuaugaau

SEQ ID NO: 222163 - RNA, 22 nt, Human
aaggacucuccagcuagcaaau

SEQ ID NO: 222164 - RNA, 22 nt, Human
aucucacagaggcccaccagga

SEQ ID NO: 222165 - RNA, 22 nt, Human
cuccagcuucugcccagagacu

SEQ ID NO: 222166 - RNA, 22 nt, Human
agaggccagcagugccuaucug

SEQ ID NO: 222167 - RNA, 22 nt, Human
uuauugaguuguaagagcucuu

SEQ ID NO: 222168 - RNA, 19 nt, Human
caucagagggcauaggaug

SEQ ID NO: 222169 - RNA, 22 nt, Human
aggcuggcuggggaugcgucuu

SEQ ID NO: 222170 - RNA, 22 nt, Human
cuucugggccauggccuuccuc

SEQ ID NO: 222171 - RNA, 22 nt, Human
uuucaacaccagagaccaugcg

SEQ ID NO: 222172 - RNA, 23 nt, Human
aaacugcaucucugagccucagc

SEQ ID NO: 222173 - RNA, 23 nt, Human
acagagacaaugguuucaucuug

SEQ ID NO: 222174 - RNA, 22 nt, Human
gacagguggguaccuuuaugga

SEQ ID NO: 222175 - RNA, 17 nt, Human
ccugcccagagacagau

SEQ ID NO: 222176 - RNA, 22 nt, Human
aggcuucuucuuccuauuuagu

SEQ ID NO: 222177 - RNA, 22 nt, Human
ucacagaagcccucgcaaacua

SEQ ID NO: 222178 - RNA, 22 nt, Human
ucaauguaauaaaauacucuau

SEQ ID NO: 222179 - RNA, 22 nt, Human
uuccuccuacgcuuaucacuuu

SEQ ID NO: 222180 - RNA, 21 nt, Human
uccugggaagcacuggggugg

SEQ ID NO: 222181 - RNA, 22 nt, Human
uagaaacaugagagaaacucuu

SEQ ID NO: 222182 - RNA, 22 nt, Human
agacuccaggagggaggcugcu

SEQ ID NO: 222183 - RNA, 22 nt, Human
aacccagccguguagcugccgc

SEQ ID NO: 222184 - RNA, 22 nt, Human
agaaucugcauuuuuaauaaca

SEQ ID NO: 222185 - RNA, 19 nt, Human
agcuaacucacuaacuaug

SEQ ID NO: 222186 - RNA, 22 nt, Human
ggcccugggcccucuagcuugu

SEQ ID NO: 222187 - RNA, 22 nt, Human
ugacugaggcagccugaguuau

SEQ ID NO: 222188 - RNA, 22 nt, Human
cucuggcuguuugcagcucaag

SEQ ID NO: 222189 - RNA, 22 nt, Human
cagggcugaacugagcuuguga

SEQ ID NO: 222190 - RNA, 22 nt, Human
agucugugaacuuggcagggaa

SEQ ID NO: 222191 - RNA, 17 nt, Human
uccugugggugcagcag

SEQ ID NO: 222192 - RNA, 22 nt, Human
cagaaggcaaggccugccacgc

SEQ ID NO: 222193 - RNA, 22 nt, Human
acaauauaguccaugagcaugc

SEQ ID NO: 222194 - RNA, 22 nt, Human
agcucuuccaccucaugauggg

SEQ ID NO: 222195 - RNA, 22 nt, Human
gaggcucaaaccuggacagagc

SEQ ID NO: 222196 - RNA, 22 nt, Human
acagacuggagugagagaaaua

SEQ ID NO: 222197 - RNA, 22 nt, Human
caaguaaugguuuuauaauagu

SEQ ID NO: 222198 - RNA, 19 nt, Human
agcauuaggcaaauuuuga

SEQ ID NO: 222199 - RNA, 22 nt, Human
agcacaggacguagagcuugga

SEQ ID NO: 222200 - RNA, 22 nt, Human
aauguccuaggcaugauuuugu

SEQ ID NO: 222201 - RNA, 22 nt, Human
cugugggaugggaccucagcug

SEQ ID NO: 222202 - RNA, 22 nt, Human
cuuuucauuguuuguacaugca

SEQ ID NO: 222203 - RNA, 22 nt, Human
auaguuugaaggcuguucuacu

SEQ ID NO: 222204 - RNA, 22 nt, Human
ucagaaguugauaaaguaguug

SEQ ID NO: 222205 - RNA, 22 nt, Human
ggcaauaguuguggguucuuua

SEQ ID NO: 222206 - RNA, 19 nt, Human
ucuugaggaaaguaaggca

SEQ ID NO: 222207 - RNA, 22 nt, Human
gagggaggcaucaugaauccag

SEQ ID NO: 222208 - RNA, 22 nt, Human
gcugccuuuagggggugcucag

SEQ ID NO: 222209 - RNA, 22 nt, Human
gcucugccaaggacccauucuc

SEQ ID NO: 222210 - RNA, 22 nt, Human
aauaugcauguauacaugugua

SEQ ID NO: 222211 - RNA, 22 nt, Human
gaaguucaacugccaugcuugg

SEQ ID NO: 222212 - RNA, 22 nt, Human
ugaggccaggacccccagcagg

SEQ ID NO: 222213 - RNA, 22 nt, Human
uacaguagacaggaccacaggc

SEQ ID NO: 222214 - RNA, 22 nt, Human
accaauuucuuggcuuccaaau

SEQ ID NO: 222215 - RNA, 22 nt, Human
aguggcuaauaacagcuaaaca

SEQ ID NO: 222216 - RNA, 22 nt, Human
aaccagcuccucaccccauugu

SEQ ID NO: 222217 - RNA, 22 nt, Human
ggcugaggguauagcuguccca

SEQ ID NO: 222218 - RNA, 22 nt, Human
gcacugagcaccagccacagau

SEQ ID NO: 222219 - RNA, 22 nt, Human
gggugguggccagcagugggca

SEQ ID NO: 222220 - RNA, 22 nt, Human
ugcacuucauuguaaauuguac

SEQ ID NO: 222221 - RNA, 22 nt, Human
gcacagugauaggcaguugugc

SEQ ID NO: 222222 - RNA, 22 nt, Human
aagcuuuaugaucucucagcua

SEQ ID NO: 222223 - RNA, 21 nt, Human
agcaagcagaauccaucuaga

SEQ ID NO: 222224 - RNA, 22 nt, Human
uuccucagagagacagaaacua

SEQ ID NO: 222225 - RNA, 21 nt, Human
acucaggcaccaggggauggc

SEQ ID NO: 222226 - RNA, 22 nt, Human
gggccuccggggugagcugugg

SEQ ID NO: 222227 - RNA, 22 nt, Human
uuauauauauguagaggucacg

SEQ ID NO: 222228 - RNA, 22 nt, Human
cuccucagaagaggguaacaca

SEQ ID NO: 222229 - RNA, 22 nt, Human
ggcaguugcgugcaucaguggu

SEQ ID NO: 222230 - RNA, 22 nt, Human
ugcuggcacguggaccaggaga

SEQ ID NO: 222231 - RNA, 22 nt, Human
ucaguguccugugcggugcagc

SEQ ID NO: 222232 - RNA, 22 nt, Human
ucugcccaaggcugucacuaga

SEQ ID NO: 222233 - RNA, 18 nt, Human
gagggaguagcugagguu

SEQ ID NO: 222234 - RNA, 22 nt, Human
ugcuuaaaaugaugauuauuuu

SEQ ID NO: 222235 - RNA, 22 nt, Human
uggcugagaaaaaagagcuaua

SEQ ID NO: 222236 - RNA, 18 nt, Human
aagcugggaaggagacag

SEQ ID NO: 222237 - RNA, 19 nt, Human
ggcugcagagccccggcgc

SEQ ID NO: 222238 - RNA, 22 nt, Human
agaggagguccuuuucugaugu

SEQ ID NO: 222239 - RNA, 21 nt, Human
cacuggaauuuucugugacau

SEQ ID NO: 222240 - RNA, 17 nt, Human
ucugucugugguccacu

SEQ ID NO: 222241 - RNA, 22 nt, Human
aauagagucaguucuacauucu

SEQ ID NO: 222242 - RNA, 22 nt, Human
uggagcaggaaacaucuagagg

SEQ ID NO: 222243 - RNA, 22 nt, Human
uucuuauaaguuaauauuucca

SEQ ID NO: 222244 - RNA, 22 nt, Human
uccugggcacaagugagucucc

SEQ ID NO: 222245 - RNA, 22 nt, Human
uucucuuuauguauuuaguggg

SEQ ID NO: 222246 - RNA, 23 nt, Human
cagugggcuucuaacugcuccug

SEQ ID NO: 222247 - RNA, 22 nt, Human
cagaggccauauuucuucacuc

SEQ ID NO: 222248 - RNA, 22 nt, Human
ggugcaaacguaauugugguuu

SEQ ID NO: 222249 - RNA, 22 nt, Human
gugcuacagacugaguacacuu

SEQ ID NO: 222250 - RNA, 22 nt, Human
aagcaugggaggccuggaggag

SEQ ID NO: 222251 - RNA, 22 nt, Human
aguguucagugauugucaaccg

SEQ ID NO: 222252 - RNA, 22 nt, Human
uagcaggugcucauuuaacucc

SEQ ID NO: 222253 - RNA, 22 nt, Human
cagccagaaccuaggaugagcu

SEQ ID NO: 222254 - RNA, 22 nt, Human
uuccuucuuccuuuaguaacca

SEQ ID NO: 222255 - RNA, 22 nt, Human
caaacauugcuaccagagguuu

SEQ ID NO: 222256 - RNA, 22 nt, Human
agcucccugcacgacccugccc

SEQ ID NO: 222257 - RNA, 22 nt, Human
uuauuaggaaaaggucagaugu

SEQ ID NO: 222258 - RNA, 22 nt, Human
cagagcagccuccagggggagc

SEQ ID NO: 222259 - RNA, 22 nt, Human
gggcuguguaaugugcucuuuu

SEQ ID NO: 222260 - RNA, 22 nt, Human
uuuauucacuucagugccaaag

SEQ ID NO: 222261 - RNA, 22 nt, Human
ucuguggcugucuuuccagagg

SEQ ID NO: 222262 - RNA, 22 nt, Human
cagcuuucaucagugacacuca

SEQ ID NO: 222263 - RNA, 21 nt, Human
cauuagggcagaagcaggaag

SEQ ID NO: 222264 - RNA, 22 nt, Human
auggaacaggcucagagaugcu

SEQ ID NO: 222265 - RNA, 21 nt, Human
gaaauacugccuuaggagcug

SEQ ID NO: 222266 - RNA, 20 nt, Human
cuacauguucugcuucucuc

SEQ ID NO: 222267 - RNA, 22 nt, Human
ucuuuguuuguacuguuagaau

SEQ ID NO: 222268 - RNA, 22 nt, Human
gggccagagcacagaggauguu

SEQ ID NO: 222269 - RNA, 22 nt, Human
aauucacaaaaccagauugcuu

SEQ ID NO: 222270 - RNA, 23 nt, Human
ucaguuaacuguguuaccugugc

SEQ ID NO: 222271 - RNA, 22 nt, Human
augaggauaccgcagggggcag

SEQ ID NO: 222272 - RNA, 22 nt, Human
aaggcuuccuggaggagguguc

SEQ ID NO: 222273 - RNA, 22 nt, Human
uggcacagccaucuucuccugc

SEQ ID NO: 222274 - RNA, 22 nt, Human
agagcccagguccuggagaggg

SEQ ID NO: 222275 - RNA, 22 nt, Human
cucuguuuuucaauaguucuug

SEQ ID NO: 222276 - RNA, 22 nt, Human
gucucauugguucugccagagu

SEQ ID NO: 222277 - RNA, 22 nt, Human
gcagccuuccguggaccuggac

SEQ ID NO: 222278 - RNA, 22 nt, Human
ccaauaauucuucaaguguuuu

SEQ ID NO: 222279 - RNA, 21 nt, Human
uauacaugugcacacacaugc

SEQ ID NO: 222280 - RNA, 22 nt, Human
agcagcagaagggagacccagg

SEQ ID NO: 222281 - RNA, 22 nt, Human
uugcccugcguuaccaucucuu

SEQ ID NO: 222282 - RNA, 22 nt, Human
cauuuggaaagagacuagagaa

SEQ ID NO: 222283 - RNA, 22 nt, Human
acaggaagugcuggcacuuaca

SEQ ID NO: 222284 - RNA, 22 nt, Human
uacuggguauacaaagaugaau

SEQ ID NO: 222285 - RNA, 22 nt, Human
auacaugugucccugauuuauu

SEQ ID NO: 222286 - RNA, 22 nt, Human
ucuccccagacccuggacauaa

SEQ ID NO: 222287 - RNA, 22 nt, Human
ugcaggcugccuucacagagcc

SEQ ID NO: 222288 - RNA, 20 nt, Human
gccuccacacucaccccuua

SEQ ID NO: 222289 - RNA, 20 nt, Human
cugugaccagagacccagga

SEQ ID NO: 222290 - RNA, 19 nt, Human
uuccaaaaucaggauuuga

SEQ ID NO: 222291 - RNA, 22 nt, Human
ggcagguguggaguguuauuuu

SEQ ID NO: 222292 - RNA, 22 nt, Human
ccccagagaaagucagcagcau

SEQ ID NO: 222293 - RNA, 22 nt, Human
ugggagcacucuuugggaagca

SEQ ID NO: 222294 - RNA, 22 nt, Human
gcccagggcgauggucggggcc

SEQ ID NO: 222295 - RNA, 22 nt, Human
uaguuucauaugcaaaauagua

SEQ ID NO: 222296 - RNA, 22 nt, Human
aauugcuaaagauuauguuuuc

SEQ ID NO: 222297 - RNA, 22 nt, Human
cuuauaaaguccaucugaacaa

SEQ ID NO: 222298 - RNA, 19 nt, Human
cuguggcugaccucuggcc

SEQ ID NO: 222299 - RNA, 21 nt, Human
agaaacaugaucaaaggaacc

SEQ ID NO: 222300 - RNA, 22 nt, Human
augcauauagaacauuugacau

SEQ ID NO: 222301 - RNA, 22 nt, Human
cagcaucuucuagauccaggcu

SEQ ID NO: 222302 - RNA, 22 nt, Human
ggaaggcuuuaagcaccaaagc

SEQ ID NO: 222303 - RNA, 22 nt, Human
ugacauguuagggaaaugugau

SEQ ID NO: 222304 - RNA, 22 nt, Human
uccuuggagcucuccaagggau

SEQ ID NO: 222305 - RNA, 22 nt, Human
uaugcauagugauuuagaacag

SEQ ID NO: 222306 - RNA, 22 nt, Human
uccuggagagaggccuggaaga

SEQ ID NO: 222307 - RNA, 22 nt, Human
aauucagagacucauucuggag

SEQ ID NO: 222308 - RNA, 22 nt, Human
ccauggcucuuaccuuguuaua

SEQ ID NO: 222309 - RNA, 19 nt, Human
agagccagacagcauagga

SEQ ID NO: 222310 - RNA, 22 nt, Human
gggguacuggcuggagccccac

SEQ ID NO: 222311 - RNA, 22 nt, Human
ugaggagaaaugcucagagcca

SEQ ID NO: 222312 - RNA, 20 nt, Human
uagaacuuuucaguauggau

SEQ ID NO: 222313 - RNA, 22 nt, Human
gagagagaaggccugugggugu

SEQ ID NO: 222314 - RNA, 22 nt, Human
ggaugucgaggaugggguagca

SEQ ID NO: 222315 - RNA, 22 nt, Human
ggggcagaaagcccacagagug

SEQ ID NO: 222316 - RNA, 22 nt, Human
cuggagcugucuucacaggccu

SEQ ID NO: 222317 - RNA, 22 nt, Human
uggcagcugcaggccuccugag

SEQ ID NO: 222318 - RNA, 22 nt, Human
agcaucuggauggaaagcaagg

SEQ ID NO: 222319 - RNA, 22 nt, Human
ucuguggcuucuauuuaacuuu

SEQ ID NO: 222320 - RNA, 22 nt, Human
agacagaaauaggagaaaccag

SEQ ID NO: 222321 - RNA, 22 nt, Human
uauaguuaguuucauaaucaug

SEQ ID NO: 222322 - RNA, 22 nt, Human
caauaauugcuuuccagaguua

SEQ ID NO: 222323 - RNA, 22 nt, Human
cugugggagcacaugacagaua

SEQ ID NO: 222324 - RNA, 21 nt, Human
uagcccucucugucuguguac

SEQ ID NO: 222325 - RNA, 22 nt, Human
uaguuaaagagauccacauucc

SEQ ID NO: 222326 - RNA, 22 nt, Human
ccuggcugcugucacugaccau

SEQ ID NO: 222327 - RNA, 20 nt, Human
cugugcuuuggaaccuggaa

SEQ ID NO: 222328 - RNA, 22 nt, Human
uuaguguguuaaugaguauauc

SEQ ID NO: 222329 - RNA, 22 nt, Human
aaauaguucagcuuguaaaccc

SEQ ID NO: 222330 - RNA, 22 nt, Human
ggggcuccagucuucacauuuu

SEQ ID NO: 222331 - RNA, 22 nt, Human
gugcaggcucucguucuugaca

SEQ ID NO: 222332 - RNA, 22 nt, Human
agcuuuagaauuguucagcaag

SEQ ID NO: 222333 - RNA, 22 nt, Human
uauugcugaugcugaagggaag

SEQ ID NO: 222334 - RNA, 18 nt, Human
agcuggggccucuggucc

SEQ ID NO: 222335 - RNA, 22 nt, Human
gcuggaguuagaacuagccugg

SEQ ID NO: 222336 - RNA, 22 nt, Human
uugcagggaaaucagugaggau

SEQ ID NO: 222337 - RNA, 22 nt, Human
uuucuguauuuugucauaaccu

SEQ ID NO: 222338 - RNA, 22 nt, Human
cugagcugugcuaagugaaaug

SEQ ID NO: 222339 - RNA, 22 nt, Human
uaaauucacuccugguagaccu

SEQ ID NO: 222340 - RNA, 22 nt, Human
uggcacaguuaaaguuguagaa

SEQ ID NO: 222341 - RNA, 22 nt, Human
agguuucuccuuuaaagcaugg

SEQ ID NO: 222342 - RNA, 21 nt, Human
aucaccagcagaagcugcaga

SEQ ID NO: 222343 - RNA, 22 nt, Human
uucaugaaacuuaacuguuggg

SEQ ID NO: 222344 - RNA, 22 nt, Human
uuggaaagcaagcuggacauac

SEQ ID NO: 222345 - RNA, 22 nt, Human
ugcccuguuccugccuccagcu

SEQ ID NO: 222346 - RNA, 22 nt, Human
uaaacagaaagcagauguacuu

SEQ ID NO: 222347 - RNA, 22 nt, Human
ugugugucacugaaagaaaucu

SEQ ID NO: 222348 - RNA, 22 nt, Human
caugcaaaugguggcuaaaugg

SEQ ID NO: 222349 - RNA, 22 nt, Human
uuacagagggcuucucugaacu

SEQ ID NO: 222350 - RNA, 22 nt, Human
ucucacugggucacagcagagg

SEQ ID NO: 222351 - RNA, 22 nt, Human
ggcagguguuuuuauauuaaag

SEQ ID NO: 222352 - RNA, 22 nt, Human
cugccugggccaugcccagucc

SEQ ID NO: 222353 - RNA, 22 nt, Human
agucacccuccaacucuccacu

SEQ ID NO: 222354 - RNA, 23 nt, Human
cagggccaggcagcagcugucac

SEQ ID NO: 222355 - RNA, 22 nt, Human
agggccuggcuucacuuucuca

SEQ ID NO: 222356 - RNA, 22 nt, Human
cagucuaaucuguuacucauua

SEQ ID NO: 222357 - RNA, 22 nt, Human
auucucuggcuaaaaccugaag

SEQ ID NO: 222358 - RNA, 20 nt, Human
uuggcucugaucaguggagc

SEQ ID NO: 222359 - RNA, 22 nt, Human
ugggaggcccaggccuggcagg

SEQ ID NO: 222360 - RNA, 22 nt, Human
gacauaauaaucugaccuagau

SEQ ID NO: 222361 - RNA, 22 nt, Human
agaggccaccacugucagggac

SEQ ID NO: 222362 - RNA, 20 nt, Human
gccugggauuauccacuggu

SEQ ID NO: 222363 - RNA, 22 nt, Human
caucuaccuccacccuauauau

SEQ ID NO: 222364 - RNA, 19 nt, Human
cacauuuugagucugagau

SEQ ID NO: 222365 - RNA, 20 nt, Human
aagggagaauaaugauugua

SEQ ID NO: 222366 - RNA, 22 nt, Human
uggaguuccuuugaaaggcucu

SEQ ID NO: 222367 - RNA, 22 nt, Human
aguggggccggugaggccgagg

SEQ ID NO: 222368 - RNA, 22 nt, Human
auauauacaacuagauuaaaag

SEQ ID NO: 222369 - RNA, 17 nt, Human
gauggggcugacaucag

SEQ ID NO: 222370 - RNA, 22 nt, Human
caugcaggccuauggagcagug

SEQ ID NO: 222371 - RNA, 22 nt, Human
ugggaugauagguaaguaauua

SEQ ID NO: 222372 - RNA, 22 nt, Human
aggcucaguuugguuuccauug

SEQ ID NO: 222373 - RNA, 22 nt, Human
agcaggggcaggguuuugugcu

SEQ ID NO: 222374 - RNA, 22 nt, Human
uuuucugugugucccucgacag

SEQ ID NO: 222375 - RNA, 22 nt, Human
ccucccucccucuuaugguuua

SEQ ID NO: 222376 - RNA, 22 nt, Human
ugggggugugccagggaccucc

SEQ ID NO: 222377 - RNA, 22 nt, Human
cuagaaagauacuuaaaucaag

SEQ ID NO: 222378 - RNA, 22 nt, Human
ugugcacauucuaggacuagua

SEQ ID NO: 222379 - RNA, 22 nt, Human
agggcuccuaugaugcucugcc

SEQ ID NO: 222380 - RNA, 22 nt, Human
cugggacauauugcuaguguug

SEQ ID NO: 222381 - RNA, 22 nt, Human
uuagaagugggccuauaguccu

SEQ ID NO: 222382 - RNA, 22 nt, Human
caguggcuucucaugucauuca

SEQ ID NO: 222383 - RNA, 22 nt, Human
ggagaaggugcuggucacugug

SEQ ID NO: 222384 - RNA, 20 nt, Human
ugcaaggaagcaggcaagug

SEQ ID NO: 222385 - RNA, 22 nt, Human
cuguacuaauugcuuuacaugu

SEQ ID NO: 222386 - RNA, 22 nt, Human
ucauuuugccugccauuugagu

SEQ ID NO: 222387 - RNA, 22 nt, Human
gccaggccacucccggguccug

SEQ ID NO: 222388 - RNA, 22 nt, Human
aaggcuugauauuuacagucuu

SEQ ID NO: 222389 - RNA, 22 nt, Human
auguuacaauccaacaaaauua

SEQ ID NO: 222390 - RNA, 23 nt, Human
aguuucuuugagacuugcccugu

SEQ ID NO: 222391 - RNA, 22 nt, Human
uggcuccucuucuggguguccc

SEQ ID NO: 222392 - RNA, 22 nt, Human
uaggcucagugaguagggaguu

SEQ ID NO: 222393 - RNA, 22 nt, Human
gcagcuuucugggacagaaagg

SEQ ID NO: 222394 - RNA, 22 nt, Human
cuuucugaaguuuaaguucuaa

SEQ ID NO: 222395 - RNA, 22 nt, Human
gucaggaugacaagugcuuuca

SEQ ID NO: 222396 - RNA, 22 nt, Human
ucuggcuagauugaugaguccc

SEQ ID NO: 222397 - RNA, 22 nt, Human
ugccaggcuuagagcaggggcu

SEQ ID NO: 222398 - RNA, 22 nt, Human
gcuccugcaggacccaggagac

SEQ ID NO: 222399 - RNA, 22 nt, Human
uuugaaagagcugauacaugaa

SEQ ID NO: 222400 - RNA, 22 nt, Human
cagucccacuagugccaauacc

SEQ ID NO: 222401 - RNA, 22 nt, Human
auuauuuauccucuuggucuau

SEQ ID NO: 222402 - RNA, 22 nt, Human
uggcucaggcuugaaaauagau

SEQ ID NO: 222403 - RNA, 22 nt, Human
cucagccccaauucuccccauu

SEQ ID NO: 222404 - RNA, 22 nt, Human
ggcuccagaaacuucaguccau

SEQ ID NO: 222405 - RNA, 22 nt, Human
gcacaauuauuuaugcaguaug

SEQ ID NO: 222406 - RNA, 22 nt, Human
ugcucuggacgcugagugguuu

SEQ ID NO: 222407 - RNA, 22 nt, Human
uuuuaaaggcagauuauggcuu

SEQ ID NO: 222408 - RNA, 22 nt, Human
aguuuggaagaauuuggucugu

SEQ ID NO: 222409 - RNA, 20 nt, Human
uauuuacaacuuagagccuc

SEQ ID NO: 222410 - RNA, 22 nt, Human
agcuccugcaccaggggccccu

SEQ ID NO: 222411 - RNA, 22 nt, Human
gcagcaucuguacauagacgcu

SEQ ID NO: 222412 - RNA, 22 nt, Human
aaagugcugagacagacuggga

SEQ ID NO: 222413 - RNA, 22 nt, Human
agggucuguuguuuguucugga

SEQ ID NO: 222414 - RNA, 22 nt, Human
aaguccagcagugcuuguugau

SEQ ID NO: 222415 - RNA, 22 nt, Human
ggccgcugcgccuccaaccgag

SEQ ID NO: 222416 - RNA, 22 nt, Human
cagagccucucagaggucagac

SEQ ID NO: 222417 - RNA, 22 nt, Human
ucucuucuuguguuuuccugcc

SEQ ID NO: 222418 - RNA, 19 nt, Human
ggacagucucagccucaug

SEQ ID NO: 222419 - RNA, 22 nt, Human
agcaguuauauuacucucaggu

SEQ ID NO: 222420 - RNA, 23 nt, Human
acuggacagaguggacgaggcug

SEQ ID NO: 222421 - RNA, 22 nt, Human
cuucccugagcuuucucaggcu

SEQ ID NO: 222422 - RNA, 22 nt, Human
agauauuaaucguacauaaggu

SEQ ID NO: 222423 - RNA, 20 nt, Human
uuuaucugugggaguggaga

SEQ ID NO: 222424 - RNA, 22 nt, Human
cccaaguuaauuuguagcugaa

SEQ ID NO: 222425 - RNA, 22 nt, Human
gcagaagcuguucgaaggccgc

SEQ ID NO: 222426 - RNA, 22 nt, Human
ugcagcugcugguggcugaaag

SEQ ID NO: 222427 - RNA, 22 nt, Human
ucacagaacaauguuuaguucu

SEQ ID NO: 222428 - RNA, 22 nt, Human
uacauucaacaugucacuaugu

SEQ ID NO: 222429 - RNA, 22 nt, Human
aucacauugccagugauuaccc

SEQ ID NO: 222430 - RNA, 19 nt, Human
agcccagcuuauuugucag

SEQ ID NO: 222431 - RNA, 22 nt, Human
gcucuggcagcugauauuagga

SEQ ID NO: 222432 - RNA, 20 nt, Human
agcucuuacuuugcagcagc

SEQ ID NO: 222433 - RNA, 19 nt, Human
acagcagggauuuuuggag

SEQ ID NO: 222434 - RNA, 22 nt, Human
auuugaagaaaguuuucuagau

SEQ ID NO: 222435 - RNA, 22 nt, Human
agcugccagaugacagugcuau

SEQ ID NO: 222436 - RNA, 22 nt, Human
aucauggaagccuaucuugaga

SEQ ID NO: 222437 - RNA, 22 nt, Human
auuucuuuucaagagggugcuu

SEQ ID NO: 222438 - RNA, 18 nt, Human
aaugaaauguacaccuuu

SEQ ID NO: 222439 - RNA, 22 nt, Human
ucuggcaggacaugcugaccau

SEQ ID NO: 222440 - RNA, 17 nt, Human
cauuuguugaucaguug

SEQ ID NO: 222441 - RNA, 22 nt, Human
ccagcugcagguguuccagaug

SEQ ID NO: 222442 - RNA, 22 nt, Human
ucccaggccauaaaacucagag

SEQ ID NO: 222443 - RNA, 22 nt, Human
aaagacuuuagguuagaggcau

SEQ ID NO: 222444 - RNA, 22 nt, Human
cauagaacagcuccuagcacau

SEQ ID NO: 222445 - RNA, 20 nt, Human
cugugccuccugcuaguccu

SEQ ID NO: 222446 - RNA, 19 nt, Human
cagcugccuuuucuuugca

SEQ ID NO: 222447 - RNA, 22 nt, Human
cuucuauucacuggucacaguu

SEQ ID NO: 222448 - RNA, 23 nt, Human
aggcccaacucugugagggcugc

SEQ ID NO: 222449 - RNA, 22 nt, Human
auaaauuuauaauuguuuccug

SEQ ID NO: 222450 - RNA, 16 nt, Human
caauacauggcauuuc

SEQ ID NO: 222451 - RNA, 22 nt, Human
uucucaguuucacugauaacag

SEQ ID NO: 222452 - RNA, 22 nt, Human
ucccagcccagguaugaugaua

SEQ ID NO: 222453 - RNA, 22 nt, Human
cagaugaacuaggcugcacuug

SEQ ID NO: 222454 - RNA, 22 nt, Human
uccaggcuuuggggcaggagcg

SEQ ID NO: 222455 - RNA, 22 nt, Human
guucaguuuugaaauguuaauu

SEQ ID NO: 222456 - RNA, 22 nt, Human
augggggcggcugaagcccagg

SEQ ID NO: 222457 - RNA, 22 nt, Human
auaauauaauccuacuucccau

SEQ ID NO: 222458 - RNA, 22 nt, Human
uagggcagcugcaucaggcacu

SEQ ID NO: 222459 - RNA, 22 nt, Human
aaguuucaugauguaauuauug

SEQ ID NO: 222460 - RNA, 22 nt, Human
uucaggaagugcugccuggugu

SEQ ID NO: 222461 - RNA, 22 nt, Human
ggagaggggcaaguuuaucuag

SEQ ID NO: 222462 - RNA, 22 nt, Human
agacaugccaagaaacccagug

SEQ ID NO: 222463 - RNA, 22 nt, Human
uuugcuuugggagguugucugg

SEQ ID NO: 222464 - RNA, 22 nt, Human
gaggagaaauuuggggaccuga

SEQ ID NO: 222465 - RNA, 22 nt, Human
uccugcaggccagaggggugag

SEQ ID NO: 222466 - RNA, 22 nt, Human
auuuucucucaaaccuuaaaau

SEQ ID NO: 222467 - RNA, 22 nt, Human
aaugaacaggugaaugucagau

SEQ ID NO: 222468 - RNA, 22 nt, Human
ugggccagcaauugcugcucag

SEQ ID NO: 222469 - RNA, 22 nt, Human
ucuauauuauacauccaggauu

SEQ ID NO: 222470 - RNA, 19 nt, Human
guguggcagagagugacca

SEQ ID NO: 222471 - RNA, 22 nt, Human
ucuuugaaaagggagauagaaa

SEQ ID NO: 222472 - RNA, 22 nt, Human
uucacauuagugguucuauaua

SEQ ID NO: 222473 - RNA, 22 nt, Human
gacagggaggagcagagcuucu

SEQ ID NO: 222474 - RNA, 23 nt, Human
gcucuggcagcuugugucagcac

SEQ ID NO: 222475 - RNA, 22 nt, Human
ucuagaaagccaaauuaggaau

SEQ ID NO: 222476 - RNA, 22 nt, Human
aacaaauuuagcucugagugcu

SEQ ID NO: 222477 - RNA, 19 nt, Human
ugagggacauugggagcag

SEQ ID NO: 222478 - RNA, 22 nt, Human
agguagaucaacuggggaggga

SEQ ID NO: 222479 - RNA, 22 nt, Human
aagaggaagucuccauggagag

SEQ ID NO: 222480 - RNA, 22 nt, Human
ccucagaccccugcugagcuuc

SEQ ID NO: 222481 - RNA, 22 nt, Human
aggccacagucagugggugcug

SEQ ID NO: 222482 - RNA, 22 nt, Human
uuucucaguuacuagcuguggu

SEQ ID NO: 222483 - RNA, 20 nt, Human
gcagcagugcaaguccucuu

SEQ ID NO: 222484 - RNA, 22 nt, Human
augguuuaguuagggcuuuuca

SEQ ID NO: 222485 - RNA, 22 nt, Human
gugcaaaaauaauugugguuuu

SEQ ID NO: 222486 - RNA, 22 nt, Human
ccuuccagauguaagagcugau

SEQ ID NO: 222487 - RNA, 22 nt, Human
uauggaaauaauuagacaagug

SEQ ID NO: 222488 - RNA, 22 nt, Human
cuccagaauuguccauuggaaa

SEQ ID NO: 222489 - RNA, 23 nt, Human
cagugggaggacugagauaaaac

SEQ ID NO: 222490 - RNA, 22 nt, Human
uccaaaaaacguuugaauaguu

SEQ ID NO: 222491 - RNA, 22 nt, Human
aagucuuuuguucaggcuggca

SEQ ID NO: 222492 - RNA, 22 nt, Human
aagggcugaucucacuuucuuu

SEQ ID NO: 222493 - RNA, 22 nt, Human
cacagcauaaugaaauauacuu

SEQ ID NO: 222494 - RNA, 22 nt, Human
auuggcuccuucuaacaugucu

SEQ ID NO: 222495 - RNA, 22 nt, Human
ccugcaguuuguugugaccccg

SEQ ID NO: 222496 - RNA, 22 nt, Human
gaaacagcacguuuggagagau

SEQ ID NO: 222497 - RNA, 22 nt, Human
aaaaaguauuggccaugguuga

SEQ ID NO: 222498 - RNA, 22 nt, Human
cagaaguuccuauuuaccuccu

SEQ ID NO: 222499 - RNA, 22 nt, Human
auuuccaaaaccacuuauugcc

SEQ ID NO: 222500 - RNA, 22 nt, Human
agcugcacugugaaguucauag

SEQ ID NO: 222501 - RNA, 22 nt, Human
ccuucaaucagcagucuagcuu

SEQ ID NO: 222502 - RNA, 22 nt, Human
acuuccuuguacugacuccauu

SEQ ID NO: 222503 - RNA, 18 nt, Human
ggacacagauagguacag

SEQ ID NO: 222504 - RNA, 22 nt, Human
uuucaaauagaaucuuuccaaa

SEQ ID NO: 222505 - RNA, 22 nt, Human
acggggcuagagaagguuucuu

SEQ ID NO: 222506 - RNA, 22 nt, Human
aaaauugagagucuugugcaag

SEQ ID NO: 222507 - RNA, 22 nt, Human
uaucacuacacuucagcuuuaa

SEQ ID NO: 222508 - RNA, 22 nt, Human
cugcaaucuccaugcuugauuu

SEQ ID NO: 222509 - RNA, 22 nt, Human
aaaacaguuuuugcuaacugcu

SEQ ID NO: 222510 - RNA, 22 nt, Human
ugagaauuuuuugucaugcauu

SEQ ID NO: 222511 - RNA, 22 nt, Human
aggcucuggaguguggugcugg

SEQ ID NO: 222512 - RNA, 22 nt, Human
aaaucuuucccuuuacuaucca

SEQ ID NO: 222513 - RNA, 22 nt, Human
uaucuagaaauuucuuuuguug

SEQ ID NO: 222514 - RNA, 22 nt, Human
uaaagcuguuagaguaguaaga

SEQ ID NO: 222515 - RNA, 22 nt, Human
augcugaaaauuggauuugaau

SEQ ID NO: 222516 - RNA, 22 nt, Human
uagguucacugucuugaggagc

SEQ ID NO: 222517 - RNA, 22 nt, Human
gugaauuaggcuauggcagagg

SEQ ID NO: 222518 - RNA, 22 nt, Human
gugcagggcuggcaccggaggc

SEQ ID NO: 222519 - RNA, 22 nt, Human
cugagggagggacuuugagacu

SEQ ID NO: 222520 - RNA, 22 nt, Human
aacacuguaacagcaucauuuu

SEQ ID NO: 222521 - RNA, 22 nt, Human
agaacguggaauguggcuccuu

SEQ ID NO: 222522 - RNA, 18 nt, Human
ggcaccucucuugccuua

SEQ ID NO: 222523 - RNA, 22 nt, Human
agaguccagaaaacagugugcu

SEQ ID NO: 222524 - RNA, 22 nt, Human
agcggucaggagaaauaagcau

SEQ ID NO: 222525 - RNA, 22 nt, Human
gaacaguaaauuuaugcagcac

SEQ ID NO: 222526 - RNA, 22 nt, Human
aggcuucuguuucuuaaaggug

SEQ ID NO: 222527 - RNA, 19 nt, Human
uccuuucuguuccugagau

SEQ ID NO: 222528 - RNA, 22 nt, Human
cagaggaaaugggaaggagaua

SEQ ID NO: 222529 - RNA, 22 nt, Human
uuaccuguguguuugauacaua

SEQ ID NO: 222530 - RNA, 22 nt, Human
gaggaaaauaacaacuaagggc

SEQ ID NO: 222531 - RNA, 22 nt, Human
agagugggccucugagucccag

SEQ ID NO: 222532 - RNA, 22 nt, Human
guauucuuauacucagugagcu

SEQ ID NO: 222533 - RNA, 22 nt, Human
aggcaguggcugagaccagggg

SEQ ID NO: 222534 - RNA, 22 nt, Human
cccugcagagaccacugaccuu

SEQ ID NO: 222535 - RNA, 22 nt, Human
ugaggcaacagaaagggccaau

SEQ ID NO: 222536 - RNA, 22 nt, Human
uggccaccccuuucucugcacu

SEQ ID NO: 222537 - RNA, 22 nt, Human
caguguggagggagagagccug

SEQ ID NO: 222538 - RNA, 17 nt, Human
cugaggagaacagaaag

SEQ ID NO: 222539 - RNA, 22 nt, Human
uagggcuguuuaaaagugaggu

SEQ ID NO: 222540 - RNA, 22 nt, Human
ugagcuuucauguaugaaaaga

SEQ ID NO: 222541 - RNA, 21 nt, Human
aggccaaguuggauuucuuca

SEQ ID NO: 222542 - RNA, 22 nt, Human
uuuuaccugaaccacacaguau

SEQ ID NO: 222543 - RNA, 22 nt, Human
ccaggucuuggcccccggaccu

SEQ ID NO: 222544 - RNA, 22 nt, Human
uaugcuaaauauguucacauug

SEQ ID NO: 222545 - RNA, 22 nt, Human
auggcuucgaguauauacauag

SEQ ID NO: 222546 - RNA, 22 nt, Human
cauguuaaugaauuuuugcagu

SEQ ID NO: 222547 - RNA, 18 nt, Human
cccagcuuagcgccccuc

SEQ ID NO: 222548 - RNA, 22 nt, Human
ggcaguggcauguggguagugg

SEQ ID NO: 222549 - RNA, 22 nt, Human
gcagcaguaggaaauaacacag

SEQ ID NO: 222550 - RNA, 22 nt, Human
cccugagaugccucacccuagu

SEQ ID NO: 222551 - RNA, 22 nt, Human
acaucuucacugguuucuggaa

SEQ ID NO: 222552 - RNA, 22 nt, Human
gcuggcucugcacccaggccuc

SEQ ID NO: 222553 - RNA, 23 nt, Human
uucugucuugcugucagcuuucu

SEQ ID NO: 222554 - RNA, 22 nt, Human
aggcacaggccucagcacccag

SEQ ID NO: 222555 - RNA, 22 nt, Human
cuugcacacauguacaugugua

SEQ ID NO: 222556 - RNA, 22 nt, Human
cugggagagccuuuccugaguc

SEQ ID NO: 222557 - RNA, 22 nt, Human
ugagucacuaucacuuucucug

SEQ ID NO: 222558 - RNA, 22 nt, Human
guacuucuggccaggcuggcca

SEQ ID NO: 222559 - RNA, 22 nt, Human
ggguaggccagaagggccugga

SEQ ID NO: 222560 - RNA, 22 nt, Human
ugugcuuucaaaguuaaguaaa

SEQ ID NO: 222561 - RNA, 22 nt, Human
aggaccauccuaagguaggcaa

SEQ ID NO: 222562 - RNA, 22 nt, Human
cugaggcaggauggccuggcug

SEQ ID NO: 222563 - RNA, 22 nt, Human
ugccuucaaucaggauggucuc

SEQ ID NO: 222564 - RNA, 22 nt, Human
cacaucuacugaaugagcagug

SEQ ID NO: 222565 - RNA, 22 nt, Human
uagaggcaaccaguguugagaa

SEQ ID NO: 222566 - RNA, 22 nt, Human
gaguccuuccagcaggcauuua

SEQ ID NO: 222567 - RNA, 22 nt, Human
aaauggaaguguauuuaguguu

SEQ ID NO: 222568 - RNA, 22 nt, Human
cuguuuucccuggaguucagca

SEQ ID NO: 222569 - RNA, 23 nt, Human
cauccaggagcugagucugacug

SEQ ID NO: 222570 - RNA, 22 nt, Human
ggccuggcauggggacuaaggg

SEQ ID NO: 222571 - RNA, 17 nt, Human
ccaggagcgugggucuc

SEQ ID NO: 222572 - RNA, 22 nt, Human
ugcagauucaaaugaaaugcaa

SEQ ID NO: 222573 - RNA, 22 nt, Human
agcuccagaagccugcaaggua

SEQ ID NO: 222574 - RNA, 20 nt, Human
agugcaagaaagcacagcug

SEQ ID NO: 222575 - RNA, 22 nt, Human
gugaaaagagagccugugucag

SEQ ID NO: 222576 - RNA, 22 nt, Human
ucuggcuguuaggccugaccuu

SEQ ID NO: 222577 - RNA, 20 nt, Human
agugacugggagaauggauu

SEQ ID NO: 222578 - RNA, 23 nt, Human
ccuguggcaaguagaugagauga

SEQ ID NO: 222579 - RNA, 22 nt, Human
auacuucuggugacaaagucuu

SEQ ID NO: 222580 - RNA, 22 nt, Human
uuugaguagugagacuaggcag

SEQ ID NO: 222581 - RNA, 22 nt, Human
uccugcagccauuagaggucaa

SEQ ID NO: 222582 - RNA, 22 nt, Human
aggcuccacggucacuggcucu

SEQ ID NO: 222583 - RNA, 22 nt, Human
cacagguucaaauucaggucgc

SEQ ID NO: 222584 - RNA, 22 nt, Human
aagcaaagugcuuugccuccag

SEQ ID NO: 222585 - RNA, 22 nt, Human
uucuuaaaacuuauggacaggu

SEQ ID NO: 222586 - RNA, 22 nt, Human
cuuucuaguaggaaguagauca

SEQ ID NO: 222587 - RNA, 22 nt, Human
gcuggcagacugggggcagaac

SEQ ID NO: 222588 - RNA, 22 nt, Human
ccagcuggucugugcucauguu

SEQ ID NO: 222589 - RNA, 22 nt, Human
uacacaucacuguaucuuucag

SEQ ID NO: 222590 - RNA, 22 nt, Human
cuuuaguuuaagaacaugauga

SEQ ID NO: 222591 - RNA, 22 nt, Human
auaaggcaagcugucaguuugu

SEQ ID NO: 222592 - RNA, 22 nt, Human
uccagugcaauggcucauucau

SEQ ID NO: 222593 - RNA, 22 nt, Human
ccucaggauccgcaggugcagu

SEQ ID NO: 222594 - RNA, 22 nt, Human
gcaccugguuuauauaaucaua

SEQ ID NO: 222595 - RNA, 22 nt, Human
ggccagaaguuggaaaagagcc

SEQ ID NO: 222596 - RNA, 22 nt, Human
cagcagagcuuauguuggguca

SEQ ID NO: 222597 - RNA, 22 nt, Human
agcaggcuaagggaccuguuua

SEQ ID NO: 222598 - RNA, 22 nt, Human
gccucaggccuauagcugcugu

SEQ ID NO: 222599 - RNA, 23 nt, Human
cagcccuggagaugugggaggca

SEQ ID NO: 222600 - RNA, 16 nt, Human
cagcuuuaugucagug

SEQ ID NO: 222601 - RNA, 22 nt, Human
cuugaauguaaauaauguacag

SEQ ID NO: 222602 - RNA, 23 nt, Human
cuagaugcaagcuccaugaggga

SEQ ID NO: 222603 - RNA, 22 nt, Human
gacaauuucucaauauagaaac

SEQ ID NO: 222604 - RNA, 22 nt, Human
ucagcaggugaacaucaugcca

SEQ ID NO: 222605 - RNA, 22 nt, Human
cugaaggagaaggccacuguuc

SEQ ID NO: 222606 - RNA, 16 nt, Human
gagaagagcccggcag

SEQ ID NO: 222607 - RNA, 22 nt, Human
aguggcaucaaaucaagguuug

SEQ ID NO: 222608 - RNA, 21 nt, Human
aaacuagcagcaaccaugauc

SEQ ID NO: 222609 - RNA, 22 nt, Human
ugcaggcucugugugugccugg

SEQ ID NO: 222610 - RNA, 22 nt, Human
uauuuccuguggauacuuuuag

SEQ ID NO: 222611 - RNA, 22 nt, Human
aaauccaacgacagguguacuu

SEQ ID NO: 222612 - RNA, 22 nt, Human
uggcugucagcugccuggugcg

SEQ ID NO: 222613 - RNA, 22 nt, Human
uauacacauauacguuugugug

SEQ ID NO: 222614 - RNA, 22 nt, Human
gaggcugagacucugaauuuuu

SEQ ID NO: 222615 - RNA, 22 nt, Human
ugggcucugugccagguuggug

SEQ ID NO: 222616 - RNA, 22 nt, Human
auuacagaaauauggucaaaga

SEQ ID NO: 222617 - RNA, 22 nt, Human
ccagugcacaauggaacaacuc

SEQ ID NO: 222618 - RNA, 21 nt, Human
uacaagauagagguaauauau

SEQ ID NO: 222619 - RNA, 23 nt, Human
aggcccagguauguuuguuuugg

SEQ ID NO: 222620 - RNA, 22 nt, Human
ccucuggcauagcaaguggccu

SEQ ID NO: 222621 - RNA, 22 nt, Human
gcugcuguugauuuaguccaau

SEQ ID NO: 222622 - RNA, 19 nt, Human
ggcaccuuggcuaugccug

SEQ ID NO: 222623 - RNA, 22 nt, Human
ucucuguggagcaguguguuca

SEQ ID NO: 222624 - RNA, 22 nt, Human
uggggaagggcacccuggagac

SEQ ID NO: 222625 - RNA, 22 nt, Human
gcuucugcgccuagccucaggu

SEQ ID NO: 222626 - RNA, 21 nt, Human
cucaggcuggcagcaggcuag

SEQ ID NO: 222627 - RNA, 22 nt, Human
gcccugagaagaagucggaggg

SEQ ID NO: 222628 - RNA, 22 nt, Human
caggcugccgugggguccaggc

SEQ ID NO: 222629 - RNA, 22 nt, Human
guagggacaauauguuauuaga

SEQ ID NO: 222630 - RNA, 22 nt, Human
uuugguaaguacccaccugggu

SEQ ID NO: 222631 - RNA, 22 nt, Human
caugcuaaccagagacauaaag

SEQ ID NO: 222632 - RNA, 22 nt, Human
uuuagcagugaagugaagugaa

SEQ ID NO: 222633 - RNA, 16 nt, Human
gcagguggggcgcgca

SEQ ID NO: 222634 - RNA, 22 nt, Human
uucaguuucaaauccugugaag

SEQ ID NO: 222635 - RNA, 16 nt, Human
guuccuucccacaccu

SEQ ID NO: 222636 - RNA, 22 nt, Human
cacaccagagguuaccugcaaa

SEQ ID NO: 222637 - RNA, 22 nt, Human
gguccaugauaggaaguuccga

SEQ ID NO: 222638 - RNA, 23 nt, Human
uucauuuaggaguucauaagagc

SEQ ID NO: 222639 - RNA, 22 nt, Human
cagaggcugaugugggaugggc

SEQ ID NO: 222640 - RNA, 22 nt, Human
auccuucuucugcuagugucua

SEQ ID NO: 222641 - RNA, 22 nt, Human
augauucucauuuuauaaacuu

SEQ ID NO: 222642 - RNA, 22 nt, Human
gcccaggcuagcguagagugca

SEQ ID NO: 222643 - RNA, 22 nt, Human
ggcucagaaaccucuggugucu

SEQ ID NO: 222644 - RNA, 22 nt, Human
aaagcagauucugaugcaguag

SEQ ID NO: 222645 - RNA, 21 nt, Human
aacaugauauguguauggauu

SEQ ID NO: 222646 - RNA, 22 nt, Human
uuagaucauuuuagcuaaaugg

SEQ ID NO: 222647 - RNA, 22 nt, Human
gaaauucugugucccagagugc

SEQ ID NO: 222648 - RNA, 22 nt, Human
cugcacaguggguggggcguca

SEQ ID NO: 222649 - RNA, 22 nt, Human
cccugccucugaagcugcucag

SEQ ID NO: 222650 - RNA, 22 nt, Human
guagaaauauuuaucucugaga

SEQ ID NO: 222651 - RNA, 22 nt, Human
uacaagugugcaccaccauguc

SEQ ID NO: 222652 - RNA, 22 nt, Human
acuuucuauucccacagagaua

SEQ ID NO: 222653 - RNA, 22 nt, Human
cuguagcagacagacccuaggu

SEQ ID NO: 222654 - RNA, 22 nt, Human
ggaagcucuguggcuuggaguc

SEQ ID NO: 222655 - RNA, 22 nt, Human
gggacaugccccucagugggug

SEQ ID NO: 222656 - RNA, 22 nt, Human
gccgggaccaaggccacggagc

SEQ ID NO: 222657 - RNA, 22 nt, Human
ccauggagcgggugagugagug

SEQ ID NO: 222658 - RNA, 22 nt, Human
ucucuggcagggauaucuggcu

SEQ ID NO: 222659 - RNA, 22 nt, Human
ggcaggcaggagcucugucucc

SEQ ID NO: 222660 - RNA, 22 nt, Human
ucccugggccacagcugugagc

SEQ ID NO: 222661 - RNA, 22 nt, Human
cuccuggggccauggaaggaac

SEQ ID NO: 222662 - RNA, 22 nt, Human
uuuuauucucaagacaauggga

SEQ ID NO: 222663 - RNA, 22 nt, Human
uggcucaguuuagcagcucagu

SEQ ID NO: 222664 - RNA, 22 nt, Human
auacaugaggcucauuuauguc

SEQ ID NO: 222665 - RNA, 22 nt, Human
agguccaguuuucugacaaggg

SEQ ID NO: 222666 - RNA, 20 nt, Human
aggguggcaaguuagugaca

SEQ ID NO: 222667 - RNA, 22 nt, Human
uauuuucuggacagucuugcuu

SEQ ID NO: 222668 - RNA, 22 nt, Human
uugaacauuggcaauuucauau

SEQ ID NO: 222669 - RNA, 23 nt, Human
auguuaaacauaacugaagagcc

SEQ ID NO: 222670 - RNA, 22 nt, Human
aagcagagcaagcguauuuauu

SEQ ID NO: 222671 - RNA, 22 nt, Human
uagaaacacagaucugguguca

SEQ ID NO: 222672 - RNA, 22 nt, Human
ugccugguauuugaauaaagag

SEQ ID NO: 222673 - RNA, 22 nt, Human
ccauguguugagauuccagccu

SEQ ID NO: 222674 - RNA, 22 nt, Human
augaggcaggagugcaguggca

SEQ ID NO: 222675 - RNA, 19 nt, Human
cugguuuagguagugaguc

SEQ ID NO: 222676 - RNA, 22 nt, Human
ucuaacuuguauguauaguuuu

SEQ ID NO: 222677 - RNA, 22 nt, Human
gucuagaauugcuuggcagaug

SEQ ID NO: 222678 - RNA, 22 nt, Human
ccucaaaggccuggcaccagaa

SEQ ID NO: 222679 - RNA, 22 nt, Human
ccauggcuaaguaucuguagaa

SEQ ID NO: 222680 - RNA, 22 nt, Human
augaggugauggacauauuaac

SEQ ID NO: 222681 - RNA, 21 nt, Human
ugccagggauuuacagagccu

SEQ ID NO: 222682 - RNA, 22 nt, Human
cucaggaugcaauuccaucaag

SEQ ID NO: 222683 - RNA, 22 nt, Human
cccugcaguccuuucuuggcuc

SEQ ID NO: 222684 - RNA, 22 nt, Human
aaacaaguguaaacuagucugu

SEQ ID NO: 222685 - RNA, 22 nt, Human
gccuggcacaggaauuaggagg

SEQ ID NO: 222686 - RNA, 22 nt, Human
cucugcacccccggcuccucgu

SEQ ID NO: 222687 - RNA, 18 nt, Human
cuguugagauguggcuga

SEQ ID NO: 222688 - RNA, 22 nt, Human
uccugucugcucacagagcugg

SEQ ID NO: 222689 - RNA, 22 nt, Human
ugggccaguuucucauugaaau

SEQ ID NO: 222690 - RNA, 22 nt, Human
uuuaaauguguucuuaguagcu

SEQ ID NO: 222691 - RNA, 23 nt, Human
ugagaucuuuguaguaucaauga

SEQ ID NO: 222692 - RNA, 22 nt, Human
uccugggcgagguacuggggcu

SEQ ID NO: 222693 - RNA, 22 nt, Human
uccauuuucuaaguaucacuua

SEQ ID NO: 222694 - RNA, 22 nt, Human
gagcuggucgaaaugggcugac

SEQ ID NO: 222695 - RNA, 19 nt, Human
uucuaccuuacuguaggcu

SEQ ID NO: 222696 - RNA, 21 nt, Human
ccaggcagagcugugaguucu

SEQ ID NO: 222697 - RNA, 22 nt, Human
uaauuuuacuuccugagcaccu

SEQ ID NO: 222698 - RNA, 22 nt, Human
uggcaaagacugcaaggacuuu

SEQ ID NO: 222699 - RNA, 22 nt, Human
aaaauuacuauuguuccugggc

SEQ ID NO: 222700 - RNA, 22 nt, Human
uggagcaggacggggaguggua

SEQ ID NO: 222701 - RNA, 22 nt, Human
uuagcucagaaaauuuaaacuu

SEQ ID NO: 222702 - RNA, 22 nt, Human
guuuacauuaaguauuagcauc

SEQ ID NO: 222703 - RNA, 22 nt, Human
augaggucuggcaaucagaaac

SEQ ID NO: 222704 - RNA, 22 nt, Human
agagcagauggagcuggaagag

SEQ ID NO: 222705 - RNA, 22 nt, Human
gacagcagcauguuuacaggcc

SEQ ID NO: 222706 - RNA, 22 nt, Human
aggcagaugugauuaauuuccu

SEQ ID NO: 222707 - RNA, 22 nt, Human
ccugugggagcccaggcagaua

SEQ ID NO: 222708 - RNA, 22 nt, Human
uagaauaaguugaugauauaug

SEQ ID NO: 222709 - RNA, 22 nt, Human
uccugucuaaagaccugcaggc

SEQ ID NO: 222710 - RNA, 22 nt, Human
uuguucaggccugggacaguuu

SEQ ID NO: 222711 - RNA, 22 nt, Human
gcagggcugggugggagacaga

SEQ ID NO: 222712 - RNA, 22 nt, Human
agacaggugcucgcccaagucc

SEQ ID NO: 222713 - RNA, 22 nt, Human
cauuacaucuuugaugcaguau

SEQ ID NO: 222714 - RNA, 22 nt, Human
uaacugguuuggcucagggucu

SEQ ID NO: 222715 - RNA, 23 nt, Human
ccagggagugcuacuaucaagcc

SEQ ID NO: 222716 - RNA, 22 nt, Human
uugaaugaauuugagcagagau

SEQ ID NO: 222717 - RNA, 22 nt, Human
agucaguucauggcucuguccu

SEQ ID NO: 222718 - RNA, 22 nt, Human
uaucuaaaggauuuaauuuagu

SEQ ID NO: 222719 - RNA, 22 nt, Human
uaguccugaccuugccaccagc

SEQ ID NO: 222720 - RNA, 22 nt, Human
acagaagugacaauuucuuggg

SEQ ID NO: 222721 - RNA, 22 nt, Human
auaguacaagggaagagugaag

SEQ ID NO: 222722 - RNA, 22 nt, Human
ggcgcaggccuuggauccuggu

SEQ ID NO: 222723 - RNA, 22 nt, Human
aaaggcuuuaaagaaccagaac

SEQ ID NO: 222724 - RNA, 22 nt, Human
caggaaagggaugggcugccac

SEQ ID NO: 222725 - RNA, 22 nt, Human
cuguacauauacauuuuuuucc

SEQ ID NO: 222726 - RNA, 22 nt, Human
gcccuggagggccagcgacugg

SEQ ID NO: 222727 - RNA, 22 nt, Human
accauuugacucucuaaggaua

SEQ ID NO: 222728 - RNA, 22 nt, Human
augcaugugcauggcucuaucu

SEQ ID NO: 222729 - RNA, 22 nt, Human
gugcccagugcaggcccgcagg

SEQ ID NO: 222730 - RNA, 19 nt, Human
caagauuuguucacacaug

SEQ ID NO: 222731 - RNA, 22 nt, Human
auguccuuccugagaucccugu

SEQ ID NO: 222732 - RNA, 22 nt, Human
uuggagucagaugacuguagga

SEQ ID NO: 222733 - RNA, 22 nt, Human
ccuggccuuaagggcagggagc

SEQ ID NO: 222734 - RNA, 22 nt, Human
ccuccagcugccucagucucuu

SEQ ID NO: 222735 - RNA, 22 nt, Human
uucugauucaugauccaguucu

SEQ ID NO: 222736 - RNA, 22 nt, Human
cuagggaaugagagacuggauc

SEQ ID NO: 222737 - RNA, 22 nt, Human
uguaagaauaaugauuucuaag

SEQ ID NO: 222738 - RNA, 22 nt, Human
ucuguggaagauuccaggcguu

SEQ ID NO: 222739 - RNA, 22 nt, Human
acugugcaggggaagagagaaa

SEQ ID NO: 222740 - RNA, 22 nt, Human
agagacacaucauauaaguaua

SEQ ID NO: 222741 - RNA, 22 nt, Human
gcaagcuggcuguuagaggaug

SEQ ID NO: 222742 - RNA, 22 nt, Human
ucugagaaaauaggaaacuuga

SEQ ID NO: 222743 - RNA, 22 nt, Human
ccugccuucccagcuuggcuuu

SEQ ID NO: 222744 - RNA, 22 nt, Human
cuuuuuguguaugcuacaguug

SEQ ID NO: 222745 - RNA, 22 nt, Human
agccucaguuucaggccuccuc

SEQ ID NO: 222746 - RNA, 22 nt, Human
agcccugcaggaggugggagag

SEQ ID NO: 222747 - RNA, 22 nt, Human
auaauguagguauguguauuua

SEQ ID NO: 222748 - RNA, 22 nt, Human
cacccagcuuuugcauccuccg

SEQ ID NO: 222749 - RNA, 20 nt, Human
ggcuucuucaggugucuauu

SEQ ID NO: 222750 - RNA, 22 nt, Human
ucugcccucaggguaaugauca

SEQ ID NO: 222751 - RNA, 22 nt, Human
gcuucucuuaaugccuggcuuu

SEQ ID NO: 222752 - RNA, 22 nt, Human
gggcugacaccacccaggcgca

SEQ ID NO: 222753 - RNA, 22 nt, Human
ucuauuuucuugccaaaacugc

SEQ ID NO: 222754 - RNA, 22 nt, Human
aguggcaguuugggagcuacag

SEQ ID NO: 222755 - RNA, 22 nt, Human
ccugcucagccccagcucaccc

SEQ ID NO: 222756 - RNA, 22 nt, Human
aggcuccugcaggccuuguagg

SEQ ID NO: 222757 - RNA, 21 nt, Human
ggccucugccuugccccacuc

SEQ ID NO: 222758 - RNA, 19 nt, Human
ucucagaauuaagagugcu

SEQ ID NO: 222759 - RNA, 22 nt, Human
gguggaaggccuggaaggaggc

SEQ ID NO: 222760 - RNA, 22 nt, Human
auuuccuguugcuuuugccacu

SEQ ID NO: 222761 - RNA, 22 nt, Human
gcacaggucaggagaugagauu

SEQ ID NO: 222762 - RNA, 22 nt, Human
ugcaauaauguaugucacuccc

SEQ ID NO: 222763 - RNA, 22 nt, Human
ggcucagaaacuaaaggcgcug

SEQ ID NO: 222764 - RNA, 22 nt, Human
agggaggaaggaacuccuucua

SEQ ID NO: 222765 - RNA, 22 nt, Human
ucugagcuuuagcugggauuuu

SEQ ID NO: 222766 - RNA, 22 nt, Human
cuacuucuugaucugucgaccu

SEQ ID NO: 222767 - RNA, 22 nt, Human
uagucagacccaagagagccau

SEQ ID NO: 222768 - RNA, 22 nt, Human
ugcuuugugauaugcugugucu

SEQ ID NO: 222769 - RNA, 22 nt, Human
ccacgacgagucaucagggcga

SEQ ID NO: 222770 - RNA, 22 nt, Human
aaaagagaauccuguacagaga

SEQ ID NO: 222771 - RNA, 22 nt, Human
ugcuuuauggauuuguguccug

SEQ ID NO: 222772 - RNA, 22 nt, Human
gccuccuggccuuugcuccuca

SEQ ID NO: 222773 - RNA, 22 nt, Human
uacaagaaggaaaacuagcaau

SEQ ID NO: 222774 - RNA, 22 nt, Human
ugagaaggaaacaauggcuuuu

SEQ ID NO: 222775 - RNA, 22 nt, Human
agugugagggguucuuugauau

SEQ ID NO: 222776 - RNA, 22 nt, Human
uuucccaguuagugaagacaug

SEQ ID NO: 222777 - RNA, 22 nt, Human
gcagcucccuugaacuucuccu

SEQ ID NO: 222778 - RNA, 22 nt, Human
gcagagcuguuaauggagcuga

SEQ ID NO: 222779 - RNA, 20 nt, Human
uuccagccgccacuuccgcc

SEQ ID NO: 222780 - RNA, 22 nt, Human
ccaaacaaauccccauucuuag

SEQ ID NO: 222781 - RNA, 22 nt, Human
guguuacugacacauuuuuguc

SEQ ID NO: 222782 - RNA, 22 nt, Human
ccagguggacggcgaguacagg

SEQ ID NO: 222783 - RNA, 22 nt, Human
gaggaagaaagcauaggugggg

SEQ ID NO: 222784 - RNA, 22 nt, Human
gcaggcagucaucuuucauauu

SEQ ID NO: 222785 - RNA, 22 nt, Human
caggacaauggucauacuggau

SEQ ID NO: 222786 - RNA, 17 nt, Human
uccuggauccauggugg

SEQ ID NO: 222787 - RNA, 22 nt, Human
agggccagcacuccuggcagga

SEQ ID NO: 222788 - RNA, 22 nt, Human
cuuuguuacugauuucaguggg

SEQ ID NO: 222789 - RNA, 22 nt, Human
gcuggaggcuggagugcagugg

SEQ ID NO: 222790 - RNA, 22 nt, Human
aucuaagauuuugcuaagauca

SEQ ID NO: 222791 - RNA, 22 nt, Human
gcagguggauauugcuacuuga

SEQ ID NO: 222792 - RNA, 22 nt, Human
ucaggagccugaaagaggucua

SEQ ID NO: 222793 - RNA, 22 nt, Human
uucccauuugugguagugaauu

SEQ ID NO: 222794 - RNA, 22 nt, Human
ugcuggcuggagugccucugga

SEQ ID NO: 222795 - RNA, 22 nt, Human
ccaggaguuggaagcugccaug

SEQ ID NO: 222796 - RNA, 22 nt, Human
aaaggccuugagcugggugcca

SEQ ID NO: 222797 - RNA, 22 nt, Human
aaguuugagagccuuuaguaua

SEQ ID NO: 222798 - RNA, 22 nt, Human
aagacaccauuugacaguggca

SEQ ID NO: 222799 - RNA, 22 nt, Human
acuggggaauggaacugggaau

SEQ ID NO: 222800 - RNA, 22 nt, Human
agcccuggguuagggugggagc

SEQ ID NO: 222801 - RNA, 22 nt, Human
gagagaaaugugcaguuugggc

SEQ ID NO: 222802 - RNA, 22 nt, Human
aggugcagaaaaaaguccuuua

SEQ ID NO: 222803 - RNA, 22 nt, Human
augcaggaguuggaaaaaauga

SEQ ID NO: 222804 - RNA, 22 nt, Human
uguccuauuucucugugcauga

SEQ ID NO: 222805 - RNA, 22 nt, Human
uuacaacacuacuuauccuuga

SEQ ID NO: 222806 - RNA, 22 nt, Human
caguccugcuggccuucccugg

SEQ ID NO: 222807 - RNA, 22 nt, Human
uccaggaaaaggcuugcagggg

SEQ ID NO: 222808 - RNA, 23 nt, Human
uagagcaguagaucaccauggga

SEQ ID NO: 222809 - RNA, 22 nt, Human
uugcagcuucaagcagguugac

SEQ ID NO: 222810 - RNA, 22 nt, Human
cagaugaggacagaugacuggg

SEQ ID NO: 222811 - RNA, 20 nt, Human
cugaagagacuggaggggca

SEQ ID NO: 222812 - RNA, 22 nt, Human
cgagagauggguuggcaggggc

SEQ ID NO: 222813 - RNA, 22 nt, Human
ugccuucaccaggccuucagcc

SEQ ID NO: 222814 - RNA, 16 nt, Human
ugggugggaggagcgg

SEQ ID NO: 222815 - RNA, 22 nt, Human
cauaucauuugcuuauaaaucu

SEQ ID NO: 222816 - RNA, 22 nt, Human
cagauucuucauucauucuaca

SEQ ID NO: 222817 - RNA, 22 nt, Human
aagggcugccagggggugccag

SEQ ID NO: 222818 - RNA, 21 nt, Human
auacacauacacauaaaugug

SEQ ID NO: 222819 - RNA, 22 nt, Human
agaagcacaccaguagacaggg

SEQ ID NO: 222820 - RNA, 22 nt, Human
uaguuacaaaccaacaggcagc

SEQ ID NO: 222821 - RNA, 22 nt, Human
ggccagggaggagaggccccug

SEQ ID NO: 222822 - RNA, 22 nt, Human
ggaggcacaccucagacuggga

SEQ ID NO: 222823 - RNA, 22 nt, Human
acaaguuucauuguuuagaacc

SEQ ID NO: 222824 - RNA, 22 nt, Human
aaagcaaugcuuguggaaugua

SEQ ID NO: 222825 - RNA, 23 nt, Human
ugucuggcucauggugggucuca

SEQ ID NO: 222826 - RNA, 22 nt, Human
aauucaugaguagaaucuauau

SEQ ID NO: 222827 - RNA, 22 nt, Human
cagccccucacagagcuguccu

SEQ ID NO: 222828 - RNA, 20 nt, Human
aaagcauuuacuugugauug

SEQ ID NO: 222829 - RNA, 22 nt, Human
cacugagagaugugucacagca

SEQ ID NO: 222830 - RNA, 22 nt, Human
uugcagcugcaguaaauguuca

SEQ ID NO: 222831 - RNA, 21 nt, Human
uaucaagauguuaugguugaa

SEQ ID NO: 222832 - RNA, 22 nt, Human
cuuuacuucagcaagcuuuccu

SEQ ID NO: 222833 - RNA, 19 nt, Human
acuagcacccagguaaaug

SEQ ID NO: 222834 - RNA, 22 nt, Human
uuggccuuugucaucaagauca

SEQ ID NO: 222835 - RNA, 22 nt, Human
aguguuaguggcugcagcuggu

SEQ ID NO: 222836 - RNA, 22 nt, Human
ggaagagaauuucucucuuuuu

SEQ ID NO: 222837 - RNA, 22 nt, Human
aggcugaggcuuuccuuggaga

SEQ ID NO: 222838 - RNA, 22 nt, Human
cuccuccacuaggcaaaaugug

SEQ ID NO: 222839 - RNA, 22 nt, Human
uucuguggcugggagccuggcu

SEQ ID NO: 222840 - RNA, 22 nt, Human
gaaaacuaacggaaaaguuagg

SEQ ID NO: 222841 - RNA, 22 nt, Human
auuuccuauacaguuguccaua

SEQ ID NO: 222842 - RNA, 22 nt, Human
cagggccugcaagagaccuggg

SEQ ID NO: 222843 - RNA, 22 nt, Human
acuggaggccccucccagugaa

SEQ ID NO: 222844 - RNA, 22 nt, Human
cuggaucugaacaucgguauca

SEQ ID NO: 222845 - RNA, 22 nt, Human
cagagcaugucaacuagcuuua

SEQ ID NO: 222846 - RNA, 22 nt, Human
uccucccaacuuuuccaucuca

SEQ ID NO: 222847 - RNA, 22 nt, Human
aaaauagcaugaaaggccuuug

SEQ ID NO: 222848 - RNA, 22 nt, Human
auuaaacaauguaaaguucuug

SEQ ID NO: 222849 - RNA, 22 nt, Human
cacugucuccuagggggacuuc

SEQ ID NO: 222850 - RNA, 20 nt, Human
ccaggccugggccugcucua

SEQ ID NO: 222851 - RNA, 22 nt, Human
acaagcaugggcuuugacauca

SEQ ID NO: 222852 - RNA, 22 nt, Human
cuccaugggggcuggccugugu

SEQ ID NO: 222853 - RNA, 22 nt, Human
uuggccuuugcugggcuguuga

SEQ ID NO: 222854 - RNA, 23 nt, Human
uccaauucaauugggucaggaag

SEQ ID NO: 222855 - RNA, 22 nt, Human
gauaacuacacuuaagacaacc

SEQ ID NO: 222856 - RNA, 22 nt, Human
aauaugcauuaacuguguacau

SEQ ID NO: 222857 - RNA, 22 nt, Human
uucacauuugcccuuaugugug

SEQ ID NO: 222858 - RNA, 22 nt, Human
guugcuuuucuccaucacaugg

SEQ ID NO: 222859 - RNA, 22 nt, Human
caggauggagggagggcuguua

SEQ ID NO: 222860 - RNA, 22 nt, Human
ggaaugaauuuccagcuggguc

SEQ ID NO: 222861 - RNA, 22 nt, Human
ccauuuuauuagugacauuuag

SEQ ID NO: 222862 - RNA, 23 nt, Human
gggaccagcuagggcugugaccu

SEQ ID NO: 222863 - RNA, 22 nt, Human
uauucagaguauuccaugaggu

SEQ ID NO: 222864 - RNA, 22 nt, Human
cagcagccuacaaugcacagaa

SEQ ID NO: 222865 - RNA, 22 nt, Human
cagggauggagagacuacuggc

SEQ ID NO: 222866 - RNA, 22 nt, Human
cugcuguggguuaagacacugu

SEQ ID NO: 222867 - RNA, 22 nt, Human
aaaucagucccucuuggaauuu

SEQ ID NO: 222868 - RNA, 22 nt, Human
ggcugaaaccguuauccacuga

SEQ ID NO: 222869 - RNA, 22 nt, Human
aaagccacguggccuggggagc

SEQ ID NO: 222870 - RNA, 22 nt, Human
gaggagcuucagaggaaucuua

SEQ ID NO: 222871 - RNA, 22 nt, Human
ucuagaauguuccaccuuguuu

SEQ ID NO: 222872 - RNA, 19 nt, Human
uucagcagugucugcucuu

SEQ ID NO: 222873 - RNA, 22 nt, Human
agcugucugucuccugaggaga

SEQ ID NO: 222874 - RNA, 22 nt, Human
ucugggcccugagauguucuuc

SEQ ID NO: 222875 - RNA, 23 nt, Human
uggcuggcgccugccucacccug

SEQ ID NO: 222876 - RNA, 22 nt, Human
cagcuccucagcccugccuugg

SEQ ID NO: 222877 - RNA, 22 nt, Human
augaguguuuagaaaacacugg

SEQ ID NO: 222878 - RNA, 22 nt, Human
uccaguuuacaggguugcuuuu

SEQ ID NO: 222879 - RNA, 22 nt, Human
gaccuuagaacgugacacaaga

SEQ ID NO: 222880 - RNA, 22 nt, Human
aagcuuucagagcagaauguga

SEQ ID NO: 222881 - RNA, 22 nt, Human
ucagaacauuaaggauuugaag

SEQ ID NO: 222882 - RNA, 23 nt, Human
agagccaagcuucuuucucacau

SEQ ID NO: 222883 - RNA, 22 nt, Human
cagggugguaccagcaucuagu

SEQ ID NO: 222884 - RNA, 22 nt, Human
uuugguauugcacacugucuuc

SEQ ID NO: 222885 - RNA, 22 nt, Human
aauauuaguuucucaagagaga

SEQ ID NO: 222886 - RNA, 22 nt, Human
cagcuuuauuaaugauugucuu

SEQ ID NO: 222887 - RNA, 20 nt, Human
uccaggcagcucagaguguc

SEQ ID NO: 222888 - RNA, 22 nt, Human
uaugcacacauguaugcaugug

SEQ ID NO: 222889 - RNA, 22 nt, Human
agccauguuggggaaggugggc

SEQ ID NO: 222890 - RNA, 22 nt, Human
aagcuguguauuacagaauauu

SEQ ID NO: 222891 - RNA, 21 nt, Human
cagccugcugcuccagggcca

SEQ ID NO: 222892 - RNA, 22 nt, Human
gaaucauuggaaccacauccaa

SEQ ID NO: 222893 - RNA, 22 nt, Human
guuuugaauacuacuagaacuu

SEQ ID NO: 222894 - RNA, 21 nt, Human
cuuaagauggcauaguacgaa

SEQ ID NO: 222895 - RNA, 22 nt, Human
auuacauauguuggcaacauuu

SEQ ID NO: 222896 - RNA, 22 nt, Human
ucacagugugaaggucagucac

SEQ ID NO: 222897 - RNA, 22 nt, Human
aaguccuuggagaauagaaagg

SEQ ID NO: 222898 - RNA, 22 nt, Human
uugcagaggcaaaaaugaacuc

SEQ ID NO: 222899 - RNA, 22 nt, Human
aggcuacaauaauucccaugca

SEQ ID NO: 222900 - RNA, 22 nt, Human
agacccugguaaacacuccagg

SEQ ID NO: 222901 - RNA, 22 nt, Human
caaggccacugcucagguuucc

SEQ ID NO: 222902 - RNA, 22 nt, Human
caggaugagaagggcucuuacg

SEQ ID NO: 222903 - RNA, 22 nt, Human
cagggcucgcucgcucgcucgc

SEQ ID NO: 222904 - RNA, 22 nt, Human
ugcacagugaccacugagcaag

SEQ ID NO: 222905 - RNA, 22 nt, Human
uggaggagggcuggugucugua

SEQ ID NO: 222906 - RNA, 22 nt, Human
aaucuggagagucaucucugac

SEQ ID NO: 222907 - RNA, 22 nt, Human
ccugcugucaguggggcaggca

SEQ ID NO: 222908 - RNA, 22 nt, Human
cugggaacuguacugccuugaa

SEQ ID NO: 222909 - RNA, 22 nt, Human
ucagcagggccaugcucucucu

SEQ ID NO: 222910 - RNA, 17 nt, Human
uacauguguaucugauu

SEQ ID NO: 222911 - RNA, 22 nt, Human
augaggcaucuaacauugcaaa

SEQ ID NO: 222912 - RNA, 22 nt, Human
aaauauguaaccaaggugaagu

SEQ ID NO: 222913 - RNA, 22 nt, Human
uucuguggagguuuggaacauu

SEQ ID NO: 222914 - RNA, 23 nt, Human
gagauguggguuuguucaguguc

SEQ ID NO: 222915 - RNA, 22 nt, Human
ugcaauaaagugcuauaaaucc

SEQ ID NO: 222916 - RNA, 23 nt, Human
uacauucuguauuuuuauagagu

SEQ ID NO: 222917 - RNA, 21 nt, Human
ugcuccagggcagcuuccagc

SEQ ID NO: 222918 - RNA, 22 nt, Human
ucuccccaguauggauucucug

SEQ ID NO: 222919 - RNA, 22 nt, Human
gcuuccugagaaacaaucugau

SEQ ID NO: 222920 - RNA, 22 nt, Human
aaggcugguggauuaugagguc

SEQ ID NO: 222921 - RNA, 22 nt, Human
ugaguuuuggaagacaacacaa

SEQ ID NO: 222922 - RNA, 22 nt, Human
ucugaaauguucucuuguuuug

SEQ ID NO: 222923 - RNA, 23 nt, Human
gaaagucaauaugguagcuuuga

SEQ ID NO: 222924 - RNA, 22 nt, Human
guggccugccgugugguauggg

SEQ ID NO: 222925 - RNA, 22 nt, Human
gacuuuggagcagaaagaaauu

SEQ ID NO: 222926 - RNA, 20 nt, Human
cagagcagugcccaggcggc

SEQ ID NO: 222927 - RNA, 22 nt, Human
ugaagccaucccucagauggcc

SEQ ID NO: 222928 - RNA, 22 nt, Human
ccagugucuacuguggcauauc

SEQ ID NO: 222929 - RNA, 22 nt, Human
acagaggacaacuaggcgcuca

SEQ ID NO: 222930 - RNA, 21 nt, Human
ugagucucccuuagcccacgc

SEQ ID NO: 222931 - RNA, 21 nt, Human
uacaccaguuuacacuuccuc

SEQ ID NO: 222932 - RNA, 22 nt, Human
aacuugguuguuggcaauuugc

SEQ ID NO: 222933 - RNA, 22 nt, Human
ggcaggugcccagagagcacga

SEQ ID NO: 222934 - RNA, 22 nt, Human
cagagccuaaaacgacuccacu

SEQ ID NO: 222935 - RNA, 22 nt, Human
uggcagaaagaaccaugugcaa

SEQ ID NO: 222936 - RNA, 22 nt, Human
gcuggagcuugagaggacaggg

SEQ ID NO: 222937 - RNA, 22 nt, Human
aguuuacaugacguguauuuca

SEQ ID NO: 222938 - RNA, 22 nt, Human
gucccucaguagugcacagugg

SEQ ID NO: 222939 - RNA, 22 nt, Human
gagcagugaugggaggacguca

SEQ ID NO: 222940 - RNA, 22 nt, Human
acaggcuuuaaauuuaaaacca

SEQ ID NO: 222941 - RNA, 22 nt, Human
ugauuacacuauuugggaauag

SEQ ID NO: 222942 - RNA, 22 nt, Human
cuugccucugcuaaugguuucu

SEQ ID NO: 222943 - RNA, 22 nt, Human
ggcugugggaugcauaggagcu

SEQ ID NO: 222944 - RNA, 22 nt, Human
gaggucugggcuugggccuggu

SEQ ID NO: 222945 - RNA, 22 nt, Human
uuacugaacccuacuuuuacag

SEQ ID NO: 222946 - RNA, 20 nt, Human
aacauuuguagucaggcaca

SEQ ID NO: 222947 - RNA, 22 nt, Human
agccaggcggggcagguuuccu

SEQ ID NO: 222948 - RNA, 22 nt, Human
ucaauuuaagguacuacuuugg

SEQ ID NO: 222949 - RNA, 22 nt, Human
caguaacaugaagagacaugga

SEQ ID NO: 222950 - RNA, 22 nt, Human
ucccugggaaaugucaguuuca

SEQ ID NO: 222951 - RNA, 17 nt, Human
caagagagaugacugga

SEQ ID NO: 222952 - RNA, 22 nt, Human
caacagaagguguacuacugaa

SEQ ID NO: 222953 - RNA, 22 nt, Human
uccugaggagaagagugcuagg

SEQ ID NO: 222954 - RNA, 22 nt, Human
acagggcagagaggcaggcuug

SEQ ID NO: 222955 - RNA, 22 nt, Human
gucuguggucccugcuggggac

SEQ ID NO: 222956 - RNA, 22 nt, Human
ucccagggugcgccugcccucg

SEQ ID NO: 222957 - RNA, 22 nt, Human
acauaccauacauggugagaug

SEQ ID NO: 222958 - RNA, 22 nt, Human
auccaggcuuaaugggagccac

SEQ ID NO: 222959 - RNA, 22 nt, Human
cagguccugcagggagaguaaa

SEQ ID NO: 222960 - RNA, 21 nt, Human
gcagagcuggaaccaggaccc

SEQ ID NO: 222961 - RNA, 22 nt, Human
aggaucugugccucaacccaga

SEQ ID NO: 222962 - RNA, 22 nt, Human
acagcagagacacucaggaggc

SEQ ID NO: 222963 - RNA, 22 nt, Human
agacacuguguacagaaaaaga

SEQ ID NO: 222964 - RNA, 22 nt, Human
caaauagaagguacucagagaa

SEQ ID NO: 222965 - RNA, 22 nt, Human
ucaaaaauguuuuauauuggua

SEQ ID NO: 222966 - RNA, 22 nt, Human
ugcaggaaauuccaggguggcc

SEQ ID NO: 222967 - RNA, 19 nt, Human
cagaggcacuuucucuuag

SEQ ID NO: 222968 - RNA, 22 nt, Human
ugucucagggcagcagcagggg

SEQ ID NO: 222969 - RNA, 22 nt, Human
ucugggccucaccugcugcuca

SEQ ID NO: 222970 - RNA, 22 nt, Human
cucacagcauggaauuuucugg

SEQ ID NO: 222971 - RNA, 22 nt, Human
gguguccuuguccuuugguacc

SEQ ID NO: 222972 - RNA, 22 nt, Human
cuccuguguucaagcgauucuc

SEQ ID NO: 222973 - RNA, 22 nt, Human
guuuccuggagguuauuuuuga

SEQ ID NO: 222974 - RNA, 22 nt, Human
aggaaacuguccccucauccua

SEQ ID NO: 222975 - RNA, 22 nt, Human
gcucuggggaugcuucugccgu

SEQ ID NO: 222976 - RNA, 22 nt, Human
agggcugacagugaggagucaa

SEQ ID NO: 222977 - RNA, 19 nt, Human
uggaaacuccugauauuag

SEQ ID NO: 222978 - RNA, 22 nt, Human
uacuaguuuuuaggaaaaguga

SEQ ID NO: 222979 - RNA, 22 nt, Human
ggagauaguccaggugaaggga

SEQ ID NO: 222980 - RNA, 20 nt, Human
acaggaugccugccauuuca

SEQ ID NO: 222981 - RNA, 21 nt, Human
acaggaugauuuuuccuuaug

SEQ ID NO: 222982 - RNA, 22 nt, Human
ggcccagagggguugagcaucu

SEQ ID NO: 222983 - RNA, 22 nt, Human
gcugugcagagcacaggguccc

SEQ ID NO: 222984 - RNA, 22 nt, Human
cccuggcauaaaacuucuccag

SEQ ID NO: 222985 - RNA, 20 nt, Human
uggcagguggccucaguucc

SEQ ID NO: 222986 - RNA, 22 nt, Human
uacauucucuucccauugucuc

SEQ ID NO: 222987 - RNA, 22 nt, Human
aaauaguaaagugguagccauc

SEQ ID NO: 222988 - RNA, 22 nt, Human
accugggaacgcuuuguggagg

SEQ ID NO: 222989 - RNA, 22 nt, Human
ggagugaaucacuagaugcaga

SEQ ID NO: 222990 - RNA, 22 nt, Human
ugacaguuaagguauacauuca

SEQ ID NO: 222991 - RNA, 22 nt, Human
uauaaagaaaugauuuccagaa

SEQ ID NO: 222992 - RNA, 22 nt, Human
gcuccuggcuucacugacauca

SEQ ID NO: 222993 - RNA, 22 nt, Human
uggaaggagacugggaagugug

SEQ ID NO: 222994 - RNA, 22 nt, Human
agcauacaguugaaaguggcuu

SEQ ID NO: 222995 - RNA, 19 nt, Human
uaauaagcaauauggaagu

SEQ ID NO: 222996 - RNA, 22 nt, Human
cugggucugugcccagggaccu

SEQ ID NO: 222997 - RNA, 22 nt, Human
gccugcucuccggaucccugau

SEQ ID NO: 222998 - RNA, 22 nt, Human
cuucaaguugggcggcgggcag

SEQ ID NO: 222999 - RNA, 22 nt, Human
acugaaugaggggugaucuggg

SEQ ID NO: 223000 - RNA, 22 nt, Human
ggcugcucugccuuccagcugg

SEQ ID NO: 223001 - RNA, 22 nt, Human
ggugucuguugccuccugguua

SEQ ID NO: 223002 - RNA, 22 nt, Human
uagaaaguaaaucaguuuuauu

SEQ ID NO: 223003 - RNA, 22 nt, Human
aauaugcacucugauuuagcag

SEQ ID NO: 223004 - RNA, 22 nt, Human
ucaggagcuauggacugucaaa

SEQ ID NO: 223005 - RNA, 22 nt, Human
cugagccauaagggaggcuggg

SEQ ID NO: 223006 - RNA, 22 nt, Human
uagcaugggucgcgucucugga

SEQ ID NO: 223007 - RNA, 22 nt, Human
cucauguagcucucaggccaca

SEQ ID NO: 223008 - RNA, 22 nt, Human
caguuuauuuccaagaugacaa

SEQ ID NO: 223009 - RNA, 22 nt, Human
uucaaguuaccuuuaaacagcu

SEQ ID NO: 223010 - RNA, 21 nt, Human
gcaaggcaaugccaugauuuc

SEQ ID NO: 223011 - RNA, 22 nt, Human
aggaagaggguggcagauaauc

SEQ ID NO: 223012 - RNA, 22 nt, Human
cgcagguguguuuucaggacua

SEQ ID NO: 223013 - RNA, 19 nt, Human
ugaggcacaugauaagaac

SEQ ID NO: 223014 - RNA, 22 nt, Human
guuugccugccgacgcucucau

SEQ ID NO: 223015 - RNA, 22 nt, Human
gagacacagagaggcuguguga

SEQ ID NO: 223016 - RNA, 22 nt, Human
ucugggcuuuugcacuggccau

SEQ ID NO: 223017 - RNA, 22 nt, Human
ucagaggagaaguugggaaaau

SEQ ID NO: 223018 - RNA, 22 nt, Human
uuuguguuguacuucugugcau

SEQ ID NO: 223019 - RNA, 22 nt, Human
gggcugccaagccugccugccu

SEQ ID NO: 223020 - RNA, 22 nt, Human
gccugggaaagaguagggaaau

SEQ ID NO: 223021 - RNA, 22 nt, Human
gacacagggggauguguggacg

SEQ ID NO: 223022 - RNA, 22 nt, Human
ucugaagaacugaguaaacaug

SEQ ID NO: 223023 - RNA, 22 nt, Human
accagcauccuuccuauuaaca

SEQ ID NO: 223024 - RNA, 22 nt, Human
ccacagaggacaacugccuggc

SEQ ID NO: 223025 - RNA, 22 nt, Human
uggagcugaacuuugaggccag

SEQ ID NO: 223026 - RNA, 22 nt, Human
uugaauggcuucuagguucucc

SEQ ID NO: 223027 - RNA, 22 nt, Human
gaaucucaaauuaagaauuuua

SEQ ID NO: 223028 - RNA, 23 nt, Human
ucuguggcuccuucaggcugcug

SEQ ID NO: 223029 - RNA, 22 nt, Human
auaaacaucuguuucucuucug

SEQ ID NO: 223030 - RNA, 22 nt, Human
ccuggagaggcgcugcagagga

SEQ ID NO: 223031 - RNA, 22 nt, Human
uuuacagacaacuuaauagggg

SEQ ID NO: 223032 - RNA, 22 nt, Human
agcccugaagcuggccaugucc

SEQ ID NO: 223033 - RNA, 22 nt, Human
agcugccagcaaguuucaaaca

SEQ ID NO: 223034 - RNA, 22 nt, Human
gucuggaguggggccugagaau

SEQ ID NO: 223035 - RNA, 22 nt, Human
ugauuauauucuaacuucauaa

SEQ ID NO: 223036 - RNA, 17 nt, Human
ggagcagauccaccauu

SEQ ID NO: 223037 - RNA, 22 nt, Human
acuggaggauuccuggaaggcg

SEQ ID NO: 223038 - RNA, 22 nt, Human
uuccuggcagaggccccgacag

SEQ ID NO: 223039 - RNA, 22 nt, Human
acagguguaaaacccaggaugg

SEQ ID NO: 223040 - RNA, 22 nt, Human
uuggaaauggcuguaguuauga

SEQ ID NO: 223041 - RNA, 22 nt, Human
uccaaggacuaaauucuagauu

SEQ ID NO: 223042 - RNA, 22 nt, Human
cugagcgcaugguugcugggga

SEQ ID NO: 223043 - RNA, 22 nt, Human
auuacugugacuagccaucugg

SEQ ID NO: 223044 - RNA, 22 nt, Human
uaguuacagugcauagcaagau

SEQ ID NO: 223045 - RNA, 22 nt, Human
uucaugaaauucucguguaccu

SEQ ID NO: 223046 - RNA, 22 nt, Human
ucaugugucugcugcagcuguu

SEQ ID NO: 223047 - RNA, 22 nt, Human
uauuuucuguggaggaccagau

SEQ ID NO: 223048 - RNA, 22 nt, Human
agccagaggccagccugccuca

SEQ ID NO: 223049 - RNA, 22 nt, Human
ucucugggaucagguggcccag

SEQ ID NO: 223050 - RNA, 22 nt, Human
aagcaguguucccagcuggccc

SEQ ID NO: 223051 - RNA, 22 nt, Human
uggcacagagggacccagcagc

SEQ ID NO: 223052 - RNA, 22 nt, Human
cugagaggcggagguugcagug

SEQ ID NO: 223053 - RNA, 22 nt, Human
ccaaggagcaaguuuacaccug

SEQ ID NO: 223054 - RNA, 20 nt, Human
acagaauaugcugguugugg

SEQ ID NO: 223055 - RNA, 22 nt, Human
agcugucaggcagaacugagcu

SEQ ID NO: 223056 - RNA, 22 nt, Human
auuuuuuauauaccaagguggg

SEQ ID NO: 223057 - RNA, 22 nt, Human
gggcuguaggagcuggaauggg

SEQ ID NO: 223058 - RNA, 22 nt, Human
cuccauauggcccugggaccug

SEQ ID NO: 223059 - RNA, 22 nt, Human
ggcugugcccucacauggggca

SEQ ID NO: 223060 - RNA, 22 nt, Human
auguucaaacuuuuuacacacc

SEQ ID NO: 223061 - RNA, 22 nt, Human
uaauaaaugaaagugcuggcau

SEQ ID NO: 223062 - RNA, 22 nt, Human
agagagcugacuuuggagucag

SEQ ID NO: 223063 - RNA, 22 nt, Human
ucaaacagaggaacaauuguuu

SEQ ID NO: 223064 - RNA, 22 nt, Human
ucugagcucaagugacaguuag

SEQ ID NO: 223065 - RNA, 21 nt, Human
ccuggcuccagaacuuccggu

SEQ ID NO: 223066 - RNA, 22 nt, Human
caagucaaugauuauaagaguc

SEQ ID NO: 223067 - RNA, 17 nt, Human
gcuccaggcgugaguga

SEQ ID NO: 223068 - RNA, 22 nt, Human
acauucuuugaguuuuguuaaa

SEQ ID NO: 223069 - RNA, 19 nt, Human
uccucugguaccacccuug

SEQ ID NO: 223070 - RNA, 22 nt, Human
uacacaggggagcaugguugac

SEQ ID NO: 223071 - RNA, 22 nt, Human
auguaaacuuuaccagcucuga

SEQ ID NO: 223072 - RNA, 22 nt, Human
auggcagaccugggcuggagaa

SEQ ID NO: 223073 - RNA, 22 nt, Human
cccaggcagucuggcucuaaag

SEQ ID NO: 223074 - RNA, 22 nt, Human
gaggaggcacuugagcagaugu

SEQ ID NO: 223075 - RNA, 18 nt, Human
cugccccuucucugagau

SEQ ID NO: 223076 - RNA, 22 nt, Human
guggccagccagggugcugaug

SEQ ID NO: 223077 - RNA, 22 nt, Human
uguuacuccuucccuacucaug

SEQ ID NO: 223078 - RNA, 22 nt, Human
gagaaagauguaggcugggagg

SEQ ID NO: 223079 - RNA, 22 nt, Human
gagcuuuaagggcacuggucuu

SEQ ID NO: 223080 - RNA, 22 nt, Human
uagcugggaauuaucugguugc

SEQ ID NO: 223081 - RNA, 22 nt, Human
acuuccagccccugucagcaaa

SEQ ID NO: 223082 - RNA, 22 nt, Human
cuucuuguaucugccgccgagc

SEQ ID NO: 223083 - RNA, 22 nt, Human
uugauuccuugaaauauccuug

SEQ ID NO: 223084 - RNA, 22 nt, Human
gugagagggcugggcucaugau

SEQ ID NO: 223085 - RNA, 22 nt, Human
uucauauaccuugcguuucaca

SEQ ID NO: 223086 - RNA, 23 nt, Human
gggcugcuccaggccaaggcugg

SEQ ID NO: 223087 - RNA, 22 nt, Human
uagggaugaaguugcuauuuac

SEQ ID NO: 223088 - RNA, 22 nt, Human
acaauucaagaagagagaugaa

SEQ ID NO: 223089 - RNA, 19 nt, Human
ucugugcugggaggcagca

SEQ ID NO: 223090 - RNA, 22 nt, Human
cugaaggcaccaggggugccag

SEQ ID NO: 223091 - RNA, 22 nt, Human
uuugcagugucagcuucugugu

SEQ ID NO: 223092 - RNA, 22 nt, Human
uuuuauugucucccaguucugg

SEQ ID NO: 223093 - RNA, 22 nt, Human
ccuccacaggagcugcagugcu

SEQ ID NO: 223094 - RNA, 23 nt, Human
augugcaaagugcuacaguauag

SEQ ID NO: 223095 - RNA, 22 nt, Human
ugguccuggggugcaggcugac

SEQ ID NO: 223096 - RNA, 22 nt, Human
cugaggccagcugcagagcucu

SEQ ID NO: 223097 - RNA, 22 nt, Human
ggaucuucagccagcaggugcc

SEQ ID NO: 223098 - RNA, 22 nt, Human
agcccugcugcuucuuguauuu

SEQ ID NO: 223099 - RNA, 22 nt, Human
cuccugaggaaaagcuugguca

SEQ ID NO: 223100 - RNA, 22 nt, Human
cuaggguggauuugugcagagu

SEQ ID NO: 223101 - RNA, 22 nt, Human
acacuuuaucucaucucagaca

SEQ ID NO: 223102 - RNA, 22 nt, Human
ggagaagccacacauugggugu

SEQ ID NO: 223103 - RNA, 17 nt, Human
uuaagguggaucagcac

SEQ ID NO: 223104 - RNA, 22 nt, Human
uuuuuaucuacagauucucagc

SEQ ID NO: 223105 - RNA, 22 nt, Human
cuuugcauacaauuuuuagaaa

SEQ ID NO: 223106 - RNA, 20 nt, Human
uggcuccuggcuccucccuc

SEQ ID NO: 223107 - RNA, 22 nt, Human
ugcaaauauuccaugcuguuca

SEQ ID NO: 223108 - RNA, 23 nt, Human
ggaauguuuaccugugaauguca

SEQ ID NO: 223109 - RNA, 22 nt, Human
uggauaaauggugcuaucaccc

SEQ ID NO: 223110 - RNA, 22 nt, Human
ugaaaaaccucaguccgcuuua

SEQ ID NO: 223111 - RNA, 22 nt, Human
uccagugcuguuuccaauguaa

SEQ ID NO: 223112 - RNA, 22 nt, Human
uuagagaaccaaugaauagucu

SEQ ID NO: 223113 - RNA, 18 nt, Human
uggcuucugaacaacugc

SEQ ID NO: 223114 - RNA, 22 nt, Human
gucuggaagaacuagggauguu

SEQ ID NO: 223115 - RNA, 22 nt, Human
ucauguguuaaacuccaagaua

SEQ ID NO: 223116 - RNA, 22 nt, Human
ucuguggcuaucauacugaagg

SEQ ID NO: 223117 - RNA, 22 nt, Human
caagaucuuccucaauagaccu

SEQ ID NO: 223118 - RNA, 22 nt, Human
gugauuuugagaccuauauagu

SEQ ID NO: 223119 - RNA, 22 nt, Human
caggcuacuggggcuuggaugg

SEQ ID NO: 223120 - RNA, 22 nt, Human
uccuggccuuauccccaaacug

SEQ ID NO: 223121 - RNA, 22 nt, Human
acucaggcuguuuuuuccuugu

SEQ ID NO: 223122 - RNA, 22 nt, Human
uaaggguucagaaugcaguggu

SEQ ID NO: 223123 - RNA, 22 nt, Human
aguguccuccucugggagccag

SEQ ID NO: 223124 - RNA, 22 nt, Human
uccuagaauaaguaacaggaca

SEQ ID NO: 223125 - RNA, 19 nt, Human
acagagggcaacugagaaa

SEQ ID NO: 223126 - RNA, 22 nt, Human
guuuuucuaggaccaugugauu

SEQ ID NO: 223127 - RNA, 22 nt, Human
cacugguaguuucagcaaccag

SEQ ID NO: 223128 - RNA, 23 nt, Human
ugcagcucaaagauggguaaaug

SEQ ID NO: 223129 - RNA, 20 nt, Human
aggaaggagaaucugagcaa

SEQ ID NO: 223130 - RNA, 22 nt, Human
augugggagauuucaggaggug

SEQ ID NO: 223131 - RNA, 18 nt, Human
cccauguugccagucagc

SEQ ID NO: 223132 - RNA, 22 nt, Human
acacaugcagguauacauguuc

SEQ ID NO: 223133 - RNA, 22 nt, Human
caggaccuggaaugcuugugaa

SEQ ID NO: 223134 - RNA, 22 nt, Human
agcugaaagugcuuugaggacu

SEQ ID NO: 223135 - RNA, 22 nt, Human
aagcacccaauuuacagcaguu

SEQ ID NO: 223136 - RNA, 22 nt, Human
ucagguguggaccgaggucaga

SEQ ID NO: 223137 - RNA, 22 nt, Human
aaucaagaggcgauggauggaa

SEQ ID NO: 223138 - RNA, 22 nt, Human
aagcuuuaugacuuggagacag

SEQ ID NO: 223139 - RNA, 22 nt, Human
gaauauuuucaguacagauggu

SEQ ID NO: 223140 - RNA, 22 nt, Human
gaauuacauaauaaaaugagag

SEQ ID NO: 223141 - RNA, 22 nt, Human
ugguggcuaccagguccugggg

SEQ ID NO: 223142 - RNA, 18 nt, Human
uacuguuuaauugauuac

SEQ ID NO: 223143 - RNA, 22 nt, Human
ccugugggcgcagcuggaguca

SEQ ID NO: 223144 - RNA, 22 nt, Human
gaaacauucagucaacaguguu

SEQ ID NO: 223145 - RNA, 18 nt, Human
agcaagcaguuuucaugu

SEQ ID NO: 223146 - RNA, 22 nt, Human
aggcaguguucuucuaagggca

SEQ ID NO: 223147 - RNA, 22 nt, Human
gccuggcacucaaucaucugcu

SEQ ID NO: 223148 - RNA, 22 nt, Human
uccuggcuccugaucugucacu

SEQ ID NO: 223149 - RNA, 22 nt, Human
cagacacagcaauucuguguug

SEQ ID NO: 223150 - RNA, 22 nt, Human
gguuucaacuuuugugaggaau

SEQ ID NO: 223151 - RNA, 22 nt, Human
ugggacagagugagcuuuggcc

SEQ ID NO: 223152 - RNA, 22 nt, Human
ugaaauuaugcauuguuguacc

SEQ ID NO: 223153 - RNA, 22 nt, Human
caugguuuuuacccuacaccau

SEQ ID NO: 223154 - RNA, 22 nt, Human
uucugcagcaugaggcuggagc

SEQ ID NO: 223155 - RNA, 22 nt, Human
uagaggaaccaggcaggcugag

SEQ ID NO: 223156 - RNA, 22 nt, Human
gcagaggagugauuaugccgug

SEQ ID NO: 223157 - RNA, 17 nt, Human
gcuuuggaaggguagac

SEQ ID NO: 223158 - RNA, 22 nt, Human
gagacagagagguacucaacau

SEQ ID NO: 223159 - RNA, 22 nt, Human
ucccuguauaucacaagggcua

SEQ ID NO: 223160 - RNA, 21 nt, Human
cucaaagaccaaaaguguaga

SEQ ID NO: 223161 - RNA, 22 nt, Human
uccugcaguuacaucccagcca

SEQ ID NO: 223162 - RNA, 22 nt, Human
ccaugugucgggccugcagugg

SEQ ID NO: 223163 - RNA, 22 nt, Human
uugcagggucccagaggccugg

SEQ ID NO: 223164 - RNA, 22 nt, Human
uuacugauacacauaagaauuu

SEQ ID NO: 223165 - RNA, 23 nt, Human
uucuuuguggauaaucuccagug

SEQ ID NO: 223166 - RNA, 22 nt, Human
cagggcuguggcuuugugcugu

SEQ ID NO: 223167 - RNA, 22 nt, Human
aucucugguccaaauguuaccu

SEQ ID NO: 223168 - RNA, 22 nt, Human
uggugagauguauggaggguug

SEQ ID NO: 223169 - RNA, 22 nt, Human
ucaccaggauugggcuguaggc

SEQ ID NO: 223170 - RNA, 22 nt, Human
ucuggcuccacuuucuucauuu

SEQ ID NO: 223171 - RNA, 22 nt, Human
uacaguuuacaugagaggaagc

SEQ ID NO: 223172 - RNA, 22 nt, Human
aauaucuguggccauacaauuu

SEQ ID NO: 223173 - RNA, 22 nt, Human
ugcagagauuuggcucuuaaag

SEQ ID NO: 223174 - RNA, 22 nt, Human
gagcaagacucacugcaucuug

SEQ ID NO: 223175 - RNA, 22 nt, Human
aggaugccuucauugcauggcc

SEQ ID NO: 223176 - RNA, 22 nt, Human
auauauaaccuggauaaggcuu

SEQ ID NO: 223177 - RNA, 17 nt, Human
cugucugcugcuuccuc

SEQ ID NO: 223178 - RNA, 22 nt, Human
gagcugggcacacgccacuuga

SEQ ID NO: 223179 - RNA, 22 nt, Human
ccauuaaaauggaauguaguga

SEQ ID NO: 223180 - RNA, 22 nt, Human
cuguguccucccgcugcaccca

SEQ ID NO: 223181 - RNA, 22 nt, Human
aaaaaucacuuuuauaggcagc

SEQ ID NO: 223182 - RNA, 22 nt, Human
gggcugagggccaauuccuacu

SEQ ID NO: 223183 - RNA, 22 nt, Human
ugcuuccuauccacacaaugcc

SEQ ID NO: 223184 - RNA, 22 nt, Human
gcuacaagucuugucauucauu

SEQ ID NO: 223185 - RNA, 22 nt, Human
auuguacagaugagguaaguga

SEQ ID NO: 223186 - RNA, 15 nt, Human
ucccugggagauggu

SEQ ID NO: 223187 - RNA, 22 nt, Human
gcugagccccccugcguggguc

SEQ ID NO: 223188 - RNA, 17 nt, Human
aggagcuggggguggug

SEQ ID NO: 223189 - RNA, 21 nt, Human
ucuucccucaggauguccugc

SEQ ID NO: 223190 - RNA, 21 nt, Human
gcccucaggggaggauggccu

SEQ ID NO: 223191 - RNA, 22 nt, Human
augccagggucccuucagagau

SEQ ID NO: 223192 - RNA, 22 nt, Human
aguccccucuaacccaacuuua

SEQ ID NO: 223193 - RNA, 19 nt, Human
ugagauuucuuaggugauu

SEQ ID NO: 223194 - RNA, 22 nt, Human
gcugaggcugggagcagccugu

SEQ ID NO: 223195 - RNA, 22 nt, Human
cagcaggaccauugaggcauca

SEQ ID NO: 223196 - RNA, 22 nt, Human
cagcaugagaaaaugaaucaga

SEQ ID NO: 223197 - RNA, 22 nt, Human
caaaugaagagggcaacuucug

SEQ ID NO: 223198 - RNA, 22 nt, Human
guauccucaccuauacaaugga

SEQ ID NO: 223199 - RNA, 23 nt, Human
auguuuuaugucucuagcugcca

SEQ ID NO: 223200 - RNA, 22 nt, Human
uaguuuuaugaauugguauaau

SEQ ID NO: 223201 - RNA, 22 nt, Human
uggcucaguuugggggauugaa

SEQ ID NO: 223202 - RNA, 22 nt, Human
cagggaugguaaauauguaaag

SEQ ID NO: 223203 - RNA, 22 nt, Human
uaucauuuguuauuauuagugg

SEQ ID NO: 223204 - RNA, 18 nt, Human
ggcacuggugaugcagag

SEQ ID NO: 223205 - RNA, 22 nt, Human
aaauuauuauaggcagagcuga

SEQ ID NO: 223206 - RNA, 19 nt, Human
ucagggccaugagcgccac

SEQ ID NO: 223207 - RNA, 22 nt, Human
ugccugccucuggagcccaucc

SEQ ID NO: 223208 - RNA, 22 nt, Human
gcagcagcagcaauuuucuguc

SEQ ID NO: 223209 - RNA, 22 nt, Human
caagaaccgcaauuacuuuugc

SEQ ID NO: 223210 - RNA, 22 nt, Human
caagaauauaaauacuuucaaa

SEQ ID NO: 223211 - RNA, 22 nt, Human
uaacauuuaaauuuuucacaua

SEQ ID NO: 223212 - RNA, 22 nt, Human
accagaguaauguguggaaauu

SEQ ID NO: 223213 - RNA, 22 nt, Human
gucuuuauuacaaauccuuuuc

SEQ ID NO: 223214 - RNA, 22 nt, Human
uuaguucacugcuauaucauca

SEQ ID NO: 223215 - RNA, 18 nt, Human
cagaaaguuauuuacucu

SEQ ID NO: 223216 - RNA, 22 nt, Human
aaccaagcccauuacuuuacuu

SEQ ID NO: 223217 - RNA, 22 nt, Human
auaguuuacaaaaaugaugcau

SEQ ID NO: 223218 - RNA, 22 nt, Human
uucccaaagcuuugucugugaa

SEQ ID NO: 223219 - RNA, 19 nt, Human
uccagggcuuuauggcuuu

SEQ ID NO: 223220 - RNA, 22 nt, Human
ucacaaauagcuauauuaagga

SEQ ID NO: 223221 - RNA, 22 nt, Human
ccuggaagagcugaaucaggca

SEQ ID NO: 223222 - RNA, 22 nt, Human
cucggcagguggagguuguagu

SEQ ID NO: 223223 - RNA, 22 nt, Human
aggggagguggcagaaaugugc

SEQ ID NO: 223224 - RNA, 22 nt, Human
auacaguaaccacauucuauag

SEQ ID NO: 223225 - RNA, 22 nt, Human
ugugaaauucuugaaaugcaca

SEQ ID NO: 223226 - RNA, 17 nt, Human
ucuggaugucauggaag

SEQ ID NO: 223227 - RNA, 15 nt, Human
aagaaucugaagcuu

SEQ ID NO: 223228 - RNA, 19 nt, Human
aaaguuuuauucucauuug

SEQ ID NO: 223229 - RNA, 22 nt, Human
ucaaaucagcaagcagcuuccc

SEQ ID NO: 223230 - RNA, 22 nt, Human
uacugucuaauaagauugaugg

SEQ ID NO: 223231 - RNA, 22 nt, Human
cagauuaagugcucaacagugu

SEQ ID NO: 223232 - RNA, 22 nt, Human
auguaaaggcagacuuuaauuu

SEQ ID NO: 223233 - RNA, 22 nt, Human
uggcagguuucguuaaaaaugg

SEQ ID NO: 223234 - RNA, 22 nt, Human
gaaugcugagucuuaucucuua

SEQ ID NO: 223235 - RNA, 22 nt, Human
gagggcucuacucaccacccug

SEQ ID NO: 223236 - RNA, 22 nt, Human
guccaguuucagggucugcgcu

SEQ ID NO: 223237 - RNA, 22 nt, Human
uuacacaacaucuguauuauua

SEQ ID NO: 223238 - RNA, 22 nt, Human
cugaggcagaaaaagcaagggu

SEQ ID NO: 223239 - RNA, 22 nt, Human
aggcuucuaaaucacaaggaaa

SEQ ID NO: 223240 - RNA, 22 nt, Human
ggcgcccaucggugcagagggc

SEQ ID NO: 223241 - RNA, 22 nt, Human
gguauacugcaugacauugggg

SEQ ID NO: 223242 - RNA, 22 nt, Human
ucucagauggcaucagcuagag

SEQ ID NO: 223243 - RNA, 22 nt, Human
agccagagcagggaauuggaca

SEQ ID NO: 223244 - RNA, 22 nt, Human
ucagggcagccuaaggcaccuc

SEQ ID NO: 223245 - RNA, 22 nt, Human
gucauuuucuagaauuauuuga

SEQ ID NO: 223246 - RNA, 22 nt, Human
gcuccugucagucaucaggugc

SEQ ID NO: 223247 - RNA, 22 nt, Human
gagcucagaggauucuggggag

SEQ ID NO: 223248 - RNA, 22 nt, Human
uggagcagcugaacagaguuga

SEQ ID NO: 223249 - RNA, 22 nt, Human
uucugugauugacauguggcuu

SEQ ID NO: 223250 - RNA, 22 nt, Human
aagaugaaaauuuacugugaug

SEQ ID NO: 223251 - RNA, 22 nt, Human
cucugccacucgaagucaagga

SEQ ID NO: 223252 - RNA, 22 nt, Human
cagagucagagcaccugggauu

SEQ ID NO: 223253 - RNA, 17 nt, Human
agccgggcauggaccag

SEQ ID NO: 223254 - RNA, 22 nt, Human
ccaggugugauuucaucugagg

SEQ ID NO: 223255 - RNA, 22 nt, Human
cuccagauaggagggggucccc

SEQ ID NO: 223256 - RNA, 22 nt, Human
ccagcaucagcacccaaggagc

SEQ ID NO: 223257 - RNA, 22 nt, Human
cagcagcuacuuggagcagcag

SEQ ID NO: 223258 - RNA, 22 nt, Human
gcaggguaggugacagguaguc

SEQ ID NO: 223259 - RNA, 22 nt, Human
ccucagaguuuaagaugucaga

SEQ ID NO: 223260 - RNA, 22 nt, Human
aaaucugaaauagugugaagua

SEQ ID NO: 223261 - RNA, 22 nt, Human
cauucaaaagcuccauguuugu

SEQ ID NO: 223262 - RNA, 22 nt, Human
acgugauauauuuacuucccca

SEQ ID NO: 223263 - RNA, 22 nt, Human
acugugccuucuuauugggucc

SEQ ID NO: 223264 - RNA, 22 nt, Human
agagagcaguggaucaccuagc

SEQ ID NO: 223265 - RNA, 22 nt, Human
aucucuagcuaacccucuggca

SEQ ID NO: 223266 - RNA, 22 nt, Human
accaggacuucauuagguucuu

SEQ ID NO: 223267 - RNA, 21 nt, Human
aaagaacaggcagauguucuu

SEQ ID NO: 223268 - RNA, 22 nt, Human
cugccuguaacuuucugaagca

SEQ ID NO: 223269 - RNA, 22 nt, Human
uggaaugagcuggcuaauaacc

SEQ ID NO: 223270 - RNA, 22 nt, Human
uauuuccaccuauuauuuucug

SEQ ID NO: 223271 - RNA, 22 nt, Human
acauagaagugaugcuuaucca

SEQ ID NO: 223272 - RNA, 22 nt, Human
augggaaagaagccacugccca

SEQ ID NO: 223273 - RNA, 22 nt, Human
aacaggcaggagaauucugccu

SEQ ID NO: 223274 - RNA, 22 nt, Human
cuuucucuuacccaaggaucug

SEQ ID NO: 223275 - RNA, 22 nt, Human
uguguguguuccuccucagcua

SEQ ID NO: 223276 - RNA, 22 nt, Human
acagucuucaugcuagaauggc

SEQ ID NO: 223277 - RNA, 22 nt, Human
ccugcagguaaggcuaacugcc

SEQ ID NO: 223278 - RNA, 22 nt, Human
aggaugaggcuggacacuucuu

SEQ ID NO: 223279 - RNA, 21 nt, Human
agacaaugcuguaaaauucag

SEQ ID NO: 223280 - RNA, 22 nt, Human
uaugaaauuucuaguucugcuu

SEQ ID NO: 223281 - RNA, 22 nt, Human
aagcaggaagcucagguccuug

SEQ ID NO: 223282 - RNA, 22 nt, Human
ucagugugaggucuuccacccg

SEQ ID NO: 223283 - RNA, 22 nt, Human
cucuguauagaaaggaaacauu

SEQ ID NO: 223284 - RNA, 22 nt, Human
uaggggaacuggcacagggcag

SEQ ID NO: 223285 - RNA, 22 nt, Human
agcuggagaaaccugggagggu

SEQ ID NO: 223286 - RNA, 22 nt, Human
aagguggugcuucugcuccucu

SEQ ID NO: 223287 - RNA, 22 nt, Human
ugccugggccucugaggaaggc

SEQ ID NO: 223288 - RNA, 22 nt, Human
ccucaagucaauucugucucgc

SEQ ID NO: 223289 - RNA, 22 nt, Human
uccuuggagucaugauggaggu

SEQ ID NO: 223290 - RNA, 22 nt, Human
ugaguacuuuauguuaguuauu

SEQ ID NO: 223291 - RNA, 22 nt, Human
ggaucuuuaaguucuuuuccau

SEQ ID NO: 223292 - RNA, 22 nt, Human
auguagggaacuaaauucacug

SEQ ID NO: 223293 - RNA, 22 nt, Human
cauugaaaaacguugacugagu

SEQ ID NO: 223294 - RNA, 22 nt, Human
uugggaaauuacucugcuagga

SEQ ID NO: 223295 - RNA, 22 nt, Human
agaagccauugaagcagaccuc

SEQ ID NO: 223296 - RNA, 22 nt, Human
ggcugccucccaggagaaucug

SEQ ID NO: 223297 - RNA, 22 nt, Human
aagcagcauuguaaccaaugcc

SEQ ID NO: 223298 - RNA, 17 nt, Human
cuuauacuuuacggaag

SEQ ID NO: 223299 - RNA, 22 nt, Human
gacuguggggggcggacacaag

SEQ ID NO: 223300 - RNA, 22 nt, Human
uauacuuaugcuaaaaaauguu

SEQ ID NO: 223301 - RNA, 22 nt, Human
cugcaggguuucgccaguugug

SEQ ID NO: 223302 - RNA, 22 nt, Human
aagaaacaaccacugcucuccu

SEQ ID NO: 223303 - RNA, 22 nt, Human
gcugauuuugucacauagcaag

SEQ ID NO: 223304 - RNA, 22 nt, Human
accauccugaaaccuucaugcu

SEQ ID NO: 223305 - RNA, 22 nt, Human
cacugggucaggauagagccca

SEQ ID NO: 223306 - RNA, 22 nt, Human
auuuccaaucucugcauauggg

SEQ ID NO: 223307 - RNA, 22 nt, Human
guacauuuauuuuugcagcaua

SEQ ID NO: 223308 - RNA, 22 nt, Human
gaggagaaagcagugauuugug

SEQ ID NO: 223309 - RNA, 22 nt, Human
aguggagaagaggauggucucc

SEQ ID NO: 223310 - RNA, 22 nt, Human
augugguuuuggauuauucaug

SEQ ID NO: 223311 - RNA, 22 nt, Human
uugauacauagcacaguuuagg

SEQ ID NO: 223312 - RNA, 22 nt, Human
uggcugggcccccaccugccuc

SEQ ID NO: 223313 - RNA, 22 nt, Human
ccugggcuugcaucugugcugg

SEQ ID NO: 223314 - RNA, 22 nt, Human
auuacacuaaugugacaacaau

SEQ ID NO: 223315 - RNA, 22 nt, Human
gaaacuuuggcuaaaagccaga

SEQ ID NO: 223316 - RNA, 22 nt, Human
gcaucccucugaggggccaggc

SEQ ID NO: 223317 - RNA, 22 nt, Human
uucauucuugucuuuguauagu

SEQ ID NO: 223318 - RNA, 22 nt, Human
ucugggcuuuaguuuguuaucu

SEQ ID NO: 223319 - RNA, 22 nt, Human
guuuacuggagaagaugaccug

SEQ ID NO: 223320 - RNA, 22 nt, Human
uccugcuagagaauaacagcac

SEQ ID NO: 223321 - RNA, 19 nt, Human
uuuuuaaugggcuggagca

SEQ ID NO: 223322 - RNA, 21 nt, Human
uuucugucucugccacuaguu

SEQ ID NO: 223323 - RNA, 22 nt, Human
uguuacagugacuaauguuuua

SEQ ID NO: 223324 - RNA, 22 nt, Human
gcccugcugucuucagaguaua

SEQ ID NO: 223325 - RNA, 22 nt, Human
uaggauuuggcuuuagucaggu

SEQ ID NO: 223326 - RNA, 22 nt, Human
aaaacugaaccuugagaucuuu

SEQ ID NO: 223327 - RNA, 22 nt, Human
ccaaaauaacagcccaauucac

SEQ ID NO: 223328 - RNA, 22 nt, Human
cacaugcucauuggcacuguuc

SEQ ID NO: 223329 - RNA, 22 nt, Human
gacugugggcuccuugagggca

SEQ ID NO: 223330 - RNA, 20 nt, Human
auuagcuuggagacaguggc

SEQ ID NO: 223331 - RNA, 22 nt, Human
uaggaaacaaaccugccucuuc

SEQ ID NO: 223332 - RNA, 21 nt, Human
cagcuucuucugugaccuggu

SEQ ID NO: 223333 - RNA, 22 nt, Human
gcugugcagauguagggagugg

SEQ ID NO: 223334 - RNA, 22 nt, Human
uuggcuggcuucucgacuuguu

SEQ ID NO: 223335 - RNA, 22 nt, Human
cugcugucccagccuccucaca

SEQ ID NO: 223336 - RNA, 22 nt, Human
aaggcugaggcuggagaauuac

SEQ ID NO: 223337 - RNA, 22 nt, Human
gucagauuaauagcaauaauaa

SEQ ID NO: 223338 - RNA, 22 nt, Human
cagguugguauucaucuccaca

SEQ ID NO: 223339 - RNA, 22 nt, Human
auacuacaaucauaauuguaca

SEQ ID NO: 223340 - RNA, 22 nt, Human
ggcagugaaugaaacagaggcu

SEQ ID NO: 223341 - RNA, 22 nt, Human
acuguucaucucuuagaaagua

SEQ ID NO: 223342 - RNA, 19 nt, Human
augaaugagcugugagguu

SEQ ID NO: 223343 - RNA, 22 nt, Human
cugggccuuugcuuauuaauuu

SEQ ID NO: 223344 - RNA, 22 nt, Human
ucaggcugcuuucaugcuuaga

SEQ ID NO: 223345 - RNA, 22 nt, Human
ugcucuucacaguuucagcauc

SEQ ID NO: 223346 - RNA, 22 nt, Human
cuccuggccccagaucccaauc

SEQ ID NO: 223347 - RNA, 22 nt, Human
gguaacacaggugcaguuuuaa

SEQ ID NO: 223348 - RNA, 22 nt, Human
cuugaaagcacuccuuugacug

SEQ ID NO: 223349 - RNA, 22 nt, Human
ccagccuugcaccgagccagcc

SEQ ID NO: 223350 - RNA, 22 nt, Human
gcacuuucagcaggcagacaga

SEQ ID NO: 223351 - RNA, 19 nt, Human
ggaacuuggccuuuaccca

SEQ ID NO: 223352 - RNA, 22 nt, Human
uggcagagucugggcuugggca

SEQ ID NO: 223353 - RNA, 22 nt, Human
uccuccuuguuuugucucugcu

SEQ ID NO: 223354 - RNA, 22 nt, Human
uagggcuggguacacucuugcc

SEQ ID NO: 223355 - RNA, 22 nt, Human
uauugcuggaaaauggugugau

SEQ ID NO: 223356 - RNA, 22 nt, Human
aagugugggaaguagguggcga

SEQ ID NO: 223357 - RNA, 22 nt, Human
acuccaggcaucugcuucugcu

SEQ ID NO: 223358 - RNA, 22 nt, Human
gcagaugaggaagcuaaugcug

SEQ ID NO: 223359 - RNA, 22 nt, Human
aagcaccacccucccaaccugu

SEQ ID NO: 223360 - RNA, 22 nt, Human
uagaaagucaugaauuacacca

SEQ ID NO: 223361 - RNA, 22 nt, Human
ggccagaggccauccuccugcu

SEQ ID NO: 223362 - RNA, 22 nt, Human
ccagacaguuccuugagguuca

SEQ ID NO: 223363 - RNA, 22 nt, Human
uguccagguuagcuucaaacac

SEQ ID NO: 223364 - RNA, 22 nt, Human
aagcccucauuagccauagccc

SEQ ID NO: 223365 - RNA, 23 nt, Human
uccucaguauauaaaggcagaug

SEQ ID NO: 223366 - RNA, 22 nt, Human
gagcucuguguagccugagggu

SEQ ID NO: 223367 - RNA, 22 nt, Human
uuuacaaggcagaacugauuaa

SEQ ID NO: 223368 - RNA, 22 nt, Human
aaagaauacuccuuuugccuug

SEQ ID NO: 223369 - RNA, 21 nt, Human
ccaggacuccauggggucucu

SEQ ID NO: 223370 - RNA, 22 nt, Human
augagcagauauggauuuuaga

SEQ ID NO: 223371 - RNA, 22 nt, Human
uuaccuguuuuacaugcacaac

SEQ ID NO: 223372 - RNA, 22 nt, Human
gaccaggcuguuccagucuaac

SEQ ID NO: 223373 - RNA, 22 nt, Human
uccugcaggggcugaggaacca

SEQ ID NO: 223374 - RNA, 22 nt, Human
guggcagggugcucaucaugca

SEQ ID NO: 223375 - RNA, 22 nt, Human
ucuuuccccuacauuugguuaa

SEQ ID NO: 223376 - RNA, 22 nt, Human
augucacuccagggacacaggu

SEQ ID NO: 223377 - RNA, 22 nt, Human
ucauugcagacuaacaaucuca

SEQ ID NO: 223378 - RNA, 22 nt, Human
uagaaaccaucucacugcucag

SEQ ID NO: 223379 - RNA, 22 nt, Human
uucuuuauugagacuucauugu

SEQ ID NO: 223380 - RNA, 22 nt, Human
acuguugaagugccagcuugau

SEQ ID NO: 223381 - RNA, 22 nt, Human
cauagcuuagggguuaaacuca

SEQ ID NO: 223382 - RNA, 22 nt, Human
uaaaucuuuaggaagcucaaac

SEQ ID NO: 223383 - RNA, 22 nt, Human
uagggguuaccuuuagcaucuc

SEQ ID NO: 223384 - RNA, 22 nt, Human
caaaggcugguagaaugagcca

SEQ ID NO: 223385 - RNA, 22 nt, Human
aucuuucucugcacuauacaau

SEQ ID NO: 223386 - RNA, 22 nt, Human
cugcaggggcuggaguuggcuu

SEQ ID NO: 223387 - RNA, 22 nt, Human
agaggaggcuggguccagauaa

SEQ ID NO: 223388 - RNA, 21 nt, Human
agucuuugauaaagacaaagu

SEQ ID NO: 223389 - RNA, 22 nt, Human
uucaggauccccaccgcguuua

SEQ ID NO: 223390 - RNA, 22 nt, Human
cccaggccagaacuugguugcu

SEQ ID NO: 223391 - RNA, 22 nt, Human
gagcauuuuugucugcauuuua

SEQ ID NO: 223392 - RNA, 22 nt, Human
auacacauguguaugugcaugc

SEQ ID NO: 223393 - RNA, 22 nt, Human
uccuggcccacuccuagcuucu

SEQ ID NO: 223394 - RNA, 22 nt, Human
aauuccauccauuuguuucaac

SEQ ID NO: 223395 - RNA, 18 nt, Human
aggcacagagcauacaua

SEQ ID NO: 223396 - RNA, 22 nt, Human
uccugagcuucaguuucuucau

SEQ ID NO: 223397 - RNA, 19 nt, Human
gccugcagaaaaggcaggg

SEQ ID NO: 223398 - RNA, 22 nt, Human
cauacaaucaaguucuuuauua

SEQ ID NO: 223399 - RNA, 22 nt, Human
aacugcaaaaaugguagucuua

SEQ ID NO: 223400 - RNA, 22 nt, Human
uuucacaucagagguagauuag

SEQ ID NO: 223401 - RNA, 22 nt, Human
uuacacaaaaauaagauauggc

SEQ ID NO: 223402 - RNA, 22 nt, Human
ugggugaggagaggcugucuaa

SEQ ID NO: 223403 - RNA, 22 nt, Human
aauaagaauuuacuugucaaga

SEQ ID NO: 223404 - RNA, 18 nt, Human
gaaaauacucugggcuca

SEQ ID NO: 223405 - RNA, 22 nt, Human
cuucuucaucuguaaaacuugg

SEQ ID NO: 223406 - RNA, 22 nt, Human
cucaacauuuaacagugaaaaa

SEQ ID NO: 223407 - RNA, 22 nt, Human
uuggagggacugagcuucaguc

SEQ ID NO: 223408 - RNA, 22 nt, Human
uagcaaaaacugcaguuacuuu

SEQ ID NO: 223409 - RNA, 22 nt, Human
gagugucugaauuagagcacaa

SEQ ID NO: 223410 - RNA, 22 nt, Human
acagcuuuguuuucccugcuga

SEQ ID NO: 223411 - RNA, 22 nt, Human
gggcagcuagcccucuagccca

SEQ ID NO: 223412 - RNA, 22 nt, Human
aaagagcacccucaaugucuga

SEQ ID NO: 223413 - RNA, 22 nt, Human
guuuguaugaauguuuuaugcu

SEQ ID NO: 223414 - RNA, 22 nt, Human
cagcagggcccccgggugcgcc

SEQ ID NO: 223415 - RNA, 22 nt, Human
uuuaugaaccacucuacaccuu

SEQ ID NO: 223416 - RNA, 22 nt, Human
aacuugaaacuguuccagaaaa

SEQ ID NO: 223417 - RNA, 22 nt, Human
ucugcaggaaaaaagugccugg

SEQ ID NO: 223418 - RNA, 22 nt, Human
aacagacuuagagcaucccaau

SEQ ID NO: 223419 - RNA, 22 nt, Human
cagccagggagcaaagaguuga

SEQ ID NO: 223420 - RNA, 22 nt, Human
aggaugaauaacugaaauggug

SEQ ID NO: 223421 - RNA, 23 nt, Human
aaauaggaguaucuggaucauga

SEQ ID NO: 223422 - RNA, 22 nt, Human
ugccuacauuccuugcuuaugg

SEQ ID NO: 223423 - RNA, 22 nt, Human
ucgugcaaaccugacacagcca

SEQ ID NO: 223424 - RNA, 19 nt, Human
aauguuuaagagaaaaagg

SEQ ID NO: 223425 - RNA, 22 nt, Human
aaaagagaguugccagucugua

SEQ ID NO: 223426 - RNA, 22 nt, Human
acaauuagugaucagugaugcc

SEQ ID NO: 223427 - RNA, 22 nt, Human
aagucuuuugcugucauaggug

SEQ ID NO: 223428 - RNA, 18 nt, Human
cagaugagaugcaaucuc

SEQ ID NO: 223429 - RNA, 22 nt, Human
caaaugugguuucucagcauuc

SEQ ID NO: 223430 - RNA, 23 nt, Human
uucuggauguucuagucugagag

SEQ ID NO: 223431 - RNA, 22 nt, Human
gccagccagaguccaucugaga

SEQ ID NO: 223432 - RNA, 22 nt, Human
caggcugggcugguguuagagu

SEQ ID NO: 223433 - RNA, 22 nt, Human
gugucaacagccgaagauaaau

SEQ ID NO: 223434 - RNA, 22 nt, Human
cucaaauaccucuccaugugac

SEQ ID NO: 223435 - RNA, 22 nt, Human
auacaacuuuaucuguaaugag

SEQ ID NO: 223436 - RNA, 22 nt, Human
ucaauucuaguggagagaguuu

SEQ ID NO: 223437 - RNA, 22 nt, Human
ccuccugggacaggcuggcaca

SEQ ID NO: 223438 - RNA, 22 nt, Human
aguaaacagaaagcaagaugau

SEQ ID NO: 223439 - RNA, 22 nt, Human
ugcucccaggcucuguggucug

SEQ ID NO: 223440 - RNA, 22 nt, Human
aaaaguauuggccaccauuucu

SEQ ID NO: 223441 - RNA, 22 nt, Human
aggcaguguggagggcuguugc

SEQ ID NO: 223442 - RNA, 22 nt, Human
aaccagcugagaaugcuucugc

SEQ ID NO: 223443 - RNA, 22 nt, Human
ugcuggcugggcugcuggagac

SEQ ID NO: 223444 - RNA, 22 nt, Human
guuuuuucaugaguaguuaucu

SEQ ID NO: 223445 - RNA, 22 nt, Human
gaagcuuggauaacuguauggg

SEQ ID NO: 223446 - RNA, 22 nt, Human
aguggguguagucuuccuccug

SEQ ID NO: 223447 - RNA, 22 nt, Human
caggcagcaggagcccugcucg

SEQ ID NO: 223448 - RNA, 22 nt, Human
ggguccaggcggcauaguugua

SEQ ID NO: 223449 - RNA, 22 nt, Human
guuuacuguuaaccaacgaaug

SEQ ID NO: 223450 - RNA, 22 nt, Human
cuggagagaccgaaagaggcug

SEQ ID NO: 223451 - RNA, 22 nt, Human
ugccuggcaagaggggcuggcu

SEQ ID NO: 223452 - RNA, 22 nt, Human
uugccauuaaaacauguuaucu

SEQ ID NO: 223453 - RNA, 22 nt, Human
uucaguguuaaucuugggagaa

SEQ ID NO: 223454 - RNA, 22 nt, Human
ggaaggucgagcugcaucuggc

SEQ ID NO: 223455 - RNA, 22 nt, Human
acauauauuuucacacaugguu

SEQ ID NO: 223456 - RNA, 22 nt, Human
caggcuccuuaucuuacaacuu

SEQ ID NO: 223457 - RNA, 20 nt, Human
ugagcuucagauaucgugca

SEQ ID NO: 223458 - RNA, 22 nt, Human
gcucucuuuuuccagugguggu

SEQ ID NO: 223459 - RNA, 22 nt, Human
aagcaagccaaucuguuuuguu

SEQ ID NO: 223460 - RNA, 22 nt, Human
aauggcuucugaagcacacuuu

SEQ ID NO: 223461 - RNA, 22 nt, Human
uacuguuuuugccucuuuagaa

SEQ ID NO: 223462 - RNA, 22 nt, Human
acugccuucuuggccuucaaaa

SEQ ID NO: 223463 - RNA, 22 nt, Human
ccaggcugaauauguuccaggg

SEQ ID NO: 223464 - RNA, 22 nt, Human
uaaacagagagugcaguuauag

SEQ ID NO: 223465 - RNA, 22 nt, Human
ucugggcucugggaauuaggga

SEQ ID NO: 223466 - RNA, 22 nt, Human
ccagucuguacuuugcucuguu

SEQ ID NO: 223467 - RNA, 22 nt, Human
ucugucuuagccaucucaggcu

SEQ ID NO: 223468 - RNA, 22 nt, Human
ggacaucucuugccagggcugc

SEQ ID NO: 223469 - RNA, 22 nt, Human
aagugcugagacuacaggcaug

SEQ ID NO: 223470 - RNA, 21 nt, Human
ugcaggcugugcgcuccugcc

SEQ ID NO: 223471 - RNA, 22 nt, Human
ggcugcugggucaugaugcaga

SEQ ID NO: 223472 - RNA, 22 nt, Human
gccaggcuccaggcccuccuga

SEQ ID NO: 223473 - RNA, 22 nt, Human
ucaucugaggcaccagagcaua

SEQ ID NO: 223474 - RNA, 22 nt, Human
uuagagaagcuguaauuauuca

SEQ ID NO: 223475 - RNA, 22 nt, Human
ccugagcaaaggcccagaggga

SEQ ID NO: 223476 - RNA, 22 nt, Human
aaaauuuccaccaucuuugugu

SEQ ID NO: 223477 - RNA, 22 nt, Human
gugcagcugggcgcugaccuuc

SEQ ID NO: 223478 - RNA, 22 nt, Human
gacaccagcaaggcugugagga

SEQ ID NO: 223479 - RNA, 18 nt, Human
uaagagcagacuguaggc

SEQ ID NO: 223480 - RNA, 22 nt, Human
ucuccaggacugagcuccagcc

SEQ ID NO: 223481 - RNA, 22 nt, Human
auuaagcuccaaguugcucuga

SEQ ID NO: 223482 - RNA, 22 nt, Human
ccacagaaugaugacacuucag

SEQ ID NO: 223483 - RNA, 22 nt, Human
aaauucauuuuucuuagugugc

SEQ ID NO: 223484 - RNA, 22 nt, Human
auucuugauauagauaguuaau

SEQ ID NO: 223485 - RNA, 22 nt, Human
agaugguuaucuuuucuuugua

SEQ ID NO: 223486 - RNA, 22 nt, Human
cacauucuugaguuacagucua

SEQ ID NO: 223487 - RNA, 22 nt, Human
cgggcagugcccagcggggcag

SEQ ID NO: 223488 - RNA, 22 nt, Human
auuuaagauugcguauucaugu

SEQ ID NO: 223489 - RNA, 22 nt, Human
gagggaggggagcuccacccuc

SEQ ID NO: 223490 - RNA, 20 nt, Human
gaguccuuaugggcugaggu

SEQ ID NO: 223491 - RNA, 22 nt, Human
ucagcucuuaacccucuggccu

SEQ ID NO: 223492 - RNA, 22 nt, Human
cacccuagcugucauuucaguu

SEQ ID NO: 223493 - RNA, 20 nt, Human
agcaccucccauaugcuaga

SEQ ID NO: 223494 - RNA, 22 nt, Human
uguucuugagccuuuagaccua

SEQ ID NO: 223495 - RNA, 22 nt, Human
gaggucaggcuugcagcagggu

SEQ ID NO: 223496 - RNA, 22 nt, Human
uuggcgcccaggacgccgccgc

SEQ ID NO: 223497 - RNA, 21 nt, Human
aggaagaucuggaggucggcg

SEQ ID NO: 223498 - RNA, 22 nt, Human
ugggaagggucaacagcuggaa

SEQ ID NO: 223499 - RNA, 22 nt, Human
ggcuaccagauaaauuacagag

SEQ ID NO: 223500 - RNA, 22 nt, Human
accagccccaccgggacugcag

SEQ ID NO: 223501 - RNA, 22 nt, Human
aggcugaggcgggaggaucacu

SEQ ID NO: 223502 - RNA, 22 nt, Human
auaugaaaagaagucaccauug

SEQ ID NO: 223503 - RNA, 22 nt, Human
cauaauuuuccaugguuugcua

SEQ ID NO: 223504 - RNA, 22 nt, Human
gaaaaaggauaaauacaguguu

SEQ ID NO: 223505 - RNA, 22 nt, Human
auccacccugugguggcuuucu

SEQ ID NO: 223506 - RNA, 22 nt, Human
agccaggccagcugucuugagu

SEQ ID NO: 223507 - RNA, 22 nt, Human
aacagagcauucugcacuacaa

SEQ ID NO: 223508 - RNA, 22 nt, Human
uguccucaaggagcuucagucu

SEQ ID NO: 223509 - RNA, 22 nt, Human
aagguuuuuuuccaguaucucu

SEQ ID NO: 223510 - RNA, 18 nt, Human
ccauggcucccuccugcc

SEQ ID NO: 223511 - RNA, 19 nt, Human
cugaggugcaguaagaggc

SEQ ID NO: 223512 - RNA, 22 nt, Human
gaggccugaaaggggaccuaug

SEQ ID NO: 223513 - RNA, 22 nt, Human
ugugguggcuauucuggucuca

SEQ ID NO: 223514 - RNA, 22 nt, Human
ggugagggaguggaacgaggug

SEQ ID NO: 223515 - RNA, 22 nt, Human
gugcagcugguggagucugggg

SEQ ID NO: 223516 - RNA, 22 nt, Human
augagcaggaagagcacaaaga

SEQ ID NO: 223517 - RNA, 22 nt, Human
aggcugaggcagguggaucacc

SEQ ID NO: 223518 - RNA, 22 nt, Human
uuguacaaaggauuuggaagag

SEQ ID NO: 223519 - RNA, 22 nt, Human
ccaggcacaggugggccucaga

SEQ ID NO: 223520 - RNA, 22 nt, Human
ucacagugcaccagugugaagc

SEQ ID NO: 223521 - RNA, 19 nt, Human
ccugugugggguagagauc

SEQ ID NO: 223522 - RNA, 22 nt, Human
aaugcagaccaguaugaaaaac

SEQ ID NO: 223523 - RNA, 22 nt, Human
aggcuccaccagucaggugcau

SEQ ID NO: 223524 - RNA, 22 nt, Human
gcuggcuugacagaggccuggg

SEQ ID NO: 223525 - RNA, 22 nt, Human
uaacauguuaagaaauuagaua

SEQ ID NO: 223526 - RNA, 22 nt, Human
gcucagaggagcaucauaagga

SEQ ID NO: 223527 - RNA, 22 nt, Human
aaagcauuucaugucuagaaag

SEQ ID NO: 223528 - RNA, 22 nt, Human
acuguuacagagcaggaaauug

SEQ ID NO: 223529 - RNA, 18 nt, Human
agcuucccucugagaggg

SEQ ID NO: 223530 - RNA, 22 nt, Human
ucuuucaaaguaacaaccacga

SEQ ID NO: 223531 - RNA, 22 nt, Human
cacauguucuugaagccaacuc

SEQ ID NO: 223532 - RNA, 22 nt, Human
agaaccucacgagauuccuuca

SEQ ID NO: 223533 - RNA, 21 nt, Human
uccagggaacuucucaggaau

SEQ ID NO: 223534 - RNA, 22 nt, Human
ugugguuuugguucagaaacaa

SEQ ID NO: 223535 - RNA, 22 nt, Human
ccaggcugcucacaagcugccc

SEQ ID NO: 223536 - RNA, 18 nt, Human
aagaacugagguccuaga

SEQ ID NO: 223537 - RNA, 22 nt, Human
uugaaagacuucuccugugaaa

SEQ ID NO: 223538 - RNA, 22 nt, Human
caugggcaccuuaaaaugaggc

SEQ ID NO: 223539 - RNA, 22 nt, Human
uaaagacaugcaaagucuaauu

SEQ ID NO: 223540 - RNA, 22 nt, Human
uggcugcaguugggcccucaga

SEQ ID NO: 223541 - RNA, 22 nt, Human
gugguccuggcaaccaugguga

SEQ ID NO: 223542 - RNA, 19 nt, Human
uugugacuggcucugcaua

SEQ ID NO: 223543 - RNA, 22 nt, Human
gcuuuggaaauauagacucaag

SEQ ID NO: 223544 - RNA, 22 nt, Human
gugggggcuggaaaucuugcca

SEQ ID NO: 223545 - RNA, 22 nt, Human
gacaagaugacaucauggcuuc

SEQ ID NO: 223546 - RNA, 21 nt, Human
auaaacagcaugugauccaug

SEQ ID NO: 223547 - RNA, 21 nt, Human
guucaugucagcauuaaggga

SEQ ID NO: 223548 - RNA, 22 nt, Human
auggcagaaaggcaugugggcc

SEQ ID NO: 223549 - RNA, 22 nt, Human
gggaucugcuccagagggaaaa

SEQ ID NO: 223550 - RNA, 22 nt, Human
uuauagcagcaugauuuauaau

SEQ ID NO: 223551 - RNA, 22 nt, Human
aagggcagggaguuugugucua

SEQ ID NO: 223552 - RNA, 22 nt, Human
cuggcugcgcuaguccagaaga

SEQ ID NO: 223553 - RNA, 22 nt, Human
uuugaaagucaaccuuccaguu

SEQ ID NO: 223554 - RNA, 21 nt, Human
augguagguggagcaggugau

SEQ ID NO: 223555 - RNA, 22 nt, Human
uagcucaaagguuaagugugga

SEQ ID NO: 223556 - RNA, 22 nt, Human
aggcagccuuuagacagucugc

SEQ ID NO: 223557 - RNA, 22 nt, Human
uuaaaaccaucagcuguaagau

SEQ ID NO: 223558 - RNA, 22 nt, Human
caccagcucuccaccagguuuc

SEQ ID NO: 223559 - RNA, 22 nt, Human
ggcuggcucuuaccgacagcgu

SEQ ID NO: 223560 - RNA, 22 nt, Human
gcacagacucaccuuaauuuga

SEQ ID NO: 223561 - RNA, 22 nt, Human
aagguauuauugucuauguacu

SEQ ID NO: 223562 - RNA, 22 nt, Human
cuggcccucagacucaugggca

SEQ ID NO: 223563 - RNA, 22 nt, Human
uugagaaauaagcaugucuaga

SEQ ID NO: 223564 - RNA, 22 nt, Human
ucagggcaccaaaaaagaugcc

SEQ ID NO: 223565 - RNA, 21 nt, Human
uuguguuuccccagucacuuu

SEQ ID NO: 223566 - RNA, 22 nt, Human
uagcugagaggccaauugaacu

SEQ ID NO: 223567 - RNA, 22 nt, Human
cugcucagucauguuggauugu

SEQ ID NO: 223568 - RNA, 22 nt, Human
cuagagaacaacauucauaugg

SEQ ID NO: 223569 - RNA, 22 nt, Human
auuuuaccuuaaagucuauauu

SEQ ID NO: 223570 - RNA, 22 nt, Human
gcucccuccaugaggcagaccg

SEQ ID NO: 223571 - RNA, 22 nt, Human
ugucacauguuuaauguggacu

SEQ ID NO: 223572 - RNA, 22 nt, Human
uccaggccgcaggggcagcccc

SEQ ID NO: 223573 - RNA, 22 nt, Human
ggacugggcaugggugcucugc

SEQ ID NO: 223574 - RNA, 22 nt, Human
ccucagcauccuccugcucagu

SEQ ID NO: 223575 - RNA, 22 nt, Human
caguuacagcugcaccagagcc

SEQ ID NO: 223576 - RNA, 22 nt, Human
uacacacagaggccaugggauu

SEQ ID NO: 223577 - RNA, 22 nt, Human
uaguggaggggaugcaaagcuu

SEQ ID NO: 223578 - RNA, 20 nt, Human
ugggagcuggugaggucuca

SEQ ID NO: 223579 - RNA, 22 nt, Human
cucuaaaggcuuguuauugcau

SEQ ID NO: 223580 - RNA, 20 nt, Human
ugcucuggggguggagagac

SEQ ID NO: 223581 - RNA, 22 nt, Human
ucuuuggaucucaagguggcag

SEQ ID NO: 223582 - RNA, 20 nt, Human
gcuuccagaggaggccccgu

SEQ ID NO: 223583 - RNA, 22 nt, Human
uucaguguauauuuuuugagua

SEQ ID NO: 223584 - RNA, 22 nt, Human
uggucucugcaggccaggcuca

SEQ ID NO: 223585 - RNA, 22 nt, Human
agcuugggcaacacagcaagac

SEQ ID NO: 223586 - RNA, 22 nt, Human
ugguccuggagaucaauaugca

SEQ ID NO: 223587 - RNA, 22 nt, Human
cagcacaguuugcuuggcagag

SEQ ID NO: 223588 - RNA, 22 nt, Human
accuguuuucagaaaaugcaga

SEQ ID NO: 223589 - RNA, 22 nt, Human
ucugggcucuuaguguacccuc

SEQ ID NO: 223590 - RNA, 22 nt, Human
ucaguaauauucuuuaaaauac

SEQ ID NO: 223591 - RNA, 22 nt, Human
cucuggaggccguuggcccuua

SEQ ID NO: 223592 - RNA, 22 nt, Human
uacauuaucuuguuaucuuuca

SEQ ID NO: 223593 - RNA, 22 nt, Human
uggcccugcuuaugucucucuu

SEQ ID NO: 223594 - RNA, 22 nt, Human
acauucuuucucuucaggaaac

SEQ ID NO: 223595 - RNA, 22 nt, Human
auuuucaugacuaccuuaaaua

SEQ ID NO: 223596 - RNA, 22 nt, Human
uuucaugcacaaaugagcaagg

SEQ ID NO: 223597 - RNA, 22 nt, Human
uggaaggcugugauuacugugc

SEQ ID NO: 223598 - RNA, 22 nt, Human
uccuccacgauggcacaccugg

SEQ ID NO: 223599 - RNA, 22 nt, Human
ggcucuggagacauguggagag

SEQ ID NO: 223600 - RNA, 22 nt, Human
ugaguccaauaggggccuggaa

SEQ ID NO: 223601 - RNA, 22 nt, Human
ugcagcagcagggaggaggcuc

SEQ ID NO: 223602 - RNA, 23 nt, Human
uaagugauuagaauuugcuguca

SEQ ID NO: 223603 - RNA, 22 nt, Human
uccugggcuuaguggcuagguc

SEQ ID NO: 223604 - RNA, 22 nt, Human
ugucaugguagcugaaggaugu

SEQ ID NO: 223605 - RNA, 22 nt, Human
cuucccaggugcucuuagcaug

SEQ ID NO: 223606 - RNA, 22 nt, Human
uccuucuguagucccugucccu

SEQ ID NO: 223607 - RNA, 22 nt, Human
cagccugggcuccagagucccu

SEQ ID NO: 223608 - RNA, 22 nt, Human
cgguccuguacuugaugagaua

SEQ ID NO: 223609 - RNA, 22 nt, Human
acauguuuaaguuuaaugaaaa

SEQ ID NO: 223610 - RNA, 22 nt, Human
gcauucauacaucaauaagcuu

SEQ ID NO: 223611 - RNA, 22 nt, Human
cagagcuggcucugcauguaca

SEQ ID NO: 223612 - RNA, 22 nt, Human
gaguccaguuguucacagaggc

SEQ ID NO: 223613 - RNA, 22 nt, Human
auggcugcuuucccuuagcacc

SEQ ID NO: 223614 - RNA, 22 nt, Human
guccuagagggugagcuaggcu

SEQ ID NO: 223615 - RNA, 22 nt, Human
accucagaggaggcuccuggcu

SEQ ID NO: 223616 - RNA, 22 nt, Human
cggcugaggaucuccaggccug

SEQ ID NO: 223617 - RNA, 22 nt, Human
agucagguacuccgagggcaug

SEQ ID NO: 223618 - RNA, 22 nt, Human
aaugcacacauuugguacugaa

SEQ ID NO: 223619 - RNA, 22 nt, Human
ugagcccaggaguuggaggcug

SEQ ID NO: 223620 - RNA, 21 nt, Human
acagcaagccuucacaugagu

SEQ ID NO: 223621 - RNA, 22 nt, Human
auccuucagcugcccuguuacc

SEQ ID NO: 223622 - RNA, 22 nt, Human
uguacuugcuuauuagaaaucu

SEQ ID NO: 223623 - RNA, 22 nt, Human
aguggcaaaagcaggcuuaggc

SEQ ID NO: 223624 - RNA, 22 nt, Human
uacaacauuguguugcuucaua

SEQ ID NO: 223625 - RNA, 21 nt, Human
auucagaguaauucaucuuua

SEQ ID NO: 223626 - RNA, 22 nt, Human
gccccaccgagggugcaguccu

SEQ ID NO: 223627 - RNA, 22 nt, Human
acaaauuuggugagaguaaaua

SEQ ID NO: 223628 - RNA, 22 nt, Human
uacuuguuaucaucuuuuccuu

SEQ ID NO: 223629 - RNA, 22 nt, Human
ucacacauuucucaaguguagg

SEQ ID NO: 223630 - RNA, 22 nt, Human
ucuguuauauguuuuuucuaaa

SEQ ID NO: 223631 - RNA, 22 nt, Human
gucucccaucucuguccuugug

SEQ ID NO: 223632 - RNA, 22 nt, Human
uccaggcccauagacacuucuc

SEQ ID NO: 223633 - RNA, 19 nt, Human
uggcucuguuucucuggag

SEQ ID NO: 223634 - RNA, 22 nt, Human
aaaggccaauaaagacaagcug

SEQ ID NO: 223635 - RNA, 19 nt, Human
ccagugcaagguaagauag

SEQ ID NO: 223636 - RNA, 22 nt, Human
uguggagguuuaaguaauggga

SEQ ID NO: 223637 - RNA, 22 nt, Human
ugcaaaugggugaggguuagga

SEQ ID NO: 223638 - RNA, 22 nt, Human
augaaugggucauuauuugauc

SEQ ID NO: 223639 - RNA, 22 nt, Human
uggcccuguucuguaccucaua

SEQ ID NO: 223640 - RNA, 22 nt, Human
acccauacacacauauuuaugu

SEQ ID NO: 223641 - RNA, 22 nt, Human
cuaauauuuuuagaaaucacga

SEQ ID NO: 223642 - RNA, 22 nt, Human
ucuguuuuguaccagauacagc

SEQ ID NO: 223643 - RNA, 22 nt, Human
aguuggcaaggucuggccagcg

SEQ ID NO: 223644 - RNA, 22 nt, Human
augucacagcucccauuccucc

SEQ ID NO: 223645 - RNA, 22 nt, Human
cuuucuuugcagugagccagag

SEQ ID NO: 223646 - RNA, 22 nt, Human
agaugcugugaggaagcuagga

SEQ ID NO: 223647 - RNA, 22 nt, Human
ugcaucugauucucaggcagaa

SEQ ID NO: 223648 - RNA, 22 nt, Human
uaaacauggcuguuucaguuau

SEQ ID NO: 223649 - RNA, 20 nt, Human
ucccaaggaugccugggugu

SEQ ID NO: 223650 - RNA, 22 nt, Human
acaggccacaguggagucucug

SEQ ID NO: 223651 - RNA, 22 nt, Human
cauuccugagggcccccuacuu

SEQ ID NO: 223652 - RNA, 22 nt, Human
ggccagcuguaagcugcugaau

SEQ ID NO: 223653 - RNA, 22 nt, Human
caguguaucauuagugugauga

SEQ ID NO: 223654 - RNA, 22 nt, Human
ggucaacacugugaccaacagg

SEQ ID NO: 223655 - RNA, 18 nt, Human
agcaacaggaucccaggg

SEQ ID NO: 223656 - RNA, 23 nt, Human
aaggguccauagcuaucauuaca

SEQ ID NO: 223657 - RNA, 22 nt, Human
ggccccagggaagaaggugguc

SEQ ID NO: 223658 - RNA, 22 nt, Human
gucacacucaaaagcuaggaug

SEQ ID NO: 223659 - RNA, 22 nt, Human
uagagacaccaguaccauucug

SEQ ID NO: 223660 - RNA, 22 nt, Human
auuugucuagugguauucacgu

SEQ ID NO: 223661 - RNA, 22 nt, Human
agggaugguggaggaauuucaa

SEQ ID NO: 223662 - RNA, 22 nt, Human
uuggcuucuuuagucaguuugg

SEQ ID NO: 223663 - RNA, 22 nt, Human
ucucaggcaugguuuguucauc

SEQ ID NO: 223664 - RNA, 22 nt, Human
gaggggcuggcacgauggcugc

SEQ ID NO: 223665 - RNA, 22 nt, Human
auauuacacacgguaucacggg

SEQ ID NO: 223666 - RNA, 22 nt, Human
augcagcugacauuuucauguu

SEQ ID NO: 223667 - RNA, 20 nt, Human
auuagagcuacauggcuaca

SEQ ID NO: 223668 - RNA, 22 nt, Human
acagcugggugucccacuucug

SEQ ID NO: 223669 - RNA, 22 nt, Human
aaguggcuuugagcuucugcca

SEQ ID NO: 223670 - RNA, 22 nt, Human
ugcauauugugaaaauguagau

SEQ ID NO: 223671 - RNA, 22 nt, Human
ggcuccagaaaucauagagcag

SEQ ID NO: 223672 - RNA, 22 nt, Human
cacagcuucccaaaguggaccu

SEQ ID NO: 223673 - RNA, 22 nt, Human
uccacagguauuucuccuugcu

SEQ ID NO: 223674 - RNA, 22 nt, Human
uaaauacuuuacaggaugucuc

SEQ ID NO: 223675 - RNA, 22 nt, Human
uuguacuuaaauaugcaaauag

SEQ ID NO: 223676 - RNA, 22 nt, Human
ggggccagguccagcuuccaaa

SEQ ID NO: 223677 - RNA, 22 nt, Human
aggcuggcgacaucuggcgggc

SEQ ID NO: 223678 - RNA, 22 nt, Human
acucuuugucuguugccgcuua

SEQ ID NO: 223679 - RNA, 22 nt, Human
uccugguggugccagcugcagg

SEQ ID NO: 223680 - RNA, 22 nt, Human
cccucucccugcagaauguggc

SEQ ID NO: 223681 - RNA, 22 nt, Human
uagaucuuucacuacuguguag

SEQ ID NO: 223682 - RNA, 22 nt, Human
cugagcagcacagggcgccagg

SEQ ID NO: 223683 - RNA, 17 nt, Human
uggcaagacagcucagg

SEQ ID NO: 223684 - RNA, 22 nt, Human
cuuuggaaggcagagcucugug

SEQ ID NO: 223685 - RNA, 23 nt, Human
ucacuugaagcuagaaucugccc

SEQ ID NO: 223686 - RNA, 19 nt, Human
ccaggccuggcgucuccgc

SEQ ID NO: 223687 - RNA, 22 nt, Human
cugcacagcugggcaagauaua

SEQ ID NO: 223688 - RNA, 23 nt, Human
uggccaggguacuacacccaccc

SEQ ID NO: 223689 - RNA, 22 nt, Human
ucucaggcuaguaaaagauggg

SEQ ID NO: 223690 - RNA, 22 nt, Human
uugguuuagcaacuuccugugu

SEQ ID NO: 223691 - RNA, 22 nt, Human
cuccacagccccuccaguggca

SEQ ID NO: 223692 - RNA, 22 nt, Human
guuuucugauuagcaaaucuga

SEQ ID NO: 223693 - RNA, 22 nt, Human
uuuuucaucugauugauaacuc

SEQ ID NO: 223694 - RNA, 22 nt, Human
agucaccaucuguggcagccug

SEQ ID NO: 223695 - RNA, 22 nt, Human
ccugccaggccagugagcuucc

SEQ ID NO: 223696 - RNA, 22 nt, Human
aaugucuacaccguauguuguu

SEQ ID NO: 223697 - RNA, 22 nt, Human
ucucugaagaaucgaugauucu

SEQ ID NO: 223698 - RNA, 22 nt, Human
agcuggugugccacuguugggg

SEQ ID NO: 223699 - RNA, 22 nt, Human
ucugcaggagagugcccuagag

SEQ ID NO: 223700 - RNA, 22 nt, Human
ugcuuuuaggagauuaaaauua

SEQ ID NO: 223701 - RNA, 22 nt, Human
aguggcugccaagagcaaugcu

SEQ ID NO: 223702 - RNA, 22 nt, Human
ggggaaagugaauuguguagug

SEQ ID NO: 223703 - RNA, 22 nt, Human
gagcagcucugugccuggagac

SEQ ID NO: 223704 - RNA, 22 nt, Human
cucgcaggacagugcuaggacu

SEQ ID NO: 223705 - RNA, 22 nt, Human
uauguuuaguauccauuuucag

SEQ ID NO: 223706 - RNA, 21 nt, Human
aggacagauguaggaauaaag

SEQ ID NO: 223707 - RNA, 22 nt, Human
ccuggucagagcagucaggauc

SEQ ID NO: 223708 - RNA, 22 nt, Human
aacucuauuuacccuacuaaac

SEQ ID NO: 223709 - RNA, 22 nt, Human
aagacucuaucuuuagagauca

SEQ ID NO: 223710 - RNA, 22 nt, Human
ccuguguuaguuaugggucucu

SEQ ID NO: 223711 - RNA, 22 nt, Human
ucccaccccuugacucuuuaag

SEQ ID NO: 223712 - RNA, 22 nt, Human
gcccucuggcagccuuggcugg

SEQ ID NO: 223713 - RNA, 22 nt, Human
aggcuucugagcauggaguuuu

SEQ ID NO: 223714 - RNA, 22 nt, Human
gaggccaggaagcccaagauca

SEQ ID NO: 223715 - RNA, 22 nt, Human
cugaggcacugucagcugaggc

SEQ ID NO: 223716 - RNA, 22 nt, Human
ucuaggaggcacacaaguaguu

SEQ ID NO: 223717 - RNA, 22 nt, Human
caauuugauuaauaccauacuu

SEQ ID NO: 223718 - RNA, 22 nt, Human
ugaugaggggcucagaggucag

SEQ ID NO: 223719 - RNA, 22 nt, Human
auuucccacucaggccgcggcg

SEQ ID NO: 223720 - RNA, 22 nt, Human
ucagagaaugugaauauuaaac

SEQ ID NO: 223721 - RNA, 19 nt, Human
uccugcugugugaagggga

SEQ ID NO: 223722 - RNA, 22 nt, Human
agaagccaaaugccagugaccu

SEQ ID NO: 223723 - RNA, 22 nt, Human
aauugaugauucuuaugugaaa

SEQ ID NO: 223724 - RNA, 22 nt, Human
cuccagaggaaagcacauagug

SEQ ID NO: 223725 - RNA, 22 nt, Human
cugaagagaaagggagcucuuc

SEQ ID NO: 223726 - RNA, 22 nt, Human
gcuggcaguguauuguuagcug

SEQ ID NO: 223727 - RNA, 22 nt, Human
aaguuucaaauauaaaauuaca

SEQ ID NO: 223728 - RNA, 20 nt, Human
aagcacugugguggcaugga

SEQ ID NO: 223729 - RNA, 22 nt, Human
aggaggcccuagagcucuagag

SEQ ID NO: 223730 - RNA, 22 nt, Human
ccaguuuagguacuaggcucua

SEQ ID NO: 223731 - RNA, 22 nt, Human
uccugugaguagauaguauugu

SEQ ID NO: 223732 - RNA, 22 nt, Human
cagaggugcuggagugaguccu

SEQ ID NO: 223733 - RNA, 22 nt, Human
gaggcucacugggcaaagacuc

SEQ ID NO: 223734 - RNA, 22 nt, Human
aagacacugauacucugugauu

SEQ ID NO: 223735 - RNA, 22 nt, Human
agugacaacaaguugacuagaa

SEQ ID NO: 223736 - RNA, 22 nt, Human
aaggcauagucuuuaaguucug

SEQ ID NO: 223737 - RNA, 22 nt, Human
gcaaggcugugcacuuugcauu

SEQ ID NO: 223738 - RNA, 22 nt, Human
agaggggcgggaacucaaccuc

SEQ ID NO: 223739 - RNA, 22 nt, Human
cccugcagcauucucuaacugg

SEQ ID NO: 223740 - RNA, 22 nt, Human
ugggcagguuguuauuugacau

SEQ ID NO: 223741 - RNA, 22 nt, Human
ucacagacgcauccucagguag

SEQ ID NO: 223742 - RNA, 22 nt, Human
agcagcugccagagagaguucc

SEQ ID NO: 223743 - RNA, 22 nt, Human
uggagauguaaagcaaggcuua

SEQ ID NO: 223744 - RNA, 22 nt, Human
cuuucuagaguauggagucugu

SEQ ID NO: 223745 - RNA, 22 nt, Human
aauauaguucuagaaauauuuu

SEQ ID NO: 223746 - RNA, 22 nt, Human
gccuuggcuguuggagcuugau

SEQ ID NO: 223747 - RNA, 22 nt, Human
agaauaaauguuggacuuagga

SEQ ID NO: 223748 - RNA, 22 nt, Human
cugcugcugagaaugccucagg

SEQ ID NO: 223749 - RNA, 22 nt, Human
uuacaaaguguuaugauaaaca

SEQ ID NO: 223750 - RNA, 22 nt, Human
ugggauaagguaugugaaguac

SEQ ID NO: 223751 - RNA, 22 nt, Human
agacaugacagauaguugcuag

SEQ ID NO: 223752 - RNA, 22 nt, Human
ucuggguggcuucagaggccac

SEQ ID NO: 223753 - RNA, 20 nt, Human
caugccagaaugugagguag

SEQ ID NO: 223754 - RNA, 22 nt, Human
aauaccaccucauucuggaggc

SEQ ID NO: 223755 - RNA, 22 nt, Human
aagcagcauaugacagcaucca

SEQ ID NO: 223756 - RNA, 22 nt, Human
auaugcuugggacugauacagu

SEQ ID NO: 223757 - RNA, 22 nt, Human
cagcuccugcagcuggcuccca

SEQ ID NO: 223758 - RNA, 19 nt, Human
aacaccagagucaggaguc

SEQ ID NO: 223759 - RNA, 22 nt, Human
gaugugucauuuggucaucugc

SEQ ID NO: 223760 - RNA, 22 nt, Human
uuucauguauuucccaaagcuu

SEQ ID NO: 223761 - RNA, 22 nt, Human
gcagggcugggauuugagccca

SEQ ID NO: 223762 - RNA, 20 nt, Human
uugguugagccagggccugg

SEQ ID NO: 223763 - RNA, 22 nt, Human
uggcucugggaaugggaagaug

SEQ ID NO: 223764 - RNA, 22 nt, Human
ccugaaaauauccucuccuuug

SEQ ID NO: 223765 - RNA, 22 nt, Human
aggagacccaaugccagaaaga

SEQ ID NO: 223766 - RNA, 22 nt, Human
ucuuuggcuuugccacacccaa

SEQ ID NO: 223767 - RNA, 22 nt, Human
aagauaauguucuagcugucag

SEQ ID NO: 223768 - RNA, 22 nt, Human
cugccaggcgauggauuggcug

SEQ ID NO: 223769 - RNA, 22 nt, Human
guggggaggcauucuucucccu

SEQ ID NO: 223770 - RNA, 23 nt, Human
acuuuauugaccccaggucaguu

SEQ ID NO: 223771 - RNA, 22 nt, Human
acugcaaaaaugggugcauuca

SEQ ID NO: 223772 - RNA, 22 nt, Human
ucugaagagcuuuggaaguaug

SEQ ID NO: 223773 - RNA, 19 nt, Human
cagagccuucagugacucc

SEQ ID NO: 223774 - RNA, 22 nt, Human
aagcaaaggcaggagcuuguga

SEQ ID NO: 223775 - RNA, 22 nt, Human
auuucaaggcuacagaaaccuu

SEQ ID NO: 223776 - RNA, 22 nt, Human
acugggccuacccagauuggca

SEQ ID NO: 223777 - RNA, 22 nt, Human
agaacucucgcuggaucagacu

SEQ ID NO: 223778 - RNA, 22 nt, Human
uaacacugauuuguucucaggg

SEQ ID NO: 223779 - RNA, 22 nt, Human
gcaaagcaaucaggaguagcau

SEQ ID NO: 223780 - RNA, 22 nt, Human
ucaggcaccccuugaguagggg

SEQ ID NO: 223781 - RNA, 22 nt, Human
uuccagaaaguucuggaacugg

SEQ ID NO: 223782 - RNA, 22 nt, Human
ugcagggucccgaagggaagac

SEQ ID NO: 223783 - RNA, 22 nt, Human
uggccuggaaaaaugcagaugg

SEQ ID NO: 223784 - RNA, 22 nt, Human
augaaaugaaguuggccuggcu

SEQ ID NO: 223785 - RNA, 22 nt, Human
accaggcaaaaccacaggagca

SEQ ID NO: 223786 - RNA, 22 nt, Human
augaggcaggagcggggacccu

SEQ ID NO: 223787 - RNA, 22 nt, Human
agaaccuuucuuuagaaauuca

SEQ ID NO: 223788 - RNA, 22 nt, Human
uggagcuggaauuucugggccu

SEQ ID NO: 223789 - RNA, 19 nt, Human
uccaggcuccauuggcaga

SEQ ID NO: 223790 - RNA, 22 nt, Human
ugcauuaagcacacuuuugaau

SEQ ID NO: 223791 - RNA, 22 nt, Human
uagacacaucaaggaucaguuu

SEQ ID NO: 223792 - RNA, 22 nt, Human
uuaauauacaauuuuacgggcu

SEQ ID NO: 223793 - RNA, 22 nt, Human
ccugaagggacuccagagagca

SEQ ID NO: 223794 - RNA, 22 nt, Human
agcugcaagaagaggucccuga

SEQ ID NO: 223795 - RNA, 22 nt, Human
ugcagucuuccagcugcacaaa

SEQ ID NO: 223796 - RNA, 23 nt, Human
ggucacaugugagauuaaacuug

SEQ ID NO: 223797 - RNA, 20 nt, Human
cugugcuccggguuccugga

SEQ ID NO: 223798 - RNA, 22 nt, Human
uaugugcaggggcaggagcuca

SEQ ID NO: 223799 - RNA, 22 nt, Human
uuuacaugaguagcagauguuc

SEQ ID NO: 223800 - RNA, 22 nt, Human
uucuucugacacugaugcugua

SEQ ID NO: 223801 - RNA, 22 nt, Human
ugucccugccugcccacucugu

SEQ ID NO: 223802 - RNA, 22 nt, Human
ucugaggaccaucggggagcug

SEQ ID NO: 223803 - RNA, 20 nt, Human
ucuguggcagguggcgcuug

SEQ ID NO: 223804 - RNA, 22 nt, Human
agugggggccaacgagggcagc

SEQ ID NO: 223805 - RNA, 20 nt, Human
ucagacccagauuagcaggu

SEQ ID NO: 223806 - RNA, 23 nt, Human
uuucccacccucucucauugcug

SEQ ID NO: 223807 - RNA, 22 nt, Human
auucagcauaaucaguagcuug

SEQ ID NO: 223808 - RNA, 22 nt, Human
agagcccuggagggcagucccg

SEQ ID NO: 223809 - RNA, 22 nt, Human
gcuccaggugaauccucucacc

SEQ ID NO: 223810 - RNA, 22 nt, Human
cagcugcucugguggucucucc

SEQ ID NO: 223811 - RNA, 22 nt, Human
ucuggcuuggcuggcaucucug

SEQ ID NO: 223812 - RNA, 23 nt, Human
uccuuuaaugcuggaauggcuag

SEQ ID NO: 223813 - RNA, 22 nt, Human
cauacuguaagugcaaaagugu

SEQ ID NO: 223814 - RNA, 22 nt, Human
ucaggguaaaccuucacuguga

SEQ ID NO: 223815 - RNA, 22 nt, Human
cugguuuagucauaauggagaa

SEQ ID NO: 223816 - RNA, 22 nt, Human
uuacaaguacugaauaugauuu

SEQ ID NO: 223817 - RNA, 22 nt, Human
cuggggcccugggucugcccuc

SEQ ID NO: 223818 - RNA, 19 nt, Human
cagcccucuuaccacugug

SEQ ID NO: 223819 - RNA, 22 nt, Human
uacaccagaaucucugugggga

SEQ ID NO: 223820 - RNA, 22 nt, Human
cuuuuuauagcuauguccuaug

SEQ ID NO: 223821 - RNA, 22 nt, Human
cuggacagugggcagaggagac

SEQ ID NO: 223822 - RNA, 22 nt, Human
caguaaacacuagcauucuugg

SEQ ID NO: 223823 - RNA, 22 nt, Human
agaagaugucacugcagacagc

SEQ ID NO: 223824 - RNA, 22 nt, Human
cucuggagggaggcugagcugg

SEQ ID NO: 223825 - RNA, 22 nt, Human
caggaggcagaggaugcccagu

SEQ ID NO: 223826 - RNA, 22 nt, Human
uuccuaauggcaaaacauguuu

SEQ ID NO: 223827 - RNA, 22 nt, Human
cagccucugagccuuggcagau

SEQ ID NO: 223828 - RNA, 22 nt, Human
gagcaggccagcaauggaaggg

SEQ ID NO: 223829 - RNA, 22 nt, Human
aagacaggaaaagcuccaggcc

SEQ ID NO: 223830 - RNA, 22 nt, Human
uguccuggagugcuugggggaa

SEQ ID NO: 223831 - RNA, 22 nt, Human
aaaaaaucagaucuuugguuaa

SEQ ID NO: 223832 - RNA, 22 nt, Human
uccccaccuacacacugcuccu

SEQ ID NO: 223833 - RNA, 22 nt, Human
aguggaccagaagacugaagcu

SEQ ID NO: 223834 - RNA, 20 nt, Human
agaaaauguuuucagcugga

SEQ ID NO: 223835 - RNA, 22 nt, Human
ccuccccaugacccggugcugg

SEQ ID NO: 223836 - RNA, 22 nt, Human
aagcaagcaagguguuacauau

SEQ ID NO: 223837 - RNA, 22 nt, Human
cucuggacagcaggugcugugg

SEQ ID NO: 223838 - RNA, 18 nt, Human
uggcagguagacucaggu

SEQ ID NO: 223839 - RNA, 22 nt, Human
accucuguauaguugccugugg

SEQ ID NO: 223840 - RNA, 22 nt, Human
uuauucagggauaacauccagg

SEQ ID NO: 223841 - RNA, 22 nt, Human
cuuccuggccauugccauggca

SEQ ID NO: 223842 - RNA, 22 nt, Human
uauaagugugucagcuuccaac

SEQ ID NO: 223843 - RNA, 22 nt, Human
agcaaagauguccggggcaagc

SEQ ID NO: 223844 - RNA, 22 nt, Human
ucugagcuguaaguagacaagg

SEQ ID NO: 223845 - RNA, 22 nt, Human
ggggagaauuacauggcgugga

SEQ ID NO: 223846 - RNA, 22 nt, Human
acucagagucugagauaaaucu

SEQ ID NO: 223847 - RNA, 19 nt, Human
cagcucaggacucagcccc

SEQ ID NO: 223848 - RNA, 22 nt, Human
agggaagaaucacugggauguu

SEQ ID NO: 223849 - RNA, 22 nt, Human
gagaggagucccuaucacaguu

SEQ ID NO: 223850 - RNA, 22 nt, Human
ucucucugagcccugcuuuuuc

SEQ ID NO: 223851 - RNA, 22 nt, Human
cuuuucuggaaucaucucuaac

SEQ ID NO: 223852 - RNA, 22 nt, Human
ggugcugggaacgaggaauuca

SEQ ID NO: 223853 - RNA, 23 nt, Human
uccuccaaccagcagcugcauaa

SEQ ID NO: 223854 - RNA, 22 nt, Human
caaauucaaauuucaucagugu

SEQ ID NO: 223855 - RNA, 22 nt, Human
uggcuucucccgacacccuggc

SEQ ID NO: 223856 - RNA, 22 nt, Human
auaguuacaaagacuuuuuaaa

SEQ ID NO: 223857 - RNA, 23 nt, Human
agcugaggugcagauccaaagaa

SEQ ID NO: 223858 - RNA, 22 nt, Human
ggagccagugcccucuggugga

SEQ ID NO: 223859 - RNA, 22 nt, Human
gacagagauugaaucaggaaau

SEQ ID NO: 223860 - RNA, 22 nt, Human
uccuccccucagggcaacggau

SEQ ID NO: 223861 - RNA, 22 nt, Human
gcuggguccuaugcugguagag

SEQ ID NO: 223862 - RNA, 22 nt, Human
uacauauacugagugauuugcu

SEQ ID NO: 223863 - RNA, 21 nt, Human
aguuuuauauuauaagcuaaa

SEQ ID NO: 223864 - RNA, 19 nt, Human
gcacacauacacccuuugg

SEQ ID NO: 223865 - RNA, 22 nt, Human
aaaguaugauuggggauuauuu

SEQ ID NO: 223866 - RNA, 21 nt, Human
uucuguagcuguuagcuuuuc

SEQ ID NO: 223867 - RNA, 22 nt, Human
uauuaaauauaucuguuaguug

SEQ ID NO: 223868 - RNA, 22 nt, Human
guccuuucuuaaauuccugcuu

SEQ ID NO: 223869 - RNA, 22 nt, Human
gcacagaacacuggugaguccc

SEQ ID NO: 223870 - RNA, 22 nt, Human
uggccaggggaguuccccucca

SEQ ID NO: 223871 - RNA, 22 nt, Human
gcaggagcuggaaagugauguu

SEQ ID NO: 223872 - RNA, 22 nt, Human
uaacauuugcugucuccuaugu

SEQ ID NO: 223873 - RNA, 22 nt, Human
agccaugugucuuuauucuguu

SEQ ID NO: 223874 - RNA, 22 nt, Human
ucugcccaggaggucccauggg

SEQ ID NO: 223875 - RNA, 22 nt, Human
gcacaugacaguaaguagagca

SEQ ID NO: 223876 - RNA, 22 nt, Human
gugaaaaaucaucaugacuuga

SEQ ID NO: 223877 - RNA, 22 nt, Human
auuucuacaguacacaugcauu

SEQ ID NO: 223878 - RNA, 22 nt, Human
cugcagaaaccuuuccugauuu

SEQ ID NO: 223879 - RNA, 22 nt, Human
ccaggaggcucugacuggaccc

SEQ ID NO: 223880 - RNA, 22 nt, Human
auauuucaugggguuccauacu

SEQ ID NO: 223881 - RNA, 22 nt, Human
agaaugucaacagccucucaag

SEQ ID NO: 223882 - RNA, 17 nt, Human
ggcuuccagguggcucu

SEQ ID NO: 223883 - RNA, 22 nt, Human
aacaggcaauuuaggacucuuu

SEQ ID NO: 223884 - RNA, 22 nt, Human
gucauuuuuuucguaauagugg

SEQ ID NO: 223885 - RNA, 22 nt, Human
cucuucaaaagucuaauccuua

SEQ ID NO: 223886 - RNA, 22 nt, Human
uccucccuguaccauuccucug

SEQ ID NO: 223887 - RNA, 22 nt, Human
ccacaguaaagaaacaacuucg

SEQ ID NO: 223888 - RNA, 22 nt, Human
aagcuauugaauuuauagcaua

SEQ ID NO: 223889 - RNA, 22 nt, Human
ugggccagcucccugccccugg

SEQ ID NO: 223890 - RNA, 22 nt, Human
agcaggugguaggcagucagca

SEQ ID NO: 223891 - RNA, 22 nt, Human
ugcccagagccugagaggauua

SEQ ID NO: 223892 - RNA, 22 nt, Human
agggcgaggagacggaggcaca

SEQ ID NO: 223893 - RNA, 22 nt, Human
auuagagguacaaaccuucacu

SEQ ID NO: 223894 - RNA, 22 nt, Human
gcagagaguugggcugcgccag

SEQ ID NO: 223895 - RNA, 22 nt, Human
agugugcuauugcaccaucaua

SEQ ID NO: 223896 - RNA, 22 nt, Human
aguucuaaguaaauauuuuaua

SEQ ID NO: 223897 - RNA, 17 nt, Human
auuuccucagggcugag

SEQ ID NO: 223898 - RNA, 22 nt, Human
uggaaaaacugagacuuagaca

SEQ ID NO: 223899 - RNA, 22 nt, Human
uccagccacguauuaucucacu

SEQ ID NO: 223900 - RNA, 22 nt, Human
ggcagccuucucucauagguga

SEQ ID NO: 223901 - RNA, 22 nt, Human
accagcagguggcaguauguau

SEQ ID NO: 223902 - RNA, 22 nt, Human
uuccagcacagaaguauacauu

SEQ ID NO: 223903 - RNA, 22 nt, Human
auccaauucuaauauuguguuu

SEQ ID NO: 223904 - RNA, 22 nt, Human
uagaaccuccagaguggccccc

SEQ ID NO: 223905 - RNA, 22 nt, Human
ugcccugggaguuggagcugcu

SEQ ID NO: 223906 - RNA, 22 nt, Human
gcucagggaaggccacgugaga

SEQ ID NO: 223907 - RNA, 22 nt, Human
auuuccaugccuuagcuuaagg

SEQ ID NO: 223908 - RNA, 22 nt, Human
cuauugaaaguguacaauucaa

SEQ ID NO: 223909 - RNA, 22 nt, Human
ucugaaagaagggcagucuuuu

SEQ ID NO: 223910 - RNA, 22 nt, Human
aucuuuguugcucucauuucug

SEQ ID NO: 223911 - RNA, 22 nt, Human
uauuccaagcacagcaacccag

SEQ ID NO: 223912 - RNA, 22 nt, Human
ccccagcagacucagggcaggu

SEQ ID NO: 223913 - RNA, 22 nt, Human
agcuggagaucaugcugauacu

SEQ ID NO: 223914 - RNA, 22 nt, Human
uggcagguuuccuccucauagu

SEQ ID NO: 223915 - RNA, 22 nt, Human
aguucuuauugaauagaaauca

SEQ ID NO: 223916 - RNA, 22 nt, Human
gacucagugauuugacaugccu

SEQ ID NO: 223917 - RNA, 22 nt, Human
gcugagucuugccugugcuguc

SEQ ID NO: 223918 - RNA, 22 nt, Human
uugaaacugcuuauugaauuug

SEQ ID NO: 223919 - RNA, 22 nt, Human
aaggcuccagugaaugcuggca

SEQ ID NO: 223920 - RNA, 22 nt, Human
aagcagaauuucccacuaguug

SEQ ID NO: 223921 - RNA, 22 nt, Human
aaagaaguguugaauuugcaag

SEQ ID NO: 223922 - RNA, 22 nt, Human
uuuauucacucauucagccagu

SEQ ID NO: 223923 - RNA, 22 nt, Human
uuacaguaaucgaguguugugg

SEQ ID NO: 223924 - RNA, 22 nt, Human
agcagggcagcuuuuuucagaa

SEQ ID NO: 223925 - RNA, 22 nt, Human
agcugagcuaguaguuccagug

SEQ ID NO: 223926 - RNA, 22 nt, Human
agacccucuccaugcccacugc

SEQ ID NO: 223927 - RNA, 22 nt, Human
aaagugcaccugcuucuucuug

SEQ ID NO: 223928 - RNA, 22 nt, Human
aagugcuuucauauagucuuaa

SEQ ID NO: 223929 - RNA, 22 nt, Human
auguuucagauacagaucaaau

SEQ ID NO: 223930 - RNA, 21 nt, Human
uucuucaguuuaauauaaaau

SEQ ID NO: 223931 - RNA, 22 nt, Human
aacaguuuggguagguauguag

SEQ ID NO: 223932 - RNA, 22 nt, Human
aucuggaauuaagagaaaguga

SEQ ID NO: 223933 - RNA, 22 nt, Human
uuuccaaagcugaguugagcaa

SEQ ID NO: 223934 - RNA, 22 nt, Human
agcaggcugagcacccaggggg

SEQ ID NO: 223935 - RNA, 22 nt, Human
uccuggacagauccccaucauc

SEQ ID NO: 223936 - RNA, 22 nt, Human
agggaaggaggccauguguccc

SEQ ID NO: 223937 - RNA, 22 nt, Human
caucacaucaaaccuacucuca

SEQ ID NO: 223938 - RNA, 22 nt, Human
gcagaggcugggugucccaguc

SEQ ID NO: 223939 - RNA, 22 nt, Human
ugcugugcucuuuaaggugcug

SEQ ID NO: 223940 - RNA, 22 nt, Human
agugcaacagcaguucucuuua

SEQ ID NO: 223941 - RNA, 22 nt, Human
uucuccaguuauauuauguuaa

SEQ ID NO: 223942 - RNA, 22 nt, Human
caguuuuaucaucugugaaaug

SEQ ID NO: 223943 - RNA, 22 nt, Human
cuuucucuugagcaagagcugu

SEQ ID NO: 223944 - RNA, 22 nt, Human
agagagggcauagaaaaaggga

SEQ ID NO: 223945 - RNA, 22 nt, Human
cucccagguugauucuuucccu

SEQ ID NO: 223946 - RNA, 22 nt, Human
auucuuuuuuaaggaauagaac

SEQ ID NO: 223947 - RNA, 22 nt, Human
agcagguguuggcugggccauc

SEQ ID NO: 223948 - RNA, 22 nt, Human
cugcugggccuggucucugagg

SEQ ID NO: 223949 - RNA, 22 nt, Human
ccuggguggcagagguugcagu

SEQ ID NO: 223950 - RNA, 22 nt, Human
uucucugacccccuuaaauauu

SEQ ID NO: 223951 - RNA, 22 nt, Human
cugaggcaucauggagaacagu

SEQ ID NO: 223952 - RNA, 22 nt, Human
ugaggccugaagccuggagccu

SEQ ID NO: 223953 - RNA, 23 nt, Human
ugacaggcugcuucuggcugagg

SEQ ID NO: 223954 - RNA, 22 nt, Human
ucuguuuaugcauauuuaaaac

SEQ ID NO: 223955 - RNA, 22 nt, Human
uggcauugcuagugacccagca

SEQ ID NO: 223956 - RNA, 22 nt, Human
ggccacagcaaugcugugaugu

SEQ ID NO: 223957 - RNA, 22 nt, Human
cacuugaauggcauuguuccuu

SEQ ID NO: 223958 - RNA, 22 nt, Human
uggaaauacaagaaguauguca

SEQ ID NO: 223959 - RNA, 22 nt, Human
gccugcacucaaacacucucuu

SEQ ID NO: 223960 - RNA, 22 nt, Human
guucucugccacuuaccagcua

SEQ ID NO: 223961 - RNA, 22 nt, Human
uuauaucuuuuuacaucucucc

SEQ ID NO: 223962 - RNA, 18 nt, Human
ccucacagacuuccaugu

SEQ ID NO: 223963 - RNA, 22 nt, Human
uccuggccuuagcgaggcgguc

SEQ ID NO: 223964 - RNA, 22 nt, Human
gggugguguauuagagcugcag

SEQ ID NO: 223965 - RNA, 22 nt, Human
ugaggcaaagacaaagcagcau

SEQ ID NO: 223966 - RNA, 22 nt, Human
ugagggagucaugauuaaggaa

SEQ ID NO: 223967 - RNA, 21 nt, Human
uaugguaaccagacaagaaug

SEQ ID NO: 223968 - RNA, 22 nt, Human
ugcuacauaccacgaugcagua

SEQ ID NO: 223969 - RNA, 22 nt, Human
uuccuguguguugguggcagaa

SEQ ID NO: 223970 - RNA, 22 nt, Human
cacaaauggccguguucaaaga

SEQ ID NO: 223971 - RNA, 22 nt, Human
uggcuucccaggaaaggagaag

SEQ ID NO: 223972 - RNA, 22 nt, Human
cagccaggccuggugaccaaag

SEQ ID NO: 223973 - RNA, 22 nt, Human
aaugaugagaacuggaguaauu

SEQ ID NO: 223974 - RNA, 22 nt, Human
uuguuaaaaugcauauucuggu

SEQ ID NO: 223975 - RNA, 22 nt, Human
aggcuaagauguggucugagca

SEQ ID NO: 223976 - RNA, 22 nt, Human
ccuaggcuuguuuucaucagcu

SEQ ID NO: 223977 - RNA, 22 nt, Human
agaguuuggagguguuccugga

SEQ ID NO: 223978 - RNA, 22 nt, Human
ccuccuggaggcucuaagggag

SEQ ID NO: 223979 - RNA, 22 nt, Human
cgcaggggaggaagguacaccu

SEQ ID NO: 223980 - RNA, 22 nt, Human
aagcaggcaagguuguggggca

SEQ ID NO: 223981 - RNA, 17 nt, Human
acacagggagagggagc

SEQ ID NO: 223982 - RNA, 22 nt, Human
aacaaacucaaauggaagagug

SEQ ID NO: 223983 - RNA, 22 nt, Human
cagcuggcuccaccucugggcu

SEQ ID NO: 223984 - RNA, 22 nt, Human
cagcccucaaaccacuuccagg

SEQ ID NO: 223985 - RNA, 22 nt, Human
gagcccagggcaggcaaggcag

SEQ ID NO: 223986 - RNA, 22 nt, Human
aaagugcacucucagugcugcu

SEQ ID NO: 223987 - RNA, 22 nt, Human
ucuagaaaaacaaaguaucuga

SEQ ID NO: 223988 - RNA, 22 nt, Human
aaagcaauaguaaugguaauag

SEQ ID NO: 223989 - RNA, 22 nt, Human
gcacuugaagaauugaacugga

SEQ ID NO: 223990 - RNA, 22 nt, Human
ucugggugagcugccucggguc

SEQ ID NO: 223991 - RNA, 19 nt, Human
guauaacuuacaccagcaa

SEQ ID NO: 223992 - RNA, 22 nt, Human
ggauucugccuuguugcuucaa

SEQ ID NO: 223993 - RNA, 22 nt, Human
cugggccauggaagucucugcc

SEQ ID NO: 223994 - RNA, 23 nt, Human
ucguugaauagcaauagcacaac

SEQ ID NO: 223995 - RNA, 22 nt, Human
acaaacagcuaacauauguuaa

SEQ ID NO: 223996 - RNA, 22 nt, Human
aguucuucauaaccuuacugug

SEQ ID NO: 223997 - RNA, 22 nt, Human
uaauacaucauucaucuaagga

SEQ ID NO: 223998 - RNA, 22 nt, Human
ucacaucugugugauugucauu

SEQ ID NO: 223999 - RNA, 22 nt, Human
cgcugggggaacagcgagggug

SEQ ID NO: 224000 - RNA, 22 nt, Human
agggcucuguuggggucagcac

SEQ ID NO: 224001 - RNA, 22 nt, Human
ggcucagaccucccagcuccag

SEQ ID NO: 224002 - RNA, 22 nt, Human
uugcaaauaauagccugaaacu

SEQ ID NO: 224003 - RNA, 22 nt, Human
uguccagugauucucaugagcc

SEQ ID NO: 224004 - RNA, 17 nt, Human
cucuggaauuggugaag

SEQ ID NO: 224005 - RNA, 22 nt, Human
ucagacagucaucagagcuugu

SEQ ID NO: 224006 - RNA, 22 nt, Human
cuuacaggaaagaagaaagcau

SEQ ID NO: 224007 - RNA, 20 nt, Human
caggcagaggaugcugacca

SEQ ID NO: 224008 - RNA, 22 nt, Human
ucucuuggaaagcuugcccacu

SEQ ID NO: 224009 - RNA, 22 nt, Human
uacaucuauacugaucuacauu

SEQ ID NO: 224010 - RNA, 22 nt, Human
cuuucucuguguuucacaugcu

SEQ ID NO: 224011 - RNA, 22 nt, Human
uccagcccucagccaaguggaa

SEQ ID NO: 224012 - RNA, 21 nt, Human
agcagacacuugugaccuucc

SEQ ID NO: 224013 - RNA, 22 nt, Human
gcagaauacauuuuguuuuccu

SEQ ID NO: 224014 - RNA, 22 nt, Human
guacuuuaaaucaauguagauu

SEQ ID NO: 224015 - RNA, 19 nt, Human
agauggggaagagugugag

SEQ ID NO: 224016 - RNA, 22 nt, Human
uaagguuuguggggagcaaaag

SEQ ID NO: 224017 - RNA, 22 nt, Human
gcaggguccauggaggcagccc

SEQ ID NO: 224018 - RNA, 22 nt, Human
uugcagacauuccagagcuuuu

SEQ ID NO: 224019 - RNA, 20 nt, Human
ucugugcaccugcuacaagg

SEQ ID NO: 224020 - RNA, 22 nt, Human
agcccagagggguuugaggacu

SEQ ID NO: 224021 - RNA, 22 nt, Human
caggugagaggcgguccugcau

SEQ ID NO: 224022 - RNA, 22 nt, Human
uggaaauauuugcucauuaucu

SEQ ID NO: 224023 - RNA, 19 nt, Human
caggccucuggucugcugu

SEQ ID NO: 224024 - RNA, 22 nt, Human
ugagccagccuugcagcugugc

SEQ ID NO: 224025 - RNA, 22 nt, Human
ccuguucaagguauuaauuauc

SEQ ID NO: 224026 - RNA, 22 nt, Human
ucucagugagcuuuucuauguu

SEQ ID NO: 224027 - RNA, 22 nt, Human
agcauuuaauccuacauagauc

SEQ ID NO: 224028 - RNA, 22 nt, Human
gggcugaccccaccccucacuc

SEQ ID NO: 224029 - RNA, 22 nt, Human
gagaaagggauaauuugaagag

SEQ ID NO: 224030 - RNA, 18 nt, Human
uggcuccugccuccugca

SEQ ID NO: 224031 - RNA, 22 nt, Human
ggaagcuggacaggcuuugagu

SEQ ID NO: 224032 - RNA, 15 nt, Human
gcagguggaucacuu

SEQ ID NO: 224033 - RNA, 22 nt, Human
aagcucagcagccaggcccugu

SEQ ID NO: 224034 - RNA, 22 nt, Human
uggcuaugguauugauggguuu

SEQ ID NO: 224035 - RNA, 22 nt, Human
caggcuugagggcaggcccagu

SEQ ID NO: 224036 - RNA, 22 nt, Human
gccacacuuauucucaugcaca

SEQ ID NO: 224037 - RNA, 22 nt, Human
uuucaguugauugcuuggguua

SEQ ID NO: 224038 - RNA, 22 nt, Human
uaacaagucauuuuaaauuaug

SEQ ID NO: 224039 - RNA, 22 nt, Human
ccugaccuauuuuucucagcug

SEQ ID NO: 224040 - RNA, 22 nt, Human
ucaggcugauuucuuuugaggg

SEQ ID NO: 224041 - RNA, 22 nt, Human
ggccugagaauguaccagaucu

SEQ ID NO: 224042 - RNA, 23 nt, Human
uucauuugucuacuucacuuguu

SEQ ID NO: 224043 - RNA, 22 nt, Human
aggugccuaucuggucucugca

SEQ ID NO: 224044 - RNA, 22 nt, Human
ucuagaaauuuugccuuguauu

SEQ ID NO: 224045 - RNA, 22 nt, Human
caggggagugagucccucucug

SEQ ID NO: 224046 - RNA, 22 nt, Human
uuucuggcagcgggacaggggu

SEQ ID NO: 224047 - RNA, 22 nt, Human
uggcagaaguacacaagcaugc

SEQ ID NO: 224048 - RNA, 22 nt, Human
gcucuauuacuuucaauaaaaa

SEQ ID NO: 224049 - RNA, 22 nt, Human
uccugcagccacugcaggcaga

SEQ ID NO: 224050 - RNA, 22 nt, Human
cucaggcccacagcagacccac

SEQ ID NO: 224051 - RNA, 22 nt, Human
ugaaacaggcaaaacugcagau

SEQ ID NO: 224052 - RNA, 22 nt, Human
uuuccaagacuccaguucuccc

SEQ ID NO: 224053 - RNA, 22 nt, Human
gugugucccuuggaaccucagc

SEQ ID NO: 224054 - RNA, 22 nt, Human
cuguuuguuggcuauugacagu

SEQ ID NO: 224055 - RNA, 22 nt, Human
cuggccaguugccuuccugggu

SEQ ID NO: 224056 - RNA, 22 nt, Human
ggcaguggcuguagucucuugg

SEQ ID NO: 224057 - RNA, 22 nt, Human
acaggcauugggauggagguug

SEQ ID NO: 224058 - RNA, 22 nt, Human
acucugagggguauguuccuau

SEQ ID NO: 224059 - RNA, 22 nt, Human
agaagcagacucugaggcaagg

SEQ ID NO: 224060 - RNA, 22 nt, Human
ggcucuggguucugcaaugcgu

SEQ ID NO: 224061 - RNA, 21 nt, Human
aggcuuggauagguuauguga

SEQ ID NO: 224062 - RNA, 22 nt, Human
ugcuucugacugggucaguuga

SEQ ID NO: 224063 - RNA, 20 nt, Human
aacagggggcugcagagggc

SEQ ID NO: 224064 - RNA, 22 nt, Human
ugcaaaggaggaugggaaagaa

SEQ ID NO: 224065 - RNA, 22 nt, Human
gagggaauggugugcaagaggu

SEQ ID NO: 224066 - RNA, 22 nt, Human
uccuggcuccuggagaccugcu

SEQ ID NO: 224067 - RNA, 22 nt, Human
acugccauuggucaaaugagug

SEQ ID NO: 224068 - RNA, 22 nt, Human
ucuauaaaacucaagagcaauu

SEQ ID NO: 224069 - RNA, 22 nt, Human
uggcaaaguuuaucaggaauau

SEQ ID NO: 224070 - RNA, 20 nt, Human
uccagagaguggcaaagcuc

SEQ ID NO: 224071 - RNA, 22 nt, Human
caguguggugagauuccaggug

SEQ ID NO: 224072 - RNA, 23 nt, Human
uguguacacaauagaugagguuu

SEQ ID NO: 224073 - RNA, 22 nt, Human
agagcugggaccgucuggaagu

SEQ ID NO: 224074 - RNA, 22 nt, Human
auucuacaugauagaagggaga

SEQ ID NO: 224075 - RNA, 22 nt, Human
cuacagacccaccuuggaagaa

SEQ ID NO: 224076 - RNA, 22 nt, Human
caggaaacggcuauucuuuugu

SEQ ID NO: 224077 - RNA, 22 nt, Human
ucuggcagugauuucugugauc

SEQ ID NO: 224078 - RNA, 23 nt, Human
uucuggguugcugugcuuggaau

SEQ ID NO: 224079 - RNA, 22 nt, Human
ggucucugcucagaugccacuu

SEQ ID NO: 224080 - RNA, 22 nt, Human
aggccucugggucuccucugac

SEQ ID NO: 224081 - RNA, 22 nt, Human
ccaggcugcuuagccuuaucuu

SEQ ID NO: 224082 - RNA, 22 nt, Human
augcuaaauguuaauguuaccu

SEQ ID NO: 224083 - RNA, 22 nt, Human
uuacaacuugcagaggauguug

SEQ ID NO: 224084 - RNA, 22 nt, Human
ugcccaggcuggaaugcagugg

SEQ ID NO: 224085 - RNA, 22 nt, Human
gcaggcucguuggaaguccccu

SEQ ID NO: 224086 - RNA, 22 nt, Human
aauccaggguguggccuuucca

SEQ ID NO: 224087 - RNA, 22 nt, Human
gguuccaccuggcgagggguau

SEQ ID NO: 224088 - RNA, 20 nt, Human
accugggaaaaccuuuuccu

SEQ ID NO: 224089 - RNA, 19 nt, Human
ggccaccucucuucccagg

SEQ ID NO: 224090 - RNA, 23 nt, Human
uaccuuucccugggagacugcuc

SEQ ID NO: 224091 - RNA, 22 nt, Human
ccagaucuaaguccaaaguacu

SEQ ID NO: 224092 - RNA, 23 nt, Human
guacacauaguguaguuauauuu

SEQ ID NO: 224093 - RNA, 22 nt, Human
gcuuucaauuaugucagccugu

SEQ ID NO: 224094 - RNA, 22 nt, Human
ccucagagaaagguauggcuga

SEQ ID NO: 224095 - RNA, 22 nt, Human
cugagccagcgggcucacuuuu

SEQ ID NO: 224096 - RNA, 22 nt, Human
gacaagacaugugaugacauca

SEQ ID NO: 224097 - RNA, 22 nt, Human
ccugcaagacuauuuaguucca

SEQ ID NO: 224098 - RNA, 22 nt, Human
ugucucugccagcuagcagaau

SEQ ID NO: 224099 - RNA, 21 nt, Human
agaaaaacacgauauaagccc

SEQ ID NO: 224100 - RNA, 22 nt, Human
uuacagaguucgcaccuggugg

SEQ ID NO: 224101 - RNA, 22 nt, Human
cagccuguggcagaggucuaau

SEQ ID NO: 224102 - RNA, 22 nt, Human
ugaguggacaccugcuucuuua

SEQ ID NO: 224103 - RNA, 22 nt, Human
uauggcuucugggccaaauuua

SEQ ID NO: 224104 - RNA, 22 nt, Human
uccugagugguuguuuucuucc

SEQ ID NO: 224105 - RNA, 22 nt, Human
ugcagggcaguuuguuucggca

SEQ ID NO: 224106 - RNA, 22 nt, Human
aaggcuggcaauauauuuguua

SEQ ID NO: 224107 - RNA, 22 nt, Human
cuggaaggagcccgggcggauc

SEQ ID NO: 224108 - RNA, 22 nt, Human
ugcuuuauaaccauuucugugg

SEQ ID NO: 224109 - RNA, 22 nt, Human
ugaggccacuuccccacagccc

SEQ ID NO: 224110 - RNA, 22 nt, Human
cagggccagccgcagcauccac

SEQ ID NO: 224111 - RNA, 22 nt, Human
ucaggcagguuggcugcagguc

SEQ ID NO: 224112 - RNA, 22 nt, Human
auuuuucucuccacuccauuaa

SEQ ID NO: 224113 - RNA, 22 nt, Human
cuguucagaaaaaaucuucaug

SEQ ID NO: 224114 - RNA, 20 nt, Human
ccuccuggucaggugugcag

SEQ ID NO: 224115 - RNA, 22 nt, Human
uucuacaugguugcucagaggg

SEQ ID NO: 224116 - RNA, 22 nt, Human
cagaaagccaacuccaacuguc

SEQ ID NO: 224117 - RNA, 22 nt, Human
uggacacaguggugaagguaca

SEQ ID NO: 224118 - RNA, 22 nt, Human
uaguuuaccaaauugaucuucc

SEQ ID NO: 224119 - RNA, 22 nt, Human
gucuuuaucuuugaaauuaguc

SEQ ID NO: 224120 - RNA, 22 nt, Human
aauaagcuggagcuauauugag

SEQ ID NO: 224121 - RNA, 22 nt, Human
aagggacauagacuguacaucu

SEQ ID NO: 224122 - RNA, 22 nt, Human
ggcaccugguaagugcucagua

SEQ ID NO: 224123 - RNA, 22 nt, Human
uuucugaauaacucuaugauau

SEQ ID NO: 224124 - RNA, 20 nt, Human
acuaaucauccagucacagu

SEQ ID NO: 224125 - RNA, 22 nt, Human
aguccuuagaacacuguaucug

SEQ ID NO: 224126 - RNA, 22 nt, Human
agaccucaauaccaggcaccac

SEQ ID NO: 224127 - RNA, 22 nt, Human
agaagcugccuacaugaccagc

SEQ ID NO: 224128 - RNA, 22 nt, Human
ccuucaaggcaaggagggcugg

SEQ ID NO: 224129 - RNA, 22 nt, Human
auuagugucugugaauaauucu

SEQ ID NO: 224130 - RNA, 22 nt, Human
ucccaggauuuuaggcucucag

SEQ ID NO: 224131 - RNA, 22 nt, Human
cagaauuuuucacucaaucuuc

SEQ ID NO: 224132 - RNA, 22 nt, Human
cagggccuccccggcagucuuu

SEQ ID NO: 224133 - RNA, 22 nt, Human
aagcccugucacccugacuuca

SEQ ID NO: 224134 - RNA, 22 nt, Human
ggcagccaugcacgcugccugg

SEQ ID NO: 224135 - RNA, 20 nt, Human
aacaaacuacaaaauuaugu

SEQ ID NO: 224136 - RNA, 22 nt, Human
gaggggagaggcuuauggauca

SEQ ID NO: 224137 - RNA, 22 nt, Human
caacuaauccuuugaaaagaag

SEQ ID NO: 224138 - RNA, 22 nt, Human
aauacaaucaaauucacuagca

SEQ ID NO: 224139 - RNA, 18 nt, Human
ugaggcucagcuccuggu

SEQ ID NO: 224140 - RNA, 22 nt, Human
cugcuuuagacaacugcuggga

SEQ ID NO: 224141 - RNA, 22 nt, Human
uuagaaaacauaagugguaaag

SEQ ID NO: 224142 - RNA, 22 nt, Human
gaugcaaacugugacauagagu

SEQ ID NO: 224143 - RNA, 22 nt, Human
ccaggaucuggguccaugggac

SEQ ID NO: 224144 - RNA, 22 nt, Human
gacccugaggauucccugcuga

SEQ ID NO: 224145 - RNA, 22 nt, Human
guuacucuugagaggcugaggu

SEQ ID NO: 224146 - RNA, 22 nt, Human
cagccagggucaggcagcuucu

SEQ ID NO: 224147 - RNA, 22 nt, Human
ccuggcugguugucugauucua

SEQ ID NO: 224148 - RNA, 22 nt, Human
cccuguuuauuuuuggagagaa

SEQ ID NO: 224149 - RNA, 22 nt, Human
gcugucucucccaggauccaug

SEQ ID NO: 224150 - RNA, 22 nt, Human
gccugccacgcaugcagaguca

SEQ ID NO: 224151 - RNA, 22 nt, Human
cugagccaguagucagggacaa

SEQ ID NO: 224152 - RNA, 22 nt, Human
aucuuuuuugucuuggucacug

SEQ ID NO: 224153 - RNA, 22 nt, Human
aaguuacauauucuugggcuau

SEQ ID NO: 224154 - RNA, 22 nt, Human
cuaaaugucauggaguuguaga

SEQ ID NO: 224155 - RNA, 22 nt, Human
augacacuguccuaguaaggaa

SEQ ID NO: 224156 - RNA, 22 nt, Human
cagcccugcucuuagugucucc

SEQ ID NO: 224157 - RNA, 22 nt, Human
cccagccucuggauucugcccu

SEQ ID NO: 224158 - RNA, 22 nt, Human
uacagaauaaagcgugaagcuu

SEQ ID NO: 224159 - RNA, 22 nt, Human
ucaggacacuuggcacaagguc

SEQ ID NO: 224160 - RNA, 22 nt, Human
uggugggacaucugaggagagg

SEQ ID NO: 224161 - RNA, 22 nt, Human
guuugugucaaugacuucugca

SEQ ID NO: 224162 - RNA, 22 nt, Human
ucaggucuguacuauugucuug

SEQ ID NO: 224163 - RNA, 18 nt, Human
agaagccacgaggagucc

SEQ ID NO: 224164 - RNA, 22 nt, Human
ucugggaauuuauuggcacuuu

SEQ ID NO: 224165 - RNA, 22 nt, Human
ggcaguuucaucaggagaaaag

SEQ ID NO: 224166 - RNA, 22 nt, Human
ugcugucugauucagggugauu

SEQ ID NO: 224167 - RNA, 22 nt, Human
acugaaagaaccuuccuguugc

SEQ ID NO: 224168 - RNA, 22 nt, Human
uuuggcucggcugcugauggug

SEQ ID NO: 224169 - RNA, 21 nt, Human
gggugggaggacacagcaggc

SEQ ID NO: 224170 - RNA, 22 nt, Human
uaaauuuacccaaggaacaugu

SEQ ID NO: 224171 - RNA, 22 nt, Human
auggaauuaaaagucaaguaau

SEQ ID NO: 224172 - RNA, 22 nt, Human
cucugaagguuucuguuacugu

SEQ ID NO: 224173 - RNA, 18 nt, Human
cacaggcucccagugagg

SEQ ID NO: 224174 - RNA, 22 nt, Human
aacagcugcuucaguacuugaa

SEQ ID NO: 224175 - RNA, 19 nt, Human
guauuucaggacaagacgu

SEQ ID NO: 224176 - RNA, 22 nt, Human
guggcagguuccguagacagca

SEQ ID NO: 224177 - RNA, 22 nt, Human
accuacauacggaaauauuuac

SEQ ID NO: 224178 - RNA, 22 nt, Human
ucaagagaaggggaaauagacu

SEQ ID NO: 224179 - RNA, 22 nt, Human
acaucuuuuuggaaacggcuga

SEQ ID NO: 224180 - RNA, 22 nt, Human
aaauguaguugaaaaguuaagg

SEQ ID NO: 224181 - RNA, 23 nt, Human
gcccacauuggugcaugaauguu

SEQ ID NO: 224182 - RNA, 22 nt, Human
ucugaggccuugggacagaagu

SEQ ID NO: 224183 - RNA, 19 nt, Human
gcacacccugcaccaccau

SEQ ID NO: 224184 - RNA, 22 nt, Human
gcaggcaggcuuccuugaacug

SEQ ID NO: 224185 - RNA, 22 nt, Human
agaaaaacacaaucgggccucc

SEQ ID NO: 224186 - RNA, 22 nt, Human
auuuagcaaaaaaugaugaagc

SEQ ID NO: 224187 - RNA, 22 nt, Human
caacacagggguuaugccaugg

SEQ ID NO: 224188 - RNA, 22 nt, Human
gggcuguggagccgcgagggcu

SEQ ID NO: 224189 - RNA, 22 nt, Human
cagggccagagagggcuggcug

SEQ ID NO: 224190 - RNA, 22 nt, Human
gagcuucagcugccaugacugu

SEQ ID NO: 224191 - RNA, 22 nt, Human
ccugagcugcggggcagugcuc

SEQ ID NO: 224192 - RNA, 22 nt, Human
auacuguaauaccuaaaugaac

SEQ ID NO: 224193 - RNA, 22 nt, Human
cuucagagugacucagcaucuu

SEQ ID NO: 224194 - RNA, 17 nt, Human
aaguccagaguugagca

SEQ ID NO: 224195 - RNA, 22 nt, Human
cauuuguauguuccuccuuagg

SEQ ID NO: 224196 - RNA, 22 nt, Human
gcagcgcuacucacagcucuga

SEQ ID NO: 224197 - RNA, 22 nt, Human
gcagaagggaauaaggagcuuu

SEQ ID NO: 224198 - RNA, 22 nt, Human
ggaagaguaacaggagguggaa

SEQ ID NO: 224199 - RNA, 22 nt, Human
gaggccagaguuccccgaguca

SEQ ID NO: 224200 - RNA, 22 nt, Human
caaaaugaugugauuuuauugu

SEQ ID NO: 224201 - RNA, 22 nt, Human
cacaggcacgccucuggccagg

SEQ ID NO: 224202 - RNA, 22 nt, Human
uuuauucuagcucagaauaguu

SEQ ID NO: 224203 - RNA, 22 nt, Human
uugaaggacauccuauuucuag

SEQ ID NO: 224204 - RNA, 22 nt, Human
ucuugaaaggagauuggaggca

SEQ ID NO: 224205 - RNA, 22 nt, Human
gcagggcagccacaggcccccu

SEQ ID NO: 224206 - RNA, 22 nt, Human
uccauuuuagagaugaagaaac

SEQ ID NO: 224207 - RNA, 22 nt, Human
cuggauguccuuccccugaagc

SEQ ID NO: 224208 - RNA, 22 nt, Human
cggcagggcuccaugcauuucu

SEQ ID NO: 224209 - RNA, 22 nt, Human
ucuugggcauguguuugauuuc

SEQ ID NO: 224210 - RNA, 22 nt, Human
ccuccuuuccuguuuuccugag

SEQ ID NO: 224211 - RNA, 22 nt, Human
ccagacccugcucuggggcucu

SEQ ID NO: 224212 - RNA, 22 nt, Human
ugugcagcagcagcuguggaga

SEQ ID NO: 224213 - RNA, 22 nt, Human
agcugcagugaacuguuuuguc

SEQ ID NO: 224214 - RNA, 22 nt, Human
cagggcucgcugccagcuucag

SEQ ID NO: 224215 - RNA, 22 nt, Human
acauugaauucaaaauuacuga

SEQ ID NO: 224216 - RNA, 22 nt, Human
gcagggcuccacuguggccaag

SEQ ID NO: 224217 - RNA, 22 nt, Human
uacacaugaucauuuaguagca

SEQ ID NO: 224218 - RNA, 22 nt, Human
ucugcaggcucuagaugagguu

SEQ ID NO: 224219 - RNA, 22 nt, Human
agaugcagaguuugcuguggac

SEQ ID NO: 224220 - RNA, 22 nt, Human
gugugcaggugucagugcagcu

SEQ ID NO: 224221 - RNA, 22 nt, Human
ucccagggacucucugccuucc

SEQ ID NO: 224222 - RNA, 22 nt, Human
auuugccuugugaauuggauau

SEQ ID NO: 224223 - RNA, 21 nt, Human
cagugcagggguuagcgugua

SEQ ID NO: 224224 - RNA, 22 nt, Human
aauaacuucaguucuuacauua

SEQ ID NO: 224225 - RNA, 22 nt, Human
caaguacugugauagcugaagu

SEQ ID NO: 224226 - RNA, 22 nt, Human
ucaaagcuuagauaauuucuuu

SEQ ID NO: 224227 - RNA, 17 nt, Human
gcaguggagggguaguu

SEQ ID NO: 224228 - RNA, 22 nt, Human
ggcucugaacauggggaggagu

SEQ ID NO: 224229 - RNA, 22 nt, Human
ccugcugcuaugaaggugacag

SEQ ID NO: 224230 - RNA, 22 nt, Human
caagauuugacuucgugguuug

SEQ ID NO: 224231 - RNA, 22 nt, Human
agcagggcaugaauaaggguuu

SEQ ID NO: 224232 - RNA, 22 nt, Human
cagagcuggacuuaaauauauu

SEQ ID NO: 224233 - RNA, 22 nt, Human
caugaaacaucagagauuucuc

SEQ ID NO: 224234 - RNA, 21 nt, Human
ucacaucuauguuaagcaaac

SEQ ID NO: 224235 - RNA, 22 nt, Human
acauucuaugaagauaauuuua

SEQ ID NO: 224236 - RNA, 22 nt, Human
gcagacaucaccucagugcuau

SEQ ID NO: 224237 - RNA, 22 nt, Human
uacugucuuuccauccuugccu

SEQ ID NO: 224238 - RNA, 22 nt, Human
agcuccuggggguuccaagcag

SEQ ID NO: 224239 - RNA, 22 nt, Human
ugcucuauuaauuuuaacgaug

SEQ ID NO: 224240 - RNA, 22 nt, Human
cagguccagucacuggucugca

SEQ ID NO: 224241 - RNA, 22 nt, Human
uucugggcaguuggaaauuuca

SEQ ID NO: 224242 - RNA, 23 nt, Human
aaaugacauaugguuucugaagg

SEQ ID NO: 224243 - RNA, 23 nt, Human
aagcacagaaugguuuaggaguu

SEQ ID NO: 224244 - RNA, 22 nt, Human
caugcacaaagguaagaugcgu

SEQ ID NO: 224245 - RNA, 22 nt, Human
gcaggcucacucuguuuggcuc

SEQ ID NO: 224246 - RNA, 18 nt, Human
ucugcaggaccucagggc

SEQ ID NO: 224247 - RNA, 22 nt, Human
cacaauuauagaagaaagcaua

SEQ ID NO: 224248 - RNA, 22 nt, Human
gacagcuguggagaggcaugug

SEQ ID NO: 224249 - RNA, 23 nt, Human
ccucuccagacacugggccuugu

SEQ ID NO: 224250 - RNA, 22 nt, Human
uagaaagacaugggccagcagc

SEQ ID NO: 224251 - RNA, 22 nt, Human
cauaauauacuacauugaugaa

SEQ ID NO: 224252 - RNA, 17 nt, Human
ucugucuugacugucac

SEQ ID NO: 224253 - RNA, 22 nt, Human
aggaaacucaaagugucaggua

SEQ ID NO: 224254 - RNA, 23 nt, Human
agugccauugacccuaugucuau

SEQ ID NO: 224255 - RNA, 22 nt, Human
acauaacauaguugacauuuuu

SEQ ID NO: 224256 - RNA, 22 nt, Human
gcagguguccugggcuggcagu

SEQ ID NO: 224257 - RNA, 22 nt, Human
gaaaagcuaggccaguucagcu

SEQ ID NO: 224258 - RNA, 22 nt, Human
aaguuacaggagaaagagauca

SEQ ID NO: 224259 - RNA, 23 nt, Human
guguuacuaaagaugaacauuua

SEQ ID NO: 224260 - RNA, 22 nt, Human
ccugugacaaacccgccuauuc

SEQ ID NO: 224261 - RNA, 22 nt, Human
uacagaauagaauagggacagg

SEQ ID NO: 224262 - RNA, 18 nt, Human
ucagguguuuucuguaua

SEQ ID NO: 224263 - RNA, 22 nt, Human
aggaucaggcccucuaggguag

SEQ ID NO: 224264 - RNA, 22 nt, Human
gcccugcucuggucucugcccg

SEQ ID NO: 224265 - RNA, 22 nt, Human
ucaggcagaguggaagcugcaa

SEQ ID NO: 224266 - RNA, 22 nt, Human
uuuagcuuuaccucauagauuu

SEQ ID NO: 224267 - RNA, 18 nt, Human
cacaggagccacacucac

SEQ ID NO: 224268 - RNA, 22 nt, Human
agcccagcuuccuucugucucu

SEQ ID NO: 224269 - RNA, 22 nt, Human
aauaaugaacauuuaaaaccug

SEQ ID NO: 224270 - RNA, 22 nt, Human
ugaagugaccuggggcagugua

SEQ ID NO: 224271 - RNA, 22 nt, Human
cuggauguccagguagaaguuu

SEQ ID NO: 224272 - RNA, 22 nt, Human
uuucagaaccaagagagacauc

SEQ ID NO: 224273 - RNA, 22 nt, Human
uauugcuguucuuuaaaugaag

SEQ ID NO: 224274 - RNA, 22 nt, Human
uuccugggcucuggcuggccua

SEQ ID NO: 224275 - RNA, 22 nt, Human
ucuucaaaugcuaguaauauca

SEQ ID NO: 224276 - RNA, 22 nt, Human
ugacauuauuaucaugucacca

SEQ ID NO: 224277 - RNA, 22 nt, Human
cucuuaaaaacuugauauauuu

SEQ ID NO: 224278 - RNA, 22 nt, Human
gaccauuucaggggcagggacu

SEQ ID NO: 224279 - RNA, 22 nt, Human
cagugaggaguccagggcagag

SEQ ID NO: 224280 - RNA, 19 nt, Human
cuguacagguugcuucugg

SEQ ID NO: 224281 - RNA, 22 nt, Human
uuuuccuaguaggccuauuaga

SEQ ID NO: 224282 - RNA, 22 nt, Human
cauccauagccucaauaaauag

SEQ ID NO: 224283 - RNA, 22 nt, Human
ccacagaaagccugggaagugg

SEQ ID NO: 224284 - RNA, 22 nt, Human
uuuccuuugggagcaugaauuu

SEQ ID NO: 224285 - RNA, 22 nt, Human
ucuuuucuugcauuauugcacu

SEQ ID NO: 224286 - RNA, 22 nt, Human
cccuggcugccagucaccagac

SEQ ID NO: 224287 - RNA, 22 nt, Human
ugaaauucaaaacacauuuguc

SEQ ID NO: 224288 - RNA, 22 nt, Human
acaauauuguacccagaaguuu

SEQ ID NO: 224289 - RNA, 22 nt, Human
uucuaacuuucaagguccuuuc

SEQ ID NO: 224290 - RNA, 22 nt, Human
auccacaggaggguuuggaaaa

SEQ ID NO: 224291 - RNA, 22 nt, Human
gggggacuaacuggauccugga

SEQ ID NO: 224292 - RNA, 22 nt, Human
aaaagucugcuuucuauuauca

SEQ ID NO: 224293 - RNA, 22 nt, Human
gggagcucgugcgcccaggugc

SEQ ID NO: 224294 - RNA, 22 nt, Human
gcagcccaggacccuggacaga

SEQ ID NO: 224295 - RNA, 22 nt, Human
cagaaguuagacuucaacuaau

SEQ ID NO: 224296 - RNA, 22 nt, Human
cuguuauuugagaguguugaau

SEQ ID NO: 224297 - RNA, 22 nt, Human
ggcaggcaccagcucagcaaua

SEQ ID NO: 224298 - RNA, 22 nt, Human
cuccugguuccugucuuaaaua

SEQ ID NO: 224299 - RNA, 20 nt, Human
guauuacaggcuuagaacca

SEQ ID NO: 224300 - RNA, 22 nt, Human
ugaucuccugaccuuguaaucc

SEQ ID NO: 224301 - RNA, 22 nt, Human
acuuucuuaggcuguauaaaug

SEQ ID NO: 224302 - RNA, 21 nt, Human
cggcucagugccugcuccuuc

SEQ ID NO: 224303 - RNA, 22 nt, Human
guccagaagcucaaguugaacu

SEQ ID NO: 224304 - RNA, 22 nt, Human
acaaauuugaauccugacuucu

SEQ ID NO: 224305 - RNA, 21 nt, Human
agacacagggguugcuggggu

SEQ ID NO: 224306 - RNA, 22 nt, Human
ugcuggaguucgacauugcaaa

SEQ ID NO: 224307 - RNA, 22 nt, Human
gcugccugcaguguuuucccag

SEQ ID NO: 224308 - RNA, 22 nt, Human
cagggggcagcguagaaaauga

SEQ ID NO: 224309 - RNA, 22 nt, Human
ccaggacaagccagagggacag

SEQ ID NO: 224310 - RNA, 22 nt, Human
aaugcauauguaggcaagcagu

SEQ ID NO: 224311 - RNA, 22 nt, Human
ucagugcauggacagauuuaga

SEQ ID NO: 224312 - RNA, 22 nt, Human
aaaguggugggcgaacucauca

SEQ ID NO: 224313 - RNA, 22 nt, Human
gugcacagaaacauacaaugug

SEQ ID NO: 224314 - RNA, 22 nt, Human
ugaaggcuugguggcagccucu

SEQ ID NO: 224315 - RNA, 22 nt, Human
aaauuacagaucaccaaugcau

SEQ ID NO: 224316 - RNA, 22 nt, Human
cuguucaguaaccuauaaaaca

SEQ ID NO: 224317 - RNA, 23 nt, Human
aggcagagccaaggucaaaaccc

SEQ ID NO: 224318 - RNA, 22 nt, Human
aguauuuagcugacucgcuaca

SEQ ID NO: 224319 - RNA, 22 nt, Human
aguuccugaacuucuuaaugac

SEQ ID NO: 224320 - RNA, 22 nt, Human
uguauauucugccuaaaagcuu

SEQ ID NO: 224321 - RNA, 22 nt, Human
aggucagaagugccagggaauu

SEQ ID NO: 224322 - RNA, 22 nt, Human
auauacacagagcuuaugguga

SEQ ID NO: 224323 - RNA, 22 nt, Human
ugggcucucucaccuggaggcu

SEQ ID NO: 224324 - RNA, 22 nt, Human
ugucucuggcugcagccuguuc

SEQ ID NO: 224325 - RNA, 22 nt, Human
aguggcagaagccaagucugca

SEQ ID NO: 224326 - RNA, 22 nt, Human
uccaggcccgagaugggcugga

SEQ ID NO: 224327 - RNA, 22 nt, Human
aaagcagucucagacuuaagca

SEQ ID NO: 224328 - RNA, 22 nt, Human
gugcccaggggccagcugccgg

SEQ ID NO: 224329 - RNA, 22 nt, Human
gaaaggcugggauuuagcgcug

SEQ ID NO: 224330 - RNA, 22 nt, Human
auggccagagaggccagccugg

SEQ ID NO: 224331 - RNA, 22 nt, Human
guuaagaaucaagacuuaucuu

SEQ ID NO: 224332 - RNA, 22 nt, Human
cugagggcuggagcugaggccu

SEQ ID NO: 224333 - RNA, 22 nt, Human
agcugaaucucaggcauccuuu

SEQ ID NO: 224334 - RNA, 22 nt, Human
uuucucuuuggaggggcugaau

SEQ ID NO: 224335 - RNA, 22 nt, Human
auguccuuuuauuuaaagcagg

SEQ ID NO: 224336 - RNA, 21 nt, Human
ggcuuuaugcucacccagccu

SEQ ID NO: 224337 - RNA, 22 nt, Human
agcugagggcaggaugggguga

SEQ ID NO: 224338 - RNA, 22 nt, Human
ucucagagauuuuguuucccuu

SEQ ID NO: 224339 - RNA, 22 nt, Human
gaguuacauggacauucucucc

SEQ ID NO: 224340 - RNA, 22 nt, Human
uguucucaucuggaucucagga

SEQ ID NO: 224341 - RNA, 22 nt, Human
caaaugauaccuauuacuaggc

SEQ ID NO: 224342 - RNA, 22 nt, Human
ggcaggugcucaaaaauauuug

SEQ ID NO: 224343 - RNA, 22 nt, Human
gccagucucccucaguccucug

SEQ ID NO: 224344 - RNA, 22 nt, Human
caggcaggugcagauuccucuu

SEQ ID NO: 224345 - RNA, 22 nt, Human
gugucacuggaauacugucugu

SEQ ID NO: 224346 - RNA, 22 nt, Human
cucucagcaggaaagcaugcaa

SEQ ID NO: 224347 - RNA, 22 nt, Human
guuuccuaccagugguuccaga

SEQ ID NO: 224348 - RNA, 22 nt, Human
acugacuuuggaauauuucuag

SEQ ID NO: 224349 - RNA, 22 nt, Human
ugccuugcuggaugucaguuuu

SEQ ID NO: 224350 - RNA, 22 nt, Human
agcuucuuuaauucagcaugau

SEQ ID NO: 224351 - RNA, 23 nt, Human
ugacacaggucaaaaauaagaug

SEQ ID NO: 224352 - RNA, 22 nt, Human
cuuguuaaaaugcagauuccaa

SEQ ID NO: 224353 - RNA, 22 nt, Human
uuauaugaacuggacuuuagga

SEQ ID NO: 224354 - RNA, 22 nt, Human
gcaaggaacaaaugcucugcuu

SEQ ID NO: 224355 - RNA, 22 nt, Human
ucaggauguuaauauagcauua

SEQ ID NO: 224356 - RNA, 22 nt, Human
gauauuuugagaaauccuauga

SEQ ID NO: 224357 - RNA, 22 nt, Human
uuauacuuuauacuacaucauu

SEQ ID NO: 224358 - RNA, 22 nt, Human
cuagggaaaguggacauggcuu

SEQ ID NO: 224359 - RNA, 22 nt, Human
ccucaggccagggggcggccag

SEQ ID NO: 224360 - RNA, 22 nt, Human
augguuuuagaaucaggaaaaa

SEQ ID NO: 224361 - RNA, 22 nt, Human
acagucucuccacacugcaggg

SEQ ID NO: 224362 - RNA, 22 nt, Human
uuugaaacccgucacuuugagu

SEQ ID NO: 224363 - RNA, 22 nt, Human
agacagacuguguuugaauccu

SEQ ID NO: 224364 - RNA, 22 nt, Human
acauuucuggaguuucucaaca

SEQ ID NO: 224365 - RNA, 18 nt, Human
ucucucagggaaacagaa

SEQ ID NO: 224366 - RNA, 22 nt, Human
aaugucuuuuaaauguugaggu

SEQ ID NO: 224367 - RNA, 22 nt, Human
guccaugauucugugacacccu

SEQ ID NO: 224368 - RNA, 20 nt, Human
aggccugagagaugacuggg

SEQ ID NO: 224369 - RNA, 22 nt, Human
ccaggguuggcaagcaaggcuu

SEQ ID NO: 224370 - RNA, 22 nt, Human
ucaguggaguauggaugaaguc

SEQ ID NO: 224371 - RNA, 21 nt, Human
ccuguucacagaucuguaacu

SEQ ID NO: 224372 - RNA, 22 nt, Human
caggguggcacucagcgcaucu

SEQ ID NO: 224373 - RNA, 22 nt, Human
acauuugacuacauuuauauau

SEQ ID NO: 224374 - RNA, 22 nt, Human
ucagggcagguuaacuugggug

SEQ ID NO: 224375 - RNA, 22 nt, Human
uguuaaacuguauugcauaagg

SEQ ID NO: 224376 - RNA, 22 nt, Human
gcaaguuuagcuaacuggccca

SEQ ID NO: 224377 - RNA, 22 nt, Human
uucauugaaauguuucuagcug

SEQ ID NO: 224378 - RNA, 22 nt, Human
aggaagcuggugugaggaugaa

SEQ ID NO: 224379 - RNA, 22 nt, Human
uuguuucuggaaaaggcgagaa

SEQ ID NO: 224380 - RNA, 22 nt, Human
ugcuggagaucauuaauguuca

SEQ ID NO: 224381 - RNA, 22 nt, Human
gcucaguguucaucuguaugca

SEQ ID NO: 224382 - RNA, 22 nt, Human
ccaugccccaauacaggacacc

SEQ ID NO: 224383 - RNA, 22 nt, Human
uuuucucaggugcuuaucuaag

SEQ ID NO: 224384 - RNA, 22 nt, Human
aggugcaccugagggugucauc

SEQ ID NO: 224385 - RNA, 22 nt, Human
ucagaagaaagauguuauuacu

SEQ ID NO: 224386 - RNA, 22 nt, Human
ucuguccauucagaauggcccu

SEQ ID NO: 224387 - RNA, 22 nt, Human
uuccuuucccucacagccucgg

SEQ ID NO: 224388 - RNA, 22 nt, Human
gugccagccgcaccccaggaga

SEQ ID NO: 224389 - RNA, 22 nt, Human
aucuacaggauaguuuaauauu

SEQ ID NO: 224390 - RNA, 22 nt, Human
gcugugcagucuuuggugugcc

SEQ ID NO: 224391 - RNA, 18 nt, Human
gucucugugggaauuggc

SEQ ID NO: 224392 - RNA, 22 nt, Human
gcuggaaaugaauggagaggug

SEQ ID NO: 224393 - RNA, 22 nt, Human
ucagggcccagagcucaggcaa

SEQ ID NO: 224394 - RNA, 19 nt, Human
gaagaagcuugagaaguag

SEQ ID NO: 224395 - RNA, 22 nt, Human
ucuggcccugcugcugugagca

SEQ ID NO: 224396 - RNA, 22 nt, Human
caguggcgugaucucugcucac

SEQ ID NO: 224397 - RNA, 22 nt, Human
gaggccaggagugcuguaaguu

SEQ ID NO: 224398 - RNA, 22 nt, Human
gaccacagcagugcaagaggag

SEQ ID NO: 224399 - RNA, 22 nt, Human
cagucucucugaaguauuaaga

SEQ ID NO: 224400 - RNA, 22 nt, Human
gcugccugugcgggucgcuagg

SEQ ID NO: 224401 - RNA, 22 nt, Human
agguuaggaaauagggcuguaa

SEQ ID NO: 224402 - RNA, 22 nt, Human
ucugcaggccucgacaaggcca

SEQ ID NO: 224403 - RNA, 22 nt, Human
gggagcauuucccuguguugaa

SEQ ID NO: 224404 - RNA, 22 nt, Human
cugggaacaggcacugcuguca

SEQ ID NO: 224405 - RNA, 22 nt, Human
agaucuggaaaaucacaggugc

SEQ ID NO: 224406 - RNA, 22 nt, Human
ccaggcagccaagugugugugu

SEQ ID NO: 224407 - RNA, 21 nt, Human
uagggcucuauuuuuauuuca

SEQ ID NO: 224408 - RNA, 22 nt, Human
cugccguugugaagcucuuaga

SEQ ID NO: 224409 - RNA, 22 nt, Human
ucugcaaacuggcucuuacugc

SEQ ID NO: 224410 - RNA, 22 nt, Human
aggcugugacagggucauggag

SEQ ID NO: 224411 - RNA, 22 nt, Human
ucagucuauccagcucagaucc

SEQ ID NO: 224412 - RNA, 22 nt, Human
uucucuggauguuucucaguca

SEQ ID NO: 224413 - RNA, 22 nt, Human
augcugagguguguuuaauuua

SEQ ID NO: 224414 - RNA, 22 nt, Human
ucuggcuuggacacaaucuucc

SEQ ID NO: 224415 - RNA, 22 nt, Human
cccugcuaguugucucagugau

SEQ ID NO: 224416 - RNA, 22 nt, Human
auguuaaagauggugggaaauu

SEQ ID NO: 224417 - RNA, 22 nt, Human
aucauuacuccuguaaaauugu

SEQ ID NO: 224418 - RNA, 22 nt, Human
aacaucauuauguccauuaaug

SEQ ID NO: 224419 - RNA, 22 nt, Human
ugcaucuuucugcauauguaaa

SEQ ID NO: 224420 - RNA, 22 nt, Human
cuuccaggacaccaggguagua

SEQ ID NO: 224421 - RNA, 22 nt, Human
ggucaaagugaggagucagguu

SEQ ID NO: 224422 - RNA, 22 nt, Human
cagccagguucaaguccuuaua

SEQ ID NO: 224423 - RNA, 22 nt, Human
ccagcuuuagguugccugccag

SEQ ID NO: 224424 - RNA, 21 nt, Human
acuguuauucccauuuucacc

SEQ ID NO: 224425 - RNA, 22 nt, Human
acagauuuggcccagccaaugc

SEQ ID NO: 224426 - RNA, 22 nt, Human
gccaggcgggucucaaacuccu

SEQ ID NO: 224427 - RNA, 22 nt, Human
gagggucagaagggccugguuc

SEQ ID NO: 224428 - RNA, 18 nt, Human
gaggaaacaggcucugug

SEQ ID NO: 224429 - RNA, 20 nt, Human
cucugggucgagacagacuu

SEQ ID NO: 224430 - RNA, 22 nt, Human
gcucugugcuagaacuaagaau

SEQ ID NO: 224431 - RNA, 22 nt, Human
caccagcugcaacaccaucucc

SEQ ID NO: 224432 - RNA, 22 nt, Human
ucagaggaacacuguuucaugc

SEQ ID NO: 224433 - RNA, 22 nt, Human
caugcagggacuugugcuccau

SEQ ID NO: 224434 - RNA, 22 nt, Human
ggggcucaguucggacagccug

SEQ ID NO: 224435 - RNA, 22 nt, Human
gguuucaaauuaaagucuuaag

SEQ ID NO: 224436 - RNA, 16 nt, Human
ucugccagggacaggc

SEQ ID NO: 224437 - RNA, 22 nt, Human
cuggaggaccccugccuggaag

SEQ ID NO: 224438 - RNA, 22 nt, Human
aacgugcaccaggaggucauga

SEQ ID NO: 224439 - RNA, 22 nt, Human
auacauagcaggguaguagauc

SEQ ID NO: 224440 - RNA, 22 nt, Human
ugucucuuggcucuaucacuua

SEQ ID NO: 224441 - RNA, 22 nt, Human
agaaaguuuugugcuauauaug

SEQ ID NO: 224442 - RNA, 23 nt, Human
cuuuucauugccuuagcgcagag

SEQ ID NO: 224443 - RNA, 22 nt, Human
agcugaaauuuuacugaguaua

SEQ ID NO: 224444 - RNA, 22 nt, Human
ucugggucacugugggagggca

SEQ ID NO: 224445 - RNA, 22 nt, Human
agaggggcccgguucuccgucu

SEQ ID NO: 224446 - RNA, 22 nt, Human
agaaaagugcucuagugagagc

SEQ ID NO: 224447 - RNA, 22 nt, Human
uagaaagcugaguaauacauuu

SEQ ID NO: 224448 - RNA, 22 nt, Human
aggugccaggagggaauuuagg

SEQ ID NO: 224449 - RNA, 22 nt, Human
cacagaggauuuuuagggcagu

SEQ ID NO: 224450 - RNA, 22 nt, Human
ugcaggaccuugauccuggacu

SEQ ID NO: 224451 - RNA, 22 nt, Human
ucacaaaagcuuuugaauuugg

SEQ ID NO: 224452 - RNA, 22 nt, Human
uagauccugcauagguugugcu

SEQ ID NO: 224453 - RNA, 22 nt, Human
augugucuuugagacucugcua

SEQ ID NO: 224454 - RNA, 22 nt, Human
cuguggcaagucugccugucac

SEQ ID NO: 224455 - RNA, 23 nt, Human
gcaguggaaugucucuguuugga

SEQ ID NO: 224456 - RNA, 22 nt, Human
uuggcuucuuuucuagacagaa

SEQ ID NO: 224457 - RNA, 22 nt, Human
ucuuuaucuggcucagagacac

SEQ ID NO: 224458 - RNA, 22 nt, Human
caggcuucuuuucuuuccagac

SEQ ID NO: 224459 - RNA, 19 nt, Human
gucacauuugucucccagg

SEQ ID NO: 224460 - RNA, 22 nt, Human
aacauaaauuugaaguggcaaa

SEQ ID NO: 224461 - RNA, 22 nt, Human
aacaggcaacaguugacucuga

SEQ ID NO: 224462 - RNA, 22 nt, Human
aaacuguaaacacagcaguaca

SEQ ID NO: 224463 - RNA, 22 nt, Human
ugucauaugcugucauagccau

SEQ ID NO: 224464 - RNA, 22 nt, Human
cccaagccagacccugacccug

SEQ ID NO: 224465 - RNA, 22 nt, Human
agcacagugcugggcacacagu

SEQ ID NO: 224466 - RNA, 22 nt, Human
agcagccaggaaucugcagagc

SEQ ID NO: 224467 - RNA, 22 nt, Human
ucuggcagcucaguucaggucu

SEQ ID NO: 224468 - RNA, 22 nt, Human
uggcagcuuccugcucauagga

SEQ ID NO: 224469 - RNA, 22 nt, Human
cuggggaccgagcaagcucugg

SEQ ID NO: 224470 - RNA, 16 nt, Human
agcaccagaucauauc

SEQ ID NO: 224471 - RNA, 22 nt, Human
ggcuggcucagggcuugagaga

SEQ ID NO: 224472 - RNA, 22 nt, Human
cuggcuuuaaugucaucuuucu

SEQ ID NO: 224473 - RNA, 22 nt, Human
aucuccagugcccaaaggaaau

SEQ ID NO: 224474 - RNA, 23 nt, Human
ucucaagaggaagcagggcucau

SEQ ID NO: 224475 - RNA, 22 nt, Human
ggcccagagucugcaauggagu

SEQ ID NO: 224476 - RNA, 22 nt, Human
agaaauuaugcaguaguuuuau

SEQ ID NO: 224477 - RNA, 22 nt, Human
cauuugcagagggugacacucu

SEQ ID NO: 224478 - RNA, 22 nt, Human
agauauauuuaagguaauaagu

SEQ ID NO: 224479 - RNA, 22 nt, Human
augcuucagugcuaccuucaaa

SEQ ID NO: 224480 - RNA, 22 nt, Human
uuaugaaagacauuucuguugg

SEQ ID NO: 224481 - RNA, 22 nt, Human
gagcugaacaaauugcgagugg

SEQ ID NO: 224482 - RNA, 22 nt, Human
uggccugccuucgcugagcuga

SEQ ID NO: 224483 - RNA, 22 nt, Human
gauuguaauuuucaagagguaa

SEQ ID NO: 224484 - RNA, 22 nt, Human
ucagccaagcagccaucaucug

SEQ ID NO: 224485 - RNA, 22 nt, Human
uuggaaagaagggcugagcaag

SEQ ID NO: 224486 - RNA, 22 nt, Human
ucagugucuugaccugggugug

SEQ ID NO: 224487 - RNA, 19 nt, Human
gugaggaguguuuacagaa

SEQ ID NO: 224488 - RNA, 22 nt, Human
augaagcaggcacagcuucagg

SEQ ID NO: 224489 - RNA, 22 nt, Human
uggggaggaagucagauuucag

SEQ ID NO: 224490 - RNA, 22 nt, Human
uuucucugcuguguuggcagcu

SEQ ID NO: 224491 - RNA, 22 nt, Human
acccuggccugguucaugugau

SEQ ID NO: 224492 - RNA, 22 nt, Human
gauucucugcuaucuaucaccu

SEQ ID NO: 224493 - RNA, 22 nt, Human
ugcccugcuugguuuauuuuca

SEQ ID NO: 224494 - RNA, 22 nt, Human
acugucacugugauguuagaga

SEQ ID NO: 224495 - RNA, 18 nt, Human
uccagcccacauuuucug

SEQ ID NO: 224496 - RNA, 22 nt, Human
acagacagaggcuccaugagga

SEQ ID NO: 224497 - RNA, 22 nt, Human
agugcugaggccauacuccaua

SEQ ID NO: 224498 - RNA, 22 nt, Human
agcuccugcucuuugucccuaa

SEQ ID NO: 224499 - RNA, 22 nt, Human
gugugcugcccaacucgcagau

SEQ ID NO: 224500 - RNA, 22 nt, Human
aguauacauauauuagccuucg

SEQ ID NO: 224501 - RNA, 22 nt, Human
acuuuaaaaagagccuucuaac

SEQ ID NO: 224502 - RNA, 22 nt, Human
agggcugacaaauggcagugac

SEQ ID NO: 224503 - RNA, 22 nt, Human
uucuggcuccagaugcuucugu

SEQ ID NO: 224504 - RNA, 22 nt, Human
aggugcuggagucugggcagga

SEQ ID NO: 224505 - RNA, 22 nt, Human
gcagcugggucugugugggcug

SEQ ID NO: 224506 - RNA, 22 nt, Human
aagaaauauugggccuuauaaa

SEQ ID NO: 224507 - RNA, 22 nt, Human
aacagcaguuacuuuugcauca

SEQ ID NO: 224508 - RNA, 22 nt, Human
auauuuugguagcucucaauga

SEQ ID NO: 224509 - RNA, 22 nt, Human
gacaccagagacugaugaggcc

SEQ ID NO: 224510 - RNA, 22 nt, Human
auucuacaggacuggcaauccc

SEQ ID NO: 224511 - RNA, 22 nt, Human
guuuagaauucuaacuuuaagg

SEQ ID NO: 224512 - RNA, 22 nt, Human
uggcuuccagaacugagcaaca

SEQ ID NO: 224513 - RNA, 22 nt, Human
uaacugccagcagcgaugaaca

SEQ ID NO: 224514 - RNA, 22 nt, Human
ggacaguccaccucagugaaga

SEQ ID NO: 224515 - RNA, 22 nt, Human
gcccucuggugggugagccccg

SEQ ID NO: 224516 - RNA, 22 nt, Human
uccuuggcuuucuggagcuucu

SEQ ID NO: 224517 - RNA, 22 nt, Human
uuuuaaugggcgacuauuaugg

SEQ ID NO: 224518 - RNA, 22 nt, Human
uaaaggcuuuauuuuccaguca

SEQ ID NO: 224519 - RNA, 22 nt, Human
uguggugguaaugagccagaug

SEQ ID NO: 224520 - RNA, 22 nt, Human
ucugcucuguggcuucagcuaa

SEQ ID NO: 224521 - RNA, 22 nt, Human
uucauguguauggaacauuuuu

SEQ ID NO: 224522 - RNA, 22 nt, Human
aguaacacuuggaaugauagca

SEQ ID NO: 224523 - RNA, 22 nt, Human
gaauucugucgcuuacuagaug

SEQ ID NO: 224524 - RNA, 19 nt, Human
ggcugggucuggcagguuc

SEQ ID NO: 224525 - RNA, 22 nt, Human
uacacagacucuucaauucaga

SEQ ID NO: 224526 - RNA, 22 nt, Human
ucuguggcauguugcacuugua

SEQ ID NO: 224527 - RNA, 22 nt, Human
ggcugagcuuauauaugugcug

SEQ ID NO: 224528 - RNA, 22 nt, Human
uagugcauaccuaacauuuuug

SEQ ID NO: 224529 - RNA, 22 nt, Human
ggcaggguggcagaggcucaga

SEQ ID NO: 224530 - RNA, 22 nt, Human
acacaaaguuggaugacaaaau

SEQ ID NO: 224531 - RNA, 22 nt, Human
auacagagcaguaauagaggag

SEQ ID NO: 224532 - RNA, 22 nt, Human
uuggcuucuguuuuggcucugu

SEQ ID NO: 224533 - RNA, 22 nt, Human
auuucucagcacuuccuaucuc

SEQ ID NO: 224534 - RNA, 22 nt, Human
cagagcagguaucuuuggugaa

SEQ ID NO: 224535 - RNA, 22 nt, Human
cagcacacagugacucgcaccu

SEQ ID NO: 224536 - RNA, 22 nt, Human
cucacaggagaaagucaugguc

SEQ ID NO: 224537 - RNA, 22 nt, Human
uaauucagggccagaaucccca

SEQ ID NO: 224538 - RNA, 22 nt, Human
uuaacaaggugacugcauuaaa

SEQ ID NO: 224539 - RNA, 22 nt, Human
uaccauuuugaaacauuucauc

SEQ ID NO: 224540 - RNA, 22 nt, Human
uucacauuauaaucaguucugc

SEQ ID NO: 224541 - RNA, 22 nt, Human
aacuuaggaaaauaaggcauga

SEQ ID NO: 224542 - RNA, 18 nt, Human
gcagcuagccaggggggc

SEQ ID NO: 224543 - RNA, 22 nt, Human
acuuccagguuccacccaagac

SEQ ID NO: 224544 - RNA, 22 nt, Human
ucuagaauucccuuuugacaau

SEQ ID NO: 224545 - RNA, 19 nt, Human
aguguguacugaaagcacu

SEQ ID NO: 224546 - RNA, 22 nt, Human
cccacccugggcuacacaucca

SEQ ID NO: 224547 - RNA, 17 nt, Human
uugaacugcugagucag

SEQ ID NO: 224548 - RNA, 22 nt, Human
acaggcuuagggcuugggcccg

SEQ ID NO: 224549 - RNA, 22 nt, Human
agauaucuuacacuuugaaguu

SEQ ID NO: 224550 - RNA, 18 nt, Human
uggaucuuuaugaggcug

SEQ ID NO: 224551 - RNA, 22 nt, Human
uaaggaaagugccaugauuucu

SEQ ID NO: 224552 - RNA, 22 nt, Human
cuagccugggauuugaacuuau

SEQ ID NO: 224553 - RNA, 22 nt, Human
cuggcuaugugguuagacauaa

SEQ ID NO: 224554 - RNA, 22 nt, Human
cccagugugguucuuuggagaa

SEQ ID NO: 224555 - RNA, 23 nt, Human
aagaaucucagaauuagaaauac

SEQ ID NO: 224556 - RNA, 22 nt, Human
ggaaucuuugaaggauuuuaag

SEQ ID NO: 224557 - RNA, 22 nt, Human
aagggcugagaaguggggcugg

SEQ ID NO: 224558 - RNA, 22 nt, Human
ugagucacacauuucuucauac

SEQ ID NO: 224559 - RNA, 22 nt, Human
auuauguauuugguauaguuug

SEQ ID NO: 224560 - RNA, 22 nt, Human
ggauguagugcaaggagugaau

SEQ ID NO: 224561 - RNA, 22 nt, Human
ccagcaggcagucauauccuuu

SEQ ID NO: 224562 - RNA, 22 nt, Human
ugaaggccucugguacaugcca

SEQ ID NO: 224563 - RNA, 22 nt, Human
ucacuggggcccacaucaacau

SEQ ID NO: 224564 - RNA, 20 nt, Human
agacccucuggacugggccc

SEQ ID NO: 224565 - RNA, 22 nt, Human
augaaaaguucgaucuagaagg

SEQ ID NO: 224566 - RNA, 17 nt, Human
ugccugccagcauugga

SEQ ID NO: 224567 - RNA, 22 nt, Human
ccugggugaugugcugcccucg

SEQ ID NO: 224568 - RNA, 22 nt, Human
augacugcucugggcucccaug

SEQ ID NO: 224569 - RNA, 22 nt, Human
ugaggaaagaaaggcaugcaug

SEQ ID NO: 224570 - RNA, 19 nt, Human
uuuggaacuuuuugaugcc

SEQ ID NO: 224571 - RNA, 22 nt, Human
ccacagcuagggcaaucugauu

SEQ ID NO: 224572 - RNA, 22 nt, Human
uagucucugcuuugcccuuggc

SEQ ID NO: 224573 - RNA, 22 nt, Human
ggccucaguuucuucaacugua

SEQ ID NO: 224574 - RNA, 22 nt, Human
ggcugcagguugguuggcagcu

SEQ ID NO: 224575 - RNA, 22 nt, Human
acugugcauuucaugucuuuuc

SEQ ID NO: 224576 - RNA, 22 nt, Human
aagcuguagaggcaguacauuu

SEQ ID NO: 224577 - RNA, 17 nt, Human
caucuuuaaaauccuga

SEQ ID NO: 224578 - RNA, 22 nt, Human
agaaagcacccugcacuuucug

SEQ ID NO: 224579 - RNA, 22 nt, Human
acuguacuuuagaaaguguagu

SEQ ID NO: 224580 - RNA, 18 nt, Human
agagaagagguguuaguc

SEQ ID NO: 224581 - RNA, 22 nt, Human
ugagaccucuggguucugagcu

SEQ ID NO: 224582 - RNA, 22 nt, Human
uccugaggccucugugauguga

SEQ ID NO: 224583 - RNA, 22 nt, Human
cuggcugguuggggagaagaca

SEQ ID NO: 224584 - RNA, 22 nt, Human
ugaaagauugugauucaauaug

SEQ ID NO: 224585 - RNA, 22 nt, Human
acuugucuggcagaucaugcaa

SEQ ID NO: 224586 - RNA, 22 nt, Human
caggaaguggggucauggagua

SEQ ID NO: 224587 - RNA, 22 nt, Human
ugaccaggauacugcagggaug

SEQ ID NO: 224588 - RNA, 22 nt, Human
gaccagcugguccuguccuggg

SEQ ID NO: 224589 - RNA, 22 nt, Human
aagggcagaaagggacgcuuug

SEQ ID NO: 224590 - RNA, 22 nt, Human
aaacacaauguuucuuuguucu

SEQ ID NO: 224591 - RNA, 22 nt, Human
auguuuacagaggaagugccuc

SEQ ID NO: 224592 - RNA, 21 nt, Human
auacauucuauuaagcauuua

SEQ ID NO: 224593 - RNA, 22 nt, Human
caggguccccgggucuccugug

SEQ ID NO: 224594 - RNA, 16 nt, Human
ucaggugugacuuuuu

SEQ ID NO: 224595 - RNA, 22 nt, Human
gaacuggucaguuuagcccacu

SEQ ID NO: 224596 - RNA, 22 nt, Human
gaaaagggcaagagagagggca

SEQ ID NO: 224597 - RNA, 20 nt, Human
auguccucagccacugcccu

SEQ ID NO: 224598 - RNA, 22 nt, Human
uccuguuuuuguaaucgacucu

SEQ ID NO: 224599 - RNA, 22 nt, Human
uuaaagcuagguggaacaaauu

SEQ ID NO: 224600 - RNA, 22 nt, Human
cuggaugcugagagguaccaag

SEQ ID NO: 224601 - RNA, 22 nt, Human
uggcuuccccuaccuuccaauu

SEQ ID NO: 224602 - RNA, 22 nt, Human
agagacaggauaucugcucaug

SEQ ID NO: 224603 - RNA, 19 nt, Human
gcaggcacagcccugggug

SEQ ID NO: 224604 - RNA, 22 nt, Human
uuggaauuuuccagguacagug

SEQ ID NO: 224605 - RNA, 22 nt, Human
uuggcccagcaugcgggucugu

SEQ ID NO: 224606 - RNA, 22 nt, Human
ggcaucaggguaggaagguauc

SEQ ID NO: 224607 - RNA, 22 nt, Human
gagcugaauugcugccauuugc

SEQ ID NO: 224608 - RNA, 22 nt, Human
aagauuauggcagauaacaauu

SEQ ID NO: 224609 - RNA, 19 nt, Human
cuguugcuggggcucucuu

SEQ ID NO: 224610 - RNA, 22 nt, Human
agcuggaaagaagguggcagcc

SEQ ID NO: 224611 - RNA, 22 nt, Human
cacagcugccauggcugcacuu

SEQ ID NO: 224612 - RNA, 22 nt, Human
uuuaaagaaauuccucaucuuu

SEQ ID NO: 224613 - RNA, 22 nt, Human
uuagugcucauccagauggggg

SEQ ID NO: 224614 - RNA, 22 nt, Human
aaggaacuugccacagaaaaga

SEQ ID NO: 224615 - RNA, 22 nt, Human
cauucugggucuggcucaggga

SEQ ID NO: 224616 - RNA, 22 nt, Human
aggcugugagaaguccuucagu

SEQ ID NO: 224617 - RNA, 22 nt, Human
auuauucaauguuauuucagug

SEQ ID NO: 224618 - RNA, 22 nt, Human
gggccugcagguucugagaggc

SEQ ID NO: 224619 - RNA, 23 nt, Human
caugcaaacacuauugcauuugg

SEQ ID NO: 224620 - RNA, 22 nt, Human
auguacagugauaagagggcag

SEQ ID NO: 224621 - RNA, 17 nt, Human
auacauuguuaaaguau

SEQ ID NO: 224622 - RNA, 20 nt, Human
ggcauccuucugacccagag

SEQ ID NO: 224623 - RNA, 22 nt, Human
auuuaaugucgagcuauuguag

SEQ ID NO: 224624 - RNA, 22 nt, Human
guuccucaaaaaggagagcccc

SEQ ID NO: 224625 - RNA, 22 nt, Human
acuguggcucaucaggcuggug

SEQ ID NO: 224626 - RNA, 22 nt, Human
cagggugacugcccuggccacu

SEQ ID NO: 224627 - RNA, 20 nt, Human
ugcuauauugaagugcaguu

SEQ ID NO: 224628 - RNA, 22 nt, Human
ugggaagguacacgggaaagag

SEQ ID NO: 224629 - RNA, 22 nt, Human
cagggagcagccccuagaagua

SEQ ID NO: 224630 - RNA, 22 nt, Human
cucacucagacauccagugcag

SEQ ID NO: 224631 - RNA, 22 nt, Human
cagcuucuggcguggagccuga

SEQ ID NO: 224632 - RNA, 22 nt, Human
gucccaggcuccauggcagcca

SEQ ID NO: 224633 - RNA, 22 nt, Human
uucugugcguaggcgaugcagu

SEQ ID NO: 224634 - RNA, 22 nt, Human
ugaaggcugucaccugcaccuu

SEQ ID NO: 224635 - RNA, 22 nt, Human
cuguaugaggaucagacuggac

SEQ ID NO: 224636 - RNA, 22 nt, Human
gaaacaaucaucaugugauuug

SEQ ID NO: 224637 - RNA, 22 nt, Human
gcaugcaggaagggcuugggga

SEQ ID NO: 224638 - RNA, 22 nt, Human
uucccuccuaugcccacugaaa

SEQ ID NO: 224639 - RNA, 22 nt, Human
aacaucaucaugaacaacuaau

SEQ ID NO: 224640 - RNA, 22 nt, Human
uugggaaguuuaaugacagacu

SEQ ID NO: 224641 - RNA, 22 nt, Human
auuguacaugcagugagucauc

SEQ ID NO: 224642 - RNA, 22 nt, Human
cacugagaguagggcacaagug

SEQ ID NO: 224643 - RNA, 21 nt, Human
ccaggcugggagggcaguucc

SEQ ID NO: 224644 - RNA, 22 nt, Human
ugagucugcuccugguagcaga

SEQ ID NO: 224645 - RNA, 22 nt, Human
gcaggcaguuauuuaguagaau

SEQ ID NO: 224646 - RNA, 23 nt, Human
gggagaugggaaaugaaggcucu

SEQ ID NO: 224647 - RNA, 22 nt, Human
uuacaucacuuuacuuaauaau

SEQ ID NO: 224648 - RNA, 22 nt, Human
ggcuagggaucuagaccaggac

SEQ ID NO: 224649 - RNA, 22 nt, Human
accaggcccgcugcuauggugg

SEQ ID NO: 224650 - RNA, 22 nt, Human
agcccagccggauucccaguuc

SEQ ID NO: 224651 - RNA, 22 nt, Human
ucuguuccauguuuuguuccau

SEQ ID NO: 224652 - RNA, 20 nt, Human
ucacagaaacaaauagagaa

SEQ ID NO: 224653 - RNA, 22 nt, Human
ccacagaauucugucuccagga

SEQ ID NO: 224654 - RNA, 22 nt, Human
ugggggcagaggauucaggaau

SEQ ID NO: 224655 - RNA, 18 nt, Human
cuugagcuaagggacccc

SEQ ID NO: 224656 - RNA, 22 nt, Human
aggcucagucccggcccgcgcc

SEQ ID NO: 224657 - RNA, 23 nt, Human
uggcccugaaucuguccuggagg

SEQ ID NO: 224658 - RNA, 22 nt, Human
uauuagguuggugcaacaguaa

SEQ ID NO: 224659 - RNA, 22 nt, Human
gccuugggggugaaagaggcua

SEQ ID NO: 224660 - RNA, 22 nt, Human
aauuuuguucuuggaaaucagg

SEQ ID NO: 224661 - RNA, 22 nt, Human
cccugcagagggaugggggcag

SEQ ID NO: 224662 - RNA, 20 nt, Human
ggcuucuuuacaucuguguu

SEQ ID NO: 224663 - RNA, 22 nt, Human
agccagggucucucgcucuguu

SEQ ID NO: 224664 - RNA, 22 nt, Human
caccauuuucuaaaaauaugac

SEQ ID NO: 224665 - RNA, 19 nt, Human
aaggcagcaguagcaucca

SEQ ID NO: 224666 - RNA, 22 nt, Human
ggccucuguucugcauuccucc

SEQ ID NO: 224667 - RNA, 22 nt, Human
ugggccacucuucccugggucu

SEQ ID NO: 224668 - RNA, 22 nt, Human
aauagacuccagggucuauuuu

SEQ ID NO: 224669 - RNA, 22 nt, Human
ugcugaaauuagaacauugagg

SEQ ID NO: 224670 - RNA, 22 nt, Human
uaaaccaaguguccauauuagu

SEQ ID NO: 224671 - RNA, 22 nt, Human
aaacugguaauaaaauggauua

SEQ ID NO: 224672 - RNA, 22 nt, Human
agcccaggagccuuuggagggu

SEQ ID NO: 224673 - RNA, 22 nt, Human
ucugggcugaaaugaaggccuu

SEQ ID NO: 224674 - RNA, 22 nt, Human
cugggagacaagagagggcuga

SEQ ID NO: 224675 - RNA, 21 nt, Human
ugcccaugagcagaagucacc

SEQ ID NO: 224676 - RNA, 22 nt, Human
uucugauauaacacucuagcua

SEQ ID NO: 224677 - RNA, 22 nt, Human
gcaucugauccaauagauauau

SEQ ID NO: 224678 - RNA, 22 nt, Human
ggcacacagcuuggcaggagau

SEQ ID NO: 224679 - RNA, 21 nt, Human
aguccaggccugcccacuucc

SEQ ID NO: 224680 - RNA, 22 nt, Human
ugccuauucaauauaugcauuu

SEQ ID NO: 224681 - RNA, 22 nt, Human
acugugaacggacugaagccca

SEQ ID NO: 224682 - RNA, 22 nt, Human
aagcugcacuacuugagggacc

SEQ ID NO: 224683 - RNA, 22 nt, Human
gcuaggcucuuccaucagggca

SEQ ID NO: 224684 - RNA, 22 nt, Human
acacagcuucaaagucuaauuc

SEQ ID NO: 224685 - RNA, 22 nt, Human
cuggcucccgaagcccucagug

SEQ ID NO: 224686 - RNA, 22 nt, Human
uuaaaguguuaacugaagcuua

SEQ ID NO: 224687 - RNA, 22 nt, Human
gccaggaaggcugaagccagaa

SEQ ID NO: 224688 - RNA, 22 nt, Human
cucaggauuuaaaggggcacuc

SEQ ID NO: 224689 - RNA, 22 nt, Human
acugccuuuuccauuacuuaau

SEQ ID NO: 224690 - RNA, 22 nt, Human
cugggccucaugcacagagaug

SEQ ID NO: 224691 - RNA, 22 nt, Human
gccucaggccgcccugcugcuc

SEQ ID NO: 224692 - RNA, 22 nt, Human
gggcaguguggucgugccuuug

SEQ ID NO: 224693 - RNA, 22 nt, Human
gcccagguuucaucugcuccgu

SEQ ID NO: 224694 - RNA, 22 nt, Human
uugaaaucaccacuagcauuug

SEQ ID NO: 224695 - RNA, 22 nt, Human
gaggaggguuggccuuagguag

SEQ ID NO: 224696 - RNA, 22 nt, Human
uacaggcaugaaugaaaucugu

SEQ ID NO: 224697 - RNA, 22 nt, Human
ucuggccccuggucucuggugu

SEQ ID NO: 224698 - RNA, 21 nt, Human
ugcaccuguucacugcaguuc

SEQ ID NO: 224699 - RNA, 22 nt, Human
ggaagccccagcugugggaucc

SEQ ID NO: 224700 - RNA, 22 nt, Human
caggccuggagugcaauggcac

SEQ ID NO: 224701 - RNA, 22 nt, Human
agucuggggucugguagaacga

SEQ ID NO: 224702 - RNA, 21 nt, Human
ugcagcugacacccuuuggga

SEQ ID NO: 224703 - RNA, 22 nt, Human
uuaauuuuuauguauagugugu

SEQ ID NO: 224704 - RNA, 22 nt, Human
gccccagcccuguggaccaugg

SEQ ID NO: 224705 - RNA, 22 nt, Human
ccucuggcuuacuguuggguuu

SEQ ID NO: 224706 - RNA, 22 nt, Human
gguccagucagauauucaugca

SEQ ID NO: 224707 - RNA, 22 nt, Human
augugucucuaccaaugcaauu

SEQ ID NO: 224708 - RNA, 22 nt, Human
uuucauugucuacauaugacau

SEQ ID NO: 224709 - RNA, 22 nt, Human
uaucauuuaacagaaucauugc

SEQ ID NO: 224710 - RNA, 22 nt, Human
ccuggcugccgagugugcagcg

SEQ ID NO: 224711 - RNA, 22 nt, Human
gcuucccaaugugcuaguuucu

SEQ ID NO: 224712 - RNA, 22 nt, Human
cuagaugccaauuuuuauggau

SEQ ID NO: 224713 - RNA, 22 nt, Human
cagcuggcgggcagagccgcca

SEQ ID NO: 224714 - RNA, 21 nt, Human
uucaaaaugguguguuugucu

SEQ ID NO: 224715 - RNA, 22 nt, Human
cuggcugguccucggggacagc

SEQ ID NO: 224716 - RNA, 22 nt, Human
uuccaagaguaaauucaaauug

SEQ ID NO: 224717 - RNA, 22 nt, Human
uguuuugcuucucuguuuccca

SEQ ID NO: 224718 - RNA, 21 nt, Human
uagaauccuggacugggacuc

SEQ ID NO: 224719 - RNA, 22 nt, Human
ggacaacauguuuuaauuaagg

SEQ ID NO: 224720 - RNA, 17 nt, Human
agugagaaugucaugua

SEQ ID NO: 224721 - RNA, 22 nt, Human
gugggguagaucuuucucagga

SEQ ID NO: 224722 - RNA, 22 nt, Human
uauacacaccuccaaagcagga

SEQ ID NO: 224723 - RNA, 22 nt, Human
gggugggagucuggcccucaaa

SEQ ID NO: 224724 - RNA, 22 nt, Human
cuuugguggaggggugcaggca

SEQ ID NO: 224725 - RNA, 22 nt, Human
uaaagguuuauucaacaaaaua

SEQ ID NO: 224726 - RNA, 22 nt, Human
cuggccagugccugugggcccc

SEQ ID NO: 224727 - RNA, 22 nt, Human
aauugcuuuuauuuagggccag

SEQ ID NO: 224728 - RNA, 22 nt, Human
ggggggugcugaucaguggagc

SEQ ID NO: 224729 - RNA, 22 nt, Human
cucugagguccuacagugaccc

SEQ ID NO: 224730 - RNA, 22 nt, Human
acagaauuaaaguguuugugga

SEQ ID NO: 224731 - RNA, 22 nt, Human
cagcuggggcagccacgugcgg

SEQ ID NO: 224732 - RNA, 22 nt, Human
uuccagccagauuugcuggguu

SEQ ID NO: 224733 - RNA, 22 nt, Human
aagacacacacauaugcugagu

SEQ ID NO: 224734 - RNA, 22 nt, Human
auguagaaaguucauagaugcg

SEQ ID NO: 224735 - RNA, 22 nt, Human
gauggcuuacagacaguuagga

SEQ ID NO: 224736 - RNA, 22 nt, Human
augguccuuauggccgugauau

SEQ ID NO: 224737 - RNA, 22 nt, Human
uguggcaguauaagagcuagaa

SEQ ID NO: 224738 - RNA, 22 nt, Human
gugcaaaaguaauggcaguuuu

SEQ ID NO: 224739 - RNA, 22 nt, Human
aaaaagauguccugaaguuuag

SEQ ID NO: 224740 - RNA, 22 nt, Human
gcaacuuucaagcaccaugggg

SEQ ID NO: 224741 - RNA, 22 nt, Human
agacgcuauuuugaggggucua

SEQ ID NO: 224742 - RNA, 22 nt, Human
cccugcagccuugcaugccuuc

SEQ ID NO: 224743 - RNA, 22 nt, Human
uuccaaugacuaguggcauccu

SEQ ID NO: 224744 - RNA, 22 nt, Human
gacaauaaaaugaucuuacagu

SEQ ID NO: 224745 - RNA, 22 nt, Human
ucaccccuacauuucccuugcu

SEQ ID NO: 224746 - RNA, 22 nt, Human
aaugaucuacucucauuaucuc

SEQ ID NO: 224747 - RNA, 18 nt, Human
gcuuucuguagaaaaggg

SEQ ID NO: 224748 - RNA, 22 nt, Human
uguuaauauacuaaaauccacu

SEQ ID NO: 224749 - RNA, 22 nt, Human
uguccugggccggcgacugguc

SEQ ID NO: 224750 - RNA, 22 nt, Human
aagcaguagaaugcauugcuuu

SEQ ID NO: 224751 - RNA, 22 nt, Human
uggcagcucccagagcuuccaa

SEQ ID NO: 224752 - RNA, 22 nt, Human
cugcuuuaacucugggaagcca

SEQ ID NO: 224753 - RNA, 21 nt, Human
cugucgcaggucgccccaccc

SEQ ID NO: 224754 - RNA, 22 nt, Human
cauugauuauggaaagcagugg

SEQ ID NO: 224755 - RNA, 22 nt, Human
gccugccugcugucaucugccu

SEQ ID NO: 224756 - RNA, 22 nt, Human
auaacagaugugaagugcuaau

SEQ ID NO: 224757 - RNA, 22 nt, Human
uguaauauuguagugacaguac

SEQ ID NO: 224758 - RNA, 22 nt, Human
uuucucuuaaugucucugugcu

SEQ ID NO: 224759 - RNA, 22 nt, Human
uggucacccacugggacugcgg

SEQ ID NO: 224760 - RNA, 23 nt, Human
ccuggcuucauucucuuagggug

SEQ ID NO: 224761 - RNA, 22 nt, Human
gaaaggaagaaaggucauuuua

SEQ ID NO: 224762 - RNA, 22 nt, Human
aagugugaauuuuagagucagg

SEQ ID NO: 224763 - RNA, 22 nt, Human
gcaggugucugacugccuucuu

SEQ ID NO: 224764 - RNA, 22 nt, Human
uccuagaaucuuuguaagauug

SEQ ID NO: 224765 - RNA, 22 nt, Human
aaacuguauagggaaaaguaga

SEQ ID NO: 224766 - RNA, 22 nt, Human
gccuguuuguuaugucauggua

SEQ ID NO: 224767 - RNA, 22 nt, Human
caccagcuucccaucgcggguc

SEQ ID NO: 224768 - RNA, 20 nt, Human
gcugaagauucccaugcaag

SEQ ID NO: 224769 - RNA, 22 nt, Human
uggcuucuuuguagaaauugaa

SEQ ID NO: 224770 - RNA, 22 nt, Human
gguuucuagcagagucucuuua

SEQ ID NO: 224771 - RNA, 22 nt, Human
ugucugucagcagugggucagg

SEQ ID NO: 224772 - RNA, 22 nt, Human
ucugagaaaucaguggugaaua

SEQ ID NO: 224773 - RNA, 22 nt, Human
uuagaaccagcauuuguccugg

SEQ ID NO: 224774 - RNA, 22 nt, Human
uggagcuggcuuguggaaguug

SEQ ID NO: 224775 - RNA, 22 nt, Human
ugcugccagggcucugcccaca

SEQ ID NO: 224776 - RNA, 22 nt, Human
ggcacagcgacuaccaucgaaa

SEQ ID NO: 224777 - RNA, 22 nt, Human
cacaguaugaucuaaaguaagu

SEQ ID NO: 224778 - RNA, 22 nt, Human
aacacuuuccugccuuucugau

SEQ ID NO: 224779 - RNA, 23 nt, Human
uuccaggcagagcagggauuaga

SEQ ID NO: 224780 - RNA, 22 nt, Human
aaauaacagucagggacaacau

SEQ ID NO: 224781 - RNA, 22 nt, Human
cugaaaggaauaaggcucuuug

SEQ ID NO: 224782 - RNA, 22 nt, Human
ucagaaguugagauauucaggg

SEQ ID NO: 224783 - RNA, 21 nt, Human
gcugcccuggcucagcauuca

SEQ ID NO: 224784 - RNA, 22 nt, Human
auggcagggcacagcucuaguu

SEQ ID NO: 224785 - RNA, 22 nt, Human
gcagguggaagcagcagacuca

SEQ ID NO: 224786 - RNA, 22 nt, Human
aguuugaagaaggaucuaugaa

SEQ ID NO: 224787 - RNA, 22 nt, Human
aucaagaauugggagcuauuga

SEQ ID NO: 224788 - RNA, 22 nt, Human
uuaugauuugccacagauuggu

SEQ ID NO: 224789 - RNA, 22 nt, Human
augaaaugugaaugcuuuucau

SEQ ID NO: 224790 - RNA, 22 nt, Human
gaaacugaguaggcuagagcac

SEQ ID NO: 224791 - RNA, 22 nt, Human
ucugagcugggcacagaaggcg

SEQ ID NO: 224792 - RNA, 22 nt, Human
aagaguuaaaugaaugaguggg

SEQ ID NO: 224793 - RNA, 23 nt, Human
ucuuuagaagaacaucagaaaug

SEQ ID NO: 224794 - RNA, 22 nt, Human
ggcccagccuugggguuucuuu

SEQ ID NO: 224795 - RNA, 22 nt, Human
uccuggcagagagcaugaggcc

SEQ ID NO: 224796 - RNA, 21 nt, Human
aagugccacccacagaugcau

SEQ ID NO: 224797 - RNA, 22 nt, Human
cggggucccugcccacccauac

SEQ ID NO: 224798 - RNA, 22 nt, Human
cuccuggugacucccagauaaa

SEQ ID NO: 224799 - RNA, 22 nt, Human
gaacucagagccugagcuagga

SEQ ID NO: 224800 - RNA, 22 nt, Human
uucuguacucuuugagaagaau

SEQ ID NO: 224801 - RNA, 22 nt, Human
acaggagccaaacacaugccag

SEQ ID NO: 224802 - RNA, 23 nt, Human
ccuggcugaccugaagguguagu

SEQ ID NO: 224803 - RNA, 22 nt, Human
agcaaguggaaucauggaaaag

SEQ ID NO: 224804 - RNA, 22 nt, Human
caggaagugcucgcugugggga

SEQ ID NO: 224805 - RNA, 22 nt, Human
ggcucccuggaaaucccgaggc

SEQ ID NO: 224806 - RNA, 22 nt, Human
ucagagccaaucauggugcauu

SEQ ID NO: 224807 - RNA, 20 nt, Human
agggucagagagcgugagug

SEQ ID NO: 224808 - RNA, 22 nt, Human
ggcuucuuaaucaugagaguga

SEQ ID NO: 224809 - RNA, 22 nt, Human
ucuaauccuugcuaccugggug

SEQ ID NO: 224810 - RNA, 22 nt, Human
aggcuggcuuggcucuccugug

SEQ ID NO: 224811 - RNA, 17 nt, Human
ugcuggcaacauacaaa

SEQ ID NO: 224812 - RNA, 22 nt, Human
ucaugcauauuuguaguaguuc

SEQ ID NO: 224813 - RNA, 22 nt, Human
ggcuaggccucaggccugccug

SEQ ID NO: 224814 - RNA, 22 nt, Human
guggaggaaaagaaguugggug

SEQ ID NO: 224815 - RNA, 22 nt, Human
augcugaauaguucacucuucu

SEQ ID NO: 224816 - RNA, 20 nt, Human
gauguguccucagcaguggu

SEQ ID NO: 224817 - RNA, 22 nt, Human
gccacaggugggcucugggaaa

SEQ ID NO: 224818 - RNA, 19 nt, Human
cugcuccaggagcugggga

SEQ ID NO: 224819 - RNA, 22 nt, Human
uuagaguuuuaucauugccuua

SEQ ID NO: 224820 - RNA, 22 nt, Human
uucuugcaggucacucacugag

SEQ ID NO: 224821 - RNA, 22 nt, Human
gccaggugcauauuagaagcau

SEQ ID NO: 224822 - RNA, 22 nt, Human
uccaggaaagugggaugugugu

SEQ ID NO: 224823 - RNA, 22 nt, Human
ccuggccugugaaucugagagc

SEQ ID NO: 224824 - RNA, 22 nt, Human
ucugauguggagacacuguuuu

SEQ ID NO: 224825 - RNA, 22 nt, Human
ccacagaaccucagcuuugagc

SEQ ID NO: 224826 - RNA, 22 nt, Human
gcacagcucagcaugggaggac

SEQ ID NO: 224827 - RNA, 22 nt, Human
guccuggguccccgcaggucag

SEQ ID NO: 224828 - RNA, 19 nt, Human
uagucuuuauucuuaauuu

SEQ ID NO: 224829 - RNA, 22 nt, Human
cccagccugaucucggccagcu

SEQ ID NO: 224830 - RNA, 22 nt, Human
agacagcugguagcacuuccug

SEQ ID NO: 224831 - RNA, 22 nt, Human
uuaccuaaaauagcucaauuua

SEQ ID NO: 224832 - RNA, 22 nt, Human
ugccugcaagaguuggggcuac

SEQ ID NO: 224833 - RNA, 22 nt, Human
uuuaggaugcucuauucugacu

SEQ ID NO: 224834 - RNA, 22 nt, Human
cuuaauuacuguccaauaugca

SEQ ID NO: 224835 - RNA, 22 nt, Human
aaacaguuucauuuucaugacc

SEQ ID NO: 224836 - RNA, 22 nt, Human
cucuggcagagcuguagacuuc

SEQ ID NO: 224837 - RNA, 22 nt, Human
auuguuggguaguuuguucagc

SEQ ID NO: 224838 - RNA, 22 nt, Human
cagggcaguuuuacuucucucu

SEQ ID NO: 224839 - RNA, 22 nt, Human
cccaggcugaugggaugggcca

SEQ ID NO: 224840 - RNA, 22 nt, Human
cugagcugggcaacucuuagau

SEQ ID NO: 224841 - RNA, 21 nt, Human
ucaagacagcauauuuaagaa

SEQ ID NO: 224842 - RNA, 22 nt, Human
ccaggguuucuucucuguauag

SEQ ID NO: 224843 - RNA, 22 nt, Human
gacuuuauaaaugagaggcgga

SEQ ID NO: 224844 - RNA, 22 nt, Human
uccuccagcaggacugaggccc

SEQ ID NO: 224845 - RNA, 22 nt, Human
aggagggagaugcccauccugg

SEQ ID NO: 224846 - RNA, 22 nt, Human
aaagauucgagcgauguauaaa

SEQ ID NO: 224847 - RNA, 22 nt, Human
uuguagcugaaaguaaagaagu

SEQ ID NO: 224848 - RNA, 20 nt, Human
cagcaaaaugaaaauggauu

SEQ ID NO: 224849 - RNA, 22 nt, Human
aacuaaaucuggcauuuagagc

SEQ ID NO: 224850 - RNA, 19 nt, Human
ugcuuugccuugauuagcu

SEQ ID NO: 224851 - RNA, 22 nt, Human
aagguguucagguuuucccauu

SEQ ID NO: 224852 - RNA, 22 nt, Human
acucuggcuauucacuauaaua

SEQ ID NO: 224853 - RNA, 22 nt, Human
gcccagcuuuucacuuccacac

SEQ ID NO: 224854 - RNA, 22 nt, Human
gcugcccuagaaguacagagag

SEQ ID NO: 224855 - RNA, 22 nt, Human
aaggccuugguucugagcaaua

SEQ ID NO: 224856 - RNA, 22 nt, Human
uuucacauauaggggaagcuac

SEQ ID NO: 224857 - RNA, 22 nt, Human
auucacaaagaagggaaguaca

SEQ ID NO: 224858 - RNA, 22 nt, Human
ccuuucuugcuaagaguuuaug

SEQ ID NO: 224859 - RNA, 22 nt, Human
uccaggcuucacgucugcccuc

SEQ ID NO: 224860 - RNA, 22 nt, Human
aaagguguugccuuggagaccu

SEQ ID NO: 224861 - RNA, 22 nt, Human
uggcaguagauccagucucucu

SEQ ID NO: 224862 - RNA, 22 nt, Human
uaauacaauggaguugggcccc

SEQ ID NO: 224863 - RNA, 22 nt, Human
aaagcuuagaggccaguggagg

SEQ ID NO: 224864 - RNA, 19 nt, Human
ucugaagaauuagagagca

SEQ ID NO: 224865 - RNA, 22 nt, Human
ucccagggacugggcuaggcuu

SEQ ID NO: 224866 - RNA, 22 nt, Human
ucaaauaaugccauucaucauc

SEQ ID NO: 224867 - RNA, 22 nt, Human
gaaucuuauuuuuaaaucuucc

SEQ ID NO: 224868 - RNA, 20 nt, Human
aaaaagacaaaacgaguugg

SEQ ID NO: 224869 - RNA, 22 nt, Human
ugagcaguggcaccaggucacc

SEQ ID NO: 224870 - RNA, 22 nt, Human
agacaucauguuacagauuaag

SEQ ID NO: 224871 - RNA, 22 nt, Human
acaugaaugaagacuuuacaau

SEQ ID NO: 224872 - RNA, 22 nt, Human
ccugugcauugcaggguguuca

SEQ ID NO: 224873 - RNA, 22 nt, Human
gaacaaacagucaggacagucu

SEQ ID NO: 224874 - RNA, 22 nt, Human
gggaucuugggaacacccuuac

SEQ ID NO: 224875 - RNA, 22 nt, Human
gcaugcagggagggucuggcug

SEQ ID NO: 224876 - RNA, 22 nt, Human
gaggcaguuugccaugccagga

SEQ ID NO: 224877 - RNA, 22 nt, Human
ggcagggcccugauuccugggg

SEQ ID NO: 224878 - RNA, 22 nt, Human
aauucuaaauguaauuuagaau

SEQ ID NO: 224879 - RNA, 22 nt, Human
ucccuagucgcaucuguggaga

SEQ ID NO: 224880 - RNA, 22 nt, Human
cuggagcagcagguggccaggg

SEQ ID NO: 224881 - RNA, 22 nt, Human
ucuguccuguuuccuccugaca

SEQ ID NO: 224882 - RNA, 22 nt, Human
acucugggaugagaaaaggguu

SEQ ID NO: 224883 - RNA, 22 nt, Human
uuucuaacagcaaauguuuauc

SEQ ID NO: 224884 - RNA, 22 nt, Human
cugggcucaguggcucauggcu

SEQ ID NO: 224885 - RNA, 22 nt, Human
ugucaaaaauaagagagauugu

SEQ ID NO: 224886 - RNA, 22 nt, Human
ucauucuugaucacuaguuagu

SEQ ID NO: 224887 - RNA, 22 nt, Human
ugcagucuggauguccucagau

SEQ ID NO: 224888 - RNA, 22 nt, Human
gccuggagacaaggacaaaggg

SEQ ID NO: 224889 - RNA, 22 nt, Human
ucucuguaguugggcagcugcu

SEQ ID NO: 224890 - RNA, 22 nt, Human
cuuucccugcuuagaaggauuu

SEQ ID NO: 224891 - RNA, 22 nt, Human
aggcaacuuuuggggaugaugg

SEQ ID NO: 224892 - RNA, 22 nt, Human
ucccagggggaugaacacugcc

SEQ ID NO: 224893 - RNA, 22 nt, Human
ucaggccuagggagccacacca

SEQ ID NO: 224894 - RNA, 22 nt, Human
gaaagugcuaggaaguguuaga

SEQ ID NO: 224895 - RNA, 22 nt, Human
acuguucugccaacuuugguua

SEQ ID NO: 224896 - RNA, 22 nt, Human
uagcugaaugugaccuuaaaga

SEQ ID NO: 224897 - RNA, 22 nt, Human
ccugggccuggcgggucggcuc

SEQ ID NO: 224898 - RNA, 22 nt, Human
caccaggagcaucuaggaggcg

SEQ ID NO: 224899 - RNA, 22 nt, Human
uccuggaggggacagcaugggc

SEQ ID NO: 224900 - RNA, 18 nt, Human
ucucucugauaacauuuu

SEQ ID NO: 224901 - RNA, 22 nt, Human
uguuucuuacguuuuuagaggc

SEQ ID NO: 224902 - RNA, 22 nt, Human
aggcuucuaggaaacuuucugg

SEQ ID NO: 224903 - RNA, 22 nt, Human
gcauuacagcaguucaacuugg

SEQ ID NO: 224904 - RNA, 22 nt, Human
gagcccagguucugcuuccagc

SEQ ID NO: 224905 - RNA, 22 nt, Human
agagagggaauauuugggguau

SEQ ID NO: 224906 - RNA, 22 nt, Human
caguuaaacgaugaugggguca

SEQ ID NO: 224907 - RNA, 20 nt, Human
cuguggcucaugcaucugcc

SEQ ID NO: 224908 - RNA, 22 nt, Human
auuaagaucauuguagaagauu

SEQ ID NO: 224909 - RNA, 22 nt, Human
ccagagcccagggucaugcagg

SEQ ID NO: 224910 - RNA, 22 nt, Human
accuuuauaugaaagaugacau

SEQ ID NO: 224911 - RNA, 22 nt, Human
ccuggauucaagucuuucuuuc

SEQ ID NO: 224912 - RNA, 22 nt, Human
cugacauguauaagcuuuaagu

SEQ ID NO: 224913 - RNA, 19 nt, Human
ggcuucgaggcuggggaag

SEQ ID NO: 224914 - RNA, 22 nt, Human
gagguugggaaguccaagcugg

SEQ ID NO: 224915 - RNA, 21 nt, Human
aaccagagccaggcucucagc

SEQ ID NO: 224916 - RNA, 23 nt, Human
cccagcugcagacaagggagggu

SEQ ID NO: 224917 - RNA, 22 nt, Human
ucuuuguguucaggagccacgu

SEQ ID NO: 224918 - RNA, 22 nt, Human
acuuucaagcaagaacacuuug

SEQ ID NO: 224919 - RNA, 16 nt, Human
gcuccugggcccucga

SEQ ID NO: 224920 - RNA, 22 nt, Human
auccauuguggucuuguacauu

SEQ ID NO: 224921 - RNA, 22 nt, Human
agaggucauaucucagaagaga

SEQ ID NO: 224922 - RNA, 22 nt, Human
uggcuuuaggagcuauauaccu

SEQ ID NO: 224923 - RNA, 22 nt, Human
cagacaggguggguuucugggc

SEQ ID NO: 224924 - RNA, 22 nt, Human
auuuuaguaccucaaguaucca

SEQ ID NO: 224925 - RNA, 22 nt, Human
cagaugcuuggaggacacuugg

SEQ ID NO: 224926 - RNA, 22 nt, Human
ucaggccccuugucagcucugu

SEQ ID NO: 224927 - RNA, 19 nt, Human
aggcccagcgcugggggcu

SEQ ID NO: 224928 - RNA, 22 nt, Human
ccaggaagauuuauuuuggcuu

SEQ ID NO: 224929 - RNA, 20 nt, Human
gcagagccucacugcaaggg

SEQ ID NO: 224930 - RNA, 23 nt, Human
auccagccuggggguuuaaccac

SEQ ID NO: 224931 - RNA, 22 nt, Human
uaagugguaccaagcucaguga

SEQ ID NO: 224932 - RNA, 22 nt, Human
gaagccaggggccugacaggca

SEQ ID NO: 224933 - RNA, 22 nt, Human
gcuggagugcaguugcacaguc

SEQ ID NO: 224934 - RNA, 22 nt, Human
ugaaacugaaagguauuuauag

SEQ ID NO: 224935 - RNA, 22 nt, Human
cuuaaugaaagguugcacaugg

SEQ ID NO: 224936 - RNA, 22 nt, Human
ucugucuuagcaucuuugcuca

SEQ ID NO: 224937 - RNA, 22 nt, Human
agccucugacugucagcaaggu

SEQ ID NO: 224938 - RNA, 22 nt, Human
ccacacuaaacugcucaaacca

SEQ ID NO: 224939 - RNA, 22 nt, Human
accucccagaaaguuuugcagg

SEQ ID NO: 224940 - RNA, 22 nt, Human
agagccagguguagucucggag

SEQ ID NO: 224941 - RNA, 22 nt, Human
aaaagacaucuauuucaggcag

SEQ ID NO: 224942 - RNA, 22 nt, Human
cuggugcaagauucccugcuuc

SEQ ID NO: 224943 - RNA, 22 nt, Human
cuuuuauuuugaauuaagggcu

SEQ ID NO: 224944 - RNA, 22 nt, Human
accaccccagaauuuuucaagg

SEQ ID NO: 224945 - RNA, 22 nt, Human
aggccucucugcuuagcuugua

SEQ ID NO: 224946 - RNA, 22 nt, Human
ugugugucagagucuccauggu

SEQ ID NO: 224947 - RNA, 22 nt, Human
gacucguucauaguuccaauuu

SEQ ID NO: 224948 - RNA, 22 nt, Human
ugcaggcaggggaugagcagcc

SEQ ID NO: 224949 - RNA, 22 nt, Human
auuagagaaugugcugacauug

SEQ ID NO: 224950 - RNA, 22 nt, Human
ugaguuugguaucuaggggguc

SEQ ID NO: 224951 - RNA, 22 nt, Human
ugauggcucccaugggcauaug

SEQ ID NO: 224952 - RNA, 22 nt, Human
caggagugaaaugaggcccagg

SEQ ID NO: 224953 - RNA, 22 nt, Human
ucccugagggcagcucaagucc

SEQ ID NO: 224954 - RNA, 22 nt, Human
acaguguucacuuaacaaugga

SEQ ID NO: 224955 - RNA, 22 nt, Human
aacuauacauauuuacauagac

SEQ ID NO: 224956 - RNA, 22 nt, Human
uuuagagcccaugugaguguga

SEQ ID NO: 224957 - RNA, 22 nt, Human
uuuauccauucaccaguugaac

SEQ ID NO: 224958 - RNA, 21 nt, Human
ugguggagugugcugagcaug

SEQ ID NO: 224959 - RNA, 22 nt, Human
cucucuggauauuuguaugcug

SEQ ID NO: 224960 - RNA, 22 nt, Human
uucuaugccauguucagcuacu

SEQ ID NO: 224961 - RNA, 22 nt, Human
ugacaggugaaauguccuuauu

SEQ ID NO: 224962 - RNA, 23 nt, Human
uucagggccucagaggugaagcu

SEQ ID NO: 224963 - RNA, 22 nt, Human
gggcacaggaauuugggaugug

SEQ ID NO: 224964 - RNA, 19 nt, Human
acuuccugcccgcuccuuu

SEQ ID NO: 224965 - RNA, 22 nt, Human
cauuagaagaacaguuauauua

SEQ ID NO: 224966 - RNA, 22 nt, Human
uagauucuacugucacuuaguu

SEQ ID NO: 224967 - RNA, 22 nt, Human
aaauuuaaaaagcagcauugca

SEQ ID NO: 224968 - RNA, 22 nt, Human
aggugggguguuggauguuuau

SEQ ID NO: 224969 - RNA, 22 nt, Human
aaacuguuauagcagaaaggac

SEQ ID NO: 224970 - RNA, 19 nt, Human
ccaugccaucauuuuaaag

SEQ ID NO: 224971 - RNA, 22 nt, Human
cagggaugagcagauggagcaa

SEQ ID NO: 224972 - RNA, 22 nt, Human
uugcacccaguaguuuaaauuc

SEQ ID NO: 224973 - RNA, 22 nt, Human
gcuuuguguagaaggaggaugg

SEQ ID NO: 224974 - RNA, 22 nt, Human
uaauugcuuuauccuguuagaa

SEQ ID NO: 224975 - RNA, 22 nt, Human
cugugaccuccaggaaggggug

SEQ ID NO: 224976 - RNA, 22 nt, Human
uguccuggugcuccagguggcu

SEQ ID NO: 224977 - RNA, 22 nt, Human
ugacucaccaucggaguuugaa

SEQ ID NO: 224978 - RNA, 22 nt, Human
ucaauauucuucuuuaguagga

SEQ ID NO: 224979 - RNA, 22 nt, Human
gcaugugucuuuauagcagcau

SEQ ID NO: 224980 - RNA, 22 nt, Human
auuugcaauuacucaugucauu

SEQ ID NO: 224981 - RNA, 22 nt, Human
agcugagcacauucaaacaggu

SEQ ID NO: 224982 - RNA, 22 nt, Human
agguguggcuugaagucucuau

SEQ ID NO: 224983 - RNA, 22 nt, Human
ggguccaguaguugguggccgu

SEQ ID NO: 224984 - RNA, 22 nt, Human
uacuguauaugcuuguaucuga

SEQ ID NO: 224985 - RNA, 22 nt, Human
gaaaggcaguacagcugagccu

SEQ ID NO: 224986 - RNA, 20 nt, Human
caguccugucccugcugccc

SEQ ID NO: 224987 - RNA, 22 nt, Human
cucaggaucgcuugcccuaggg

SEQ ID NO: 224988 - RNA, 22 nt, Human
cugggcuuagcagcuccugguc

SEQ ID NO: 224989 - RNA, 22 nt, Human
acuucucuccacccaagucccu

SEQ ID NO: 224990 - RNA, 19 nt, Human
uuuuuacaaguagguguga

SEQ ID NO: 224991 - RNA, 22 nt, Human
cacugagccuugccagcuuggu

SEQ ID NO: 224992 - RNA, 22 nt, Human
cagacaggcaggugagagcucc

SEQ ID NO: 224993 - RNA, 22 nt, Human
uugagaaauguuuuuuaagcug

SEQ ID NO: 224994 - RNA, 19 nt, Human
ccugcagggaugagagguu

SEQ ID NO: 224995 - RNA, 22 nt, Human
ucugaacauccagcaaugcaca

SEQ ID NO: 224996 - RNA, 22 nt, Human
cugggccuaggauggaagggcc

SEQ ID NO: 224997 - RNA, 16 nt, Human
ggggaaggcaagaggg

SEQ ID NO: 224998 - RNA, 22 nt, Human
uaggugguuaugucagccuaga

SEQ ID NO: 224999 - RNA, 18 nt, Human
uaauccauaugcuuugcc

SEQ ID NO: 225000 - RNA, 21 nt, Human
uuacaacauuuguguucuaug

SEQ ID NO: 225001 - RNA, 22 nt, Human
agcuggggcugcagagaacagg

SEQ ID NO: 225002 - RNA, 22 nt, Human
gccaggcucagcagucaaccug

SEQ ID NO: 225003 - RNA, 19 nt, Human
agaagcugugaaaugaagg

SEQ ID NO: 225004 - RNA, 22 nt, Human
ucauggauggccgggaggugau

SEQ ID NO: 225005 - RNA, 22 nt, Human
gagaacugauuagcauuugcca

SEQ ID NO: 225006 - RNA, 22 nt, Human
caaaucuuuaauugaggaauca

SEQ ID NO: 225007 - RNA, 22 nt, Human
uucccucucacuuaaagcuugg

SEQ ID NO: 225008 - RNA, 22 nt, Human
cuggugaauauuggaggcauug

SEQ ID NO: 225009 - RNA, 22 nt, Human
accuccugaugagaguaaagga

SEQ ID NO: 225010 - RNA, 22 nt, Human
acuuucugucaucuagacaagu

SEQ ID NO: 225011 - RNA, 22 nt, Human
acuaugauguauuuugcaucua

SEQ ID NO: 225012 - RNA, 18 nt, Human
ucuguugagcagagaggc

SEQ ID NO: 225013 - RNA, 22 nt, Human
gaugauuuaaguggccaaagua

SEQ ID NO: 225014 - RNA, 22 nt, Human
accugccucuaagcagcaggug

SEQ ID NO: 225015 - RNA, 19 nt, Human
aucugccuuagugcugcug

SEQ ID NO: 225016 - RNA, 22 nt, Human
cccagcauccucagggagcggg

SEQ ID NO: 225017 - RNA, 22 nt, Human
auguacaggucuuggcaaaggg

SEQ ID NO: 225018 - RNA, 22 nt, Human
cugcagggacccaagucuuugg

SEQ ID NO: 225019 - RNA, 22 nt, Human
aaauagacaggcuuaaauagga

SEQ ID NO: 225020 - RNA, 22 nt, Human
agagggguuaagugcuaguccg

SEQ ID NO: 225021 - RNA, 22 nt, Human
caggccucuuccaugcagcagc

SEQ ID NO: 225022 - RNA, 22 nt, Human
cuccccauccaggcagcaggug

SEQ ID NO: 225023 - RNA, 22 nt, Human
aaguauaagcuauucuucauga

SEQ ID NO: 225024 - RNA, 22 nt, Human
agcugcugagccaggcugaugu

SEQ ID NO: 225025 - RNA, 22 nt, Human
gagaagccgagucagcugagcc

SEQ ID NO: 225026 - RNA, 22 nt, Human
acugggccagacacugauuccc

SEQ ID NO: 225027 - RNA, 22 nt, Human
cagcagugucuccagcaucaca

SEQ ID NO: 225028 - RNA, 22 nt, Human
caucagaauagcucuguggaua

SEQ ID NO: 225029 - RNA, 22 nt, Human
ugccuuuuccaguuccuagaag

SEQ ID NO: 225030 - RNA, 22 nt, Human
gucuucauucucauagcccugg

SEQ ID NO: 225031 - RNA, 22 nt, Human
cagagcacugcuuggaggauuu

SEQ ID NO: 225032 - RNA, 22 nt, Human
gagaaagggaacuuacagagug

SEQ ID NO: 225033 - RNA, 22 nt, Human
cccuggugcccugggucagccu

SEQ ID NO: 225034 - RNA, 21 nt, Human
uuucccagcugaaaauaaaug

SEQ ID NO: 225035 - RNA, 22 nt, Human
aacaggcuuccaggagggacga

SEQ ID NO: 225036 - RNA, 22 nt, Human
gccacaggcuccagcaucagua

SEQ ID NO: 225037 - RNA, 22 nt, Human
agaggcugauggaguagugucu

SEQ ID NO: 225038 - RNA, 22 nt, Human
ugauuuacaguagugucuaaac

SEQ ID NO: 225039 - RNA, 22 nt, Human
cagauggagucccguggaguuc

SEQ ID NO: 225040 - RNA, 22 nt, Human
aggcaaagaggauauuuugggg

SEQ ID NO: 225041 - RNA, 22 nt, Human
auaaaaaugagggcgguagcua

SEQ ID NO: 225042 - RNA, 22 nt, Human
cugggcucagcaggccaaggcc

SEQ ID NO: 225043 - RNA, 22 nt, Human
acaguguccccagcucugugag

SEQ ID NO: 225044 - RNA, 22 nt, Human
uuucuucagccacuccaaacug

SEQ ID NO: 225045 - RNA, 22 nt, Human
guucucagggauaacuuccccc

SEQ ID NO: 225046 - RNA, 20 nt, Human
cugacucuccuuggcuugga

SEQ ID NO: 225047 - RNA, 22 nt, Human
cagcaucccucaggggccucug

SEQ ID NO: 225048 - RNA, 22 nt, Human
ucucagaggugcccuggcaucu

SEQ ID NO: 225049 - RNA, 22 nt, Human
gucuuucugccaugugaagaga

SEQ ID NO: 225050 - RNA, 22 nt, Human
uggcauuuggcuuacuuauguu

SEQ ID NO: 225051 - RNA, 21 nt, Human
uuuacugagcacuuacuaugu

SEQ ID NO: 225052 - RNA, 22 nt, Human
ggagggggacugacacugauuu

SEQ ID NO: 225053 - RNA, 17 nt, Human
cguggcugagccauaga

SEQ ID NO: 225054 - RNA, 22 nt, Human
gagcuuuaggagaaggagguca

SEQ ID NO: 225055 - RNA, 22 nt, Human
uggaagaauuuggggauaaauu

SEQ ID NO: 225056 - RNA, 22 nt, Human
ggcugcagauuguagucuguua

SEQ ID NO: 225057 - RNA, 22 nt, Human
agcauccugccucuccucccaa

SEQ ID NO: 225058 - RNA, 22 nt, Human
agcuggaggggccagcaggugu

SEQ ID NO: 225059 - RNA, 22 nt, Human
gcuggcugaguucugucgucug

SEQ ID NO: 225060 - RNA, 22 nt, Human
agggagcuuccgaacuacagcu

SEQ ID NO: 225061 - RNA, 22 nt, Human
uugcaugcuagaaagauugauu

SEQ ID NO: 225062 - RNA, 22 nt, Human
gccuugggaaagugggaggaga

SEQ ID NO: 225063 - RNA, 22 nt, Human
gcuccagggaguacauuuauca

SEQ ID NO: 225064 - RNA, 22 nt, Human
ccaccaggacagcccugagggg

SEQ ID NO: 225065 - RNA, 22 nt, Human
agcucccagaaggcccugcgcc

SEQ ID NO: 225066 - RNA, 22 nt, Human
uuaaaauagccagugccccucu

SEQ ID NO: 225067 - RNA, 22 nt, Human
uuugaaagccuggcuuuucucu

SEQ ID NO: 225068 - RNA, 22 nt, Human
ucugagcuggagcccaucaccu

SEQ ID NO: 225069 - RNA, 22 nt, Human
ccuuggcugugcugcccuuugc

SEQ ID NO: 225070 - RNA, 22 nt, Human
uccaggagcauccaggugaagc

SEQ ID NO: 225071 - RNA, 22 nt, Human
uaaagccaacacuuuacugcuc

SEQ ID NO: 225072 - RNA, 19 nt, Human
ggacacagaaagcugcauu

SEQ ID NO: 225073 - RNA, 22 nt, Human
aggggagcaaggccguggugua

SEQ ID NO: 225074 - RNA, 21 nt, Human
uucccuucugguuuugagaga

SEQ ID NO: 225075 - RNA, 22 nt, Human
cucaggauccaucuccugcccu

SEQ ID NO: 225076 - RNA, 22 nt, Human
cagcagcaaaucuagaagagga

SEQ ID NO: 225077 - RNA, 22 nt, Human
acccuucauagaggagaagcug

SEQ ID NO: 225078 - RNA, 22 nt, Human
ugaccagugaucuacugggauu

SEQ ID NO: 225079 - RNA, 19 nt, Human
uuugcagugguuccuuugu

SEQ ID NO: 225080 - RNA, 22 nt, Human
gcauuacaggcuguaagaugca

SEQ ID NO: 225081 - RNA, 22 nt, Human
cugagcuguuacucuguccucg

SEQ ID NO: 225082 - RNA, 22 nt, Human
ucugggagccaugccuuggagu

SEQ ID NO: 225083 - RNA, 21 nt, Human
aggaugccgcaggcggagaag

SEQ ID NO: 225084 - RNA, 22 nt, Human
ugcaggaccggaaccaugggau

SEQ ID NO: 225085 - RNA, 22 nt, Human
auuauacauuuuguguagagau

SEQ ID NO: 225086 - RNA, 22 nt, Human
gccagaugccguaaagaugggc

SEQ ID NO: 225087 - RNA, 22 nt, Human
gugaaggacuagcauggagggc

SEQ ID NO: 225088 - RNA, 22 nt, Human
gaugcgggcccgcuccacugcc

SEQ ID NO: 225089 - RNA, 22 nt, Human
cagccaggcccagaucaugcug

SEQ ID NO: 225090 - RNA, 22 nt, Human
cccagccucuggguucugccgg

SEQ ID NO: 225091 - RNA, 19 nt, Human
agugaaauggaguauucaa

SEQ ID NO: 225092 - RNA, 22 nt, Human
augaguacauugggaucaaaga

SEQ ID NO: 225093 - RNA, 22 nt, Human
aaaugugucauauucaaaguca

SEQ ID NO: 225094 - RNA, 22 nt, Human
aaggaagcagccagagacccuc

SEQ ID NO: 225095 - RNA, 22 nt, Human
agcauaaaggcacuagaaagag

SEQ ID NO: 225096 - RNA, 22 nt, Human
uccagcuuugagauuuuaugga

SEQ ID NO: 225097 - RNA, 23 nt, Human
aagaguuuagagucuugcagagu

SEQ ID NO: 225098 - RNA, 22 nt, Human
acauaauaaaaauaacagcuca

SEQ ID NO: 225099 - RNA, 22 nt, Human
ccuggcagcgccgaagcuggcc

SEQ ID NO: 225100 - RNA, 22 nt, Human
auuuacagugugccuacuauau

SEQ ID NO: 225101 - RNA, 22 nt, Human
uugcaauuaacauaugucaacu

SEQ ID NO: 225102 - RNA, 20 nt, Human
uggccuuuuggcuuggagcu

SEQ ID NO: 225103 - RNA, 22 nt, Human
gccagccuucuguggccugcaa

SEQ ID NO: 225104 - RNA, 22 nt, Human
gcugggcugcgucggggaagcc

SEQ ID NO: 225105 - RNA, 22 nt, Human
ugcauuuccagauuucuggagu

SEQ ID NO: 225106 - RNA, 22 nt, Human
cugaguggaacauaggaugaua

SEQ ID NO: 225107 - RNA, 22 nt, Human
aagaaauggaagauccauggug

SEQ ID NO: 225108 - RNA, 22 nt, Human
aacucaguuacauauuagaaua

SEQ ID NO: 225109 - RNA, 22 nt, Human
gaaaauuauugaaaauggcucu

SEQ ID NO: 225110 - RNA, 22 nt, Human
ucuaugaaccucugcaaugaca

SEQ ID NO: 225111 - RNA, 22 nt, Human
auauugaacccuacagacugua

SEQ ID NO: 225112 - RNA, 22 nt, Human
ccagaagcaaaacagacaguuu

SEQ ID NO: 225113 - RNA, 22 nt, Human
gcauaggccacuagugccagga

SEQ ID NO: 225114 - RNA, 22 nt, Human
aggcagcucuguggccucccag

SEQ ID NO: 225115 - RNA, 22 nt, Human
gucugggacaggacuggggaac

SEQ ID NO: 225116 - RNA, 22 nt, Human
acugccuguagcucuucaucuc

SEQ ID NO: 225117 - RNA, 17 nt, Human
gguggccugcaguggcu

SEQ ID NO: 225118 - RNA, 18 nt, Human
uuucucugucgucuucug

SEQ ID NO: 225119 - RNA, 22 nt, Human
gaaagccauagcccagcuuuac

SEQ ID NO: 225120 - RNA, 22 nt, Human
agaggacagacggaaagugcca

SEQ ID NO: 225121 - RNA, 23 nt, Human
gugcgccaggacaaccugacgga

SEQ ID NO: 225122 - RNA, 21 nt, Human
acagccugucaucucaugguc

SEQ ID NO: 225123 - RNA, 22 nt, Human
gagcaagacuacaggcagauga

SEQ ID NO: 225124 - RNA, 22 nt, Human
uagaagcucaggaauaggcaua

SEQ ID NO: 225125 - RNA, 22 nt, Human
uaacugguagauuuuaaaucgg

SEQ ID NO: 225126 - RNA, 22 nt, Human
ugaaugaugaggggagaauaau

SEQ ID NO: 225127 - RNA, 22 nt, Human
ucaauucugguccucaggaacu

SEQ ID NO: 225128 - RNA, 22 nt, Human
uggcaucucaaacaggcagauu

SEQ ID NO: 225129 - RNA, 22 nt, Human
caauaaagaagauuuuugcaau

SEQ ID NO: 225130 - RNA, 22 nt, Human
ugcauagggaaccucaugcauu

SEQ ID NO: 225131 - RNA, 22 nt, Human
uagcucuggagucuucucagaa

SEQ ID NO: 225132 - RNA, 20 nt, Human
acaguuuauccaguuagcag

SEQ ID NO: 225133 - RNA, 22 nt, Human
ggucuggauaauuccaguaccu

SEQ ID NO: 225134 - RNA, 20 nt, Human
ucaaguuuugcuugacaaga

SEQ ID NO: 225135 - RNA, 22 nt, Human
ugaggaaguugaucucaucagu

SEQ ID NO: 225136 - RNA, 22 nt, Human
aacuuucuuugcaucuaaguuu

SEQ ID NO: 225137 - RNA, 22 nt, Human
cuugacucuugcuucccaugga

SEQ ID NO: 225138 - RNA, 22 nt, Human
auuauaaagaacaugugugugg

SEQ ID NO: 225139 - RNA, 22 nt, Human
ccaggguugcuguauggcacuu

SEQ ID NO: 225140 - RNA, 22 nt, Human
cuugagaaucuugaugucuacc

SEQ ID NO: 225141 - RNA, 22 nt, Human
caaagggcauuuuagugaacug

SEQ ID NO: 225142 - RNA, 22 nt, Human
cugauuuacauauacaaaagau

SEQ ID NO: 225143 - RNA, 22 nt, Human
aagagaacagucaccaugcaca

SEQ ID NO: 225144 - RNA, 22 nt, Human
ucacugugcucucuagauaggc

SEQ ID NO: 225145 - RNA, 22 nt, Human
acacugugucuagcauuuuaca

SEQ ID NO: 225146 - RNA, 22 nt, Human
gcaguggaagccucuuuaagca

SEQ ID NO: 225147 - RNA, 22 nt, Human
cugccucugcgucccacagagu

SEQ ID NO: 225148 - RNA, 21 nt, Human
gagcccaggcaucucauuaau

SEQ ID NO: 225149 - RNA, 22 nt, Human
cugggccuuggauugacacugu

SEQ ID NO: 225150 - RNA, 22 nt, Human
aauaucaacaguguccuucuaa

SEQ ID NO: 225151 - RNA, 22 nt, Human
cuggcucuuuccuagcuaggcu

SEQ ID NO: 225152 - RNA, 22 nt, Human
uggaggugagugugguacagca

SEQ ID NO: 225153 - RNA, 22 nt, Human
agugagucaaaaaacuuagaua

SEQ ID NO: 225154 - RNA, 22 nt, Human
augauucuggggcaaaagcugg

SEQ ID NO: 225155 - RNA, 22 nt, Human
ggcucagguuuccuucccagcu

SEQ ID NO: 225156 - RNA, 22 nt, Human
ccauggcagccuggccuggcuu

SEQ ID NO: 225157 - RNA, 22 nt, Human
uuaaugcagaaaucaaacugac

SEQ ID NO: 225158 - RNA, 22 nt, Human
aguccuggccccaaggaaggau

SEQ ID NO: 225159 - RNA, 22 nt, Human
aguggggcggacaggaccagga

SEQ ID NO: 225160 - RNA, 22 nt, Human
caucaucaaaacaaauggaguc

SEQ ID NO: 225161 - RNA, 22 nt, Human
augccagaagagucugcaggga

SEQ ID NO: 225162 - RNA, 22 nt, Human
cccagaggaggaucucggcccg

SEQ ID NO: 225163 - RNA, 22 nt, Human
uccugugaccagcuuccaugcu

SEQ ID NO: 225164 - RNA, 22 nt, Human
aaaggcuacgggggccgugugc

SEQ ID NO: 225165 - RNA, 22 nt, Human
aacuuuauuguuaggggcuaaa

SEQ ID NO: 225166 - RNA, 22 nt, Human
agacauagauaggcacugauug

SEQ ID NO: 225167 - RNA, 22 nt, Human
uguggcugugccgucacacgug

SEQ ID NO: 225168 - RNA, 22 nt, Human
aggaucuuauguaauaauuaug

SEQ ID NO: 225169 - RNA, 23 nt, Human
caggcucccggaccaggauccgc

SEQ ID NO: 225170 - RNA, 22 nt, Human
ugcuauauaauggaauuucuaa

SEQ ID NO: 225171 - RNA, 22 nt, Human
ucagggagagccugucugacgu

SEQ ID NO: 225172 - RNA, 22 nt, Human
ugagugggauuaaaugagguga

SEQ ID NO: 225173 - RNA, 22 nt, Human
acagcaucuaguacagucuagu

SEQ ID NO: 225174 - RNA, 22 nt, Human
ggcuuugcccuggacugaggca

SEQ ID NO: 225175 - RNA, 22 nt, Human
cuccucccacggucucaggaag

SEQ ID NO: 225176 - RNA, 18 nt, Human
gucucaggaguggcacgu

SEQ ID NO: 225177 - RNA, 18 nt, Human
gcuuccugaaagcugccc

SEQ ID NO: 225178 - RNA, 23 nt, Human
ucuggcucuaugugacagcucuc

SEQ ID NO: 225179 - RNA, 22 nt, Human
caggcucccuaagucagcagcc

SEQ ID NO: 225180 - RNA, 22 nt, Human
cuguacaaguccuucaucaggg

SEQ ID NO: 225181 - RNA, 22 nt, Human
aaagacacauaugcuuaaccca

SEQ ID NO: 225182 - RNA, 20 nt, Human
uacuucugaggcacucugaa

SEQ ID NO: 225183 - RNA, 22 nt, Human
ccugccuucagcccugaagucu

SEQ ID NO: 225184 - RNA, 22 nt, Human
ugcuuuaguucaacaugccaaa

SEQ ID NO: 225185 - RNA, 22 nt, Human
ccaggugugccagcagggacug

SEQ ID NO: 225186 - RNA, 22 nt, Human
ucagauggaaagguuacugucc

SEQ ID NO: 225187 - RNA, 22 nt, Human
augugaaaauccaauggcagca

SEQ ID NO: 225188 - RNA, 22 nt, Human
gccuggagaaaggaagguggga

SEQ ID NO: 225189 - RNA, 22 nt, Human
gucuggggaagucagggcauca

SEQ ID NO: 225190 - RNA, 22 nt, Human
gaggccugguuugcaugagaau

SEQ ID NO: 225191 - RNA, 22 nt, Human
caggucuggugagagaacaguu

SEQ ID NO: 225192 - RNA, 22 nt, Human
uuuguucaugccuauauucuca

SEQ ID NO: 225193 - RNA, 22 nt, Human
acagagcuuaauucaggagcuu

SEQ ID NO: 225194 - RNA, 22 nt, Human
ccaccagcagugugcaaggauu

SEQ ID NO: 225195 - RNA, 22 nt, Human
cgggcagcggcguggccauggu

SEQ ID NO: 225196 - RNA, 22 nt, Human
caggccuggcugcagcucgccu

SEQ ID NO: 225197 - RNA, 22 nt, Human
aagcccucauccccaugggcgu

SEQ ID NO: 225198 - RNA, 22 nt, Human
gaaaagaguccugugugaggag

SEQ ID NO: 225199 - RNA, 22 nt, Human
uuggcugagagcugcucugcag

SEQ ID NO: 225200 - RNA, 22 nt, Human
gagugagggcagcaggggcugc

SEQ ID NO: 225201 - RNA, 22 nt, Human
ucuuuauaaaagucauuauguc

SEQ ID NO: 225202 - RNA, 22 nt, Human
cuccaguggugauggggaagaa

SEQ ID NO: 225203 - RNA, 21 nt, Human
agcugcuuucagcuccuagag

SEQ ID NO: 225204 - RNA, 22 nt, Human
uugcucugaaccacaccaucac

SEQ ID NO: 225205 - RNA, 22 nt, Human
ucauaaauucuggugcugugag

SEQ ID NO: 225206 - RNA, 22 nt, Human
uuuuaauucaaagugaauagug

SEQ ID NO: 225207 - RNA, 22 nt, Human
aucuucaaagggauguccaugg

SEQ ID NO: 225208 - RNA, 22 nt, Human
gccucuguggcucagccuugcu

SEQ ID NO: 225209 - RNA, 22 nt, Human
cuucagagugcagaagauuggg

SEQ ID NO: 225210 - RNA, 22 nt, Human
cuccagugggggugagccuaga

SEQ ID NO: 225211 - RNA, 22 nt, Human
agcagaagaaagccacaugacu

SEQ ID NO: 225212 - RNA, 22 nt, Human
agugugggugagggaggcccuc

SEQ ID NO: 225213 - RNA, 22 nt, Human
uguccugggucaaauccugguc

SEQ ID NO: 225214 - RNA, 22 nt, Human
caagcagauauuuuagucaaga

SEQ ID NO: 225215 - RNA, 22 nt, Human
aaugugucuaugugguucacag

SEQ ID NO: 225216 - RNA, 22 nt, Human
aaauacaguguguguucuuuga

SEQ ID NO: 225217 - RNA, 22 nt, Human
aggcucagcugguggugaucgc

SEQ ID NO: 225218 - RNA, 22 nt, Human
cccucagcuucucccugcagcu

SEQ ID NO: 225219 - RNA, 22 nt, Human
agagucuuccaggcagccugag

SEQ ID NO: 225220 - RNA, 22 nt, Human
guccagcccgggcuccgccagc

SEQ ID NO: 225221 - RNA, 22 nt, Human
accugccuucucaaggacauga

SEQ ID NO: 225222 - RNA, 21 nt, Human
cuccugggcuaagauauagug

SEQ ID NO: 225223 - RNA, 22 nt, Human
ugauaaacuggagagguggagg

SEQ ID NO: 225224 - RNA, 22 nt, Human
cucuggaauguuuacaugcccu

SEQ ID NO: 225225 - RNA, 22 nt, Human
ucugcaggaucagagccagagg

SEQ ID NO: 225226 - RNA, 22 nt, Human
uggcucagaguucaucuuuuag

SEQ ID NO: 225227 - RNA, 22 nt, Human
agucuucuugaucuuuucagug

SEQ ID NO: 225228 - RNA, 22 nt, Human
ccugccuggagcugagugugga

SEQ ID NO: 225229 - RNA, 22 nt, Human
ggagcugaguggguuuauugau

SEQ ID NO: 225230 - RNA, 22 nt, Human
uuccaggaacacucuguguccc

SEQ ID NO: 225231 - RNA, 23 nt, Human
gcaaagacucugccaaaaacugc

SEQ ID NO: 225232 - RNA, 22 nt, Human
agcuuacuguaauuaaaagacu

SEQ ID NO: 225233 - RNA, 22 nt, Human
ccauccugcauugcuauucaga

SEQ ID NO: 225234 - RNA, 22 nt, Human
acuucuuucacaauguuucuag

SEQ ID NO: 225235 - RNA, 22 nt, Human
cucugagcugaaacaugagcau

SEQ ID NO: 225236 - RNA, 22 nt, Human
uucuguaucucuguguuucuug

SEQ ID NO: 225237 - RNA, 22 nt, Human
cuuauucagaaggagaaaugga

SEQ ID NO: 225238 - RNA, 22 nt, Human
gcuguacaucacaauuugcugu

SEQ ID NO: 225239 - RNA, 22 nt, Human
gugcucaggggcaauccuggga

SEQ ID NO: 225240 - RNA, 22 nt, Human
agcuggccagcaccuccagguc

SEQ ID NO: 225241 - RNA, 22 nt, Human
ggccugagggugggcucucagu

SEQ ID NO: 225242 - RNA, 22 nt, Human
aagggaggaggauuuauuguac

SEQ ID NO: 225243 - RNA, 20 nt, Human
ccagaagcacucuucauguu

SEQ ID NO: 225244 - RNA, 22 nt, Human
guacauuucucuuguucuuauu

SEQ ID NO: 225245 - RNA, 22 nt, Human
cagcaagauuuuuaaagcaagg

SEQ ID NO: 225246 - RNA, 22 nt, Human
guggccagaggucccauguguc

SEQ ID NO: 225247 - RNA, 22 nt, Human
augcaaacauucgcuugucucu

SEQ ID NO: 225248 - RNA, 23 nt, Human
agagcaaggaaaugaggugugau

SEQ ID NO: 225249 - RNA, 22 nt, Human
caguuacuguaugucaaagacu

SEQ ID NO: 225250 - RNA, 22 nt, Human
aggccacagagagugcaugugc

SEQ ID NO: 225251 - RNA, 23 nt, Human
acaagauagggauaaaaagauaa

SEQ ID NO: 225252 - RNA, 20 nt, Human
gggguugacccucuuggacu

SEQ ID NO: 225253 - RNA, 22 nt, Human
uaagagaauguuguggcuaggu

SEQ ID NO: 225254 - RNA, 22 nt, Human
ucagaaaggaguuagaggucuc

SEQ ID NO: 225255 - RNA, 22 nt, Human
uuuaagcuguggcauuaauucu

SEQ ID NO: 225256 - RNA, 22 nt, Human
aaggccuugccgaaggaugcca

SEQ ID NO: 225257 - RNA, 22 nt, Human
ugguccaguucugugauauugc

SEQ ID NO: 225258 - RNA, 22 nt, Human
auuucagaugaccaaauggaaa

SEQ ID NO: 225259 - RNA, 22 nt, Human
gcugaggccccagggugauggg

SEQ ID NO: 225260 - RNA, 22 nt, Human
uacaagauaagaauuggcaagg

SEQ ID NO: 225261 - RNA, 22 nt, Human
ucugccaguuuauagacaagcc

SEQ ID NO: 225262 - RNA, 22 nt, Human
augguuuagcaacuuagggaaa

SEQ ID NO: 225263 - RNA, 22 nt, Human
gcagacuggucuucagccuugg

SEQ ID NO: 225264 - RNA, 22 nt, Human
gcucagggugcaguguccauga

SEQ ID NO: 225265 - RNA, 22 nt, Human
aaugaucuggcucaggauauca

SEQ ID NO: 225266 - RNA, 22 nt, Human
cucugcugcaggaaggcgugca

SEQ ID NO: 225267 - RNA, 22 nt, Human
uacaaaugaguuguaugaacca

SEQ ID NO: 225268 - RNA, 22 nt, Human
caagagacuuauguggaaaccu

SEQ ID NO: 225269 - RNA, 22 nt, Human
aagaguuugggcaagucauaaa

SEQ ID NO: 225270 - RNA, 19 nt, Human
agcagcucagggaggcacc

SEQ ID NO: 225271 - RNA, 22 nt, Human
uccuuccugcaggccaaguccu

SEQ ID NO: 225272 - RNA, 22 nt, Human
acuugguuguuuuaacuuggca

SEQ ID NO: 225273 - RNA, 22 nt, Human
uuugagaaggugacaaauucua

SEQ ID NO: 225274 - RNA, 22 nt, Human
augaggcauagcagggaucgga

SEQ ID NO: 225275 - RNA, 21 nt, Human
cccugcuuggggcagaacaac

SEQ ID NO: 225276 - RNA, 22 nt, Human
agcagcaugaugacagagucuc

SEQ ID NO: 225277 - RNA, 22 nt, Human
ugcccagccaauuuguuauguu

SEQ ID NO: 225278 - RNA, 22 nt, Human
aaauuuguucaaugucuauuug

SEQ ID NO: 225279 - RNA, 22 nt, Human
gagcuuccacucuagaaggagu

SEQ ID NO: 225280 - RNA, 22 nt, Human
cuguggcucaaaaucccaugau

SEQ ID NO: 225281 - RNA, 22 nt, Human
ccuccugucuccuuccuauauu

SEQ ID NO: 225282 - RNA, 22 nt, Human
acaugucuacacauucugcaau

SEQ ID NO: 225283 - RNA, 22 nt, Human
ugagguggugcuaaucucugcu

SEQ ID NO: 225284 - RNA, 21 nt, Human
uccaggcuggaaggggcguug

SEQ ID NO: 225285 - RNA, 22 nt, Human
caccaggcuggagugcagaggu

SEQ ID NO: 225286 - RNA, 22 nt, Human
ccagccagucccgcaugaccgc

SEQ ID NO: 225287 - RNA, 22 nt, Human
caggcuggcaaugcgucaagca

SEQ ID NO: 225288 - RNA, 22 nt, Human
caccagggcagcagccuagucu

SEQ ID NO: 225289 - RNA, 22 nt, Human
uugagcaaaggaguaaaaugca

SEQ ID NO: 225290 - RNA, 17 nt, Human
gcugagaggcagcacag

SEQ ID NO: 225291 - RNA, 22 nt, Human
aggggagaauuucaacucaggu

SEQ ID NO: 225292 - RNA, 22 nt, Human
uucuuucuguccauaaugagac

SEQ ID NO: 225293 - RNA, 21 nt, Human
agccagucauuaugagcggga

SEQ ID NO: 225294 - RNA, 22 nt, Human
acaguguuuggcaaugcaugca

SEQ ID NO: 225295 - RNA, 22 nt, Human
uugugaguagugccgcaauaaa

SEQ ID NO: 225296 - RNA, 22 nt, Human
cugcucuucacacuacacccgu

SEQ ID NO: 225297 - RNA, 22 nt, Human
augcccugugacucuccuggac

SEQ ID NO: 225298 - RNA, 22 nt, Human
gacaguaacugagagauguaau

SEQ ID NO: 225299 - RNA, 22 nt, Human
agagguggagcucuuggcauca

SEQ ID NO: 225300 - RNA, 22 nt, Human
aaugaaacucgaaauaaucaca

SEQ ID NO: 225301 - RNA, 22 nt, Human
ggaagggcaauaaaaucucagg

SEQ ID NO: 225302 - RNA, 22 nt, Human
acuuuacuacauccacagaugg

SEQ ID NO: 225303 - RNA, 22 nt, Human
cggcucagacuucccaagaaca

SEQ ID NO: 225304 - RNA, 22 nt, Human
ugggacagugugccuugcuccu

SEQ ID NO: 225305 - RNA, 22 nt, Human
gccccaccuugagagcagaaac

SEQ ID NO: 225306 - RNA, 22 nt, Human
aggcuggugcuuccuagggcag

SEQ ID NO: 225307 - RNA, 22 nt, Human
uggagcaggaagucuauggcug

SEQ ID NO: 225308 - RNA, 22 nt, Human
gaggaggcuaagugggcucugg

SEQ ID NO: 225309 - RNA, 22 nt, Human
uguaucaaaccaaauuaauucu

SEQ ID NO: 225310 - RNA, 22 nt, Human
augaaggacaacaggggagcag

SEQ ID NO: 225311 - RNA, 21 nt, Human
ucagcagcuuuugcagucccu

SEQ ID NO: 225312 - RNA, 22 nt, Human
agaggggaaggaugugauguga

SEQ ID NO: 225313 - RNA, 22 nt, Human
agcugcagcccuccugcauggc

SEQ ID NO: 225314 - RNA, 18 nt, Human
uuuuaauuucaggggugg

SEQ ID NO: 225315 - RNA, 22 nt, Human
auccugugaggauaagcccuug

SEQ ID NO: 225316 - RNA, 22 nt, Human
agcgcaggaacacgucugccuu

SEQ ID NO: 225317 - RNA, 22 nt, Human
aggaaucugugguuuuaacagg

SEQ ID NO: 225318 - RNA, 22 nt, Human
ccccucucccucacuuaucaau

SEQ ID NO: 225319 - RNA, 22 nt, Human
agcccagaaaugaaaggaugau

SEQ ID NO: 225320 - RNA, 23 nt, Human
aggaagcuaccaauuuuguaggc

SEQ ID NO: 225321 - RNA, 22 nt, Human
acagacauauuuggcccauagc

SEQ ID NO: 225322 - RNA, 22 nt, Human
caaggaaaagaaguauuucaga

SEQ ID NO: 225323 - RNA, 22 nt, Human
ugaaagcaggcgggcuacuuua

SEQ ID NO: 225324 - RNA, 22 nt, Human
cagcuguguaugagagcaugcu

SEQ ID NO: 225325 - RNA, 21 nt, Human
aagcuuggcugauguuauugg

SEQ ID NO: 225326 - RNA, 22 nt, Human
acagaauugggguucuugggga

SEQ ID NO: 225327 - RNA, 22 nt, Human
uuuccucaacugucaaaugggg

SEQ ID NO: 225328 - RNA, 22 nt, Human
ucaaaaguuucacauagagaua

SEQ ID NO: 225329 - RNA, 22 nt, Human
cucagugugaaugcucaguaaa

SEQ ID NO: 225330 - RNA, 22 nt, Human
agaaaucaauaucuauauguug

SEQ ID NO: 225331 - RNA, 22 nt, Human
cuuuaaauaauacaagguccag

SEQ ID NO: 225332 - RNA, 22 nt, Human
caguuaaagugcuuaucacaga

SEQ ID NO: 225333 - RNA, 22 nt, Human
uuccugaauauaaagacacuag

SEQ ID NO: 225334 - RNA, 22 nt, Human
aacaaagucguugccuagaaga

SEQ ID NO: 225335 - RNA, 22 nt, Human
ugcuggcuguauaugugagagu

SEQ ID NO: 225336 - RNA, 22 nt, Human
gaaagacuuccuuugagaguac

SEQ ID NO: 225337 - RNA, 22 nt, Human
guaaacauuacugugcuguaua

SEQ ID NO: 225338 - RNA, 22 nt, Human
ucucuaaaugauuguguacucc

SEQ ID NO: 225339 - RNA, 22 nt, Human
uuggaacaaucacauccuugcu

SEQ ID NO: 225340 - RNA, 23 nt, Human
uccagcagagccuuccaggaggg

SEQ ID NO: 225341 - RNA, 22 nt, Human
acagggauuaugacugacagcc

SEQ ID NO: 225342 - RNA, 22 nt, Human
aggccagccucaggcagggacc

SEQ ID NO: 225343 - RNA, 22 nt, Human
aauguuuuaaaagagauugaga

SEQ ID NO: 225344 - RNA, 22 nt, Human
cuuccaguggcaccaacaugca

SEQ ID NO: 225345 - RNA, 22 nt, Human
uggcacagacauuuaauagccu

SEQ ID NO: 225346 - RNA, 22 nt, Human
uugagggacagaggugcugucu

SEQ ID NO: 225347 - RNA, 22 nt, Human
aucagaaaguucaucauguuug

SEQ ID NO: 225348 - RNA, 22 nt, Human
ugaguucuuugcaaauaacaag

SEQ ID NO: 225349 - RNA, 19 nt, Human
cuggucugcugcuuccagg

SEQ ID NO: 225350 - RNA, 18 nt, Human
augcugcccucugagggu

SEQ ID NO: 225351 - RNA, 22 nt, Human
aaaaauugcugagaacggaauu

SEQ ID NO: 225352 - RNA, 22 nt, Human
ugcaggugguuuggacacugcu

SEQ ID NO: 225353 - RNA, 22 nt, Human
uuugaacuucuccauucugaug

SEQ ID NO: 225354 - RNA, 22 nt, Human
gcuggucagagagaaaggaggc

SEQ ID NO: 225355 - RNA, 22 nt, Human
ucugagguuacugcuuuguaga

SEQ ID NO: 225356 - RNA, 22 nt, Human
ugagaacugaggauuugaauuc

SEQ ID NO: 225357 - RNA, 22 nt, Human
uggaauguaaaccucagguggg

SEQ ID NO: 225358 - RNA, 22 nt, Human
uucaauguuucuuaucaaguug

SEQ ID NO: 225359 - RNA, 22 nt, Human
uacuucaaccuucucuauuaga

SEQ ID NO: 225360 - RNA, 21 nt, Human
cagaggcaggcucugugugug

SEQ ID NO: 225361 - RNA, 22 nt, Human
gaauaauuuugaucagaaggga

SEQ ID NO: 225362 - RNA, 22 nt, Human
aagcauuugguucugaagacuc

SEQ ID NO: 225363 - RNA, 22 nt, Human
auggcugccuuaauucuucagc

SEQ ID NO: 225364 - RNA, 22 nt, Human
aagcccugggauguucagcagu

SEQ ID NO: 225365 - RNA, 22 nt, Human
cauuguuuguaaaauuccagua

SEQ ID NO: 225366 - RNA, 22 nt, Human
aggcuuguggauuggagcgagu

SEQ ID NO: 225367 - RNA, 22 nt, Human
auuuggaaacaauuauauucuu

SEQ ID NO: 225368 - RNA, 22 nt, Human
ggugacauaguuacuucaggcu

SEQ ID NO: 225369 - RNA, 17 nt, Human
augauuacaucuuuccu

SEQ ID NO: 225370 - RNA, 22 nt, Human
ugcugaggagggcacccggggg

SEQ ID NO: 225371 - RNA, 22 nt, Human
ucagagaguuagugucuuagcu

SEQ ID NO: 225372 - RNA, 22 nt, Human
cccuccucaacucuggcuucca

SEQ ID NO: 225373 - RNA, 22 nt, Human
cauggcugaacacucagugacu

SEQ ID NO: 225374 - RNA, 22 nt, Human
uuugaaguccaucuggcccagu

SEQ ID NO: 225375 - RNA, 22 nt, Human
aaaaggcucuucaaaauggaag

SEQ ID NO: 225376 - RNA, 22 nt, Human
aaagcugcccuacacggaagca

SEQ ID NO: 225377 - RNA, 22 nt, Human
aaacagaugaguuauaauagcc

SEQ ID NO: 225378 - RNA, 19 nt, Human
ggcugagcgccuuggcugc

SEQ ID NO: 225379 - RNA, 22 nt, Human
uuccauauuuguguggcaaaag

SEQ ID NO: 225380 - RNA, 22 nt, Human
cucuguccuccaccugcuuuca

SEQ ID NO: 225381 - RNA, 22 nt, Human
cucaggccuugaagucuuuucu

SEQ ID NO: 225382 - RNA, 22 nt, Human
gccuguccuauacaggcggcug

SEQ ID NO: 225383 - RNA, 22 nt, Human
cuagaaauguagauucuuagug

SEQ ID NO: 225384 - RNA, 22 nt, Human
uuacauucccagugugcagcau

SEQ ID NO: 225385 - RNA, 22 nt, Human
caacauauaauauuugaguucu

SEQ ID NO: 225386 - RNA, 19 nt, Human
cauuuagaaguacauauua

SEQ ID NO: 225387 - RNA, 22 nt, Human
gccaggcagcuagcaaccccug

SEQ ID NO: 225388 - RNA, 22 nt, Human
ugcaauaacccaguaucuguga

SEQ ID NO: 225389 - RNA, 22 nt, Human
cacacuaucuuccuauccuggc

SEQ ID NO: 225390 - RNA, 22 nt, Human
gggccccuugcugcucugcugg

SEQ ID NO: 225391 - RNA, 22 nt, Human
cugguuuauguaucaucuagaa

SEQ ID NO: 225392 - RNA, 22 nt, Human
cccagcagcuugcacagugcug

SEQ ID NO: 225393 - RNA, 22 nt, Human
gcugguuuccuuaucuauaaag

SEQ ID NO: 225394 - RNA, 22 nt, Human
ugucauuuaugcuucuucagug

SEQ ID NO: 225395 - RNA, 20 nt, Human
uacaucucucagaugucuaa

SEQ ID NO: 225396 - RNA, 22 nt, Human
ugaaacuucuaauaugaauagu

SEQ ID NO: 225397 - RNA, 22 nt, Human
ugcaugcaugcuacugggaggu

SEQ ID NO: 225398 - RNA, 21 nt, Human
uggugccuucagcugucuuuu

SEQ ID NO: 225399 - RNA, 22 nt, Human
ccgggccucgggacaccgggua

SEQ ID NO: 225400 - RNA, 22 nt, Human
guaagccucugcucuaucuggu

SEQ ID NO: 225401 - RNA, 22 nt, Human
ggagccaggcaaucuguacuuu

SEQ ID NO: 225402 - RNA, 22 nt, Human
gcuguggcaauguuuauaauua

SEQ ID NO: 225403 - RNA, 22 nt, Human
auuccaaagcacaucagaacua

SEQ ID NO: 225404 - RNA, 20 nt, Human
uaaauuagccuugaagauua

SEQ ID NO: 225405 - RNA, 22 nt, Human
cagcuggcauaccugggcccgg

SEQ ID NO: 225406 - RNA, 22 nt, Human
acaggcaccugccaccacaucu

SEQ ID NO: 225407 - RNA, 22 nt, Human
aguaagcaauagagugagaauu

SEQ ID NO: 225408 - RNA, 22 nt, Human
ugaggagcuucuggaaagugca

SEQ ID NO: 225409 - RNA, 22 nt, Human
ugaguucuucacauuaccuacg

SEQ ID NO: 225410 - RNA, 22 nt, Human
cuagagaagaggcucagccagc

SEQ ID NO: 225411 - RNA, 22 nt, Human
caguguuuaaucauugugaauu

SEQ ID NO: 225412 - RNA, 22 nt, Human
caacugguggucaaccuucugu

SEQ ID NO: 225413 - RNA, 22 nt, Human
ccaagguugagaaacuguagga

SEQ ID NO: 225414 - RNA, 22 nt, Human
acaaauaugguacucggagaaa

SEQ ID NO: 225415 - RNA, 22 nt, Human
aaaagcacuacaauuucgcuuc

SEQ ID NO: 225416 - RNA, 22 nt, Human
aucagagaccggucaagucaug

SEQ ID NO: 225417 - RNA, 22 nt, Human
gacuccagguguccaggccucc

SEQ ID NO: 225418 - RNA, 22 nt, Human
uucauuuuuaccgcgugucaaa

SEQ ID NO: 225419 - RNA, 22 nt, Human
gagugggggguccgucucagug

SEQ ID NO: 225420 - RNA, 22 nt, Human
cuggguaaguuccuaaggcuca

SEQ ID NO: 225421 - RNA, 22 nt, Human
agcugagaaucuuccccagugu

SEQ ID NO: 225422 - RNA, 16 nt, Human
ugcagagagcauggug

SEQ ID NO: 225423 - RNA, 22 nt, Human
gcagcauauuguacuggccugc

SEQ ID NO: 225424 - RNA, 22 nt, Human
gaggagccuggccccacaucca

SEQ ID NO: 225425 - RNA, 22 nt, Human
gcugcccugugguagagggugg

SEQ ID NO: 225426 - RNA, 22 nt, Human
gcagucccauaucuuuaacaua

SEQ ID NO: 225427 - RNA, 22 nt, Human
cacaguuagagguagaguccag

SEQ ID NO: 225428 - RNA, 22 nt, Human
uugagaacuagcauggucuauc

SEQ ID NO: 225429 - RNA, 22 nt, Human
uccccacucaccacuggccaaa

SEQ ID NO: 225430 - RNA, 22 nt, Human
cuggcagcugcccgagaugccc

SEQ ID NO: 225431 - RNA, 22 nt, Human
uguggggcugucaggcaacugg

SEQ ID NO: 225432 - RNA, 22 nt, Human
cuuauuagaaagaaaagacaug

SEQ ID NO: 225433 - RNA, 22 nt, Human
ugcuaucuaggcaagguggucc

SEQ ID NO: 225434 - RNA, 22 nt, Human
aaccccaggcuggaggagucuc

SEQ ID NO: 225435 - RNA, 22 nt, Human
gcagcuuuaaacauuggaaaua

SEQ ID NO: 225436 - RNA, 22 nt, Human
cagaaccugugaauguguuauc

SEQ ID NO: 225437 - RNA, 22 nt, Human
gccagguggucuggcuccagag

SEQ ID NO: 225438 - RNA, 22 nt, Human
aaucuacauuucaguuuugccc

SEQ ID NO: 225439 - RNA, 22 nt, Human
caaagcaguauuggauucuuua

SEQ ID NO: 225440 - RNA, 22 nt, Human
uagugaaagucaaagacagcua

SEQ ID NO: 225441 - RNA, 22 nt, Human
ugcuggcuuuaagguuaaagug

SEQ ID NO: 225442 - RNA, 22 nt, Human
caaguccuuuucuuggcucagg

SEQ ID NO: 225443 - RNA, 22 nt, Human
cacaguuucaauaauuauucuu

SEQ ID NO: 225444 - RNA, 22 nt, Human
uugaaaggguuaaagugguaaa

SEQ ID NO: 225445 - RNA, 19 nt, Human
gcacacaguagggcuggca

SEQ ID NO: 225446 - RNA, 22 nt, Human
gucauucaacugcacauuaggu

SEQ ID NO: 225447 - RNA, 22 nt, Human
ugguucagagaguugcugacca

SEQ ID NO: 225448 - RNA, 22 nt, Human
gcugcagagggaggggcucgca

SEQ ID NO: 225449 - RNA, 22 nt, Human
uugcaacaucugaacauuuauc

SEQ ID NO: 225450 - RNA, 19 nt, Human
gcaggguggcagagcucuu

SEQ ID NO: 225451 - RNA, 22 nt, Human
ggcucaccauggccucccugcu

SEQ ID NO: 225452 - RNA, 20 nt, Human
gaggccucagccucagcucc

SEQ ID NO: 225453 - RNA, 22 nt, Human
uuggaacuuaacccugauaggu

SEQ ID NO: 225454 - RNA, 22 nt, Human
aggauguggguuuucacauugu

SEQ ID NO: 225455 - RNA, 19 nt, Human
ggcugccuccugggagauu

SEQ ID NO: 225456 - RNA, 22 nt, Human
agaacaaaucgauggaagccug

SEQ ID NO: 225457 - RNA, 22 nt, Human
cagucagagucacaguaauuug

SEQ ID NO: 225458 - RNA, 22 nt, Human
gcgagccucuggaguccucugg

SEQ ID NO: 225459 - RNA, 22 nt, Human
guuuuccuacuguaucaucaaa

SEQ ID NO: 225460 - RNA, 22 nt, Human
gacuuuggcuuuuauucuaggu

SEQ ID NO: 225461 - RNA, 22 nt, Human
agaccauggccauccuaggaaa

SEQ ID NO: 225462 - RNA, 22 nt, Human
gagcacugauuuauuuuugucu

SEQ ID NO: 225463 - RNA, 22 nt, Human
gcaccagggagggugugcuuca

SEQ ID NO: 225464 - RNA, 22 nt, Human
aggcuucucaauagguuugaag

SEQ ID NO: 225465 - RNA, 22 nt, Human
cagauggcugccaagaugggcu

SEQ ID NO: 225466 - RNA, 22 nt, Human
gaggccagugugcuguguuuuc

SEQ ID NO: 225467 - RNA, 19 nt, Human
aucuuuggguccugaaggg

SEQ ID NO: 225468 - RNA, 22 nt, Human
gcagugcuaaggauucugccuu

SEQ ID NO: 225469 - RNA, 22 nt, Human
uucuguuuacucagaaauacaa

SEQ ID NO: 225470 - RNA, 22 nt, Human
cucuuagaaacuauagagauua

SEQ ID NO: 225471 - RNA, 18 nt, Human
gggaagccgggaagccgg

SEQ ID NO: 225472 - RNA, 22 nt, Human
ggcagcuuacguuuugcuagug

SEQ ID NO: 225473 - RNA, 22 nt, Human
acucccuggcaggucuuuaucu

SEQ ID NO: 225474 - RNA, 22 nt, Human
uaguuuacuguucacuuugccc

SEQ ID NO: 225475 - RNA, 22 nt, Human
ggaagaaagguggacaacaggu

SEQ ID NO: 225476 - RNA, 22 nt, Human
ucuggcuccugaguccaugcuc

SEQ ID NO: 225477 - RNA, 22 nt, Human
augccuuucuuuggugcagguu

SEQ ID NO: 225478 - RNA, 22 nt, Human
agauggcugauuaacuccaugg

SEQ ID NO: 225479 - RNA, 22 nt, Human
acuugguugcaaaugaauuauu

SEQ ID NO: 225480 - RNA, 22 nt, Human
cccaguggugcuggcaucugug

SEQ ID NO: 225481 - RNA, 22 nt, Human
ucuguggcauagugcuugggaa

SEQ ID NO: 225482 - RNA, 22 nt, Human
augaggagcuccuugaaaugag

SEQ ID NO: 225483 - RNA, 22 nt, Human
ugaaguaggcagcaugcugaga

SEQ ID NO: 225484 - RNA, 22 nt, Human
uguucccaagauaagauuauga

SEQ ID NO: 225485 - RNA, 22 nt, Human
uccuggcccucugcaaacgcca

SEQ ID NO: 225486 - RNA, 22 nt, Human
cuuuauauauucccaggcugcc

SEQ ID NO: 225487 - RNA, 22 nt, Human
gauacauaaaaaugugcucuau

SEQ ID NO: 225488 - RNA, 22 nt, Human
ggcuuucuuguuaaauguccau

SEQ ID NO: 225489 - RNA, 22 nt, Human
caugccaacaacaagcaaugag

SEQ ID NO: 225490 - RNA, 22 nt, Human
ugagcaguggggccugcauucu

SEQ ID NO: 225491 - RNA, 22 nt, Human
uggaugaguucaaugaggcaga

SEQ ID NO: 225492 - RNA, 22 nt, Human
ugagccaguucuucagauccau

SEQ ID NO: 225493 - RNA, 22 nt, Human
cacuguauuauuaggaaugaca

SEQ ID NO: 225494 - RNA, 22 nt, Human
agcagagccugggcuaggggug

SEQ ID NO: 225495 - RNA, 22 nt, Human
cuuguccuuuacuugagacuca

SEQ ID NO: 225496 - RNA, 22 nt, Human
ucccagagugugggcaucaagg

SEQ ID NO: 225497 - RNA, 22 nt, Human
ccccacagccgccagcagggag

SEQ ID NO: 225498 - RNA, 20 nt, Human
agcuucauuauagcccacag

SEQ ID NO: 225499 - RNA, 22 nt, Human
aauaacaggcucaucagaugcu

SEQ ID NO: 225500 - RNA, 22 nt, Human
ccaggucugucuucuuagcuca

SEQ ID NO: 225501 - RNA, 22 nt, Human
uccugggcgaguggugguacac

SEQ ID NO: 225502 - RNA, 22 nt, Human
gcaggucuggcauagagccugc

SEQ ID NO: 225503 - RNA, 22 nt, Human
uuugacuccuguguuucuggaa

SEQ ID NO: 225504 - RNA, 22 nt, Human
acaggugcaugcuaccaugucu

SEQ ID NO: 225505 - RNA, 22 nt, Human
caggcugaggguuaggccuuag

SEQ ID NO: 225506 - RNA, 22 nt, Human
gacuucuguuaacuuguaagag

SEQ ID NO: 225507 - RNA, 22 nt, Human
cagagagcuuagugugcugcau

SEQ ID NO: 225508 - RNA, 22 nt, Human
caucaaauuaugugucaaagca

SEQ ID NO: 225509 - RNA, 22 nt, Human
ccagaaaacucuacaugcuugu

SEQ ID NO: 225510 - RNA, 22 nt, Human
ugacccuuucauuauucucauu

SEQ ID NO: 225511 - RNA, 22 nt, Human
ggagcuguuggcagcuaucuug

SEQ ID NO: 225512 - RNA, 22 nt, Human
cacagagaucggaacagaagua

SEQ ID NO: 225513 - RNA, 22 nt, Human
agcccaggagguggagguugca

SEQ ID NO: 225514 - RNA, 22 nt, Human
uuuccucauuuaucugcuggga

SEQ ID NO: 225515 - RNA, 22 nt, Human
uggguccacaaacaucagauau

SEQ ID NO: 225516 - RNA, 22 nt, Human
gcucccagcauugcugcugaau

SEQ ID NO: 225517 - RNA, 22 nt, Human
caaggcuauaauguugcuggaa

SEQ ID NO: 225518 - RNA, 22 nt, Human
gcuggcucugaugggcuccagg

SEQ ID NO: 225519 - RNA, 20 nt, Human
ucucuggcaagaagcugcag

SEQ ID NO: 225520 - RNA, 22 nt, Human
auuauuuacagugugcucgaag

SEQ ID NO: 225521 - RNA, 22 nt, Human
aggaagcuuagugaaaggacca

SEQ ID NO: 225522 - RNA, 22 nt, Human
acuccaguuaccuuggcugagg

SEQ ID NO: 225523 - RNA, 22 nt, Human
aagcagaacugggaaguagugg

SEQ ID NO: 225524 - RNA, 23 nt, Human
aggaaggagguccuaacaguauc

SEQ ID NO: 225525 - RNA, 22 nt, Human
uagaaagaucuguaggcaagag

SEQ ID NO: 225526 - RNA, 22 nt, Human
cugucuuuaguacaaaaaaugu

SEQ ID NO: 225527 - RNA, 22 nt, Human
ugggagcagcuuugcgagggag

SEQ ID NO: 225528 - RNA, 22 nt, Human
caggagccagcugucccaacca

SEQ ID NO: 225529 - RNA, 22 nt, Human
auccaaaauuuacuguagcauu

SEQ ID NO: 225530 - RNA, 20 nt, Human
cagcccugugaccuggcccu

SEQ ID NO: 225531 - RNA, 21 nt, Human
acaguagcugacacacaguuu

SEQ ID NO: 225532 - RNA, 22 nt, Human
uaagcccacauuuuucugaaga

SEQ ID NO: 225533 - RNA, 22 nt, Human
acagcugugacuuagagaaguu

SEQ ID NO: 225534 - RNA, 20 nt, Human
uacugggucuggguccugga

SEQ ID NO: 225535 - RNA, 22 nt, Human
ugcaggaaucagaggggaagcg

SEQ ID NO: 225536 - RNA, 22 nt, Human
guguuacuuaccugggacagca

SEQ ID NO: 225537 - RNA, 22 nt, Human
uagaagaaagugaagcugggga

SEQ ID NO: 225538 - RNA, 22 nt, Human
aggacacagcugcucugcagag

SEQ ID NO: 225539 - RNA, 22 nt, Human
guucagagacacuuauuggaaa

SEQ ID NO: 225540 - RNA, 22 nt, Human
gauuacauucuccuuguauuag

SEQ ID NO: 225541 - RNA, 22 nt, Human
ggcaggcugcuugggucauguc

SEQ ID NO: 225542 - RNA, 22 nt, Human
cagacaggcaggugcugcuuug

SEQ ID NO: 225543 - RNA, 22 nt, Human
gggcuccaaggaggccagccug

SEQ ID NO: 225544 - RNA, 22 nt, Human
cagguucuauacugaauaauuu

SEQ ID NO: 225545 - RNA, 22 nt, Human
gggcacagccuaacuauggaga

SEQ ID NO: 225546 - RNA, 22 nt, Human
aggaaugugaaacagguggcug

SEQ ID NO: 225547 - RNA, 22 nt, Human
ccugagacaugaaccaggcucc

SEQ ID NO: 225548 - RNA, 22 nt, Human
cgaugcuggaaugacagcugcu

SEQ ID NO: 225549 - RNA, 22 nt, Human
ucagcauuucagaaguggcaua

SEQ ID NO: 225550 - RNA, 18 nt, Human
auccaaaaagauggaagu

SEQ ID NO: 225551 - RNA, 22 nt, Human
uuaggaacuucugucucagugu

SEQ ID NO: 225552 - RNA, 22 nt, Human
cccuaggcugaggccagggugc

SEQ ID NO: 225553 - RNA, 22 nt, Human
uguguccuacugaggagcuccu

SEQ ID NO: 225554 - RNA, 22 nt, Human
ugaaggagggaagaaggcucug

SEQ ID NO: 225555 - RNA, 22 nt, Human
cccaggcacacugaagugacau

SEQ ID NO: 225556 - RNA, 22 nt, Human
ggcuugggagcaggcaugugac

SEQ ID NO: 225557 - RNA, 21 nt, Human
uggccaaacuggagcauuuga

SEQ ID NO: 225558 - RNA, 22 nt, Human
gagacacacccaagguuaugag

SEQ ID NO: 225559 - RNA, 22 nt, Human
gccuggcuucccuuggagcauu

SEQ ID NO: 225560 - RNA, 19 nt, Human
ucagaggauuuggcuauga

SEQ ID NO: 225561 - RNA, 22 nt, Human
agcccuggcccggcugugcuuu

SEQ ID NO: 225562 - RNA, 22 nt, Human
cugcccuggaaaacguaucuua

SEQ ID NO: 225563 - RNA, 22 nt, Human
agacccuggggaaagucacuuc

SEQ ID NO: 225564 - RNA, 22 nt, Human
uagccagugaauguuuccagug

SEQ ID NO: 225565 - RNA, 22 nt, Human
acaaggcuuauaguugcuuuuu

SEQ ID NO: 225566 - RNA, 22 nt, Human
agggacuugaugucagggagau

SEQ ID NO: 225567 - RNA, 22 nt, Human
cccaggaguaagugacauuguu

SEQ ID NO: 225568 - RNA, 22 nt, Human
gaccauuagcugcuauucagua

SEQ ID NO: 225569 - RNA, 22 nt, Human
cagcuuuggcccagucgggagg

SEQ ID NO: 225570 - RNA, 22 nt, Human
cuucaucuuucugagccucagu

SEQ ID NO: 225571 - RNA, 22 nt, Human
ugcagggaugcuagagguaaga

SEQ ID NO: 225572 - RNA, 22 nt, Human
aauaagacucugcuagaaauuc

SEQ ID NO: 225573 - RNA, 22 nt, Human
agcagguggucuguugcugcug

SEQ ID NO: 225574 - RNA, 22 nt, Human
aaagaucacgucccaggacucg

SEQ ID NO: 225575 - RNA, 22 nt, Human
agcaacagcccugagguucaug

SEQ ID NO: 225576 - RNA, 22 nt, Human
cauagacauucagcacucacua

SEQ ID NO: 225577 - RNA, 22 nt, Human
cccagccuacucugccauagca

SEQ ID NO: 225578 - RNA, 22 nt, Human
gcccucagaugggaaaggaggg

SEQ ID NO: 225579 - RNA, 22 nt, Human
caugaacauugcagggauguga

SEQ ID NO: 225580 - RNA, 22 nt, Human
guuuuucugugagcgguaaagg

SEQ ID NO: 225581 - RNA, 22 nt, Human
gggcagguguuuccaaggugag

SEQ ID NO: 225582 - RNA, 22 nt, Human
ggaugagguagaugaacaaggg

SEQ ID NO: 225583 - RNA, 22 nt, Human
ugcacaagucagaguaacauuu

SEQ ID NO: 225584 - RNA, 22 nt, Human
ucuggggagggagccacagguc

SEQ ID NO: 225585 - RNA, 22 nt, Human
gagugaugucuguagugaagaa

SEQ ID NO: 225586 - RNA, 22 nt, Human
accugcagcugagaaaaugacu

SEQ ID NO: 225587 - RNA, 22 nt, Human
agcagggcuguguagguaauga

SEQ ID NO: 225588 - RNA, 22 nt, Human
ccugggcuguaccugugcgcgg

SEQ ID NO: 225589 - RNA, 22 nt, Human
gucugggauugggguaaagaag

SEQ ID NO: 225590 - RNA, 22 nt, Human
ugaggugguucaagagccuugu

SEQ ID NO: 225591 - RNA, 22 nt, Human
gcaucuaaacuugcaucauugu

SEQ ID NO: 225592 - RNA, 22 nt, Human
acauucaaguuucugcucaugg

SEQ ID NO: 225593 - RNA, 22 nt, Human
gcucccaggcauggagguaauu

SEQ ID NO: 225594 - RNA, 22 nt, Human
ccugggucuucagucugcuggu

SEQ ID NO: 225595 - RNA, 22 nt, Human
ugagcagacuugaugaggcagc

SEQ ID NO: 225596 - RNA, 22 nt, Human
aaacugaguaccucugcauuca

SEQ ID NO: 225597 - RNA, 21 nt, Human
ugauuucugccaaguucacua

SEQ ID NO: 225598 - RNA, 22 nt, Human
ucagagaggauuuuaauaagug

SEQ ID NO: 225599 - RNA, 22 nt, Human
agucuuagagucugugucauga

SEQ ID NO: 225600 - RNA, 22 nt, Human
guagacaucuagauuuaugugu

SEQ ID NO: 225601 - RNA, 22 nt, Human
uccuuagagugguugugcuaug

SEQ ID NO: 225602 - RNA, 22 nt, Human
gucaguuacagccacggcgggu

SEQ ID NO: 225603 - RNA, 22 nt, Human
gagagaagaacaaugucauuca

SEQ ID NO: 225604 - RNA, 22 nt, Human
agcuggguguucuugggccuaa

SEQ ID NO: 225605 - RNA, 20 nt, Human
agucacaggccuggaacaug

SEQ ID NO: 225606 - RNA, 22 nt, Human
caggaauguuugugcuccuuua

SEQ ID NO: 225607 - RNA, 22 nt, Human
uaaggcuuuuguucagcguggg

SEQ ID NO: 225608 - RNA, 22 nt, Human
ccaagggaaaccgagaggcugg

SEQ ID NO: 225609 - RNA, 22 nt, Human
agaaauguauucuguauguuuu

SEQ ID NO: 225610 - RNA, 22 nt, Human
gagucuuuguauuuacuuccca

SEQ ID NO: 225611 - RNA, 22 nt, Human
acuaaaugagauacugucuuca

SEQ ID NO: 225612 - RNA, 22 nt, Human
aguuucagaauuuaugcagaca

SEQ ID NO: 225613 - RNA, 22 nt, Human
gucuggagccugggucccugcu

SEQ ID NO: 225614 - RNA, 22 nt, Human
uuccaggcaugucagacauagg

SEQ ID NO: 225615 - RNA, 22 nt, Human
ccagccagccuugaucugagua

SEQ ID NO: 225616 - RNA, 22 nt, Human
gagucuaaguagaaugugaaaa

SEQ ID NO: 225617 - RNA, 22 nt, Human
accagggccgcgggcgacuagc

SEQ ID NO: 225618 - RNA, 23 nt, Human
guuaauaaugaacacuuucuccc

SEQ ID NO: 225619 - RNA, 22 nt, Human
uccauacauacagauaugcauu

SEQ ID NO: 225620 - RNA, 22 nt, Human
uacuuaaaacugauagaaucuc

SEQ ID NO: 225621 - RNA, 22 nt, Human
aagugucuagcaccuggaugca

SEQ ID NO: 225622 - RNA, 22 nt, Human
ugggccaccugcucuguuucua

SEQ ID NO: 225623 - RNA, 22 nt, Human
ugcagugccucggcagugcagc

SEQ ID NO: 225624 - RNA, 22 nt, Human
agugcauugcaucucugcuuca

SEQ ID NO: 225625 - RNA, 22 nt, Human
gaagccaguguuugaagaauuu

SEQ ID NO: 225626 - RNA, 22 nt, Human
gaacacaacucagaaugcuggu

SEQ ID NO: 225627 - RNA, 22 nt, Human
caaggaggaagaugcaggggac

SEQ ID NO: 225628 - RNA, 22 nt, Human
ugguucagauauggagcuggga

SEQ ID NO: 225629 - RNA, 22 nt, Human
acagcuggugaauguucucugu

SEQ ID NO: 225630 - RNA, 22 nt, Human
gggcuucuugcaggggcaacau

SEQ ID NO: 225631 - RNA, 22 nt, Human
uucuaacucuguuauguguuuc

SEQ ID NO: 225632 - RNA, 22 nt, Human
uauauaugggggaagcuggaug

SEQ ID NO: 225633 - RNA, 22 nt, Human
aggaggaaagaaggcccccagc

SEQ ID NO: 225634 - RNA, 22 nt, Human
caggaugggauguagugggccc

SEQ ID NO: 225635 - RNA, 22 nt, Human
uuccaguucuggcuuugccacu

SEQ ID NO: 225636 - RNA, 22 nt, Human
augacauaagugaaaaacauca

SEQ ID NO: 225637 - RNA, 22 nt, Human
uacuuuuagccuauuugauucu

SEQ ID NO: 225638 - RNA, 22 nt, Human
gccuucccacccugcgaggcug

SEQ ID NO: 225639 - RNA, 22 nt, Human
ccacucugauuuuggcuccacu

SEQ ID NO: 225640 - RNA, 22 nt, Human
auauuguugacuauaagaguaa

SEQ ID NO: 225641 - RNA, 22 nt, Human
cacaucuauggagacagagagu

SEQ ID NO: 225642 - RNA, 20 nt, Human
ggccacagggugcuggugga

SEQ ID NO: 225643 - RNA, 22 nt, Human
cacugcaggucugagauggggg

SEQ ID NO: 225644 - RNA, 22 nt, Human
ugucuuuuuacuauguucaauc

SEQ ID NO: 225645 - RNA, 22 nt, Human
auacuacacauugacuauauuu

SEQ ID NO: 225646 - RNA, 22 nt, Human
aaacaggcuugcaacauguuuu

SEQ ID NO: 225647 - RNA, 22 nt, Human
agucuuugguuauaagagacag

SEQ ID NO: 225648 - RNA, 22 nt, Human
agaugcugauugaauagauuuc

SEQ ID NO: 225649 - RNA, 22 nt, Human
uauauccauaggcugugccuag

SEQ ID NO: 225650 - RNA, 22 nt, Human
cgccggcuugaggcaggcggca

SEQ ID NO: 225651 - RNA, 22 nt, Human
ccagggugcucuguggcgucgc

SEQ ID NO: 225652 - RNA, 22 nt, Human
agaauuacagcuuuuagaauag

SEQ ID NO: 225653 - RNA, 22 nt, Human
caggccagggagaauaugaagc

SEQ ID NO: 225654 - RNA, 22 nt, Human
cauuccuuaacguggggagucu

SEQ ID NO: 225655 - RNA, 22 nt, Human
uuagaggacuguaggugggaau

SEQ ID NO: 225656 - RNA, 22 nt, Human
cuuggcagagggcugggcucag

SEQ ID NO: 225657 - RNA, 22 nt, Human
ugggccagggcacccaguccag

SEQ ID NO: 225658 - RNA, 22 nt, Human
ucuagaaaguuuguacugauuu

SEQ ID NO: 225659 - RNA, 22 nt, Human
guuagggaagcgcuguguucuu

SEQ ID NO: 225660 - RNA, 22 nt, Human
uggcugaggagagggcggaagu

SEQ ID NO: 225661 - RNA, 22 nt, Human
ggagggaagugaguucucagcu

SEQ ID NO: 225662 - RNA, 22 nt, Human
cagugucaggaucaguauauuu

SEQ ID NO: 225663 - RNA, 22 nt, Human
uuucuuuguuguuaucacauca

SEQ ID NO: 225664 - RNA, 22 nt, Human
gggcuucuggucauuccucauc

SEQ ID NO: 225665 - RNA, 22 nt, Human
cauagaauguaauaaagaguag

SEQ ID NO: 225666 - RNA, 22 nt, Human
aaauucaauuaacuuucaugcu

SEQ ID NO: 225667 - RNA, 22 nt, Human
cauagaaugcagcaggaaaguu

SEQ ID NO: 225668 - RNA, 22 nt, Human
ugcucuggcugggaugagugca

SEQ ID NO: 225669 - RNA, 22 nt, Human
ucaagaauuuggauaagaaaug

SEQ ID NO: 225670 - RNA, 22 nt, Human
uugguaaauacucuuuggagac

SEQ ID NO: 225671 - RNA, 22 nt, Human
gcuuuagagaagaaagguugcu

SEQ ID NO: 225672 - RNA, 22 nt, Human
ucaccaggcaacuauguacucc

SEQ ID NO: 225673 - RNA, 22 nt, Human
agcagggcugugcuccuuccga

SEQ ID NO: 225674 - RNA, 22 nt, Human
aaacacuguacaaucugcaggg

SEQ ID NO: 225675 - RNA, 19 nt, Human
ucuggcagguaauuaggga

SEQ ID NO: 225676 - RNA, 22 nt, Human
gugcaauauugccauguucuug

SEQ ID NO: 225677 - RNA, 22 nt, Human
guugugcaaccaucaccaccau

SEQ ID NO: 225678 - RNA, 22 nt, Human
uaccuagaccaguuacaaugca

SEQ ID NO: 225679 - RNA, 22 nt, Human
aaccagcuuugauacgcauuau

SEQ ID NO: 225680 - RNA, 22 nt, Human
caggcggccaugaucuggcagg

SEQ ID NO: 225681 - RNA, 22 nt, Human
cagcuccagccgacuguaagaa

SEQ ID NO: 225682 - RNA, 22 nt, Human
uaucuauuauguucuauguguc

SEQ ID NO: 225683 - RNA, 22 nt, Human
uugcugauucuguauuuaaggu

SEQ ID NO: 225684 - RNA, 22 nt, Human
ccacagaagauggggagagugg

SEQ ID NO: 225685 - RNA, 21 nt, Human
ugcagagauaucugaagcaga

SEQ ID NO: 225686 - RNA, 22 nt, Human
aagcacaucuccugugcagaac

SEQ ID NO: 225687 - RNA, 22 nt, Human
cuugucuugcacacgguugcca

SEQ ID NO: 225688 - RNA, 23 nt, Human
gcacaagaccuggcagcuuccau

SEQ ID NO: 225689 - RNA, 22 nt, Human
aggcaggugggucacuugaguc

SEQ ID NO: 225690 - RNA, 22 nt, Human
aaaguaguccuuggagcgaaau

SEQ ID NO: 225691 - RNA, 22 nt, Human
auuggucuggggaaaugaagag

SEQ ID NO: 225692 - RNA, 21 nt, Human
uagggcucucugugucaggug

SEQ ID NO: 225693 - RNA, 22 nt, Human
aagaaauggcuucaucugagua

SEQ ID NO: 225694 - RNA, 22 nt, Human
ggaggcacuucaugcugacccg

SEQ ID NO: 225695 - RNA, 22 nt, Human
acugaugaagaguaccacuguu

SEQ ID NO: 225696 - RNA, 22 nt, Human
auucauuugcuauuguguaugg

SEQ ID NO: 225697 - RNA, 22 nt, Human
aagcaauaggguaaucuacuca

SEQ ID NO: 225698 - RNA, 22 nt, Human
uccuguagcugucacugggggc

SEQ ID NO: 225699 - RNA, 22 nt, Human
cacagcuagauggauagauaga

SEQ ID NO: 225700 - RNA, 22 nt, Human
acagaaauucugggacagaaaa

SEQ ID NO: 225701 - RNA, 22 nt, Human
gagccuccuccuggugugccga

SEQ ID NO: 225702 - RNA, 22 nt, Human
ucuccugugcacccucccugug

SEQ ID NO: 225703 - RNA, 22 nt, Human
agcuacagcuguacucugcagg

SEQ ID NO: 225704 - RNA, 22 nt, Human
ccaggccuggaccaugccaggg

SEQ ID NO: 225705 - RNA, 22 nt, Human
aaggguccagcaccucggcucc

SEQ ID NO: 225706 - RNA, 22 nt, Human
uaaaugaagcucaugggccaca

SEQ ID NO: 225707 - RNA, 22 nt, Human
aggugcagcugguggagucugg

SEQ ID NO: 225708 - RNA, 22 nt, Human
acagugcagugugaugaguauu

SEQ ID NO: 225709 - RNA, 22 nt, Human
uagugaaaugauaacagagcag

SEQ ID NO: 225710 - RNA, 22 nt, Human
cucuggaaaauugugugggggu

SEQ ID NO: 225711 - RNA, 22 nt, Human
agaacucugaacacugucugga

SEQ ID NO: 225712 - RNA, 20 nt, Human
cagagauuuuacuuccucac

SEQ ID NO: 225713 - RNA, 22 nt, Human
acaugcaauauugagacuuucu

SEQ ID NO: 225714 - RNA, 21 nt, Human
uucauugaacuauuuguggag

SEQ ID NO: 225715 - RNA, 22 nt, Human
gacuaggcucucauagagguag

SEQ ID NO: 225716 - RNA, 22 nt, Human
agcccagcuccuccacagaaua

SEQ ID NO: 225717 - RNA, 22 nt, Human
gccaaaguccacuugcuuucug

SEQ ID NO: 225718 - RNA, 22 nt, Human
gcaggucuugaaggugugauuu

SEQ ID NO: 225719 - RNA, 22 nt, Human
uuccaggauagcuuucaggaau

SEQ ID NO: 225720 - RNA, 22 nt, Human
gagcaguugggcucuaggaagu

SEQ ID NO: 225721 - RNA, 22 nt, Human
aacagaacccgagugugaaucu

SEQ ID NO: 225722 - RNA, 22 nt, Human
gggguggccuguaggcagcaug

SEQ ID NO: 225723 - RNA, 22 nt, Human
ugcuugucccucuuuaugaugg

SEQ ID NO: 225724 - RNA, 23 nt, Human
cauuagaagguagaguggaauga

SEQ ID NO: 225725 - RNA, 22 nt, Human
aauuucagaccauuugcaauua

SEQ ID NO: 225726 - RNA, 22 nt, Human
cagcccugggaguuggggccga

SEQ ID NO: 225727 - RNA, 22 nt, Human
uagggcuuagaaaagaauuuac

SEQ ID NO: 225728 - RNA, 22 nt, Human
gcugaaggucucuggagagguc

SEQ ID NO: 225729 - RNA, 22 nt, Human
gggcuucuaagugaaaguguaa

SEQ ID NO: 225730 - RNA, 22 nt, Human
cguguaaccccugaacucgcau

SEQ ID NO: 225731 - RNA, 17 nt, Human
uucaaagcuuaucaagg

SEQ ID NO: 225732 - RNA, 16 nt, Human
uuauugaggccaagga

SEQ ID NO: 225733 - RNA, 22 nt, Human
agagccaggugcugcuguuuga

SEQ ID NO: 225734 - RNA, 22 nt, Human
ugggggaagagcuuguuaaagu

SEQ ID NO: 225735 - RNA, 22 nt, Human
ucagaauaugcuaaugacauuu

SEQ ID NO: 225736 - RNA, 22 nt, Human
gcugcugugccuggcguccugu

SEQ ID NO: 225737 - RNA, 22 nt, Human
ugcaggguagacaggugagguc

SEQ ID NO: 225738 - RNA, 22 nt, Human
auagcuguagaauguauacaca

SEQ ID NO: 225739 - RNA, 22 nt, Human
uucucugggaacauaaaugaag

SEQ ID NO: 225740 - RNA, 22 nt, Human
cacagggcagagaccugggugc

SEQ ID NO: 225741 - RNA, 22 nt, Human
aaaugcacagguuuuaaauccu

SEQ ID NO: 225742 - RNA, 22 nt, Human
uuauuuagucuagaugaauuuu

SEQ ID NO: 225743 - RNA, 22 nt, Human
aacuccuaugacccacugaacu

SEQ ID NO: 225744 - RNA, 18 nt, Human
uuggaggauguccaugaa

SEQ ID NO: 225745 - RNA, 22 nt, Human
guaauuaggaauaaaaugggaa

SEQ ID NO: 225746 - RNA, 22 nt, Human
ugggccagaggcauggagcuau

SEQ ID NO: 225747 - RNA, 22 nt, Human
aaggugucggguuagcucagcc

SEQ ID NO: 225748 - RNA, 22 nt, Human
cuggguuuagggucuccccuug

SEQ ID NO: 225749 - RNA, 22 nt, Human
ugcucagccgugagcagagccg

SEQ ID NO: 225750 - RNA, 22 nt, Human
auugucuuaaacaaauguguuu

SEQ ID NO: 225751 - RNA, 22 nt, Human
uccagggcaggugcugggcucu

SEQ ID NO: 225752 - RNA, 22 nt, Human
ucugccuguugcuagaauguca

SEQ ID NO: 225753 - RNA, 20 nt, Human
ccucaaauaagugccagcau

SEQ ID NO: 225754 - RNA, 22 nt, Human
aggaauguuuacacgacagaaa

SEQ ID NO: 225755 - RNA, 22 nt, Human
ucucagugcuauccauauucca

SEQ ID NO: 225756 - RNA, 22 nt, Human
uucaacaagucuuuuuucacug

SEQ ID NO: 225757 - RNA, 22 nt, Human
gaggacaccucacagccucaca

SEQ ID NO: 225758 - RNA, 22 nt, Human
gcuaggaggaagaaugugaauu

SEQ ID NO: 225759 - RNA, 22 nt, Human
guccugugccgaggugggaagc

SEQ ID NO: 225760 - RNA, 22 nt, Human
uagaacaugggauagaguuuuu

SEQ ID NO: 225761 - RNA, 22 nt, Human
ggaagccacccagcuuugauag

SEQ ID NO: 225762 - RNA, 22 nt, Human
guuaauacaaccaugaucuucu

SEQ ID NO: 225763 - RNA, 22 nt, Human
ccuuagaggcaggaagaauugc

SEQ ID NO: 225764 - RNA, 22 nt, Human
ugucuuuucuacuguaagcaua

SEQ ID NO: 225765 - RNA, 22 nt, Human
acauuuuuuagagucccacauu

SEQ ID NO: 225766 - RNA, 22 nt, Human
ucuuuggcauuuaggagcagga

SEQ ID NO: 225767 - RNA, 22 nt, Human
ucuggcucccagccugcucuca

SEQ ID NO: 225768 - RNA, 22 nt, Human
uaucuguagucagaauaauuuu

SEQ ID NO: 225769 - RNA, 22 nt, Human
uuacagagaggugauugugaag

SEQ ID NO: 225770 - RNA, 22 nt, Human
gcagcugccccgacugugaguc

SEQ ID NO: 225771 - RNA, 22 nt, Human
aaaguacuuugggcuauguuug

SEQ ID NO: 225772 - RNA, 17 nt, Human
ugcuccuguggcagccu

SEQ ID NO: 225773 - RNA, 22 nt, Human
aaaguuuucugccuucauuaga

SEQ ID NO: 225774 - RNA, 22 nt, Human
uuuccauauucugcgucugcca

SEQ ID NO: 225775 - RNA, 22 nt, Human
gacuuccuaagauucaggaaug

SEQ ID NO: 225776 - RNA, 22 nt, Human
acacagaguuugacacauggga

SEQ ID NO: 225777 - RNA, 22 nt, Human
cagcagaaguccgacuccaguc

SEQ ID NO: 225778 - RNA, 22 nt, Human
uuaauacauuucagacuguuau

SEQ ID NO: 225779 - RNA, 22 nt, Human
ucuauuuaccaaauguaguucc

SEQ ID NO: 225780 - RNA, 21 nt, Human
ugcaauauauauuugccugaa

SEQ ID NO: 225781 - RNA, 22 nt, Human
cccaggcagugugugcaugcgu

SEQ ID NO: 225782 - RNA, 22 nt, Human
gggcagggguagcauuccaagu

SEQ ID NO: 225783 - RNA, 22 nt, Human
agccagagaguguuggagaugu

SEQ ID NO: 225784 - RNA, 22 nt, Human
ucuggcagaucuucccacguuu

SEQ ID NO: 225785 - RNA, 22 nt, Human
ucugugcaauaguuuguuuuac

SEQ ID NO: 225786 - RNA, 22 nt, Human
gccagcagguggagagaucaag

SEQ ID NO: 225787 - RNA, 22 nt, Human
caggcugauuaggccucgucca

SEQ ID NO: 225788 - RNA, 22 nt, Human
aaaccugauagauuuucagaau

SEQ ID NO: 225789 - RNA, 22 nt, Human
ggagacaguauggcuuguagcu

SEQ ID NO: 225790 - RNA, 22 nt, Human
ucuagaaacaugacauugaucu

SEQ ID NO: 225791 - RNA, 22 nt, Human
gccagggaaacugcagaccagc

SEQ ID NO: 225792 - RNA, 22 nt, Human
aggccucugagcagcacucaug

SEQ ID NO: 225793 - RNA, 23 nt, Human
uuguuuaccguaggacuuuuaac

SEQ ID NO: 225794 - RNA, 22 nt, Human
cagcaugguggagcugcucuuu

SEQ ID NO: 225795 - RNA, 22 nt, Human
gucuucuggggccaggcccgcu

SEQ ID NO: 225796 - RNA, 22 nt, Human
cucacuguuuaauagcuggauc

SEQ ID NO: 225797 - RNA, 20 nt, Human
caaauucuguugaauacacc

SEQ ID NO: 225798 - RNA, 22 nt, Human
aaaaauacuucacuucugggug

SEQ ID NO: 225799 - RNA, 22 nt, Human
cuuguuuaauaauaccuuagca

SEQ ID NO: 225800 - RNA, 22 nt, Human
ucuuuuaaaagcccugcugucu

SEQ ID NO: 225801 - RNA, 22 nt, Human
accaggagccauagagucaggc

SEQ ID NO: 225802 - RNA, 22 nt, Human
ucuuaaaaguaugccaauugga

SEQ ID NO: 225803 - RNA, 22 nt, Human
uaggaaauauuugaacauagga

SEQ ID NO: 225804 - RNA, 20 nt, Human
auguuaaauagcauuuagag

SEQ ID NO: 225805 - RNA, 22 nt, Human
agcccugcauaaaucaguuggu

SEQ ID NO: 225806 - RNA, 22 nt, Human
cacauuuaagugcuuguucaga

SEQ ID NO: 225807 - RNA, 20 nt, Human
uugcaaauaucuauugauug

SEQ ID NO: 225808 - RNA, 22 nt, Human
agccacagucugaugccugaga

SEQ ID NO: 225809 - RNA, 22 nt, Human
uacaaaggagauaaauuggagg

SEQ ID NO: 225810 - RNA, 22 nt, Human
ccagccagggaaacuuuuucuu

SEQ ID NO: 225811 - RNA, 22 nt, Human
ccaggcuagagugcaguggcau

SEQ ID NO: 225812 - RNA, 20 nt, Human
ccuuuauuauuuguaugaug

SEQ ID NO: 225813 - RNA, 22 nt, Human
uccagcuuuuaccaaaugagca

SEQ ID NO: 225814 - RNA, 22 nt, Human
cuagagaaaaagcuuagguacg

SEQ ID NO: 225815 - RNA, 22 nt, Human
gaguuacacagaagucaguuug

SEQ ID NO: 225816 - RNA, 22 nt, Human
ucaggcuuuuccugccuccuac

SEQ ID NO: 225817 - RNA, 22 nt, Human
uuggcugccuucaccccuggcc

SEQ ID NO: 225818 - RNA, 22 nt, Human
ccugggcauaaaucacuccaag

SEQ ID NO: 225819 - RNA, 22 nt, Human
ucucagagagaugaaacuucca

SEQ ID NO: 225820 - RNA, 21 nt, Human
aagcuacagaaaauaauuuga

SEQ ID NO: 225821 - RNA, 23 nt, Human
ucaggcagcugggguaguuggag

SEQ ID NO: 225822 - RNA, 20 nt, Human
gcagccguggagacuaggag

SEQ ID NO: 225823 - RNA, 22 nt, Human
ccuggcugaacaaagucccucc

SEQ ID NO: 225824 - RNA, 22 nt, Human
agcucagggcgaucugucucgg

SEQ ID NO: 225825 - RNA, 22 nt, Human
agucuggucaucugauucuuuu

SEQ ID NO: 225826 - RNA, 22 nt, Human
gcagcagggugccagcuuugca

SEQ ID NO: 225827 - RNA, 22 nt, Human
acaggcagugggccagauuugu

SEQ ID NO: 225828 - RNA, 22 nt, Human
uccucccacauaggacaauggg

SEQ ID NO: 225829 - RNA, 22 nt, Human
gcugcccaggcaacauugacuu

SEQ ID NO: 225830 - RNA, 19 nt, Human
ugcugaggaugcaagaucc

SEQ ID NO: 225831 - RNA, 22 nt, Human
uuggguuuucccuugaaacuga

SEQ ID NO: 225832 - RNA, 22 nt, Human
uugagucugugcccuaugcugu

SEQ ID NO: 225833 - RNA, 22 nt, Human
caucuuuguuucaucuguccag

SEQ ID NO: 225834 - RNA, 22 nt, Human
cuggcuucccugucuuauggaa

SEQ ID NO: 225835 - RNA, 22 nt, Human
ugauaacucucaguuucucaug

SEQ ID NO: 225836 - RNA, 22 nt, Human
gcagcagcggggccccugcgcg

SEQ ID NO: 225837 - RNA, 22 nt, Human
gaugccuguggugagcacacau

SEQ ID NO: 225838 - RNA, 22 nt, Human
uaguaaacccaugaggcuuaaa

SEQ ID NO: 225839 - RNA, 22 nt, Human
caggacaguuggcaucugcugc

SEQ ID NO: 225840 - RNA, 22 nt, Human
uuacaaagugcugcaccauuuu

SEQ ID NO: 225841 - RNA, 22 nt, Human
agugauugcuugcuuaaggaca

SEQ ID NO: 225842 - RNA, 22 nt, Human
aagagcuggauggaaucuggga

SEQ ID NO: 225843 - RNA, 22 nt, Human
ggccagcucaggguccuugggc

SEQ ID NO: 225844 - RNA, 22 nt, Human
auucugggaguguaggaugguu

SEQ ID NO: 225845 - RNA, 22 nt, Human
gcucagggaaagagcuccuguc

SEQ ID NO: 225846 - RNA, 22 nt, Human
ucuguucaagacugaggugaca

SEQ ID NO: 225847 - RNA, 22 nt, Human
agugcuccacauugcacuauuc

SEQ ID NO: 225848 - RNA, 22 nt, Human
ugugggaaucagccaggggggc

SEQ ID NO: 225849 - RNA, 22 nt, Human
cuacaucucaccuuccaggaca

SEQ ID NO: 225850 - RNA, 22 nt, Human
aagaagcauggcuguagauucc

SEQ ID NO: 225851 - RNA, 20 nt, Human
cagcagccaaacuucuauuc

SEQ ID NO: 225852 - RNA, 22 nt, Human
aagggaaaauaguugaugacca

SEQ ID NO: 225853 - RNA, 22 nt, Human
cucuaggccauccagggccauu

SEQ ID NO: 225854 - RNA, 22 nt, Human
cagaaagugauuugcuauucca

SEQ ID NO: 225855 - RNA, 23 nt, Human
guccagaacccaggcuggggugg

SEQ ID NO: 225856 - RNA, 22 nt, Human
ugguaaaaacugcaauuacuuu

SEQ ID NO: 225857 - RNA, 22 nt, Human
gcccgugugcagagugggagcu

SEQ ID NO: 225858 - RNA, 22 nt, Human
gcagcagaugcuuucauggaca

SEQ ID NO: 225859 - RNA, 22 nt, Human
uuucacagcuuccacuuaagga

SEQ ID NO: 225860 - RNA, 22 nt, Human
gccccaggggaggugcccugca

SEQ ID NO: 225861 - RNA, 22 nt, Human
cugcuggggucagagcacuggg

SEQ ID NO: 225862 - RNA, 22 nt, Human
gauggcuuguuuucuggcugaa

SEQ ID NO: 225863 - RNA, 22 nt, Human
gcuuucugaugagcuuaagaaa

SEQ ID NO: 225864 - RNA, 22 nt, Human
uuugcuuaaaguucuuucuggu

SEQ ID NO: 225865 - RNA, 22 nt, Human
agucugguguucucacacuagu

SEQ ID NO: 225866 - RNA, 22 nt, Human
agggagcucugggggcacacgg

SEQ ID NO: 225867 - RNA, 22 nt, Human
acauguaaaaauuaagguaaga

SEQ ID NO: 225868 - RNA, 23 nt, Human
agugccagggagaucaggacgga

SEQ ID NO: 225869 - RNA, 22 nt, Human
cacaggugucucuaguagcguu

SEQ ID NO: 225870 - RNA, 22 nt, Human
ggagaccagaaggaagcuucga

SEQ ID NO: 225871 - RNA, 22 nt, Human
cuggguggagccuggucaucug

SEQ ID NO: 225872 - RNA, 22 nt, Human
ggagaaaggauaggaaugugcu

SEQ ID NO: 225873 - RNA, 22 nt, Human
cuggcaguauuaagagaaguga

SEQ ID NO: 225874 - RNA, 23 nt, Human
ugagaagccgccgggcagccugg

SEQ ID NO: 225875 - RNA, 22 nt, Human
aaugacaugcuuuuuaauuaua

SEQ ID NO: 225876 - RNA, 22 nt, Human
ugcauuccauguguuuccugag

SEQ ID NO: 225877 - RNA, 22 nt, Human
uccccagacagcgggaggccug

SEQ ID NO: 225878 - RNA, 22 nt, Human
cucaaggacuuauucaugccug

SEQ ID NO: 225879 - RNA, 22 nt, Human
uucuagaauccuugucuacuuu

SEQ ID NO: 225880 - RNA, 22 nt, Human
uccagccauucauuaugacacc

SEQ ID NO: 225881 - RNA, 22 nt, Human
aggaagaaaccuacuagaguuu

SEQ ID NO: 225882 - RNA, 22 nt, Human
agaggggguguuccagaagcau

SEQ ID NO: 225883 - RNA, 22 nt, Human
aggaagagcuggaccagaggac

SEQ ID NO: 225884 - RNA, 22 nt, Human
cuauuucagcagaagccggaga

SEQ ID NO: 225885 - RNA, 22 nt, Human
gacaugugcugucucuuaaauu

SEQ ID NO: 225886 - RNA, 22 nt, Human
uggaguucauccaugacagcuu

SEQ ID NO: 225887 - RNA, 23 nt, Human
acaucaugauagccaacuuggga

SEQ ID NO: 225888 - RNA, 22 nt, Human
auagacauagccguaauuuauu

SEQ ID NO: 225889 - RNA, 22 nt, Human
ugaucaaagugcuggaauuaca

SEQ ID NO: 225890 - RNA, 22 nt, Human
ugccuggguguaaagggccaac

SEQ ID NO: 225891 - RNA, 22 nt, Human
ucuucuguuaccacagcgauga

SEQ ID NO: 225892 - RNA, 22 nt, Human
uucugucacagugcugguauca

SEQ ID NO: 225893 - RNA, 22 nt, Human
guucuucaucauuuuagauagg

SEQ ID NO: 225894 - RNA, 22 nt, Human
ugaaaucauugggguugaauaa

SEQ ID NO: 225895 - RNA, 22 nt, Human
ugguccagugacagauaggcac

SEQ ID NO: 225896 - RNA, 22 nt, Human
aagcaucuuagaccugaguucc

SEQ ID NO: 225897 - RNA, 22 nt, Human
auuuuaauaagauccauuuggu

SEQ ID NO: 225898 - RNA, 22 nt, Human
acaguggcaucuacuuaaucug

SEQ ID NO: 225899 - RNA, 22 nt, Human
gcucuguguuuugcccaggaga

SEQ ID NO: 225900 - RNA, 22 nt, Human
uauugguaugguaagaauugaa

SEQ ID NO: 225901 - RNA, 22 nt, Human
ggcagcaucacuugucuccagc

SEQ ID NO: 225902 - RNA, 22 nt, Human
uuugggaauaauugcacagauu

SEQ ID NO: 225903 - RNA, 22 nt, Human
ucugaaaugaccuuuccccacu

SEQ ID NO: 225904 - RNA, 22 nt, Human
cugcagggcuguggucuggagu

SEQ ID NO: 225905 - RNA, 22 nt, Human
uccuuucuccagcuggcauugu

SEQ ID NO: 225906 - RNA, 22 nt, Human
gacuuucuuuuaccucaaggau

SEQ ID NO: 225907 - RNA, 21 nt, Human
agaaaaaccagcauguuuuca

SEQ ID NO: 225908 - RNA, 22 nt, Human
agaauccugaugaaaaggagag

SEQ ID NO: 225909 - RNA, 22 nt, Human
caagcagguuugcuauuuucuu

SEQ ID NO: 225910 - RNA, 22 nt, Human
ugcaaauaggggacaacucuuu

SEQ ID NO: 225911 - RNA, 22 nt, Human
uagugugguaaauaaauguuuu

SEQ ID NO: 225912 - RNA, 22 nt, Human
aauguauucucuuuauaagaua

SEQ ID NO: 225913 - RNA, 22 nt, Human
aggccaggggugagcacuucug

SEQ ID NO: 225914 - RNA, 22 nt, Human
aaaauuaagugucugggaagcc

SEQ ID NO: 225915 - RNA, 22 nt, Human
ucaugucaguuucuucuauaaa

SEQ ID NO: 225916 - RNA, 21 nt, Human
cagagcugaaggguguagugu

SEQ ID NO: 225917 - RNA, 22 nt, Human
aggcuccuggguguggccgcca

SEQ ID NO: 225918 - RNA, 22 nt, Human
ggcucugcgccugcggggacuu

SEQ ID NO: 225919 - RNA, 17 nt, Human
cacaugucuacauggau

SEQ ID NO: 225920 - RNA, 22 nt, Human
uaacuguagcuaaccgaugaga

SEQ ID NO: 225921 - RNA, 19 nt, Human
aggcagcacccaguccuug

SEQ ID NO: 225922 - RNA, 22 nt, Human
cagaggcacaagaaagcaaggc

SEQ ID NO: 225923 - RNA, 20 nt, Human
cauuugaaucuccauucugc

SEQ ID NO: 225924 - RNA, 22 nt, Human
uuagaaucagguguuauaauca

SEQ ID NO: 225925 - RNA, 22 nt, Human
gagcuggggcagcuuaggagug

SEQ ID NO: 225926 - RNA, 22 nt, Human
aauaaauguuuguuggauguuu

SEQ ID NO: 225927 - RNA, 22 nt, Human
gugaauuaggacaaaagggcuu

SEQ ID NO: 225928 - RNA, 22 nt, Human
uuuuagaaggaaugcuauggug

SEQ ID NO: 225929 - RNA, 23 nt, Human
ucuguacaauugagaagagaaca

SEQ ID NO: 225930 - RNA, 20 nt, Human
cuggcccaucuaccgcucug

SEQ ID NO: 225931 - RNA, 22 nt, Human
ucagacagggcuucucaaacuu

SEQ ID NO: 225932 - RNA, 22 nt, Human
cauuuguuaaugcugcuuuuaa

SEQ ID NO: 225933 - RNA, 22 nt, Human
uccugugaagaauagcacucaa

SEQ ID NO: 225934 - RNA, 22 nt, Human
uccugggcugugugccacucug

SEQ ID NO: 225935 - RNA, 22 nt, Human
gcuggagaaacugcagcugagg

SEQ ID NO: 225936 - RNA, 18 nt, Human
cagucccaaaccuuagga

SEQ ID NO: 225937 - RNA, 22 nt, Human
gcugugugacugagagccuggc

SEQ ID NO: 225938 - RNA, 22 nt, Human
aagcacagugccaaguucuauu

SEQ ID NO: 225939 - RNA, 18 nt, Human
ugauucaaguugcccucc

SEQ ID NO: 225940 - RNA, 22 nt, Human
guuuuccuucucagccauugcc

SEQ ID NO: 225941 - RNA, 22 nt, Human
uuguauguuucugugcacauga

SEQ ID NO: 225942 - RNA, 22 nt, Human
aguaaacacugucuuuauauau

SEQ ID NO: 225943 - RNA, 22 nt, Human
gauuuauaaagguugcacugga

SEQ ID NO: 225944 - RNA, 22 nt, Human
gagggacagcuaaagagaaauu

SEQ ID NO: 225945 - RNA, 22 nt, Human
caguuuauaugucagagcugua

SEQ ID NO: 225946 - RNA, 22 nt, Human
auuugcuggugaaauagugaca

SEQ ID NO: 225947 - RNA, 22 nt, Human
cugcugggucuaugcaagugga

SEQ ID NO: 225948 - RNA, 21 nt, Human
ccuggcugcacaguugcuggu

SEQ ID NO: 225949 - RNA, 19 nt, Human
cuguuucugagcuugcuuu

SEQ ID NO: 225950 - RNA, 22 nt, Human
aaggcauuaugauuugaguacc

SEQ ID NO: 225951 - RNA, 22 nt, Human
aggagagagcugagcuuugcug

SEQ ID NO: 225952 - RNA, 22 nt, Human
ucaggagcagccuuggagagcg

SEQ ID NO: 225953 - RNA, 22 nt, Human
gucugggcaggaaucugcauuc

SEQ ID NO: 225954 - RNA, 22 nt, Human
uauuggucaaguugaggacccu

SEQ ID NO: 225955 - RNA, 22 nt, Human
gauuuuacaugucauaucuauu

SEQ ID NO: 225956 - RNA, 22 nt, Human
agacagaauuugucagauaaau

SEQ ID NO: 225957 - RNA, 22 nt, Human
agggaauguagcaagaugccaa

SEQ ID NO: 225958 - RNA, 22 nt, Human
ugauuacaguauuugagaucca

SEQ ID NO: 225959 - RNA, 22 nt, Human
augcggugaauugacuguuucu

SEQ ID NO: 225960 - RNA, 18 nt, Human
uagaaucuguuauugccu

SEQ ID NO: 225961 - RNA, 22 nt, Human
cagugaggcucugcugagcggu

SEQ ID NO: 225962 - RNA, 22 nt, Human
ucagucuuugcuuaugacaaua

SEQ ID NO: 225963 - RNA, 22 nt, Human
caccugggucauugcugguguu

SEQ ID NO: 225964 - RNA, 22 nt, Human
auuuccagcagcauauuugucu

SEQ ID NO: 225965 - RNA, 22 nt, Human
gucuggccauuugcccauugug

SEQ ID NO: 225966 - RNA, 22 nt, Human
cuggcagcugugugaagaacug

SEQ ID NO: 225967 - RNA, 22 nt, Human
uacacugaagugucuugguaua

SEQ ID NO: 225968 - RNA, 22 nt, Human
gccuguggggcugaggcugccu

SEQ ID NO: 225969 - RNA, 22 nt, Human
aggugcuggaguagaagaaaaa

SEQ ID NO: 225970 - RNA, 22 nt, Human
uccaaggacauuguucuaguug

SEQ ID NO: 225971 - RNA, 22 nt, Human
uccucuggggcgugguccugga

SEQ ID NO: 225972 - RNA, 22 nt, Human
cuggacacaaacaucuccucug

SEQ ID NO: 225973 - RNA, 22 nt, Human
uaacacauaucuacaacaugug

SEQ ID NO: 225974 - RNA, 22 nt, Human
agcuagcaaauagcauguagga

SEQ ID NO: 225975 - RNA, 22 nt, Human
ugacaaguacauaauuucaugu

SEQ ID NO: 225976 - RNA, 22 nt, Human
augaugaaauuuucuaucaugu

SEQ ID NO: 225977 - RNA, 22 nt, Human
gauauuuuuaggugaugcaggc

SEQ ID NO: 225978 - RNA, 22 nt, Human
uuccuggcgccacggagccggu

SEQ ID NO: 225979 - RNA, 22 nt, Human
uacaagacgagggaaguucuuu

SEQ ID NO: 225980 - RNA, 22 nt, Human
aggcccugcugaggccucccuc

SEQ ID NO: 225981 - RNA, 22 nt, Human
uuucaaaauuuugcagugguaa

SEQ ID NO: 225982 - RNA, 22 nt, Human
ugaaagcagauagcucuguugu

SEQ ID NO: 225983 - RNA, 20 nt, Human
cagggcacacugcagccucg

SEQ ID NO: 225984 - RNA, 22 nt, Human
agacacagcugcaggagguggg

SEQ ID NO: 225985 - RNA, 22 nt, Human
guuauuaguaagacucgcacau

SEQ ID NO: 225986 - RNA, 23 nt, Human
caugugugacaguaucacuguuu

SEQ ID NO: 225987 - RNA, 22 nt, Human
acaggacauguaccaggugguc

SEQ ID NO: 225988 - RNA, 22 nt, Human
caguuagcugacaaguaggcua

SEQ ID NO: 225989 - RNA, 22 nt, Human
auucauguuagcccacauguag

SEQ ID NO: 225990 - RNA, 22 nt, Human
auaugaaguuacagguaagaaa

SEQ ID NO: 225991 - RNA, 22 nt, Human
uuaggaaaauggaguccuuuua

SEQ ID NO: 225992 - RNA, 22 nt, Human
uggcuucuugacuucuuggcug

SEQ ID NO: 225993 - RNA, 22 nt, Human
ucaaaggguaauguaauagucu

SEQ ID NO: 225994 - RNA, 22 nt, Human
gaugugucccuuucaacucaga

SEQ ID NO: 225995 - RNA, 22 nt, Human
ucaggagauguaaccuuagcug

SEQ ID NO: 225996 - RNA, 22 nt, Human
uuuuuaaugcagucugagacau

SEQ ID NO: 225997 - RNA, 21 nt, Human
ugagcaggugcagggaagugg

SEQ ID NO: 225998 - RNA, 22 nt, Human
cugacaggguagacagagggca

SEQ ID NO: 225999 - RNA, 22 nt, Human
agcuggcauugcagggagcugc

SEQ ID NO: 226000 - RNA, 22 nt, Human
ccugagugccaugagagcaccc

SEQ ID NO: 226001 - RNA, 22 nt, Human
aaacauuguacauucuguagcu

SEQ ID NO: 226002 - RNA, 22 nt, Human
gucugucuguuguugagaagca

SEQ ID NO: 226003 - RNA, 22 nt, Human
cacauggaagagauacagugag

SEQ ID NO: 226004 - RNA, 22 nt, Human
guuagagggcugccuuuuguuu

SEQ ID NO: 226005 - RNA, 22 nt, Human
agguccugacgcccuuugaaau

SEQ ID NO: 226006 - RNA, 22 nt, Human
gccccagauggaggaagcuggg

SEQ ID NO: 226007 - RNA, 22 nt, Human
gccugggugagggucuccuuca

SEQ ID NO: 226008 - RNA, 22 nt, Human
augaaucaagugagaacagcau

SEQ ID NO: 226009 - RNA, 22 nt, Human
aggcagagcugauguucuguga

SEQ ID NO: 226010 - RNA, 22 nt, Human
uuagggaaauaaaauuaucagu

SEQ ID NO: 226011 - RNA, 21 nt, Human
cacuugaaugguguuuuacaa

SEQ ID NO: 226012 - RNA, 22 nt, Human
aggagaaggaggccccucacac

SEQ ID NO: 226013 - RNA, 18 nt, Human
ggugagggagcuggaagc

SEQ ID NO: 226014 - RNA, 22 nt, Human
gggaagaagacauggugaaggc

SEQ ID NO: 226015 - RNA, 22 nt, Human
gcagcuguagaggggagaaaga

SEQ ID NO: 226016 - RNA, 22 nt, Human
ggagggccccuccagugggcag

SEQ ID NO: 226017 - RNA, 22 nt, Human
caauuucuggaacuaauucuga

SEQ ID NO: 226018 - RNA, 22 nt, Human
ggccuuccuggcggcucagggu

SEQ ID NO: 226019 - RNA, 23 nt, Human
cggcuucugaaaucccaucuguu

SEQ ID NO: 226020 - RNA, 22 nt, Human
gccuggcuaguuagugucaggu

SEQ ID NO: 226021 - RNA, 22 nt, Human
uuugggcucacuaugcugaaga

SEQ ID NO: 226022 - RNA, 22 nt, Human
aaguguuuaacggugauugagc

SEQ ID NO: 226023 - RNA, 22 nt, Human
gucucagauaacauguauucua

SEQ ID NO: 226024 - RNA, 22 nt, Human
gauucccaugucugaggaggug

SEQ ID NO: 226025 - RNA, 22 nt, Human
accaggaaacugugcccacgac

SEQ ID NO: 226026 - RNA, 22 nt, Human
gguguccuugcagaaggcggcg

SEQ ID NO: 226027 - RNA, 22 nt, Human
gcagacuguacacuggacuuug

SEQ ID NO: 226028 - RNA, 22 nt, Human
gugguccucauaauucagugag

SEQ ID NO: 226029 - RNA, 22 nt, Human
gaugccuccaaaugagggcaga

SEQ ID NO: 226030 - RNA, 22 nt, Human
gcccagagugaguccugggccc

SEQ ID NO: 226031 - RNA, 22 nt, Human
aagccuugauucacucugugga

SEQ ID NO: 226032 - RNA, 22 nt, Human
uugaggaguagaagcuuugaau

SEQ ID NO: 226033 - RNA, 22 nt, Human
agauuuugucucaauacuucug

SEQ ID NO: 226034 - RNA, 22 nt, Human
ucugugccaucagucuccagag

SEQ ID NO: 226035 - RNA, 22 nt, Human
cuggggccagugaggaggcuuu

SEQ ID NO: 226036 - RNA, 22 nt, Human
ucuguagguuaaaaguagacaa

SEQ ID NO: 226037 - RNA, 22 nt, Human
uguucagagacagaaauucuaa

SEQ ID NO: 226038 - RNA, 22 nt, Human
aaaguccugacugcaggggaug

SEQ ID NO: 226039 - RNA, 22 nt, Human
cagcaucucugcacccuccccc

SEQ ID NO: 226040 - RNA, 19 nt, Human
acaugcaaggcaccugcag

SEQ ID NO: 226041 - RNA, 20 nt, Human
ucagagagagggugccacuu

SEQ ID NO: 226042 - RNA, 22 nt, Human
gcaguguccaggguggucugca

SEQ ID NO: 226043 - RNA, 19 nt, Human
acauucccaucagcaaugu

SEQ ID NO: 226044 - RNA, 22 nt, Human
ggugaaggucagagcaggaaaa

SEQ ID NO: 226045 - RNA, 22 nt, Human
caggaagaaagaggugaggugu

SEQ ID NO: 226046 - RNA, 22 nt, Human
guuaaagaagaauaguuccuuu

SEQ ID NO: 226047 - RNA, 22 nt, Human
cagagacaguuucacagggucu

SEQ ID NO: 226048 - RNA, 22 nt, Human
uauucaagauugaacuggcaga

SEQ ID NO: 226049 - RNA, 22 nt, Human
auuagcauauuaaauagucauu

SEQ ID NO: 226050 - RNA, 22 nt, Human
gagcuauaauagagcuucagug

SEQ ID NO: 226051 - RNA, 22 nt, Human
ugccaguguggaacuaggaaga

SEQ ID NO: 226052 - RNA, 22 nt, Human
gcaagcaaguaucuggcaggga

SEQ ID NO: 226053 - RNA, 22 nt, Human
ucauucuuuaccaaguugucac

SEQ ID NO: 226054 - RNA, 22 nt, Human
ccuccagggcagacggggagca

SEQ ID NO: 226055 - RNA, 22 nt, Human
uguccauacaauguaacaucuu

SEQ ID NO: 226056 - RNA, 22 nt, Human
guugcaggaagcacacacaugu

SEQ ID NO: 226057 - RNA, 22 nt, Human
uaaguauuggccuauagcuaga

SEQ ID NO: 226058 - RNA, 22 nt, Human
guacuucccugggaggcaagca

SEQ ID NO: 226059 - RNA, 22 nt, Human
gacuuucugagucaaagaaagg

SEQ ID NO: 226060 - RNA, 17 nt, Human
aggcaccucuuccugcu

SEQ ID NO: 226061 - RNA, 22 nt, Human
augcagggauuaaaugacugcc

SEQ ID NO: 226062 - RNA, 16 nt, Human
gccugggagggaacag

SEQ ID NO: 226063 - RNA, 22 nt, Human
ucagcuuugggggucucaggag

SEQ ID NO: 226064 - RNA, 22 nt, Human
ugccccucagggaacggguauc

SEQ ID NO: 226065 - RNA, 17 nt, Human
agcuccugcccauggcu

SEQ ID NO: 226066 - RNA, 22 nt, Human
cccaggccuggucugggccagu

SEQ ID NO: 226067 - RNA, 22 nt, Human
uggauucugggagaguucuaua

SEQ ID NO: 226068 - RNA, 22 nt, Human
aggcuucuugcuuccaaaugca

SEQ ID NO: 226069 - RNA, 22 nt, Human
cauguuaaaauauacauucuga

SEQ ID NO: 226070 - RNA, 22 nt, Human
ucaagcuuucugucucuuaugg

SEQ ID NO: 226071 - RNA, 22 nt, Human
gggcucucaaggcagggcccca

SEQ ID NO: 226072 - RNA, 22 nt, Human
uuguacuuuugucagguggaca

SEQ ID NO: 226073 - RNA, 22 nt, Human
uagaagaacaugucaaacuaua

SEQ ID NO: 226074 - RNA, 22 nt, Human
ugcuccaggagcaaccuuugag

SEQ ID NO: 226075 - RNA, 22 nt, Human
gaguagcagccacagaggaccc

SEQ ID NO: 226076 - RNA, 23 nt, Human
uaaagcaaagucaagugcacucc

SEQ ID NO: 226077 - RNA, 22 nt, Human
auaagaugagaucagcuuucug

SEQ ID NO: 226078 - RNA, 22 nt, Human
cauacauauguggaugucauau

SEQ ID NO: 226079 - RNA, 19 nt, Human
gaguacaggugcagaaaug

SEQ ID NO: 226080 - RNA, 22 nt, Human
aguguggcaggaaugacuagaa

SEQ ID NO: 226081 - RNA, 21 nt, Human
aaaaagcuggggcaugcaugc

SEQ ID NO: 226082 - RNA, 22 nt, Human
gauguggaugaucuuagauggu

SEQ ID NO: 226083 - RNA, 22 nt, Human
agauuacaacaugggacgcaua

SEQ ID NO: 226084 - RNA, 22 nt, Human
ccuggggaagucacuucucuuu

SEQ ID NO: 226085 - RNA, 22 nt, Human
caggaagcuggguuuccauaca

SEQ ID NO: 226086 - RNA, 22 nt, Human
gucaaaaugagcuuuguuauug

SEQ ID NO: 226087 - RNA, 22 nt, Human
uauguacaucuugagcaaugaa

SEQ ID NO: 226088 - RNA, 22 nt, Human
uucauucacccaggaaacaucu

SEQ ID NO: 226089 - RNA, 22 nt, Human
ugucaucuucacugggucacaa

SEQ ID NO: 226090 - RNA, 22 nt, Human
gagcagugagugaauguugccu

SEQ ID NO: 226091 - RNA, 22 nt, Human
agcccugcauagaagggaacac

SEQ ID NO: 226092 - RNA, 22 nt, Human
uagggaugaggauagauuuuuc

SEQ ID NO: 226093 - RNA, 22 nt, Human
aacagcaccgaagucgucuaag

SEQ ID NO: 226094 - RNA, 22 nt, Human
agaaugcaagauaaacuuuauu

SEQ ID NO: 226095 - RNA, 22 nt, Human
ggcagguggauuuucuacucua

SEQ ID NO: 226096 - RNA, 22 nt, Human
ggugagggacaucacucagcca

SEQ ID NO: 226097 - RNA, 22 nt, Human
aucuagaggagggcugcuggau

SEQ ID NO: 226098 - RNA, 22 nt, Human
uccccaccccagaacuacuagg

SEQ ID NO: 226099 - RNA, 20 nt, Human
uagauuucauacuucucuuu

SEQ ID NO: 226100 - RNA, 22 nt, Human
ugcccagagccucuuaccucca

SEQ ID NO: 226101 - RNA, 22 nt, Human
aaguuacacauuuucauuguaa

SEQ ID NO: 226102 - RNA, 18 nt, Human
ggagcugggccugguucc

SEQ ID NO: 226103 - RNA, 22 nt, Human
acagcauuuaaagaaaaugaac

SEQ ID NO: 226104 - RNA, 22 nt, Human
cugaaugaaaucaaggacugag

SEQ ID NO: 226105 - RNA, 22 nt, Human
uggaagaagcuacaagcgguga

SEQ ID NO: 226106 - RNA, 22 nt, Human
guagaauuaccucucuaugucc

SEQ ID NO: 226107 - RNA, 22 nt, Human
cugagggaguuccugagcccac

SEQ ID NO: 226108 - RNA, 22 nt, Human
agucacuugauucuccugagcu

SEQ ID NO: 226109 - RNA, 22 nt, Human
gcucuuuucacaguccaaaaug

SEQ ID NO: 226110 - RNA, 22 nt, Human
uccagggccaguccuugucugu

SEQ ID NO: 226111 - RNA, 22 nt, Human
cgcaggcuccggggugcccugg

SEQ ID NO: 226112 - RNA, 20 nt, Human
ggcaguuaaggcacagucau

SEQ ID NO: 226113 - RNA, 18 nt, Human
cugucccauccucagguu

SEQ ID NO: 226114 - RNA, 22 nt, Human
cucaaaaugguuaauuuuaaua

SEQ ID NO: 226115 - RNA, 22 nt, Human
aagggcuguaguuuguugauca

SEQ ID NO: 226116 - RNA, 22 nt, Human
cuacaggaguaaaauaauuuca

SEQ ID NO: 226117 - RNA, 23 nt, Human
agaagcugggagccuggggaugg

SEQ ID NO: 226118 - RNA, 22 nt, Human
ucucugaaagcagcugcucauc

SEQ ID NO: 226119 - RNA, 22 nt, Human
uucucucuuacugccaugcugu

SEQ ID NO: 226120 - RNA, 22 nt, Human
acauuuaaauaccuauguuucu

SEQ ID NO: 226121 - RNA, 22 nt, Human
augagcaguagguucauggcug

SEQ ID NO: 226122 - RNA, 22 nt, Human
aacaguuuguggauagcuugua

SEQ ID NO: 226123 - RNA, 22 nt, Human
gaaguauuauagcauauuagcc

SEQ ID NO: 226124 - RNA, 22 nt, Human
uauuuguuccagagauaaaaau

SEQ ID NO: 226125 - RNA, 22 nt, Human
ucaggcagugguaaaugaguua

SEQ ID NO: 226126 - RNA, 19 nt, Human
uagugucaaggaggagggu

SEQ ID NO: 226127 - RNA, 22 nt, Human
ugcucaggugccuuggcugcug

SEQ ID NO: 226128 - RNA, 22 nt, Human
auggcccacucuggucccggca

SEQ ID NO: 226129 - RNA, 22 nt, Human
gugauaaaauucaaauagcucu

SEQ ID NO: 226130 - RNA, 22 nt, Human
ucauuuaauaauuuuugaguag

SEQ ID NO: 226131 - RNA, 22 nt, Human
caggugucggucaggcgguuuu

SEQ ID NO: 226132 - RNA, 22 nt, Human
uucuuuuagucauucagggaag

SEQ ID NO: 226133 - RNA, 22 nt, Human
guccuggcccacuggcaggcug

SEQ ID NO: 226134 - RNA, 22 nt, Human
uagaaacugauagucuugugcu

SEQ ID NO: 226135 - RNA, 22 nt, Human
auggaaauguuccauauauuga

SEQ ID NO: 226136 - RNA, 22 nt, Human
guguuacuugccauacagaaaa

SEQ ID NO: 226137 - RNA, 22 nt, Human
aucuccagcucgcagagcuccu

SEQ ID NO: 226138 - RNA, 22 nt, Human
gcagacagaugagggugcuggg

SEQ ID NO: 226139 - RNA, 20 nt, Human
agaaaaaguguggaaauuuc

SEQ ID NO: 226140 - RNA, 22 nt, Human
uuucaaggugcaggaggguuuu

SEQ ID NO: 226141 - RNA, 22 nt, Human
caggguggcacaucacagcauu

SEQ ID NO: 226142 - RNA, 22 nt, Human
uucacuuaacaucauaucauga

SEQ ID NO: 226143 - RNA, 22 nt, Human
ugcaggagagcuggucuggccc

SEQ ID NO: 226144 - RNA, 22 nt, Human
cuuaggaagcuuuugaggacaa

SEQ ID NO: 226145 - RNA, 22 nt, Human
cugggccuucauugcucuccca

SEQ ID NO: 226146 - RNA, 22 nt, Human
uaacagcacuggcaggcacugu

SEQ ID NO: 226147 - RNA, 20 nt, Human
guaaaauauggucuuugggu

SEQ ID NO: 226148 - RNA, 22 nt, Human
caauguuuuuccuuccuuaaua

SEQ ID NO: 226149 - RNA, 22 nt, Human
cagagccucccuccucugccau

SEQ ID NO: 226150 - RNA, 22 nt, Human
uguaaaaggaaaucaaagcacu

SEQ ID NO: 226151 - RNA, 22 nt, Human
uagaaagcuugggguguuuaaa

SEQ ID NO: 226152 - RNA, 22 nt, Human
uagaaccucugauuauguuacu

SEQ ID NO: 226153 - RNA, 22 nt, Human
aggaugagagauacauggagca

SEQ ID NO: 226154 - RNA, 22 nt, Human
caagcagagacuagauagcugu

SEQ ID NO: 226155 - RNA, 19 nt, Human
aggugaggggcaccauguc

SEQ ID NO: 226156 - RNA, 22 nt, Human
cuuuuaaugagcauugcugucu

SEQ ID NO: 226157 - RNA, 22 nt, Human
agugauggcagugaauaaggcu

SEQ ID NO: 226158 - RNA, 22 nt, Human
gcugccagggaggugguggagg

SEQ ID NO: 226159 - RNA, 22 nt, Human
gcucuuuggauuccuuuacaaa

SEQ ID NO: 226160 - RNA, 16 nt, Human
uguuugcaaagcaauc

SEQ ID NO: 226161 - RNA, 22 nt, Human
uuagaaccaggguuacgauucu

SEQ ID NO: 226162 - RNA, 22 nt, Human
ugcuccuggaugagguacucca

SEQ ID NO: 226163 - RNA, 22 nt, Human
ccaaguacucucaccaaagcuu

SEQ ID NO: 226164 - RNA, 22 nt, Human
ucuauacaaguuucacuuugac

SEQ ID NO: 226165 - RNA, 22 nt, Human
augaguucccaggugauuugug

SEQ ID NO: 226166 - RNA, 21 nt, Human
uuaccaauggcuucucuuucc

SEQ ID NO: 226167 - RNA, 22 nt, Human
ugcagggcagcuagggagcuuu

SEQ ID NO: 226168 - RNA, 21 nt, Human
agagacagagaaaguaacauu

SEQ ID NO: 226169 - RNA, 22 nt, Human
agccacaccuguccugccagcu

SEQ ID NO: 226170 - RNA, 22 nt, Human
acauggggcccaaagagagguc

SEQ ID NO: 226171 - RNA, 22 nt, Human
caagauuuccaacccuggguaa

SEQ ID NO: 226172 - RNA, 22 nt, Human
agugcauucuccaucaucuagg

SEQ ID NO: 226173 - RNA, 22 nt, Human
gaccucagauuuucccaggcca

SEQ ID NO: 226174 - RNA, 22 nt, Human
guacaggccaccacugaauuuu

SEQ ID NO: 226175 - RNA, 22 nt, Human
cucaggagacaguguccacaug

SEQ ID NO: 226176 - RNA, 22 nt, Human
gggaccuggcgagggucacaca

SEQ ID NO: 226177 - RNA, 22 nt, Human
cagggcugaggacacaaguaaa

SEQ ID NO: 226178 - RNA, 23 nt, Human
gaggcagcuccugcagugcccug

SEQ ID NO: 226179 - RNA, 22 nt, Human
gggaaugugcagccacagugag

SEQ ID NO: 226180 - RNA, 22 nt, Human
acagcaaaagacaagaacuuaa

SEQ ID NO: 226181 - RNA, 22 nt, Human
cugucccagugauccugagugc

SEQ ID NO: 226182 - RNA, 22 nt, Human
aaagccuuuuaugaucaguuaa

SEQ ID NO: 226183 - RNA, 22 nt, Human
uccuuucuccuuccgacuucau

SEQ ID NO: 226184 - RNA, 22 nt, Human
uaggugguagagccuggcuugc

SEQ ID NO: 226185 - RNA, 18 nt, Human
agcugaggggacugaaga

SEQ ID NO: 226186 - RNA, 22 nt, Human
caagauaaaaucagcauuccaa

SEQ ID NO: 226187 - RNA, 22 nt, Human
ucuaaccuuugaaacugcuuuc

SEQ ID NO: 226188 - RNA, 22 nt, Human
uagaaacagaaaacuguaauag

SEQ ID NO: 226189 - RNA, 22 nt, Human
gggagacacgcugcaggcauaa

SEQ ID NO: 226190 - RNA, 22 nt, Human
auuuaaaugcuuaagaggguuu

SEQ ID NO: 226191 - RNA, 22 nt, Human
gggcucuggaaaugggagcucc

SEQ ID NO: 226192 - RNA, 22 nt, Human
acagguguccucacagggggug

SEQ ID NO: 226193 - RNA, 22 nt, Human
acuucucugguugagguccaau

SEQ ID NO: 226194 - RNA, 22 nt, Human
gcagaaguggugcugugccacu

SEQ ID NO: 226195 - RNA, 22 nt, Human
ucccagagugagccaggggcag

SEQ ID NO: 226196 - RNA, 22 nt, Human
cugggugguuuugaugugaauu

SEQ ID NO: 226197 - RNA, 22 nt, Human
uaaaaucauucuggugucagua

SEQ ID NO: 226198 - RNA, 22 nt, Human
cgggagccucugggucacacug

SEQ ID NO: 226199 - RNA, 22 nt, Human
agcacagaaaguauugacugaa

SEQ ID NO: 226200 - RNA, 22 nt, Human
gguugcaaacuccugggaucaa

SEQ ID NO: 226201 - RNA, 22 nt, Human
aucgagggugaguacagcggac

SEQ ID NO: 226202 - RNA, 22 nt, Human
acaggcagcgucauugcugcuc

SEQ ID NO: 226203 - RNA, 22 nt, Human
uaggaaacauuugaagaggauu

SEQ ID NO: 226204 - RNA, 22 nt, Human
uucauucagguguauuuauggg

SEQ ID NO: 226205 - RNA, 22 nt, Human
cuaauuuaaugaaugagucuua

SEQ ID NO: 226206 - RNA, 22 nt, Human
ggagacacgggugcugaggacc

SEQ ID NO: 226207 - RNA, 22 nt, Human
aacuuucuauagguugggauuu

SEQ ID NO: 226208 - RNA, 20 nt, Human
agccaggccucaaguuaagu

SEQ ID NO: 226209 - RNA, 22 nt, Human
cccaggcagaauuaguguuuca

SEQ ID NO: 226210 - RNA, 22 nt, Human
cacagcugugagaagggagccu

SEQ ID NO: 226211 - RNA, 22 nt, Human
ucuguggcacgauugcacugca

SEQ ID NO: 226212 - RNA, 22 nt, Human
cccagugccaggcacaggcagc

SEQ ID NO: 226213 - RNA, 21 nt, Human
gaggcugucugcugcuggccu

SEQ ID NO: 226214 - RNA, 22 nt, Human
ucuuggauuuuaauggaucaaa

SEQ ID NO: 226215 - RNA, 22 nt, Human
cccacgucgaacuugcuccaga

SEQ ID NO: 226216 - RNA, 22 nt, Human
aggaacagaagagcaaugcagg

SEQ ID NO: 226217 - RNA, 22 nt, Human
ucagggagaggugagagccugu

SEQ ID NO: 226218 - RNA, 22 nt, Human
ccaggagucaauaaaggaagcu

SEQ ID NO: 226219 - RNA, 22 nt, Human
auauacaugggaauauguggag

SEQ ID NO: 226220 - RNA, 22 nt, Human
gcuccaguggauacagcagugg

SEQ ID NO: 226221 - RNA, 19 nt, Human
ccuccugcuagauaugcaa

SEQ ID NO: 226222 - RNA, 22 nt, Human
ucugcagaauucgaggaagaaa

SEQ ID NO: 226223 - RNA, 22 nt, Human
aguguguaagggaucaaagagu

SEQ ID NO: 226224 - RNA, 22 nt, Human
gaggcagagugcaccccaggag

SEQ ID NO: 226225 - RNA, 17 nt, Human
caguuggagacaagucc

SEQ ID NO: 226226 - RNA, 22 nt, Human
ccaggcuugguguguggucagg

SEQ ID NO: 226227 - RNA, 22 nt, Human
guauuaggugguggaauuguag

SEQ ID NO: 226228 - RNA, 22 nt, Human
augugcaauggugucaccacau

SEQ ID NO: 226229 - RNA, 22 nt, Human
agcagccagaaauccagaggug

SEQ ID NO: 226230 - RNA, 22 nt, Human
uccgccaggacugagggcccau

SEQ ID NO: 226231 - RNA, 23 nt, Human
uagauccuuccaacuacucuuac

SEQ ID NO: 226232 - RNA, 22 nt, Human
uccaguccagggaauggcugau

SEQ ID NO: 226233 - RNA, 21 nt, Human
uuuuuucuugcgugaggccug

SEQ ID NO: 226234 - RNA, 22 nt, Human
ucaguuugaauguuagcacagu

SEQ ID NO: 226235 - RNA, 22 nt, Human
uggcuguguuaccacuucaugu

SEQ ID NO: 226236 - RNA, 22 nt, Human
ccucccugcgcuccugcggcgg

SEQ ID NO: 226237 - RNA, 22 nt, Human
guagaauuuuaauaauggagau

SEQ ID NO: 226238 - RNA, 22 nt, Human
cuuguauucugccuaaccuuca

SEQ ID NO: 226239 - RNA, 22 nt, Human
gaggcugcggggaggagccugc

SEQ ID NO: 226240 - RNA, 22 nt, Human
uguuuucucuugaaaagcaguc

SEQ ID NO: 226241 - RNA, 22 nt, Human
uuacaacaaaggcacgugcaug

SEQ ID NO: 226242 - RNA, 22 nt, Human
accucagcuauuucaaaacaga

SEQ ID NO: 226243 - RNA, 22 nt, Human
uaacagaauccuguuauugcca

SEQ ID NO: 226244 - RNA, 22 nt, Human
uacugucuggguucccaagcaa

SEQ ID NO: 226245 - RNA, 22 nt, Human
uguaggauguaaggcaggcauc

SEQ ID NO: 226246 - RNA, 22 nt, Human
agucagugacuuuugcugagag

SEQ ID NO: 226247 - RNA, 22 nt, Human
gcaccaggcagcugagcaggcc

SEQ ID NO: 226248 - RNA, 22 nt, Human
aauagaaaggaggggcucuugu

SEQ ID NO: 226249 - RNA, 22 nt, Human
uagaaacagaauaugagugaga

SEQ ID NO: 226250 - RNA, 22 nt, Human
aggcccagugccauuaguuuug

SEQ ID NO: 226251 - RNA, 22 nt, Human
gggagggaaggaggcgccgugu

SEQ ID NO: 226252 - RNA, 22 nt, Human
cugggccugucagggcuuuuug

SEQ ID NO: 226253 - RNA, 22 nt, Human
gccagcugaggccgugcaggcu

SEQ ID NO: 226254 - RNA, 22 nt, Human
uguccugggaaugggaugcagu

SEQ ID NO: 226255 - RNA, 19 nt, Human
agcugcaaaagguggaacu

SEQ ID NO: 226256 - RNA, 22 nt, Human
caggcccaucugcucccaggcu

SEQ ID NO: 226257 - RNA, 22 nt, Human
cagagcuguuacuauucaugaa

SEQ ID NO: 226258 - RNA, 22 nt, Human
ugcagagagauauggcaagagg

SEQ ID NO: 226259 - RNA, 22 nt, Human
aaaaaugcugugguagcugugu

SEQ ID NO: 226260 - RNA, 20 nt, Human
aggcuuggcuuggcaggaac

SEQ ID NO: 226261 - RNA, 22 nt, Human
aggcuucugucuuuaggaguug

SEQ ID NO: 226262 - RNA, 22 nt, Human
ucuuaagcagagaagaaguuga

SEQ ID NO: 226263 - RNA, 22 nt, Human
cccuggcucuucaccaccugcc

SEQ ID NO: 226264 - RNA, 22 nt, Human
gcugccacuuggucaugucaug

SEQ ID NO: 226265 - RNA, 22 nt, Human
acacacguauauauacguaugu

SEQ ID NO: 226266 - RNA, 19 nt, Human
cuguggacucuagaucaug

SEQ ID NO: 226267 - RNA, 22 nt, Human
agcuucuuggcucagcacuugg

SEQ ID NO: 226268 - RNA, 23 nt, Human
cccaagccugugcccucugacuc

SEQ ID NO: 226269 - RNA, 22 nt, Human
auuuugacugcauuacagaaca

SEQ ID NO: 226270 - RNA, 22 nt, Human
acuguggcuaauucauuugguc

SEQ ID NO: 226271 - RNA, 22 nt, Human
aauuauguagccauaugaaaca

SEQ ID NO: 226272 - RNA, 22 nt, Human
ucucuggggaugcuuauucuug

SEQ ID NO: 226273 - RNA, 22 nt, Human
ucuucaguauuuggauaacauu

SEQ ID NO: 226274 - RNA, 22 nt, Human
uugaaaguuuauggagucugca

SEQ ID NO: 226275 - RNA, 22 nt, Human
cuagaauaucauaugaagagac

SEQ ID NO: 226276 - RNA, 22 nt, Human
aggcagguguuaccucugguuu

SEQ ID NO: 226277 - RNA, 22 nt, Human
ccuccuggcuuuucccauugaa

SEQ ID NO: 226278 - RNA, 22 nt, Human
gucuucuuuaaccuacuaaagc

SEQ ID NO: 226279 - RNA, 22 nt, Human
cucugugcccuacugcucagcu

SEQ ID NO: 226280 - RNA, 22 nt, Human
ugccugggggacuaaggccaaa

SEQ ID NO: 226281 - RNA, 22 nt, Human
gacaggguccaaaggcagggga

SEQ ID NO: 226282 - RNA, 19 nt, Human
ggcugccuuuccuuaccag

SEQ ID NO: 226283 - RNA, 22 nt, Human
cagucccaggguugguucagcu

SEQ ID NO: 226284 - RNA, 22 nt, Human
uccaggcaagggaggagcaugg

SEQ ID NO: 226285 - RNA, 22 nt, Human
guuacauggagcaaugaugcau

SEQ ID NO: 226286 - RNA, 22 nt, Human
caaaguuuggcucucaugacau

SEQ ID NO: 226287 - RNA, 22 nt, Human
gucucaguaagaaaggcuccug

SEQ ID NO: 226288 - RNA, 22 nt, Human
aaggcugggaaacaugcaggcc

SEQ ID NO: 226289 - RNA, 21 nt, Human
caagcugccugagggugguug

SEQ ID NO: 226290 - RNA, 22 nt, Human
ucucacuggguauaaaugagua

SEQ ID NO: 226291 - RNA, 22 nt, Human
gcucugagaggaugcugagcag

SEQ ID NO: 226292 - RNA, 22 nt, Human
ugggcugagcacugaggaagga

SEQ ID NO: 226293 - RNA, 22 nt, Human
agggcccaguggagagcugagc

SEQ ID NO: 226294 - RNA, 22 nt, Human
acagccuggacuggcucucugc

SEQ ID NO: 226295 - RNA, 22 nt, Human
caggaagaccagggcuguggcu

SEQ ID NO: 226296 - RNA, 22 nt, Human
uguucucuucucauugaacaug

SEQ ID NO: 226297 - RNA, 22 nt, Human
guuaaugucacuuuauguggcu

SEQ ID NO: 226298 - RNA, 22 nt, Human
aagugggaauagaaaugaaggu

SEQ ID NO: 226299 - RNA, 22 nt, Human
gagcaaagcuuuuagggccuuu

SEQ ID NO: 226300 - RNA, 22 nt, Human
gacaggaggcagagcucaggug

SEQ ID NO: 226301 - RNA, 22 nt, Human
uaaggcuuucuaaauaugcaga

SEQ ID NO: 226302 - RNA, 22 nt, Human
ggaacuugcaaccucuggucac

SEQ ID NO: 226303 - RNA, 22 nt, Human
aauaugcagcaugaugaaguaa

SEQ ID NO: 226304 - RNA, 22 nt, Human
gaggagaagggcacggagaaaa

SEQ ID NO: 226305 - RNA, 22 nt, Human
auguguuuguaccuuuaaauau

SEQ ID NO: 226306 - RNA, 22 nt, Human
uagaauauacacuacagcuuaa

SEQ ID NO: 226307 - RNA, 22 nt, Human
uuucauaaucugucaagugggg

SEQ ID NO: 226308 - RNA, 22 nt, Human
ugcuggguguuccgcacuugac

SEQ ID NO: 226309 - RNA, 22 nt, Human
gguggcaccuuacccugcgcag

SEQ ID NO: 226310 - RNA, 22 nt, Human
gucccaggugcccagugggcag

SEQ ID NO: 226311 - RNA, 22 nt, Human
auacagaagaacuauagccacu

SEQ ID NO: 226312 - RNA, 20 nt, Human
acugugaaugcugaauuagc

SEQ ID NO: 226313 - RNA, 22 nt, Human
aucaaagugauuuguaaacagg

SEQ ID NO: 226314 - RNA, 22 nt, Human
uuucuuuaggcuguguugccaa

SEQ ID NO: 226315 - RNA, 22 nt, Human
aggcucuguuauucuagagggc

SEQ ID NO: 226316 - RNA, 22 nt, Human
uauacacaggaaucugugaaaa

SEQ ID NO: 226317 - RNA, 22 nt, Human
gaagucuucauucucucugaga

SEQ ID NO: 226318 - RNA, 22 nt, Human
uuacuacugcuuuacuacuggg

SEQ ID NO: 226319 - RNA, 22 nt, Human
ugucucaggcccaagccaguaa

SEQ ID NO: 226320 - RNA, 19 nt, Human
ccagagacauuggcaucuu

SEQ ID NO: 226321 - RNA, 22 nt, Human
ccaccaggcacucacagggaag

SEQ ID NO: 226322 - RNA, 22 nt, Human
uggugcagagagggaucuaggg

SEQ ID NO: 226323 - RNA, 22 nt, Human
aagaaucucugaucaggcuuua

SEQ ID NO: 226324 - RNA, 22 nt, Human
gcagcaggaauuuaaauuuaua

SEQ ID NO: 226325 - RNA, 22 nt, Human
caguggaggcucaagugugcuu

SEQ ID NO: 226326 - RNA, 22 nt, Human
ucuggggguuaagugaggacaa

SEQ ID NO: 226327 - RNA, 22 nt, Human
guggccucuguuggcuccuagg

SEQ ID NO: 226328 - RNA, 20 nt, Human
uggagcuguaaucuugucug

SEQ ID NO: 226329 - RNA, 22 nt, Human
ucagucucuggggcuucuguuu

SEQ ID NO: 226330 - RNA, 22 nt, Human
cucauggcagagucaccugucc

SEQ ID NO: 226331 - RNA, 21 nt, Human
agcagcaaccacauaguuuuu

SEQ ID NO: 226332 - RNA, 23 nt, Human
uggagcugacagucagagggagg

SEQ ID NO: 226333 - RNA, 22 nt, Human
uccuggcugucacucggguuga

SEQ ID NO: 226334 - RNA, 22 nt, Human
caaagcuauaaauucagacaga

SEQ ID NO: 226335 - RNA, 22 nt, Human
auucucugccauugcgguggau

SEQ ID NO: 226336 - RNA, 22 nt, Human
uauaugcaugcccauguauaca

SEQ ID NO: 226337 - RNA, 22 nt, Human
ugacauuugagagagauauaca

SEQ ID NO: 226338 - RNA, 18 nt, Human
ucaggcuuugagagaauc

SEQ ID NO: 226339 - RNA, 22 nt, Human
cagggaugucucuggaagggag

SEQ ID NO: 226340 - RNA, 22 nt, Human
uccuggcagugcuuguuuugga

SEQ ID NO: 226341 - RNA, 22 nt, Human
acuguacucuuauagccaucug

SEQ ID NO: 226342 - RNA, 22 nt, Human
uucugcugagugggcaggugca

SEQ ID NO: 226343 - RNA, 22 nt, Human
gaggagacauauuuuugaagca

SEQ ID NO: 226344 - RNA, 22 nt, Human
ccacaguagaauucaucucccu

SEQ ID NO: 226345 - RNA, 22 nt, Human
cuccuaggacgccgcugcuccu

SEQ ID NO: 226346 - RNA, 22 nt, Human
aagggugggcccuggcagccau

SEQ ID NO: 226347 - RNA, 22 nt, Human
cagggcagggccacacccccug

SEQ ID NO: 226348 - RNA, 22 nt, Human
aaggagggaaagcagugcuucu

SEQ ID NO: 226349 - RNA, 22 nt, Human
cugagggagcugcuggccuugg

SEQ ID NO: 226350 - RNA, 22 nt, Human
gagcugaaucagagauauuauu

SEQ ID NO: 226351 - RNA, 22 nt, Human
uugggagauauuguucuuuaca

SEQ ID NO: 226352 - RNA, 22 nt, Human
ccugggugaaugauauucuaaa

SEQ ID NO: 226353 - RNA, 22 nt, Human
acagacagacagauugcauaug

SEQ ID NO: 226354 - RNA, 22 nt, Human
aaaauaacuucuacuauuugca

SEQ ID NO: 226355 - RNA, 22 nt, Human
gcugccuuccaaagaguuuuau

SEQ ID NO: 226356 - RNA, 22 nt, Human
aaguuucucaauggcaacuggg

SEQ ID NO: 226357 - RNA, 22 nt, Human
aaugcucaaaauguuucaucua

SEQ ID NO: 226358 - RNA, 22 nt, Human
ugaggcagcuuuuucugugugu

SEQ ID NO: 226359 - RNA, 22 nt, Human
gcugucaguuuuacccacagac

SEQ ID NO: 226360 - RNA, 22 nt, Human
auggcugggaugggguagagaa

SEQ ID NO: 226361 - RNA, 22 nt, Human
acucugaggaauguacaggacc

SEQ ID NO: 226362 - RNA, 22 nt, Human
ccucaaauagcccccagucuag

SEQ ID NO: 226363 - RNA, 22 nt, Human
cugagacuguaccacuuccucc

SEQ ID NO: 226364 - RNA, 22 nt, Human
uucugugucuucuuguucugug

SEQ ID NO: 226365 - RNA, 22 nt, Human
cagugggguuucugugggugcu

SEQ ID NO: 226366 - RNA, 22 nt, Human
ucccuguaaaccucaaguugau

SEQ ID NO: 226367 - RNA, 18 nt, Human
ucugaaagcccuuuucca

SEQ ID NO: 226368 - RNA, 22 nt, Human
acuuccuguuaugugugccucu

SEQ ID NO: 226369 - RNA, 20 nt, Human
uucaggauucuagaccacac

SEQ ID NO: 226370 - RNA, 22 nt, Human
aggugucuuugcggcccgccgc

SEQ ID NO: 226371 - RNA, 22 nt, Human
auggcccaggccuccuguggcu

SEQ ID NO: 226372 - RNA, 22 nt, Human
ucccaggcuggggccaggugac

SEQ ID NO: 226373 - RNA, 22 nt, Human
uggcuuccuccagagcaggagg

SEQ ID NO: 226374 - RNA, 22 nt, Human
ucagugcacagagauuuuuguu

SEQ ID NO: 226375 - RNA, 22 nt, Human
ccaggaggcagaaguugcagug

SEQ ID NO: 226376 - RNA, 22 nt, Human
uaaaaucaugacagauugacau

SEQ ID NO: 226377 - RNA, 22 nt, Human
ugucugcagaagauggcauggg

SEQ ID NO: 226378 - RNA, 18 nt, Human
aggagaaagggaccaggg

SEQ ID NO: 226379 - RNA, 22 nt, Human
auuucucagugaaaugacaggc

SEQ ID NO: 226380 - RNA, 21 nt, Human
aggcugcaugcaugagugugg

SEQ ID NO: 226381 - RNA, 22 nt, Human
aggcugaggcagguggaucacu

SEQ ID NO: 226382 - RNA, 22 nt, Human
agaaguaugugagaaauuaucc

SEQ ID NO: 226383 - RNA, 22 nt, Human
ccaguggacaauuucugaggaa

SEQ ID NO: 226384 - RNA, 22 nt, Human
ucuuuuaaccuaacuagcuugg

SEQ ID NO: 226385 - RNA, 22 nt, Human
uuuguuuucaaugugucauuca

SEQ ID NO: 226386 - RNA, 22 nt, Human
gccucaagacauuuuuaauugc

SEQ ID NO: 226387 - RNA, 22 nt, Human
uggcuucuccagaaaucuuggu

SEQ ID NO: 226388 - RNA, 22 nt, Human
uuguuaaagaugcagauuccau

SEQ ID NO: 226389 - RNA, 22 nt, Human
accaggccuggcugggcagcca

SEQ ID NO: 226390 - RNA, 22 nt, Human
gcagcagaguagacagagcccu

SEQ ID NO: 226391 - RNA, 22 nt, Human
aaagcagucacuccagugugau

SEQ ID NO: 226392 - RNA, 22 nt, Human
acaggacagggaauucgaaauu

SEQ ID NO: 226393 - RNA, 22 nt, Human
cauuaauuguauuuuucaaagu

SEQ ID NO: 226394 - RNA, 22 nt, Human
caggagucuguuccucauuugu

SEQ ID NO: 226395 - RNA, 22 nt, Human
cagaggaagcagacacaucuug

SEQ ID NO: 226396 - RNA, 22 nt, Human
ucagugcagaauagugaugcau

SEQ ID NO: 226397 - RNA, 22 nt, Human
aagucagagcaacugagacauu

SEQ ID NO: 226398 - RNA, 22 nt, Human
caaaguuuuaguaaacauauau

SEQ ID NO: 226399 - RNA, 22 nt, Human
ggccugagaaccauggggccaa

SEQ ID NO: 226400 - RNA, 23 nt, Human
cccacaugucugagucagugcca

SEQ ID NO: 226401 - RNA, 22 nt, Human
acagaagaccagagagcuaacu

SEQ ID NO: 226402 - RNA, 22 nt, Human
uccauuuucuugcucuagguaa

SEQ ID NO: 226403 - RNA, 22 nt, Human
aaacaucuaucagcauuuuuua

SEQ ID NO: 226404 - RNA, 22 nt, Human
uggggcagaguaggauuuuggc

SEQ ID NO: 226405 - RNA, 22 nt, Human
ucagcaggcagugggucacaau

SEQ ID NO: 226406 - RNA, 22 nt, Human
aacaugugagcagguuuuuuau

SEQ ID NO: 226407 - RNA, 22 nt, Human
auagauguacguauguaaauca

SEQ ID NO: 226408 - RNA, 22 nt, Human
aaguacauuuuuaacuuacagc

SEQ ID NO: 226409 - RNA, 22 nt, Human
cagagcauuuggaagccacgug

SEQ ID NO: 226410 - RNA, 22 nt, Human
auuauuagacuuauaugguagu

SEQ ID NO: 226411 - RNA, 22 nt, Human
gccauccucugagcacuaggca

SEQ ID NO: 226412 - RNA, 22 nt, Human
uuuaagaucuaucccauuuugu

SEQ ID NO: 226413 - RNA, 22 nt, Human
uccaggaccugacugggccugc

SEQ ID NO: 226414 - RNA, 22 nt, Human
guccucuggccuuucccaggac

SEQ ID NO: 226415 - RNA, 22 nt, Human
ccugugaguuuacauucuggcc

SEQ ID NO: 226416 - RNA, 21 nt, Human
ggaaagaaggcaaggcucagg

SEQ ID NO: 226417 - RNA, 22 nt, Human
aacaucucagaagugacccuga

SEQ ID NO: 226418 - RNA, 22 nt, Human
cucacagcacuugugucauugg

SEQ ID NO: 226419 - RNA, 22 nt, Human
agccuugaacacugacugaagg

SEQ ID NO: 226420 - RNA, 22 nt, Human
ucagggcugccgggcagaccgu

SEQ ID NO: 226421 - RNA, 22 nt, Human
aagccuugcucuugaaaaaguu

SEQ ID NO: 226422 - RNA, 21 nt, Human
agcuggcucucucuggagaga

SEQ ID NO: 226423 - RNA, 22 nt, Human
gauuuuacugucuguguaucuc

SEQ ID NO: 226424 - RNA, 22 nt, Human
auuugcaugcuucuauugugaa

SEQ ID NO: 226425 - RNA, 22 nt, Human
agaggccagcccaggccaccga

SEQ ID NO: 226426 - RNA, 22 nt, Human
aaaaggcuuggaaccuuucccu

SEQ ID NO: 226427 - RNA, 21 nt, Human
agcugagguaaggcaagagag

SEQ ID NO: 226428 - RNA, 22 nt, Human
ggcuacuagacuuugauacuag

SEQ ID NO: 226429 - RNA, 22 nt, Human
auucaacuguaaacuuguucac

SEQ ID NO: 226430 - RNA, 22 nt, Human
ucacacagcuaguaagggccga

SEQ ID NO: 226431 - RNA, 22 nt, Human
gcugggucucuggguguaacaa

SEQ ID NO: 226432 - RNA, 19 nt, Human
gcuccugggccucacucau

SEQ ID NO: 226433 - RNA, 22 nt, Human
acaauuuuccccauagguuauc

SEQ ID NO: 226434 - RNA, 22 nt, Human
auucuucaccugagucagucua

SEQ ID NO: 226435 - RNA, 22 nt, Human
uucauugugauucuuggcuagc

SEQ ID NO: 226436 - RNA, 22 nt, Human
guuuuuguccauggaggcaaac

SEQ ID NO: 226437 - RNA, 22 nt, Human
aucugucuaugauauagucugu

SEQ ID NO: 226438 - RNA, 17 nt, Human
ucugcagggggccgugu

SEQ ID NO: 226439 - RNA, 22 nt, Human
cuccuggaggcuccaagggaga

SEQ ID NO: 226440 - RNA, 22 nt, Human
ggcuacugugauggucugcaag

SEQ ID NO: 226441 - RNA, 22 nt, Human
caggaacagaguggcauugucu

SEQ ID NO: 226442 - RNA, 22 nt, Human
uaacacugaaaaugaugcaugu

SEQ ID NO: 226443 - RNA, 22 nt, Human
uggcuucaaaaucuaguggucu

SEQ ID NO: 226444 - RNA, 22 nt, Human
gggaccugccaaggccacccag

SEQ ID NO: 226445 - RNA, 22 nt, Human
aagcaaaggaaagcugacuuuu

SEQ ID NO: 226446 - RNA, 22 nt, Human
cugaggcacugguaaugggcau

SEQ ID NO: 226447 - RNA, 22 nt, Human
acugucugugccagaugcuggg

SEQ ID NO: 226448 - RNA, 22 nt, Human
auuuuucagcuucauugaggca

SEQ ID NO: 226449 - RNA, 22 nt, Human
caggaaagccgagugccauagg

SEQ ID NO: 226450 - RNA, 22 nt, Human
cugcccugccuggccagugugg

SEQ ID NO: 226451 - RNA, 22 nt, Human
gccuuuauuguuuauucagugc

SEQ ID NO: 226452 - RNA, 22 nt, Human
gcugugcagaggugagaaucca

SEQ ID NO: 226453 - RNA, 22 nt, Human
uuggagcccugaggaucuggau

SEQ ID NO: 226454 - RNA, 20 nt, Human
acaguagaagggauuucaaa

SEQ ID NO: 226455 - RNA, 22 nt, Human
ugggacagggaaucugaucccc

SEQ ID NO: 226456 - RNA, 22 nt, Human
cauaaaauggcuuguucuuuaa

SEQ ID NO: 226457 - RNA, 22 nt, Human
aaaccuuucugcucucagcgua

SEQ ID NO: 226458 - RNA, 19 nt, Human
caugcugaccugcuguggu

SEQ ID NO: 226459 - RNA, 22 nt, Human
ugaggcuugucucagauggggg

SEQ ID NO: 226460 - RNA, 22 nt, Human
uuuauauguauugacuuugaug

SEQ ID NO: 226461 - RNA, 22 nt, Human
uacacuuuuuacuacagauucu

SEQ ID NO: 226462 - RNA, 23 nt, Human
uagaauccucugagauggaauag

SEQ ID NO: 226463 - RNA, 22 nt, Human
ugcccugugccagacuuccugg

SEQ ID NO: 226464 - RNA, 20 nt, Human
cuaacuaaccacuuucugau

SEQ ID NO: 226465 - RNA, 22 nt, Human
agcuggugugccaguuccaguu

SEQ ID NO: 226466 - RNA, 22 nt, Human
ucauugaauuucacagcuuuau

SEQ ID NO: 226467 - RNA, 22 nt, Human
gcaagcagcccagaacagcucu

SEQ ID NO: 226468 - RNA, 22 nt, Human
gagggaugucaggggaccuugg

SEQ ID NO: 226469 - RNA, 22 nt, Human
ucaauuucauucuauuaguuaa

SEQ ID NO: 226470 - RNA, 22 nt, Human
auccaguucucagugcuuacag

SEQ ID NO: 226471 - RNA, 22 nt, Human
auggaaaaggcugauuucauua

SEQ ID NO: 226472 - RNA, 22 nt, Human
uuguuucuccuggugccugaua

SEQ ID NO: 226473 - RNA, 22 nt, Human
ugugaaaugaguauauuugaau

SEQ ID NO: 226474 - RNA, 18 nt, Human
ccagagcuggcuccucgc

SEQ ID NO: 226475 - RNA, 22 nt, Human
cuucuucccagcuucccucacc

SEQ ID NO: 226476 - RNA, 22 nt, Human
ccagcccugccucucagggccc

SEQ ID NO: 226477 - RNA, 22 nt, Human
ucuguucacugagcaauggcaa

SEQ ID NO: 226478 - RNA, 22 nt, Human
agugcauucuggcagaacaggu

SEQ ID NO: 226479 - RNA, 22 nt, Human
gaaaggggcauguagggaucac

SEQ ID NO: 226480 - RNA, 22 nt, Human
aaggaggaauaaagagguggug

SEQ ID NO: 226481 - RNA, 22 nt, Human
agaaaauuagauuuuacugugu

SEQ ID NO: 226482 - RNA, 22 nt, Human
auguccuugagacccuccucgg

SEQ ID NO: 226483 - RNA, 22 nt, Human
gaacuuuaauuagcuuuugucu

SEQ ID NO: 226484 - RNA, 22 nt, Human
aaucuagaguucccagcauaaa

SEQ ID NO: 226485 - RNA, 22 nt, Human
cuagagaaucuuuuaagaagug

SEQ ID NO: 226486 - RNA, 22 nt, Human
gggcugcuuggaggaggcgcuc

SEQ ID NO: 226487 - RNA, 22 nt, Human
cugggucuggugucaggcgacg

SEQ ID NO: 226488 - RNA, 22 nt, Human
agucagcauuuucacugagcua

SEQ ID NO: 226489 - RNA, 22 nt, Human
uucucuggagaguaucuucuua

SEQ ID NO: 226490 - RNA, 22 nt, Human
ugacaaauauuugaagaggcug

SEQ ID NO: 226491 - RNA, 22 nt, Human
gacugucuccugucaugaggga

SEQ ID NO: 226492 - RNA, 22 nt, Human
gagagggcaaacuuguagcuaa

SEQ ID NO: 226493 - RNA, 22 nt, Human
gaguggagcaaaagagguagau

SEQ ID NO: 226494 - RNA, 22 nt, Human
acagagcaguaagaacacagcu

SEQ ID NO: 226495 - RNA, 22 nt, Human
aguacauauaguaauuuagcca

SEQ ID NO: 226496 - RNA, 22 nt, Human
ugagacaggagaggccccuccu

SEQ ID NO: 226497 - RNA, 23 nt, Human
agaaaaacaggauuguguuccua

SEQ ID NO: 226498 - RNA, 22 nt, Human
uacagaggaggggauuuuaaua

SEQ ID NO: 226499 - RNA, 22 nt, Human
gcaggcugugaggcucagaugg

SEQ ID NO: 226500 - RNA, 22 nt, Human
uucuguuuuagaaauaaguagu

SEQ ID NO: 226501 - RNA, 22 nt, Human
agcaaugcuuauugcugacuau

SEQ ID NO: 226502 - RNA, 22 nt, Human
gauuagaaauguuaccauacag

SEQ ID NO: 226503 - RNA, 22 nt, Human
gaauuccacuuuggcuuuuggg

SEQ ID NO: 226504 - RNA, 22 nt, Human
gucaggagagaucaggacagca

SEQ ID NO: 226505 - RNA, 22 nt, Human
aagaguaaagcaaagcacuugu

SEQ ID NO: 226506 - RNA, 22 nt, Human
uucauauuugaaacagaaguua

SEQ ID NO: 226507 - RNA, 21 nt, Human
ugucacagauucucagcuugc

SEQ ID NO: 226508 - RNA, 22 nt, Human
acauuuugaaagggaaauuguu

SEQ ID NO: 226509 - RNA, 22 nt, Human
uagggaugacuaugauucccac

SEQ ID NO: 226510 - RNA, 22 nt, Human
ugcccagcuauuccuuucuuag

SEQ ID NO: 226511 - RNA, 22 nt, Human
cauguuauuuauccauuaaaca

SEQ ID NO: 226512 - RNA, 22 nt, Human
aguggcagagucaggguuugga

SEQ ID NO: 226513 - RNA, 22 nt, Human
aagaauaaauuaagauacuuag

SEQ ID NO: 226514 - RNA, 22 nt, Human
agaagcuuccuacauuguucuu

SEQ ID NO: 226515 - RNA, 23 nt, Human
ggucagugaguucguuucucugg

SEQ ID NO: 226516 - RNA, 22 nt, Human
uaaggcuaggaauucucugaag

SEQ ID NO: 226517 - RNA, 22 nt, Human
gcauggcuccugucuuacuccc

SEQ ID NO: 226518 - RNA, 22 nt, Human
ugagaucugugcauguuaguua

SEQ ID NO: 226519 - RNA, 22 nt, Human
gggcacuggcagucggggacgc

SEQ ID NO: 226520 - RNA, 22 nt, Human
cagcagguauguuuguucagca

SEQ ID NO: 226521 - RNA, 22 nt, Human
cugccugcuuuucugggagccg

SEQ ID NO: 226522 - RNA, 22 nt, Human
aggucagcaggccaggggcgaa

SEQ ID NO: 226523 - RNA, 22 nt, Human
ugcuuuaaccaucuuguuugga

SEQ ID NO: 226524 - RNA, 22 nt, Human
uauugugccccucccaggaaca

SEQ ID NO: 226525 - RNA, 22 nt, Human
cagagacauuaagugccaugau

SEQ ID NO: 226526 - RNA, 22 nt, Human
gugaccaucagagaauaacaaa

SEQ ID NO: 226527 - RNA, 20 nt, Human
ugggagaagaacacuggaac

SEQ ID NO: 226528 - RNA, 22 nt, Human
cagugcuggaggggugcuugca

SEQ ID NO: 226529 - RNA, 22 nt, Human
cagagccaugguaugggcuugu

SEQ ID NO: 226530 - RNA, 22 nt, Human
ugacagaccacugcaacucugu

SEQ ID NO: 226531 - RNA, 22 nt, Human
ugauucaaauauuguguaugau

SEQ ID NO: 226532 - RNA, 22 nt, Human
cuggcaggucucgcugacgugu

SEQ ID NO: 226533 - RNA, 22 nt, Human
auuucacaucuaucucagauuu

SEQ ID NO: 226534 - RNA, 22 nt, Human
agugugucuuauccugggagaa

SEQ ID NO: 226535 - RNA, 22 nt, Human
gcaagaaaaaggcuucaugaac

SEQ ID NO: 226536 - RNA, 23 nt, Human
ugaaucaauuaugggauucaaug

SEQ ID NO: 226537 - RNA, 18 nt, Human
gaguccaggcucuucacc

SEQ ID NO: 226538 - RNA, 22 nt, Human
auauaguaagcagucuguaaau

SEQ ID NO: 226539 - RNA, 21 nt, Human
uagaaucacuaauaagaugua

SEQ ID NO: 226540 - RNA, 22 nt, Human
agcuguggaagacugucagggu

SEQ ID NO: 226541 - RNA, 22 nt, Human
agcucagguagacucagcaucu

SEQ ID NO: 226542 - RNA, 22 nt, Human
ucccagccuuucuuuucugcug

SEQ ID NO: 226543 - RNA, 22 nt, Human
acuggcagguccaucgcccuuu

SEQ ID NO: 226544 - RNA, 22 nt, Human
cugccugcucuauccaggccug

SEQ ID NO: 226545 - RNA, 22 nt, Human
ggaggcugagaggucgcagugg

SEQ ID NO: 226546 - RNA, 22 nt, Human
acuccaguucucuuguuuauaa

SEQ ID NO: 226547 - RNA, 23 nt, Human
aauaucugcagcuccuggggagg

SEQ ID NO: 226548 - RNA, 22 nt, Human
aguuuguaaaauguggccugga

SEQ ID NO: 226549 - RNA, 22 nt, Human
cugagagaugauauagcuuaau

SEQ ID NO: 226550 - RNA, 22 nt, Human
gccaguggcccucuggagaagg

SEQ ID NO: 226551 - RNA, 22 nt, Human
gucuggacuuuaucccaagguu

SEQ ID NO: 226552 - RNA, 22 nt, Human
uuucucugaggcuggccucccu

SEQ ID NO: 226553 - RNA, 22 nt, Human
aagcauuuuaguaaugaacuug

SEQ ID NO: 226554 - RNA, 17 nt, Human
cccaugagcccacuccc

SEQ ID NO: 226555 - RNA, 22 nt, Human
uacagagaguacagcauccaca

SEQ ID NO: 226556 - RNA, 22 nt, Human
guguaaaaacauacuauuucua

SEQ ID NO: 226557 - RNA, 22 nt, Human
accugcaggcacaggugugcgc

SEQ ID NO: 226558 - RNA, 22 nt, Human
ugucuagacaagaaguauugcc

SEQ ID NO: 226559 - RNA, 22 nt, Human
agccuggcuuagcucucucacu

SEQ ID NO: 226560 - RNA, 22 nt, Human
ucauugcaguugaguuguguua

SEQ ID NO: 226561 - RNA, 22 nt, Human
cacugucuuuugugaagacaau

SEQ ID NO: 226562 - RNA, 22 nt, Human
acagguggucuuugcuccuuuu

SEQ ID NO: 226563 - RNA, 22 nt, Human
cgagcaugaugacggcuguggc

SEQ ID NO: 226564 - RNA, 22 nt, Human
gugccuggcacacagaaggcaa

SEQ ID NO: 226565 - RNA, 22 nt, Human
accagcccucaggucagauacu

SEQ ID NO: 226566 - RNA, 22 nt, Human
guccaggcugcccaggguccug

SEQ ID NO: 226567 - RNA, 20 nt, Human
aaaagagugcuucaacugcu

SEQ ID NO: 226568 - RNA, 22 nt, Human
cauguuaaauugaguuugcaau

SEQ ID NO: 226569 - RNA, 22 nt, Human
gcuugguuucuaacuuuucaua

SEQ ID NO: 226570 - RNA, 22 nt, Human
uggagccagcgagccgaggcgg

SEQ ID NO: 226571 - RNA, 22 nt, Human
caaguuauuccuuuacacuaua

SEQ ID NO: 226572 - RNA, 22 nt, Human
ggccuccaucuuaucuuacucu

SEQ ID NO: 226573 - RNA, 22 nt, Human
ucaugacaggugaguuuuuagg

SEQ ID NO: 226574 - RNA, 22 nt, Human
uuuugaaagggugauuuggcuu

SEQ ID NO: 226575 - RNA, 22 nt, Human
uccuccugccuuugcuucuugu

SEQ ID NO: 226576 - RNA, 22 nt, Human
aggccagcgcugcuagcucccg

SEQ ID NO: 226577 - RNA, 22 nt, Human
gauccacagggcccuggcccag

SEQ ID NO: 226578 - RNA, 22 nt, Human
uugacaggaaaaaguuuaggau

SEQ ID NO: 226579 - RNA, 22 nt, Human
aggcugaggaucccuguguucu

SEQ ID NO: 226580 - RNA, 22 nt, Human
ggacaagccugugaguggguuu

SEQ ID NO: 226581 - RNA, 20 nt, Human
ucugccuuaugaccuucgcc

SEQ ID NO: 226582 - RNA, 22 nt, Human
gcagagcuggaacugguacuca

SEQ ID NO: 226583 - RNA, 22 nt, Human
augaacaaucuguugacuucug

SEQ ID NO: 226584 - RNA, 22 nt, Human
uggagaugaauauguguaccug

SEQ ID NO: 226585 - RNA, 22 nt, Human
ugcaggugcugauaccuacucc

SEQ ID NO: 226586 - RNA, 22 nt, Human
ugcuccuucccuucccagugag

SEQ ID NO: 226587 - RNA, 22 nt, Human
ugcucccagggacucuggcugg

SEQ ID NO: 226588 - RNA, 22 nt, Human
ugcccagaauagaugggcugug

SEQ ID NO: 226589 - RNA, 22 nt, Human
cauggcuuuuagcccuacauga

SEQ ID NO: 226590 - RNA, 22 nt, Human
accuagaaacugacagaauauu

SEQ ID NO: 226591 - RNA, 21 nt, Human
aagagcucuuuuguuaugguc

SEQ ID NO: 226592 - RNA, 22 nt, Human
acagcagagaacuuuagagggu

SEQ ID NO: 226593 - RNA, 22 nt, Human
gucuucuuguguugccugucuu

SEQ ID NO: 226594 - RNA, 22 nt, Human
ggaccacaauauuugugagguu

SEQ ID NO: 226595 - RNA, 22 nt, Human
acaggcaggcgggacagcccga

SEQ ID NO: 226596 - RNA, 19 nt, Human
agcuguggaugugggauuu

SEQ ID NO: 226597 - RNA, 22 nt, Human
cucucaguccugcgcgccucug

SEQ ID NO: 226598 - RNA, 22 nt, Human
agugugaguaauucagggaggg

SEQ ID NO: 226599 - RNA, 21 nt, Human
ucucuuucuggaagcuucccu

SEQ ID NO: 226600 - RNA, 22 nt, Human
ggacuucuggggacuguagauu

SEQ ID NO: 226601 - RNA, 19 nt, Human
cuggcugcaaugccagggu

SEQ ID NO: 226602 - RNA, 22 nt, Human
ccucaggauacaggagccacag

SEQ ID NO: 226603 - RNA, 22 nt, Human
gucacacucuucccuccacaug

SEQ ID NO: 226604 - RNA, 21 nt, Human
uuugaauagaaauagugcuua

SEQ ID NO: 226605 - RNA, 22 nt, Human
aucuguguccuuauaagagaca

SEQ ID NO: 226606 - RNA, 22 nt, Human
ggaaguagaaguaaugaaauca

SEQ ID NO: 226607 - RNA, 22 nt, Human
uccucacagggcaggaaggagg

SEQ ID NO: 226608 - RNA, 22 nt, Human
cagacuuucugacucccuugcc

SEQ ID NO: 226609 - RNA, 22 nt, Human
gagguggguguaucacagguca

SEQ ID NO: 226610 - RNA, 22 nt, Human
ccugacaggcggaggcugcagu

SEQ ID NO: 226611 - RNA, 22 nt, Human
acauucaugcaccuuccuaucc

SEQ ID NO: 226612 - RNA, 22 nt, Human
ccaaauaauauuucagaaccau

SEQ ID NO: 226613 - RNA, 20 nt, Human
auuauucauacaugugugac

SEQ ID NO: 226614 - RNA, 17 nt, Human
ucuucucuuccagucuu

SEQ ID NO: 226615 - RNA, 22 nt, Human
agucaggauaugccuugugggc

SEQ ID NO: 226616 - RNA, 23 nt, Human
gguauucauucauuuaugcuaag

SEQ ID NO: 226617 - RNA, 22 nt, Human
gaggucugggauggggccugaa

SEQ ID NO: 226618 - RNA, 22 nt, Human
gaucugguacaggccugcagcc

SEQ ID NO: 226619 - RNA, 22 nt, Human
uuacaguuuaagaggaaacaaa

SEQ ID NO: 226620 - RNA, 22 nt, Human
auucuguuacuuggugaucuuc

SEQ ID NO: 226621 - RNA, 22 nt, Human
uuauucugcacuuuuaaaauau

SEQ ID NO: 226622 - RNA, 22 nt, Human
cagcccaggacugcagguguuu

SEQ ID NO: 226623 - RNA, 22 nt, Human
gagugcaguaucuucugugucc

SEQ ID NO: 226624 - RNA, 22 nt, Human
aaccuggcugcaaagaagggga

SEQ ID NO: 226625 - RNA, 22 nt, Human
gggaggagugaagauucaccug

SEQ ID NO: 226626 - RNA, 22 nt, Human
ucauuguuucugcuuuucauga

SEQ ID NO: 226627 - RNA, 22 nt, Human
guguccugggcauuaggcuuag

SEQ ID NO: 226628 - RNA, 22 nt, Human
agagcugagaauguggcuuccu

SEQ ID NO: 226629 - RNA, 22 nt, Human
ucaagauguccagugccuauaa

SEQ ID NO: 226630 - RNA, 22 nt, Human
agaucccaaaucaccugcuuau

SEQ ID NO: 226631 - RNA, 22 nt, Human
gcugggaggaauuuggggaaua

SEQ ID NO: 226632 - RNA, 22 nt, Human
ugccuacuaguacuauuuugug

SEQ ID NO: 226633 - RNA, 22 nt, Human
aaauuuuagacuccugggucua

SEQ ID NO: 226634 - RNA, 22 nt, Human
ucugaaauacugcagguucucu

SEQ ID NO: 226635 - RNA, 22 nt, Human
uuauucuuuaaacauauauguu

SEQ ID NO: 226636 - RNA, 22 nt, Human
acuccuguguggcugggagguu

SEQ ID NO: 226637 - RNA, 22 nt, Human
aaaggcuucagugaguggguau

SEQ ID NO: 226638 - RNA, 22 nt, Human
uugauucauuuauugagugccu

SEQ ID NO: 226639 - RNA, 22 nt, Human
acacuuauuuuuguccacuucc

SEQ ID NO: 226640 - RNA, 20 nt, Human
ccaccuggccaaggcugugc

SEQ ID NO: 226641 - RNA, 22 nt, Human
uacacauacaccaaugugguca

SEQ ID NO: 226642 - RNA, 23 nt, Human
uugaggagcagcgcuuuuuaccg

SEQ ID NO: 226643 - RNA, 22 nt, Human
acugucuuccaggucuggaggu

SEQ ID NO: 226644 - RNA, 22 nt, Human
uagggauggaaacccguuuucu

SEQ ID NO: 226645 - RNA, 22 nt, Human
aaacucuauuucuguuggcuua

SEQ ID NO: 226646 - RNA, 22 nt, Human
ucuccaggagcaagucacccag

SEQ ID NO: 226647 - RNA, 22 nt, Human
uuguguccuaacaucuaguuaa

SEQ ID NO: 226648 - RNA, 22 nt, Human
uguucuuugcuguugauguaga

SEQ ID NO: 226649 - RNA, 22 nt, Human
ucucugaagagucagacauaac

SEQ ID NO: 226650 - RNA, 21 nt, Human
ccuucuccauuacaguaagcu

SEQ ID NO: 226651 - RNA, 22 nt, Human
ugaaaucuucacuaagucucuu

SEQ ID NO: 226652 - RNA, 22 nt, Human
aaagacuagcauuuauauguac

SEQ ID NO: 226653 - RNA, 22 nt, Human
aaaagucucucugaguaaaagu

SEQ ID NO: 226654 - RNA, 22 nt, Human
aggcuguauguuuccauuugaa

SEQ ID NO: 226655 - RNA, 22 nt, Human
aaaagagucuuaggcagucaua

SEQ ID NO: 226656 - RNA, 20 nt, Human
ucugugcauugccugcuggu

SEQ ID NO: 226657 - RNA, 22 nt, Human
agcugcagaaaggacaacuaau

SEQ ID NO: 226658 - RNA, 22 nt, Human
uucuauguucuaagucucaagg

SEQ ID NO: 226659 - RNA, 22 nt, Human
gugcacaggugggaaaaugagu

SEQ ID NO: 226660 - RNA, 22 nt, Human
cuguccuggccgcccuugugag

SEQ ID NO: 226661 - RNA, 22 nt, Human
uauguacaaucagcaguucaua

SEQ ID NO: 226662 - RNA, 23 nt, Human
ugcagcugccucuggcgggccgg

SEQ ID NO: 226663 - RNA, 22 nt, Human
cugccucagcguuguggcccua

SEQ ID NO: 226664 - RNA, 22 nt, Human
gggguuaacaguauugcucaug

SEQ ID NO: 226665 - RNA, 22 nt, Human
ucacuaagugccgaguuuaguu

SEQ ID NO: 226666 - RNA, 22 nt, Human
auugguuaacucugugugucaa

SEQ ID NO: 226667 - RNA, 22 nt, Human
uugauacaggcucuauuucauc

SEQ ID NO: 226668 - RNA, 22 nt, Human
uauugcacaugcgcuagaacca

SEQ ID NO: 226669 - RNA, 22 nt, Human
uugagacuccugguguagaaua

SEQ ID NO: 226670 - RNA, 22 nt, Human
ccuggcagcccagagcgccgcu

SEQ ID NO: 226671 - RNA, 22 nt, Human
caaaaguucucacccagacaug

SEQ ID NO: 226672 - RNA, 17 nt, Human
agcuccuggggucuuua

SEQ ID NO: 226673 - RNA, 22 nt, Human
uccuucuggaggcucuaagggg

SEQ ID NO: 226674 - RNA, 22 nt, Human
agggccuccagggcagcagugg

SEQ ID NO: 226675 - RNA, 22 nt, Human
uggguccuuuuuggacuucuuc

SEQ ID NO: 226676 - RNA, 22 nt, Human
aauggaauaccuagguggccca

SEQ ID NO: 226677 - RNA, 22 nt, Human
aaggccagagcagacuggaguu

SEQ ID NO: 226678 - RNA, 22 nt, Human
uuguagcuagguuuuuguagaa

SEQ ID NO: 226679 - RNA, 22 nt, Human
agcuggcucagccggguggucu

SEQ ID NO: 226680 - RNA, 22 nt, Human
gauccagcuucuacacagagcu

SEQ ID NO: 226681 - RNA, 22 nt, Human
agccucagcacgcagcucugug

SEQ ID NO: 226682 - RNA, 22 nt, Human
ccagaggcuggcaagggcuccu

SEQ ID NO: 226683 - RNA, 22 nt, Human
uagaaccuauuagaaauguauu

SEQ ID NO: 226684 - RNA, 22 nt, Human
gaaucucaggaagaucucugca

SEQ ID NO: 226685 - RNA, 22 nt, Human
cuuagaaagaguuuucuccccu

SEQ ID NO: 226686 - RNA, 20 nt, Human
aacacaggguuaccaucaga

SEQ ID NO: 226687 - RNA, 22 nt, Human
uuucugugguggguaguucaga

SEQ ID NO: 226688 - RNA, 22 nt, Human
aucagcaaguccuguuaauucu

SEQ ID NO: 226689 - RNA, 22 nt, Human
auacaguagacaaucucaugaa

SEQ ID NO: 226690 - RNA, 22 nt, Human
cauggcucacaggaugggcuag

SEQ ID NO: 226691 - RNA, 22 nt, Human
ugggccacgugacccuuacccu

SEQ ID NO: 226692 - RNA, 22 nt, Human
ccucuggcaagugauuuaucau

SEQ ID NO: 226693 - RNA, 22 nt, Human
cuuaagaauauugaaguugugg

SEQ ID NO: 226694 - RNA, 22 nt, Human
gugcuucugccaacuaauuaac

SEQ ID NO: 226695 - RNA, 17 nt, Human
ccugccugagccauagc

SEQ ID NO: 226696 - RNA, 22 nt, Human
uccaguguugucagaucaucug

SEQ ID NO: 226697 - RNA, 21 nt, Human
gaaggcuucugccuggaggag

SEQ ID NO: 226698 - RNA, 22 nt, Human
agugucuuugucucucaagcac

SEQ ID NO: 226699 - RNA, 22 nt, Human
uucacaaaaaugcugaacaguu

SEQ ID NO: 226700 - RNA, 22 nt, Human
agugucugagcuaucauuaggg

SEQ ID NO: 226701 - RNA, 22 nt, Human
caggcugcaagaaaggcauuca

SEQ ID NO: 226702 - RNA, 22 nt, Human
acugucuguccugcucuccgug

SEQ ID NO: 226703 - RNA, 22 nt, Human
gcaguggggaaugcuggggaga

SEQ ID NO: 226704 - RNA, 22 nt, Human
ucugcaccuccugcuugcuaga

SEQ ID NO: 226705 - RNA, 22 nt, Human
uucuuuuaauugugggggagug

SEQ ID NO: 226706 - RNA, 22 nt, Human
guaaagaaggcaaccugguuau

SEQ ID NO: 226707 - RNA, 22 nt, Human
cuuccugcccacuuccugcugg

SEQ ID NO: 226708 - RNA, 22 nt, Human
uucuccagagggcucugcagga

SEQ ID NO: 226709 - RNA, 22 nt, Human
ugucaguucagugauuacaaaa

SEQ ID NO: 226710 - RNA, 23 nt, Human
cacaaagguuccauucucucacc

SEQ ID NO: 226711 - RNA, 22 nt, Human
gcauuauuaauagcugcaugag

SEQ ID NO: 226712 - RNA, 22 nt, Human
aucgugcauuuuuauuaacccu

SEQ ID NO: 226713 - RNA, 22 nt, Human
uaguaugggaagaacuuuguag

SEQ ID NO: 226714 - RNA, 22 nt, Human
gugcccucaugaaacgaaggau

SEQ ID NO: 226715 - RNA, 22 nt, Human
cauuuguaucugggcugcugug

SEQ ID NO: 226716 - RNA, 22 nt, Human
gguccuggaaauugacggaaag

SEQ ID NO: 226717 - RNA, 22 nt, Human
gugggcugcccuugaggucagc

SEQ ID NO: 226718 - RNA, 22 nt, Human
uccaggcugacgcagcuauuua

SEQ ID NO: 226719 - RNA, 22 nt, Human
uguacagauugaucauggagag

SEQ ID NO: 226720 - RNA, 22 nt, Human
gggcagguuggcaucccgggca

SEQ ID NO: 226721 - RNA, 22 nt, Human
ugaaauguacaagugcuuuuuu

SEQ ID NO: 226722 - RNA, 22 nt, Human
aagaugaagaacaugagcacac

SEQ ID NO: 226723 - RNA, 22 nt, Human
uauuuaguuaucuuucauaaaa

SEQ ID NO: 226724 - RNA, 22 nt, Human
aagcugaggucaaguagcuagu

SEQ ID NO: 226725 - RNA, 22 nt, Human
uagaaaugucgucuccacauuu

SEQ ID NO: 226726 - RNA, 22 nt, Human
guagacagguuauaaaucagug

SEQ ID NO: 226727 - RNA, 22 nt, Human
aagaauaaguagaugggagaag

SEQ ID NO: 226728 - RNA, 22 nt, Human
cagcaaggacugggcaugugaa

SEQ ID NO: 226729 - RNA, 22 nt, Human
ucucuuauuuugccuuugacaa

SEQ ID NO: 226730 - RNA, 22 nt, Human
gccuggagaagauggaacuagc

SEQ ID NO: 226731 - RNA, 22 nt, Human
aaauccuaauaaugcacuagug

SEQ ID NO: 226732 - RNA, 22 nt, Human
acaagcuguggugggacaagag

SEQ ID NO: 226733 - RNA, 22 nt, Human
ugucuccacaggugucagcuca

SEQ ID NO: 226734 - RNA, 18 nt, Human
gcuuggcugcagagagag

SEQ ID NO: 226735 - RNA, 22 nt, Human
ugccucugcugcuguggcauca

SEQ ID NO: 226736 - RNA, 15 nt, Human
ucugggcugugagca

SEQ ID NO: 226737 - RNA, 22 nt, Human
auuuauugaacacugacuaugu

SEQ ID NO: 226738 - RNA, 22 nt, Human
gcaugugucccucagucugugc

SEQ ID NO: 226739 - RNA, 22 nt, Human
cuggcucaccuccgcuccagca

SEQ ID NO: 226740 - RNA, 22 nt, Human
aggcaauuguuuguguaauagg

SEQ ID NO: 226741 - RNA, 22 nt, Human
aagacauugucauuuuauaauu

SEQ ID NO: 226742 - RNA, 22 nt, Human
gaauuauaaacuagugacuuca

SEQ ID NO: 226743 - RNA, 22 nt, Human
gcacagcaguggcauaaacaau

SEQ ID NO: 226744 - RNA, 22 nt, Human
cccaggcuaguaugauaucagu

SEQ ID NO: 226745 - RNA, 22 nt, Human
agaggccagaaaguaugccacc

SEQ ID NO: 226746 - RNA, 22 nt, Human
gaaauugugcauuuagcaacac

SEQ ID NO: 226747 - RNA, 22 nt, Human
gcugccuucuggaggaagugaa

SEQ ID NO: 226748 - RNA, 22 nt, Human
aggcuucacgaugggugaggug

SEQ ID NO: 226749 - RNA, 22 nt, Human
uacaaugugugcuucuugucac

SEQ ID NO: 226750 - RNA, 18 nt, Human
ggaaguuuggguccccug

SEQ ID NO: 226751 - RNA, 22 nt, Human
uuacaagauaaccugaugcugu

SEQ ID NO: 226752 - RNA, 22 nt, Human
uauuauugaaucaguucuuuga

SEQ ID NO: 226753 - RNA, 22 nt, Human
ucuggcuucaguaggguucacu

SEQ ID NO: 226754 - RNA, 22 nt, Human
ucacaggcuccagggccuggau

SEQ ID NO: 226755 - RNA, 22 nt, Human
ucagaggagggacucagaccca

SEQ ID NO: 226756 - RNA, 22 nt, Human
gcugggcucauuugugugucug

SEQ ID NO: 226757 - RNA, 22 nt, Human
cauaauuuuuuuaagucagaac

SEQ ID NO: 226758 - RNA, 22 nt, Human
agagcuggauggucaagauggc

SEQ ID NO: 226759 - RNA, 22 nt, Human
agguucuugacucuaccuucca

SEQ ID NO: 226760 - RNA, 22 nt, Human
ggucagugcgauuucccacucc

SEQ ID NO: 226761 - RNA, 22 nt, Human
auuuagagugaaacauuaugca

SEQ ID NO: 226762 - RNA, 22 nt, Human
ugagguggccgaggagcaggac

SEQ ID NO: 226763 - RNA, 22 nt, Human
uugccaggggacaucuggagcc

SEQ ID NO: 226764 - RNA, 22 nt, Human
cagcccugcuggcaaugaugag

SEQ ID NO: 226765 - RNA, 22 nt, Human
cugcugucgccgagcugcaugc

SEQ ID NO: 226766 - RNA, 22 nt, Human
ucaggcugcccguucagggcuc

SEQ ID NO: 226767 - RNA, 22 nt, Human
cuggccuggcagggagggcaug

SEQ ID NO: 226768 - RNA, 22 nt, Human
gaacagcauguaagaagcuacu

SEQ ID NO: 226769 - RNA, 22 nt, Human
aacacugucuuauacuucaaug

SEQ ID NO: 226770 - RNA, 20 nt, Human
ggagaugcagcccaggugcc

SEQ ID NO: 226771 - RNA, 17 nt, Human
cuacuucuucuauucuu

SEQ ID NO: 226772 - RNA, 22 nt, Human
uaaacagagugcuaguucacgg

SEQ ID NO: 226773 - RNA, 22 nt, Human
acaaaccagcuuaagcaagaug

SEQ ID NO: 226774 - RNA, 22 nt, Human
gucuccuaaaccauccugguac

SEQ ID NO: 226775 - RNA, 22 nt, Human
uuccaggaggagguacuagagg

SEQ ID NO: 226776 - RNA, 20 nt, Human
aacugccugcccagaggugg

SEQ ID NO: 226777 - RNA, 22 nt, Human
gcucucugguuccagucaggaa

SEQ ID NO: 226778 - RNA, 22 nt, Human
uuuggaauucugcagcucaugu

SEQ ID NO: 226779 - RNA, 22 nt, Human
acuggcugaggaaguugccacu

SEQ ID NO: 226780 - RNA, 22 nt, Human
cuuagggaauugggaggaugcc

SEQ ID NO: 226781 - RNA, 22 nt, Human
gacagacaggaggcauucaggg

SEQ ID NO: 226782 - RNA, 22 nt, Human
acagugaaugagaauggagaaa

SEQ ID NO: 226783 - RNA, 19 nt, Human
agugagcauggcuugacug

SEQ ID NO: 226784 - RNA, 22 nt, Human
ucuuccaagguugcacacuauc

SEQ ID NO: 226785 - RNA, 22 nt, Human
uucuagaaccaugacuucaggg

SEQ ID NO: 226786 - RNA, 22 nt, Human
ccaggcuuucccagccucucca

SEQ ID NO: 226787 - RNA, 22 nt, Human
uccauuuucaucucauguauaa

SEQ ID NO: 226788 - RNA, 22 nt, Human
ucucaggaauagaguggcagca

SEQ ID NO: 226789 - RNA, 22 nt, Human
uagcaagaaaacacaagaauua

SEQ ID NO: 226790 - RNA, 22 nt, Human
agccuccaguagcugaagagac

SEQ ID NO: 226791 - RNA, 22 nt, Human
aaagccuuugucucaggcucug

SEQ ID NO: 226792 - RNA, 23 nt, Human
cugggccuauggucugaauccaa

SEQ ID NO: 226793 - RNA, 22 nt, Human
gcugaaaucccagcauucccca

SEQ ID NO: 226794 - RNA, 22 nt, Human
gccuacuuaguagcugggauua

SEQ ID NO: 226795 - RNA, 20 nt, Human
ugcaggaauuugcauuccuu

SEQ ID NO: 226796 - RNA, 22 nt, Human
uagcaaaagccacgauuacuuu

SEQ ID NO: 226797 - RNA, 22 nt, Human
cuccccuuuggaagaagggucu

SEQ ID NO: 226798 - RNA, 22 nt, Human
uuagaaaaaggcuguggucuua

SEQ ID NO: 226799 - RNA, 22 nt, Human
uacagaggagaccaaggcucag

SEQ ID NO: 226800 - RNA, 22 nt, Human
agcugaaauucuuuguccucag

SEQ ID NO: 226801 - RNA, 22 nt, Human
acagugcaaacuuuugucuccu

SEQ ID NO: 226802 - RNA, 22 nt, Human
cauuagggucucucagcugaau

SEQ ID NO: 226803 - RNA, 22 nt, Human
aagaacuuuaaagcacuuauga

SEQ ID NO: 226804 - RNA, 22 nt, Human
gccugcugaagccagagugugu

SEQ ID NO: 226805 - RNA, 22 nt, Human
ggaaggaaguaaaugaugcuau

SEQ ID NO: 226806 - RNA, 22 nt, Human
agauggucuuuugaguaaugaa

SEQ ID NO: 226807 - RNA, 22 nt, Human
acucaguuaucauguguccaca

SEQ ID NO: 226808 - RNA, 22 nt, Human
acuuugaaacuaaaauucauua

SEQ ID NO: 226809 - RNA, 22 nt, Human
ucaacaguggcaaagaggcacg

SEQ ID NO: 226810 - RNA, 22 nt, Human
cuaguuuaaagcagcugaaagg

SEQ ID NO: 226811 - RNA, 22 nt, Human
uggauuuauuagguuggugaaa

SEQ ID NO: 226812 - RNA, 22 nt, Human
acauuucuuccuaauuaucccu

SEQ ID NO: 226813 - RNA, 22 nt, Human
aagcagccuggcaugaugcuuu

SEQ ID NO: 226814 - RNA, 22 nt, Human
guuguuuuaaaauacuccagaa

SEQ ID NO: 226815 - RNA, 22 nt, Human
auuuauuaugggauuuggcuca

SEQ ID NO: 226816 - RNA, 22 nt, Human
gauguacaagauuguaggaaug

SEQ ID NO: 226817 - RNA, 22 nt, Human
uuuggccuuaguccagaagaag

SEQ ID NO: 226818 - RNA, 22 nt, Human
gcucuagaucauaggucauuau

SEQ ID NO: 226819 - RNA, 22 nt, Human
aacuggugagauaaauuauuua

SEQ ID NO: 226820 - RNA, 22 nt, Human
gccuccuggaagucacauguuu

SEQ ID NO: 226821 - RNA, 20 nt, Human
ugcacagcugugaauaggau

SEQ ID NO: 226822 - RNA, 22 nt, Human
gugcacccccaaggagguggag

SEQ ID NO: 226823 - RNA, 22 nt, Human
gcagcccaggcucgcucacugc

SEQ ID NO: 226824 - RNA, 20 nt, Human
ccagcauguacacaugugga

SEQ ID NO: 226825 - RNA, 22 nt, Human
ggcugcucuccaucccaggccu

SEQ ID NO: 226826 - RNA, 22 nt, Human
gucuggaagugucuuguuaagu

SEQ ID NO: 226827 - RNA, 22 nt, Human
uuccuggcuucauacuuuguac

SEQ ID NO: 226828 - RNA, 22 nt, Human
cuacauuucauccagggagagc

SEQ ID NO: 226829 - RNA, 22 nt, Human
gugcugaggugggugggcagcc

SEQ ID NO: 226830 - RNA, 22 nt, Human
cagguggcuuauuagggucagu

SEQ ID NO: 226831 - RNA, 22 nt, Human
cacugagguaucugucucuccu

SEQ ID NO: 226832 - RNA, 22 nt, Human
agguuucuuuaugcugcuagaa

SEQ ID NO: 226833 - RNA, 22 nt, Human
ccugggaagcccauagcagcuu

SEQ ID NO: 226834 - RNA, 22 nt, Human
uggaugcugcugucagggaugg

SEQ ID NO: 226835 - RNA, 22 nt, Human
agaggaauguauuucccugcaa

SEQ ID NO: 226836 - RNA, 22 nt, Human
uuagcagcuaaacugacagacc

SEQ ID NO: 226837 - RNA, 22 nt, Human
aguggagacaggacagucgaua

SEQ ID NO: 226838 - RNA, 22 nt, Human
aaaaccagguagcaaaggagac

SEQ ID NO: 226839 - RNA, 22 nt, Human
caggagaccugguaagccaagu

SEQ ID NO: 226840 - RNA, 21 nt, Human
caauaaacugcacauugagac

SEQ ID NO: 226841 - RNA, 22 nt, Human
cgucccaguuccagccgcgcug

SEQ ID NO: 226842 - RNA, 22 nt, Human
gcccuagcgccagcucagcacc

SEQ ID NO: 226843 - RNA, 22 nt, Human
cugccaggccuccgcugucccc

SEQ ID NO: 226844 - RNA, 22 nt, Human
cugcugugcaacauugcaccua

SEQ ID NO: 226845 - RNA, 22 nt, Human
uggcuucucaaaauaacugguu

SEQ ID NO: 226846 - RNA, 22 nt, Human
uuuaguucacaccaggguagca

SEQ ID NO: 226847 - RNA, 22 nt, Human
ucacaucacuagcugguaauga

SEQ ID NO: 226848 - RNA, 22 nt, Human
ugguccuguagcacuugauuag

SEQ ID NO: 226849 - RNA, 22 nt, Human
uuugacucauugauuuucucug

SEQ ID NO: 226850 - RNA, 22 nt, Human
ugcaggucauguggcgggacug

SEQ ID NO: 226851 - RNA, 22 nt, Human
caguaaaugcagauauagauac

SEQ ID NO: 226852 - RNA, 22 nt, Human
ccaggccuguguuguguggagg

SEQ ID NO: 226853 - RNA, 22 nt, Human
ugaaagcuuguuggaaauguag

SEQ ID NO: 226854 - RNA, 22 nt, Human
ggaaaaauagaguauacuuuaa

SEQ ID NO: 226855 - RNA, 22 nt, Human
cccugggcaagcccuauuuucc

SEQ ID NO: 226856 - RNA, 23 nt, Human
uuguacagcccagauuccucuuc

SEQ ID NO: 226857 - RNA, 22 nt, Human
aauuacaaauguagacucucau

SEQ ID NO: 226858 - RNA, 22 nt, Human
gaaaaggcugcccacuuauuga

SEQ ID NO: 226859 - RNA, 22 nt, Human
aggccucagccugccaggccug

SEQ ID NO: 226860 - RNA, 19 nt, Human
uaagacacaaaugcaagcc

SEQ ID NO: 226861 - RNA, 22 nt, Human
aggauccuuuuucugcuguuug

SEQ ID NO: 226862 - RNA, 22 nt, Human
cuccagggcagcauggcagugg

SEQ ID NO: 226863 - RNA, 22 nt, Human
ugggaagaggcgggaggcuguu

SEQ ID NO: 226864 - RNA, 22 nt, Human
uaggugucuuguguaugguaca

SEQ ID NO: 226865 - RNA, 22 nt, Human
auggaguggggacugcagugga

SEQ ID NO: 226866 - RNA, 22 nt, Human
accuucaacucaaaguguccca

SEQ ID NO: 226867 - RNA, 22 nt, Human
gcuacaggugacagccucugca

SEQ ID NO: 226868 - RNA, 22 nt, Human
ccugggcucugucagaauuggg

SEQ ID NO: 226869 - RNA, 22 nt, Human
cuguuaaaugagaaagcagacu

SEQ ID NO: 226870 - RNA, 16 nt, Human
uccuggccuuuggaag

SEQ ID NO: 226871 - RNA, 22 nt, Human
guccagagagaucuucugauag

SEQ ID NO: 226872 - RNA, 22 nt, Human
uuacauauugucuauuguucaa

SEQ ID NO: 226873 - RNA, 22 nt, Human
ccaagcugccugaggcaaauuu

SEQ ID NO: 226874 - RNA, 22 nt, Human
gagcagggagacaacucuggug

SEQ ID NO: 226875 - RNA, 22 nt, Human
caaggcagaauucagacucagg

SEQ ID NO: 226876 - RNA, 22 nt, Human
ugaagcaguucucagaaguggg

SEQ ID NO: 226877 - RNA, 22 nt, Human
acuggcagagguuggacaccau

SEQ ID NO: 226878 - RNA, 22 nt, Human
ccaggcuggucugaauuucuag

SEQ ID NO: 226879 - RNA, 22 nt, Human
gcauucaggaaccggaagggua

SEQ ID NO: 226880 - RNA, 22 nt, Human
ucaagacaucacugugcauuuu

SEQ ID NO: 226881 - RNA, 22 nt, Human
uccagccccgggauguucuuca

SEQ ID NO: 226882 - RNA, 22 nt, Human
cuuuccaacucuagugaaauuu

SEQ ID NO: 226883 - RNA, 22 nt, Human
uggcagucugccucuucaccau

SEQ ID NO: 226884 - RNA, 22 nt, Human
gagccagcugagcugcacuguc

SEQ ID NO: 226885 - RNA, 19 nt, Human
ucauugaacauaauuacuu

SEQ ID NO: 226886 - RNA, 22 nt, Human
gagcuccacuuagcaaggccac

SEQ ID NO: 226887 - RNA, 22 nt, Human
gccagagguaucaaagauagua

SEQ ID NO: 226888 - RNA, 22 nt, Human
ucuagaauuuugccauauagcu

SEQ ID NO: 226889 - RNA, 19 nt, Human
gacauuccugacacuggcu

SEQ ID NO: 226890 - RNA, 22 nt, Human
ugggcucugaagucagucugcu

SEQ ID NO: 226891 - RNA, 22 nt, Human
gacuuucucuccucccaggugu

SEQ ID NO: 226892 - RNA, 22 nt, Human
ucugagagccacugaacagcaa

SEQ ID NO: 226893 - RNA, 22 nt, Human
uauguacaucguugaauucaaa

SEQ ID NO: 226894 - RNA, 22 nt, Human
uugcuaauaaaguuuuuaugug

SEQ ID NO: 226895 - RNA, 22 nt, Human
cucaguuuuuuuaagagccaug

SEQ ID NO: 226896 - RNA, 22 nt, Human
aggcuucagaaagaguaauugg

SEQ ID NO: 226897 - RNA, 22 nt, Human
uggguaggaaucgaguguaugg

SEQ ID NO: 226898 - RNA, 22 nt, Human
uuuauaucuggaguugcuagga

SEQ ID NO: 226899 - RNA, 22 nt, Human
uggggagagauugaggaguuuu

SEQ ID NO: 226900 - RNA, 22 nt, Human
ucuuccugcuuggugugucugg

SEQ ID NO: 226901 - RNA, 22 nt, Human
uggagcagaguucagcggggag

SEQ ID NO: 226902 - RNA, 22 nt, Human
uuguauuugauugucauaucgu

SEQ ID NO: 226903 - RNA, 22 nt, Human
auuaguguacaucucacacgca

SEQ ID NO: 226904 - RNA, 22 nt, Human
uucaggauccccuugaugggcu

SEQ ID NO: 226905 - RNA, 19 nt, Human
gcaggcuugggucucccca

SEQ ID NO: 226906 - RNA, 18 nt, Human
uucggcagauacgcuugg

SEQ ID NO: 226907 - RNA, 22 nt, Human
ucugccccugcugggcacagag

SEQ ID NO: 226908 - RNA, 22 nt, Human
auguuaaauaaucccuuaaagc

SEQ ID NO: 226909 - RNA, 19 nt, Human
uuucuguuugcuucugguu

SEQ ID NO: 226910 - RNA, 22 nt, Human
aagugcuuggcuaaugguuaug

SEQ ID NO: 226911 - RNA, 22 nt, Human
caucuuugaacucuguauaaac

SEQ ID NO: 226912 - RNA, 22 nt, Human
auuuucacccugaauauauuga

SEQ ID NO: 226913 - RNA, 22 nt, Human
ugauggucaacaauuuugagug

SEQ ID NO: 226914 - RNA, 22 nt, Human
ucugggggcgaccagggacugc

SEQ ID NO: 226915 - RNA, 22 nt, Human
caguuauaggagccauuguaua

SEQ ID NO: 226916 - RNA, 22 nt, Human
caugaguucaucugcuucucuu

SEQ ID NO: 226917 - RNA, 22 nt, Human
uuugaaaguccuaggagagucc

SEQ ID NO: 226918 - RNA, 22 nt, Human
agaggcagcagucauacuacag

SEQ ID NO: 226919 - RNA, 22 nt, Human
uuuaucugaccucacuucuuaa

SEQ ID NO: 226920 - RNA, 21 nt, Human
uacuguagccuugcacuguag

SEQ ID NO: 226921 - RNA, 22 nt, Human
uucacaagucauuagcugcaua

SEQ ID NO: 226922 - RNA, 22 nt, Human
gucaggggaugugcugguggcc

SEQ ID NO: 226923 - RNA, 22 nt, Human
auuugcaaagucguaucuguga

SEQ ID NO: 226924 - RNA, 22 nt, Human
auuuggaaaugcaucucuugag

SEQ ID NO: 226925 - RNA, 22 nt, Human
gcuccccuugguccuccuggga

SEQ ID NO: 226926 - RNA, 22 nt, Human
cacuuucucaugaauuuggccc

SEQ ID NO: 226927 - RNA, 22 nt, Human
uuagacaucagugcuucucagc

SEQ ID NO: 226928 - RNA, 22 nt, Human
agcagagcauggugggaagggc

SEQ ID NO: 226929 - RNA, 22 nt, Human
caaagacugcauaacacaugaa

SEQ ID NO: 226930 - RNA, 22 nt, Human
uggucugggcaaauccuucuga

SEQ ID NO: 226931 - RNA, 22 nt, Human
ccucagaguuggaaucacauuu

SEQ ID NO: 226932 - RNA, 22 nt, Human
ccuccuggugacaaggcaaagc

SEQ ID NO: 226933 - RNA, 22 nt, Human
acugaauuuuaauuagaucugc

SEQ ID NO: 226934 - RNA, 22 nt, Human
cagagucaugggccgucaggca

SEQ ID NO: 226935 - RNA, 22 nt, Human
cuucugugaagagcagaaccau

SEQ ID NO: 226936 - RNA, 22 nt, Human
ccaggaaggcguuguuccucuc

SEQ ID NO: 226937 - RNA, 23 nt, Human
uccagcucccuucaauggcacug

SEQ ID NO: 226938 - RNA, 22 nt, Human
gcaagcugcucuuauguggagg

SEQ ID NO: 226939 - RNA, 22 nt, Human
agcaccagagcuaugggccugc

SEQ ID NO: 226940 - RNA, 22 nt, Human
agcugcaggcccaugcucaguc

SEQ ID NO: 226941 - RNA, 22 nt, Human
cagggugugaacaguguaaaac

SEQ ID NO: 226942 - RNA, 22 nt, Human
ugucucaguacacuccgauguu

SEQ ID NO: 226943 - RNA, 22 nt, Human
aauggagacccuaaggaagagg

SEQ ID NO: 226944 - RNA, 22 nt, Human
agacacaguacuugcccucaug

SEQ ID NO: 226945 - RNA, 22 nt, Human
aggaccugacauuguguuuucu

SEQ ID NO: 226946 - RNA, 22 nt, Human
ucuccccuacucuaaaucugca

SEQ ID NO: 226947 - RNA, 22 nt, Human
aggcagcaugggccccagcucc

SEQ ID NO: 226948 - RNA, 22 nt, Human
ccaggcugggcuacaaguugag

SEQ ID NO: 226949 - RNA, 22 nt, Human
gaaggggaguggcuagugugug

SEQ ID NO: 226950 - RNA, 22 nt, Human
augaacaauaaucaugucuaug

SEQ ID NO: 226951 - RNA, 22 nt, Human
aucaaugcuugccaaauggaag

SEQ ID NO: 226952 - RNA, 22 nt, Human
aaaacuccugaaauuguuuccc

SEQ ID NO: 226953 - RNA, 21 nt, Human
acuuuaauauacaugaggagg

SEQ ID NO: 226954 - RNA, 22 nt, Human
aggcagcauuucugcuuaucca

SEQ ID NO: 226955 - RNA, 18 nt, Human
aggcaggauccuggccuc

SEQ ID NO: 226956 - RNA, 22 nt, Human
agaugaauccacacauggcaaa

SEQ ID NO: 226957 - RNA, 23 nt, Human
ccaccuggacucugggcaggugc

SEQ ID NO: 226958 - RNA, 17 nt, Human
gcaaccagcccccaucu

SEQ ID NO: 226959 - RNA, 22 nt, Human
cccuccagcucaaagcaaccgg

SEQ ID NO: 226960 - RNA, 22 nt, Human
uucugauugcugaugaggccca

SEQ ID NO: 226961 - RNA, 22 nt, Human
agaggugggagccuggucacau

SEQ ID NO: 226962 - RNA, 22 nt, Human
cagcuucugcucauggaggggu

SEQ ID NO: 226963 - RNA, 22 nt, Human
uaguuaggaauagcagcgacuc

SEQ ID NO: 226964 - RNA, 23 nt, Human
gcaugaagugcuacgucuacagc

SEQ ID NO: 226965 - RNA, 22 nt, Human
uccuucaagaugccacagcuuu

SEQ ID NO: 226966 - RNA, 22 nt, Human
aguccuggcucuacgggcuuca

SEQ ID NO: 226967 - RNA, 22 nt, Human
ugaggcacugggagagcacacu

SEQ ID NO: 226968 - RNA, 22 nt, Human
aaggaagguucauagucaaaga

SEQ ID NO: 226969 - RNA, 22 nt, Human
agacaggcuuggaaaaaaccuc

SEQ ID NO: 226970 - RNA, 22 nt, Human
uuuaauguuaaauuuguagaug

SEQ ID NO: 226971 - RNA, 22 nt, Human
ugggcugcccugaugguccuca

SEQ ID NO: 226972 - RNA, 22 nt, Human
gugcaaaaguaaaugugguuuu

SEQ ID NO: 226973 - RNA, 22 nt, Human
ccaggaggucugaguguggaca

SEQ ID NO: 226974 - RNA, 22 nt, Human
ugcccugcaugcagggagcugu

SEQ ID NO: 226975 - RNA, 22 nt, Human
uccuuccaugguggggcugcuu

SEQ ID NO: 226976 - RNA, 15 nt, Human
gcucuggguauuuga

SEQ ID NO: 226977 - RNA, 22 nt, Human
aaaaaugaauucuucaguggca

SEQ ID NO: 226978 - RNA, 22 nt, Human
uaagaguuagggcuagcaauau

SEQ ID NO: 226979 - RNA, 22 nt, Human
guauuuuauggcaugcaguggc

SEQ ID NO: 226980 - RNA, 22 nt, Human
uuagcaauaugaaugcauuugc

SEQ ID NO: 226981 - RNA, 22 nt, Human
uaaagcaauuugagcaaguucu

SEQ ID NO: 226982 - RNA, 22 nt, Human
acuuuuaaaugaguuucaguug

SEQ ID NO: 226983 - RNA, 22 nt, Human
agggaagggaaaaacacucguc

SEQ ID NO: 226984 - RNA, 22 nt, Human
ccagcucugcuugcccagucag

SEQ ID NO: 226985 - RNA, 22 nt, Human
acugcuuuagaccuagagcucu

SEQ ID NO: 226986 - RNA, 22 nt, Human
cagggcagggauguugcggcag

SEQ ID NO: 226987 - RNA, 22 nt, Human
cuggcugccagcauuuggggga

SEQ ID NO: 226988 - RNA, 22 nt, Human
uucaugagguaccugugaucau

SEQ ID NO: 226989 - RNA, 22 nt, Human
uuugaaagcaccauuugaguag

SEQ ID NO: 226990 - RNA, 22 nt, Human
ugcaaacaggcauuucacaaac

SEQ ID NO: 226991 - RNA, 22 nt, Human
aaggccagauucacuuuacaau

SEQ ID NO: 226992 - RNA, 22 nt, Human
uggcuacaaguguguuuaguuu

SEQ ID NO: 226993 - RNA, 22 nt, Human
auaguucacuaauagcaaaagc

SEQ ID NO: 226994 - RNA, 22 nt, Human
gacuaaaugcuuugugcaugca

SEQ ID NO: 226995 - RNA, 22 nt, Human
agugcugucuccuucccccggg

SEQ ID NO: 226996 - RNA, 21 nt, Human
guuuucaugauagagucugua

SEQ ID NO: 226997 - RNA, 22 nt, Human
uggaauggaaacaaacugagga

SEQ ID NO: 226998 - RNA, 18 nt, Human
ggcaucugcacagcagcc

SEQ ID NO: 226999 - RNA, 22 nt, Human
aauguauucuucaaccuugcua

SEQ ID NO: 227000 - RNA, 22 nt, Human
caggccaggugcucuagaauca

SEQ ID NO: 227001 - RNA, 22 nt, Human
ugagucacagccuugccuuggu

SEQ ID NO: 227002 - RNA, 19 nt, Human
ccugaguguuucagagaca

SEQ ID NO: 227003 - RNA, 22 nt, Human
acguuagaaaagcaggagcuca

SEQ ID NO: 227004 - RNA, 22 nt, Human
cuucagaagccugcagccuuug

SEQ ID NO: 227005 - RNA, 22 nt, Human
aaaaggacaagcuuuggaguua

SEQ ID NO: 227006 - RNA, 22 nt, Human
cagcuuuauuucacguguuugu

SEQ ID NO: 227007 - RNA, 22 nt, Human
acauucuagauauguuauauuu

SEQ ID NO: 227008 - RNA, 22 nt, Human
uucuguuacauggggcacagug

SEQ ID NO: 227009 - RNA, 22 nt, Human
ggccucagagaaggcugugcgg

SEQ ID NO: 227010 - RNA, 22 nt, Human
uacugaaagaauacauaauuuc

SEQ ID NO: 227011 - RNA, 22 nt, Human
agcagcagggugauagugccca

SEQ ID NO: 227012 - RNA, 22 nt, Human
aaaaugaauaaguuaacccagg

SEQ ID NO: 227013 - RNA, 22 nt, Human
gaaagcaguauuuaguucuguu

SEQ ID NO: 227014 - RNA, 22 nt, Human
aggcucaggaggagcugccgga

SEQ ID NO: 227015 - RNA, 22 nt, Human
uacauguguucuguuucaaguu

SEQ ID NO: 227016 - RNA, 22 nt, Human
aaaggcuaguggauucauugau

SEQ ID NO: 227017 - RNA, 22 nt, Human
ucugugcacuaacauuccuggu

SEQ ID NO: 227018 - RNA, 22 nt, Human
uagggaugggagauucucaaac

SEQ ID NO: 227019 - RNA, 22 nt, Human
aaugaguucugacacuucacga

SEQ ID NO: 227020 - RNA, 22 nt, Human
ugggaacaacaugcacugccac

SEQ ID NO: 227021 - RNA, 19 nt, Human
ugaggcaagauggcucugg

SEQ ID NO: 227022 - RNA, 22 nt, Human
aaauauguaagauuagcacuag

SEQ ID NO: 227023 - RNA, 22 nt, Human
aggaauguggcaaucuucaagu

SEQ ID NO: 227024 - RNA, 23 nt, Human
uccaggcaugagcucuggaugga

SEQ ID NO: 227025 - RNA, 22 nt, Human
uuuaucuguuccucuuggaggc

SEQ ID NO: 227026 - RNA, 22 nt, Human
augcaacagagaaaauauugag

SEQ ID NO: 227027 - RNA, 22 nt, Human
guccagagggcugcaggaugcu

SEQ ID NO: 227028 - RNA, 22 nt, Human
ugucagggauuuaaagacacaa

SEQ ID NO: 227029 - RNA, 22 nt, Human
guuccagguggucacagagcuc

SEQ ID NO: 227030 - RNA, 22 nt, Human
uucucuggacuauuugcacucc

SEQ ID NO: 227031 - RNA, 22 nt, Human
agagcugggugaagugccauca

SEQ ID NO: 227032 - RNA, 22 nt, Human
gaggcaguaauugugggcaaua

SEQ ID NO: 227033 - RNA, 22 nt, Human
aacaaugcugaacugaggaaag

SEQ ID NO: 227034 - RNA, 22 nt, Human
acagugaugagccggcugaggc

SEQ ID NO: 227035 - RNA, 22 nt, Human
aggugcuguuaacauaugaggu

SEQ ID NO: 227036 - RNA, 23 nt, Human
acagacauuccauaauguacacc

SEQ ID NO: 227037 - RNA, 23 nt, Human
ugggaccuguuugcccacagaug

SEQ ID NO: 227038 - RNA, 22 nt, Human
cccaguuucaacuuuccagugg

SEQ ID NO: 227039 - RNA, 22 nt, Human
agggccaccagagcagggcagu

SEQ ID NO: 227040 - RNA, 22 nt, Human
aguguccuuucuguuccagcca

SEQ ID NO: 227041 - RNA, 22 nt, Human
auagaaucaucugugcacuagu

SEQ ID NO: 227042 - RNA, 22 nt, Human
gcagagcucaagguguucagcu

SEQ ID NO: 227043 - RNA, 22 nt, Human
cagaggcacagugcgggccacu

SEQ ID NO: 227044 - RNA, 22 nt, Human
augggcucggcgcugcugggau

SEQ ID NO: 227045 - RNA, 22 nt, Human
aaauggauguugaguuaaaugu

SEQ ID NO: 227046 - RNA, 22 nt, Human
ugaaacauuauagaauauuuau

SEQ ID NO: 227047 - RNA, 22 nt, Human
cugcaucauuuucagacaaugg

SEQ ID NO: 227048 - RNA, 22 nt, Human
ccugaggggcugcaggccagcu

SEQ ID NO: 227049 - RNA, 22 nt, Human
cuaucaaacagccauuaauaua

SEQ ID NO: 227050 - RNA, 22 nt, Human
ugucuucaaauauugaaauccu

SEQ ID NO: 227051 - RNA, 22 nt, Human
ucucagcucagcuuccacagag

SEQ ID NO: 227052 - RNA, 22 nt, Human
ccagagccuggcaucugcauaa

SEQ ID NO: 227053 - RNA, 22 nt, Human
guccugagaugucacaagguuu

SEQ ID NO: 227054 - RNA, 22 nt, Human
gcagguguuuuaagacauugaa

SEQ ID NO: 227055 - RNA, 22 nt, Human
aaagccaugaauguuauagagg

SEQ ID NO: 227056 - RNA, 22 nt, Human
acuccuggguuccggagauucu

SEQ ID NO: 227057 - RNA, 22 nt, Human
guuucuuaaaagaggaguuaga

SEQ ID NO: 227058 - RNA, 22 nt, Human
ucugaggguuguagagagggac

SEQ ID NO: 227059 - RNA, 22 nt, Human
uuugcugauauuuugcugauac

SEQ ID NO: 227060 - RNA, 22 nt, Human
uuucaacagcucucaaaugauc

SEQ ID NO: 227061 - RNA, 22 nt, Human
aaaugucagaggaacauauuga

SEQ ID NO: 227062 - RNA, 22 nt, Human
ccacaggacacaacugcugacc

SEQ ID NO: 227063 - RNA, 22 nt, Human
uuuuggaugagcccagauuucu

SEQ ID NO: 227064 - RNA, 22 nt, Human
uucuguauguaugccagagcau

SEQ ID NO: 227065 - RNA, 22 nt, Human
agccauuuuccugaaauauaac

SEQ ID NO: 227066 - RNA, 22 nt, Human
ugcagggccuuguugaugugcu

SEQ ID NO: 227067 - RNA, 22 nt, Human
gccugggagaaugaccuccaac

SEQ ID NO: 227068 - RNA, 23 nt, Human
gcaggugguucgaacagaaguuu

SEQ ID NO: 227069 - RNA, 22 nt, Human
gacagggaacuucauuagcugu

SEQ ID NO: 227070 - RNA, 22 nt, Human
aggaauguuaggagaugagucu

SEQ ID NO: 227071 - RNA, 22 nt, Human
cuuaagcaaaauauucuuucac

SEQ ID NO: 227072 - RNA, 22 nt, Human
aggucaaggcugcagugagcug

SEQ ID NO: 227073 - RNA, 22 nt, Human
agagcagcugugacauggacag

SEQ ID NO: 227074 - RNA, 22 nt, Human
acaaaggcagccaaucaucugc

SEQ ID NO: 227075 - RNA, 19 nt, Human
uacuuauuagaaauauggg

SEQ ID NO: 227076 - RNA, 22 nt, Human
augauugaccaucugcugggcu

SEQ ID NO: 227077 - RNA, 22 nt, Human
ugaaugaucuccgauuaguccu

SEQ ID NO: 227078 - RNA, 20 nt, Human
auugacagaaaguguucacc

SEQ ID NO: 227079 - RNA, 22 nt, Human
aucaguuuuuauuaauguagcu

SEQ ID NO: 227080 - RNA, 22 nt, Human
acagcauggauaacaaggcacu

SEQ ID NO: 227081 - RNA, 22 nt, Human
ggugggaggacuguuugaggca

SEQ ID NO: 227082 - RNA, 22 nt, Human
gcaagcugugccuucucaggau

SEQ ID NO: 227083 - RNA, 22 nt, Human
cccugcuugucaccccuggguc

SEQ ID NO: 227084 - RNA, 22 nt, Human
uuugacucuugcuuugguggcu

SEQ ID NO: 227085 - RNA, 22 nt, Human
ccaggacucaaugaccacaggg

SEQ ID NO: 227086 - RNA, 22 nt, Human
agcagggggcauccuugcccuu

SEQ ID NO: 227087 - RNA, 22 nt, Human
ucucagaguuuagagcugagcc

SEQ ID NO: 227088 - RNA, 22 nt, Human
auguuucuaguuguaugucacu

SEQ ID NO: 227089 - RNA, 22 nt, Human
gaaaucuugcucauugugacaa

SEQ ID NO: 227090 - RNA, 22 nt, Human
cugggccugggaggccaggucu

SEQ ID NO: 227091 - RNA, 22 nt, Human
guuauaaaaugcacaguuguuu

SEQ ID NO: 227092 - RNA, 22 nt, Human
uccagcugcaaggggcacagcu

SEQ ID NO: 227093 - RNA, 22 nt, Human
aaauuauuaugccccucuauaa

SEQ ID NO: 227094 - RNA, 22 nt, Human
augaggaggucaggccuuacaa

SEQ ID NO: 227095 - RNA, 22 nt, Human
agaaucaauucacugcugcagc

SEQ ID NO: 227096 - RNA, 22 nt, Human
ccagagagguagcuuacccucu

SEQ ID NO: 227097 - RNA, 22 nt, Human
uccuuggagguguucaucugcc

SEQ ID NO: 227098 - RNA, 22 nt, Human
aauuuuacaaaauaccuccgau

SEQ ID NO: 227099 - RNA, 22 nt, Human
ucuggcagggguucugcacuug

SEQ ID NO: 227100 - RNA, 22 nt, Human
ugcaggagcagagauggcugga

SEQ ID NO: 227101 - RNA, 22 nt, Human
uagcuucucauaauuuaugcug

SEQ ID NO: 227102 - RNA, 22 nt, Human
ucuguuuagaugcuuuaucugu

SEQ ID NO: 227103 - RNA, 23 nt, Human
gcagaggagcaagcuggacacca

SEQ ID NO: 227104 - RNA, 22 nt, Human
aaagacaugacacauuggagag

SEQ ID NO: 227105 - RNA, 22 nt, Human
cuggagagauccuccugaaaaa

SEQ ID NO: 227106 - RNA, 21 nt, Human
uaaauaauaaguugcugagau

SEQ ID NO: 227107 - RNA, 22 nt, Human
ugucaguuuggcucuaaaguuu

SEQ ID NO: 227108 - RNA, 22 nt, Human
ggagucugauacugaguuccuc

SEQ ID NO: 227109 - RNA, 22 nt, Human
acuucuugaugaaaaugguacu

SEQ ID NO: 227110 - RNA, 22 nt, Human
agaaaaacuaagaguggguggu

SEQ ID NO: 227111 - RNA, 22 nt, Human
agucacauggacucaggaugac

SEQ ID NO: 227112 - RNA, 23 nt, Human
agggcaugaagcagaggacgugg

SEQ ID NO: 227113 - RNA, 22 nt, Human
ggcauccaaauaccaagaugua

SEQ ID NO: 227114 - RNA, 22 nt, Human
aagcagaaaaacugagcuccaa

SEQ ID NO: 227115 - RNA, 22 nt, Human
cuggaggaaucacagaaggcuu

SEQ ID NO: 227116 - RNA, 22 nt, Human
aguccagggcucucugugggau

SEQ ID NO: 227117 - RNA, 22 nt, Human
aacuggaucaguugagggaggc

SEQ ID NO: 227118 - RNA, 18 nt, Human
cauuguuuccagaagacc

SEQ ID NO: 227119 - RNA, 22 nt, Human
gagcugagaucgugccauugca

SEQ ID NO: 227120 - RNA, 22 nt, Human
cuuuucucugcgggucuuucau

SEQ ID NO: 227121 - RNA, 22 nt, Human
ccucuuccuucucacuguggaa

SEQ ID NO: 227122 - RNA, 22 nt, Human
cugccaggcacugggcucugca

SEQ ID NO: 227123 - RNA, 22 nt, Human
uccacccugcuuuugucuuuga

SEQ ID NO: 227124 - RNA, 22 nt, Human
auucuucauuguugauucaugu

SEQ ID NO: 227125 - RNA, 22 nt, Human
gagguaacacuguucagugggc

SEQ ID NO: 227126 - RNA, 21 nt, Human
uccuugcuauuuuccucagcu

SEQ ID NO: 227127 - RNA, 22 nt, Human
uagcaaagaaccugauacccca

SEQ ID NO: 227128 - RNA, 22 nt, Human
cuggcccuguaggaugugaguu

SEQ ID NO: 227129 - RNA, 22 nt, Human
uuuuuuauaucaacugaagucu

SEQ ID NO: 227130 - RNA, 22 nt, Human
agccaggcuaaaugagccauga

SEQ ID NO: 227131 - RNA, 22 nt, Human
gcuagagaccagaggccuugaa

SEQ ID NO: 227132 - RNA, 22 nt, Human
uuggcugcuuuacucugacggg

SEQ ID NO: 227133 - RNA, 22 nt, Human
gcagccaggaagcccaggacac

SEQ ID NO: 227134 - RNA, 22 nt, Human
uccaggaguccugggagugauu

SEQ ID NO: 227135 - RNA, 22 nt, Human
uucagugugccuaagucaguug

SEQ ID NO: 227136 - RNA, 22 nt, Human
aaguuacagauugggagcagag

SEQ ID NO: 227137 - RNA, 22 nt, Human
cugccuuuucaucugagcugga

SEQ ID NO: 227138 - RNA, 22 nt, Human
gccuccaggguagaggaggaag

SEQ ID NO: 227139 - RNA, 22 nt, Human
auuuacuggaaaaacuaugagc

SEQ ID NO: 227140 - RNA, 22 nt, Human
uguggcagcuggagguggagaa

SEQ ID NO: 227141 - RNA, 22 nt, Human
gaaggcuugcaagugguucaua

SEQ ID NO: 227142 - RNA, 22 nt, Human
aacugcaagcucuuuacugcua

SEQ ID NO: 227143 - RNA, 22 nt, Human
gagcuuggggcauauggugcua

SEQ ID NO: 227144 - RNA, 22 nt, Human
ucagugcacccaauucucucca

SEQ ID NO: 227145 - RNA, 22 nt, Human
cagcaaauacuacuaguuuuua

SEQ ID NO: 227146 - RNA, 22 nt, Human
ccuuuugcucucccauccagaa

SEQ ID NO: 227147 - RNA, 22 nt, Human
ucagguggaauuaauuaagaga

SEQ ID NO: 227148 - RNA, 22 nt, Human
ucaggcaggcucagaggaaaac

SEQ ID NO: 227149 - RNA, 22 nt, Human
gugccuggaacuggguaggcug

SEQ ID NO: 227150 - RNA, 22 nt, Human
ccuuuagaauacagacuuucua

SEQ ID NO: 227151 - RNA, 22 nt, Human
uguggcugcucaggugcagacc

SEQ ID NO: 227152 - RNA, 22 nt, Human
aagguguuauagcugaggaaua

SEQ ID NO: 227153 - RNA, 22 nt, Human
aggcucagugcaaaucauucug

SEQ ID NO: 227154 - RNA, 22 nt, Human
uguaucuuucuguacuuuuaug

SEQ ID NO: 227155 - RNA, 22 nt, Human
cuguuuauaaaccaccaguuua

SEQ ID NO: 227156 - RNA, 22 nt, Human
cuggagcuggcccaggcuggcc

SEQ ID NO: 227157 - RNA, 22 nt, Human
aguuuagaguucaaauuaguuc

SEQ ID NO: 227158 - RNA, 22 nt, Human
aaggcacagaggcagggcacuu

SEQ ID NO: 227159 - RNA, 22 nt, Human
aguauguugacuuauucuugga

SEQ ID NO: 227160 - RNA, 22 nt, Human
gacagacaggagcucacaggca

SEQ ID NO: 227161 - RNA, 22 nt, Human
gcagggcacaaggacgcacagg

SEQ ID NO: 227162 - RNA, 22 nt, Human
caggcuucgcucugugggcagg

SEQ ID NO: 227163 - RNA, 20 nt, Human
ucccaggcuccacccuagac

SEQ ID NO: 227164 - RNA, 22 nt, Human
aacugguagaaagcaguaagug

SEQ ID NO: 227165 - RNA, 22 nt, Human
cugaagcacagcauauaaauaa

SEQ ID NO: 227166 - RNA, 22 nt, Human
ucccagugagguccuggcuguc

SEQ ID NO: 227167 - RNA, 22 nt, Human
ccuccuguuguccugcuggggc

SEQ ID NO: 227168 - RNA, 22 nt, Human
augccacauaauuacaaauaga

SEQ ID NO: 227169 - RNA, 22 nt, Human
ugaggcucaaggucugguggag

SEQ ID NO: 227170 - RNA, 18 nt, Human
ggagcccagaggacagga

SEQ ID NO: 227171 - RNA, 22 nt, Human
uggaugguucugggcggcagca

SEQ ID NO: 227172 - RNA, 22 nt, Human
cauccgcaugcaagugcugucc

SEQ ID NO: 227173 - RNA, 22 nt, Human
aaagccuucuuguaucgagcca

SEQ ID NO: 227174 - RNA, 22 nt, Human
gcugggucccaagccuggggag

SEQ ID NO: 227175 - RNA, 22 nt, Human
uuuaauguagcgugaaaugauu

SEQ ID NO: 227176 - RNA, 22 nt, Human
guccuggcugguucuguggggc

SEQ ID NO: 227177 - RNA, 22 nt, Human
ugggagaugguucugagacuuu

SEQ ID NO: 227178 - RNA, 22 nt, Human
uucugugauuccuccagccagc

SEQ ID NO: 227179 - RNA, 22 nt, Human
uguuacagggauaaaugaggua

SEQ ID NO: 227180 - RNA, 22 nt, Human
ggcaccagggaaggaaggcugg

SEQ ID NO: 227181 - RNA, 22 nt, Human
ggucugagugggcaggggccgg

SEQ ID NO: 227182 - RNA, 22 nt, Human
agucccuguacuuuccacugcc

SEQ ID NO: 227183 - RNA, 22 nt, Human
cagcacuucagcauucagauuu

SEQ ID NO: 227184 - RNA, 22 nt, Human
acauugaugaucccacuuacag

SEQ ID NO: 227185 - RNA, 22 nt, Human
gagcuggcuaauacugacuuau

SEQ ID NO: 227186 - RNA, 22 nt, Human
cuucuuuacuuucuagaaauaa

SEQ ID NO: 227187 - RNA, 22 nt, Human
gagggggucuaugagguagagc

SEQ ID NO: 227188 - RNA, 22 nt, Human
ccuuuuggccaggucagugcag

SEQ ID NO: 227189 - RNA, 22 nt, Human
uugcuggcaauuuagagauuuc

SEQ ID NO: 227190 - RNA, 22 nt, Human
uucagcaagaccaccauguacc

SEQ ID NO: 227191 - RNA, 22 nt, Human
auagggcccccgugggugcuca

SEQ ID NO: 227192 - RNA, 22 nt, Human
acaguuugguugcuacaguaaa

SEQ ID NO: 227193 - RNA, 22 nt, Human
uggagagaaaguugaauggagg

SEQ ID NO: 227194 - RNA, 22 nt, Human
gcagcagcucaguucugggagg

SEQ ID NO: 227195 - RNA, 22 nt, Human
augaggcacuuaaaagugaaga

SEQ ID NO: 227196 - RNA, 22 nt, Human
acguagcacugagagaugcagg

SEQ ID NO: 227197 - RNA, 22 nt, Human
uuucacaaguuucaggauucug

SEQ ID NO: 227198 - RNA, 22 nt, Human
ugagacuuggcacugaggaacu

SEQ ID NO: 227199 - RNA, 22 nt, Human
ggacagcucugccaggagcuca

SEQ ID NO: 227200 - RNA, 22 nt, Human
agaaacauccugcuuuccauuu

SEQ ID NO: 227201 - RNA, 22 nt, Human
uaucucagcuggaucaguggaa

SEQ ID NO: 227202 - RNA, 22 nt, Human
ggucucuguugccuccaucaag

SEQ ID NO: 227203 - RNA, 22 nt, Human
cuggccacugcgggccucugcc

SEQ ID NO: 227204 - RNA, 22 nt, Human
ugagcagucauccauuucuccu

SEQ ID NO: 227205 - RNA, 22 nt, Human
uuuguacaugaaugugcaccca

SEQ ID NO: 227206 - RNA, 22 nt, Human
acugucuuugagcuggaggagg

SEQ ID NO: 227207 - RNA, 22 nt, Human
ucugacuuccuuuucugaucca

SEQ ID NO: 227208 - RNA, 22 nt, Human
aggcagugguguuugcuggugg

SEQ ID NO: 227209 - RNA, 22 nt, Human
guagaaaugguguguuucuucu

SEQ ID NO: 227210 - RNA, 22 nt, Human
ugucucugucucccagguugug

SEQ ID NO: 227211 - RNA, 23 nt, Human
aggaggaaaaguuaucugcugag

SEQ ID NO: 227212 - RNA, 22 nt, Human
aaauggaacugggcuacuaggu

SEQ ID NO: 227213 - RNA, 18 nt, Human
uuucacaaccuccagagg

SEQ ID NO: 227214 - RNA, 22 nt, Human
gaauuacauuuguguuacugca

SEQ ID NO: 227215 - RNA, 22 nt, Human
ucugugcucaaguucugccucu

SEQ ID NO: 227216 - RNA, 22 nt, Human
gguacaaaguuagauuuaacuu

SEQ ID NO: 227217 - RNA, 22 nt, Human
uuuagggacaagggucuggggu

SEQ ID NO: 227218 - RNA, 22 nt, Human
caucuguagcuccaugacaauu

SEQ ID NO: 227219 - RNA, 22 nt, Human
ugggaagaguuagagacagcug

SEQ ID NO: 227220 - RNA, 22 nt, Human
uaaagacagauggaccagccau

SEQ ID NO: 227221 - RNA, 22 nt, Human
uauagauagacugacgauacag

SEQ ID NO: 227222 - RNA, 22 nt, Human
ugggauaauaaauagaggcaga

SEQ ID NO: 227223 - RNA, 22 nt, Human
ucuguauuuuaagaugcuguuu

SEQ ID NO: 227224 - RNA, 22 nt, Human
gcaggagcucguuuccaggcug

SEQ ID NO: 227225 - RNA, 22 nt, Human
gcagcagagcuuuguccuggcu

SEQ ID NO: 227226 - RNA, 21 nt, Human
gcauggcaggucacuggggca

SEQ ID NO: 227227 - RNA, 22 nt, Human
gcagggugauagugaggcucag

SEQ ID NO: 227228 - RNA, 22 nt, Human
aggugcugaacuggugaggucu

SEQ ID NO: 227229 - RNA, 19 nt, Human
guucuuucauaguaagagc

SEQ ID NO: 227230 - RNA, 22 nt, Human
auuacaaucgagagaaacaaau

SEQ ID NO: 227231 - RNA, 18 nt, Human
uggugccuuucacucuuc

SEQ ID NO: 227232 - RNA, 23 nt, Human
ccacagcuauaggguagugcagu

SEQ ID NO: 227233 - RNA, 22 nt, Human
gguuagagggcaugcgaucuuu

SEQ ID NO: 227234 - RNA, 22 nt, Human
cuacccuuaaguuucugugggg

SEQ ID NO: 227235 - RNA, 22 nt, Human
auucagaagcuauucuuaguuc

SEQ ID NO: 227236 - RNA, 22 nt, Human
cccagcagaaucugaugagggc

SEQ ID NO: 227237 - RNA, 22 nt, Human
ggcagcucgaugacuucugcau

SEQ ID NO: 227238 - RNA, 22 nt, Human
aagggcucugugcuugucccau

SEQ ID NO: 227239 - RNA, 22 nt, Human
cauuugcaagagauaaauguuu

SEQ ID NO: 227240 - RNA, 22 nt, Human
aaacagaaggguagguaaacau

SEQ ID NO: 227241 - RNA, 22 nt, Human
uguuuauaaauuuucuugccau

SEQ ID NO: 227242 - RNA, 22 nt, Human
ccucagaauaguccucagauca

SEQ ID NO: 227243 - RNA, 22 nt, Human
cuggaaagugcugagacaauug

SEQ ID NO: 227244 - RNA, 19 nt, Human
cucuuuggagauccuugga

SEQ ID NO: 227245 - RNA, 22 nt, Human
ugcaggugcguuuucaagccuc

SEQ ID NO: 227246 - RNA, 22 nt, Human
auaggcagacucuuuuuggagg

SEQ ID NO: 227247 - RNA, 22 nt, Human
cagagcugacccaaggauugaa

SEQ ID NO: 227248 - RNA, 22 nt, Human
caggugcuguccugcacauguc

SEQ ID NO: 227249 - RNA, 17 nt, Human
ccugggaggaguuauga

SEQ ID NO: 227250 - RNA, 22 nt, Human
agcuggcuauacuugaaaaguc

SEQ ID NO: 227251 - RNA, 21 nt, Human
cacacagcugcccuuagguag

SEQ ID NO: 227252 - RNA, 22 nt, Human
ucccuguacuuacacagcgucc

SEQ ID NO: 227253 - RNA, 21 nt, Human
ugagcaggagucaugggaaug

SEQ ID NO: 227254 - RNA, 22 nt, Human
uuccaggaggucaaaggccugu

SEQ ID NO: 227255 - RNA, 22 nt, Human
guccuugcuugagacaggcagu

SEQ ID NO: 227256 - RNA, 23 nt, Human
agucuucauuguauuuccagacc

SEQ ID NO: 227257 - RNA, 22 nt, Human
ucucuggcccuguuuucuaucu

SEQ ID NO: 227258 - RNA, 23 nt, Human
aucaaaugauuggccauucagug

SEQ ID NO: 227259 - RNA, 21 nt, Human
gagugcagcaagguagagucu

SEQ ID NO: 227260 - RNA, 22 nt, Human
uuguuucaggaugguuuguuac

SEQ ID NO: 227261 - RNA, 22 nt, Human
ccaguggacuucucccuguggu

SEQ ID NO: 227262 - RNA, 22 nt, Human
uuccugggauuauugucaagca

SEQ ID NO: 227263 - RNA, 19 nt, Human
gcaggccucuugggaauua

SEQ ID NO: 227264 - RNA, 17 nt, Human
cagcugugagagccuua

SEQ ID NO: 227265 - RNA, 22 nt, Human
gagcccaggcagagguugcagu

SEQ ID NO: 227266 - RNA, 22 nt, Human
uagaacuugagaucaggucuuc

SEQ ID NO: 227267 - RNA, 22 nt, Human
cccaggucuaugccagcucuga

SEQ ID NO: 227268 - RNA, 22 nt, Human
uuggcucugaaacccaagcucu

SEQ ID NO: 227269 - RNA, 22 nt, Human
uuccugggagcuagccacaucu

SEQ ID NO: 227270 - RNA, 22 nt, Human
aaaccauuugaauuauuacuga

SEQ ID NO: 227271 - RNA, 22 nt, Human
gcuccugugaggacacagccgc

SEQ ID NO: 227272 - RNA, 22 nt, Human
accugggaggcggagguugcag

SEQ ID NO: 227273 - RNA, 22 nt, Human
gggugggcccagcccagagaag

SEQ ID NO: 227274 - RNA, 22 nt, Human
aggaaaugggaauagaugguau

SEQ ID NO: 227275 - RNA, 22 nt, Human
cuacaacauagucuucuacaga

SEQ ID NO: 227276 - RNA, 22 nt, Human
aacacuguaucagucuucaaua

SEQ ID NO: 227277 - RNA, 22 nt, Human
caggcaugcuucugucugggca

SEQ ID NO: 227278 - RNA, 22 nt, Human
aagaaaugcagaaaugugcugg

SEQ ID NO: 227279 - RNA, 22 nt, Human
ugguggggucaucgucagaugc

SEQ ID NO: 227280 - RNA, 22 nt, Human
cagcaugaugagugcaguuugg

SEQ ID NO: 227281 - RNA, 22 nt, Human
aggagcugcagauucugccuug

SEQ ID NO: 227282 - RNA, 22 nt, Human
agacacagcaauaacuacuguu

SEQ ID NO: 227283 - RNA, 22 nt, Human
guauagaaggaucuggugaauu

SEQ ID NO: 227284 - RNA, 22 nt, Human
gccuguuuccaucaacacaugc

SEQ ID NO: 227285 - RNA, 22 nt, Human
uaaugcugccaagccaugcaga

SEQ ID NO: 227286 - RNA, 19 nt, Human
gccacaucuuuuccagagu

SEQ ID NO: 227287 - RNA, 22 nt, Human
guaaaaccugcuuuucaacacc

SEQ ID NO: 227288 - RNA, 22 nt, Human
uuucucaaauugcaugaguagc

SEQ ID NO: 227289 - RNA, 22 nt, Human
cagcagaguaggugcuacuucu

SEQ ID NO: 227290 - RNA, 22 nt, Human
agcagaggacaguucuuaggaa

SEQ ID NO: 227291 - RNA, 22 nt, Human
ccugagccugaguggugcaggg

SEQ ID NO: 227292 - RNA, 22 nt, Human
aauuacuguaauuuucuacagc

SEQ ID NO: 227293 - RNA, 22 nt, Human
uaacaacaugcaauuuaaccuu

SEQ ID NO: 227294 - RNA, 21 nt, Human
aaguggagaagaaaagcugga

SEQ ID NO: 227295 - RNA, 22 nt, Human
agagugucugguagcugcucug

SEQ ID NO: 227296 - RNA, 22 nt, Human
accaggcuuaauccuuugcuau

SEQ ID NO: 227297 - RNA, 19 nt, Human
ccuccuguggcgggugggg

SEQ ID NO: 227298 - RNA, 22 nt, Human
aguguucuucugggguaugcuc

SEQ ID NO: 227299 - RNA, 22 nt, Human
cccagaaggcuugccaggaagc

SEQ ID NO: 227300 - RNA, 22 nt, Human
aacacugaguaucagaguuggg

SEQ ID NO: 227301 - RNA, 22 nt, Human
uaaggcuuggggaaaagugagg

SEQ ID NO: 227302 - RNA, 22 nt, Human
acuucuuuucaaaucaugcaaa

SEQ ID NO: 227303 - RNA, 22 nt, Human
aagggcugaaugaaggguugaa

SEQ ID NO: 227304 - RNA, 23 nt, Human
caggaaaugaauccaggaggaug

SEQ ID NO: 227305 - RNA, 22 nt, Human
ugacccaucaggccacaugagg

SEQ ID NO: 227306 - RNA, 22 nt, Human
agagaggcgaguuaccugugcu

SEQ ID NO: 227307 - RNA, 22 nt, Human
ugccuucaagacccauccucca

SEQ ID NO: 227308 - RNA, 21 nt, Human
ucacguggucacaugagcuuu

SEQ ID NO: 227309 - RNA, 22 nt, Human
uuccucagagggcgcuggggaa

SEQ ID NO: 227310 - RNA, 22 nt, Human
uucauagugcuuaauuugauaa

SEQ ID NO: 227311 - RNA, 22 nt, Human
acucuaaauagauaaccaugca

SEQ ID NO: 227312 - RNA, 22 nt, Human
aguuugaaauguuggcaauauu

SEQ ID NO: 227313 - RNA, 22 nt, Human
agagguugggucugaggugaga

SEQ ID NO: 227314 - RNA, 22 nt, Human
agacaucuugcacacauauacu

SEQ ID NO: 227315 - RNA, 22 nt, Human
aaggccagcaguuugagaccag

SEQ ID NO: 227316 - RNA, 22 nt, Human
ggcaguggugggaggcucgcuc

SEQ ID NO: 227317 - RNA, 22 nt, Human
gaggcaggguguugauuacaga

SEQ ID NO: 227318 - RNA, 23 nt, Human
gcagugcuuggcacagcuggguc

SEQ ID NO: 227319 - RNA, 22 nt, Human
acagguguagcaggagcaucaa

SEQ ID NO: 227320 - RNA, 22 nt, Human
cugccucuauaggaguccacca

SEQ ID NO: 227321 - RNA, 22 nt, Human
aaacugguauucaaauguuugg

SEQ ID NO: 227322 - RNA, 22 nt, Human
cccaaagguugaggcugcagug

SEQ ID NO: 227323 - RNA, 22 nt, Human
gcugguccauuggcacugcuca

SEQ ID NO: 227324 - RNA, 22 nt, Human
aagcaugucccuugugauucaa

SEQ ID NO: 227325 - RNA, 22 nt, Human
uuuuaaaucuccaguugacccc

SEQ ID NO: 227326 - RNA, 22 nt, Human
cacaugcuccauacagaauggg

SEQ ID NO: 227327 - RNA, 22 nt, Human
ugagccagucugucugggugaa

SEQ ID NO: 227328 - RNA, 22 nt, Human
gaagucugacucuuuguaagcu

SEQ ID NO: 227329 - RNA, 22 nt, Human
uuauuuaaugugaucugaagag

SEQ ID NO: 227330 - RNA, 22 nt, Human
acuuuccuggcccuguccucug

SEQ ID NO: 227331 - RNA, 22 nt, Human
acaguggauauauuaaaugaga

SEQ ID NO: 227332 - RNA, 22 nt, Human
ccaugccauacuggccacccgg

SEQ ID NO: 227333 - RNA, 22 nt, Human
ugcaggguauccuugucucugc

SEQ ID NO: 227334 - RNA, 22 nt, Human
cagcaucaacauucucagcucu

SEQ ID NO: 227335 - RNA, 22 nt, Human
uuauuacaaugcagaaaauaga

SEQ ID NO: 227336 - RNA, 22 nt, Human
uuuacaauucucuaccaguguu

SEQ ID NO: 227337 - RNA, 22 nt, Human
cauuucuaccaaaugugacugg

SEQ ID NO: 227338 - RNA, 22 nt, Human
uuaggaaacgcugcuauugacu

SEQ ID NO: 227339 - RNA, 22 nt, Human
cagcagagguuuugcuccauga

SEQ ID NO: 227340 - RNA, 22 nt, Human
ggccaggcugguuccuugaccu

SEQ ID NO: 227341 - RNA, 22 nt, Human
uggguucuuucacuucucaguu

SEQ ID NO: 227342 - RNA, 17 nt, Human
aagcauuuaauuugcua

SEQ ID NO: 227343 - RNA, 22 nt, Human
aacauuugaaaaucaagaaucu

SEQ ID NO: 227344 - RNA, 20 nt, Human
uuuacauuuugaaacaguga

SEQ ID NO: 227345 - RNA, 22 nt, Human
uguguccugugcaaggggauga

SEQ ID NO: 227346 - RNA, 22 nt, Human
gcaggugauucacccugggccu

SEQ ID NO: 227347 - RNA, 22 nt, Human
aacaagaauaagugguuucugg

SEQ ID NO: 227348 - RNA, 21 nt, Human
gucauccaccucucgggcucu

SEQ ID NO: 227349 - RNA, 22 nt, Human
uugauuuuuccagcuucuagag

SEQ ID NO: 227350 - RNA, 23 nt, Human
ugcuggcuuccagcugcucccuc

SEQ ID NO: 227351 - RNA, 22 nt, Human
ggagagagagcucauuagcugc

SEQ ID NO: 227352 - RNA, 22 nt, Human
agcgacagaaaccaaggacaag

SEQ ID NO: 227353 - RNA, 22 nt, Human
agauuuguugugagcaggaaua

SEQ ID NO: 227354 - RNA, 22 nt, Human
gcgacagugcggccaccuucau

SEQ ID NO: 227355 - RNA, 22 nt, Human
cuggcugcauuggcaagucaau

SEQ ID NO: 227356 - RNA, 23 nt, Human
ucuccuggcugcacuguggccac

SEQ ID NO: 227357 - RNA, 22 nt, Human
cagcagguccugggcguggccu

SEQ ID NO: 227358 - RNA, 22 nt, Human
ccucaggcagugguauggaugg

SEQ ID NO: 227359 - RNA, 22 nt, Human
aguggcaaagucuucagaaguu

SEQ ID NO: 227360 - RNA, 22 nt, Human
auugcuuuugagcuagaauuuu

SEQ ID NO: 227361 - RNA, 22 nt, Human
uuuccagagggugcucagggcg

SEQ ID NO: 227362 - RNA, 22 nt, Human
aaggaucugacagacuauagaa

SEQ ID NO: 227363 - RNA, 22 nt, Human
cagaaccugaacgugaggugga

SEQ ID NO: 227364 - RNA, 22 nt, Human
ccaaaagcagcugucugugaau

SEQ ID NO: 227365 - RNA, 22 nt, Human
ucuacaaauaaauuacuaugua

SEQ ID NO: 227366 - RNA, 22 nt, Human
auaaugcaccuuugaguauggc

SEQ ID NO: 227367 - RNA, 22 nt, Human
gaggaaaagagacagguuauug

SEQ ID NO: 227368 - RNA, 22 nt, Human
aaccaguacuuuacacagcucu

SEQ ID NO: 227369 - RNA, 22 nt, Human
uacaagaagaggcagagcugga

SEQ ID NO: 227370 - RNA, 22 nt, Human
gcugugugaaaacugggccugg

SEQ ID NO: 227371 - RNA, 22 nt, Human
agcugcccuuaauaggcauuca

SEQ ID NO: 227372 - RNA, 22 nt, Human
aauuuggagcuuuguuucuaga

SEQ ID NO: 227373 - RNA, 22 nt, Human
ggcugcagcagagggacucacg

SEQ ID NO: 227374 - RNA, 22 nt, Human
aaaggacaugucaauaucaggc

SEQ ID NO: 227375 - RNA, 22 nt, Human
ccagcauccaugcucccucggg

SEQ ID NO: 227376 - RNA, 22 nt, Human
uucugggcucccacauauuuca

SEQ ID NO: 227377 - RNA, 22 nt, Human
gcucccaggaagagaagggcca

SEQ ID NO: 227378 - RNA, 22 nt, Human
uacaguuauaugugauaaguaa

SEQ ID NO: 227379 - RNA, 22 nt, Human
uagagaugaauucugcagucuu

SEQ ID NO: 227380 - RNA, 22 nt, Human
cuggugaauggauaaacuguug

SEQ ID NO: 227381 - RNA, 23 nt, Human
uccuccuggauacaaagggaaca

SEQ ID NO: 227382 - RNA, 22 nt, Human
ccuucucccucugagaggaacc

SEQ ID NO: 227383 - RNA, 22 nt, Human
ugacaagagcauucccacaccu

SEQ ID NO: 227384 - RNA, 22 nt, Human
cacaugagagcccccaagagca

SEQ ID NO: 227385 - RNA, 22 nt, Human
uacaaguguaagcuugugagac

SEQ ID NO: 227386 - RNA, 17 nt, Human
gcccugccugcugcccu

SEQ ID NO: 227387 - RNA, 22 nt, Human
aacagcagcaugacagcugggu

SEQ ID NO: 227388 - RNA, 22 nt, Human
agccaggaaugcaugcucugcu

SEQ ID NO: 227389 - RNA, 22 nt, Human
ggccugacauuugcaucaacac

SEQ ID NO: 227390 - RNA, 22 nt, Human
aaguugagaugucauaggagac

SEQ ID NO: 227391 - RNA, 22 nt, Human
guggauggauugaggcaguggg

SEQ ID NO: 227392 - RNA, 22 nt, Human
ucugcagaacuuuaugagcaaa

SEQ ID NO: 227393 - RNA, 22 nt, Human
uuuacuguguccaucugugacu

SEQ ID NO: 227394 - RNA, 22 nt, Human
agcuggcaguaugacuggugac

SEQ ID NO: 227395 - RNA, 22 nt, Human
caguuucuuagugacacaaauc

SEQ ID NO: 227396 - RNA, 22 nt, Human
uauaauuuuagaagagauggaa

SEQ ID NO: 227397 - RNA, 22 nt, Human
agcucccagaagccagagucgg

SEQ ID NO: 227398 - RNA, 22 nt, Human
guuacaaacucaggugccaaaa

SEQ ID NO: 227399 - RNA, 22 nt, Human
uccugaggcacaauccuagaau

SEQ ID NO: 227400 - RNA, 22 nt, Human
ucaaagcacacuuagugguaga

SEQ ID NO: 227401 - RNA, 22 nt, Human
gaguggggcuuuaaaggcucag

SEQ ID NO: 227402 - RNA, 22 nt, Human
gcagggagggccuuucaugaca

SEQ ID NO: 227403 - RNA, 22 nt, Human
uggcagggucuugcuguguugc

SEQ ID NO: 227404 - RNA, 22 nt, Human
auguauuugcguauggacauac

SEQ ID NO: 227405 - RNA, 22 nt, Human
cuggaggggcuggcaugguagc

SEQ ID NO: 227406 - RNA, 21 nt, Human
ugacugaggcuucuucacaca

SEQ ID NO: 227407 - RNA, 22 nt, Human
aaccacagagcccccucagaug

SEQ ID NO: 227408 - RNA, 22 nt, Human
acaugaaaugcagccuguaacc

SEQ ID NO: 227409 - RNA, 22 nt, Human
aguggcuguacuauuuuuucau

SEQ ID NO: 227410 - RNA, 22 nt, Human
aagaugugcaguucauggcagg

SEQ ID NO: 227411 - RNA, 22 nt, Human
ucagggccaucuuuugccucaa

SEQ ID NO: 227412 - RNA, 22 nt, Human
gcaggccuaagagaaggcauug

SEQ ID NO: 227413 - RNA, 22 nt, Human
ccucagugcguacugaacagug

SEQ ID NO: 227414 - RNA, 22 nt, Human
aaaagcagaucuccaaagucua

SEQ ID NO: 227415 - RNA, 22 nt, Human
uagaaccuccacaggaccucca

SEQ ID NO: 227416 - RNA, 21 nt, Human
uuuguucaggggcaaaguuaa

SEQ ID NO: 227417 - RNA, 22 nt, Human
ccagcauggcaccugagaugag

SEQ ID NO: 227418 - RNA, 20 nt, Human
auucaccaaaucaucccagg

SEQ ID NO: 227419 - RNA, 23 nt, Human
ccagcucauccauuaccucucuu

SEQ ID NO: 227420 - RNA, 22 nt, Human
aggggcucaaagugugcaggga

SEQ ID NO: 227421 - RNA, 22 nt, Human
gcacaauuccaugggacagccc

SEQ ID NO: 227422 - RNA, 22 nt, Human
cuuucucugugugguaaagggc

SEQ ID NO: 227423 - RNA, 19 nt, Human
ucaagauggauggcuccca

SEQ ID NO: 227424 - RNA, 22 nt, Human
uggcagaauuuuaaagacagau

SEQ ID NO: 227425 - RNA, 22 nt, Human
cugacuucagggauaaaaagua

SEQ ID NO: 227426 - RNA, 22 nt, Human
gccuggcagauugacauagcca

SEQ ID NO: 227427 - RNA, 22 nt, Human
gggagaaggaggacugugcugu

SEQ ID NO: 227428 - RNA, 22 nt, Human
uuacaguguuacuugaugucca

SEQ ID NO: 227429 - RNA, 22 nt, Human
ugucagagcaaggccaggccag

SEQ ID NO: 227430 - RNA, 22 nt, Human
caaaaguaccuugugugcuuug

SEQ ID NO: 227431 - RNA, 22 nt, Human
ucuggccccggucuucacagcu

SEQ ID NO: 227432 - RNA, 22 nt, Human
uccaagcucucuaugccaugau

SEQ ID NO: 227433 - RNA, 22 nt, Human
auucagaagcaaucacagugag

SEQ ID NO: 227434 - RNA, 22 nt, Human
cuuuggaauaauuuccuggagu

SEQ ID NO: 227435 - RNA, 22 nt, Human
ucacaucacaugacaguaggcc

SEQ ID NO: 227436 - RNA, 22 nt, Human
accagccaccaccaggagaucg

SEQ ID NO: 227437 - RNA, 22 nt, Human
caggcacaugggagcucaucau

SEQ ID NO: 227438 - RNA, 21 nt, Human
gaaucuuugauuuacauggga

SEQ ID NO: 227439 - RNA, 22 nt, Human
acacagaagaucucuuaaugcu

SEQ ID NO: 227440 - RNA, 22 nt, Human
ggcugugcuuugcccaaagggc

SEQ ID NO: 227441 - RNA, 22 nt, Human
agcagggcucugccaugggccc

SEQ ID NO: 227442 - RNA, 22 nt, Human
agagcuuuagcugcuggucugg

SEQ ID NO: 227443 - RNA, 22 nt, Human
acagaguccuagcugcaaagaa

SEQ ID NO: 227444 - RNA, 22 nt, Human
ucacugcucugaaaguacaggg

SEQ ID NO: 227445 - RNA, 22 nt, Human
uccuucaaucacccagugggga

SEQ ID NO: 227446 - RNA, 22 nt, Human
guagcuuccagaaagugucuuu

SEQ ID NO: 227447 - RNA, 23 nt, Human
uuucaguugagaaugcacggacc

SEQ ID NO: 227448 - RNA, 20 nt, Human
uaggugucuuugccagcuuu

SEQ ID NO: 227449 - RNA, 22 nt, Human
auguuuguguuucccauucagg

SEQ ID NO: 227450 - RNA, 22 nt, Human
agcuucuugaccaagccuguaa

SEQ ID NO: 227451 - RNA, 22 nt, Human
gggccugcuccccaucgcugcu

SEQ ID NO: 227452 - RNA, 22 nt, Human
acuggggcagugggcagugguu

SEQ ID NO: 227453 - RNA, 22 nt, Human
agguggcagccgagacauaagg

SEQ ID NO: 227454 - RNA, 21 nt, Human
agcaggcuuuggaguggggcu

SEQ ID NO: 227455 - RNA, 22 nt, Human
ccagguguggccacauggcugg

SEQ ID NO: 227456 - RNA, 22 nt, Human
ucagaggagcugcagaacgcug

SEQ ID NO: 227457 - RNA, 20 nt, Human
ucacuguaauugccuacauu

SEQ ID NO: 227458 - RNA, 22 nt, Human
aaagcaaugggucuaagguaaa

SEQ ID NO: 227459 - RNA, 18 nt, Human
aaaggcugaauauagaag

SEQ ID NO: 227460 - RNA, 22 nt, Human
cuggcugggguccauccucuaa

SEQ ID NO: 227461 - RNA, 20 nt, Human
cagagccaggguuuuguuuu

SEQ ID NO: 227462 - RNA, 22 nt, Human
uuacugauuuuugggcccuacc

SEQ ID NO: 227463 - RNA, 22 nt, Human
cacuccagccucagugacagag

SEQ ID NO: 227464 - RNA, 22 nt, Human
uucugcuuagagggcauuugca

SEQ ID NO: 227465 - RNA, 22 nt, Human
gguuuauuaaugugaacuguau

SEQ ID NO: 227466 - RNA, 22 nt, Human
gccuccccaggggugucaugag

SEQ ID NO: 227467 - RNA, 18 nt, Human
agcagggcauuuugccau

SEQ ID NO: 227468 - RNA, 22 nt, Human
accaggcccuccagcugcgugg

SEQ ID NO: 227469 - RNA, 17 nt, Human
ucucuuucccuuucugc

SEQ ID NO: 227470 - RNA, 22 nt, Human
ucaauaauggcaggauaaauuu

SEQ ID NO: 227471 - RNA, 22 nt, Human
augaauggauggggucaagaua

SEQ ID NO: 227472 - RNA, 22 nt, Human
caggaggcuccuagggcucugu

SEQ ID NO: 227473 - RNA, 19 nt, Human
aucugaaguaggugcagcu

SEQ ID NO: 227474 - RNA, 22 nt, Human
uuguauuuauauugaauagcuu

SEQ ID NO: 227475 - RNA, 22 nt, Human
agauggucaaggauacuguuca

SEQ ID NO: 227476 - RNA, 22 nt, Human
augcccugagcaggccuucaag

SEQ ID NO: 227477 - RNA, 22 nt, Human
uuuacagagagagaacuggacu

SEQ ID NO: 227478 - RNA, 22 nt, Human
acugucaaaagagauuauauua

SEQ ID NO: 227479 - RNA, 22 nt, Human
cuguggcacucaagaagccucc

SEQ ID NO: 227480 - RNA, 22 nt, Human
uagaaaguaaacacgaagucuc

SEQ ID NO: 227481 - RNA, 22 nt, Human
agggagacacaugaggaaguca

SEQ ID NO: 227482 - RNA, 22 nt, Human
uccaguccuaucugcccuugga

SEQ ID NO: 227483 - RNA, 17 nt, Human
cuaaauacuugcguuuc

SEQ ID NO: 227484 - RNA, 20 nt, Human
uucugagaguucacagcccc

SEQ ID NO: 227485 - RNA, 22 nt, Human
uaaccagacagaaacagcuaga

SEQ ID NO: 227486 - RNA, 22 nt, Human
aagggcuccauccuuauaaaug

SEQ ID NO: 227487 - RNA, 22 nt, Human
gagcccuguucaggccuccuca

SEQ ID NO: 227488 - RNA, 22 nt, Human
caguuuaaagaaggaugggagu

SEQ ID NO: 227489 - RNA, 22 nt, Human
ucauucauugcaagcacacgca

SEQ ID NO: 227490 - RNA, 22 nt, Human
cguuuuucaguggucuuagguc

SEQ ID NO: 227491 - RNA, 22 nt, Human
ucaggaagcugcucuggguggu

SEQ ID NO: 227492 - RNA, 22 nt, Human
gggcuaggucugaucagagaag

SEQ ID NO: 227493 - RNA, 22 nt, Human
gaggagcuugaggcuaggagcc

SEQ ID NO: 227494 - RNA, 22 nt, Human
uuugaaauuaagauauugucca

SEQ ID NO: 227495 - RNA, 22 nt, Human
acugugcaggugaacuguuugc

SEQ ID NO: 227496 - RNA, 22 nt, Human
gcagugggccugaggaagggug

SEQ ID NO: 227497 - RNA, 22 nt, Human
uguucucuuuuccugcugagcc

SEQ ID NO: 227498 - RNA, 22 nt, Human
ggagcuggcagcgcaacccaga

SEQ ID NO: 227499 - RNA, 22 nt, Human
accacaucuagauugcagcccu

SEQ ID NO: 227500 - RNA, 22 nt, Human
uuaaaaggcaucauaggugaau

SEQ ID NO: 227501 - RNA, 22 nt, Human
ucuuggagaauggcagagaagc

SEQ ID NO: 227502 - RNA, 22 nt, Human
aggacagagccugugcagaccg

SEQ ID NO: 227503 - RNA, 22 nt, Human
aucagagcuaguacuugcaggu

SEQ ID NO: 227504 - RNA, 22 nt, Human
caugugugggacccuuagguug

SEQ ID NO: 227505 - RNA, 22 nt, Human
uuacagaagagaaagaauucag

SEQ ID NO: 227506 - RNA, 22 nt, Human
cuggcccagagagcagagcuua

SEQ ID NO: 227507 - RNA, 22 nt, Human
ucagucuuuaaaagcucaggaa

SEQ ID NO: 227508 - RNA, 22 nt, Human
accuguuuguguuuggacugca

SEQ ID NO: 227509 - RNA, 17 nt, Human
ugaaacaccaagacugu

SEQ ID NO: 227510 - RNA, 22 nt, Human
uuugaaagggaaauaaacuccu

SEQ ID NO: 227511 - RNA, 22 nt, Human
gcuggcuguguuccuucugcca

SEQ ID NO: 227512 - RNA, 22 nt, Human
cucugcuacuguuaaaccauuu

SEQ ID NO: 227513 - RNA, 22 nt, Human
cucagcacauuccuaagggaug

SEQ ID NO: 227514 - RNA, 22 nt, Human
gagcaucugugguccaucagaa

SEQ ID NO: 227515 - RNA, 22 nt, Human
gggcccagcacuggcugggauc

SEQ ID NO: 227516 - RNA, 22 nt, Human
cuugcuuuugcugaugauuaag

SEQ ID NO: 227517 - RNA, 20 nt, Human
uugaagagucagguagggcc

SEQ ID NO: 227518 - RNA, 22 nt, Human
ggcaaaaaccacaauuacuuuu

SEQ ID NO: 227519 - RNA, 20 nt, Human
gcuguggcaaagcuuugugu

SEQ ID NO: 227520 - RNA, 20 nt, Human
cuggggagcugcucccacga

SEQ ID NO: 227521 - RNA, 22 nt, Human
uguucuuuggcuucacagcucu

SEQ ID NO: 227522 - RNA, 22 nt, Human
cuguguccugcgucaagccaau

SEQ ID NO: 227523 - RNA, 22 nt, Human
ggccagagagccgcuguuagga

SEQ ID NO: 227524 - RNA, 22 nt, Human
ucuucagacccuuagcugugau

SEQ ID NO: 227525 - RNA, 22 nt, Human
gugcuggcugccaggaggcugc

SEQ ID NO: 227526 - RNA, 22 nt, Human
acagaaguguguguguaggaau

SEQ ID NO: 227527 - RNA, 22 nt, Human
caugugguucaaguacuccaca

SEQ ID NO: 227528 - RNA, 22 nt, Human
cacugugguuauuaucacuguu

SEQ ID NO: 227529 - RNA, 22 nt, Human
gugcuacuaguuucauuuuuca

SEQ ID NO: 227530 - RNA, 22 nt, Human
guaucuuuaucccucguuggag

SEQ ID NO: 227531 - RNA, 22 nt, Human
uagaugaccuuguguuaggcaa

SEQ ID NO: 227532 - RNA, 22 nt, Human
uuagccauuuuauacaagugua

SEQ ID NO: 227533 - RNA, 22 nt, Human
ucacccagaaaagacagcagau

SEQ ID NO: 227534 - RNA, 22 nt, Human
ugaauagacuggggcugugaag

SEQ ID NO: 227535 - RNA, 22 nt, Human
uuaaacauuuauggaggcagca

SEQ ID NO: 227536 - RNA, 22 nt, Human
uauuagguaugaacuggcaacc

SEQ ID NO: 227537 - RNA, 22 nt, Human
acaaaguauuuuuagguuugua

SEQ ID NO: 227538 - RNA, 19 nt, Human
auucucugguuugcuggcu

SEQ ID NO: 227539 - RNA, 18 nt, Human
ucccuggggcugccaccc

SEQ ID NO: 227540 - RNA, 22 nt, Human
ucugcaggcuuggaguggcagc

SEQ ID NO: 227541 - RNA, 22 nt, Human
ucagagaaguaagguggggugc

SEQ ID NO: 227542 - RNA, 22 nt, Human
gaagcaaaaugucugcacauau

SEQ ID NO: 227543 - RNA, 22 nt, Human
auacaagacaguaggaaacuga

SEQ ID NO: 227544 - RNA, 22 nt, Human
aagcugcagguugaauccaggu

SEQ ID NO: 227545 - RNA, 22 nt, Human
auuccucaaagguagcccauua

SEQ ID NO: 227546 - RNA, 22 nt, Human
ucuggcagagucagugcacaca

SEQ ID NO: 227547 - RNA, 22 nt, Human
agugugagcuaauagcagagcc

SEQ ID NO: 227548 - RNA, 22 nt, Human
guagauaaggauugauuuuuau

SEQ ID NO: 227549 - RNA, 22 nt, Human
ucuggcagguucccauguuaug

SEQ ID NO: 227550 - RNA, 22 nt, Human
cccaggagagaggccaguuggc

SEQ ID NO: 227551 - RNA, 22 nt, Human
ggaggccaaggcagguggaucg

SEQ ID NO: 227552 - RNA, 22 nt, Human
agagcagcuggggcagagacca

SEQ ID NO: 227553 - RNA, 22 nt, Human
ucuggcagagugauaggauaag

SEQ ID NO: 227554 - RNA, 22 nt, Human
ggagaaggaauauuggaguagg

SEQ ID NO: 227555 - RNA, 22 nt, Human
aagcuguauguuaccacuguca

SEQ ID NO: 227556 - RNA, 22 nt, Human
cagcccugcagagggcgcuccu

SEQ ID NO: 227557 - RNA, 22 nt, Human
cuauuguuucuaugcucugagg

SEQ ID NO: 227558 - RNA, 22 nt, Human
gcaggcucaaaagcugguagga

SEQ ID NO: 227559 - RNA, 19 nt, Human
uccucccuuugguguccug

SEQ ID NO: 227560 - RNA, 22 nt, Human
gcugugagugagcugccuaggc

SEQ ID NO: 227561 - RNA, 22 nt, Human
guagaaaauuaggaugaggcuu

SEQ ID NO: 227562 - RNA, 22 nt, Human
acucugggcuuugauuuguuac

SEQ ID NO: 227563 - RNA, 20 nt, Human
augcaucugguaucuuuccu

SEQ ID NO: 227564 - RNA, 22 nt, Human
uacaaguuccauuuugaaagug

SEQ ID NO: 227565 - RNA, 22 nt, Human
augcaugucugccaguugcuua

SEQ ID NO: 227566 - RNA, 22 nt, Human
ggagaugcuuuccaguggggau

SEQ ID NO: 227567 - RNA, 22 nt, Human
aagccggcugggccgaggcugc

SEQ ID NO: 227568 - RNA, 22 nt, Human
agcugcuccaacccagcgggcu

SEQ ID NO: 227569 - RNA, 21 nt, Human
cauauuaaaucggugccuuua

SEQ ID NO: 227570 - RNA, 22 nt, Human
acucagagaacauucccagucu

SEQ ID NO: 227571 - RNA, 22 nt, Human
auguacaaaauguuuugaaaug

SEQ ID NO: 227572 - RNA, 18 nt, Human
uucucugguggauguuau

SEQ ID NO: 227573 - RNA, 22 nt, Human
uucaacaaguaguacacacagu

SEQ ID NO: 227574 - RNA, 22 nt, Human
accuacauggcuuuaaguaagu

SEQ ID NO: 227575 - RNA, 22 nt, Human
ugggacagguuggagagaagca

SEQ ID NO: 227576 - RNA, 22 nt, Human
acacuguagauauagaguuagu

SEQ ID NO: 227577 - RNA, 22 nt, Human
gacccauauauacguaauuugu

SEQ ID NO: 227578 - RNA, 22 nt, Human
gaacaaacagaagaggcggaac

SEQ ID NO: 227579 - RNA, 21 nt, Human
agggccagaucaccaaggagc

SEQ ID NO: 227580 - RNA, 22 nt, Human
auguacagccacuucacaguua

SEQ ID NO: 227581 - RNA, 22 nt, Human
acagaaauugggcaaauggaag

SEQ ID NO: 227582 - RNA, 22 nt, Human
gcuuuacauaaacauuuauuau

SEQ ID NO: 227583 - RNA, 22 nt, Human
ucaaauggguaugcuuuauaau

SEQ ID NO: 227584 - RNA, 22 nt, Human
cuuuacagaauaagaauacugg

SEQ ID NO: 227585 - RNA, 22 nt, Human
gacuuuaugaagagaugaccaa

SEQ ID NO: 227586 - RNA, 22 nt, Human
auaauuaucucagacacuuguu

SEQ ID NO: 227587 - RNA, 22 nt, Human
gaggccaaucaauagggcaaua

SEQ ID NO: 227588 - RNA, 22 nt, Human
acacacagaguuuauacaggca

SEQ ID NO: 227589 - RNA, 22 nt, Human
ggcugagaaucaacaaccugcu

SEQ ID NO: 227590 - RNA, 22 nt, Human
gggcugcaucagcaggacccgg

SEQ ID NO: 227591 - RNA, 22 nt, Human
gcaguguuacuuggaguacuaa

SEQ ID NO: 227592 - RNA, 22 nt, Human
agcuacagaugagcccaguauc

SEQ ID NO: 227593 - RNA, 22 nt, Human
gggcagcucagccaccaugcag

SEQ ID NO: 227594 - RNA, 22 nt, Human
cuccccaacucagccgaggcuu

SEQ ID NO: 227595 - RNA, 22 nt, Human
cacugucuguguguccuugggg

SEQ ID NO: 227596 - RNA, 22 nt, Human
agcuuuaucuucaccugggaau

SEQ ID NO: 227597 - RNA, 19 nt, Human
acucugaggcugagacaag

SEQ ID NO: 227598 - RNA, 22 nt, Human
ccaggaggcuucguccguggag

SEQ ID NO: 227599 - RNA, 22 nt, Human
ggagacagugguagggccuaag

SEQ ID NO: 227600 - RNA, 22 nt, Human
cugcagcuaaggaaugugguug

SEQ ID NO: 227601 - RNA, 22 nt, Human
gguucccggaucuccgaguccc

SEQ ID NO: 227602 - RNA, 22 nt, Human
agcuccaggauaagacaggugc

SEQ ID NO: 227603 - RNA, 22 nt, Human
aucaggaucagggcuagcagag

SEQ ID NO: 227604 - RNA, 22 nt, Human
auuaaauguuggcauauuuugu

SEQ ID NO: 227605 - RNA, 22 nt, Human
aguaacucauguaaaccucaca

SEQ ID NO: 227606 - RNA, 22 nt, Human
uauacagauggaaagauacaca

SEQ ID NO: 227607 - RNA, 22 nt, Human
ucaggcugcagcugucagcagc

SEQ ID NO: 227608 - RNA, 22 nt, Human
cagucucuugcuucauuaguug

SEQ ID NO: 227609 - RNA, 22 nt, Human
cuggcauucuuguuucuggaaa

SEQ ID NO: 227610 - RNA, 22 nt, Human
gagggggagaugugcacacacu

SEQ ID NO: 227611 - RNA, 22 nt, Human
uuuuucauauuccccucucugg

SEQ ID NO: 227612 - RNA, 22 nt, Human
cugcagggcccaaggucaacgg

SEQ ID NO: 227613 - RNA, 23 nt, Human
cccagcuggaaguuagaggacca

SEQ ID NO: 227614 - RNA, 22 nt, Human
cucugugcgggccauggucagg

SEQ ID NO: 227615 - RNA, 22 nt, Human
uagaaacagcauauauuagccc

SEQ ID NO: 227616 - RNA, 20 nt, Human
uggugagagcaccugauggg

SEQ ID NO: 227617 - RNA, 22 nt, Human
cagucuaaguuaauuuccacaa

SEQ ID NO: 227618 - RNA, 22 nt, Human
uaugcauaguggaauuagcaaa

SEQ ID NO: 227619 - RNA, 22 nt, Human
aagggcuguaagccaaguaaag

SEQ ID NO: 227620 - RNA, 22 nt, Human
uaaaacugaauacauacugagg

SEQ ID NO: 227621 - RNA, 22 nt, Human
aggcaaauugugagaaaaugaa

SEQ ID NO: 227622 - RNA, 22 nt, Human
aaugucugccugaacuuuauau

SEQ ID NO: 227623 - RNA, 22 nt, Human
ugucuucaucucagacacaguu

SEQ ID NO: 227624 - RNA, 22 nt, Human
uaccagcuuccuucaagaugug

SEQ ID NO: 227625 - RNA, 22 nt, Human
aguuaggacacuugagggcuaa

SEQ ID NO: 227626 - RNA, 22 nt, Human
aagugucugcaaaaugacagag

SEQ ID NO: 227627 - RNA, 22 nt, Human
agagggcaaguguaguccagua

SEQ ID NO: 227628 - RNA, 17 nt, Human
ugccuccagcaggguga

SEQ ID NO: 227629 - RNA, 22 nt, Human
cagggcugaagaaauucaaaag

SEQ ID NO: 227630 - RNA, 22 nt, Human
cucacagguucugcagcucaca

SEQ ID NO: 227631 - RNA, 18 nt, Human
cgaggcaggcggaucacg

SEQ ID NO: 227632 - RNA, 22 nt, Human
gguagggcaaaguagggcaccu

SEQ ID NO: 227633 - RNA, 22 nt, Human
gccaggagcccugggcaaguuc

SEQ ID NO: 227634 - RNA, 22 nt, Human
ccucaggugugggccagcuguc

SEQ ID NO: 227635 - RNA, 22 nt, Human
uauuugaagauucuucugaugu

SEQ ID NO: 227636 - RNA, 22 nt, Human
caguguauaaacuuuaacauag

SEQ ID NO: 227637 - RNA, 23 nt, Human
agggcugaaugcagagaagcaga

SEQ ID NO: 227638 - RNA, 22 nt, Human
gcuggcuggcacguucgcacgu

SEQ ID NO: 227639 - RNA, 22 nt, Human
cugauccagagccaaccaaggc

SEQ ID NO: 227640 - RNA, 21 nt, Human
aggaggccaguacugcugaac

SEQ ID NO: 227641 - RNA, 22 nt, Human
agcagugggggaguguuaguuu

SEQ ID NO: 227642 - RNA, 20 nt, Human
agcuaggagaaagcauggag

SEQ ID NO: 227643 - RNA, 22 nt, Human
ucaagaaacugugcuacagagu

SEQ ID NO: 227644 - RNA, 22 nt, Human
uagcccucuuuaauccuucccu

SEQ ID NO: 227645 - RNA, 22 nt, Human
gaggugucaggguagucaugau

SEQ ID NO: 227646 - RNA, 22 nt, Human
ucuguagcaucuuaaauguagu

SEQ ID NO: 227647 - RNA, 22 nt, Human
uucagagaacuucauggaagag

SEQ ID NO: 227648 - RNA, 22 nt, Human
aacaagaagagagggacguaau

SEQ ID NO: 227649 - RNA, 22 nt, Human
ucuuuugugauucuuuaguuac

SEQ ID NO: 227650 - RNA, 22 nt, Human
gguuggggcgagcuggaggccc

SEQ ID NO: 227651 - RNA, 22 nt, Human
cuguuacuguuggcccagggug

SEQ ID NO: 227652 - RNA, 22 nt, Human
aguggcuucauuucugccagaa

SEQ ID NO: 227653 - RNA, 22 nt, Human
ucucagcucauggcagccuuga

SEQ ID NO: 227654 - RNA, 22 nt, Human
ccaaaguccauaguuuacuuua

SEQ ID NO: 227655 - RNA, 22 nt, Human
cagcaggugucuagcaaggguc

SEQ ID NO: 227656 - RNA, 22 nt, Human
uccaggagcucauccacgucaa

SEQ ID NO: 227657 - RNA, 23 nt, Human
uggcaaggaaugggauggagacu

SEQ ID NO: 227658 - RNA, 22 nt, Human
gcagagaccccgcagugaggcc

SEQ ID NO: 227659 - RNA, 22 nt, Human
ugucacauauauaauguucaau

SEQ ID NO: 227660 - RNA, 21 nt, Human
ucagcaaaauaagcaaaugga

SEQ ID NO: 227661 - RNA, 22 nt, Human
auugcuuuuagugaaauuauau

SEQ ID NO: 227662 - RNA, 22 nt, Human
aucuggagugggacacagaaau

SEQ ID NO: 227663 - RNA, 22 nt, Human
ugcccagccuaaacuuggcaag

SEQ ID NO: 227664 - RNA, 22 nt, Human
gguuuuaacuacagaauugcaa

SEQ ID NO: 227665 - RNA, 22 nt, Human
uuccaugacugaagcaggggcg

SEQ ID NO: 227666 - RNA, 22 nt, Human
uuucuccugaguuccacgcuac

SEQ ID NO: 227667 - RNA, 22 nt, Human
gaaggaagucauuagugcagac

SEQ ID NO: 227668 - RNA, 22 nt, Human
aagcccugccacccauucacug

SEQ ID NO: 227669 - RNA, 21 nt, Human
aaagauguuucaucugagaaa

SEQ ID NO: 227670 - RNA, 22 nt, Human
gaaaucuuugccuuagcugugu

SEQ ID NO: 227671 - RNA, 22 nt, Human
caagcuuguuucuccugggggu

SEQ ID NO: 227672 - RNA, 22 nt, Human
cccuccaggccugucauguucc

SEQ ID NO: 227673 - RNA, 22 nt, Human
auagauguucaaucagauauuu

SEQ ID NO: 227674 - RNA, 22 nt, Human
cugagcugaaacuugagaggcu

SEQ ID NO: 227675 - RNA, 22 nt, Human
ucucaguguguuuucucucaga

SEQ ID NO: 227676 - RNA, 21 nt, Human
ccaccaggucuucugcucggg

SEQ ID NO: 227677 - RNA, 22 nt, Human
aaggaaguuaagucuuagaaug

SEQ ID NO: 227678 - RNA, 22 nt, Human
augcaccccagaagcugcagug

SEQ ID NO: 227679 - RNA, 22 nt, Human
cauggccugccuccuccuggug

SEQ ID NO: 227680 - RNA, 22 nt, Human
guuuccuagaucaguguucuua

SEQ ID NO: 227681 - RNA, 22 nt, Human
cagcaagaguugggguuguugg

SEQ ID NO: 227682 - RNA, 22 nt, Human
agcugguggaagggagcccaaa

SEQ ID NO: 227683 - RNA, 22 nt, Human
gaagcaagugcaaggaagaggc

SEQ ID NO: 227684 - RNA, 22 nt, Human
gauuuacagaucuaagggucac

SEQ ID NO: 227685 - RNA, 22 nt, Human
cccaggcacaccccgaacggaa

SEQ ID NO: 227686 - RNA, 22 nt, Human
agaggggaaguaaugaaugaua

SEQ ID NO: 227687 - RNA, 22 nt, Human
ccugaguguaauaaugaaggca

SEQ ID NO: 227688 - RNA, 22 nt, Human
gguuucaaaguggacaguuagu

SEQ ID NO: 227689 - RNA, 22 nt, Human
cuggcagcucuacucagagccu

SEQ ID NO: 227690 - RNA, 16 nt, Human
cuuccucuucacuggc

SEQ ID NO: 227691 - RNA, 22 nt, Human
caggcagccugagggaucuggg

SEQ ID NO: 227692 - RNA, 22 nt, Human
acauccaccacaugccaggcuc

SEQ ID NO: 227693 - RNA, 22 nt, Human
acagggcucugacaccaaggua

SEQ ID NO: 227694 - RNA, 22 nt, Human
ccugaguggccaggcagcugug

SEQ ID NO: 227695 - RNA, 22 nt, Human
gcugcucugugacagccuccgg

SEQ ID NO: 227696 - RNA, 22 nt, Human
guuuccugcccugucuuaucca

SEQ ID NO: 227697 - RNA, 22 nt, Human
gugacuguaauuaccuuagcaa

SEQ ID NO: 227698 - RNA, 22 nt, Human
ucuuuagagccuuuccucccga

SEQ ID NO: 227699 - RNA, 23 nt, Human
acuccccagucucuucuugccaa

SEQ ID NO: 227700 - RNA, 22 nt, Human
ggcuuccuaauacucccuacac

SEQ ID NO: 227701 - RNA, 19 nt, Human
cucuggagaacaauagugc

SEQ ID NO: 227702 - RNA, 22 nt, Human
accugggaguaugcagugguga

SEQ ID NO: 227703 - RNA, 23 nt, Human
ucugcuggugacacggucacauu

SEQ ID NO: 227704 - RNA, 20 nt, Human
ucccaggcugggcuccagcu

SEQ ID NO: 227705 - RNA, 22 nt, Human
ugaggcagugcugggaagccug

SEQ ID NO: 227706 - RNA, 22 nt, Human
ccuggguacgcagggcuccucu

SEQ ID NO: 227707 - RNA, 22 nt, Human
ggcuuugacaugcugaauuaaa

SEQ ID NO: 227708 - RNA, 22 nt, Human
cuccuggcaggcugagugaaau

SEQ ID NO: 227709 - RNA, 22 nt, Human
uccaggcauuggagagauaaug

SEQ ID NO: 227710 - RNA, 23 nt, Human
gccuggagaaaagcugcaguuca

SEQ ID NO: 227711 - RNA, 22 nt, Human
aaggcuuguugucacgcucuug

SEQ ID NO: 227712 - RNA, 22 nt, Human
aagguauuauuugcaaucauuu

SEQ ID NO: 227713 - RNA, 22 nt, Human
agggccacaguggggccugaga

SEQ ID NO: 227714 - RNA, 22 nt, Human
acagaagcaaagacucaggcaa

SEQ ID NO: 227715 - RNA, 22 nt, Human
auuaauguguagccaacuuaau

SEQ ID NO: 227716 - RNA, 22 nt, Human
ggauggcagacagugaguggcu

SEQ ID NO: 227717 - RNA, 22 nt, Human
gagaagaaauagaaucacauuu

SEQ ID NO: 227718 - RNA, 22 nt, Human
uuuguuuacucauucauugaug

SEQ ID NO: 227719 - RNA, 22 nt, Human
ucagacacagaugagacaagga

SEQ ID NO: 227720 - RNA, 22 nt, Human
agguccagagguugaacggugg

SEQ ID NO: 227721 - RNA, 22 nt, Human
ucagaggccaaacugagcaggg

SEQ ID NO: 227722 - RNA, 22 nt, Human
aggcuucuacguggucccaggg

SEQ ID NO: 227723 - RNA, 22 nt, Human
ucugcacccuucuggguuggaa

SEQ ID NO: 227724 - RNA, 22 nt, Human
cuccagugcacccagaggauuu

SEQ ID NO: 227725 - RNA, 22 nt, Human
caggcccucgcccgcagcgacc

SEQ ID NO: 227726 - RNA, 22 nt, Human
cuuagaaugucuacucuuacca

SEQ ID NO: 227727 - RNA, 22 nt, Human
augugcuugcagaugagccuca

SEQ ID NO: 227728 - RNA, 22 nt, Human
uuuaagaucauuuguauuaucc

SEQ ID NO: 227729 - RNA, 22 nt, Human
ucccugaggaagggguguggug

SEQ ID NO: 227730 - RNA, 22 nt, Human
uaguuugagaauugaaauagaa

SEQ ID NO: 227731 - RNA, 22 nt, Human
ccuggcagcuguuuggcuuggc

SEQ ID NO: 227732 - RNA, 22 nt, Human
acagcagaucuggcuacagguu

SEQ ID NO: 227733 - RNA, 22 nt, Human
cugaggagaaaugggaugguuc

SEQ ID NO: 227734 - RNA, 22 nt, Human
agucacaggcaagagggcucca

SEQ ID NO: 227735 - RNA, 22 nt, Human
aauauuucaaaaggaaacacag

SEQ ID NO: 227736 - RNA, 22 nt, Human
uccagcagguccgagacaaguu

SEQ ID NO: 227737 - RNA, 22 nt, Human
ggucuucucuaugagcuggucu

SEQ ID NO: 227738 - RNA, 22 nt, Human
ucaaauaccagcuuuuccagaa

SEQ ID NO: 227739 - RNA, 22 nt, Human
uacuauuuggaauuuuaaauug

SEQ ID NO: 227740 - RNA, 22 nt, Human
aggagugggggcgagaaguuaa

SEQ ID NO: 227741 - RNA, 22 nt, Human
aaugucugaaaaucagacugca

SEQ ID NO: 227742 - RNA, 22 nt, Human
gagggaugcagaaacagaggcc

SEQ ID NO: 227743 - RNA, 19 nt, Human
uuacuucaggagugaaauu

SEQ ID NO: 227744 - RNA, 22 nt, Human
acagcugacauuggcagcuauu

SEQ ID NO: 227745 - RNA, 22 nt, Human
ucaguaaaguucuuucuugcug

SEQ ID NO: 227746 - RNA, 22 nt, Human
ugacaaagguguugccagaggg

SEQ ID NO: 227747 - RNA, 22 nt, Human
aaugcaaacuccacuggagcag

SEQ ID NO: 227748 - RNA, 22 nt, Human
aaacagauaaugcuauaaaugg

SEQ ID NO: 227749 - RNA, 22 nt, Human
cugguuuaguaggggacugaag

SEQ ID NO: 227750 - RNA, 22 nt, Human
gcugcucagugggccugagccu

SEQ ID NO: 227751 - RNA, 22 nt, Human
uucacagaugccugaugugugg

SEQ ID NO: 227752 - RNA, 22 nt, Human
agggccaguucuaccucugaau

SEQ ID NO: 227753 - RNA, 22 nt, Human
cagaacagacuuaacagggcug

SEQ ID NO: 227754 - RNA, 22 nt, Human
aguguguuuaggcugcggguug

SEQ ID NO: 227755 - RNA, 22 nt, Human
agugcuccuuucauugcugccc

SEQ ID NO: 227756 - RNA, 22 nt, Human
gcauccaaauguuucauuucuu

SEQ ID NO: 227757 - RNA, 22 nt, Human
gugaggcaggcauucuccuuuc

SEQ ID NO: 227758 - RNA, 22 nt, Human
uguguccuguccccuugcugcu

SEQ ID NO: 227759 - RNA, 22 nt, Human
gggcugagcuguucugaguuua

SEQ ID NO: 227760 - RNA, 22 nt, Human
gucauuuaaaagggaacacaug

SEQ ID NO: 227761 - RNA, 18 nt, Human
agaggcuggacaggggau

SEQ ID NO: 227762 - RNA, 22 nt, Human
uguccugggucccugcuagaag

SEQ ID NO: 227763 - RNA, 22 nt, Human
ggugcauguagccaucaagaua

SEQ ID NO: 227764 - RNA, 22 nt, Human
gccuuagaaaaauaagauuuua

SEQ ID NO: 227765 - RNA, 22 nt, Human
ccuucauugcaucuuuaagaga

SEQ ID NO: 227766 - RNA, 22 nt, Human
ccaagcugacugugcuguugug

SEQ ID NO: 227767 - RNA, 22 nt, Human
cacagguguucuugcagugaaa

SEQ ID NO: 227768 - RNA, 22 nt, Human
gagguggauguugcagugagcu

SEQ ID NO: 227769 - RNA, 22 nt, Human
aagugcaucacuacucauuaca

SEQ ID NO: 227770 - RNA, 22 nt, Human
ggcaggugaggcaugugccugg

SEQ ID NO: 227771 - RNA, 22 nt, Human
ccuuuucuauguaccagcagug

SEQ ID NO: 227772 - RNA, 22 nt, Human
cucuggagagguucccauggga

SEQ ID NO: 227773 - RNA, 22 nt, Human
agggcagcaauuugguuccugg

SEQ ID NO: 227774 - RNA, 22 nt, Human
uccuccaggcaccucacuggcu

SEQ ID NO: 227775 - RNA, 23 nt, Human
agcuccugaggccagccucuccu

SEQ ID NO: 227776 - RNA, 22 nt, Human
aaggucaaagacaguaacuuuu

SEQ ID NO: 227777 - RNA, 22 nt, Human
gucugggcuucagaguuagaga

SEQ ID NO: 227778 - RNA, 20 nt, Human
uucagaaauaaggaaugagg

SEQ ID NO: 227779 - RNA, 22 nt, Human
aggcccagagcaggaaaggguu

SEQ ID NO: 227780 - RNA, 22 nt, Human
uggaaauguauuugggcaugcc

SEQ ID NO: 227781 - RNA, 22 nt, Human
ugcuccuguuucaucagcuaua

SEQ ID NO: 227782 - RNA, 22 nt, Human
cugccucuccccagaguggccc

SEQ ID NO: 227783 - RNA, 22 nt, Human
aucuuguuaaaaugcagaaacu

SEQ ID NO: 227784 - RNA, 22 nt, Human
gucaucauuuuuagcauauggg

SEQ ID NO: 227785 - RNA, 22 nt, Human
ccucacccagucaccuaggugg

SEQ ID NO: 227786 - RNA, 22 nt, Human
cuuuuguugcccuugucgcagg

SEQ ID NO: 227787 - RNA, 19 nt, Human
cuguccuuggcugcacugu

SEQ ID NO: 227788 - RNA, 22 nt, Human
caaauuacccucaacaucuaga

SEQ ID NO: 227789 - RNA, 22 nt, Human
accagggcaaauguuuguacuc

SEQ ID NO: 227790 - RNA, 21 nt, Human
ugagaugcuagaaggcaggga

SEQ ID NO: 227791 - RNA, 22 nt, Human
gcuggccugggcagccugucgg

SEQ ID NO: 227792 - RNA, 22 nt, Human
auuuccuucaguguuuaauacu

SEQ ID NO: 227793 - RNA, 22 nt, Human
aacacagaguauuugaagcauu

SEQ ID NO: 227794 - RNA, 22 nt, Human
aaaguucauugaugacugaggu

SEQ ID NO: 227795 - RNA, 21 nt, Human
aguguguguggaaugagaaua

SEQ ID NO: 227796 - RNA, 17 nt, Human
ucaaagaaugcaugcag

SEQ ID NO: 227797 - RNA, 22 nt, Human
aauucuacauugguucacauuu

SEQ ID NO: 227798 - RNA, 22 nt, Human
ugucaggcaaaggaagguauuu

SEQ ID NO: 227799 - RNA, 22 nt, Human
ggaggagauuccccucucacuu

SEQ ID NO: 227800 - RNA, 22 nt, Human
ucaguggagagcuuccaggauu

SEQ ID NO: 227801 - RNA, 22 nt, Human
cagucucucagcuuucagcugu

SEQ ID NO: 227802 - RNA, 22 nt, Human
agaggcacuguucuuagcgacu

SEQ ID NO: 227803 - RNA, 22 nt, Human
uugaaaugagcaaacugucagc

SEQ ID NO: 227804 - RNA, 22 nt, Human
aggagcugggcugcugcuggga

SEQ ID NO: 227805 - RNA, 22 nt, Human
uucauugugaacacauucugcc

SEQ ID NO: 227806 - RNA, 22 nt, Human
aauuagggagccaucauaaggu

SEQ ID NO: 227807 - RNA, 22 nt, Human
aggacugaaaaugaguucuucu

SEQ ID NO: 227808 - RNA, 22 nt, Human
ggcuccacccugcuuccagaag

SEQ ID NO: 227809 - RNA, 22 nt, Human
caggccagaguccaacuccaga

SEQ ID NO: 227810 - RNA, 22 nt, Human
agaaguuguagguuugcauauu

SEQ ID NO: 227811 - RNA, 22 nt, Human
ugugacccucuccgaugggcag

SEQ ID NO: 227812 - RNA, 22 nt, Human
cuguggcauugugaggacugca

SEQ ID NO: 227813 - RNA, 22 nt, Human
uugcaccccuugauugagccuu

SEQ ID NO: 227814 - RNA, 21 nt, Human
agagucugcauuucugacaag

SEQ ID NO: 227815 - RNA, 22 nt, Human
cagaggcucaccagccuuucac

SEQ ID NO: 227816 - RNA, 22 nt, Human
uguuauucucugccuacaaguc

SEQ ID NO: 227817 - RNA, 22 nt, Human
uugcaucuagggcaacccagag

SEQ ID NO: 227818 - RNA, 22 nt, Human
gggaagagauuuccacaucauu

SEQ ID NO: 227819 - RNA, 22 nt, Human
ucuaaagauuuggauucauuug

SEQ ID NO: 227820 - RNA, 22 nt, Human
agagaaacugauguccuuugaa

SEQ ID NO: 227821 - RNA, 22 nt, Human
uugagacacuuugggcaucacu

SEQ ID NO: 227822 - RNA, 22 nt, Human
uuuucaagggcagggaaaucau

SEQ ID NO: 227823 - RNA, 22 nt, Human
acuuucauuugugaagacugua

SEQ ID NO: 227824 - RNA, 22 nt, Human
ccaggagcuggcauguggagag

SEQ ID NO: 227825 - RNA, 19 nt, Human
ccugggucugcagcauuca

SEQ ID NO: 227826 - RNA, 22 nt, Human
gaggcagcuuaggguacugacu

SEQ ID NO: 227827 - RNA, 22 nt, Human
caaggccuucgucuccuagcuu

SEQ ID NO: 227828 - RNA, 22 nt, Human
gaaaguauucucccugaauuuu

SEQ ID NO: 227829 - RNA, 22 nt, Human
cuuaggcaagcagagcccaucc

SEQ ID NO: 227830 - RNA, 22 nt, Human
cggaaacuugagaaccagccag

SEQ ID NO: 227831 - RNA, 22 nt, Human
aaauucuuucauggcuaauaag

SEQ ID NO: 227832 - RNA, 23 nt, Human
uggaccugaaccagugccucugu

SEQ ID NO: 227833 - RNA, 22 nt, Human
auguccagaggugagucagagc

SEQ ID NO: 227834 - RNA, 22 nt, Human
cccagggcugcagauggaggcu

SEQ ID NO: 227835 - RNA, 21 nt, Human
uuuuacagaugaggggaaggg

SEQ ID NO: 227836 - RNA, 21 nt, Human
uucucaguguccauguuaguu

SEQ ID NO: 227837 - RNA, 19 nt, Human
aggcugcaagguggugggc

SEQ ID NO: 227838 - RNA, 22 nt, Human
uuugauagggaaguaagaauga

SEQ ID NO: 227839 - RNA, 22 nt, Human
uaugugucccugcuacucaaca

SEQ ID NO: 227840 - RNA, 22 nt, Human
uuccucagccagcacuuagggg

SEQ ID NO: 227841 - RNA, 22 nt, Human
caguggcaaguccgguauugaa

SEQ ID NO: 227842 - RNA, 22 nt, Human
gugcugacaggagccuggcggu

SEQ ID NO: 227843 - RNA, 22 nt, Human
uccuuucugggccucagugacu

SEQ ID NO: 227844 - RNA, 22 nt, Human
cagccuggccugggacugcuga

SEQ ID NO: 227845 - RNA, 20 nt, Human
ucaaagcaaagggagaugau

SEQ ID NO: 227846 - RNA, 21 nt, Human
gacaggacuagaccagagcuc

SEQ ID NO: 227847 - RNA, 22 nt, Human
gaggcucauugcauugugcauu

SEQ ID NO: 227848 - RNA, 22 nt, Human
aaaaugcuauuucauggaggag

SEQ ID NO: 227849 - RNA, 22 nt, Human
ucaacaauaggauauagcaggu

SEQ ID NO: 227850 - RNA, 22 nt, Human
ccuggagcaggagcugcagagg

SEQ ID NO: 227851 - RNA, 22 nt, Human
ucuggaauuuuauugaucaaaa

SEQ ID NO: 227852 - RNA, 22 nt, Human
aaacugguaaucggcaagugag

SEQ ID NO: 227853 - RNA, 22 nt, Human
ggguuggggcccagcagucugc

SEQ ID NO: 227854 - RNA, 22 nt, Human
acugagcacucacuuuuguuau

SEQ ID NO: 227855 - RNA, 22 nt, Human
ccuggcagccucagccaauucu

SEQ ID NO: 227856 - RNA, 22 nt, Human
ugggcacagggguaggaaugag

SEQ ID NO: 227857 - RNA, 22 nt, Human
agcuuuaccugccuuggggcac

SEQ ID NO: 227858 - RNA, 22 nt, Human
ugccaggcagugucagauugag

SEQ ID NO: 227859 - RNA, 22 nt, Human
uaccuguugucacgauaacacu

SEQ ID NO: 227860 - RNA, 22 nt, Human
ucucuguauucugauauucacu

SEQ ID NO: 227861 - RNA, 21 nt, Human
cugugggaccaagcacuggga

SEQ ID NO: 227862 - RNA, 22 nt, Human
uucuccagagguggcuagaguu

SEQ ID NO: 227863 - RNA, 22 nt, Human
augguaaacauuuaacaacuag

SEQ ID NO: 227864 - RNA, 22 nt, Human
uguuaaauguuuugcuaguguc

SEQ ID NO: 227865 - RNA, 21 nt, Human
uggagcucccugcaucccacu

SEQ ID NO: 227866 - RNA, 22 nt, Human
acaugugcucuugcuguacagc

SEQ ID NO: 227867 - RNA, 22 nt, Human
aauacuuaugugaccucauuuu

SEQ ID NO: 227868 - RNA, 22 nt, Human
uucaugaauauauugaauuagc

SEQ ID NO: 227869 - RNA, 21 nt, Human
uuagaacacuugcucuuggaa

SEQ ID NO: 227870 - RNA, 22 nt, Human
aagccuuccugagugcaaggcc

SEQ ID NO: 227871 - RNA, 22 nt, Human
uuucuacagcuggugcaacuuu

SEQ ID NO: 227872 - RNA, 22 nt, Human
uccuggccaggaugaccuaaca

SEQ ID NO: 227873 - RNA, 22 nt, Human
uagaggcauuaaugaauaaaca

SEQ ID NO: 227874 - RNA, 22 nt, Human
ccagguccuguuuucaccacag

SEQ ID NO: 227875 - RNA, 22 nt, Human
ccacaucugcauuuaauguaua

SEQ ID NO: 227876 - RNA, 22 nt, Human
gagugggcaccgugggcacacu

SEQ ID NO: 227877 - RNA, 22 nt, Human
cagagcaggcccacugcccucc

SEQ ID NO: 227878 - RNA, 22 nt, Human
gaggcugggggcugccuuccuc

SEQ ID NO: 227879 - RNA, 22 nt, Human
gagaaccucuccacaagucugg

SEQ ID NO: 227880 - RNA, 22 nt, Human
aagaaucugacauaauuuccug

SEQ ID NO: 227881 - RNA, 22 nt, Human
agucaguuuuaccaaucucagu

SEQ ID NO: 227882 - RNA, 22 nt, Human
ggaaagcuuuguacuugaaaac

SEQ ID NO: 227883 - RNA, 22 nt, Human
ugcuccugcugcaugcaucucc

SEQ ID NO: 227884 - RNA, 22 nt, Human
uggcugugcggccucgggcaga

SEQ ID NO: 227885 - RNA, 22 nt, Human
caccugcaaggagcuuucauuu

SEQ ID NO: 227886 - RNA, 22 nt, Human
ugcauuauacauggaucuaaag

SEQ ID NO: 227887 - RNA, 22 nt, Human
aauauaugacuccacugcauga

SEQ ID NO: 227888 - RNA, 22 nt, Human
uuucccaagaaaaauaauugga

SEQ ID NO: 227889 - RNA, 22 nt, Human
uccuguguuaaagggggugcua

SEQ ID NO: 227890 - RNA, 22 nt, Human
aauacugccugugagguaacuc

SEQ ID NO: 227891 - RNA, 22 nt, Human
ucugugcauuucaggaccugaa

SEQ ID NO: 227892 - RNA, 18 nt, Human
uuccauaauguauguaac

SEQ ID NO: 227893 - RNA, 22 nt, Human
uaccacaguuuaucuauucagc

SEQ ID NO: 227894 - RNA, 22 nt, Human
uccaggauugucagccagaagg

SEQ ID NO: 227895 - RNA, 22 nt, Human
uauauuuaauccuagagccauu

SEQ ID NO: 227896 - RNA, 22 nt, Human
cugggccucacacccaccaaau

SEQ ID NO: 227897 - RNA, 22 nt, Human
uagcugcugcagcacagggagg

SEQ ID NO: 227898 - RNA, 22 nt, Human
ugguggcagcugagugucaggu

SEQ ID NO: 227899 - RNA, 22 nt, Human
gugcacagauuuaauuuuauuc

SEQ ID NO: 227900 - RNA, 22 nt, Human
aguggcaggcggagauguagga

SEQ ID NO: 227901 - RNA, 22 nt, Human
caucccugucugccacucugaa

SEQ ID NO: 227902 - RNA, 22 nt, Human
cauauuuauucuucugccagug

SEQ ID NO: 227903 - RNA, 22 nt, Human
auggcaguguuucaguuuuugg

SEQ ID NO: 227904 - RNA, 22 nt, Human
ugcagggacaggcucuggggau

SEQ ID NO: 227905 - RNA, 22 nt, Human
acagcagggucacauucccucu

SEQ ID NO: 227906 - RNA, 19 nt, Human
agacacuggauggaaaaug

SEQ ID NO: 227907 - RNA, 22 nt, Human
uugaaugaguguuuuacucaug

SEQ ID NO: 227908 - RNA, 22 nt, Human
uuacacaaacacauuccagaua

SEQ ID NO: 227909 - RNA, 22 nt, Human
aggcuccagucuccucuggcag

SEQ ID NO: 227910 - RNA, 22 nt, Human
aucucugggcuuugaguuuguu

SEQ ID NO: 227911 - RNA, 22 nt, Human
ucacauuuuuuacuggacuuaa

SEQ ID NO: 227912 - RNA, 22 nt, Human
uagucagugaucaguggaguug

SEQ ID NO: 227913 - RNA, 22 nt, Human
gggagcugguuccugcccucca

SEQ ID NO: 227914 - RNA, 19 nt, Human
acaaauuguccucaucaag

SEQ ID NO: 227915 - RNA, 22 nt, Human
augccugcuuacuccaggugcu

SEQ ID NO: 227916 - RNA, 22 nt, Human
ucagggcaaagggcagaguuug

SEQ ID NO: 227917 - RNA, 22 nt, Human
acuucaaauuuucagaagaaau

SEQ ID NO: 227918 - RNA, 22 nt, Human
cagucuaacuucacagccugga

SEQ ID NO: 227919 - RNA, 22 nt, Human
cccugcugaaucccauggaguc

SEQ ID NO: 227920 - RNA, 22 nt, Human
agacaauggagagcagaguacu

SEQ ID NO: 227921 - RNA, 22 nt, Human
aacuccagggggucaauauuua

SEQ ID NO: 227922 - RNA, 22 nt, Human
uuggauuacaugaaaugcagaa

SEQ ID NO: 227923 - RNA, 22 nt, Human
agguccagcucuauugaaaaga

SEQ ID NO: 227924 - RNA, 22 nt, Human
ggguccaccugagcagcagccu

SEQ ID NO: 227925 - RNA, 22 nt, Human
ugaaccuucauaaaauuaagug

SEQ ID NO: 227926 - RNA, 22 nt, Human
ccagagcugaggagaugggcuu

SEQ ID NO: 227927 - RNA, 22 nt, Human
ccaggaagaaacagucuuuaua

SEQ ID NO: 227928 - RNA, 22 nt, Human
agggcucugagcuggaccaccu

SEQ ID NO: 227929 - RNA, 23 nt, Human
cagaaaacccagagcucaguccc

SEQ ID NO: 227930 - RNA, 22 nt, Human
ugcccugcuaaauauagguagc

SEQ ID NO: 227931 - RNA, 22 nt, Human
gcaguuugagguuuucugaugu

SEQ ID NO: 227932 - RNA, 22 nt, Human
ucagagagcagaacuuuuuuac

SEQ ID NO: 227933 - RNA, 22 nt, Human
guccauacaguggcacacaucu

SEQ ID NO: 227934 - RNA, 22 nt, Human
guuggugaugccacacauauuu

SEQ ID NO: 227935 - RNA, 22 nt, Human
aaggaacucuagagccuugaac

SEQ ID NO: 227936 - RNA, 20 nt, Human
acaauacagguugugucuga

SEQ ID NO: 227937 - RNA, 22 nt, Human
uggcccugcuggacacgccugc

SEQ ID NO: 227938 - RNA, 22 nt, Human
ggcagcuccucaaaaaauuaaa

SEQ ID NO: 227939 - RNA, 20 nt, Human
agccaggcucaagcuccccc

SEQ ID NO: 227940 - RNA, 22 nt, Human
cuacauuuguucuauagcuuuu

SEQ ID NO: 227941 - RNA, 22 nt, Human
gcagaggccugaagguggcggg

SEQ ID NO: 227942 - RNA, 19 nt, Human
gcucaacagcucggguccu

SEQ ID NO: 227943 - RNA, 22 nt, Human
cuagggcacuaggacucaugug

SEQ ID NO: 227944 - RNA, 22 nt, Human
accuacauaguuaaguaacaaa

SEQ ID NO: 227945 - RNA, 22 nt, Human
cgcaggugccggcagauggggu

SEQ ID NO: 227946 - RNA, 21 nt, Human
acaugucuggucauuuuuagc

SEQ ID NO: 227947 - RNA, 22 nt, Human
gaaauauugggacucagagcuu

SEQ ID NO: 227948 - RNA, 19 nt, Human
cacagcucugcucagggaa

SEQ ID NO: 227949 - RNA, 22 nt, Human
uguccuguagguuuauuugugu

SEQ ID NO: 227950 - RNA, 22 nt, Human
cagaacugaccucugauucuag

SEQ ID NO: 227951 - RNA, 22 nt, Human
ucucuguagggcugcuugagua

SEQ ID NO: 227952 - RNA, 22 nt, Human
ggacgcagccgagggagcaggg

SEQ ID NO: 227953 - RNA, 22 nt, Human
auuuggugagguagccauuguu

SEQ ID NO: 227954 - RNA, 22 nt, Human
agguggcugccuccccgcgcgg

SEQ ID NO: 227955 - RNA, 22 nt, Human
aaacuacaucucauggaugagg

SEQ ID NO: 227956 - RNA, 21 nt, Human
gcacagggacagaucaucaca

SEQ ID NO: 227957 - RNA, 22 nt, Human
aauguacaucucaguguaguac

SEQ ID NO: 227958 - RNA, 22 nt, Human
uuuccuaagguagugauaauuu

SEQ ID NO: 227959 - RNA, 22 nt, Human
ggccccaggccuuuggucuggc

SEQ ID NO: 227960 - RNA, 22 nt, Human
agcugcuuguacaugaccacau

SEQ ID NO: 227961 - RNA, 22 nt, Human
guccaggccccagggauucuug

SEQ ID NO: 227962 - RNA, 22 nt, Human
ccauuugugauguggcagcauc

SEQ ID NO: 227963 - RNA, 22 nt, Human
ucuuguaauuaacuagaaagau

SEQ ID NO: 227964 - RNA, 22 nt, Human
uucuggaguauuccuggcagcc

SEQ ID NO: 227965 - RNA, 22 nt, Human
uagguauaauauuuugaagaaa

SEQ ID NO: 227966 - RNA, 22 nt, Human
ggaggcuccaugagcuccugca

SEQ ID NO: 227967 - RNA, 22 nt, Human
agaagccaacagggcaggagag

SEQ ID NO: 227968 - RNA, 22 nt, Human
uccuggccagaggacaaagcug

SEQ ID NO: 227969 - RNA, 22 nt, Human
uaaaaccauaaggcuggaagga

SEQ ID NO: 227970 - RNA, 22 nt, Human
aauguauaaaguguuaauaacu

SEQ ID NO: 227971 - RNA, 22 nt, Human
cugcccuggcagccuaccaugg

SEQ ID NO: 227972 - RNA, 22 nt, Human
ugucuuuuuaccugugaugagu

SEQ ID NO: 227973 - RNA, 22 nt, Human
cagcaggucuuguugcugcuga

SEQ ID NO: 227974 - RNA, 22 nt, Human
uuguuagugcaauguuugguga

SEQ ID NO: 227975 - RNA, 22 nt, Human
ugagaaugaaucuuuugcuuuc

SEQ ID NO: 227976 - RNA, 22 nt, Human
cuucucugucacaggguuacgu

SEQ ID NO: 227977 - RNA, 22 nt, Human
gcugcagggggugggcgucucc

SEQ ID NO: 227978 - RNA, 22 nt, Human
aggcagguuuacucuuauuugg

SEQ ID NO: 227979 - RNA, 22 nt, Human
uggcuuggacuaaauggaccgu

SEQ ID NO: 227980 - RNA, 22 nt, Human
gcucaaagaauauucagaauga

SEQ ID NO: 227981 - RNA, 22 nt, Human
aggcucugugaugugccaggca

SEQ ID NO: 227982 - RNA, 22 nt, Human
accucuggacacugcauccuuc

SEQ ID NO: 227983 - RNA, 22 nt, Human
uuagauaaaaguguucaauaaa

SEQ ID NO: 227984 - RNA, 23 nt, Human
cucccuggaguuucuggaagaug

SEQ ID NO: 227985 - RNA, 22 nt, Human
aacagaauaguugauguacagu

SEQ ID NO: 227986 - RNA, 22 nt, Human
ggaggaagagguuguucucuca

SEQ ID NO: 227987 - RNA, 23 nt, Human
ucagucuucccugucaguaauag

SEQ ID NO: 227988 - RNA, 22 nt, Human
ggugaggggagagugaaagaaa

SEQ ID NO: 227989 - RNA, 22 nt, Human
aagucagaccuuguugauagcu

SEQ ID NO: 227990 - RNA, 22 nt, Human
caguucugguuugcagauauau

SEQ ID NO: 227991 - RNA, 22 nt, Human
aauaaauguuaagauugucuca

SEQ ID NO: 227992 - RNA, 22 nt, Human
agucucagaaaauaugcuuuuu

SEQ ID NO: 227993 - RNA, 22 nt, Human
ggccaggcuggucucagacuuc

SEQ ID NO: 227994 - RNA, 22 nt, Human
uuuccacacaggcucuacuacu

SEQ ID NO: 227995 - RNA, 22 nt, Human
aagaagucuggagcaaugcaau

SEQ ID NO: 227996 - RNA, 22 nt, Human
uuuccaugaucguuauagaacu

SEQ ID NO: 227997 - RNA, 22 nt, Human
agccaaaguccaaaugcagugu

SEQ ID NO: 227998 - RNA, 22 nt, Human
uggaucugacuggcuuuucuuc

SEQ ID NO: 227999 - RNA, 22 nt, Human
aacaggcuucuucugggcuccu

SEQ ID NO: 228000 - RNA, 22 nt, Human
ucagaaaagguagcugugacaa

SEQ ID NO: 228001 - RNA, 22 nt, Human
ucagguguguuguauuuuacca

SEQ ID NO: 228002 - RNA, 22 nt, Human
auugugcaauguuuuacaauuu

SEQ ID NO: 228003 - RNA, 22 nt, Human
aagggcucgguagcaguccuga

SEQ ID NO: 228004 - RNA, 22 nt, Human
caccaggcugaaccagagggga

SEQ ID NO: 228005 - RNA, 22 nt, Human
uucacacuuuggaauuccaccu

SEQ ID NO: 228006 - RNA, 22 nt, Human
uacaacagaccuagaugaauga

SEQ ID NO: 228007 - RNA, 22 nt, Human
acaguuuuuucaacauuggaau

SEQ ID NO: 228008 - RNA, 22 nt, Human
acauuagaacauuaauauuggg

SEQ ID NO: 228009 - RNA, 22 nt, Human
augugugcaucaaugauagauc

SEQ ID NO: 228010 - RNA, 22 nt, Human
acccagggucaccccguagggu

SEQ ID NO: 228011 - RNA, 22 nt, Human
agaaugcuuguaccuuuguuuu

SEQ ID NO: 228012 - RNA, 22 nt, Human
uggagcucaaaggccuguggga

SEQ ID NO: 228013 - RNA, 22 nt, Human
gccagcaguggccaccaccagg

SEQ ID NO: 228014 - RNA, 22 nt, Human
uccaguuuauuaugcauuuaca

SEQ ID NO: 228015 - RNA, 22 nt, Human
ccccagccagcuuguaguagaa

SEQ ID NO: 228016 - RNA, 22 nt, Human
cugggccuugaucacacaggug

SEQ ID NO: 228017 - RNA, 22 nt, Human
aaugggcuuucuuggacaggag

SEQ ID NO: 228018 - RNA, 22 nt, Human
gcacauuguuacucuuacugug

SEQ ID NO: 228019 - RNA, 22 nt, Human
agcagcaggguguaauugggca

SEQ ID NO: 228020 - RNA, 22 nt, Human
ucuguacaugaguugagaauca

SEQ ID NO: 228021 - RNA, 22 nt, Human
auuaggugggguuguuacuguu

SEQ ID NO: 228022 - RNA, 22 nt, Human
gccugggaagacuaagugggag

SEQ ID NO: 228023 - RNA, 22 nt, Human
uguguuuugaacucaucuacug

SEQ ID NO: 228024 - RNA, 22 nt, Human
aucuccagauugugaucaucag

SEQ ID NO: 228025 - RNA, 22 nt, Human
uucuuuuaaaagagagcagaaa

SEQ ID NO: 228026 - RNA, 22 nt, Human
cuggggacuuugguucuccaug

SEQ ID NO: 228027 - RNA, 22 nt, Human
guguguccuugggccucugcag

SEQ ID NO: 228028 - RNA, 22 nt, Human
gcacccagccagcaucucagag

SEQ ID NO: 228029 - RNA, 22 nt, Human
ucccacugugccuguuguaauc

SEQ ID NO: 228030 - RNA, 22 nt, Human
aaggugguuugcagacagaaua

SEQ ID NO: 228031 - RNA, 22 nt, Human
aaggugaaacuggaagcuggcc

SEQ ID NO: 228032 - RNA, 22 nt, Human
cugggugaguugaugaaggaga

SEQ ID NO: 228033 - RNA, 22 nt, Human
uccugggacucaacuuagaagg

SEQ ID NO: 228034 - RNA, 22 nt, Human
ucuuuuguugccuacuuauuaa

SEQ ID NO: 228035 - RNA, 22 nt, Human
ucccagcagaugagcugaccua

SEQ ID NO: 228036 - RNA, 22 nt, Human
ggcccagugucccggucguggc

SEQ ID NO: 228037 - RNA, 22 nt, Human
ucagagaaaugaaguagggauu

SEQ ID NO: 228038 - RNA, 22 nt, Human
acaugugucuaagaaugaaaga

SEQ ID NO: 228039 - RNA, 20 nt, Human
agaagcugauacugauggaa

SEQ ID NO: 228040 - RNA, 22 nt, Human
ggcacuuugauuuugagaugca

SEQ ID NO: 228041 - RNA, 22 nt, Human
augaagggugucccugugagca

SEQ ID NO: 228042 - RNA, 22 nt, Human
uuucauuuugguuaugccauaa

SEQ ID NO: 228043 - RNA, 17 nt, Human
acaguuugucauucuaa

SEQ ID NO: 228044 - RNA, 22 nt, Human
cagaagcuagcaggaaaguuuu

SEQ ID NO: 228045 - RNA, 22 nt, Human
gaagggaacugggucuccuugu

SEQ ID NO: 228046 - RNA, 22 nt, Human
uuuacaguuccaugugauaggc

SEQ ID NO: 228047 - RNA, 22 nt, Human
caggaugccaucugcugcugcu

SEQ ID NO: 228048 - RNA, 22 nt, Human
acucagagugcaucuccuauuu

SEQ ID NO: 228049 - RNA, 22 nt, Human
uccugcaggcuugaguccucag

SEQ ID NO: 228050 - RNA, 22 nt, Human
uuuguagauucauugaacuuuu

SEQ ID NO: 228051 - RNA, 22 nt, Human
guugacagugacccugaaagca

SEQ ID NO: 228052 - RNA, 20 nt, Human
gccacugggcaccagcaggg

SEQ ID NO: 228053 - RNA, 22 nt, Human
ccuuucucuuugcugaucaugu

SEQ ID NO: 228054 - RNA, 22 nt, Human
uguauuagguugaugcgaaagu

SEQ ID NO: 228055 - RNA, 22 nt, Human
ugggccuggacaaggccacuag

SEQ ID NO: 228056 - RNA, 22 nt, Human
uggcuucuagagcccauccuuc

SEQ ID NO: 228057 - RNA, 22 nt, Human
gcuaauucacaguaggaaauuu

SEQ ID NO: 228058 - RNA, 22 nt, Human
aagucccaaagucacucugcuu

SEQ ID NO: 228059 - RNA, 22 nt, Human
aaauacgugcacauacauacau

SEQ ID NO: 228060 - RNA, 23 nt, Human
acaugcaaaaaucacagucuccu

SEQ ID NO: 228061 - RNA, 22 nt, Human
uuccugggugguccugguagag

SEQ ID NO: 228062 - RNA, 22 nt, Human
cauccauuaacucauuuguuuc

SEQ ID NO: 228063 - RNA, 22 nt, Human
uuuccuucucagggagcuucaa

SEQ ID NO: 228064 - RNA, 22 nt, Human
ugauuuacccguccaggcccua

SEQ ID NO: 228065 - RNA, 22 nt, Human
cccugggagaaguugagggcug

SEQ ID NO: 228066 - RNA, 22 nt, Human
ugaauucuuuuagaauucagug

SEQ ID NO: 228067 - RNA, 22 nt, Human
ucccuccuuaauaagaggucug

SEQ ID NO: 228068 - RNA, 22 nt, Human
acaggcagagucagguuggguu

SEQ ID NO: 228069 - RNA, 22 nt, Human
ucuccgaucacagguuuucaau

SEQ ID NO: 228070 - RNA, 22 nt, Human
cccaggucugccagccuguggg

SEQ ID NO: 228071 - RNA, 22 nt, Human
cuccagauuccguuuauucagg

SEQ ID NO: 228072 - RNA, 22 nt, Human
cuacauuuugugauuaugaaau

SEQ ID NO: 228073 - RNA, 22 nt, Human
agaaagaacgcacuugugcugc

SEQ ID NO: 228074 - RNA, 19 nt, Human
cugcuuccuucccucacug

SEQ ID NO: 228075 - RNA, 22 nt, Human
uacauugcuuucuaauacaucu

SEQ ID NO: 228076 - RNA, 22 nt, Human
gucuccagaauucuugggaggg

SEQ ID NO: 228077 - RNA, 22 nt, Human
uuugacuucugggcauuuuggu

SEQ ID NO: 228078 - RNA, 22 nt, Human
cccagccagccucuucccauau

SEQ ID NO: 228079 - RNA, 19 nt, Human
ccagugucuagcgcacagc

SEQ ID NO: 228080 - RNA, 22 nt, Human
ugggagccuggcaggccagagg

SEQ ID NO: 228081 - RNA, 22 nt, Human
gguggcacucaaccuuuuauua

SEQ ID NO: 228082 - RNA, 22 nt, Human
augggacaggcaugggacuuag

SEQ ID NO: 228083 - RNA, 20 nt, Human
uugauucaagggcugaugga

SEQ ID NO: 228084 - RNA, 22 nt, Human
ucauggauuaaauuauuaaguu

SEQ ID NO: 228085 - RNA, 22 nt, Human
gcucagcacuuucuccaaccac

SEQ ID NO: 228086 - RNA, 22 nt, Human
guuagaaacacauucuuauuga

SEQ ID NO: 228087 - RNA, 22 nt, Human
ucugggccugucucagagcugg

SEQ ID NO: 228088 - RNA, 22 nt, Human
uuuguguggcguuggccggcgg

SEQ ID NO: 228089 - RNA, 22 nt, Human
ucuuacaccauucaaauauuuu

SEQ ID NO: 228090 - RNA, 22 nt, Human
cagcagaaaauaccuguaacuc

SEQ ID NO: 228091 - RNA, 22 nt, Human
uaggccaguaaaauguuucagu

SEQ ID NO: 228092 - RNA, 22 nt, Human
accagggcugacaaucugaugg

SEQ ID NO: 228093 - RNA, 22 nt, Human
cacuggaaccauccacauagug

SEQ ID NO: 228094 - RNA, 23 nt, Human
acuuggaagcagugaacaacuuu

SEQ ID NO: 228095 - RNA, 22 nt, Human
ucuagggugugcggcagggcua

SEQ ID NO: 228096 - RNA, 22 nt, Human
aaauagaauuaacuagcuacug

SEQ ID NO: 228097 - RNA, 22 nt, Human
acucuggcuugaggaccagguc

SEQ ID NO: 228098 - RNA, 22 nt, Human
gcugagcucccagcaguaucug

SEQ ID NO: 228099 - RNA, 22 nt, Human
gugcaaccaucaccacugacuc

SEQ ID NO: 228100 - RNA, 22 nt, Human
gggucucuccuccccagcugug

SEQ ID NO: 228101 - RNA, 22 nt, Human
agccagcuggagaccacuguuu

SEQ ID NO: 228102 - RNA, 22 nt, Human
ggaagagagaucccauagaugu

SEQ ID NO: 228103 - RNA, 22 nt, Human
ucugagagucuuucuucaagug

SEQ ID NO: 228104 - RNA, 22 nt, Human
agucaacaaaaauguggagccu

SEQ ID NO: 228105 - RNA, 22 nt, Human
gaacuguggguaauauauuaga

SEQ ID NO: 228106 - RNA, 22 nt, Human
ccagggcagggaccacgugucu

SEQ ID NO: 228107 - RNA, 22 nt, Human
aaugcaaagcucuuuaauccuu

SEQ ID NO: 228108 - RNA, 22 nt, Human
ggccaugccuggucuggcacca

SEQ ID NO: 228109 - RNA, 22 nt, Human
aucuuucaguuucauaccaauu

SEQ ID NO: 228110 - RNA, 22 nt, Human
ugucacuacaucauaaauauau

SEQ ID NO: 228111 - RNA, 22 nt, Human
aggaaugugaccacuagacucu

SEQ ID NO: 228112 - RNA, 23 nt, Human
uucaggaaaugaauacagacaca

SEQ ID NO: 228113 - RNA, 22 nt, Human
aauauuuuugaggcccuguuau

SEQ ID NO: 228114 - RNA, 22 nt, Human
uagaggugacacugagaccaua

SEQ ID NO: 228115 - RNA, 22 nt, Human
uuaagggccauuauggaugggu

SEQ ID NO: 228116 - RNA, 22 nt, Human
uuaacagagugccuggcaugua

SEQ ID NO: 228117 - RNA, 22 nt, Human
ucucauucauacccuacaugcu

SEQ ID NO: 228118 - RNA, 22 nt, Human
agguccagguuccguuucugcg

SEQ ID NO: 228119 - RNA, 22 nt, Human
ggcagugguuagaaacaugagc

SEQ ID NO: 228120 - RNA, 22 nt, Human
gccuggccugaacuaggaggug

SEQ ID NO: 228121 - RNA, 21 nt, Human
gaguccuggcuaggguggcag

SEQ ID NO: 228122 - RNA, 22 nt, Human
guucucccuguccccugagcuu

SEQ ID NO: 228123 - RNA, 22 nt, Human
acuguaacacucauacugaagu

SEQ ID NO: 228124 - RNA, 22 nt, Human
uggcucugugcuucuaguaucu

SEQ ID NO: 228125 - RNA, 22 nt, Human
acuugagagaaucggaggaguc

SEQ ID NO: 228126 - RNA, 19 nt, Human
uuucugucuguguuuugcc

SEQ ID NO: 228127 - RNA, 22 nt, Human
gaagccagauuaucacaagcca

SEQ ID NO: 228128 - RNA, 22 nt, Human
uccaggcaaaaggaacugcuug

SEQ ID NO: 228129 - RNA, 22 nt, Human
cucaaagaagggagguauuugg

SEQ ID NO: 228130 - RNA, 22 nt, Human
aaggaaaggaugagcaugcauu

SEQ ID NO: 228131 - RNA, 22 nt, Human
gccagcauaguaagcagucauc

SEQ ID NO: 228132 - RNA, 19 nt, Human
agcuggagauuggagggca

SEQ ID NO: 228133 - RNA, 18 nt, Human
cugauagggguggcagcu

SEQ ID NO: 228134 - RNA, 22 nt, Human
caggcucccuucucggaauucu

SEQ ID NO: 228135 - RNA, 22 nt, Human
ggguacuuaauauuuacggggu

SEQ ID NO: 228136 - RNA, 22 nt, Human
ucugaggccugaagcagcagag

SEQ ID NO: 228137 - RNA, 22 nt, Human
acagugcagggcgggaagaagg

SEQ ID NO: 228138 - RNA, 22 nt, Human
uuauuuauuguguaccuacugu

SEQ ID NO: 228139 - RNA, 22 nt, Human
acugaagaacgcaucagugguu

SEQ ID NO: 228140 - RNA, 18 nt, Human
gaggaaacaaggcagagg

SEQ ID NO: 228141 - RNA, 19 nt, Human
ggcugccuucugcucaucu

SEQ ID NO: 228142 - RNA, 19 nt, Human
cccucaggucugagcaguc

SEQ ID NO: 228143 - RNA, 22 nt, Human
cccaguggaaggaguagaagac

SEQ ID NO: 228144 - RNA, 22 nt, Human
uguaggcacauguauauauccc

SEQ ID NO: 228145 - RNA, 22 nt, Human
uuauuguuuaaagccauguaaa

SEQ ID NO: 228146 - RNA, 22 nt, Human
acccuuuguccaauagaaauga

SEQ ID NO: 228147 - RNA, 22 nt, Human
cuuauucagaccuuggauucuu

SEQ ID NO: 228148 - RNA, 22 nt, Human
gauucuuuacucagauuuuguu

SEQ ID NO: 228149 - RNA, 22 nt, Human
gcaaguacaaacgcaucggcug

SEQ ID NO: 228150 - RNA, 22 nt, Human
agcugcaagauaaaagugaugu

SEQ ID NO: 228151 - RNA, 22 nt, Human
ugggcuucauaauugguccuag

SEQ ID NO: 228152 - RNA, 22 nt, Human
gauggucuuugucucugauaag

SEQ ID NO: 228153 - RNA, 21 nt, Human
agugaaaugaaguguaugcuc

SEQ ID NO: 228154 - RNA, 22 nt, Human
agaggcccucucucuccugaug

SEQ ID NO: 228155 - RNA, 22 nt, Human
uggaauuuaguuaauuccauuu

SEQ ID NO: 228156 - RNA, 22 nt, Human
gacaauugcuuuugccgaauaa

SEQ ID NO: 228157 - RNA, 22 nt, Human
auaauuaggucuuauaacgucu

SEQ ID NO: 228158 - RNA, 22 nt, Human
cuuugcugagcugguuguucaa

SEQ ID NO: 228159 - RNA, 19 nt, Human
uuacacuucugcuuuguga

SEQ ID NO: 228160 - RNA, 20 nt, Human
acagaaagagagaaugucag

SEQ ID NO: 228161 - RNA, 22 nt, Human
uagugucauuucaguggaguuu

SEQ ID NO: 228162 - RNA, 22 nt, Human
ucaguuaauauggguaaagcau

SEQ ID NO: 228163 - RNA, 22 nt, Human
aaggccugcucagcugucugug

SEQ ID NO: 228164 - RNA, 18 nt, Human
auggaggcagagagcuga

SEQ ID NO: 228165 - RNA, 22 nt, Human
ggagcugugcugggugaucagg

SEQ ID NO: 228166 - RNA, 22 nt, Human
cauuugaagaagaaacguacua

SEQ ID NO: 228167 - RNA, 22 nt, Human
gaggaggaaaggaguugaaaug

SEQ ID NO: 228168 - RNA, 22 nt, Human
cugcuuuugagcccagugcuca

SEQ ID NO: 228169 - RNA, 22 nt, Human
aagucauagucgggaaagacau

SEQ ID NO: 228170 - RNA, 22 nt, Human
ggucagcagugcagggcagagc

SEQ ID NO: 228171 - RNA, 22 nt, Human
aaguuuauguugguaagauauc

SEQ ID NO: 228172 - RNA, 22 nt, Human
gcuggcuugauaguuucugcuu

SEQ ID NO: 228173 - RNA, 22 nt, Human
agugucaaauuaaauaaucugg

SEQ ID NO: 228174 - RNA, 22 nt, Human
ugcaggaggauuuuguggagcu

SEQ ID NO: 228175 - RNA, 22 nt, Human
agcuuuguggcuuugcaagacu

SEQ ID NO: 228176 - RNA, 22 nt, Human
gaccacagauuccuaaguggca

SEQ ID NO: 228177 - RNA, 22 nt, Human
gcaggcugccaccuucugaguu

SEQ ID NO: 228178 - RNA, 19 nt, Human
acaaauuggcaaaaugcaa

SEQ ID NO: 228179 - RNA, 22 nt, Human
uuugcaaauauguguuucuauu

SEQ ID NO: 228180 - RNA, 22 nt, Human
cugaggcaugggaaguugggug

SEQ ID NO: 228181 - RNA, 22 nt, Human
acaaaugaaucauacauaaugu

SEQ ID NO: 228182 - RNA, 22 nt, Human
ccauggccaauugcaccuugcu

SEQ ID NO: 228183 - RNA, 22 nt, Human
cacaccuguaauccuagcacuu

SEQ ID NO: 228184 - RNA, 22 nt, Human
uaggauaugcauuuuuauacau

SEQ ID NO: 228185 - RNA, 22 nt, Human
uugagaacucuguauguccagc

SEQ ID NO: 228186 - RNA, 22 nt, Human
ccugggcucaagcgaucuuguc

SEQ ID NO: 228187 - RNA, 22 nt, Human
guccaguggucaauuaucugga

SEQ ID NO: 228188 - RNA, 22 nt, Human
gaagcaaguggccugauucaga

SEQ ID NO: 228189 - RNA, 22 nt, Human
uacaguacacagguaccaagcu

SEQ ID NO: 228190 - RNA, 22 nt, Human
cagcugccaugacauguccugc

SEQ ID NO: 228191 - RNA, 22 nt, Human
agaccuggagugaagaguuccc

SEQ ID NO: 228192 - RNA, 19 nt, Human
guucaaacacugauucagc

SEQ ID NO: 228193 - RNA, 22 nt, Human
ucuaggagcuuaaaggaggcca

SEQ ID NO: 228194 - RNA, 22 nt, Human
ccuggaaggcaggcauggauug

SEQ ID NO: 228195 - RNA, 22 nt, Human
aguaucaaucacccuuugaagu

SEQ ID NO: 228196 - RNA, 22 nt, Human
gcccugcagugcggagguggca

SEQ ID NO: 228197 - RNA, 22 nt, Human
gaaucaaugguagauuaaguaa

SEQ ID NO: 228198 - RNA, 22 nt, Human
aagcagaaggggaauaauauuu

SEQ ID NO: 228199 - RNA, 22 nt, Human
aaccauuugcaguuacugagac

SEQ ID NO: 228200 - RNA, 22 nt, Human
aacaguguguacacaucauagg

SEQ ID NO: 228201 - RNA, 22 nt, Human
gcccaggugcccucugccuuac

SEQ ID NO: 228202 - RNA, 22 nt, Human
acagccaggaauucuggagaag

SEQ ID NO: 228203 - RNA, 20 nt, Human
auccaucauguccaugacuu

SEQ ID NO: 228204 - RNA, 22 nt, Human
caaaacugucuagagagagaag

SEQ ID NO: 228205 - RNA, 22 nt, Human
uuuucuauuaacucauuuugca

SEQ ID NO: 228206 - RNA, 16 nt, Human
ccucuggcaauuagau

SEQ ID NO: 228207 - RNA, 22 nt, Human
gacaccauuaccuuucuauauu

SEQ ID NO: 228208 - RNA, 22 nt, Human
acccucagacagcuguggccag

SEQ ID NO: 228209 - RNA, 21 nt, Human
ucugaggagaaacucuuggug

SEQ ID NO: 228210 - RNA, 22 nt, Human
ucuccuggauagauacuaucca

SEQ ID NO: 228211 - RNA, 22 nt, Human
gagcuucauauguugcagagaa

SEQ ID NO: 228212 - RNA, 22 nt, Human
ugccucugugugcaggugagca

SEQ ID NO: 228213 - RNA, 22 nt, Human
cccucccugugugccucauuug

SEQ ID NO: 228214 - RNA, 22 nt, Human
ucuggagcaacagagcaggaca

SEQ ID NO: 228215 - RNA, 22 nt, Human
ugcagagggaaaaggugcuccu

SEQ ID NO: 228216 - RNA, 22 nt, Human
aagaaaugcugauguuggaugg

SEQ ID NO: 228217 - RNA, 22 nt, Human
agcuugaauuauucugcucuua

SEQ ID NO: 228218 - RNA, 22 nt, Human
aggcagguuucccggcugucaa

SEQ ID NO: 228219 - RNA, 22 nt, Human
acucaccacacccuugcacuug

SEQ ID NO: 228220 - RNA, 22 nt, Human
aggcuucuugauaaaaugcaga

SEQ ID NO: 228221 - RNA, 22 nt, Human
uuaggaauauagacuaaguaga

SEQ ID NO: 228222 - RNA, 22 nt, Human
augagggaagcucacgugucca

SEQ ID NO: 228223 - RNA, 22 nt, Human
aguaaacaauguaugaggacag

SEQ ID NO: 228224 - RNA, 22 nt, Human
gugcaugguaagaugcuucaca

SEQ ID NO: 228225 - RNA, 22 nt, Human
ugcacaaagcauucuagacgca

SEQ ID NO: 228226 - RNA, 22 nt, Human
aucagagcaauggauaaaauca

SEQ ID NO: 228227 - RNA, 22 nt, Human
auauauacuuugacacauucug

SEQ ID NO: 228228 - RNA, 22 nt, Human
gagaacaggcucuggagucaga

SEQ ID NO: 228229 - RNA, 22 nt, Human
ggcaggagcucagguugguucc

SEQ ID NO: 228230 - RNA, 22 nt, Human
uggcacugaagcuggaaagccu

SEQ ID NO: 228231 - RNA, 22 nt, Human
aaagggcagaguucacuagaaa

SEQ ID NO: 228232 - RNA, 22 nt, Human
cugaggcuaaccucgagagaca

SEQ ID NO: 228233 - RNA, 23 nt, Human
gaggccacauuccccugcuugag

SEQ ID NO: 228234 - RNA, 22 nt, Human
ccagggcaaaugagaucauagc

SEQ ID NO: 228235 - RNA, 22 nt, Human
agauguuuaaaaagaugacucu

SEQ ID NO: 228236 - RNA, 22 nt, Human
gcucagggaaugagaagauguu

SEQ ID NO: 228237 - RNA, 22 nt, Human
caguuaaaagaagucuaucuua

SEQ ID NO: 228238 - RNA, 22 nt, Human
ucacaaagggagggauagcugg

SEQ ID NO: 228239 - RNA, 22 nt, Human
ccugugccaaaaggcugcuuau

SEQ ID NO: 228240 - RNA, 22 nt, Human
ggagaaugauucuuugcucacu

SEQ ID NO: 228241 - RNA, 22 nt, Human
cuuuugcaccuuuuaaguaaug

SEQ ID NO: 228242 - RNA, 22 nt, Human
caggcccagcccuuagccaggu

SEQ ID NO: 228243 - RNA, 22 nt, Human
gagguucugggggucugccugg

SEQ ID NO: 228244 - RNA, 22 nt, Human
uuaauuacaaaacacauagguu

SEQ ID NO: 228245 - RNA, 22 nt, Human
ucauuucaugucucaggcacug

SEQ ID NO: 228246 - RNA, 22 nt, Human
augaaauugaucuugaacuuuu

SEQ ID NO: 228247 - RNA, 22 nt, Human
ccugggcuucugucuagauguu

SEQ ID NO: 228248 - RNA, 22 nt, Human
ugcaaaaagagcgaggagcccu

SEQ ID NO: 228249 - RNA, 22 nt, Human
gggccuggcaugcagccccguu

SEQ ID NO: 228250 - RNA, 22 nt, Human
ccagggccuacagcuuaagucc

SEQ ID NO: 228251 - RNA, 22 nt, Human
ugcuuuaucugugagaaccuga

SEQ ID NO: 228252 - RNA, 22 nt, Human
aggggagcuugaggcauggccu

SEQ ID NO: 228253 - RNA, 22 nt, Human
agucucagaguaccugagggac

SEQ ID NO: 228254 - RNA, 22 nt, Human
ucucagagauguuagggaagag

SEQ ID NO: 228255 - RNA, 22 nt, Human
uaaacaaggguuacugagcaug

SEQ ID NO: 228256 - RNA, 23 nt, Human
guuuuacaggugagaaaauggag

SEQ ID NO: 228257 - RNA, 17 nt, Human
ucugcagaggcaaaccu

SEQ ID NO: 228258 - RNA, 22 nt, Human
acacuguaaagugaugcuuaaa

SEQ ID NO: 228259 - RNA, 19 nt, Human
aaaaacuuaguccagaaag

SEQ ID NO: 228260 - RNA, 20 nt, Human
uggcccuguuuucuccaggc

SEQ ID NO: 228261 - RNA, 22 nt, Human
caaaugaaaauggcgucuugga

SEQ ID NO: 228262 - RNA, 22 nt, Human
uaaagacaugguguaggugaac

SEQ ID NO: 228263 - RNA, 22 nt, Human
gcccagggcuucaaagagagaa

SEQ ID NO: 228264 - RNA, 22 nt, Human
uagggauggcagcauguagcuu

SEQ ID NO: 228265 - RNA, 22 nt, Human
uuggagggacagauggcuaggc

SEQ ID NO: 228266 - RNA, 22 nt, Human
ucagcagguggugggcagguga

SEQ ID NO: 228267 - RNA, 22 nt, Human
auguagagcuccuugauccucc

SEQ ID NO: 228268 - RNA, 21 nt, Human
agcaggaggcagucacagcuc

SEQ ID NO: 228269 - RNA, 22 nt, Human
acucuucaccgcuacugaaaua

SEQ ID NO: 228270 - RNA, 18 nt, Human
cuguucagcugaacuaca

SEQ ID NO: 228271 - RNA, 22 nt, Human
cuucucccugggggcucuuuau

SEQ ID NO: 228272 - RNA, 22 nt, Human
agcagggcaaagucaggcuaac

SEQ ID NO: 228273 - RNA, 22 nt, Human
auuccaaaaggauguuagaaug

SEQ ID NO: 228274 - RNA, 22 nt, Human
ucucugaguuuuaaggaugaug

SEQ ID NO: 228275 - RNA, 22 nt, Human
uuuauugcuggccaccuguagc

SEQ ID NO: 228276 - RNA, 22 nt, Human
uuccuggguucccucucauucu

SEQ ID NO: 228277 - RNA, 22 nt, Human
aaguguauauaugacuuauaaa

SEQ ID NO: 228278 - RNA, 22 nt, Human
uagaccugaaauauggaccugg

SEQ ID NO: 228279 - RNA, 22 nt, Human
augcuaauuccaugagcacagg

SEQ ID NO: 228280 - RNA, 22 nt, Human
gcccaggaguucaaggcugcag

SEQ ID NO: 228281 - RNA, 18 nt, Human
ugaauuaguuugugguuu

SEQ ID NO: 228282 - RNA, 22 nt, Human
cuuaaacaggaaagagccaggu

SEQ ID NO: 228283 - RNA, 22 nt, Human
aauuccaacagacaaaguuaga

SEQ ID NO: 228284 - RNA, 22 nt, Human
auggauaagucaaagaguaucc

SEQ ID NO: 228285 - RNA, 22 nt, Human
aagcagacagagaauggguuug

SEQ ID NO: 228286 - RNA, 22 nt, Human
ucuuuagaaacuuuucuucaug

SEQ ID NO: 228287 - RNA, 22 nt, Human
gggcccuggccgaaucccucug

SEQ ID NO: 228288 - RNA, 18 nt, Human
ucagcuggguuucugggu

SEQ ID NO: 228289 - RNA, 22 nt, Human
uggaacacacuucaaggagaaa

SEQ ID NO: 228290 - RNA, 22 nt, Human
gcaacuguuuugagcacccagu

SEQ ID NO: 228291 - RNA, 22 nt, Human
uuagcaauguaugauuaaaaua

SEQ ID NO: 228292 - RNA, 22 nt, Human
aaagugcugugggcuguaagug

SEQ ID NO: 228293 - RNA, 22 nt, Human
ccacugaguacccgauggcugc

SEQ ID NO: 228294 - RNA, 22 nt, Human
caggcauagaagggcaagaaua

SEQ ID NO: 228295 - RNA, 22 nt, Human
ggaagcugaggcccagugaagg

SEQ ID NO: 228296 - RNA, 22 nt, Human
aaucagaacuucucaggguggg

SEQ ID NO: 228297 - RNA, 18 nt, Human
cccacggugcuguagggc

SEQ ID NO: 228298 - RNA, 22 nt, Human
augauaacaacagcagugcugg

SEQ ID NO: 228299 - RNA, 22 nt, Human
gggccucaugauggcucaggaa

SEQ ID NO: 228300 - RNA, 22 nt, Human
ccucccuggccagagcagcagc

SEQ ID NO: 228301 - RNA, 22 nt, Human
caucaguaaggcaacauagcuu

SEQ ID NO: 228302 - RNA, 22 nt, Human
ucaaauugucaucuugauaaug

SEQ ID NO: 228303 - RNA, 22 nt, Human
agaaaugacacacaugagacau

SEQ ID NO: 228304 - RNA, 22 nt, Human
gcagcauccccaggcagcaggg

SEQ ID NO: 228305 - RNA, 22 nt, Human
ucgccagggaugcuguaaggaa

SEQ ID NO: 228306 - RNA, 22 nt, Human
ugcucagagcuccagcucuccu

SEQ ID NO: 228307 - RNA, 22 nt, Human
caacauucaaccaacauuuaug

SEQ ID NO: 228308 - RNA, 22 nt, Human
ucaaggcaaaguaaauauucaa

SEQ ID NO: 228309 - RNA, 22 nt, Human
cuuggugagacucccacccacc

SEQ ID NO: 228310 - RNA, 22 nt, Human
acagccagucaucucagcaggg

SEQ ID NO: 228311 - RNA, 22 nt, Human
augcaugcagggaagacaguag

SEQ ID NO: 228312 - RNA, 22 nt, Human
agcaaagcaccauauggcaguu

SEQ ID NO: 228313 - RNA, 22 nt, Human
ugcugcagggaagucggggggu

SEQ ID NO: 228314 - RNA, 22 nt, Human
gacaucuccaaggcaaccuguu

SEQ ID NO: 228315 - RNA, 22 nt, Human
ccaggugguucaggucaccaua

SEQ ID NO: 228316 - RNA, 22 nt, Human
ccuggcugugugaccuuggcaa

SEQ ID NO: 228317 - RNA, 22 nt, Human
ccaagcaaggcuaauucacuug

SEQ ID NO: 228318 - RNA, 22 nt, Human
ggaggccagccugaggcugagg

SEQ ID NO: 228319 - RNA, 22 nt, Human
uggcucagauuuuuguaggcuu

SEQ ID NO: 228320 - RNA, 21 nt, Human
aacugagaccagcuaaagugg

SEQ ID NO: 228321 - RNA, 22 nt, Human
gcaaggaagagcagguggugcu

SEQ ID NO: 228322 - RNA, 22 nt, Human
caaggauucucacuagacuaga

SEQ ID NO: 228323 - RNA, 22 nt, Human
uggcccuauuuggaaauagagc

SEQ ID NO: 228324 - RNA, 22 nt, Human
uaagugaugauaguaccuagaa

SEQ ID NO: 228325 - RNA, 23 nt, Human
uuuugcaauaagucacuggaaua

SEQ ID NO: 228326 - RNA, 22 nt, Human
aaacucuagggcuccacauucc

SEQ ID NO: 228327 - RNA, 22 nt, Human
cauuguaagcuguugaauccuc

SEQ ID NO: 228328 - RNA, 22 nt, Human
gcugcccagggcugaguguccu

SEQ ID NO: 228329 - RNA, 22 nt, Human
gcuuccagcaaacacuggcugc

SEQ ID NO: 228330 - RNA, 22 nt, Human
ugcagggaaugcuugcagcaug

SEQ ID NO: 228331 - RNA, 22 nt, Human
uauuuuacagacuacuuuagau

SEQ ID NO: 228332 - RNA, 22 nt, Human
agcagccaagguaaccugugcu

SEQ ID NO: 228333 - RNA, 22 nt, Human
uuggaggaaagaagguugauau

SEQ ID NO: 228334 - RNA, 22 nt, Human
cugggagacgcagcuggggauc

SEQ ID NO: 228335 - RNA, 22 nt, Human
ugacuaaaauaggacauuaacu

SEQ ID NO: 228336 - RNA, 22 nt, Human
uacagauugagguuuuuaauau

SEQ ID NO: 228337 - RNA, 22 nt, Human
uacauaaugagcuaguuaaguu

SEQ ID NO: 228338 - RNA, 22 nt, Human
ggacagcugcuuucaggccaca

SEQ ID NO: 228339 - RNA, 22 nt, Human
aagaaucuaugguacauccaag

SEQ ID NO: 228340 - RNA, 22 nt, Human
uagcaaaggaugacuauguacc

SEQ ID NO: 228341 - RNA, 20 nt, Human
ugcugaggccugaggccugg

SEQ ID NO: 228342 - RNA, 22 nt, Human
uucaaguacuguagauuucagg

SEQ ID NO: 228343 - RNA, 22 nt, Human
auguuaaaugguuuauuauuaa

SEQ ID NO: 228344 - RNA, 22 nt, Human
aauggcuuagcagaguuagaag

SEQ ID NO: 228345 - RNA, 21 nt, Human
ucucugugguccaaucccagc

SEQ ID NO: 228346 - RNA, 22 nt, Human
guuucuguaagacugaauugac

SEQ ID NO: 228347 - RNA, 22 nt, Human
cauuugaaauaguucauucuug

SEQ ID NO: 228348 - RNA, 22 nt, Human
ucuggaucucccucauccuggg

SEQ ID NO: 228349 - RNA, 22 nt, Human
ggacagacagugugagugaggc

SEQ ID NO: 228350 - RNA, 22 nt, Human
uuuaguagaaugauacagggca

SEQ ID NO: 228351 - RNA, 22 nt, Human
uauuccaacuucacuauugucu

SEQ ID NO: 228352 - RNA, 22 nt, Human
uccagccuugccacuuuucugu

SEQ ID NO: 228353 - RNA, 22 nt, Human
cuuguugcuaacauaugcuucu

SEQ ID NO: 228354 - RNA, 22 nt, Human
acauuguauaaugauuaucaca

SEQ ID NO: 228355 - RNA, 22 nt, Human
ggucccaguccucucccugcua

SEQ ID NO: 228356 - RNA, 22 nt, Human
auugcagcucagggugaugacu

SEQ ID NO: 228357 - RNA, 22 nt, Human
agcuggagaguuuccaggaagg

SEQ ID NO: 228358 - RNA, 22 nt, Human
gagauggggucagcugggacau

SEQ ID NO: 228359 - RNA, 22 nt, Human
gccugagaguugaaguucagug

SEQ ID NO: 228360 - RNA, 22 nt, Human
uaauguuuagaagcagacagcu

SEQ ID NO: 228361 - RNA, 22 nt, Human
gaacuuggaccugguccuuugg

SEQ ID NO: 228362 - RNA, 22 nt, Human
aaaguguugaagaaaauguuca

SEQ ID NO: 228363 - RNA, 22 nt, Human
ucuuuggggcaucugggagauu

SEQ ID NO: 228364 - RNA, 22 nt, Human
ggcaucagcccgguccugggcu

SEQ ID NO: 228365 - RNA, 22 nt, Human
gcccagcacagcuggaagaguc

SEQ ID NO: 228366 - RNA, 22 nt, Human
aggucugucuggccccaugaau

SEQ ID NO: 228367 - RNA, 22 nt, Human
caggcuccagcuuccugcucag

SEQ ID NO: 228368 - RNA, 22 nt, Human
cuuagaauuuugccuacuacaa

SEQ ID NO: 228369 - RNA, 22 nt, Human
auugcuuucuuuggggaacugu

SEQ ID NO: 228370 - RNA, 21 nt, Human
ucagguggcagaguguuuaug

SEQ ID NO: 228371 - RNA, 21 nt, Human
agaugcugaugcugcaggucc

SEQ ID NO: 228372 - RNA, 22 nt, Human
auaaacaagacuggccaacuuu

SEQ ID NO: 228373 - RNA, 22 nt, Human
auguaaagggcaugguauuggg

SEQ ID NO: 228374 - RNA, 22 nt, Human
ugacagggugauuaugagagcu

SEQ ID NO: 228375 - RNA, 22 nt, Human
cuauuauuuccucaucuauaaa

SEQ ID NO: 228376 - RNA, 22 nt, Human
ugauggucaggaugcauggaga

SEQ ID NO: 228377 - RNA, 22 nt, Human
ccagcuccucuucccaguguca

SEQ ID NO: 228378 - RNA, 22 nt, Human
ggagugaguacuggaguagcug

SEQ ID NO: 228379 - RNA, 22 nt, Human
aauugcuuaugccaggugagag

SEQ ID NO: 228380 - RNA, 22 nt, Human
cauuucaagcauugacuucuau

SEQ ID NO: 228381 - RNA, 22 nt, Human
caguggcuuaaauaagauuagg

SEQ ID NO: 228382 - RNA, 22 nt, Human
augcuauuuaccacacaucauu

SEQ ID NO: 228383 - RNA, 22 nt, Human
gggguugguuuaaaugcuugag

SEQ ID NO: 228384 - RNA, 22 nt, Human
agcugcccugggucuugcugcu

SEQ ID NO: 228385 - RNA, 22 nt, Human
agaggccaccuucucuugagaa

SEQ ID NO: 228386 - RNA, 22 nt, Human
ccucagcauccuggugaaguag

SEQ ID NO: 228387 - RNA, 22 nt, Human
ggaaaucaugggagaguuggaa

SEQ ID NO: 228388 - RNA, 22 nt, Human
uuuauauuaccuggaauagcuu

SEQ ID NO: 228389 - RNA, 23 nt, Human
agcagugaguaaacagauaggau

SEQ ID NO: 228390 - RNA, 22 nt, Human
ucucuuaacugguucagcaauu

SEQ ID NO: 228391 - RNA, 22 nt, Human
gcuccuggguguggcugccccu

SEQ ID NO: 228392 - RNA, 22 nt, Human
uuuaguguaauucugccuuuug

SEQ ID NO: 228393 - RNA, 22 nt, Human
agcccagggcuaauaggaacca

SEQ ID NO: 228394 - RNA, 22 nt, Human
aaguguuuaaauuauuugcagg

SEQ ID NO: 228395 - RNA, 21 nt, Human
acaaugucaaggucagacauu

SEQ ID NO: 228396 - RNA, 22 nt, Human
aacugucuugccuacucagcau

SEQ ID NO: 228397 - RNA, 22 nt, Human
agcccugauuaaccuuggcuuu

SEQ ID NO: 228398 - RNA, 22 nt, Human
ugacagguucguuagucauguu

SEQ ID NO: 228399 - RNA, 22 nt, Human
uggcagaggaaaaagucacugg

SEQ ID NO: 228400 - RNA, 22 nt, Human
ccagagccucgcccggagccuc

SEQ ID NO: 228401 - RNA, 22 nt, Human
gcugucucgccugacacuggcu

SEQ ID NO: 228402 - RNA, 22 nt, Human
cacuggaauucaagauacugag

SEQ ID NO: 228403 - RNA, 22 nt, Human
acagaguuaauggauaggcagg

SEQ ID NO: 228404 - RNA, 22 nt, Human
ggcauuuuugacaaagagcaau

SEQ ID NO: 228405 - RNA, 22 nt, Human
acauucuggaugucugaugaga

SEQ ID NO: 228406 - RNA, 22 nt, Human
ggaguccuggacuccaucucac

SEQ ID NO: 228407 - RNA, 20 nt, Human
uuucucagaacaguggcugc

SEQ ID NO: 228408 - RNA, 22 nt, Human
ucugggagcacacgcagugauc

SEQ ID NO: 228409 - RNA, 21 nt, Human
ccauaauuuuguuucagaagu

SEQ ID NO: 228410 - RNA, 18 nt, Human
cucaggcagagaagcuuu

SEQ ID NO: 228411 - RNA, 22 nt, Human
gcuggcauuacaggagagaacc

SEQ ID NO: 228412 - RNA, 22 nt, Human
gcuaaugacugaguuuuuagca

SEQ ID NO: 228413 - RNA, 22 nt, Human
cucuggaagugauggcagguca

SEQ ID NO: 228414 - RNA, 21 nt, Human
uaacacauuuugguacuuugg

SEQ ID NO: 228415 - RNA, 22 nt, Human
uaggaauccagaucuagacugu

SEQ ID NO: 228416 - RNA, 22 nt, Human
caaauuuuguguguucucuagu

SEQ ID NO: 228417 - RNA, 22 nt, Human
acauucuugaagugaaguuuau

SEQ ID NO: 228418 - RNA, 22 nt, Human
caguguggguuugggaggagua

SEQ ID NO: 228419 - RNA, 22 nt, Human
uauguacaccaaggauugaaaa

SEQ ID NO: 228420 - RNA, 22 nt, Human
aggcuacaggagacgccaggag

SEQ ID NO: 228421 - RNA, 21 nt, Human
agguccaguucugucuuggac

SEQ ID NO: 228422 - RNA, 20 nt, Human
acaauauguagaugaauagc

SEQ ID NO: 228423 - RNA, 20 nt, Human
gcaggcccucucucuagucu

SEQ ID NO: 228424 - RNA, 22 nt, Human
aguggcagagccaaguagagcc

SEQ ID NO: 228425 - RNA, 22 nt, Human
gcuccaggaggcucccgcgucu

SEQ ID NO: 228426 - RNA, 22 nt, Human
cagggcagcuuccuuuguuagg

SEQ ID NO: 228427 - RNA, 21 nt, Human
aucaggcucaaaucaucccaa

SEQ ID NO: 228428 - RNA, 22 nt, Human
gaaccucagugaaacuggaggu

SEQ ID NO: 228429 - RNA, 22 nt, Human
aaagcaaugcccguucauuauc

SEQ ID NO: 228430 - RNA, 22 nt, Human
uggccaggaggcugcuucugac

SEQ ID NO: 228431 - RNA, 22 nt, Human
ucacugcagagaccucuaguca

SEQ ID NO: 228432 - RNA, 22 nt, Human
uugggcuggcagagguggucuu

SEQ ID NO: 228433 - RNA, 18 nt, Human
cugaggcuggcaggagcc

SEQ ID NO: 228434 - RNA, 22 nt, Human
cugccuguuagucuagcaguua

SEQ ID NO: 228435 - RNA, 19 nt, Human
aggaauggaauuaauucug

SEQ ID NO: 228436 - RNA, 22 nt, Human
uguggaaugcuccuaagugaau

SEQ ID NO: 228437 - RNA, 22 nt, Human
agcuccuggcaaggucauggug

SEQ ID NO: 228438 - RNA, 22 nt, Human
cugggcucuaagggagcaccgu

SEQ ID NO: 228439 - RNA, 22 nt, Human
ggguguggcugcgugccaauaa

SEQ ID NO: 228440 - RNA, 22 nt, Human
auggggaagagccagugagcug

SEQ ID NO: 228441 - RNA, 20 nt, Human
ucauccaguugguuuauggu

SEQ ID NO: 228442 - RNA, 22 nt, Human
cccuuccuccucgccugucaga

SEQ ID NO: 228443 - RNA, 23 nt, Human
agcaacagugggugaguguugcu

SEQ ID NO: 228444 - RNA, 22 nt, Human
ugggcaucguucccuuggcuau

SEQ ID NO: 228445 - RNA, 22 nt, Human
uuuauguuugacaaugaucugg

SEQ ID NO: 228446 - RNA, 22 nt, Human
aagcagaaguugaucuaccaua

SEQ ID NO: 228447 - RNA, 22 nt, Human
ucacucugcaggaaggagcagc

SEQ ID NO: 228448 - RNA, 22 nt, Human
ccagggcugcugugggacucca

SEQ ID NO: 228449 - RNA, 22 nt, Human
ugcauuaaaaugugccucucuu

SEQ ID NO: 228450 - RNA, 22 nt, Human
cagcuccucacgagucuugaaa

SEQ ID NO: 228451 - RNA, 22 nt, Human
uugcaaauuauauaagggaugc

SEQ ID NO: 228452 - RNA, 22 nt, Human
uagcugggacuacuggcccugc

SEQ ID NO: 228453 - RNA, 22 nt, Human
aaaauauuuuagggccaggaga

SEQ ID NO: 228454 - RNA, 22 nt, Human
cccagcaggcauguugggagga

SEQ ID NO: 228455 - RNA, 22 nt, Human
uggaauguaaacucugugaggg

SEQ ID NO: 228456 - RNA, 22 nt, Human
acuguagucuaaauauagucuu

SEQ ID NO: 228457 - RNA, 22 nt, Human
uuccaagagcuuuaauuguuga

SEQ ID NO: 228458 - RNA, 22 nt, Human
aucuuuggaucgcucccccuuc

SEQ ID NO: 228459 - RNA, 20 nt, Human
cugggcucgguggcccuggc

SEQ ID NO: 228460 - RNA, 23 nt, Human
ucugucuguguaugugcagaaag

SEQ ID NO: 228461 - RNA, 22 nt, Human
ucuguggcaaacacagugacca

SEQ ID NO: 228462 - RNA, 22 nt, Human
gcuucuccucccgcucccaggc

SEQ ID NO: 228463 - RNA, 22 nt, Human
ugggcaguggcugggccucucu

SEQ ID NO: 228464 - RNA, 22 nt, Human
gggcucauggacagcucuccag

SEQ ID NO: 228465 - RNA, 22 nt, Human
aaacauuugcaacucgguuugg

SEQ ID NO: 228466 - RNA, 22 nt, Human
ugaggggcauguguuuacacau

SEQ ID NO: 228467 - RNA, 22 nt, Human
ccaguguccuuccuuuccaugg

SEQ ID NO: 228468 - RNA, 22 nt, Human
agauaaguacuguuauuauugc

SEQ ID NO: 228469 - RNA, 22 nt, Human
gcagagccccauugcuggcggg

SEQ ID NO: 228470 - RNA, 22 nt, Human
ugugugaccuggggugagauag

SEQ ID NO: 228471 - RNA, 20 nt, Human
caugccugcugguaucuggc

SEQ ID NO: 228472 - RNA, 22 nt, Human
acaggccugagauuuugcauuu

SEQ ID NO: 228473 - RNA, 22 nt, Human
gccagcuguaagcagugauucu

SEQ ID NO: 228474 - RNA, 22 nt, Human
aggguagguguaagauagcccu

SEQ ID NO: 228475 - RNA, 22 nt, Human
uuccacuuuucucucucaugcc

SEQ ID NO: 228476 - RNA, 22 nt, Human
gagccagacugccugaagcuca

SEQ ID NO: 228477 - RNA, 21 nt, Human
ggagucuguggaugcuguuuc

SEQ ID NO: 228478 - RNA, 22 nt, Human
agagguguggccaggacucaag

SEQ ID NO: 228479 - RNA, 22 nt, Human
uagaaacucucacgagugaaac

SEQ ID NO: 228480 - RNA, 22 nt, Human
uuugcuuugacugucagcaagu

SEQ ID NO: 228481 - RNA, 18 nt, Human
agcagcugucagaaugcc

SEQ ID NO: 228482 - RNA, 21 nt, Human
ucagugcaauucuauggggaa

SEQ ID NO: 228483 - RNA, 22 nt, Human
acaguacaagcaaugcauuuuu

SEQ ID NO: 228484 - RNA, 22 nt, Human
aggacugacuuuugccaugaaa

SEQ ID NO: 228485 - RNA, 22 nt, Human
gaugaggaaugcucagcucaau

SEQ ID NO: 228486 - RNA, 22 nt, Human
ccaggcaagcucugcugugccc

SEQ ID NO: 228487 - RNA, 22 nt, Human
cuggggcaucauccauucuuuc

SEQ ID NO: 228488 - RNA, 22 nt, Human
gaaggcauucuauucuacauau

SEQ ID NO: 228489 - RNA, 22 nt, Human
acaacucucaguuaaauaaaga

SEQ ID NO: 228490 - RNA, 22 nt, Human
uguagaaaauuggagcauucau

SEQ ID NO: 228491 - RNA, 22 nt, Human
ugcaguucaagguuguacagcu

SEQ ID NO: 228492 - RNA, 22 nt, Human
aauggagacuucaaaauggauu

SEQ ID NO: 228493 - RNA, 22 nt, Human
aagacacuuucuaaauagaagu

SEQ ID NO: 228494 - RNA, 22 nt, Human
agcagcucugagaggccagcac

SEQ ID NO: 228495 - RNA, 22 nt, Human
uaauacauuaccuaaccucucu

SEQ ID NO: 228496 - RNA, 22 nt, Human
cuccugggagcagggauggaug

SEQ ID NO: 228497 - RNA, 22 nt, Human
acagcugcacuugaagcagguu

SEQ ID NO: 228498 - RNA, 22 nt, Human
ucuguaucguaaucaugucugg

SEQ ID NO: 228499 - RNA, 22 nt, Human
uagcaagaagggagaugggguu

SEQ ID NO: 228500 - RNA, 20 nt, Human
uggagggauuguuggcaaau

SEQ ID NO: 228501 - RNA, 22 nt, Human
ccagcccugccagagagagcug

SEQ ID NO: 228502 - RNA, 22 nt, Human
cugcugccggcgagccucccuu

SEQ ID NO: 228503 - RNA, 22 nt, Human
caggucugaagagucacaugcc

SEQ ID NO: 228504 - RNA, 22 nt, Human
ucaggaauccagacagggcaca

SEQ ID NO: 228505 - RNA, 22 nt, Human
aagaguuuaauuuugucuagac

SEQ ID NO: 228506 - RNA, 22 nt, Human
uguguccaacccagggacaagu

SEQ ID NO: 228507 - RNA, 22 nt, Human
ugcagggcuauaacuccauucu

SEQ ID NO: 228508 - RNA, 22 nt, Human
gcagccucaaacuccccagcuc

SEQ ID NO: 228509 - RNA, 22 nt, Human
acacaguaggccaccaugucau

SEQ ID NO: 228510 - RNA, 22 nt, Human
aaugucuuuaaagugcaauaga

SEQ ID NO: 228511 - RNA, 22 nt, Human
agaagaggggugucccuguggc

SEQ ID NO: 228512 - RNA, 22 nt, Human
aagccagugugacaggaaacuu

SEQ ID NO: 228513 - RNA, 22 nt, Human
cucagaggucaagagcagagcu

SEQ ID NO: 228514 - RNA, 22 nt, Human
guuuggaauagcaguaaacauu

SEQ ID NO: 228515 - RNA, 22 nt, Human
uacaaagaggcagcuccauuuu

SEQ ID NO: 228516 - RNA, 22 nt, Human
auaguuguguggggauucuggu

SEQ ID NO: 228517 - RNA, 22 nt, Human
ucccagaggaaauggcagcuga

SEQ ID NO: 228518 - RNA, 22 nt, Human
ccugggcucuauccugacccag

SEQ ID NO: 228519 - RNA, 22 nt, Human
ucaggagacuuaugucacagug

SEQ ID NO: 228520 - RNA, 22 nt, Human
uucaugaauggaaucaaugcuc

SEQ ID NO: 228521 - RNA, 22 nt, Human
uccuggcucaggccccuggugc

SEQ ID NO: 228522 - RNA, 22 nt, Human
uaauuucacugauaugaaguca

SEQ ID NO: 228523 - RNA, 22 nt, Human
agucacaucgauuauaaaauuu

SEQ ID NO: 228524 - RNA, 19 nt, Human
aagaggcaacccucgagcc

SEQ ID NO: 228525 - RNA, 23 nt, Human
agucucagcuggaaacauguguc

SEQ ID NO: 228526 - RNA, 22 nt, Human
cuuggcugucauaagguccugg

SEQ ID NO: 228527 - RNA, 22 nt, Human
ucugggaugcaaacagaaucug

SEQ ID NO: 228528 - RNA, 22 nt, Human
gcucuugucaaaaauuaguuga

SEQ ID NO: 228529 - RNA, 22 nt, Human
aagcauuugugaaauucagaug

SEQ ID NO: 228530 - RNA, 22 nt, Human
aaggcuccacccucauggaugc

SEQ ID NO: 228531 - RNA, 22 nt, Human
auuugcuuucccuucccugaca

SEQ ID NO: 228532 - RNA, 22 nt, Human
uuccagauguuuaaguucugcu

SEQ ID NO: 228533 - RNA, 22 nt, Human
gucugagcacccuggccuguca

SEQ ID NO: 228534 - RNA, 21 nt, Human
cagaggggcuagccuggcugc

SEQ ID NO: 228535 - RNA, 22 nt, Human
ugucacagucucgugagcaucu

SEQ ID NO: 228536 - RNA, 22 nt, Human
gaggaacagcagccacaugucc

SEQ ID NO: 228537 - RNA, 22 nt, Human
aggccacaguugaggccagcaa

SEQ ID NO: 228538 - RNA, 22 nt, Human
aggccucaguucuugccaggug

SEQ ID NO: 228539 - RNA, 22 nt, Human
agaaagaacguugguuaucuua

SEQ ID NO: 228540 - RNA, 22 nt, Human
uccacagucuauuuuuagucua

SEQ ID NO: 228541 - RNA, 22 nt, Human
auacauguuguaccauauguuu

SEQ ID NO: 228542 - RNA, 22 nt, Human
guggcuuccaugugcaucugac

SEQ ID NO: 228543 - RNA, 22 nt, Human
cauuguuugagcaucugggauc

SEQ ID NO: 228544 - RNA, 22 nt, Human
gcccggccaggaacagaguaua

SEQ ID NO: 228545 - RNA, 22 nt, Human
auguacauuuguaguaauauca

SEQ ID NO: 228546 - RNA, 22 nt, Human
aggcuaggccuugcccuggaac

SEQ ID NO: 228547 - RNA, 22 nt, Human
uucagaaacaucaguggaugga

SEQ ID NO: 228548 - RNA, 22 nt, Human
uuuagagagcacuguagacacu

SEQ ID NO: 228549 - RNA, 22 nt, Human
cagcuccucuguuagcccuggg

SEQ ID NO: 228550 - RNA, 22 nt, Human
cccugagagugagugccaccuu

SEQ ID NO: 228551 - RNA, 22 nt, Human
cugggccuugccuugcccacag

SEQ ID NO: 228552 - RNA, 22 nt, Human
uaggcuccucucacauucuauu

SEQ ID NO: 228553 - RNA, 22 nt, Human
ccagcagagcucaaacuuccug

SEQ ID NO: 228554 - RNA, 22 nt, Human
ggcagggaagcuggcaucacgg

SEQ ID NO: 228555 - RNA, 19 nt, Human
gcuguuaaggacccucgga

SEQ ID NO: 228556 - RNA, 22 nt, Human
acaggaacccagaaacauuucu

SEQ ID NO: 228557 - RNA, 22 nt, Human
ugagcauuggaucaaaugacuu

SEQ ID NO: 228558 - RNA, 22 nt, Human
augcgagugaugcagaguggcu

SEQ ID NO: 228559 - RNA, 22 nt, Human
ccuggcaggacuguuguaagaa

SEQ ID NO: 228560 - RNA, 22 nt, Human
aucuuucuaugguacuuucucc

SEQ ID NO: 228561 - RNA, 22 nt, Human
ggcaggcaguguggugugaaac

SEQ ID NO: 228562 - RNA, 22 nt, Human
gggagaaaugucuggccugcug

SEQ ID NO: 228563 - RNA, 22 nt, Human
uauuucugaauccaaaagguca

SEQ ID NO: 228564 - RNA, 22 nt, Human
uggcucugagcugcaaagcugc

SEQ ID NO: 228565 - RNA, 22 nt, Human
cagagccugccaccuuucuccc

SEQ ID NO: 228566 - RNA, 22 nt, Human
uauuaauaugugugugcaugua

SEQ ID NO: 228567 - RNA, 22 nt, Human
ugugcacauaaaacaguacuag

SEQ ID NO: 228568 - RNA, 22 nt, Human
uuacaaaguucugaguucaaac

SEQ ID NO: 228569 - RNA, 22 nt, Human
acaggaagugggaagaaacagg

SEQ ID NO: 228570 - RNA, 22 nt, Human
gaggcucccaaggggcuaggcc

SEQ ID NO: 228571 - RNA, 20 nt, Human
uuauaucauaaugugccaau

SEQ ID NO: 228572 - RNA, 22 nt, Human
ucucuggguuuuuguccuguac

SEQ ID NO: 228573 - RNA, 23 nt, Human
cugcaacucagucuggagcaguu

SEQ ID NO: 228574 - RNA, 22 nt, Human
agaaucuuucugaaugacugug

SEQ ID NO: 228575 - RNA, 22 nt, Human
ggacaugugcaacuucuuugga

SEQ ID NO: 228576 - RNA, 22 nt, Human
ucauuuguugaacuuuagugcg

SEQ ID NO: 228577 - RNA, 22 nt, Human
acuuuagagaaauguagaagua

SEQ ID NO: 228578 - RNA, 22 nt, Human
ucuagagacuauaauguguccu

SEQ ID NO: 228579 - RNA, 22 nt, Human
aggccucacucucagagcuucu

SEQ ID NO: 228580 - RNA, 21 nt, Human
cagggcacacagaggauggua

SEQ ID NO: 228581 - RNA, 22 nt, Human
gcagaggggaagcugaggaauu

SEQ ID NO: 228582 - RNA, 22 nt, Human
aucucuucucccaacaccuggc

SEQ ID NO: 228583 - RNA, 22 nt, Human
cuucugaguuaacaguagauuu

SEQ ID NO: 228584 - RNA, 22 nt, Human
uucugagaugaggaggaaaaag

SEQ ID NO: 228585 - RNA, 22 nt, Human
ugcccugccugagagacaguaa

SEQ ID NO: 228586 - RNA, 22 nt, Human
uccccaggagcaaugauucagu

SEQ ID NO: 228587 - RNA, 22 nt, Human
gcuggugguuaccgugcuaaug

SEQ ID NO: 228588 - RNA, 23 nt, Human
agugcaugcuugacuuagcaagc

SEQ ID NO: 228589 - RNA, 22 nt, Human
agcagaggaggauuuaguuagg

SEQ ID NO: 228590 - RNA, 22 nt, Human
auucaguaggugugaacuuauu

SEQ ID NO: 228591 - RNA, 22 nt, Human
cugcugugcaggugccuaugau

SEQ ID NO: 228592 - RNA, 22 nt, Human
uaggugaguuuggggaagauag

SEQ ID NO: 228593 - RNA, 22 nt, Human
ggagcagcuugcaugcucaggg

SEQ ID NO: 228594 - RNA, 22 nt, Human
gagaaggcuggucuuaagucga

SEQ ID NO: 228595 - RNA, 22 nt, Human
uacaagaaacuacaugaaugca

SEQ ID NO: 228596 - RNA, 21 nt, Human
gacaaagugaagcaggcagga

SEQ ID NO: 228597 - RNA, 22 nt, Human
augaaggcuguguggagccccc

SEQ ID NO: 228598 - RNA, 21 nt, Human
uccagccaguaaaugcucagc

SEQ ID NO: 228599 - RNA, 22 nt, Human
uugguggaccucaucagaaccg

SEQ ID NO: 228600 - RNA, 22 nt, Human
ugcaggugauucugaugcaguu

SEQ ID NO: 228601 - RNA, 22 nt, Human
cacugagcugauagaauuccag

SEQ ID NO: 228602 - RNA, 22 nt, Human
aaaaggauguuuucaugaaaca

SEQ ID NO: 228603 - RNA, 22 nt, Human
aggcuucuuagauuggcuggag

SEQ ID NO: 228604 - RNA, 22 nt, Human
agugagguaauuagagcugcug

SEQ ID NO: 228605 - RNA, 22 nt, Human
gagacacucaacaaagauauga

SEQ ID NO: 228606 - RNA, 20 nt, Human
uuucaguugguuaauggcau

SEQ ID NO: 228607 - RNA, 22 nt, Human
cugaaggcuuguuguuuucuua

SEQ ID NO: 228608 - RNA, 22 nt, Human
uuugcaaaauuauucccagcau

SEQ ID NO: 228609 - RNA, 22 nt, Human
gaagcagcucagauugacugaa

SEQ ID NO: 228610 - RNA, 22 nt, Human
auccaaaguagauuaagucaca

SEQ ID NO: 228611 - RNA, 22 nt, Human
caaauucacaugauugcuucug

SEQ ID NO: 228612 - RNA, 22 nt, Human
ugcuggcuauuuaaagaagaaa

SEQ ID NO: 228613 - RNA, 22 nt, Human
ugccugucuccucugcagggug

SEQ ID NO: 228614 - RNA, 21 nt, Human
ucugagacuggguuagaaugu

SEQ ID NO: 228615 - RNA, 22 nt, Human
uucucugggacaggaacaguuu

SEQ ID NO: 228616 - RNA, 22 nt, Human
guuucacagucugcagaauuuu

SEQ ID NO: 228617 - RNA, 22 nt, Human
caggggaguuuuaugcaacaga

SEQ ID NO: 228618 - RNA, 22 nt, Human
gugcucagcccggaugagauca

SEQ ID NO: 228619 - RNA, 22 nt, Human
ucagcuccacagcuccucugcc

SEQ ID NO: 228620 - RNA, 22 nt, Human
ugcucagcuucagaggaucccc

SEQ ID NO: 228621 - RNA, 22 nt, Human
ugcauaaaacaugauuucugcu

SEQ ID NO: 228622 - RNA, 22 nt, Human
agagacugcuuuauauuguacu

SEQ ID NO: 228623 - RNA, 22 nt, Human
uucugggugcaacucuguucug

SEQ ID NO: 228624 - RNA, 22 nt, Human
cugcagggccauggguucuaua

SEQ ID NO: 228625 - RNA, 18 nt, Human
ucccucagaauuauagaa

SEQ ID NO: 228626 - RNA, 22 nt, Human
ucuggcccuauggcauguaccu

SEQ ID NO: 228627 - RNA, 22 nt, Human
aacauuuacaaauccuucugca

SEQ ID NO: 228628 - RNA, 22 nt, Human
uuacaacauauuuagcuugauu

SEQ ID NO: 228629 - RNA, 22 nt, Human
accuggaaugggguugagagcu

SEQ ID NO: 228630 - RNA, 22 nt, Human
aaaaacagaaugugucuaacuc

SEQ ID NO: 228631 - RNA, 22 nt, Human
uccuggucuacacugcauuggg

SEQ ID NO: 228632 - RNA, 22 nt, Human
cugucugcccuggccagagccc

SEQ ID NO: 228633 - RNA, 22 nt, Human
aauagcauccuguaucucuucc

SEQ ID NO: 228634 - RNA, 22 nt, Human
aaguaacaucugaacaugaugu

SEQ ID NO: 228635 - RNA, 22 nt, Human
uaaaagcucuucuguugaguua

SEQ ID NO: 228636 - RNA, 22 nt, Human
ggggaccuaggcucugucucuu

SEQ ID NO: 228637 - RNA, 22 nt, Human
uguggcugggcuaauaggcaaa

SEQ ID NO: 228638 - RNA, 22 nt, Human
ccccagggucaguguguggagg

SEQ ID NO: 228639 - RNA, 22 nt, Human
aaaaaucuaugacugcuucucc

SEQ ID NO: 228640 - RNA, 19 nt, Human
ugcuauuugaagaagugua

SEQ ID NO: 228641 - RNA, 22 nt, Human
ucuguucagacacuuuacaugu

SEQ ID NO: 228642 - RNA, 22 nt, Human
aacauguugcuuuaauaauauu

SEQ ID NO: 228643 - RNA, 22 nt, Human
cauguacacacaaagggacaau

SEQ ID NO: 228644 - RNA, 20 nt, Human
aaugaguuauuuuguauaug

SEQ ID NO: 228645 - RNA, 22 nt, Human
ggaggccaggguggguggaucg

SEQ ID NO: 228646 - RNA, 22 nt, Human
gaggcugcccacaccugcgccg

SEQ ID NO: 228647 - RNA, 22 nt, Human
aacaguacaacuccacaagacu

SEQ ID NO: 228648 - RNA, 22 nt, Human
uguuaaaaauucagcucuagau

SEQ ID NO: 228649 - RNA, 22 nt, Human
acacaugaggaugaggggauca

SEQ ID NO: 228650 - RNA, 22 nt, Human
ccaauucauccucuggggcuuc

SEQ ID NO: 228651 - RNA, 17 nt, Human
agagggaaaaugcgguu

SEQ ID NO: 228652 - RNA, 22 nt, Human
uggaucugguucccugagccuu

SEQ ID NO: 228653 - RNA, 22 nt, Human
aguucagaguaaauguugaagg

SEQ ID NO: 228654 - RNA, 22 nt, Human
ucaggccuagaacacagcagau

SEQ ID NO: 228655 - RNA, 23 nt, Human
ggaaaaacacugugucuuggcag

SEQ ID NO: 228656 - RNA, 22 nt, Human
ccuaccaguaggaggccagaga

SEQ ID NO: 228657 - RNA, 22 nt, Human
acagaauacucauaagaagggg

SEQ ID NO: 228658 - RNA, 22 nt, Human
ggcucuugagaggcacagguuu

SEQ ID NO: 228659 - RNA, 22 nt, Human
ggcaggcuuugagaaagagcau

SEQ ID NO: 228660 - RNA, 22 nt, Human
aaagaccugugguagcucuaaa

SEQ ID NO: 228661 - RNA, 22 nt, Human
ugcaggagaaaguacggagcgu

SEQ ID NO: 228662 - RNA, 22 nt, Human
aagcugaggcuccccugaggga

SEQ ID NO: 228663 - RNA, 16 nt, Human
agcagguguauagugu

SEQ ID NO: 228664 - RNA, 22 nt, Human
ugacucaagagccugacucauc

SEQ ID NO: 228665 - RNA, 22 nt, Human
aguguucuuccuaucugcuguu

SEQ ID NO: 228666 - RNA, 22 nt, Human
ccugcuguccccugagccugga

SEQ ID NO: 228667 - RNA, 22 nt, Human
aucuccagcagugcuuuugagc

SEQ ID NO: 228668 - RNA, 22 nt, Human
cauggcaauaaaccuacacagu

SEQ ID NO: 228669 - RNA, 22 nt, Human
uucaauuucauaauaucuagcu

SEQ ID NO: 228670 - RNA, 22 nt, Human
uagcuuuagaaauauucucaga

SEQ ID NO: 228671 - RNA, 22 nt, Human
agcaggcuugguccccagccuc

SEQ ID NO: 228672 - RNA, 22 nt, Human
acgugcaggaucugguuggcga

SEQ ID NO: 228673 - RNA, 22 nt, Human
cagcugucagccggugcaggcu

SEQ ID NO: 228674 - RNA, 22 nt, Human
uauuuguugaauaccccugucu

SEQ ID NO: 228675 - RNA, 22 nt, Human
acuccuggguucuaaauuugaa

SEQ ID NO: 228676 - RNA, 22 nt, Human
gcaggcuuugacuuggggcagc

SEQ ID NO: 228677 - RNA, 22 nt, Human
aaacucuguagcuaaacauaau

SEQ ID NO: 228678 - RNA, 22 nt, Human
gcugccaguaguuggagcucca

SEQ ID NO: 228679 - RNA, 22 nt, Human
gagagaagaauguuccgaggcc

SEQ ID NO: 228680 - RNA, 22 nt, Human
cccagccucugggcucacccaa

SEQ ID NO: 228681 - RNA, 22 nt, Human
aaagccagguugugugcaggaa

SEQ ID NO: 228682 - RNA, 22 nt, Human
gagcuuuaccuuagguucuguu

SEQ ID NO: 228683 - RNA, 22 nt, Human
cagguugaaaguggaggagcua

SEQ ID NO: 228684 - RNA, 22 nt, Human
acuuagaacaggcagaauucca

SEQ ID NO: 228685 - RNA, 22 nt, Human
agaugcagaaaaacuaagugau

SEQ ID NO: 228686 - RNA, 22 nt, Human
aaggugucauccaggauggugg

SEQ ID NO: 228687 - RNA, 22 nt, Human
gggcugggcaugguguucccuc

SEQ ID NO: 228688 - RNA, 22 nt, Human
ucugaaagagaguacauacagu

SEQ ID NO: 228689 - RNA, 22 nt, Human
uucucagauauuuguauggaac

SEQ ID NO: 228690 - RNA, 22 nt, Human
ggacagaggguugacagaguau

SEQ ID NO: 228691 - RNA, 22 nt, Human
agacacugauguucagcucaau

SEQ ID NO: 228692 - RNA, 22 nt, Human
uuaauuacuaagcacaaugcaa

SEQ ID NO: 228693 - RNA, 22 nt, Human
acagacagggcaccugccuccu

SEQ ID NO: 228694 - RNA, 22 nt, Human
agcaacauugagacugcaguug

SEQ ID NO: 228695 - RNA, 22 nt, Human
uuacauucagaaagauuugagu

SEQ ID NO: 228696 - RNA, 22 nt, Human
aagcugucaauguaucuagucu

SEQ ID NO: 228697 - RNA, 22 nt, Human
aaaguucuaaaacucuuuguga

SEQ ID NO: 228698 - RNA, 22 nt, Human
uacagugcaaugugauguagau

SEQ ID NO: 228699 - RNA, 22 nt, Human
aacuagcagcuaagacauaauu

SEQ ID NO: 228700 - RNA, 22 nt, Human
gugaaaagcaacauuguggacc

SEQ ID NO: 228701 - RNA, 22 nt, Human
cccagccugugacagccguccu

SEQ ID NO: 228702 - RNA, 22 nt, Human
uaguuuugauuaguauugucuu

SEQ ID NO: 228703 - RNA, 22 nt, Human
ucccugaaacaucucuguggau

SEQ ID NO: 228704 - RNA, 22 nt, Human
gccucccugagucacccaagca

SEQ ID NO: 228705 - RNA, 22 nt, Human
ugcaacagacuuuauuaacucu

SEQ ID NO: 228706 - RNA, 22 nt, Human
ugcuuggcuuucugagcuucug

SEQ ID NO: 228707 - RNA, 22 nt, Human
uuccuggccccaccccuggaga

SEQ ID NO: 228708 - RNA, 19 nt, Human
auucuuggugcaccuugua

SEQ ID NO: 228709 - RNA, 22 nt, Human
cugccuguauugucugcuuggg

SEQ ID NO: 228710 - RNA, 22 nt, Human
accuucugaccaguuaucuuga

SEQ ID NO: 228711 - RNA, 22 nt, Human
ucagcugggugaguguucugca

SEQ ID NO: 228712 - RNA, 22 nt, Human
ccagcagcugcaaagccugggu

SEQ ID NO: 228713 - RNA, 22 nt, Human
ggauggcauguugggcucuguu

SEQ ID NO: 228714 - RNA, 22 nt, Human
cagcuuuaggacucauaauaaa

SEQ ID NO: 228715 - RNA, 22 nt, Human
agaaguauaaagaauguuuaug

SEQ ID NO: 228716 - RNA, 22 nt, Human
ucuuuuggguucuuaugauuua

SEQ ID NO: 228717 - RNA, 22 nt, Human
ugugggaggucuggaaggcucc

SEQ ID NO: 228718 - RNA, 23 nt, Human
uggacccugcacaccagcucuac

SEQ ID NO: 228719 - RNA, 22 nt, Human
uacaacauuuacguuaggcugu

SEQ ID NO: 228720 - RNA, 22 nt, Human
acccucaguaaucgugcaguuu

SEQ ID NO: 228721 - RNA, 22 nt, Human
cugccuuccaaccccagacucc

SEQ ID NO: 228722 - RNA, 22 nt, Human
acugguggcccucaguguucuc

SEQ ID NO: 228723 - RNA, 22 nt, Human
ccuggccagcgccggcugcucg

SEQ ID NO: 228724 - RNA, 22 nt, Human
uccaggcuccugacuuuuuggg

SEQ ID NO: 228725 - RNA, 22 nt, Human
acucaaauagcugccccuagug

SEQ ID NO: 228726 - RNA, 20 nt, Human
agucucucccagaaugagca

SEQ ID NO: 228727 - RNA, 22 nt, Human
aaaggccaagcaugagguggac

SEQ ID NO: 228728 - RNA, 23 nt, Human
cucagcaggucaggccccuuccu

SEQ ID NO: 228729 - RNA, 22 nt, Human
aggcugcuucagcugcagggag

SEQ ID NO: 228730 - RNA, 22 nt, Human
ugcagaaguauuccaggcccca

SEQ ID NO: 228731 - RNA, 22 nt, Human
uuauugagcaacucuggggcuc

SEQ ID NO: 228732 - RNA, 22 nt, Human
auacuguuuugugacuuaucuu

SEQ ID NO: 228733 - RNA, 22 nt, Human
gguggggccagggcuccaaccu

SEQ ID NO: 228734 - RNA, 22 nt, Human
cagcuguggggagcuugggcca

SEQ ID NO: 228735 - RNA, 23 nt, Human
gucuuuauaguggggcacuuugu

SEQ ID NO: 228736 - RNA, 22 nt, Human
uaguuuccauguuauacaguuu

SEQ ID NO: 228737 - RNA, 22 nt, Human
gaguggagaucgugccacugca

SEQ ID NO: 228738 - RNA, 22 nt, Human
uuauuuguuuucugagaaguau

SEQ ID NO: 228739 - RNA, 22 nt, Human
uguuccuguuuaaugugcucau

SEQ ID NO: 228740 - RNA, 22 nt, Human
gggccagucugacucugcuggu

SEQ ID NO: 228741 - RNA, 19 nt, Human
uccuuccaguuccuggggu

SEQ ID NO: 228742 - RNA, 22 nt, Human
cagggccacacggaagggaaca

SEQ ID NO: 228743 - RNA, 22 nt, Human
auaggcuuuguguuuuguuauc

SEQ ID NO: 228744 - RNA, 19 nt, Human
ucucugcuucucuuggcau

SEQ ID NO: 228745 - RNA, 22 nt, Human
gugcccaguugaggccaggacu

SEQ ID NO: 228746 - RNA, 22 nt, Human
agugcagugaugaauaaugguu

SEQ ID NO: 228747 - RNA, 23 nt, Human
ugcccagugccuuugcccaugca

SEQ ID NO: 228748 - RNA, 22 nt, Human
ugaggcaaguacuuucccuuuu

SEQ ID NO: 228749 - RNA, 21 nt, Human
aaauacugggcagugacuuga

SEQ ID NO: 228750 - RNA, 19 nt, Human
cgcaggcuucgggucgcuc

SEQ ID NO: 228751 - RNA, 22 nt, Human
acccagccauguucaguucucu

SEQ ID NO: 228752 - RNA, 22 nt, Human
auaagagcuacagccaguucug

SEQ ID NO: 228753 - RNA, 22 nt, Human
ugcccaggcuucacccucagag

SEQ ID NO: 228754 - RNA, 22 nt, Human
acaucugacaugaucuucagua

SEQ ID NO: 228755 - RNA, 22 nt, Human
gcagagcagugcuugcccagcg

SEQ ID NO: 228756 - RNA, 20 nt, Human
cagcccuccaguggaggcag

SEQ ID NO: 228757 - RNA, 22 nt, Human
aucuuugcuauuguaaaucacg

SEQ ID NO: 228758 - RNA, 22 nt, Human
cuagagcuauucaagguuuuau

SEQ ID NO: 228759 - RNA, 20 nt, Human
auucagaauaggcauguaaa

SEQ ID NO: 228760 - RNA, 22 nt, Human
caaaauguucuggcaccuuuaa

SEQ ID NO: 228761 - RNA, 22 nt, Human
uuuagacaagauccuucugaau

SEQ ID NO: 228762 - RNA, 22 nt, Human
cagcuucuuacgagcugguacu

SEQ ID NO: 228763 - RNA, 22 nt, Human
ucuuuuuauauugacaaaaggu

SEQ ID NO: 228764 - RNA, 22 nt, Human
agcugucucucugguguccaua

SEQ ID NO: 228765 - RNA, 20 nt, Human
agggucugaugugguggccc

SEQ ID NO: 228766 - RNA, 22 nt, Human
acaguggagaagcaaaugcagu

SEQ ID NO: 228767 - RNA, 22 nt, Human
aucuucaucaaguucacagugg

SEQ ID NO: 228768 - RNA, 22 nt, Human
uuagugaucaaaaucaaaauug

SEQ ID NO: 228769 - RNA, 22 nt, Human
aaaucuaggcucauccuggucc

SEQ ID NO: 228770 - RNA, 22 nt, Human
cuccuggaccagggcuauuggg

SEQ ID NO: 228771 - RNA, 22 nt, Human
uggagcugacucacaccagcua

SEQ ID NO: 228772 - RNA, 22 nt, Human
uggugcagucauuggcccaggg

SEQ ID NO: 228773 - RNA, 22 nt, Human
aaagcauaguucaucuguccau

SEQ ID NO: 228774 - RNA, 22 nt, Human
uggcucugucaaacugcacaca

SEQ ID NO: 228775 - RNA, 23 nt, Human
ucuggaauccucccccuugguuc

SEQ ID NO: 228776 - RNA, 17 nt, Human
guguaacuaugagccau

SEQ ID NO: 228777 - RNA, 17 nt, Human
gagacagcaggagcccc

SEQ ID NO: 228778 - RNA, 23 nt, Human
aggaagagagagugccucuuucu

SEQ ID NO: 228779 - RNA, 22 nt, Human
cacagcuuagaaaagaagccau

SEQ ID NO: 228780 - RNA, 22 nt, Human
ccgccaggauauuguggcuuuu

SEQ ID NO: 228781 - RNA, 23 nt, Human
uucauucaaaaggaaaagucaug

SEQ ID NO: 228782 - RNA, 22 nt, Human
augcauuuguaaaauauaaucg

SEQ ID NO: 228783 - RNA, 22 nt, Human
cagcaggauuugaaaggaagag

SEQ ID NO: 228784 - RNA, 20 nt, Human
ucuggggaugaggucuagga

SEQ ID NO: 228785 - RNA, 22 nt, Human
aaaggcuggggacugaggaagg

SEQ ID NO: 228786 - RNA, 22 nt, Human
auuugccuuuuaaacucacaau

SEQ ID NO: 228787 - RNA, 22 nt, Human
cagucuggcacagcacacugaa

SEQ ID NO: 228788 - RNA, 22 nt, Human
cagagccacugcauuuuacagc

SEQ ID NO: 228789 - RNA, 22 nt, Human
ccaggaagcugucugauaugaa

SEQ ID NO: 228790 - RNA, 22 nt, Human
acagagacugggagcaagaggc

SEQ ID NO: 228791 - RNA, 18 nt, Human
uaugugucuguuacaacu

SEQ ID NO: 228792 - RNA, 22 nt, Human
uacuaucucuucuaacuucaga

SEQ ID NO: 228793 - RNA, 22 nt, Human
gugcagugacccuggagagcug

SEQ ID NO: 228794 - RNA, 22 nt, Human
acauuguaguuguucugcagca

SEQ ID NO: 228795 - RNA, 22 nt, Human
gcugugcauaaguauaauaaac

SEQ ID NO: 228796 - RNA, 19 nt, Human
ggaagcccuaaaggaccua

SEQ ID NO: 228797 - RNA, 22 nt, Human
uaaagcauaaugaauaucuaga

SEQ ID NO: 228798 - RNA, 22 nt, Human
cccaggcaggagugugguggcu

SEQ ID NO: 228799 - RNA, 23 nt, Human
agaccugcaucugauaggcccug

SEQ ID NO: 228800 - RNA, 22 nt, Human
acaugagauuagcucacccacu

SEQ ID NO: 228801 - RNA, 22 nt, Human
uuucaaaagcguacguagugaa

SEQ ID NO: 228802 - RNA, 22 nt, Human
uggcuucucgccugucaucccg

SEQ ID NO: 228803 - RNA, 22 nt, Human
ccaagcugagcaccaucugauc

SEQ ID NO: 228804 - RNA, 22 nt, Human
gccucagagggcagggugguga

SEQ ID NO: 228805 - RNA, 22 nt, Human
uuugcaaauuucgucuccucag

SEQ ID NO: 228806 - RNA, 22 nt, Human
guuuauuaacugucaagugauu

SEQ ID NO: 228807 - RNA, 22 nt, Human
cagcaggggaacugugggccag

SEQ ID NO: 228808 - RNA, 22 nt, Human
agagcuggaagcugcucuuaga

SEQ ID NO: 228809 - RNA, 22 nt, Human
ugaggccuggacucugcaugga

SEQ ID NO: 228810 - RNA, 22 nt, Human
cagcucuccacccuccugguuc

SEQ ID NO: 228811 - RNA, 22 nt, Human
ugaccuauuagauuuccuugcc

SEQ ID NO: 228812 - RNA, 22 nt, Human
caaaguaugaaccaguuucucu

SEQ ID NO: 228813 - RNA, 22 nt, Human
uccuugggguaacuccagccug

SEQ ID NO: 228814 - RNA, 22 nt, Human
agcaggagcugugggaagaugg

SEQ ID NO: 228815 - RNA, 21 nt, Human
caaauacuuagaaacuuaaga

SEQ ID NO: 228816 - RNA, 22 nt, Human
uacuucuguaagugcgccaagg

SEQ ID NO: 228817 - RNA, 23 nt, Human
ccacuagcaccuguucaacuucu

SEQ ID NO: 228818 - RNA, 22 nt, Human
auguccaggaucuauccccaga

SEQ ID NO: 228819 - RNA, 22 nt, Human
gucccugguuugcccaggacca

SEQ ID NO: 228820 - RNA, 22 nt, Human
ccaggacccugcaaacccuguu

SEQ ID NO: 228821 - RNA, 22 nt, Human
ccacauucucauguaauccuuu

SEQ ID NO: 228822 - RNA, 18 nt, Human
acacaggcugacagcacc

SEQ ID NO: 228823 - RNA, 22 nt, Human
gaugccucuuuuggcugaauua

SEQ ID NO: 228824 - RNA, 23 nt, Human
acugccugugccgaucucucuca

SEQ ID NO: 228825 - RNA, 22 nt, Human
gaagggagaagguugggugacg

SEQ ID NO: 228826 - RNA, 22 nt, Human
gaagccugggagggcugggcua

SEQ ID NO: 228827 - RNA, 22 nt, Human
gaacacagucaagggcugcugu

SEQ ID NO: 228828 - RNA, 22 nt, Human
uucagaauguacugauagaaca

SEQ ID NO: 228829 - RNA, 22 nt, Human
gugcugugucuaucaggaauaa

SEQ ID NO: 228830 - RNA, 22 nt, Human
cuguguccaauggccuuagcag

SEQ ID NO: 228831 - RNA, 19 nt, Human
ccuccccuuggaccagcaa

SEQ ID NO: 228832 - RNA, 22 nt, Human
aggcugugcucagccaauggga

SEQ ID NO: 228833 - RNA, 22 nt, Human
ccauguuguaucucuuaucggc

SEQ ID NO: 228834 - RNA, 22 nt, Human
guaacacagaaaugaaauucca

SEQ ID NO: 228835 - RNA, 22 nt, Human
ggucuccugaggcugccacacc

SEQ ID NO: 228836 - RNA, 22 nt, Human
uuaccuguaaaacugcgauaua

SEQ ID NO: 228837 - RNA, 22 nt, Human
augguuuauaaucuagguguga

SEQ ID NO: 228838 - RNA, 22 nt, Human
ugucauuuauucucuuauucua

SEQ ID NO: 228839 - RNA, 22 nt, Human
ugauggaauggaggacaugugg

SEQ ID NO: 228840 - RNA, 22 nt, Human
uuagaguuuuuguaaguacaau

SEQ ID NO: 228841 - RNA, 22 nt, Human
agguaagguuuggaggcagugg

SEQ ID NO: 228842 - RNA, 23 nt, Human
aagaaugcuucugaagagcugcc

SEQ ID NO: 228843 - RNA, 22 nt, Human
uugaacaguccuaagagacccu

SEQ ID NO: 228844 - RNA, 22 nt, Human
cccacugcaugaguugguauua

SEQ ID NO: 228845 - RNA, 22 nt, Human
uguaaagaaagacgcagaguua

SEQ ID NO: 228846 - RNA, 22 nt, Human
acaggauuaauaaaaaauugua

SEQ ID NO: 228847 - RNA, 22 nt, Human
ugaacaugcuguugauggccug

SEQ ID NO: 228848 - RNA, 17 nt, Human
aguuggcagccguugcu

SEQ ID NO: 228849 - RNA, 22 nt, Human
acagaguaucuaucaggaguau

SEQ ID NO: 228850 - RNA, 22 nt, Human
auggccugcagugcugccacag

SEQ ID NO: 228851 - RNA, 22 nt, Human
uuuccacacucacugcacucau

SEQ ID NO: 228852 - RNA, 22 nt, Human
auggcuccagcuuggcuucacc

SEQ ID NO: 228853 - RNA, 22 nt, Human
cagaugaaguaggugacgagca

SEQ ID NO: 228854 - RNA, 22 nt, Human
uaaaguuuauuggcaccaccau

SEQ ID NO: 228855 - RNA, 22 nt, Human
aggagccauugcaggauggcag

SEQ ID NO: 228856 - RNA, 22 nt, Human
gaaggcaguaaauggcuguuuu

SEQ ID NO: 228857 - RNA, 19 nt, Human
ugguggaggccccauguuc

SEQ ID NO: 228858 - RNA, 18 nt, Human
uacagcuugaguugacug

SEQ ID NO: 228859 - RNA, 21 nt, Human
ccacaauucuaguuacauaug

SEQ ID NO: 228860 - RNA, 22 nt, Human
gcaugagacuagcucaugagca

SEQ ID NO: 228861 - RNA, 19 nt, Human
caggauuguuuaaagcuuu

SEQ ID NO: 228862 - RNA, 21 nt, Human
caaaagagacugauucuugga

SEQ ID NO: 228863 - RNA, 22 nt, Human
aguggcuguuccaggugaggac

SEQ ID NO: 228864 - RNA, 21 nt, Human
aaguccaauaccuaaggcucc

SEQ ID NO: 228865 - RNA, 22 nt, Human
acagagguuaggauggguugua

SEQ ID NO: 228866 - RNA, 22 nt, Human
cugagcugcucccgcugcagcg

SEQ ID NO: 228867 - RNA, 21 nt, Human
acagaagcggcgaguggcccc

SEQ ID NO: 228868 - RNA, 22 nt, Human
ugcaugguguaauucuaaugcu

SEQ ID NO: 228869 - RNA, 22 nt, Human
gcagagucagguccaaggacug

SEQ ID NO: 228870 - RNA, 22 nt, Human
auaaugacauucuuagacugga

SEQ ID NO: 228871 - RNA, 22 nt, Human
uguccagaucaaugcccacaug

SEQ ID NO: 228872 - RNA, 22 nt, Human
cugagcagucuagccagguguu

SEQ ID NO: 228873 - RNA, 22 nt, Human
ugcauuaagaauuucugaggau

SEQ ID NO: 228874 - RNA, 22 nt, Human
agagcuccaggguuuuguagug

SEQ ID NO: 228875 - RNA, 22 nt, Human
cccagaggcugaguugggagca

SEQ ID NO: 228876 - RNA, 22 nt, Human
agguggaguuaagugugaacug

SEQ ID NO: 228877 - RNA, 22 nt, Human
augauuuguuaacagacuuaau

SEQ ID NO: 228878 - RNA, 22 nt, Human
guaaaucagugucauuuuagaa

SEQ ID NO: 228879 - RNA, 22 nt, Human
uggcuccacaggccagggugug

SEQ ID NO: 228880 - RNA, 22 nt, Human
agguggagaagagaugggcagu

SEQ ID NO: 228881 - RNA, 22 nt, Human
ggccucugccccgcggggcucg

SEQ ID NO: 228882 - RNA, 22 nt, Human
uuuggaaaugagaagccaccuu

SEQ ID NO: 228883 - RNA, 22 nt, Human
cuggccuggcaggggaccucua

SEQ ID NO: 228884 - RNA, 22 nt, Human
cccagccuuugcuuccugguuc

SEQ ID NO: 228885 - RNA, 22 nt, Human
auggcuguguuguuccucugaa

SEQ ID NO: 228886 - RNA, 22 nt, Human
ggcagaggagcuggaaacaugg

SEQ ID NO: 228887 - RNA, 22 nt, Human
gggcagagguucaacuucaaca

SEQ ID NO: 228888 - RNA, 22 nt, Human
ucagaagguacugaagacaugg

SEQ ID NO: 228889 - RNA, 22 nt, Human
ccaggccuguguuguguggagg

SEQ ID NO: 228890 - RNA, 18 nt, Human
aguaaauguuaaauauug

SEQ ID NO: 228891 - RNA, 22 nt, Human
gugcugagugcagagugcagag

SEQ ID NO: 228892 - RNA, 19 nt, Human
ugguggaggugcaccugac

SEQ ID NO: 228893 - RNA, 18 nt, Human
gaggcacauaguuggggc

SEQ ID NO: 228894 - RNA, 22 nt, Human
gcugccgacccacagggguuaa

SEQ ID NO: 228895 - RNA, 22 nt, Human
caggcacaagaucggcuagaua

SEQ ID NO: 228896 - RNA, 22 nt, Human
agaggagguccuuuucugaugu

SEQ ID NO: 228897 - RNA, 22 nt, Human
ugucuucuaccuugacagcauu

SEQ ID NO: 228898 - RNA, 22 nt, Human
auggaggaugugcagcaugggc

SEQ ID NO: 228899 - RNA, 19 nt, Human
ugaggauugagguccagua

SEQ ID NO: 228900 - RNA, 22 nt, Human
gugggaguggagcucagcaugu

SEQ ID NO: 228901 - RNA, 22 nt, Human
gcagaggggaagcugaggaauu

SEQ ID NO: 228902 - RNA, 22 nt, Human
aaggcuuugugcugaguugucg

SEQ ID NO: 228903 - RNA, 22 nt, Human
gcugucaggaacaugccuuggu

SEQ ID NO: 228904 - RNA, 22 nt, Human
guccagaguagucgaguauucu

SEQ ID NO: 228905 - RNA, 20 nt, Human
cugggcagguguuugaucuc

SEQ ID NO: 228906 - RNA, 22 nt, Human
aaugccuuggagagccuagagg

SEQ ID NO: 228907 - RNA, 22 nt, Human
uggcugagcugcagcguggcuu

SEQ ID NO: 228908 - RNA, 22 nt, Human
ccauggccaggaaagccaaggu

SEQ ID NO: 228909 - RNA, 19 nt, Human
ucucccaugccugugucua

SEQ ID NO: 228910 - RNA, 22 nt, Human
gggcagcaggcuccacguuccu

SEQ ID NO: 228911 - RNA, 22 nt, Human
uggcacugucaccaaugcuguc

SEQ ID NO: 228912 - RNA, 22 nt, Human
uaaugccuuaugucaaauguaa

SEQ ID NO: 228913 - RNA, 22 nt, Human
aggcagagaaaaaccagauaug

SEQ ID NO: 228914 - RNA, 22 nt, Human
agggcccaccuuggugcugagg

SEQ ID NO: 228915 - RNA, 22 nt, Human
gggcagcaucaggaggggcuuu

SEQ ID NO: 228916 - RNA, 22 nt, Human
augcccucuguuucccaaggcc

SEQ ID NO: 228917 - RNA, 22 nt, Human
ggaggugacuggaucaugggca

SEQ ID NO: 228918 - RNA, 22 nt, Human
uggcugagugaacauguccauu

SEQ ID NO: 228919 - RNA, 22 nt, Human
caggcacaaugagcgccaucuu

SEQ ID NO: 228920 - RNA, 21 nt, Human
agggaaaaggcugagugaggg

SEQ ID NO: 228921 - RNA, 22 nt, Human
cuggcagcugcccgagaugccc

SEQ ID NO: 228922 - RNA, 22 nt, Human
uggcugaguuacgaacagagca

SEQ ID NO: 228923 - RNA, 22 nt, Human
acagaagugacaauuucuuggg

SEQ ID NO: 228924 - RNA, 22 nt, Human
gagguggcugcuugcugggaaa

SEQ ID NO: 228925 - RNA, 22 nt, Human
aggauaauaauaaucucguuua

SEQ ID NO: 228926 - RNA, 22 nt, Human
uggcagcauuuuuuccagaaca

SEQ ID NO: 228927 - RNA, 22 nt, Human
uuaggauuugaaaaggggcaga

SEQ ID NO: 228928 - RNA, 22 nt, Human
ggagaagggaacugaguuuuug

SEQ ID NO: 228929 - RNA, 22 nt, Human
gugagagugguuuauguccaug

SEQ ID NO: 228930 - RNA, 17 nt, Human
uggcacagaggugcuau

SEQ ID NO: 228931 - RNA, 22 nt, Human
gagcuuggugcugccuguuguc

SEQ ID NO: 228932 - RNA, 23 nt, Human
uagacugcaggcuccuugagggc

SEQ ID NO: 228933 - RNA, 22 nt, Human
acugcauuaucaccaagaugua

SEQ ID NO: 228934 - RNA, 22 nt, Human
ugcuggaguggcacuguguggc

SEQ ID NO: 228935 - RNA, 22 nt, Human
gagccacaguggauugauucca

SEQ ID NO: 228936 - RNA, 22 nt, Human
cccacugcugcucuccauggca

SEQ ID NO: 228937 - RNA, 22 nt, Human
uccacagguccucuuugcaaag

SEQ ID NO: 228938 - RNA, 22 nt, Human
ggcagaggaagcuggaaguggg

SEQ ID NO: 228939 - RNA, 22 nt, Human
ugaauaaucuuggguauuaaua

SEQ ID NO: 228940 - RNA, 22 nt, Human
guggcccaggcuuggcgcuggc

SEQ ID NO: 228941 - RNA, 22 nt, Human
ccuggauucucacuggacucca

SEQ ID NO: 228942 - RNA, 19 nt, Human
uccugcccaccagccaggg

SEQ ID NO: 228943 - RNA, 23 nt, Human
agguggagcugugcagccggggc

SEQ ID NO: 228944 - RNA, 22 nt, Human
cugaggagauccccccagaagu

SEQ ID NO: 228945 - RNA, 22 nt, Human
aaggcacuugcccagagcugca

SEQ ID NO: 228946 - RNA, 22 nt, Human
gggcacagucugcagcccccca

SEQ ID NO: 228947 - RNA, 22 nt, Human
uuugacaugugcuuauaacuuu

SEQ ID NO: 228948 - RNA, 22 nt, Human
aaaucccacucacgaguuuugc

SEQ ID NO: 228949 - RNA, 22 nt, Human
agucaggaagcuggagcugggg

SEQ ID NO: 228950 - RNA, 22 nt, Human
uacugcauuaucaaggggaagg

SEQ ID NO: 228951 - RNA, 22 nt, Human
cugagggccuucuaugcugagc

SEQ ID NO: 228952 - RNA, 22 nt, Human
uggccuuggcagugagaagagu

SEQ ID NO: 228953 - RNA, 22 nt, Human
cagaccuggaaaacaggcuugc

SEQ ID NO: 228954 - RNA, 22 nt, Human
acuggcaguagagggagcgcau

SEQ ID NO: 228955 - RNA, 22 nt, Human
caaagaagagauuuacagagcu

SEQ ID NO: 228956 - RNA, 22 nt, Human
ggauugaagggaaccucagaau

SEQ ID NO: 228957 - RNA, 22 nt, Human
ugcaaauauuccaugcuguuca

SEQ ID NO: 228958 - RNA, 22 nt, Human
uggcagcagggccccuggagga

SEQ ID NO: 228959 - RNA, 22 nt, Human
uggcagugugggaggaagguac

SEQ ID NO: 228960 - RNA, 20 nt, Human
ugugugaauuagggcauguu

SEQ ID NO: 228961 - RNA, 22 nt, Human
augaacaguacaaagcacagac

SEQ ID NO: 228962 - RNA, 22 nt, Human
ccugaguucuuauuuccaguca

SEQ ID NO: 228963 - RNA, 22 nt, Human
ugauuugaaaccuuuggcaaga

SEQ ID NO: 228964 - RNA, 22 nt, Human
cuugaaguggagcuuuugaaau

SEQ ID NO: 228965 - RNA, 22 nt, Human
uggcacaguuaaaguuguagaa

SEQ ID NO: 228966 - RNA, 22 nt, Human
uggaaagaggaagugcccagca

SEQ ID NO: 228967 - RNA, 22 nt, Human
aaaugccucauuuucucucacu

SEQ ID NO: 228968 - RNA, 22 nt, Human
uggccugauuuugcuaagagaa

SEQ ID NO: 228969 - RNA, 22 nt, Human
uuccugagucgccgagucuaug

SEQ ID NO: 228970 - RNA, 22 nt, Human
gcagauggauguggacggcgcc

SEQ ID NO: 228971 - RNA, 22 nt, Human
uugaauaguuuuggauagcaua

SEQ ID NO: 228972 - RNA, 22 nt, Human
aaggcacauauuuuagagucac

SEQ ID NO: 228973 - RNA, 22 nt, Human
uacagccuggcacuacccuggg

SEQ ID NO: 228974 - RNA, 22 nt, Human
ggggugaagguuuucugaaagc

SEQ ID NO: 228975 - RNA, 17 nt, Human
gagguaggaagugaguc

SEQ ID NO: 228976 - RNA, 22 nt, Human
ugccuguguccccuucuuggca

SEQ ID NO: 228977 - RNA, 22 nt, Human
gcaaggagcaccuuucuggaac

SEQ ID NO: 228978 - RNA, 22 nt, Human
uugaacaguuuugucagguuca

SEQ ID NO: 228979 - RNA, 22 nt, Human
agaaggcaucagaaguguguag

SEQ ID NO: 228980 - RNA, 22 nt, Human
augcccugggagugcuguacca

SEQ ID NO: 228981 - RNA, 22 nt, Human
aagaggaggacgguucccagaa

SEQ ID NO: 228982 - RNA, 22 nt, Human
agguuuggguucauugcuggcu

SEQ ID NO: 228983 - RNA, 21 nt, Human
agaaggcaaaagcagacaucu

SEQ ID NO: 228984 - RNA, 20 nt, Human
acagaugaggaugcggaggc

SEQ ID NO: 228985 - RNA, 22 nt, Human
uaaaugaaaggguuuaauuuau

SEQ ID NO: 228986 - RNA, 21 nt, Human
agaugcaguuugcaggugggu

SEQ ID NO: 228987 - RNA, 22 nt, Human
guugcauuaaucugcucaggcu

SEQ ID NO: 228988 - RNA, 22 nt, Human
agguggcuaugaggaugcaguc

SEQ ID NO: 228989 - RNA, 20 nt, Human
ugagccugcuguaggaggcc

SEQ ID NO: 228990 - RNA, 22 nt, Human
cggcagagcccugagucagccu

SEQ ID NO: 228991 - RNA, 17 nt, Human
ugagcaguagaagaugc

SEQ ID NO: 228992 - RNA, 21 nt, Human
cccagaaguuccauggggggc

SEQ ID NO: 228993 - RNA, 22 nt, Human
gucaggaugagggaugaggagu

SEQ ID NO: 228994 - RNA, 19 nt, Human
uggcagcauugguaccuug

SEQ ID NO: 228995 - RNA, 22 nt, Human
gggcagcaaaucugagucuggu

SEQ ID NO: 228996 - RNA, 22 nt, Human
cuugucugcuauaaaaauccag

SEQ ID NO: 228997 - RNA, 16 nt, Human
ccagaugaaugggagu

SEQ ID NO: 228998 - RNA, 21 nt, Human
ucccacuggcccagggcucca

SEQ ID NO: 228999 - RNA, 22 nt, Human
gcacugagcuuuggaggagcag

SEQ ID NO: 229000 - RNA, 22 nt, Human
agagcagaggcauggccguggg

SEQ ID NO: 229001 - RNA, 22 nt, Human
cugagauggaguuucgcucuuc

SEQ ID NO: 229002 - RNA, 22 nt, Human
uggccagucuuagcugugccug

SEQ ID NO: 229003 - RNA, 22 nt, Human
gagccugagcaaugugauguuu

SEQ ID NO: 229004 - RNA, 20 nt, Human
ggccugagcauggcuggcag

SEQ ID NO: 229005 - RNA, 22 nt, Human
uggcuccaggggacacgcagua

SEQ ID NO: 229006 - RNA, 22 nt, Human
uaaugccuuucuguacuauaug

SEQ ID NO: 229007 - RNA, 22 nt, Human
ggcacagcugaugcagacacac

SEQ ID NO: 229008 - RNA, 22 nt, Human
aggauugugccuccagucagaa

SEQ ID NO: 229009 - RNA, 20 nt, Human
gaacagucuucugagccaca

SEQ ID NO: 229010 - RNA, 22 nt, Human
aggcagaugggagcuggaaguu

SEQ ID NO: 229011 - RNA, 22 nt, Human
cucagaggggaugcuuggagaa

SEQ ID NO: 229012 - RNA, 22 nt, Human
uuaccugagcggauuuguugca

SEQ ID NO: 229013 - RNA, 19 nt, Human
cgcacagccugccaggcgc

SEQ ID NO: 229014 - RNA, 22 nt, Hepatitis C virus
caaugaggguugcgggugggcg

SEQ ID NO: 229015 - RNA, 23 nt, Hepatitis C virus
gcagcccugccuccucuggacag

SEQ ID NO: 229016 - RNA, 22 nt, Hepatitis C virus
gccgggagaagguuggcgagag

SEQ ID NO: 229017 - RNA, 22 nt, Hepatitis C virus
aacuguagucucggcgggcgug

SEQ ID NO: 229018 - RNA, 22 nt, Hepatitis C virus
aguaccucuucaacugggcagu

SEQ ID NO: 229019 - RNA, 22 nt, Hepatitis C virus
ucgaucugcuugucgggagcgc

SEQ ID NO: 229020 - RNA, 22 nt, Hepatitis C virus
ugucuccccguggcucucggcc

SEQ ID NO: 229021 - RNA, 22 nt, Hepatitis C virus
uccuccugcuccugcuggcguu

SEQ ID NO: 229022 - RNA, 22 nt, Hepatitis C virus
ucuguccagaggaggcagggcu

SEQ ID NO: 229023 - RNA, 22 nt, Hepatitis C virus
uggaccaagaccuugugggcug

SEQ ID NO: 229024 - RNA, 22 nt, Hepatitis C virus
uuguucuaucuaucccggccau

SEQ ID NO: 229025 - RNA, 22 nt, Hepatitis C virus
gcgcucccgacaagcagaucga

SEQ ID NO: 229026 - RNA, 22 nt, Hepatitis C virus
gcacacuccggggugugucccu

SEQ ID NO: 229027 - RNA, 22 nt, Hepatitis C virus
acgacugguuccacagccacgg

SEQ ID NO: 229028 - RNA, 22 nt, Hepatitis C virus
cacccaaggguccugucaucca

SEQ ID NO: 229029 - RNA, 22 nt, Hepatitis C virus
cagcccgcgucauagcacucac

SEQ ID NO: 229030 - RNA, 22 nt, Hepatitis C virus
acuccccacaacgcagcuucga

SEQ ID NO: 229031 - RNA, 22 nt, Hepatitis C virus
aggccgcuuccguuggcauaac

SEQ ID NO: 229032 - RNA, 22 nt, Human
acaguuuaggaugagagaacac

SEQ ID NO: 229033 - RNA, 22 nt, Human
acuuuggaggguguuguagaug

SEQ ID NO: 229034 - RNA, 22 nt, Human
acuggcugaaguuuacuuuuug

SEQ ID NO: 229035 - RNA, 22 nt, Human
gcagucaguaaggcagccagaa

SEQ ID NO: 229036 - RNA, 22 nt, Human
ugggguugaagaaaggaucuag

SEQ ID NO: 229037 - RNA, 22 nt, Human
cagggccuuauccugccauuga

SEQ ID NO: 229038 - RNA, 22 nt, Human
aaugagauggaauucccgccua

SEQ ID NO: 229039 - RNA, 22 nt, Human
uucuaagucugcugucuucauc

SEQ ID NO: 229040 - RNA, 22 nt, Human
agugagggacuagugcugggga

SEQ ID NO: 229041 - RNA, 22 nt, Human
uauuuccaagcugaauccaaug

SEQ ID NO: 229042 - RNA, 17 nt, Human
cugagccccgggcagcu

SEQ ID NO: 229043 - RNA, 22 nt, Human
uccccucucugcgcucccaggu

SEQ ID NO: 229044 - RNA, 22 nt, Human
uaccucaaguuccaggaaagcg

SEQ ID NO: 229045 - RNA, 22 nt, Human
gucacuuuacacuccuacuaaa

SEQ ID NO: 229046 - RNA, 22 nt, Human
cugccaggcacugggcucugca

SEQ ID NO: 229047 - RNA, 22 nt, Human
ccuagggucaguguggcaggag

SEQ ID NO: 229048 - RNA, 22 nt, Human
agcuggccagcaccuccagguc

SEQ ID NO: 229049 - RNA, 22 nt, Human
ucuuuggacuuuccaauuuguu

SEQ ID NO: 229050 - RNA, 22 nt, Human
aauuuuauuagaaggcaagggg

SEQ ID NO: 229051 - RNA, 22 nt, Human
ugccuguguauuuccggccugc

SEQ ID NO: 229052 - RNA, 22 nt, Human
ugccugucuucaggagugucac

SEQ ID NO: 229053 - RNA, 22 nt, Human
uuugggcaguagauguaucacu

SEQ ID NO: 229054 - RNA, 22 nt, Human
ucauuuaauaauuuuugaguag

SEQ ID NO: 229055 - RNA, 22 nt, Human
acaaauguggacauggauaaug

SEQ ID NO: 229056 - RNA, 22 nt, Human
cuggugcaggaaggagcuggca

SEQ ID NO: 229057 - RNA, 22 nt, Human
uucuuauagaagcaaccauugu

SEQ ID NO: 229058 - RNA, 22 nt, Human
caaagaagagauuuacagagcu

SEQ ID NO: 229059 - RNA, 22 nt, Human
aguguucuuguuucuaagcaaa

SEQ ID NO: 229060 - RNA, 22 nt, Human
ucuugcauacacuauauguaca

SEQ ID NO: 229061 - RNA, 22 nt, Human
gaacagaguugaaacaaggcug

SEQ ID NO: 229062 - RNA, 22 nt, Human
ugacuuuaaaauaacaaguuua

SEQ ID NO: 229063 - RNA, 21 nt, Human
ccagccucagaucagggagcu

SEQ ID NO: 229064 - RNA, 22 nt, Human
auauacaggugguauguguaaa

SEQ ID NO: 229065 - RNA, 22 nt, Human
cagccacugaacuccuggcuau

SEQ ID NO: 229066 - RNA, 22 nt, Human
uagcaaagaagauauuauugca

SEQ ID NO: 229067 - RNA, 22 nt, Human
agaaauuccuaagguacacaag

SEQ ID NO: 229068 - RNA, 22 nt, Human
gauuuacagcuauacccaaugg

SEQ ID NO: 229069 - RNA, 22 nt, Human
ggccucagugggccgcugcagg

SEQ ID NO: 229070 - RNA, 22 nt, Human
ugcugcaggcagccccucuacu

SEQ ID NO: 229071 - RNA, 21 nt, Human
agggccucuguguacuggggg

SEQ ID NO: 229072 - RNA, 17 nt, Human
acaugggcugagacucc

SEQ ID NO: 229073 - RNA, 22 nt, Human
cagggcagccaggccccguggg

SEQ ID NO: 229074 - RNA, 22 nt, Human
auuuacaguuuagcauuucaag

SEQ ID NO: 229075 - RNA, 22 nt, Human
uccucagucucucaaaugaggc

SEQ ID NO: 229076 - RNA, 22 nt, Human
cugcaugucacucugcuguccc

SEQ ID NO: 229077 - RNA, 22 nt, Human
gccuaauaugcaaaauugauac

SEQ ID NO: 229078 - RNA, 22 nt, Human
uuccuguuagccauuauuagcu

SEQ ID NO: 229079 - RNA, 22 nt, Human
aacaacaacggagaaaggguug

SEQ ID NO: 229080 - RNA, 22 nt, Human
guggcagugggaugcuaucagg

SEQ ID NO: 229081 - RNA, 22 nt, Human
uggccacaugcgucugugaggc

SEQ ID NO: 229082 - RNA, 22 nt, Human
ccugccaggcuuugggcuucug

SEQ ID NO: 229083 - RNA, 22 nt, Human
auguucuuuggaauuuaugaaa

SEQ ID NO: 229084 - RNA, 22 nt, Human
aaguaaucuggaauuugguuuu

SEQ ID NO: 229085 - RNA, 22 nt, Human
cucagcaacagcgacuuaaggg

SEQ ID NO: 229086 - RNA, 22 nt, Human
agacaggcagggcauggaaaaa

SEQ ID NO: 229087 - RNA, 22 nt, Human
agagaguuguaccacacucaua

SEQ ID NO: 229088 - RNA, 22 nt, Human
aucugcugcccagccacuugcu

SEQ ID NO: 229089 - RNA, 22 nt, Human
acaucuucacugguuucuggaa

SEQ ID NO: 229090 - RNA, 18 nt, Human
ucugaaggaaugauucca

SEQ ID NO: 229091 - RNA, 22 nt, Human
ugggagaagcagugggacagua

SEQ ID NO: 229092 - RNA, 22 nt, Human
uggaagggaacagguggguguu

SEQ ID NO: 229093 - RNA, 22 nt, Human
ggcuggacuuuuugcaggucau

SEQ ID NO: 229094 - RNA, 22 nt, Human
agccaacacauguaaaugcacc

SEQ ID NO: 229095 - RNA, 22 nt, Human
uuaacacuugaacucuacaugu

SEQ ID NO: 229096 - RNA, 21 nt, Human
uucuucuuggacuguuuuggc

SEQ ID NO: 229097 - RNA, 22 nt, Human
acauucaaaauuagguuaguug

SEQ ID NO: 229098 - RNA, 22 nt, Human
cccaucaggaacccaggagccc

SEQ ID NO: 229099 - RNA, 22 nt, Human
uauacacauauacguuugugug

SEQ ID NO: 229100 - RNA, 22 nt, Human
uccaggagagguguggggacug

SEQ ID NO: 229101 - RNA, 22 nt, Human
uuucugaaaugcuggcuuugga

SEQ ID NO: 229102 - RNA, 22 nt, Human
ucauggcuuuuauuauguugag

SEQ ID NO: 229103 - RNA, 22 nt, Human
gccaaaguaccuagcccucugc

SEQ ID NO: 229104 - RNA, 22 nt, Human
ccuccagggccccucucacugg

SEQ ID NO: 229105 - RNA, 22 nt, Human
gugcaaaaguaauugagguuuu

SEQ ID NO: 229106 - RNA, 22 nt, Human
ucuccccucccuggaccagugc

SEQ ID NO: 229107 - RNA, 22 nt, Human
gcuuuagaaauguaggagauac

SEQ ID NO: 229108 - RNA, 22 nt, Human
uccuucuuucaccucauaguca

SEQ ID NO: 229109 - RNA, 22 nt, Human
auguuuucuagaguuuaaaauc

SEQ ID NO: 229110 - RNA, 22 nt, Human
cauuuuguagcaaugacuguug

SEQ ID NO: 229111 - RNA, 22 nt, Human
ucuguaucuaauuuuacaguag

SEQ ID NO: 229112 - RNA, 22 nt, Human
auuuauaacgugcagccagggu

SEQ ID NO: 229113 - RNA, 22 nt, Human
guaauagaacacucagcaugga

SEQ ID NO: 229114 - RNA, 22 nt, Human
uggggcuggcuauugucucccu

SEQ ID NO: 229115 - RNA, 22 nt, Human
uccagccaagccuugguagcug

SEQ ID NO: 229116 - RNA, 22 nt, Human
gucuugaucuccugaccuugug

SEQ ID NO: 229117 - RNA, 22 nt, Human
uuaggaaacgcugcuauugacu

SEQ ID NO: 229118 - RNA, 22 nt, Human
acuaaaaacuacugccaauagc

SEQ ID NO: 229119 - RNA, 22 nt, Human
ccagcucugauuuugaccucca

SEQ ID NO: 229120 - RNA, 22 nt, Human
ucacaugcccuguauuuaccag

SEQ ID NO: 229121 - RNA, 22 nt, Human
acaggucagauaaaggcuggug

SEQ ID NO: 229122 - RNA, 22 nt, Human
gcagaaacuuggagaagccagg

SEQ ID NO: 229123 - RNA, 22 nt, Human
cagauucuucauugccccauuc

SEQ ID NO: 229124 - RNA, 22 nt, Human
gugcccugagcuuaugcauucu

SEQ ID NO: 229125 - RNA, 22 nt, Human
uuaaaagaauccuguuauccuc

SEQ ID NO: 229126 - RNA, 22 nt, Human
caaaugcaugagaaauaagagg

SEQ ID NO: 229127 - RNA, 22 nt, Human
cccagggauguggcagauguua

SEQ ID NO: 229128 - RNA, 22 nt, Human
ugggagcaguugugaagcucag

SEQ ID NO: 229129 - RNA, 22 nt, Human
uaagagcagaacagcaacauau

SEQ ID NO: 229130 - RNA, 22 nt, Human
aagcaggcaagguuguggggca

SEQ ID NO: 229131 - RNA, 22 nt, Human
gcacagugaugucagaauugga

SEQ ID NO: 229132 - RNA, 22 nt, Human
gagccaaggguugccauggaga

SEQ ID NO: 229133 - RNA, 22 nt, Human
uuuggaaaguugucacuuuaga

SEQ ID NO: 229134 - RNA, 22 nt, Human
aucuccagguugugccugcguc

SEQ ID NO: 229135 - RNA, 22 nt, Human
auguccagaggugagucagagc

SEQ ID NO: 229136 - RNA, 22 nt, Human
ccccaaggugcucacugucugg

SEQ ID NO: 229137 - RNA, 22 nt, Human
uccuuaaaggacuagaagucaa

SEQ ID NO: 229138 - RNA, 22 nt, Human
aggccugggacgggagccguga

SEQ ID NO: 229139 - RNA, 22 nt, Human
ucaggcugcccguucagggcuc

SEQ ID NO: 229140 - RNA, 22 nt, Human
gcagguguggguggcugccagg

SEQ ID NO: 229141 - RNA, 22 nt, Human
uacuucaaacaaugguacaaac

SEQ ID NO: 229142 - RNA, 22 nt, Human
gcugcucuuuucagagaugaga

SEQ ID NO: 229143 - RNA, 22 nt, Human
ccagggcccacggccagaauag

SEQ ID NO: 229144 - RNA, 22 nt, Human
uugaggcugcacaguacaggcu

SEQ ID NO: 229145 - RNA, 22 nt, Human
aaagaacuuauccuagaauuug

SEQ ID NO: 229146 - RNA, 22 nt, Human
guagaaauuccauuuacuuuga

SEQ ID NO: 229147 - RNA, 22 nt, Human
ugcugaggcaguccuaacagga

SEQ ID NO: 229148 - RNA, 22 nt, Human
ugagucagugacaugaacuugu

SEQ ID NO: 229149 - RNA, 22 nt, Human
ugaggccugaagccuggagccu

SEQ ID NO: 229150 - RNA, 22 nt, Human
uugcaaaugaccauugccacau

SEQ ID NO: 229151 - RNA, 22 nt, Human
ugcagggcaucuuugaagugug

SEQ ID NO: 229152 - RNA, 22 nt, Human
ccuuuguucauugccuucaguc

SEQ ID NO: 229153 - RNA, 22 nt, Human
gggugggacucuuuggccugag

SEQ ID NO: 229154 - RNA, 18 nt, Human
gcagugcaggaagaagag

SEQ ID NO: 229155 - RNA, 21 nt, Human
cggcucagugccugcuccuuc

SEQ ID NO: 229156 - RNA, 22 nt, Human
gaagucuuggcugaaaacccuc

SEQ ID NO: 229157 - RNA, 22 nt, Human
uguacaaucugaugauguaugg

SEQ ID NO: 229158 - RNA, 22 nt, Human
accacugucuacacauugacuc

SEQ ID NO: 229159 - RNA, 22 nt, Human
ggagcuggcagcgcaacccaga

SEQ ID NO: 229160 - RNA, 22 nt, Human
acugaauaauggucugugaucu

SEQ ID NO: 229161 - RNA, 22 nt, Human
aaggccaguggauaaaaccucu

SEQ ID NO: 229162 - RNA, 22 nt, Human
ggcucugcugcacccuuggcuc

SEQ ID NO: 229163 - RNA, 19 nt, Human
gcuugggagagggagcuaa

SEQ ID NO: 229164 - RNA, 22 nt, Human
uggagagguuuaaacaaaaguu

SEQ ID NO: 229165 - RNA, 22 nt, Human
ucacacauguaagggcuuugga

SEQ ID NO: 229166 - RNA, 22 nt, Human
uguguucaguaugacauucaca

SEQ ID NO: 229167 - RNA, 22 nt, Human
auccaaagaaugcuuagaccug

SEQ ID NO: 229168 - RNA, 22 nt, Human
ccugagcugcggggcagugcuc

SEQ ID NO: 229169 - RNA, 22 nt, Human
acauagaucugugauucauucu

SEQ ID NO: 229170 - RNA, 22 nt, Human
uaccagccuuuuaacaugggcc

SEQ ID NO: 229171 - RNA, 22 nt, Human
caccagcagaagacugagggug

SEQ ID NO: 229172 - RNA, 22 nt, Human
uugaggagcaggaugggaggcu

SEQ ID NO: 229173 - RNA, 22 nt, Human
cucugagcagaggccguggcua

SEQ ID NO: 229174 - RNA, 22 nt, Human
cugaggcaucauggagaacagu

SEQ ID NO: 229175 - RNA, 22 nt, Human
cugcguguuugcacccugucug

SEQ ID NO: 229176 - RNA, 22 nt, Human
ucuuuagagcucagaaauacag

SEQ ID NO: 229177 - RNA, 22 nt, Human
ugacauguccaggugguccugu

SEQ ID NO: 229178 - RNA, 22 nt, Human
uuucuuguaagauguuuauuaa

SEQ ID NO: 229179 - RNA, 22 nt, Human
ugguuccaguuuucaauagagc

SEQ ID NO: 229180 - RNA, 22 nt, Human
gugccagagaugacaggccugc

SEQ ID NO: 229181 - RNA, 22 nt, Human
aaugauacauauguaucguuag

SEQ ID NO: 229182 - RNA, 19 nt, Human
ucaacaguggugcugugga

SEQ ID NO: 229183 - RNA, 22 nt, Human
aggcaggauugcugacaacaau

SEQ ID NO: 229184 - RNA, 22 nt, Human
aggcucugugcagccugcaucu

SEQ ID NO: 229185 - RNA, 22 nt, Human
uguaauggagcuuagaguuauc

SEQ ID NO: 229186 - RNA, 22 nt, Human
guggccuggauagacuccaucu

SEQ ID NO: 229187 - RNA, 22 nt, Human
cugggcagccucacacaauguu

SEQ ID NO: 229188 - RNA, 22 nt, Human
gagggcugugaaggagcggguu

SEQ ID NO: 229189 - RNA, 22 nt, Human
guuccucauccagucaugacua

SEQ ID NO: 229190 - RNA, 22 nt, Human
uauugucuguccgggucaaagc

SEQ ID NO: 229191 - RNA, 22 nt, Human
ccacaaaacugugugucaaaga

SEQ ID NO: 229192 - RNA, 22 nt, Human
aaacuugaggcaaugaaggugu

SEQ ID NO: 229193 - RNA, 22 nt, Human
ucuucuucccaucccucaaaug

SEQ ID NO: 229194 - RNA, 22 nt, Human
ccuggguccaauucuggcuugu

SEQ ID NO: 229195 - RNA, 22 nt, Human
aggcugaggcggguagaucacc

SEQ ID NO: 229196 - RNA, 22 nt, Human
cugauccagagccaaccaaggc

SEQ ID NO: 229197 - RNA, 22 nt, Human
uccuuggcacacucggaucuga

SEQ ID NO: 229198 - RNA, 22 nt, Human
cccaggagauaacguucccaag

SEQ ID NO: 229199 - RNA, 22 nt, Human
uuuaaacaaauaggauugccua

SEQ ID NO: 229200 - RNA, 22 nt, Human
uccucagacacccugcuggcuu

SEQ ID NO: 229201 - RNA, 19 nt, Human
auucucugguuugcuggcu

SEQ ID NO: 229202 - RNA, 22 nt, Human
uucagaaagguuaaucuggauu

SEQ ID NO: 229203 - RNA, 19 nt, Human
ucucagaauuggcaaucau

SEQ ID NO: 229204 - RNA, 22 nt, Human
gugagcuggaauaguggagaaa

SEQ ID NO: 229205 - RNA, 22 nt, Human
ggccugugcacaugugcaggaa

SEQ ID NO: 229206 - RNA, 22 nt, Human
gggcacagagggucuugaagaa

SEQ ID NO: 229207 - RNA, 21 nt, Human
ugaggaugugcagcagcagga

SEQ ID NO: 229208 - RNA, 22 nt, Human
uguuuuagcugacacauggagc

SEQ ID NO: 229209 - RNA, 22 nt, Human
cccagccucuggauucugcccu

SEQ ID NO: 229210 - RNA, 22 nt, Human
uuuuugcuaauccccagccacu

SEQ ID NO: 229211 - RNA, 22 nt, Human
ugagcuggcacuuuuccuggga

SEQ ID NO: 229212 - RNA, 22 nt, Human
uuggcaaaauuuaaagaaguga

SEQ ID NO: 229213 - RNA, 22 nt, Human
gcaucucuacaacgaagacagu

SEQ ID NO: 229214 - RNA, 22 nt, Human
ugaguucuccaggaagcagacu

SEQ ID NO: 229215 - RNA, 19 nt, Human
acucugaggcugagacaag

SEQ ID NO: 229216 - RNA, 22 nt, Human
aagaaauuaaugugccauuacu

SEQ ID NO: 229217 - RNA, 22 nt, Human
ucaaaguaagaauuuauuacaa

SEQ ID NO: 229218 - RNA, 22 nt, Human
uuuuguguccuucacaucaugu

SEQ ID NO: 229219 - RNA, 22 nt, Human
uuauugcuauggugagagggau

SEQ ID NO: 229220 - RNA, 22 nt, Human
uuucacagagaaauauaacagg

SEQ ID NO: 229221 - RNA, 22 nt, Human
acugucaucuuguaagcaaugu

SEQ ID NO: 229222 - RNA, 22 nt, Human
gucuggccauuugcccauugug

SEQ ID NO: 229223 - RNA, 19 nt, Human
agaaggcuccuguuggaga

SEQ ID NO: 229224 - RNA, 22 nt, Human
gagcuggugugugcccgagcac

SEQ ID NO: 229225 - RNA, 23 nt, Human
aaacaugcagcacaugaaugcua

SEQ ID NO: 229226 - RNA, 22 nt, Human
aaaucagugcucauuugaaagg

SEQ ID NO: 229227 - RNA, 22 nt, Human
ucugaaggcauccucacugcaa

SEQ ID NO: 229228 - RNA, 22 nt, Human
cccucuccuggcugcauggagc

SEQ ID NO: 229229 - RNA, 22 nt, Human
acacagaugcauuacacaucua

SEQ ID NO: 229230 - RNA, 22 nt, Human
uuauuauuuuguguacagcaaa

SEQ ID NO: 229231 - RNA, 22 nt, Human
ucucagaguuuagagcugagcc

SEQ ID NO: 229232 - RNA, 22 nt, Human
auuuccuugcaaguuucuguaa

SEQ ID NO: 229233 - RNA, 22 nt, Human
cuggugcaagauucccugcuuc

SEQ ID NO: 229234 - RNA, 22 nt, Human
agguggcagcagaaucagggag

SEQ ID NO: 229235 - RNA, 22 nt, Human
aaaacacaagaagcaggguaca

SEQ ID NO: 229236 - RNA, 18 nt, Human
gggaagaggaucuggccc

SEQ ID NO: 229237 - RNA, 22 nt, Human
gagcucaguguagucauggcuu

SEQ ID NO: 229238 - RNA, 22 nt, Human
augauauagagaguagauuaaa

SEQ ID NO: 229239 - RNA, 22 nt, Human
acuuggauauguucacuagacc

SEQ ID NO: 229240 - RNA, 22 nt, Human
uuuuccuaguaggccuauuaga

SEQ ID NO: 229241 - RNA, 22 nt, Human
uuggaauucagcuugcuuauaa

SEQ ID NO: 229242 - RNA, 22 nt, Human
ugucaaagacagaaggaaaugg

SEQ ID NO: 229243 - RNA, 22 nt, Human
auucagcauucauuaugcgcca

SEQ ID NO: 229244 - RNA, 22 nt, Human
cacuugaaaguaaugguugugc

SEQ ID NO: 229245 - RNA, 22 nt, Human
uuuccuccuagccuccagccgc

SEQ ID NO: 229246 - RNA, 22 nt, Human
gcgaggcugggcccugcaggcg

SEQ ID NO: 229247 - RNA, 23 nt, Human
acagagguccaaacaguauaagc

SEQ ID NO: 229248 - RNA, 22 nt, Human
cacaugaauucacauguauuuu

SEQ ID NO: 229249 - RNA, 22 nt, Human
uggaaacuagagaguuuguauu

SEQ ID NO: 229250 - RNA, 22 nt, Human
uuauauaacucaggugggcuca

SEQ ID NO: 229251 - RNA, 22 nt, Human
ugcuccagcaacaggcuuagcu

SEQ ID NO: 229252 - RNA, 22 nt, Human
uccacaguuuugccacuagcug

SEQ ID NO: 229253 - RNA, 22 nt, Human
uuguucaugguuguaaguuuga

SEQ ID NO: 229254 - RNA, 22 nt, Human
gcuaauucacaguaggaaauuu

SEQ ID NO: 229255 - RNA, 22 nt, Human
acuuuugaagaauuaugcaaaa

SEQ ID NO: 229256 - RNA, 22 nt, Human
auuagcuuuauuugaaauagga

SEQ ID NO: 229257 - RNA, 22 nt, Human
uauucauguguuggaaaggaac

SEQ ID NO: 229258 - RNA, 22 nt, Human
ugugccugucccgcauucuggu

SEQ ID NO: 229259 - RNA, 22 nt, Human
cauuuguauguuccuccuuagg

SEQ ID NO: 229260 - RNA, 22 nt, Human
uccagccaagggagguuacuag

SEQ ID NO: 229261 - RNA, 22 nt, Human
uuuuauguuccugaagcuaucu

SEQ ID NO: 229262 - RNA, 22 nt, Human
agcauaaguugguacagccacu

SEQ ID NO: 229263 - RNA, 23 nt, Human
ggcuggugcccuuggccagucgg

SEQ ID NO: 229264 - RNA, 22 nt, Human
ugcaaauguguggugaggcauu

SEQ ID NO: 229265 - RNA, 22 nt, Human
ugugcuuucaaaguuaaguaaa

SEQ ID NO: 229266 - RNA, 22 nt, Human
uacacaguauaugggaucacag

SEQ ID NO: 229267 - RNA, 22 nt, Human
agcccuuaguacauuucucaag

SEQ ID NO: 229268 - RNA, 22 nt, Human
aaacacugaaaauuuuggucau

SEQ ID NO: 229269 - RNA, 18 nt, Human
ccaggccaugaaccucug

SEQ ID NO: 229270 - RNA, 22 nt, Human
cuucaagaagacagcagagcau

SEQ ID NO: 229271 - RNA, 22 nt, Human
uggcagauguauaucacagcuu

SEQ ID NO: 229272 - RNA, 22 nt, Human
ucacaggcucuccaccaugagg

SEQ ID NO: 229273 - RNA, 22 nt, Human
ugggggcugggaugucacuuuc

SEQ ID NO: 229274 - RNA, 22 nt, Human
caaggcauuucgcuuagagaga

SEQ ID NO: 229275 - RNA, 23 nt, Human
guccagaacccaggcuggggugg

SEQ ID NO: 229276 - RNA, 22 nt, Human
acagccaguccucccacagggu

SEQ ID NO: 229277 - RNA, 22 nt, Human
uugcagggcaggaccauggaca

SEQ ID NO: 229278 - RNA, 22 nt, Human
uguguguguuuacaguuucuca

SEQ ID NO: 229279 - RNA, 22 nt, Human
ugaaagcuguacaugugguaca

SEQ ID NO: 229280 - RNA, 22 nt, Human
ugauucugagggagcauucugc

SEQ ID NO: 229281 - RNA, 22 nt, Human
ccagguguagcacugcucacag

SEQ ID NO: 229282 - RNA, 18 nt, Human
gagaggagccagaauuuu

SEQ ID NO: 229283 - RNA, 22 nt, Human
uacagugugacauuucuacaaa

SEQ ID NO: 229284 - RNA, 22 nt, Human
aagauuauggcagauaacaauu

SEQ ID NO: 229285 - RNA, 22 nt, Human
ugacauuuaucaaagaaauggu

SEQ ID NO: 229286 - RNA, 22 nt, Human
augggacacguuuuaaggaaaa

SEQ ID NO: 229287 - RNA, 19 nt, Human
caauauauagugaguggau

SEQ ID NO: 229288 - RNA, 22 nt, Human
cagcuccagcucugggcgccuc

SEQ ID NO: 229289 - RNA, 22 nt, Human
ggcuggcugcaugcccccuccu

SEQ ID NO: 229290 - RNA, 22 nt, Human
gggccagguaucgucuuuagua

SEQ ID NO: 229291 - RNA, 22 nt, Human
agcuucucagauggacuguuag

SEQ ID NO: 229292 - RNA, 20 nt, Human
auuccacuuauaugaggucc

SEQ ID NO: 229293 - RNA, 22 nt, Human
auuuccuucccagauuugguuc

SEQ ID NO: 229294 - RNA, 22 nt, Human
aaaacacacuggaccaauuuaa

SEQ ID NO: 229295 - RNA, 22 nt, Human
aaaguauguuguggcuuuuaaa

SEQ ID NO: 229296 - RNA, 22 nt, Human
gagcuaaaugaaucauaaauca

SEQ ID NO: 229297 - RNA, 22 nt, Human
ggcagguggaaguuggcagagc

SEQ ID NO: 229298 - RNA, 22 nt, Human
uuauuuauaucucugcaguuua

SEQ ID NO: 229299 - RNA, 22 nt, Human
uaacacugguuaucccugugca

SEQ ID NO: 229300 - RNA, 22 nt, Human
cuguuuaucauguacauuucca

SEQ ID NO: 229301 - RNA, 22 nt, Human
gugggccuccccuuuacgagcc

SEQ ID NO: 229302 - RNA, 20 nt, Human
uucugcuugcaaauaucaag

SEQ ID NO: 229303 - RNA, 20 nt, Human
cauuugggaucaugagguuu

SEQ ID NO: 229304 - RNA, 22 nt, Human
augcauaucagugauuguuugc

SEQ ID NO: 229305 - RNA, 22 nt, Human
aggcucagauccuuguguccug

SEQ ID NO: 229306 - RNA, 22 nt, Human
uuccuucuuccuuuaguaacca

SEQ ID NO: 229307 - RNA, 22 nt, Human
gagagaggccuccauguacuga

SEQ ID NO: 229308 - RNA, 21 nt, Human
gaaaagcaagggaguagaaca

SEQ ID NO: 229309 - RNA, 21 nt, Human
agcacagcuuuaagccaugug

SEQ ID NO: 229310 - RNA, 22 nt, Human
guuacauggagcaaugaugcau

SEQ ID NO: 229311 - RNA, 22 nt, Human
augaggcagagggcugugccag

SEQ ID NO: 229312 - RNA, 22 nt, Human
guuugcauguguacuuaauugg

SEQ ID NO: 229313 - RNA, 22 nt, Human
ucaaggcuauuaauucugugag

SEQ ID NO: 229314 - RNA, 22 nt, Human
uccuggguagccuguccaagau

SEQ ID NO: 229315 - RNA, 22 nt, Human
gaccaagauacagcaucauaga

SEQ ID NO: 229316 - RNA, 22 nt, Human
gggcaggagagggccaccugga

SEQ ID NO: 229317 - RNA, 22 nt, Human
ggcaucaggguaggaagguauc

SEQ ID NO: 229318 - RNA, 22 nt, Human
ugaucuuuacugcuguuuauaa

SEQ ID NO: 229319 - RNA, 21 nt, Human
uccagaggaggacagacucag

SEQ ID NO: 229320 - RNA, 20 nt, Human
gcugccuuguccugcuuggu

SEQ ID NO: 229321 - RNA, 20 nt, Human
ucugccuuaugaccuucgcc

SEQ ID NO: 229322 - RNA, 22 nt, Human
cucugggaaguagauuuggccu

SEQ ID NO: 229323 - RNA, 22 nt, Human
aacuacagaaaagguaagcucu

SEQ ID NO: 229324 - RNA, 18 nt, Human
aaacagugccuaaguguc

SEQ ID NO: 229325 - RNA, 22 nt, Human
cauggcaggaaggacaugcacu

SEQ ID NO: 229326 - RNA, 22 nt, Human
accagagcccaucugcuccuag

SEQ ID NO: 229327 - RNA, 22 nt, Human
cuucaucaacucuaacaaaugu

SEQ ID NO: 229328 - RNA, 17 nt, Human
cucagagcaggacagaa

SEQ ID NO: 229329 - RNA, 22 nt, Human
ggcaggcaguguggugugaaac

SEQ ID NO: 229330 - RNA, 22 nt, Human
aaguagcauuuucaaaauguau

SEQ ID NO: 229331 - RNA, 23 nt, Human
ugccucugccucccuagucugca

SEQ ID NO: 229332 - RNA, 19 nt, Human
cgcaggagccgaggugacc

SEQ ID NO: 229333 - RNA, 22 nt, Human
aggaaacuccccuacaucucaa

SEQ ID NO: 229334 - RNA, 22 nt, Human
auuauucauggucuuccacaau

SEQ ID NO: 229335 - RNA, 22 nt, Human
gccacaggugggcucugggaaa

SEQ ID NO: 229336 - RNA, 22 nt, Human
gcauuuguguucuuccuagagc

SEQ ID NO: 229337 - RNA, 22 nt, Human
agagaagagcaaugauaaauuu

SEQ ID NO: 229338 - RNA, 22 nt, Human
ucccagcagucagagcuaugug

SEQ ID NO: 229339 - RNA, 22 nt, Human
uacugucuggaguugccaaagg

SEQ ID NO: 229340 - RNA, 22 nt, Human
uuucaucucucuaaaagacagu

SEQ ID NO: 229341 - RNA, 22 nt, Human
uuaggaauauagacuaaguaga

SEQ ID NO: 229342 - RNA, 23 nt, Human
cccaagccugugcccucugacuc

SEQ ID NO: 229343 - RNA, 22 nt, Human
auuucucaguguacauuauguu

SEQ ID NO: 229344 - RNA, 22 nt, Human
aaucacauuuacauugcuaauu

SEQ ID NO: 229345 - RNA, 22 nt, Human
aguuuuucugcuggucucacua

SEQ ID NO: 229346 - RNA, 22 nt, Human
aaauagauugcugaggcauuac

SEQ ID NO: 229347 - RNA, 22 nt, Human
uuuccuuccaaaugcccgggag

SEQ ID NO: 229348 - RNA, 22 nt, Human
acugggccagacacugauuccc

SEQ ID NO: 229349 - RNA, 22 nt, Human
aggcuuuccugucacucaugcu

SEQ ID NO: 229350 - RNA, 21 nt, Human
augcacaaaaagacucuuucu

SEQ ID NO: 229351 - RNA, 22 nt, Human
auuuccugugucucuauuuaug

SEQ ID NO: 229352 - RNA, 22 nt, Human
aggcuaagugggugucagggcc

SEQ ID NO: 229353 - RNA, 22 nt, Human
auuugcugauggcauuugagcu

SEQ ID NO: 229354 - RNA, 22 nt, Human
agagccugcaguggagaccuug

SEQ ID NO: 229355 - RNA, 18 nt, Human
auccugggccagucuuuc

SEQ ID NO: 229356 - RNA, 22 nt, Human
uuagaacacugagaaagugaug

SEQ ID NO: 229357 - RNA, 19 nt, Human
gaggcaaggaguuuaagcc

SEQ ID NO: 229358 - RNA, 22 nt, Human
ccaaggccccuguggucuagcc

SEQ ID NO: 229359 - RNA, 22 nt, Human
cagucacagugacaggaugugg

SEQ ID NO: 229360 - RNA, 22 nt, Human
uuccaugaaagugaaauggagc

SEQ ID NO: 229361 - RNA, 22 nt, Human
caaauucacaugauugcuucug

SEQ ID NO: 229362 - RNA, 21 nt, Human
augacagaugcugcagaucgu

SEQ ID NO: 229363 - RNA, 22 nt, Human
agagccacggcaggccuaggaa

SEQ ID NO: 229364 - RNA, 22 nt, Human
uauguacaauuuguuguauguc

SEQ ID NO: 229365 - RNA, 22 nt, Human
agauuuuauagauaauuuccca

SEQ ID NO: 229366 - RNA, 22 nt, Human
ucuuguuaaagugaagauacug

SEQ ID NO: 229367 - RNA, 22 nt, Human
caauaauugcuuuccagaguua

SEQ ID NO: 229368 - RNA, 22 nt, Human
ucagcauuucagaaguggcaua

SEQ ID NO: 229369 - RNA, 22 nt, Human
aggucacccguuugacuaucca

SEQ ID NO: 229370 - RNA, 22 nt, Human
cauguuaaauugaguuugcaau

SEQ ID NO: 229371 - RNA, 22 nt, Human
aacugagguaucugcuguguuu

SEQ ID NO: 229372 - RNA, 22 nt, Human
uuacaucauugagacauacaua

SEQ ID NO: 229373 - RNA, 22 nt, Human
agcugguaaguggcagagauuc

SEQ ID NO: 229374 - RNA, 22 nt, Human
ugcaauuucaaauaucagaaag

SEQ ID NO: 229375 - RNA, 22 nt, Human
ccugucacgaugacugcacucu

SEQ ID NO: 229376 - RNA, 19 nt, Human
agauuuaccucauauaguu

SEQ ID NO: 229377 - RNA, 22 nt, Human
uggucauuaauucuuaccuuua

SEQ ID NO: 229378 - RNA, 22 nt, Human
agccuccaucccaugcacaaag

SEQ ID NO: 229379 - RNA, 22 nt, Human
gaggccuggucuaugagauguu

SEQ ID NO: 229380 - RNA, 22 nt, Human
uucucugcucucacauacagaa

SEQ ID NO: 229381 - RNA, 22 nt, Human
auggccugcagugcugccacag

SEQ ID NO: 229382 - RNA, 22 nt, Human
uagcacaaagagucuuucagag

SEQ ID NO: 229383 - RNA, 22 nt, Human
caauacaucaggucaaaaugug

SEQ ID NO: 229384 - RNA, 22 nt, Human
ugcaggugauucugaugcaguu

SEQ ID NO: 229385 - RNA, 22 nt, Human
guacaaaguggaccugauagua

SEQ ID NO: 229386 - RNA, 22 nt, Human
aauuaaauugguuuagagagga

SEQ ID NO: 229387 - RNA, 22 nt, Human
uucugauaauaccacaucgcag

SEQ ID NO: 229388 - RNA, 22 nt, Human
uccacccugcuuucuuaucucc

SEQ ID NO: 229389 - RNA, 22 nt, Human
uaaagacacugguuuuaaucau

SEQ ID NO: 229390 - RNA, 22 nt, Human
gcuggcugaggucuagcucuuu

SEQ ID NO: 229391 - RNA, 22 nt, Human
ccagcccaaacaagccgccuuc

SEQ ID NO: 229392 - RNA, 22 nt, Human
uucuuacagauuuggugaauga

SEQ ID NO: 229393 - RNA, 23 nt, Human
uuagacaauccucaaaagguaau

SEQ ID NO: 229394 - RNA, 22 nt, Human
ugguucauaauuugcacuacug

SEQ ID NO: 229395 - RNA, 22 nt, Human
aucucuaauuuaaaaaguaaca

SEQ ID NO: 229396 - RNA, 22 nt, Human
cauuuggaaagagacuagagaa

SEQ ID NO: 229397 - RNA, 22 nt, Human
cuagagaaaacuguguaucuug

SEQ ID NO: 229398 - RNA, 22 nt, Human
agccuuagggauugagguugcu

SEQ ID NO: 229399 - RNA, 22 nt, Human
ucugacccucagaucaugucca

SEQ ID NO: 229400 - RNA, 22 nt, Human
uuauuccauagaagucaaggaa

SEQ ID NO: 229401 - RNA, 22 nt, Human
ggggagcaauaguugaggugug

SEQ ID NO: 229402 - RNA, 16 nt, Human
acagugucucaagcac

SEQ ID NO: 229403 - RNA, 22 nt, Human
cuuagugaggaaugaauuuguu

SEQ ID NO: 229404 - RNA, 22 nt, Human
caaaugcagucccuuuguugcu

SEQ ID NO: 229405 - RNA, 22 nt, Human
cagcuuuauuucacguguuugu

SEQ ID NO: 229406 - RNA, 22 nt, Human
cugcacccaggccuggucccag

SEQ ID NO: 229407 - RNA, 22 nt, Human
aagaaagcugaauauucugugu

SEQ ID NO: 229408 - RNA, 22 nt, Human
ggggaccugggcuucaaggguu

SEQ ID NO: 229409 - RNA, 21 nt, Human
aaagauguuucuuuuccucac

SEQ ID NO: 229410 - RNA, 22 nt, Human
caggucuguuuucaaggucagu

SEQ ID NO: 229411 - RNA, 17 nt, Human
aaaauucuguaaagagg

SEQ ID NO: 229412 - RNA, 22 nt, Human
uuuaucugaccucacuucuuaa

SEQ ID NO: 229413 - RNA, 22 nt, Human
uucucaggucaccagggugcca

SEQ ID NO: 229414 - RNA, 22 nt, Human
gggagggaucugcuaggcaaug

SEQ ID NO: 229415 - RNA, 22 nt, Human
ucccaccccuugacucuuuaag

SEQ ID NO: 229416 - RNA, 22 nt, Human
cuccucccacggucucaggaag

SEQ ID NO: 229417 - RNA, 19 nt, Human
uguggucucuguucucagg

SEQ ID NO: 229418 - RNA, 22 nt, Human
acacuucucauuugauacuaac

SEQ ID NO: 229419 - RNA, 22 nt, Human
ucuggcucagggcucugaggga

SEQ ID NO: 229420 - RNA, 22 nt, Human
uuuauuggauggauggauggau

SEQ ID NO: 229421 - RNA, 18 nt, Human
uuggaggauguccaugaa

SEQ ID NO: 229422 - RNA, 22 nt, Human
cccaugcaucccucuccugggc

SEQ ID NO: 229423 - RNA, 22 nt, Human
gcuggcugggucccugagaggc

SEQ ID NO: 229424 - RNA, 22 nt, Human
uuccuugguagagagaauauuu

SEQ ID NO: 229425 - RNA, 22 nt, Human
agccuugaacacugacugaagg

SEQ ID NO: 229426 - RNA, 22 nt, Human
uccaguuuauuaugcauuuaca

SEQ ID NO: 229427 - RNA, 22 nt, Human
cuccaggcuucaagggccggcc

SEQ ID NO: 229428 - RNA, 22 nt, Human
gggaaacuagaagcaggguuau

SEQ ID NO: 229429 - RNA, 22 nt, Human
caagaggagcaggcaggugugc

SEQ ID NO: 229430 - RNA, 22 nt, Human
cacaaaguggguggaaaacuaa

SEQ ID NO: 229431 - RNA, 22 nt, Human
ucagcaaacauugauuggacuu

SEQ ID NO: 229432 - RNA, 22 nt, Human
agcacauuuaaguaugaaauau

SEQ ID NO: 229433 - RNA, 22 nt, Human
uagaaagcccuguguucacugc

SEQ ID NO: 229434 - RNA, 21 nt, Human
uucuuucugaaucugaaguau

SEQ ID NO: 229435 - RNA, 22 nt, Human
acauuucugucuuagggacugu

SEQ ID NO: 229436 - RNA, 22 nt, Human
uuucuuaauuugaguuccacua

SEQ ID NO: 229437 - RNA, 22 nt, Human
gggccucaugauggcucaggaa

SEQ ID NO: 229438 - RNA, 22 nt, Human
gaagcagcgaaguggaagggac

SEQ ID NO: 229439 - RNA, 22 nt, Human
uuaacauuugugaagcauuuag

SEQ ID NO: 229440 - RNA, 22 nt, Human
cagcacaggaauaugguggaca

SEQ ID NO: 229441 - RNA, 22 nt, Human
cagcccuuggcuggcuccuugc

SEQ ID NO: 229442 - RNA, 22 nt, Human
auacauagauagauaaucuggc

SEQ ID NO: 229443 - RNA, 22 nt, Human
augagacaagagucuaaauuca

SEQ ID NO: 229444 - RNA, 21 nt, Human
ccacaauucuaguuacauaug

SEQ ID NO: 229445 - RNA, 22 nt, Human
ucuuaaaugacugauaagagga

SEQ ID NO: 229446 - RNA, 22 nt, Human
uaaggcuuuguagugauugcuu

SEQ ID NO: 229447 - RNA, 22 nt, Human
auuucccacucaggccgcggcg

SEQ ID NO: 229448 - RNA, 22 nt, Human
gcauccaaauguuucauuucuu

SEQ ID NO: 229449 - RNA, 21 nt, Human
agcaggcccaauggagggggc

SEQ ID NO: 229450 - RNA, 22 nt, Human
gcucagaguggccuggcuaggg

SEQ ID NO: 229451 - RNA, 22 nt, Human
agccaugcucaguuccuggagc

SEQ ID NO: 229452 - RNA, 22 nt, Human
gugccuggggguaauguaggau

SEQ ID NO: 229453 - RNA, 22 nt, Human
aguccagucucacucuuggcag

SEQ ID NO: 229454 - RNA, 22 nt, Human
acagugcuaaacacuucuugaa

SEQ ID NO: 229455 - RNA, 22 nt, Human
cuguagcagugugcucuuuuuc

SEQ ID NO: 229456 - RNA, 22 nt, Human
aggaccugccaggugcaaagca

SEQ ID NO: 229457 - RNA, 19 nt, Human
ggcucuggcggcuguagcc

SEQ ID NO: 229458 - RNA, 23 nt, Human
aggacaguggaauuuagggauug

SEQ ID NO: 229459 - RNA, 16 nt, Human
agccuuaggaacagcc

SEQ ID NO: 229460 - RNA, 22 nt, Human
aguauguauuuuauacuuacag

SEQ ID NO: 229461 - RNA, 22 nt, Human
gacaggugcuaagggaccuggc

SEQ ID NO: 229462 - RNA, 22 nt, Human
cuuucauccgcagaugagccuc

SEQ ID NO: 229463 - RNA, 22 nt, Human
guguuuguuuagugcagagaga

SEQ ID NO: 229464 - RNA, 19 nt, Human
agcagcagcuaccacuugu

SEQ ID NO: 229465 - RNA, 22 nt, Human
acuuuacucuucauaugugaca

SEQ ID NO: 229466 - RNA, 22 nt, Human
caagcuggcugggagaggcacg

SEQ ID NO: 229467 - RNA, 22 nt, Human
aggugggggcuguguccuugac

SEQ ID NO: 229468 - RNA, 22 nt, Human
uuccuugagaugacugucuugu

SEQ ID NO: 229469 - RNA, 22 nt, Human
augggaguccaacaucaaggac

SEQ ID NO: 229470 - RNA, 22 nt, Human
gcuggcagugugaaugacaagc

SEQ ID NO: 229471 - RNA, 22 nt, Human
uuacaguuuacauaagaauugu

SEQ ID NO: 229472 - RNA, 22 nt, Human
auauguuuuuggaaagaacaca

SEQ ID NO: 229473 - RNA, 22 nt, Human
ucacaucuuauuagaguaucuc

SEQ ID NO: 229474 - RNA, 22 nt, Human
ucugggugugguaucuuagcca

SEQ ID NO: 229475 - RNA, 22 nt, Human
aagcugcuggugacugggcuga

SEQ ID NO: 229476 - RNA, 22 nt, Human
aaagccauaagccuaauacuaa

SEQ ID NO: 229477 - RNA, 22 nt, Human
uuccugggaggcuguguacuug

SEQ ID NO: 229478 - RNA, 22 nt, Human
gcaguguuaggaauaaaaauga

SEQ ID NO: 229479 - RNA, 22 nt, Human
uggcacugaagcuggaaagccu

SEQ ID NO: 229480 - RNA, 22 nt, Human
cagguucuuaacuuguucuucc

SEQ ID NO: 229481 - RNA, 22 nt, Human
ucucuuccaguaagagucuuua

SEQ ID NO: 229482 - RNA, 22 nt, Human
uguagauuuuggagucuacaag

SEQ ID NO: 229483 - RNA, 22 nt, Human
uagagcugauaaugaggccaag

SEQ ID NO: 229484 - RNA, 22 nt, Human
auuagggcuggaugcaaggaaa

SEQ ID NO: 229485 - RNA, 22 nt, Human
uucucuuuucaccaguugcuaa

SEQ ID NO: 229486 - RNA, 22 nt, Human
ccuccugggacucauuagcacc

SEQ ID NO: 229487 - RNA, 22 nt, Human
cuggcucccgucugguggccau

SEQ ID NO: 229488 - RNA, 22 nt, Human
gagagcuggccagcuucaguau

SEQ ID NO: 229489 - RNA, 22 nt, Human
cuguucauggaaaaauaguugg

SEQ ID NO: 229490 - RNA, 22 nt, Human
gggagcuguaguccagauaccg

SEQ ID NO: 229491 - RNA, 22 nt, Human
uagggcuccacucccagagauu

SEQ ID NO: 229492 - RNA, 22 nt, Human
cucuggaauugaccugggaggg

SEQ ID NO: 229493 - RNA, 22 nt, Human
accaggcugugaagugagacua

SEQ ID NO: 229494 - RNA, 22 nt, Human
uccugugggcucucggccucca

SEQ ID NO: 229495 - RNA, 22 nt, Human
cucugggcaggacgccaggccu

SEQ ID NO: 229496 - RNA, 22 nt, Human
aggcucuccagagagcugcuuu

SEQ ID NO: 229497 - RNA, 22 nt, Human
auggcccaaacugcaauuacuu

SEQ ID NO: 229498 - RNA, 22 nt, Human
agaacucuauauucaugaacaa

SEQ ID NO: 229499 - RNA, 22 nt, Human
aguggcuuauguuuagaaucau

SEQ ID NO: 229500 - RNA, 20 nt, Human
ggggaagaaaaggaugugau

SEQ ID NO: 229501 - RNA, 22 nt, Human
ugcaggcauuggugagagaagc

SEQ ID NO: 229502 - RNA, 20 nt, Human
uuccacaucuuugcacaugc

SEQ ID NO: 229503 - RNA, 22 nt, Human
aaggccugcucagcugucugug

SEQ ID NO: 229504 - RNA, 19 nt, Human
uccucagugacaaccucag

SEQ ID NO: 229505 - RNA, 22 nt, Human
cagcacuugagcuuucauguaa

SEQ ID NO: 229506 - RNA, 22 nt, Human
ucucuuaacugguucagcaauu

SEQ ID NO: 229507 - RNA, 22 nt, Human
uccuuccuggggucucugcugc

SEQ ID NO: 229508 - RNA, 22 nt, Human
caugguuugaugacuggaagga

SEQ ID NO: 229509 - RNA, 22 nt, Human
acagagccacuuuggugccuac

SEQ ID NO: 229510 - RNA, 22 nt, Human
cuccagugcgcaggacagcccc

SEQ ID NO: 229511 - RNA, 22 nt, Human
uaaaggcuuuauuuuccaguca

SEQ ID NO: 229512 - RNA, 22 nt, Human
uuccugggguacuggagaaaau

SEQ ID NO: 229513 - RNA, 22 nt, Human
agcauaaaggcacuagaaagag

SEQ ID NO: 229514 - RNA, 22 nt, Human
acagaugaggaauuuauuuggu

SEQ ID NO: 229515 - RNA, 22 nt, Human
uaugaguacaaggacucugucu

SEQ ID NO: 229516 - RNA, 22 nt, Human
cuggaagguaacaaggccauua

SEQ ID NO: 229517 - RNA, 22 nt, Human
gaagauuaaauggcucccauau

SEQ ID NO: 229518 - RNA, 22 nt, Human
uccaggccuuugcacauguugu

SEQ ID NO: 229519 - RNA, 22 nt, Human
agcaaacauucagcagauuggc

SEQ ID NO: 229520 - RNA, 22 nt, Human
ggagugaaucacuagaugcaga

SEQ ID NO: 229521 - RNA, 22 nt, Human
uagaagcucaggaauaggcaua

SEQ ID NO: 229522 - RNA, 22 nt, Human
caugugcuguagcagagaggaa

SEQ ID NO: 229523 - RNA, 22 nt, Human
cuucucucugcauaggcauggg

SEQ ID NO: 229524 - RNA, 22 nt, Human
agcacagaguugcagagagcgu

SEQ ID NO: 229525 - RNA, 22 nt, Human
agauaaugucaaauucugucug

SEQ ID NO: 229526 - RNA, 22 nt, Human
ccuuuggagcaacugagagcua

SEQ ID NO: 229527 - RNA, 22 nt, Human
ucaguuaauauggguaaagcau

SEQ ID NO: 229528 - RNA, 22 nt, Human
ucagagaacuccacaccuuagg

SEQ ID NO: 229529 - RNA, 22 nt, Human
uuuccucacacagaagaucuug

SEQ ID NO: 229530 - RNA, 22 nt, Human
ugucaguucagugauuacaaaa

SEQ ID NO: 229531 - RNA, 22 nt, Human
caaaucuuuaauugaggaauca

SEQ ID NO: 229532 - RNA, 22 nt, Human
gccaggcauuauuccgaucccu

SEQ ID NO: 229533 - RNA, 18 nt, Human
gguccugggccuggcuca

SEQ ID NO: 229534 - RNA, 19 nt, Human
gaggcaguagucaaagcuu

SEQ ID NO: 229535 - RNA, 22 nt, Human
acagaaauuagcagugaguuua

SEQ ID NO: 229536 - RNA, 22 nt, Human
cauuucuaagaagaucugggua

SEQ ID NO: 229537 - RNA, 22 nt, Human
cugggaaggggaagguccucuc

SEQ ID NO: 229538 - RNA, 22 nt, Human
ccugggcaaaugccagagacaa

SEQ ID NO: 229539 - RNA, 22 nt, Human
ucuguucaguuguaccuucccc

SEQ ID NO: 229540 - RNA, 22 nt, Human
ccugcagagggacuggcaggaa

SEQ ID NO: 229541 - RNA, 22 nt, Human
augucacaugguucuggggccu

SEQ ID NO: 229542 - RNA, 22 nt, Human
agauuuuaguuuggggaggugc

SEQ ID NO: 229543 - RNA, 22 nt, Human
ucugagaaaucaguggugaaua

SEQ ID NO: 229544 - RNA, 22 nt, Human
gacagcugccucuguguagauc

SEQ ID NO: 229545 - RNA, 22 nt, Human
uggaaacuuaccguuuggggaa

SEQ ID NO: 229546 - RNA, 22 nt, Human
cagagucuggacugcaggcucc

SEQ ID NO: 229547 - RNA, 22 nt, Human
ugcuauauaauggaauuucuaa

SEQ ID NO: 229548 - RNA, 22 nt, Human
gaauacaaagcagaacucauac

SEQ ID NO: 229549 - RNA, 22 nt, Human
gcagcagaugugggcccagagc

SEQ ID NO: 229550 - RNA, 22 nt, Human
uauuucuuguucccuccaaguu

SEQ ID NO: 229551 - RNA, 22 nt, Human
uaauauaccaaacuguaauuuu

SEQ ID NO: 229552 - RNA, 22 nt, Human
agcagcagggcaugucuuacuc

SEQ ID NO: 229553 - RNA, 22 nt, Human
gcuccaaaguccagcuguuucc

SEQ ID NO: 229554 - RNA, 22 nt, Human
agucgcagacaugguccccuuu

SEQ ID NO: 229555 - RNA, 22 nt, Human
gcugccacgaucucugcuguag

SEQ ID NO: 229556 - RNA, 22 nt, Human
uucucagauccaucagaagucc

SEQ ID NO: 229557 - RNA, 22 nt, Human
gcagggcacacaagaaugauaa

SEQ ID NO: 229558 - RNA, 22 nt, Human
gcccgcagagaucuuuaacaaa

SEQ ID NO: 229559 - RNA, 17 nt, Human
ugagcaguagaagaugc

SEQ ID NO: 229560 - RNA, 22 nt, Human
ugucccucugaggcuucccugg

SEQ ID NO: 229561 - RNA, 22 nt, Human
ugcucagcaaaaagcuugugag

SEQ ID NO: 229562 - RNA, 20 nt, Human
cuccagggaacagacuggag

SEQ ID NO: 229563 - RNA, 22 nt, Human
acucuguaauucugaagcaccu

SEQ ID NO: 229564 - RNA, 22 nt, Human
uaucuuuagaggaagagaaucu

SEQ ID NO: 229565 - RNA, 20 nt, Human
cagaacaugagcaucgagcc

SEQ ID NO: 229566 - RNA, 22 nt, Human
ucccagcccagguaugaugaua

SEQ ID NO: 229567 - RNA, 22 nt, Human
aagggagacaguugugugagga

SEQ ID NO: 229568 - RNA, 22 nt, Human
caggucuggguugauggccugg

SEQ ID NO: 229569 - RNA, 22 nt, Human
auguaacuucugugaaucugac

SEQ ID NO: 229570 - RNA, 22 nt, Human
uccaugagacagauacuguaag

SEQ ID NO: 229571 - RNA, 22 nt, Human
aacaucuuugauaaacuuagug

SEQ ID NO: 229572 - RNA, 22 nt, Human
accaauuuuagagcaccaagaa

SEQ ID NO: 229573 - RNA, 22 nt, Human
uccuuggaacauugauccaaac

SEQ ID NO: 229574 - RNA, 18 nt, Human
gacacauccccaggccuc

SEQ ID NO: 229575 - RNA, 22 nt, Human
caggagacucagcauccaggau

SEQ ID NO: 229576 - RNA, 22 nt, Human
ugaacuuucacaagaauaugcu

SEQ ID NO: 229577 - RNA, 22 nt, Human
aagaauguuaguuucugauaca

SEQ ID NO: 229578 - RNA, 22 nt, Human
agcugccauggccugaauuuac

SEQ ID NO: 229579 - RNA, 22 nt, Human
cuuguucaguccugacuuccug

SEQ ID NO: 229580 - RNA, 22 nt, Human
gucuggaagugucuuguuaagu

SEQ ID NO: 229581 - RNA, 22 nt, Human
acugaauuagggaacacugaac

SEQ ID NO: 229582 - RNA, 22 nt, Human
gucuccuggcugcagcuaagac

SEQ ID NO: 229583 - RNA, 22 nt, Human
aagggcucugcugucucucccc

SEQ ID NO: 229584 - RNA, 22 nt, Human
ccuggcagcgccgaagcuggcc

SEQ ID NO: 229585 - RNA, 22 nt, Human
acuuuuuacaggguguauacca

SEQ ID NO: 229586 - RNA, 22 nt, Human
gcuggcagggacagcugcgugu

SEQ ID NO: 229587 - RNA, 22 nt, Human
cuuccugcuccccugccaauuc

SEQ ID NO: 229588 - RNA, 17 nt, Human
ugaguggccgggggaca

SEQ ID NO: 229589 - RNA, 22 nt, Human
agagcuggauggucaagauggc

SEQ ID NO: 229590 - RNA, 22 nt, Human
uauugugccccucccaggaaca

SEQ ID NO: 229591 - RNA, 21 nt, Human
gcucuccagggccagcccagg

SEQ ID NO: 229592 - RNA, 22 nt, Human
cuggcuggccauguagagauga

SEQ ID NO: 229593 - RNA, 22 nt, Human
agaacucugaacacugucugga

SEQ ID NO: 229594 - RNA, 22 nt, Human
ugggccuggaguuuguccagag

SEQ ID NO: 229595 - RNA, 20 nt, Human
ucauggcugcugagagguuc

SEQ ID NO: 229596 - RNA, 22 nt, Human
aggguccaguaacagaugccag

SEQ ID NO: 229597 - RNA, 22 nt, Human
agucacacuucguaucucuagc

SEQ ID NO: 229598 - RNA, 22 nt, Human
guaaaauucuagcaucugaaag

SEQ ID NO: 229599 - RNA, 22 nt, Human
gagccacagcaaccucaaagga

SEQ ID NO: 229600 - RNA, 22 nt, Human
ccagagagggcgccaccuggag

SEQ ID NO: 229601 - RNA, 22 nt, Human
gaggcucacgacgggacgaacu

SEQ ID NO: 229602 - RNA, 21 nt, Human
ccuccugcccgcaagcuaggg

SEQ ID NO: 229603 - RNA, 19 nt, Human
ccagucccauacaggagau

SEQ ID NO: 229604 - RNA, 22 nt, Human
uauucagaauaaagacuacauu

SEQ ID NO: 229605 - RNA, 22 nt, Human
cacuggggugggccugguagag

SEQ ID NO: 229606 - RNA, 22 nt, Human
caaaguauaguguaggauggca

SEQ ID NO: 229607 - RNA, 22 nt, Human
ugacauguauguuguuggcaug

SEQ ID NO: 229608 - RNA, 14 nt, Human
gcaggcagaccacc

SEQ ID NO: 229609 - RNA, 23 nt, Human
uuucucaaagaguggcagcuuca

SEQ ID NO: 229610 - RNA, 22 nt, Human
uauuucauucuuuaucaggagc

SEQ ID NO: 229611 - RNA, 22 nt, Human
cagugcaagugacugaucaagg

SEQ ID NO: 229612 - RNA, 22 nt, Human
cugcagagcuaggcugagugaa

SEQ ID NO: 229613 - RNA, 17 nt, Human
ggaagaaaaggaucauc

SEQ ID NO: 229614 - RNA, 22 nt, Human
uuuauuguuaucaugggugagu

SEQ ID NO: 229615 - RNA, 18 nt, Human
ggcagccuacccacuugu

SEQ ID NO: 229616 - RNA, 20 nt, Human
aaacucuaccucaaucguca

SEQ ID NO: 229617 - RNA, 22 nt, Human
gcuucaggaggucggucuccuu

SEQ ID NO: 229618 - RNA, 22 nt, Human
cagcagucaggccugugggaga

SEQ ID NO: 229619 - RNA, 22 nt, Human
agcagccacccagcugcucauu

SEQ ID NO: 229620 - RNA, 22 nt, Human
cugccuugcaccggcucucugg

SEQ ID NO: 229621 - RNA, 22 nt, Human
cucuugcaugagauccaggagu

SEQ ID NO: 229622 - RNA, 22 nt, Human
uagauuuaagacccugaauuug

SEQ ID NO: 229623 - RNA, 22 nt, Human
ugcagccccccagauggccgua

SEQ ID NO: 229624 - RNA, 22 nt, Human
cugggcucaagaagucuucccu

SEQ ID NO: 229625 - RNA, 22 nt, Human
gaaaguuuucucacacaguaau

SEQ ID NO: 229626 - RNA, 22 nt, Human
accaguaggaguuggagaggaa

SEQ ID NO: 229627 - RNA, 22 nt, Human
aucaucuugcuuucuguuuacu

SEQ ID NO: 229628 - RNA, 22 nt, Human
uaugugcacauuagagagaugg

SEQ ID NO: 229629 - RNA, 22 nt, Human
ucagaacugguauuuaucaagg

SEQ ID NO: 229630 - RNA, 22 nt, Human
uucuaguucccacauaguugcc

SEQ ID NO: 229631 - RNA, 22 nt, Human
gaacaucuuauccauuuccucu

SEQ ID NO: 229632 - RNA, 22 nt, Human
aaaguuuuuaagcaagacccuu

SEQ ID NO: 229633 - RNA, 22 nt, Human
gcucagcuugggagcgcccggu

SEQ ID NO: 229634 - RNA, 22 nt, Human
gcugccuccaaucugugccccg

SEQ ID NO: 229635 - RNA, 22 nt, Human
ccagccagcaagcucccaguuc

SEQ ID NO: 229636 - RNA, 22 nt, Human
aagggcucugugcuugucccau

SEQ ID NO: 229637 - RNA, 22 nt, Human
uuccuuccuccuccaguucugg

SEQ ID NO: 229638 - RNA, 22 nt, Human
ccagugucugugguauagaaag

SEQ ID NO: 229639 - RNA, 22 nt, Human
cccugccucugaagcugcucag

SEQ ID NO: 229640 - RNA, 17 nt, Human
ggcuggagcagcucccc

SEQ ID NO: 229641 - RNA, 22 nt, Human
guagaaaugguguguuucuucu

SEQ ID NO: 229642 - RNA, 22 nt, Human
ucuguagucugugccauagcug

SEQ ID NO: 229643 - RNA, 22 nt, Human
agcuuuauauaaaagaguacau

SEQ ID NO: 229644 - RNA, 22 nt, Human
ucagucuuuugcccugaggagu

SEQ ID NO: 229645 - RNA, 22 nt, Human
uggcuucugggauguguugaca

SEQ ID NO: 229646 - RNA, 22 nt, Human
cuguggaaagagccuuuggagg

SEQ ID NO: 229647 - RNA, 22 nt, Human
auggcagccugaacacuuccug

SEQ ID NO: 229648 - RNA, 22 nt, Human
uccugagccugacaaucaccau

SEQ ID NO: 229649 - RNA, 22 nt, Human
ucccagcaggaguccaguuccc

SEQ ID NO: 229650 - RNA, 22 nt, Human
cuaaaugauauuuugguuuccu

SEQ ID NO: 229651 - RNA, 22 nt, Human
uugcuauuuccugaaauaagca

SEQ ID NO: 229652 - RNA, 22 nt, Human
gcagagauggcugccucugagu

SEQ ID NO: 229653 - RNA, 22 nt, Human
gccagcucagugccaggccccu

SEQ ID NO: 229654 - RNA, 22 nt, Human
cugugccaggcccagcugacuu

SEQ ID NO: 229655 - RNA, 22 nt, Human
accaggagccauagagucaggc

SEQ ID NO: 229656 - RNA, 22 nt, Human
cuugaguuacagcucuccaaga

SEQ ID NO: 229657 - RNA, 22 nt, Human
gcugcaggcggccgugguggcg

SEQ ID NO: 229658 - RNA, 22 nt, Human
agguggcuguauucagcuguaa

SEQ ID NO: 229659 - RNA, 22 nt, Human
ucacuggcaacuugugcucccu

SEQ ID NO: 229660 - RNA, 22 nt, Human
aggaggccaggcccucaagccu

SEQ ID NO: 229661 - RNA, 22 nt, Human
ggcagagcgcaugcgucgcaga

SEQ ID NO: 229662 - RNA, 22 nt, Human
ucuguauauauuaaugaaauuc

SEQ ID NO: 229663 - RNA, 22 nt, Human
gccuggugaaaggcagagagcg

SEQ ID NO: 229664 - RNA, 22 nt, Human
ucuuuguuuguacuguuagaau

SEQ ID NO: 229665 - RNA, 22 nt, Human
uugaacaauuugguauacaaac

SEQ ID NO: 229666 - RNA, 22 nt, Human
gacuuucuuguagugucugaug

SEQ ID NO: 229667 - RNA, 22 nt, Human
uuucaaggcuaguuuuaauuag

SEQ ID NO: 229668 - RNA, 22 nt, Human
ugagccagaguggagugugccu

SEQ ID NO: 229669 - RNA, 22 nt, Human
auucauaacggcaaaugucacc

SEQ ID NO: 229670 - RNA, 22 nt, Human
ccugcccuaugaccagcuucac

SEQ ID NO: 229671 - RNA, 22 nt, Human
cauuccaaggccaagucuaaga

SEQ ID NO: 229672 - RNA, 22 nt, Human
uaauauauuucugcuaagcuca

SEQ ID NO: 229673 - RNA, 22 nt, Human
ugaaauguacaagugcuuuuuu

SEQ ID NO: 229674 - RNA, 22 nt, Human
aaagcaaacagaaccccaagcu

SEQ ID NO: 229675 - RNA, 21 nt, Human
uuucauugaaugagauaaggu

SEQ ID NO: 229676 - RNA, 22 nt, Human
ugugggaaguuuggagggaaag

SEQ ID NO: 229677 - RNA, 22 nt, Human
uaaguauuggccuauagcuaga

SEQ ID NO: 229678 - RNA, 22 nt, Human
gucugggcucccagggucggcg

SEQ ID NO: 229679 - RNA, 23 nt, Human
aucuguucaucugacacagauuc

SEQ ID NO: 229680 - RNA, 22 nt, Human
aucuagaaguggcaugaauuac

SEQ ID NO: 229681 - RNA, 22 nt, Human
ugggggagauugugcaucucua

SEQ ID NO: 229682 - RNA, 22 nt, Human
ugcucauuaggacugcaaauuc

SEQ ID NO: 229683 - RNA, 22 nt, Human
gaagccugggagggcugggcua

SEQ ID NO: 229684 - RNA, 22 nt, Human
accaggaaacugugcccacgac

SEQ ID NO: 229685 - RNA, 22 nt, Human
ccugccagugaagcugacgggc

SEQ ID NO: 229686 - RNA, 22 nt, Human
uugaaucuauaauuucaguauu

SEQ ID NO: 229687 - RNA, 22 nt, Human
cccaggucuccugcuucccagg

SEQ ID NO: 229688 - RNA, 22 nt, Human
agaggcugugcccaccaggcaa

SEQ ID NO: 229689 - RNA, 22 nt, Human
ugagccagugugguaaagcuga

SEQ ID NO: 229690 - RNA, 22 nt, Human
auuagaaaauacaugggcuguc

SEQ ID NO: 229691 - RNA, 22 nt, Human
gccuccagcuggggcauuucag

SEQ ID NO: 229692 - RNA, 22 nt, Human
ccuggccagaggcgugccugug

SEQ ID NO: 229693 - RNA, 22 nt, Human
aaacugcacaugaggcuggugc

SEQ ID NO: 229694 - RNA, 21 nt, Human
agagacagagaaaguaacauu

SEQ ID NO: 229695 - RNA, 22 nt, Human
uugcuuuagguauagaauccau

SEQ ID NO: 229696 - RNA, 22 nt, Human
agacucuuggagaagagcuaua

SEQ ID NO: 229697 - RNA, 23 nt, Human
cucagagguguuuuucacuuacu

SEQ ID NO: 229698 - RNA, 22 nt, Human
uucauuccuucuguaccuugcc

SEQ ID NO: 229699 - RNA, 20 nt, Human
uaggcagcuugacccuuggu

SEQ ID NO: 229700 - RNA, 22 nt, Human
caggagugucgggucacuaggu

SEQ ID NO: 229701 - RNA, 22 nt, Human
ugagucuuuucauuguguggau

SEQ ID NO: 229702 - RNA, 22 nt, Human
ucagaggagggacucagaccca

SEQ ID NO: 229703 - RNA, 22 nt, Human
augucacauuggagcugcugga

SEQ ID NO: 229704 - RNA, 19 nt, Human
ucucacaguuuccuugccu

SEQ ID NO: 229705 - RNA, 19 nt, Human
gaguacaggugcagaaaug

SEQ ID NO: 229706 - RNA, 22 nt, Human
auaaggcacacauagauagggu

SEQ ID NO: 229707 - RNA, 22 nt, Human
caggacacuacagaugggaggg

SEQ ID NO: 229708 - RNA, 22 nt, Human
aggccagcauucucucuccagg

SEQ ID NO: 229709 - RNA, 22 nt, Human
gccauugggcuguaguuuuuug

SEQ ID NO: 229710 - RNA, 22 nt, Human
uaagcaguuuuucuuguauuaa

SEQ ID NO: 229711 - RNA, 22 nt, Human
aucaauucuuaggaaaauagcu

SEQ ID NO: 229712 - RNA, 22 nt, Human
auuucagacuguguuggaaaau

SEQ ID NO: 229713 - RNA, 22 nt, Human
aggcauggacauuucggcagcu

SEQ ID NO: 229714 - RNA, 22 nt, Human
acagcagaucuguggagcuuau

SEQ ID NO: 229715 - RNA, 22 nt, Human
agacaauuguucuaaguaaaaa

SEQ ID NO: 229716 - RNA, 22 nt, Human
uaaauucacuccugguagaccu

SEQ ID NO: 229717 - RNA, 23 nt, Human
uccaggcugggacuucaacuggc

SEQ ID NO: 229718 - RNA, 22 nt, Human
agaaguauucugcauguacuga

SEQ ID NO: 229719 - RNA, 22 nt, Human
ccaccaggcacucacagggaag

SEQ ID NO: 229720 - RNA, 22 nt, Human
uuugucuuaaaucuuguuacug

SEQ ID NO: 229721 - RNA, 22 nt, Human
ccagagagguagcuuacccucu

SEQ ID NO: 229722 - RNA, 17 nt, Human
gagugcugguggagcuc

SEQ ID NO: 229723 - RNA, 22 nt, Human
ccucugagccagcgucuucucu

SEQ ID NO: 229724 - RNA, 22 nt, Human
caaggcuuucucauuauccuuu

SEQ ID NO: 229725 - RNA, 22 nt, Human
gcucagagaaguugugccuggc

SEQ ID NO: 229726 - RNA, 22 nt, Human
auuccaaagccugaauaaugga

SEQ ID NO: 229727 - RNA, 22 nt, Human
uguaccaggaggaggacaaauu

SEQ ID NO: 229728 - RNA, 22 nt, Human
gcuccaggcagcauaguggaug

SEQ ID NO: 229729 - RNA, 22 nt, Human
uaaggcuaggaauucucugaag

SEQ ID NO: 229730 - RNA, 22 nt, Human
aaaaugaauaaguuaacccagg

SEQ ID NO: 229731 - RNA, 22 nt, Human
aucuuuggugcuuggugcuccc

SEQ ID NO: 229732 - RNA, 22 nt, Human
acuuuacuccccaacauaaaug

SEQ ID NO: 229733 - RNA, 22 nt, Human
gcaccaggcagcugagcaggcc

SEQ ID NO: 229734 - RNA, 22 nt, Human
ugacacacuaggaaaagcauuu

SEQ ID NO: 229735 - RNA, 22 nt, Human
aaauguguuccuuugcuacaga

SEQ ID NO: 229736 - RNA, 22 nt, Human
agucugugcuguuggugaggau

SEQ ID NO: 229737 - RNA, 22 nt, Human
uucauuugccaucaguguaaug

SEQ ID NO: 229738 - RNA, 22 nt, Human
aucucagaucuacagaucuaca

SEQ ID NO: 229739 - RNA, 22 nt, Human
cuuuauggaaucaaagacugga

SEQ ID NO: 229740 - RNA, 22 nt, Human
auggccaagaucacagacuuca

SEQ ID NO: 229741 - RNA, 22 nt, Human
gaagucagaaaagaauuaggga

SEQ ID NO: 229742 - RNA, 19 nt, Human
ggcugcagagccccggcgc

SEQ ID NO: 229743 - RNA, 22 nt, Human
gagccagagcuacaagugucug

SEQ ID NO: 229744 - RNA, 22 nt, Human
uccacauccauugcuugacuuu

SEQ ID NO: 229745 - RNA, 22 nt, Human
uaaaugcuuagauucauagaaa

SEQ ID NO: 229746 - RNA, 19 nt, Human
uggcaugaugauggauggg

SEQ ID NO: 229747 - RNA, 22 nt, Human
agauaucugaugaaaauacucu

SEQ ID NO: 229748 - RNA, 22 nt, Human
cugccugcucaccagggcucug

SEQ ID NO: 229749 - RNA, 22 nt, Human
uucaaaauccgggaggcgcccc

SEQ ID NO: 229750 - RNA, 22 nt, Human
guuuacaguggcuucauuggau

SEQ ID NO: 229751 - RNA, 19 nt, Human
cccuggcaggcaagccugg

SEQ ID NO: 229752 - RNA, 22 nt, Human
aaggccagagcguguccugccu

SEQ ID NO: 229753 - RNA, 17 nt, Human
ccuuccucaucuccuuc

SEQ ID NO: 229754 - RNA, 17 nt, Human
aaugaaugaauucuuug

SEQ ID NO: 229755 - RNA, 22 nt, Human
uacauagaggguaauagcauca

SEQ ID NO: 229756 - RNA, 22 nt, Human
uguccuggccaaggccuugcuu

SEQ ID NO: 229757 - RNA, 22 nt, Human
uccucugagacaucagguugag

SEQ ID NO: 229758 - RNA, 22 nt, Human
aagcucagugaugccuccaggg

SEQ ID NO: 229759 - RNA, 22 nt, Human
aggagcucccgugaggagacca

SEQ ID NO: 229760 - RNA, 22 nt, Human
ugcaggugguccuuccucugcu

SEQ ID NO: 229761 - RNA, 22 nt, Human
aaagcaagucucuacaaaguac

SEQ ID NO: 229762 - RNA, 22 nt, Human
ucagaaguaagguucucccaag

SEQ ID NO: 229763 - RNA, 22 nt, Human
caggaagaccagggcuguggcu

SEQ ID NO: 229764 - RNA, 18 nt, Human
agaugaaagcaaaugaca

SEQ ID NO: 229765 - RNA, 22 nt, Human
gacuggaaagccuguccucaga

SEQ ID NO: 229766 - RNA, 21 nt, Human
ugcaggaguguaaugugaccc

SEQ ID NO: 229767 - RNA, 22 nt, Human
ccagcccuugcugaaggguggc

SEQ ID NO: 229768 - RNA, 22 nt, Human
gguggccuuuuaugagcagggu

SEQ ID NO: 229769 - RNA, 22 nt, Human
cccaggaacagggcucagaccc

SEQ ID NO: 229770 - RNA, 22 nt, Human
aacagugucugugguuaaaggu

SEQ ID NO: 229771 - RNA, 22 nt, Human
ugacaaauauuugaagaggcug

SEQ ID NO: 229772 - RNA, 22 nt, Human
aaaagcuagucaaugauguauu

SEQ ID NO: 229773 - RNA, 22 nt, Human
uucacaaagcuggagcauuucc

SEQ ID NO: 229774 - RNA, 22 nt, Human
ccucuggcaagugauuuaucau

SEQ ID NO: 229775 - RNA, 22 nt, Human
uuggcugguuucaagaaggcau

SEQ ID NO: 229776 - RNA, 22 nt, Human
uagcugguccucagcuccagcc

SEQ ID NO: 229777 - RNA, 22 nt, Human
ggcagugcccggugccuccucu

SEQ ID NO: 229778 - RNA, 22 nt, Human
cagcaucuguuuuucugaccca

SEQ ID NO: 229779 - RNA, 22 nt, Human
augcagggauuaaaugacugcc

SEQ ID NO: 229780 - RNA, 23 nt, Human
ccacagcuauaggguagugcagu

SEQ ID NO: 229781 - RNA, 22 nt, Human
uucucagacuuccagcaccagc

SEQ ID NO: 229782 - RNA, 21 nt, Human
aggcugcucuuucuuguggua

SEQ ID NO: 229783 - RNA, 22 nt, Human
guauucuuaaggauugagcaaa

SEQ ID NO: 229784 - RNA, 22 nt, Human
aauaucaguauauuguaucagu

SEQ ID NO: 229785 - RNA, 22 nt, Human
cugggugagcuggccagagggu

SEQ ID NO: 229786 - RNA, 22 nt, Human
cagaggccccauuggcugugcg

SEQ ID NO: 229787 - RNA, 22 nt, Human
auuccauuguauguguagacua

SEQ ID NO: 229788 - RNA, 20 nt, Human
ucuuuguuaauuuuaucucc

SEQ ID NO: 229789 - RNA, 22 nt, Human
ggcaggugguaaggauuucaua

SEQ ID NO: 229790 - RNA, 22 nt, Human
caggaugauguuaauugaaguu

SEQ ID NO: 229791 - RNA, 22 nt, Human
agcaccaggauauuguuggaga

SEQ ID NO: 229792 - RNA, 22 nt, Human
aaacaugagcacuugcuucaua

SEQ ID NO: 229793 - RNA, 22 nt, Human
uuucucagcucagcaucugggu

SEQ ID NO: 229794 - RNA, 22 nt, Human
cucugcugagccagagucccca

SEQ ID NO: 229795 - RNA, 22 nt, Human
ugggacagggaaucugaucccc

SEQ ID NO: 229796 - RNA, 22 nt, Human
aaugcaaagcaagcagagauuu

SEQ ID NO: 229797 - RNA, 22 nt, Human
gggacaggcaaagguaugcuuc

SEQ ID NO: 229798 - RNA, 22 nt, Human
cugcaggagcaagccugggaga

SEQ ID NO: 229799 - RNA, 22 nt, Human
uauugcauacuuaaauuuccgg

SEQ ID NO: 229800 - RNA, 22 nt, Human
agcuccugcaccaggggccccu

SEQ ID NO: 229801 - RNA, 22 nt, Human
uucuacaauaugaauaaugaag

SEQ ID NO: 229802 - RNA, 22 nt, Human
uaaagugcugggauuauaggcc

SEQ ID NO: 229803 - RNA, 22 nt, Human
auuuucaagggagaggccucug

SEQ ID NO: 229804 - RNA, 22 nt, Human
aguagugugacaauuaauauuu

SEQ ID NO: 229805 - RNA, 22 nt, Human
gcagaaccugaauugaacauug

SEQ ID NO: 229806 - RNA, 22 nt, Human
aacacaaagaagcugcaggauc

SEQ ID NO: 229807 - RNA, 22 nt, Human
ugcccagcugucaaaguagaua

SEQ ID NO: 229808 - RNA, 22 nt, Human
agaucccaaaucaccugcuuau

SEQ ID NO: 229809 - RNA, 22 nt, Human
ugcaggaaucagaggggaagcg

SEQ ID NO: 229810 - RNA, 22 nt, Human
ccacugggcguuucuguccaau

SEQ ID NO: 229811 - RNA, 22 nt, Human
gagaagcaaucaguggccaccc

SEQ ID NO: 229812 - RNA, 22 nt, Human
ucccuguacuuacacagcgucc

SEQ ID NO: 229813 - RNA, 22 nt, Human
gugcaauaaauaaauagauugu

SEQ ID NO: 229814 - RNA, 22 nt, Human
agcuucuuguagaacucaaaag

SEQ ID NO: 229815 - RNA, 22 nt, Human
augaaauaucuugaagaaauuc

SEQ ID NO: 229816 - RNA, 18 nt, Human
ucugaaagcccuuuucca

SEQ ID NO: 229817 - RNA, 22 nt, Human
ccagggcagugggagaaggugc

SEQ ID NO: 229818 - RNA, 22 nt, Human
uccaggugagugcaggugcaga

SEQ ID NO: 229819 - RNA, 22 nt, Human
agaaaguuagcagacucuuggc

SEQ ID NO: 229820 - RNA, 22 nt, Human
cucugggcuccuucagcccuuu

SEQ ID NO: 229821 - RNA, 22 nt, Human
uuacuuacaaaggcaaaggaag

SEQ ID NO: 229822 - RNA, 19 nt, Human
ucucagaggaaaaauugcu

SEQ ID NO: 229823 - RNA, 22 nt, Human
acaugucaauuuaguacucuua

SEQ ID NO: 229824 - RNA, 22 nt, Human
cagagcaguggagaguaggucu

SEQ ID NO: 229825 - RNA, 22 nt, Human
uuggagaguuaauugacaguua

SEQ ID NO: 229826 - RNA, 17 nt, Human
acagcaggcccggaggg

SEQ ID NO: 229827 - RNA, 22 nt, Human
aguuuaugaaacacagauuuga

SEQ ID NO: 229828 - RNA, 22 nt, Human
gaaugcacuuccaacaucuauu

SEQ ID NO: 229829 - RNA, 22 nt, Human
auuuauuaugggauuuggcuca

SEQ ID NO: 229830 - RNA, 22 nt, Human
ugguguggggauaagcacucug

SEQ ID NO: 229831 - RNA, 22 nt, Human
caggccaguuuugauuuaagcc

SEQ ID NO: 229832 - RNA, 22 nt, Human
ucaauagcauagcaauuaaugu

SEQ ID NO: 229833 - RNA, 23 nt, Human
agacaaacuuccuucacugcacc

SEQ ID NO: 229834 - RNA, 22 nt, Human
ccaggcacucacggggcacugg

SEQ ID NO: 229835 - RNA, 22 nt, Human
uagcugaaggcuacagcagaac

SEQ ID NO: 229836 - RNA, 22 nt, Human
aacaugcauguuauuuaucagu

SEQ ID NO: 229837 - RNA, 22 nt, Human
augcccugcucucgggaaggga

SEQ ID NO: 229838 - RNA, 22 nt, Human
gcugcccaggcaacauugacuu

SEQ ID NO: 229839 - RNA, 22 nt, Human
gcugcaggagcuggagcugugg

SEQ ID NO: 229840 - RNA, 22 nt, Human
aggagacauaacuaugaugaga

SEQ ID NO: 229841 - RNA, 22 nt, Human
uaggacauguguuuuauauaug

SEQ ID NO: 229842 - RNA, 20 nt, Human
cugccuggaggccucuaccu

SEQ ID NO: 229843 - RNA, 22 nt, Human
uaaagcacgucuauuuaaugau

SEQ ID NO: 229844 - RNA, 22 nt, Human
aacuacaauauguauguaugua

SEQ ID NO: 229845 - RNA, 22 nt, Human
uucccucccccagccuggcagg

SEQ ID NO: 229846 - RNA, 22 nt, Human
auacugauuaguugagaaagca

SEQ ID NO: 229847 - RNA, 22 nt, Human
auuucucagugaaaugacaggc

SEQ ID NO: 229848 - RNA, 22 nt, Human
gccaggcuguuuuuauuacugu

SEQ ID NO: 229849 - RNA, 22 nt, Human
ucugaggaccuacugaagaguu

SEQ ID NO: 229850 - RNA, 22 nt, Human
gagggaccuuuacacagacauu

SEQ ID NO: 229851 - RNA, 22 nt, Human
uucaaugcauauagauauagaa

SEQ ID NO: 229852 - RNA, 22 nt, Human
ugaugcaauguuuacaucuuga

SEQ ID NO: 229853 - RNA, 22 nt, Human
ugccaggcugucaauucaccca

SEQ ID NO: 229854 - RNA, 22 nt, Human
acuuagaacaggcagaauucca

SEQ ID NO: 229855 - RNA, 20 nt, Human
guccuagguuugaagguaaa

SEQ ID NO: 229856 - RNA, 22 nt, Human
ggcugggcucgcugauuggcug

SEQ ID NO: 229857 - RNA, 22 nt, Human
gggucuccauguuaacaucacu

SEQ ID NO: 229858 - RNA, 20 nt, Human
aaugagaugacuuagaggaa

SEQ ID NO: 229859 - RNA, 22 nt, Human
ucaggcuguuccuguccaaaau

SEQ ID NO: 229860 - RNA, 22 nt, Human
ugggcuccucgucacucgcugu

SEQ ID NO: 229861 - RNA, 22 nt, Human
aguuuuauggcucaaccuaaua

SEQ ID NO: 229862 - RNA, 22 nt, Human
cacaucugacuuccagugcagg

SEQ ID NO: 229863 - RNA, 21 nt, Human
gguguccugagggauagguag

SEQ ID NO: 229864 - RNA, 22 nt, Human
agcaggugaauuccuggaugug

SEQ ID NO: 229865 - RNA, 22 nt, Human
gggcagguuggcaucccgggca

SEQ ID NO: 229866 - RNA, 22 nt, Human
uugaauucauuucucauugagu

SEQ ID NO: 229867 - RNA, 22 nt, Human
aaugcucaaaauguuucaucua

SEQ ID NO: 229868 - RNA, 23 nt, Human
agaggggagcaucugcuggcuga

SEQ ID NO: 229869 - RNA, 22 nt, Human
ggcuggcagcuucaucccagau

SEQ ID NO: 229870 - RNA, 22 nt, Human
agucuuaugguuaaauagaugc

SEQ ID NO: 229871 - RNA, 22 nt, Human
cagagccagaacuagaccuugu

SEQ ID NO: 229872 - RNA, 22 nt, Human
ccacaguagaauucaucucccu

SEQ ID NO: 229873 - RNA, 22 nt, Human
gaaacaugucugacaauuuacc

SEQ ID NO: 229874 - RNA, 22 nt, Human
ucuuccagaaucucagagggcu

SEQ ID NO: 229875 - RNA, 22 nt, Human
auucaacuguaaacuuguucac

SEQ ID NO: 229876 - RNA, 22 nt, Human
uccccacacuuucacuccuggc

SEQ ID NO: 229877 - RNA, 22 nt, Human
acagcagggguggaauaaacgu

SEQ ID NO: 229878 - RNA, 22 nt, Human
cagauuaacacggagcuuaaca

SEQ ID NO: 229879 - RNA, 22 nt, Human
cugcagaggucuugcugauggu

SEQ ID NO: 229880 - RNA, 22 nt, Human
uggugcccauguaucccuucac

SEQ ID NO: 229881 - RNA, 22 nt, Human
caggcacaaaaggaccccagca

SEQ ID NO: 229882 - RNA, 22 nt, Human
uauugacauuuuuauagcuuga

SEQ ID NO: 229883 - RNA, 20 nt, Human
uggcggggaugagggaguua

SEQ ID NO: 229884 - RNA, 22 nt, Human
agucagcagccuggccaggaga

SEQ ID NO: 229885 - RNA, 22 nt, Human
uagcaagaagcugucacaggug

SEQ ID NO: 229886 - RNA, 22 nt, Human
gggcuucuugcaggggcaacau

SEQ ID NO: 229887 - RNA, 22 nt, Human
ucauagaaauggaaaguauauu

SEQ ID NO: 229888 - RNA, 22 nt, Human
cuccuggugacucccagauaaa

SEQ ID NO: 229889 - RNA, 22 nt, Human
uuggauccaucucaggcauagg

SEQ ID NO: 229890 - RNA, 22 nt, Human
auucaagagcccauguuuccug

SEQ ID NO: 229891 - RNA, 22 nt, Human
aaucugcacaauucaguuucag

SEQ ID NO: 229892 - RNA, 22 nt, Human
acauuaaagaguaagguuaguu

SEQ ID NO: 229893 - RNA, 22 nt, Human
uagauaccugcuggaccucauu

SEQ ID NO: 229894 - RNA, 22 nt, Human
gccuggugauaagcagugaccu

SEQ ID NO: 229895 - RNA, 22 nt, Human
acaggcugagcguccaucuuca

SEQ ID NO: 229896 - RNA, 21 nt, Human
gacacaguaaucuuggggcuu

SEQ ID NO: 229897 - RNA, 22 nt, Human
aguuaacuaaauuaagagacaa

SEQ ID NO: 229898 - RNA, 19 nt, Human
ggcucagggcgcugccgcc

SEQ ID NO: 229899 - RNA, 22 nt, Human
ucuuuuguugccuacuuauuaa

SEQ ID NO: 229900 - RNA, 22 nt, Human
cuuucagagguuacucaggaaa

SEQ ID NO: 229901 - RNA, 22 nt, Human
uccuuucuccuuccgacuucau

SEQ ID NO: 229902 - RNA, 22 nt, Human
accuuggcaguuucuaccuuuu

SEQ ID NO: 229903 - RNA, 22 nt, Human
cucagugucuuauuguacacau

SEQ ID NO: 229904 - RNA, 22 nt, Human
ccauaguacauaauacauuuua

SEQ ID NO: 229905 - RNA, 22 nt, Human
aucuuugcuauuguaaaucacg

SEQ ID NO: 229906 - RNA, 22 nt, Human
augcauaucuccuaucuccuca

SEQ ID NO: 229907 - RNA, 22 nt, Human
aaagacagagcuguaggggaaa

SEQ ID NO: 229908 - RNA, 22 nt, Human
uggcccagggcacagcagggag

SEQ ID NO: 229909 - RNA, 22 nt, Human
accucagauuguggcuccgcug

SEQ ID NO: 229910 - RNA, 22 nt, Human
auauacaugggaauauguggag

SEQ ID NO: 229911 - RNA, 22 nt, Human
gggagcugagggaccucugugg

SEQ ID NO: 229912 - RNA, 16 nt, Human
gacaaguggaggggcc

SEQ ID NO: 229913 - RNA, 22 nt, Human
gacugccucaguuucccugcag

SEQ ID NO: 229914 - RNA, 22 nt, Human
gagguagcaugcuggaagggac

SEQ ID NO: 229915 - RNA, 20 nt, Human
cucucuccaucucaguggcc

SEQ ID NO: 229916 - RNA, 22 nt, Human
uagcaaaagcucaacaggaagg

SEQ ID NO: 229917 - RNA, 22 nt, Human
ccugcuuugcugguaccaucag

SEQ ID NO: 229918 - RNA, 22 nt, Human
ggaagcagccugaagccaaggg

SEQ ID NO: 229919 - RNA, 22 nt, Human
aagcaaaacgugcucuaggagg

SEQ ID NO: 229920 - RNA, 22 nt, Human
uuuagagcccaugugaguguga

SEQ ID NO: 229921 - RNA, 22 nt, Human
aggccaagauuuuggaucagcu

SEQ ID NO: 229922 - RNA, 22 nt, Human
ugcuccaggcaagcugagaguu

SEQ ID NO: 229923 - RNA, 22 nt, Human
aagugcaggaguggggaaagua

SEQ ID NO: 229924 - RNA, 22 nt, Human
cagaagcauugacuccuugcuc

SEQ ID NO: 229925 - RNA, 20 nt, Human
aagucccuaagucucuggcc

SEQ ID NO: 229926 - RNA, 22 nt, Human
gccagccauaggccagcacugg

SEQ ID NO: 229927 - RNA, 22 nt, Human
cuacauaaucuggauuugucug

SEQ ID NO: 229928 - RNA, 22 nt, Human
auuauuuagaaaucgauugaaa

SEQ ID NO: 229929 - RNA, 22 nt, Human
aaagcaauggcacaugauggua

SEQ ID NO: 229930 - RNA, 22 nt, Human
cagguccccuccccuaccaggc

SEQ ID NO: 229931 - RNA, 22 nt, Human
agaaauguauagugaauuuuuc

SEQ ID NO: 229932 - RNA, 18 nt, Human
cuugagcuaagggacccc

SEQ ID NO: 229933 - RNA, 22 nt, Human
aagagcuggcccaaucugagca

SEQ ID NO: 229934 - RNA, 22 nt, Human
ccacccuaacaauccuuacugu

SEQ ID NO: 229935 - RNA, 22 nt, Human
uuugacuccuguguuucuggaa

SEQ ID NO: 229936 - RNA, 22 nt, Human
cauauuucagucuaagaugugu

SEQ ID NO: 229937 - RNA, 21 nt, Human
caauuacagauggcucagggg

SEQ ID NO: 229938 - RNA, 23 nt, Human
uggcccugaaucuguccuggagg

SEQ ID NO: 229939 - RNA, 22 nt, Human
gcccagcacauugcugaggacc

SEQ ID NO: 229940 - RNA, 22 nt, Human
gaggcuggagauauuccaaucu

SEQ ID NO: 229941 - RNA, 23 nt, Human
ggccucagcgcacagaaacugcu

SEQ ID NO: 229942 - RNA, 22 nt, Human
agguuauaugucauacugaagu

SEQ ID NO: 229943 - RNA, 22 nt, Human
ugcucuccugcuccucagccca

SEQ ID NO: 229944 - RNA, 15 nt, Human
ccaggcucugcacuc

SEQ ID NO: 229945 - RNA, 22 nt, Human
agcuggagauucuggggacagu

SEQ ID NO: 229946 - RNA, 22 nt, Human
uccacuccuuaugccagacggu

SEQ ID NO: 229947 - RNA, 22 nt, Human
uggcagcagggaggccaguguu

SEQ ID NO: 229948 - RNA, 22 nt, Human
cuggccagugacugcucacccg

SEQ ID NO: 229949 - RNA, 22 nt, Human
uagaaagacaugggccagcagc

SEQ ID NO: 229950 - RNA, 22 nt, Human
cauuuguacagaacagcuuuau

SEQ ID NO: 229951 - RNA, 22 nt, Human
uauuaauaugugugugcaugua

SEQ ID NO: 229952 - RNA, 22 nt, Human
uguucaguuaacacagacacca

SEQ ID NO: 229953 - RNA, 18 nt, Human
auugagcaugacagaccu

SEQ ID NO: 229954 - RNA, 22 nt, Human
agggagcucgaugccugagugu

SEQ ID NO: 229955 - RNA, 22 nt, Human
aguaacacuauuuucauaugua

SEQ ID NO: 229956 - RNA, 22 nt, Human
caggccagagcgcgugguuggg

SEQ ID NO: 229957 - RNA, 22 nt, Human
uagagucuaguguauacaaagu

SEQ ID NO: 229958 - RNA, 22 nt, Human
ucacacaugcuaagccagagau

SEQ ID NO: 229959 - RNA, 22 nt, Human
aagggcugaaagaccuugggca

SEQ ID NO: 229960 - RNA, 22 nt, Human
ucccucacugguucugcauccc

SEQ ID NO: 229961 - RNA, 22 nt, Human
aaacucuggggguggagcccag

SEQ ID NO: 229962 - RNA, 22 nt, Human
uaguauucagcuucucaggcaa

SEQ ID NO: 229963 - RNA, 22 nt, Human
cuguuauauugguauauuuaca

SEQ ID NO: 229964 - RNA, 22 nt, Human
agucugguauuggucuuuaauc

SEQ ID NO: 229965 - RNA, 22 nt, Human
ggcugugagcaggcagaaugcu

SEQ ID NO: 229966 - RNA, 22 nt, Human
ucaugccaaaauccaguggcuu

SEQ ID NO: 229967 - RNA, 22 nt, Human
aagaaugucguugguauuuuaa

SEQ ID NO: 229968 - RNA, 22 nt, Human
ccucaguguguggauguuagag

SEQ ID NO: 229969 - RNA, 22 nt, Human
cuugaaucuggcuuugccacuu

SEQ ID NO: 229970 - RNA, 22 nt, Human
ggcagggguccugguguugacu

SEQ ID NO: 229971 - RNA, 22 nt, Human
aaugauuuggcaaaggaaucca

SEQ ID NO: 229972 - RNA, 22 nt, Human
cuccugcaugguugugcuauug

SEQ ID NO: 229973 - RNA, 22 nt, Human
uuuagccaacuauaugacuagu

SEQ ID NO: 229974 - RNA, 22 nt, Human
uucugccauugccaugagggcu

SEQ ID NO: 229975 - RNA, 22 nt, Human
gggcucuguuuagaccagagau

SEQ ID NO: 229976 - RNA, 22 nt, Human
ugucuccaggggcaggccagcc

SEQ ID NO: 229977 - RNA, 22 nt, Human
ggcagcugcaaaucugcucugu

SEQ ID NO: 229978 - RNA, 22 nt, Human
ucugagccccuagaacugagcg

SEQ ID NO: 229979 - RNA, 22 nt, Human
uccuccccugcccaugaggagg

SEQ ID NO: 229980 - RNA, 22 nt, Human
ucugccuuccccauaaucugau

SEQ ID NO: 229981 - RNA, 22 nt, Human
ucucucagggggaaggcugaag

SEQ ID NO: 229982 - RNA, 18 nt, Human
ggagcugggccugguucc

SEQ ID NO: 229983 - RNA, 22 nt, Human
uuaauuuucucaucugugaaau

SEQ ID NO: 229984 - RNA, 22 nt, Human
uccagcuguugauauucuaggu

SEQ ID NO: 229985 - RNA, 22 nt, Human
ucacacaggguucuggucucau

SEQ ID NO: 229986 - RNA, 22 nt, Human
cacauucacuucucuguccacc

SEQ ID NO: 229987 - RNA, 22 nt, Human
auugaacauacauauccacacc

SEQ ID NO: 229988 - RNA, 22 nt, Human
uuggccagugcuugugauuuuc

SEQ ID NO: 229989 - RNA, 22 nt, Human
uggcagguccacucacagaucu

SEQ ID NO: 229990 - RNA, 22 nt, Human
ugggccucccaugucuuaggga

SEQ ID NO: 229991 - RNA, 22 nt, Human
cauuagaagaacaguuauauua

SEQ ID NO: 229992 - RNA, 22 nt, Human
agcagcaggguguaauugggca

SEQ ID NO: 229993 - RNA, 22 nt, Human
aacagcaccgaagucgucuaag

SEQ ID NO: 229994 - RNA, 22 nt, Human
agucagugacuuuugcugagag

SEQ ID NO: 229995 - RNA, 22 nt, Human
ugguccagucguuccuuuccuu

SEQ ID NO: 229996 - RNA, 22 nt, Human
acagaauauugguuacuguugc

SEQ ID NO: 229997 - RNA, 22 nt, Human
ucacugcagagaccucuaguca

SEQ ID NO: 229998 - RNA, 22 nt, Human
guccacugcugugugcuucacc

SEQ ID NO: 229999 - RNA, 22 nt, Human
uugucauugggguuauuuguua

SEQ ID NO: 230000 - RNA, 22 nt, Human
gggaaagacccugagucuuauu

SEQ ID NO: 230001 - RNA, 22 nt, Human
aggaaacucaaagugucaggua

SEQ ID NO: 230002 - RNA, 22 nt, Human
aauuuggcagugucuugaagua

SEQ ID NO: 230003 - RNA, 22 nt, Human
uuuauauuaccuggaauagcuu

SEQ ID NO: 230004 - RNA, 22 nt, Human
ccacucugcugugcuccaugau

SEQ ID NO: 230005 - RNA, 22 nt, Human
uuccuggugguggugacagcac

SEQ ID NO: 230006 - RNA, 22 nt, Human
augcaacaguucauaguuuuau

SEQ ID NO: 230007 - RNA, 22 nt, Human
cagauaaauagauagauaaacu

SEQ ID NO: 230008 - RNA, 22 nt, Human
aggacacagcugcucugcagag

SEQ ID NO: 230009 - RNA, 22 nt, Human
ugugugucagagucuccauggu

SEQ ID NO: 230010 - RNA, 22 nt, Human
cugugugcugaaaugcagugag

SEQ ID NO: 230011 - RNA, 22 nt, Human
gacuuucugagucaaagaaagg

SEQ ID NO: 230012 - RNA, 22 nt, Human
uuaguuuucucaucuaucucac

SEQ ID NO: 230013 - RNA, 22 nt, Human
aucucccagccacagcauucuu

SEQ ID NO: 230014 - RNA, 22 nt, Human
ccagcucucuguccuccccaca

SEQ ID NO: 230015 - RNA, 22 nt, Human
ggagcugaaggggugggcucag

SEQ ID NO: 230016 - RNA, 22 nt, Human
acuccuggggauccauuccuuu

SEQ ID NO: 230017 - RNA, 22 nt, Human
aagcaggauggagguugaguua

SEQ ID NO: 230018 - RNA, 19 nt, Human
augcuuuauguuauuucuu

SEQ ID NO: 230019 - RNA, 22 nt, Human
agcuuuaucccuugcccaucga

SEQ ID NO: 230020 - RNA, 19 nt, Human
aguuuauuauaggugauuc

SEQ ID NO: 230021 - RNA, 22 nt, Human
auuuccuaggugcucgagugcu

SEQ ID NO: 230022 - RNA, 19 nt, Human
ugagcuggcugagccucuc

SEQ ID NO: 230023 - RNA, 19 nt, Human
ucaaugcaugaaaucagcc

SEQ ID NO: 230024 - RNA, 22 nt, Human
uccagcucaaagugcuccuguc

SEQ ID NO: 230025 - RNA, 22 nt, Human
gccugcugaagccagagugugu

SEQ ID NO: 230026 - RNA, 22 nt, Human
gaaacugaguaggcuagagcac

SEQ ID NO: 230027 - RNA, 22 nt, Human
ggaaaacugaggcucucagcag

SEQ ID NO: 230028 - RNA, 22 nt, Human
agccagaguugaaugugagucu

SEQ ID NO: 230029 - RNA, 22 nt, Human
agcccuaacucccaguaucuug

SEQ ID NO: 230030 - RNA, 22 nt, Human
uaggcuucccgcucacaugccc

SEQ ID NO: 230031 - RNA, 22 nt, Human
uucuacaucacuuaacaugcua

SEQ ID NO: 230032 - RNA, 22 nt, Human
gcaggugugaaugugaauuaag

SEQ ID NO: 230033 - RNA, 22 nt, Human
cccugcagcuuuugcauaguca

SEQ ID NO: 230034 - RNA, 22 nt, Human
ucauugcagaaauaaaggugaa

SEQ ID NO: 230035 - RNA, 22 nt, Human
cagcaggcguugggagaaagac

SEQ ID NO: 230036 - RNA, 22 nt, Human
uugagaauaaauuagcagacau

SEQ ID NO: 230037 - RNA, 22 nt, Human
cagcuccugcagcugcugccgu

SEQ ID NO: 230038 - RNA, 17 nt, Human
ugaggccugcaucagug

SEQ ID NO: 230039 - RNA, 22 nt, Human
auauugaucuuggaacugauuu

SEQ ID NO: 230040 - RNA, 22 nt, Human
uacaaugugugcuucuugucac

SEQ ID NO: 230041 - RNA, 22 nt, Human
auaggagccauaaauaaaaucu

SEQ ID NO: 230042 - RNA, 22 nt, Human
aaauucacuugccugcuuagcu

SEQ ID NO: 230043 - RNA, 22 nt, Human
aggaagaaaugugacuucaaac

SEQ ID NO: 230044 - RNA, 22 nt, Human
ucuucuggaugagagcggaggc

SEQ ID NO: 230045 - RNA, 22 nt, Human
gacaggcugugauggccgggag

SEQ ID NO: 230046 - RNA, 22 nt, Human
uccaggagaggccugaccaggu

SEQ ID NO: 230047 - RNA, 22 nt, Human
cagcagcaaaucuagaagagga

SEQ ID NO: 230048 - RNA, 22 nt, Human
gaauuacaaagugagacaagcu

SEQ ID NO: 230049 - RNA, 23 nt, Human
ugcaguaggauggggcugggccu

SEQ ID NO: 230050 - RNA, 22 nt, Human
uccaggcuggagugcaguggcg

SEQ ID NO: 230051 - RNA, 22 nt, Human
acagguggaaacaugguguugg

SEQ ID NO: 230052 - RNA, 22 nt, Human
ccuccuggaaaaauucccuggc

SEQ ID NO: 230053 - RNA, 22 nt, Human
ucuccaagaaaagaucucagcu

SEQ ID NO: 230054 - RNA, 22 nt, Human
cuucuccucugaguccugggag

SEQ ID NO: 230055 - RNA, 22 nt, Human
cacaggugcaagaaguugcagu

SEQ ID NO: 230056 - RNA, 22 nt, Human
acaagagcauugcagguguguu

SEQ ID NO: 230057 - RNA, 22 nt, Human
ucaauuauuugauaugaaaggg

SEQ ID NO: 230058 - RNA, 22 nt, Human
agagcccugacggggacagaug

SEQ ID NO: 230059 - RNA, 18 nt, Human
gcuccugguuggaaagaa

SEQ ID NO: 230060 - RNA, 22 nt, Human
uuaucugaaaaccucaaaauau

SEQ ID NO: 230061 - RNA, 19 nt, Human
cucuuuggagauccuugga

SEQ ID NO: 230062 - RNA, 21 nt, Human
ucucuuucuggaagcuucccu

SEQ ID NO: 230063 - RNA, 22 nt, Human
caggagacaguguuauuuuauu

SEQ ID NO: 230064 - RNA, 22 nt, Human
gagcaagaguguuggacuuuga

SEQ ID NO: 230065 - RNA, 22 nt, Human
cugagucucccggcaguggagg

SEQ ID NO: 230066 - RNA, 22 nt, Human
uggccuggccacauccagcagg

SEQ ID NO: 230067 - RNA, 22 nt, Human
cucugucccagacccaccucuc

SEQ ID NO: 230068 - RNA, 22 nt, Human
gaacaguacuaagagcuuuaca

SEQ ID NO: 230069 - RNA, 17 nt, Human
acccaggcucuaucuug

SEQ ID NO: 230070 - RNA, 22 nt, Human
gaggguccuggcuaagucugac

SEQ ID NO: 230071 - RNA, 22 nt, Human
cacuugauguugucacuauugc

SEQ ID NO: 230072 - RNA, 22 nt, Human
ugcacuucauuguaaauuguac

SEQ ID NO: 230073 - RNA, 22 nt, Human
acagccagguaaaggcauggca

SEQ ID NO: 230074 - RNA, 22 nt, Human
ucugaaagucugaaacaguguc

SEQ ID NO: 230075 - RNA, 22 nt, Human
aaaccuuucugcucucagcgua

SEQ ID NO: 230076 - RNA, 22 nt, Human
uucagagaguccaguaugcagu

SEQ ID NO: 230077 - RNA, 17 nt, Human
cucccccccacgugucc

SEQ ID NO: 230078 - RNA, 23 nt, Human
auuuuacaggucaguuccuugaa

SEQ ID NO: 230079 - RNA, 22 nt, Human
ugguacaagauguucuaacuga

SEQ ID NO: 230080 - RNA, 22 nt, Human
gaauguuuaaggaaggcguggc

SEQ ID NO: 230081 - RNA, 22 nt, Human
auucuacaggacuggcaauccc

SEQ ID NO: 230082 - RNA, 22 nt, Human
uuccugccccugagagcuccca

SEQ ID NO: 230083 - RNA, 18 nt, Human
ucucuccaucuauuuguu

SEQ ID NO: 230084 - RNA, 22 nt, Human
ccucuggcucacagcaccaacu

SEQ ID NO: 230085 - RNA, 22 nt, Human
auauucacuccuggugagacua

SEQ ID NO: 230086 - RNA, 22 nt, Human
cugcugugcaggugccuaugau

SEQ ID NO: 230087 - RNA, 22 nt, Human
ccacagcaccugcagccaguug

SEQ ID NO: 230088 - RNA, 22 nt, Human
aaacugguagcaauuuaagggu

SEQ ID NO: 230089 - RNA, 22 nt, Human
uugcugauucaugauuugagaa

SEQ ID NO: 230090 - RNA, 22 nt, Human
gaauacaugaacccuccugugg

SEQ ID NO: 230091 - RNA, 22 nt, Human
uaaagugguggugcuaauguau

SEQ ID NO: 230092 - RNA, 22 nt, Human
gucuuuggaaagacaaaguuca

SEQ ID NO: 230093 - RNA, 22 nt, Human
acugggccagaucagagcaacu

SEQ ID NO: 230094 - RNA, 22 nt, Human
acauccagaucucagcauggcu

SEQ ID NO: 230095 - RNA, 22 nt, Human
agugagucaaaaaacuuagaua

SEQ ID NO: 230096 - RNA, 23 nt, Human
ugggauagaauuucauggcugcu

SEQ ID NO: 230097 - RNA, 22 nt, Human
uuucauuacguguuugacuugu

SEQ ID NO: 230098 - RNA, 22 nt, Human
gaggcaaggccgcacgucucag

SEQ ID NO: 230099 - RNA, 22 nt, Human
acucagagugcaucuccuauuu

SEQ ID NO: 230100 - RNA, 22 nt, Human
agcagggcucacauuaguggau

SEQ ID NO: 230101 - RNA, 18 nt, Human
aggagacagccucaccug

SEQ ID NO: 230102 - RNA, 22 nt, Human
cauguaaagaauuucacacaag

SEQ ID NO: 230103 - RNA, 22 nt, Human
agauuguagaaacuguagcauu

SEQ ID NO: 230104 - RNA, 22 nt, Human
augcauaauguauguauugacu

SEQ ID NO: 230105 - RNA, 22 nt, Human
ccucccucuuucagucccacag

SEQ ID NO: 230106 - RNA, 22 nt, Human
aggcugagcuggcccuugaaau

SEQ ID NO: 230107 - RNA, 22 nt, Human
ggggcggggcucugagaagcau

SEQ ID NO: 230108 - RNA, 22 nt, Human
ccagugcacagccaggcaggug

SEQ ID NO: 230109 - RNA, 22 nt, Human
gcagcccaggagcaggcgaccc

SEQ ID NO: 230110 - RNA, 22 nt, Human
ugaaagcuuguuggaaauguag

SEQ ID NO: 230111 - RNA, 22 nt, Human
uuucaggaaggugaggcacaug

SEQ ID NO: 230112 - RNA, 22 nt, Human
ucagaggcucaucugccuugca

SEQ ID NO: 230113 - RNA, 22 nt, Human
cuccagggaugagacagaguag

SEQ ID NO: 230114 - RNA, 22 nt, Human
cugaaugagggauucugagggc

SEQ ID NO: 230115 - RNA, 17 nt, Human
ccugccugagccauagc

SEQ ID NO: 230116 - RNA, 22 nt, Human
uuuagagaggcucuguaaaaug

SEQ ID NO: 230117 - RNA, 22 nt, Human
ggaguagcugcauuccgagcac

SEQ ID NO: 230118 - RNA, 22 nt, Human
ucuguaggcuuacgcggcuucu

SEQ ID NO: 230119 - RNA, 22 nt, Human
gaugaucugagguacaugaaac

SEQ ID NO: 230120 - RNA, 22 nt, Human
auugcuggcccagaugcuuuag

SEQ ID NO: 230121 - RNA, 20 nt, Human
uucugggcagccauguacuu

SEQ ID NO: 230122 - RNA, 22 nt, Human
aggagcucucccaugcugcaga

SEQ ID NO: 230123 - RNA, 22 nt, Human
uccuggcccucugcaaacgcca

SEQ ID NO: 230124 - RNA, 22 nt, Human
ugacauguguaaucagcuccgu

SEQ ID NO: 230125 - RNA, 22 nt, Human
ucuuuuauuaggcugaaauggg

SEQ ID NO: 230126 - RNA, 21 nt, Human
ucucugagaggucugcuuaga

SEQ ID NO: 230127 - RNA, 22 nt, Human
ucccugagagcacuggggagcc

SEQ ID NO: 230128 - RNA, 22 nt, Human
agacaagacuaggcaguuguug

SEQ ID NO: 230129 - RNA, 22 nt, Human
agccggccauguggucuugugc

SEQ ID NO: 230130 - RNA, 22 nt, Human
uagauaaaagggcaaagggcau

SEQ ID NO: 230131 - RNA, 22 nt, Human
ccuggcugggccugauuucuca

SEQ ID NO: 230132 - RNA, 22 nt, Human
caugaaauaugcuaccugucuu

SEQ ID NO: 230133 - RNA, 22 nt, Human
agaaacucuggaagaacuuuua

SEQ ID NO: 230134 - RNA, 16 nt, Human
ggcaccagugaacaca

SEQ ID NO: 230135 - RNA, 22 nt, Human
guggccagaggucccauguguc

SEQ ID NO: 230136 - RNA, 18 nt, Human
uguggcugguccacacug

SEQ ID NO: 230137 - RNA, 22 nt, Human
ugggccugccccaggcuucagc

SEQ ID NO: 230138 - RNA, 22 nt, Human
gguccuggaaauugacggaaag

SEQ ID NO: 230139 - RNA, 22 nt, Human
gcagucuauaaaucagcuuugc

SEQ ID NO: 230140 - RNA, 22 nt, Human
ccaggcuccccaggaggcccuu

SEQ ID NO: 230141 - RNA, 22 nt, Human
aaaguucuuuuucuauaaaucc

SEQ ID NO: 230142 - RNA, 22 nt, Human
gcagacaauuuauuagcagauu

SEQ ID NO: 230143 - RNA, 22 nt, Human
guuaauaaagguauagaaucag

SEQ ID NO: 230144 - RNA, 22 nt, Human
ucacacaucucagguguuuaau

SEQ ID NO: 230145 - RNA, 22 nt, Human
ccugggagguggagguugcagu

SEQ ID NO: 230146 - RNA, 22 nt, Human
ucccaggguuacagccagggca

SEQ ID NO: 230147 - RNA, 22 nt, Human
gguccagucagauauucaugca

SEQ ID NO: 230148 - RNA, 22 nt, Human
cuggcuuucauuucaagcacgu

SEQ ID NO: 230149 - RNA, 22 nt, Human
ggcugcuguuucagagacuguu

SEQ ID NO: 230150 - RNA, 22 nt, Human
aaggcagugguuggguggagga

SEQ ID NO: 230151 - RNA, 22 nt, Human
augacagacagaagggauuuuu

SEQ ID NO: 230152 - RNA, 22 nt, Human
uggagggucaccccuugcugag

SEQ ID NO: 230153 - RNA, 22 nt, Human
uggccagcacuuagcccuuacc

SEQ ID NO: 230154 - RNA, 22 nt, Human
aauugcuuacuguuuuucaccu

SEQ ID NO: 230155 - RNA, 22 nt, Human
uacacugugacaaucaugacag

SEQ ID NO: 230156 - RNA, 22 nt, Human
acauguggaggaggcgagggua

SEQ ID NO: 230157 - RNA, 22 nt, Human
aaugugguuaacccauuuaaga

SEQ ID NO: 230158 - RNA, 22 nt, Human
auauguguacgugcaguauaua

SEQ ID NO: 230159 - RNA, 22 nt, Human
ucaguguuuuuaaagcaauaua

SEQ ID NO: 230160 - RNA, 22 nt, Human
cuucugagggccuuugcuucca

SEQ ID NO: 230161 - RNA, 22 nt, Human
auuuucagagacaucuggacuu

SEQ ID NO: 230162 - RNA, 22 nt, Human
ccucaaaggccuggcaccagaa

SEQ ID NO: 230163 - RNA, 22 nt, Human
uuaguuauacuacugaauggag

SEQ ID NO: 230164 - RNA, 20 nt, Human
ggggcagguuuuuauggcua

SEQ ID NO: 230165 - RNA, 22 nt, Human
ggggaggaccuuuccaaggcuu

SEQ ID NO: 230166 - RNA, 22 nt, Human
acacaugaggaugaggggauca

SEQ ID NO: 230167 - RNA, 22 nt, Human
aaugccaacuuggauauacauu

SEQ ID NO: 230168 - RNA, 22 nt, Human
ucagaccccagaaugaagccag

SEQ ID NO: 230169 - RNA, 22 nt, Human
guuauguauugggaaauccaag

SEQ ID NO: 230170 - RNA, 22 nt, Human
aagggaggccagagguuuugca

SEQ ID NO: 230171 - RNA, 22 nt, Human
auacaugucaucauauguuugu

SEQ ID NO: 230172 - RNA, 21 nt, Human
gccugcaguuuugaagcccuu

SEQ ID NO: 230173 - RNA, 22 nt, Human
ucuauagaucaguaaauaucuc

SEQ ID NO: 230174 - RNA, 22 nt, Human
aggaacagaagagcaaugcagg

SEQ ID NO: 230175 - RNA, 22 nt, Human
uccugauggccucuggcuccag

SEQ ID NO: 230176 - RNA, 21 nt, Human
gcucagaguauugcacuguuu

SEQ ID NO: 230177 - RNA, 22 nt, Human
ugccuuuuccagcuuccagagg

SEQ ID NO: 230178 - RNA, 22 nt, Human
aaagauuucagaagccugugcc

SEQ ID NO: 230179 - RNA, 22 nt, Human
aagccaagguuuuggucacagc

SEQ ID NO: 230180 - RNA, 22 nt, Human
aaagcacaggagaguucaguaa

SEQ ID NO: 230181 - RNA, 22 nt, Human
cccaggcucuuaugugacuugc

SEQ ID NO: 230182 - RNA, 19 nt, Human
gcaaaucugaccaaauagu

SEQ ID NO: 230183 - RNA, 22 nt, Human
uucugggcucccacauauuuca

SEQ ID NO: 230184 - RNA, 22 nt, Human
uuggaucuuaugaagguggcau

SEQ ID NO: 230185 - RNA, 22 nt, Human
agaaauuauuagugaauagucu

SEQ ID NO: 230186 - RNA, 22 nt, Human
auggccugaugcaccuguccca

SEQ ID NO: 230187 - RNA, 18 nt, Human
caauagaaacaguaggaa

SEQ ID NO: 230188 - RNA, 22 nt, Human
ucugggaaaugcuguuccuugu

SEQ ID NO: 230189 - RNA, 22 nt, Human
acaugucuacacauucugcaau

SEQ ID NO: 230190 - RNA, 22 nt, Human
cugggccucaagcucagauuuc

SEQ ID NO: 230191 - RNA, 22 nt, Human
uggcugagguuaugcugguugu

SEQ ID NO: 230192 - RNA, 22 nt, Human
aguuucuguuaccauauuugac

SEQ ID NO: 230193 - RNA, 22 nt, Human
gacaggcuuucucaggaugagc

SEQ ID NO: 230194 - RNA, 20 nt, Human
caaauucuguugaauacacc

SEQ ID NO: 230195 - RNA, 22 nt, Human
ugacaggcuaggaggcugaagg

SEQ ID NO: 230196 - RNA, 22 nt, Human
uuggccucauggacagcucauc

SEQ ID NO: 230197 - RNA, 22 nt, Human
ccugugcucccauagcuucugu

SEQ ID NO: 230198 - RNA, 22 nt, Human
acugucuucauaucugugucuc

SEQ ID NO: 230199 - RNA, 22 nt, Human
aagugcauuagauagaaugaug

SEQ ID NO: 230200 - RNA, 22 nt, Human
ucucugucugcacccaaucaau

SEQ ID NO: 230201 - RNA, 22 nt, Human
gcaagcugugauuuaugugaau

SEQ ID NO: 230202 - RNA, 21 nt, Human
agagccugagaucuuccagca

SEQ ID NO: 230203 - RNA, 22 nt, Human
caggugguuugauaggauaacu

SEQ ID NO: 230204 - RNA, 22 nt, Human
auuccaaagcacaucagaacua

SEQ ID NO: 230205 - RNA, 22 nt, Human
aguaaaaauugaggugcaaaau

SEQ ID NO: 230206 - RNA, 22 nt, Human
aguguguucucaaugaaaagaa

SEQ ID NO: 230207 - RNA, 22 nt, Human
ucuuagcaaauuuucuuugccu

SEQ ID NO: 230208 - RNA, 22 nt, Human
ucucuagagcaugugcugggca

SEQ ID NO: 230209 - RNA, 22 nt, Human
cagguggcuucucugcagccuu

SEQ ID NO: 230210 - RNA, 22 nt, Human
ugaaggcuuggauuggucauuu

SEQ ID NO: 230211 - RNA, 22 nt, Human
ccugccagccagaucacucgcc

SEQ ID NO: 230212 - RNA, 22 nt, Human
cucugagcugaaacaugagcau

SEQ ID NO: 230213 - RNA, 22 nt, Human
uggcucagcgcggccuggucuu

SEQ ID NO: 230214 - RNA, 22 nt, Human
gcuggguccaugguccucgggu

SEQ ID NO: 230215 - RNA, 22 nt, Human
cauaaaauggcuuguucuuuaa

SEQ ID NO: 230216 - RNA, 22 nt, Human
aaaugacaauaaaaguccaugc

SEQ ID NO: 230217 - RNA, 22 nt, Human
uuagggaaggacagugaagaaa

SEQ ID NO: 230218 - RNA, 22 nt, Human
aaagccaggcuggccugggguu

SEQ ID NO: 230219 - RNA, 18 nt, Human
gcugcaggcgccugcggu

SEQ ID NO: 230220 - RNA, 22 nt, Human
gcauuacaggcuguaagaugca

SEQ ID NO: 230221 - RNA, 22 nt, Human
aaagugacaaccauuuauuaag

SEQ ID NO: 230222 - RNA, 22 nt, Human
uaggcuggggguaggaauugag

SEQ ID NO: 230223 - RNA, 21 nt, Human
gcugagacgcaaccucaguga

SEQ ID NO: 230224 - RNA, 18 nt, Human
uuucacagauucaugacu

SEQ ID NO: 230225 - RNA, 22 nt, Human
gcauauuaguaaucuuucaaca

SEQ ID NO: 230226 - RNA, 22 nt, Human
cauuugaaauucuuagaacaaa

SEQ ID NO: 230227 - RNA, 22 nt, Human
uuuccucugggcccugccaccc

SEQ ID NO: 230228 - RNA, 22 nt, Human
acuagaaccagaggaggcaggu

SEQ ID NO: 230229 - RNA, 22 nt, Human
aagaaucucucaagugugacaa

SEQ ID NO: 230230 - RNA, 23 nt, Human
gcagaggagcaagcuggacacca

SEQ ID NO: 230231 - RNA, 22 nt, Human
uucccacauucuuuacauucau

SEQ ID NO: 230232 - RNA, 22 nt, Human
uuagaacaccauucuauauuac

SEQ ID NO: 230233 - RNA, 22 nt, Human
aaggcuuguugucacgcucuug

SEQ ID NO: 230234 - RNA, 22 nt, Human
ggccagcagaccucagggacuc

SEQ ID NO: 230235 - RNA, 22 nt, Human
uauguacaccaaggauugaaaa

SEQ ID NO: 230236 - RNA, 22 nt, Human
gcugccugucccaggaugagga

SEQ ID NO: 230237 - RNA, 22 nt, Human
gguccaaggcucgguggcgggg

SEQ ID NO: 230238 - RNA, 22 nt, Human
gagcuuggccucuugaacgugg

SEQ ID NO: 230239 - RNA, 22 nt, Human
uagcugacagauacaaucagau

SEQ ID NO: 230240 - RNA, 22 nt, Human
agggcugacaaauggcagugac

SEQ ID NO: 230241 - RNA, 18 nt, Human
aagccaggucaagauaag

SEQ ID NO: 230242 - RNA, 22 nt, Human
uuuuuauacuuugcucaagauu

SEQ ID NO: 230243 - RNA, 22 nt, Human
uccauuuuucaugacuccucaa

SEQ ID NO: 230244 - RNA, 22 nt, Human
auggcugcagagaccugaagaa

SEQ ID NO: 230245 - RNA, 22 nt, Human
aagcacaucuccugugcagaac

SEQ ID NO: 230246 - RNA, 22 nt, Human
acauuguaaauaccuuuaucac

SEQ ID NO: 230247 - RNA, 22 nt, Human
uggcugaguguuccaaggagca

SEQ ID NO: 230248 - RNA, 22 nt, Human
uucuagaagugucuaugucugu

SEQ ID NO: 230249 - RNA, 18 nt, Human
uuucuuucugccuggggc

SEQ ID NO: 230250 - RNA, 22 nt, Human
uggugagauguauggaggguug

SEQ ID NO: 230251 - RNA, 22 nt, Human
ucugggcccuaaaccagcucua

SEQ ID NO: 230252 - RNA, 18 nt, Human
gaugaggcugucugagaa

SEQ ID NO: 230253 - RNA, 23 nt, Human
cagugugacgaggugaggcaggc

SEQ ID NO: 230254 - RNA, 22 nt, Human
uuagcuuucuuggagaauuaca

SEQ ID NO: 230255 - RNA, 22 nt, Human
cauuucuguucucuuccuguac

SEQ ID NO: 230256 - RNA, 22 nt, Human
cauuagggucucucagcugaau

SEQ ID NO: 230257 - RNA, 22 nt, Human
uguccucagauaugucuacucu

SEQ ID NO: 230258 - RNA, 22 nt, Human
cugagcagcaacccagagccuc

SEQ ID NO: 230259 - RNA, 22 nt, Human
ugagcuguguccugggggcagu

SEQ ID NO: 230260 - RNA, 23 nt, Human
acaugcaaaaaucacagucuccu

SEQ ID NO: 230261 - RNA, 22 nt, Human
uauguauucugaguacaaguuc

SEQ ID NO: 230262 - RNA, 22 nt, Human
uuucucuugcgauaugcuacac

SEQ ID NO: 230263 - RNA, 22 nt, Human
ucccagaggaaauggcagcuga

SEQ ID NO: 230264 - RNA, 22 nt, Human
uacagucaagcauaagaaguca

SEQ ID NO: 230265 - RNA, 23 nt, Human
uggcaaggaaugggauggagacu

SEQ ID NO: 230266 - RNA, 22 nt, Human
ucagaacaauuccuuuauaaca

SEQ ID NO: 230267 - RNA, 22 nt, Human
uacagguggaucacuaguauag

SEQ ID NO: 230268 - RNA, 22 nt, Human
cacuugaguucuuaauagucag

SEQ ID NO: 230269 - RNA, 22 nt, Human
aagaaauggaagauccauggug

SEQ ID NO: 230270 - RNA, 22 nt, Human
uagcuauuguugguaguuaccc

SEQ ID NO: 230271 - RNA, 22 nt, Human
gcuggccaguguggugaccacc

SEQ ID NO: 230272 - RNA, 22 nt, Human
uccuguuuaucugugugacucg

SEQ ID NO: 230273 - RNA, 22 nt, Human
gcagagccccauugcuggcggg

SEQ ID NO: 230274 - RNA, 22 nt, Human
gcuggugguuaccgugcuaaug

SEQ ID NO: 230275 - RNA, 22 nt, Human
agcugggcaaaaugugagguug

SEQ ID NO: 230276 - RNA, 22 nt, Human
ccucagcauccuggugaaguag

SEQ ID NO: 230277 - RNA, 22 nt, Human
cuggaguuagaguagacacuga

SEQ ID NO: 230278 - RNA, 22 nt, Human
auggcugcugccuuccccugcu

SEQ ID NO: 230279 - RNA, 22 nt, Human
ucuccagggugagcuaggccag

SEQ ID NO: 230280 - RNA, 22 nt, Human
ccaccagcuuugccacccugcu

SEQ ID NO: 230281 - RNA, 22 nt, Human
gcaggguggauggcagggccag

SEQ ID NO: 230282 - RNA, 22 nt, Human
acaggucuccagagugagagga

SEQ ID NO: 230283 - RNA, 22 nt, Human
aggcuguggcaucacaucagga

SEQ ID NO: 230284 - RNA, 22 nt, Human
acaaugcaauuguaaggugugu

SEQ ID NO: 230285 - RNA, 21 nt, Human
aaucauacaaaacaugucagg

SEQ ID NO: 230286 - RNA, 22 nt, Human
agugcauugcaucucugcuuca

SEQ ID NO: 230287 - RNA, 22 nt, Human
ucagaucuggugaaguuauagu

SEQ ID NO: 230288 - RNA, 22 nt, Human
ugcaugaacacaugugcaugua

SEQ ID NO: 230289 - RNA, 22 nt, Human
uagaaauguugguauuaacauu

SEQ ID NO: 230290 - RNA, 22 nt, Human
gcaucaagacgaugugaaaucg

SEQ ID NO: 230291 - RNA, 22 nt, Human
cagcccagagaaggggcccgug

SEQ ID NO: 230292 - RNA, 22 nt, Human
agaaucagugagcaguugugau

SEQ ID NO: 230293 - RNA, 22 nt, Human
uaccugcagcgggaauccauua

SEQ ID NO: 230294 - RNA, 22 nt, Human
uuaaauuuuagaaacagacucu

SEQ ID NO: 230295 - RNA, 22 nt, Human
aggcccauguucacuugcucag

SEQ ID NO: 230296 - RNA, 22 nt, Human
cacagcuuccauuagaaugaga

SEQ ID NO: 230297 - RNA, 22 nt, Human
gcaguguccaggguggucugca

SEQ ID NO: 230298 - RNA, 22 nt, Human
auuuuagagaaacaaacguagg

SEQ ID NO: 230299 - RNA, 22 nt, Human
agugccccaugggugccugggg

SEQ ID NO: 230300 - RNA, 22 nt, Human
acauauuuccaugcagcauguc

SEQ ID NO: 230301 - RNA, 22 nt, Human
ugaggggguuaauuaggagagu

SEQ ID NO: 230302 - RNA, 22 nt, Human
aguguccucaggcuuuguuccu

SEQ ID NO: 230303 - RNA, 22 nt, Human
augagcaguagguucauggcug

SEQ ID NO: 230304 - RNA, 22 nt, Human
ucucacugauuugagaccaagg

SEQ ID NO: 230305 - RNA, 22 nt, Human
ugcauauuuuauaaagauggaa

SEQ ID NO: 230306 - RNA, 22 nt, Human
gggcuaggcuuggccagcacug

SEQ ID NO: 230307 - RNA, 22 nt, Human
uaggcugggaagaaagauucuc

SEQ ID NO: 230308 - RNA, 18 nt, Human
gcagguguggagaagggg

SEQ ID NO: 230309 - RNA, 20 nt, Human
cagcaaaaugaaaauggauu

SEQ ID NO: 230310 - RNA, 22 nt, Human
aggaaaugcaggcaaauacucu

SEQ ID NO: 230311 - RNA, 18 nt, Human
ucagucuauuguauaaga

SEQ ID NO: 230312 - RNA, 22 nt, Human
gcugccuccacuggcucccagu

SEQ ID NO: 230313 - RNA, 22 nt, Human
cagggggcucaaaggagagugc

SEQ ID NO: 230314 - RNA, 22 nt, Human
uacugcaugguggaguggagcu

SEQ ID NO: 230315 - RNA, 22 nt, Human
ucacaaagggagggauagcugg

SEQ ID NO: 230316 - RNA, 22 nt, Human
agccugggcccugccucuucuc

SEQ ID NO: 230317 - RNA, 22 nt, Human
ucccagugcugcuaaagaggua

SEQ ID NO: 230318 - RNA, 22 nt, Human
uggguacuccuauuaguucagu

SEQ ID NO: 230319 - RNA, 22 nt, Human
agcuucuccugguacagaacug

SEQ ID NO: 230320 - RNA, 22 nt, Human
uuagcuuuuaagugugcuacau

SEQ ID NO: 230321 - RNA, 16 nt, Human
ucagggcagaauggca

SEQ ID NO: 230322 - RNA, 22 nt, Human
ggcuuuugaauuccaaggcauu

SEQ ID NO: 230323 - RNA, 22 nt, Human
aggaggccgggauucuggagau

SEQ ID NO: 230324 - RNA, 19 nt, Human
aucuuuggguccugaaggg

SEQ ID NO: 230325 - RNA, 18 nt, Human
gguggcuggggacggaca

SEQ ID NO: 230326 - RNA, 22 nt, Human
ucucagguggcccccaugagug

SEQ ID NO: 230327 - RNA, 22 nt, Human
aaugcacagcguuccaugcuug

SEQ ID NO: 230328 - RNA, 22 nt, Human
agugccagcuccacacagcagc

SEQ ID NO: 230329 - RNA, 23 nt, Human
ggcucacacggagugccuccacc

SEQ ID NO: 230330 - RNA, 22 nt, Human
augauacaucuucaugucagug

SEQ ID NO: 230331 - RNA, 22 nt, Human
uuguauuuuguuaugcuacugc

SEQ ID NO: 230332 - RNA, 20 nt, Human
ugagggcuaaccagacucug

SEQ ID NO: 230333 - RNA, 22 nt, Human
ucauuuguaccauuuuuuaaga

SEQ ID NO: 230334 - RNA, 16 nt, Human
uaugugucucaucuac

SEQ ID NO: 230335 - RNA, 23 nt, Human
ccuggggagcuguauccagagug

SEQ ID NO: 230336 - RNA, 22 nt, Human
aaggaaacagaggaugaccuug

SEQ ID NO: 230337 - RNA, 22 nt, Human
ucacucaauaucccaguggggc

SEQ ID NO: 230338 - RNA, 22 nt, Human
uggcuucuuuguagaaauugaa

SEQ ID NO: 230339 - RNA, 22 nt, Human
ucugguggugggccacaagcau

SEQ ID NO: 230340 - RNA, 22 nt, Human
uuucagaaaacuuaucaucagu

SEQ ID NO: 230341 - RNA, 22 nt, Human
uguuuuaagcucuagaagggga

SEQ ID NO: 230342 - RNA, 22 nt, Human
ugugacaagcauuguauauugg

SEQ ID NO: 230343 - RNA, 22 nt, Human
ucugugccuuuaagaagcucau

SEQ ID NO: 230344 - RNA, 20 nt, Human
ucaggcuggugggcuuuccc

SEQ ID NO: 230345 - RNA, 23 nt, Human
ucucagaaaggagaaguaauuug

SEQ ID NO: 230346 - RNA, 22 nt, Human
ccaggcagccugcuccauucug

SEQ ID NO: 230347 - RNA, 22 nt, Human
cagucuaagacucacgccaaga

SEQ ID NO: 230348 - RNA, 22 nt, Human
aaauacaguguguguucuuuga

SEQ ID NO: 230349 - RNA, 22 nt, Human
auaacagaguugggaagugaaa

SEQ ID NO: 230350 - RNA, 22 nt, Human
aaugugucuaugugguucacag

SEQ ID NO: 230351 - RNA, 18 nt, Human
gcugaaauucuaaacaaa

SEQ ID NO: 230352 - RNA, 22 nt, Human
auauuucaugggguuccauacu

SEQ ID NO: 230353 - RNA, 22 nt, Human
acauuucuuuucaucucuauau

SEQ ID NO: 230354 - RNA, 22 nt, Human
ccauucugaacaauucuugucu

SEQ ID NO: 230355 - RNA, 22 nt, Human
caaugugucaggaaaagggcca

SEQ ID NO: 230356 - RNA, 22 nt, Human
cgcaggugaaagaggcugggca

SEQ ID NO: 230357 - RNA, 22 nt, Human
gccacagcccgagcaccaugag

SEQ ID NO: 230358 - RNA, 22 nt, Human
uucacaguuugcugggacagga

SEQ ID NO: 230359 - RNA, 22 nt, Human
uacacuaauagccacacuaaug

SEQ ID NO: 230360 - RNA, 22 nt, Human
gcccaggaaauaaaagugggcu

SEQ ID NO: 230361 - RNA, 22 nt, Human
ugaggggcagagagguguccag

SEQ ID NO: 230362 - RNA, 23 nt, Human
ucuggaugccaccacauacuaac

SEQ ID NO: 230363 - RNA, 22 nt, Human
uccauauauauuagucuuccuu

SEQ ID NO: 230364 - RNA, 22 nt, Human
uccaggcugcaaggccacaggg

SEQ ID NO: 230365 - RNA, 22 nt, Human
ccuaggcuuguuuucaucagcu

SEQ ID NO: 230366 - RNA, 22 nt, Human
uaagaaacccaggaauuucuua

SEQ ID NO: 230367 - RNA, 22 nt, Human
ugagcccagagcccuuguaggg

SEQ ID NO: 230368 - RNA, 22 nt, Human
cagaaguuagacuucaacuaau

SEQ ID NO: 230369 - RNA, 22 nt, Human
uuuccuuugggagcaugaauuu

SEQ ID NO: 230370 - RNA, 21 nt, Human
auauuucagauuuccguaauc

SEQ ID NO: 230371 - RNA, 22 nt, Human
uuacagaguucgcaccuggugg

SEQ ID NO: 230372 - RNA, 22 nt, Human
augcagagcuuccaguggccug

SEQ ID NO: 230373 - RNA, 22 nt, Human
gcuuuagacauaaaguucuuca

SEQ ID NO: 230374 - RNA, 22 nt, Human
ggaaaaggccauuguuucucug

SEQ ID NO: 230375 - RNA, 20 nt, Human
cugugcuccggguuccugga

SEQ ID NO: 230376 - RNA, 22 nt, Human
cagaagugauguugagcuaguc

SEQ ID NO: 230377 - RNA, 22 nt, Human
uccaggcaguuuuccagguugu

SEQ ID NO: 230378 - RNA, 22 nt, Human
gccaggaaagggaauucccuga

SEQ ID NO: 230379 - RNA, 21 nt, Human
uucaaugaaaacaaagugagg

SEQ ID NO: 230380 - RNA, 22 nt, Human
uuccacagccaucacuguugcu

SEQ ID NO: 230381 - RNA, 22 nt, Human
uccaggcaugucugaguccuuc

SEQ ID NO: 230382 - RNA, 22 nt, Human
gcuucucuggcuggucugccac

SEQ ID NO: 230383 - RNA, 22 nt, Human
auacaaaaauuagccgggagua

SEQ ID NO: 230384 - RNA, 22 nt, Human
aagcacauuuggaaaacaugga

SEQ ID NO: 230385 - RNA, 22 nt, Human
cagggggcagcguagaaaauga

SEQ ID NO: 230386 - RNA, 22 nt, Human
cucuguggaagaagaaagaagg

SEQ ID NO: 230387 - RNA, 22 nt, Human
aucuccagaugccuggaaauga

SEQ ID NO: 230388 - RNA, 23 nt, Human
uggcucuguggaucccucaggag

SEQ ID NO: 230389 - RNA, 20 nt, Human
aagauucauuguaauuaggg

SEQ ID NO: 230390 - RNA, 22 nt, Human
ccuucuccccucugcagggugu

SEQ ID NO: 230391 - RNA, 22 nt, Human
acauuucagauucaugaaguga

SEQ ID NO: 230392 - RNA, 22 nt, Human
cauaggaagccaucucagucac

SEQ ID NO: 230393 - RNA, 22 nt, Human
aggcuguggugaugauuggguc

SEQ ID NO: 230394 - RNA, 22 nt, Human
augacauaagugaaaaacauca

SEQ ID NO: 230395 - RNA, 22 nt, Human
uuucacaugcagcagggaagug

SEQ ID NO: 230396 - RNA, 22 nt, Human
aucagucuguuggaauaucgcu

SEQ ID NO: 230397 - RNA, 22 nt, Human
cuggcuuucucugugguguuca

SEQ ID NO: 230398 - RNA, 22 nt, Human
cucugcaaucugagcacuugua

SEQ ID NO: 230399 - RNA, 22 nt, Human
caggaagaggacaggcuucccc

SEQ ID NO: 230400 - RNA, 22 nt, Human
uacuguuagagcgauuuguccu

SEQ ID NO: 230401 - RNA, 22 nt, Human
aauuagagaucaguucuuugac

SEQ ID NO: 230402 - RNA, 22 nt, Human
ggagggugcauuuuacccugug

SEQ ID NO: 230403 - RNA, 22 nt, Human
ucacaggcuggucuccgaggac

SEQ ID NO: 230404 - RNA, 22 nt, Human
acuggcagugucguuuacauga

SEQ ID NO: 230405 - RNA, 22 nt, Human
aaagggagcauggcugcaggga

SEQ ID NO: 230406 - RNA, 22 nt, Human
acuuagcagguacuuucauauu

SEQ ID NO: 230407 - RNA, 22 nt, Human
cugagaggaugcugcaguggag

SEQ ID NO: 230408 - RNA, 22 nt, Human
agcaggugguaggcagucagca

SEQ ID NO: 230409 - RNA, 22 nt, Human
acuuccagugucugcugcuagc

SEQ ID NO: 230410 - RNA, 22 nt, Human
uuuaagacucuuguaguacaca

SEQ ID NO: 230411 - RNA, 22 nt, Human
gagcacaguaaagcagugucac

SEQ ID NO: 230412 - RNA, 22 nt, Human
gcaccugggcaaggauucagag

SEQ ID NO: 230413 - RNA, 22 nt, Human
gcugcagcaagcccuccagggg

SEQ ID NO: 230414 - RNA, 22 nt, Human
augggaagugaagucagggagg

SEQ ID NO: 230415 - RNA, 22 nt, Human
gggcugaccccaccccucacuc

SEQ ID NO: 230416 - RNA, 22 nt, Human
cagguggucaggcaaggacacg

SEQ ID NO: 230417 - RNA, 22 nt, Human
guagaaaauuaggaugaggcuu

SEQ ID NO: 230418 - RNA, 22 nt, Human
auuaaacaauguaaaguucuug

SEQ ID NO: 230419 - RNA, 22 nt, Human
gaacauaugcauguuuguuuug

SEQ ID NO: 230420 - RNA, 22 nt, Human
ucaggcucuggguacaccugac

SEQ ID NO: 230421 - RNA, 22 nt, Human
uuuccauguguacuggccagaa

SEQ ID NO: 230422 - RNA, 22 nt, Human
uuaaaagaccuguugagguuag

SEQ ID NO: 230423 - RNA, 22 nt, Human
guguccugggucucugauucuu

SEQ ID NO: 230424 - RNA, 22 nt, Human
aucauuacuccuguaaaauugu

SEQ ID NO: 230425 - RNA, 22 nt, Human
agcaguuacgggccuaucuagg

SEQ ID NO: 230426 - RNA, 22 nt, Human
aguuaaauguguuagccagggu

SEQ ID NO: 230427 - RNA, 22 nt, Human
cgugauuucuggcuuucuauau

SEQ ID NO: 230428 - RNA, 22 nt, Human
uauacagucuuuugcuauauuc

SEQ ID NO: 230429 - RNA, 22 nt, Human
aucuccaguccugguuuccugg

SEQ ID NO: 230430 - RNA, 17 nt, Human
uuagagcuacauguuga

SEQ ID NO: 230431 - RNA, 22 nt, Human
uggucccuagcacagcuguccu

SEQ ID NO: 230432 - RNA, 22 nt, Human
uguuauucucugccuacaaguc

SEQ ID NO: 230433 - RNA, 22 nt, Human
cugcagagggguugaagggucc

SEQ ID NO: 230434 - RNA, 22 nt, Human
cugagccaugggucuaagcacu

SEQ ID NO: 230435 - RNA, 22 nt, Human
gcuaaugauagcaagauaaaca

SEQ ID NO: 230436 - RNA, 22 nt, Human
acuuucuuaggcuguauaaaug

SEQ ID NO: 230437 - RNA, 22 nt, Human
guaggucuucugaaaaccaaaa

SEQ ID NO: 230438 - RNA, 18 nt, Human
agcccaggcaucgucugc

SEQ ID NO: 230439 - RNA, 22 nt, Human
uuagaaauacaagugagguuga

SEQ ID NO: 230440 - RNA, 22 nt, Human
uaggaaaauaucucuuauuggg

SEQ ID NO: 230441 - RNA, 22 nt, Human
uggcacaguccugggugccugc

SEQ ID NO: 230442 - RNA, 22 nt, Human
acaacaaaaugaggaagugguc

SEQ ID NO: 230443 - RNA, 22 nt, Human
agcaggugucacuuucacucca

SEQ ID NO: 230444 - RNA, 22 nt, Human
cacugugguuauuaucacuguu

SEQ ID NO: 230445 - RNA, 22 nt, Human
cuuuacaauucaagggaacucu

SEQ ID NO: 230446 - RNA, 22 nt, Human
ucugucauccaggcuggaauau

SEQ ID NO: 230447 - RNA, 22 nt, Human
uuccaugccuagaacaggauuc

SEQ ID NO: 230448 - RNA, 22 nt, Human
gaagcacauggcuauagcuauu

SEQ ID NO: 230449 - RNA, 21 nt, Human
cagcuccacuaaagcagcugu

SEQ ID NO: 230450 - RNA, 22 nt, Human
cccuguuuuaaguugauauuga

SEQ ID NO: 230451 - RNA, 22 nt, Human
agcuguguuauuagaaaccugc

SEQ ID NO: 230452 - RNA, 22 nt, Human
ggugacagcgggucaagaggag

SEQ ID NO: 230453 - RNA, 22 nt, Human
aaugauaccaaacauguagaua

SEQ ID NO: 230454 - RNA, 22 nt, Human
uggauucuaaugcacuucaaau

SEQ ID NO: 230455 - RNA, 22 nt, Human
acaugagaucacaaagauaaau

SEQ ID NO: 230456 - RNA, 22 nt, Human
ccucuggcuuacuguuggguuu

SEQ ID NO: 230457 - RNA, 22 nt, Human
acauuuaaccaaacuguuuaau

SEQ ID NO: 230458 - RNA, 22 nt, Human
aagcccuguaaauugcccuuaa

SEQ ID NO: 230459 - RNA, 19 nt, Human
gcugcuggcucuggcugga

SEQ ID NO: 230460 - RNA, 22 nt, Human
aggcucuccuccccaggaccau

SEQ ID NO: 230461 - RNA, 22 nt, Human
uaauuagagucacaaguaacca

SEQ ID NO: 230462 - RNA, 22 nt, Human
ugacauucuguuaagucucaua

SEQ ID NO: 230463 - RNA, 22 nt, Human
uuuucuuauggugaagcacaaa

SEQ ID NO: 230464 - RNA, 19 nt, Human
ugccucagggcuuugagga

SEQ ID NO: 230465 - RNA, 22 nt, Human
cugaauuaauacacagaauggc

SEQ ID NO: 230466 - RNA, 22 nt, Human
cugguuuaugagggaagggaug

SEQ ID NO: 230467 - RNA, 21 nt, Human
ccuggcugcacaguugcuggu

SEQ ID NO: 230468 - RNA, 22 nt, Human
aagcacagugccaaguucuauu

SEQ ID NO: 230469 - RNA, 22 nt, Human
ggucccaggauugguugcgcag

SEQ ID NO: 230470 - RNA, 23 nt, Human
cauuucuagguguguuuggccau

SEQ ID NO: 230471 - RNA, 22 nt, Human
aaggcugaccaguuuacacuuu

SEQ ID NO: 230472 - RNA, 22 nt, Human
agagaggcauucggugauccca

SEQ ID NO: 230473 - RNA, 22 nt, Human
cucucaaaugucauuccucuau

SEQ ID NO: 230474 - RNA, 22 nt, Human
uccaggcuggaaaugucaaacu

SEQ ID NO: 230475 - RNA, 22 nt, Human
uaacacuguaaaccuagauguu

SEQ ID NO: 230476 - RNA, 22 nt, Human
uaacuguauuuuucugagauuc

SEQ ID NO: 230477 - RNA, 22 nt, Human
cagggagcagcgcuggggccuc

SEQ ID NO: 230478 - RNA, 23 nt, Human
ucugcuggugacacggucacauu

SEQ ID NO: 230479 - RNA, 20 nt, Human
auagacaaagacaugccaga

SEQ ID NO: 230480 - RNA, 22 nt, Human
cucugaagguuucuguuacugu

SEQ ID NO: 230481 - RNA, 22 nt, Human
ucccagccuuccagucugguuu

SEQ ID NO: 230482 - RNA, 22 nt, Human
ucucaggccccugaguuucucu

SEQ ID NO: 230483 - RNA, 22 nt, Human
gucugguccucuucacaguggc

SEQ ID NO: 230484 - RNA, 22 nt, Human
aggcagaagccagccagggucc

SEQ ID NO: 230485 - RNA, 22 nt, Human
ucccuucuggcagcagugugag

SEQ ID NO: 230486 - RNA, 22 nt, Human
acagccugcagccccaggucgc

SEQ ID NO: 230487 - RNA, 22 nt, Human
agagcuggacgucugagcccua

SEQ ID NO: 230488 - RNA, 22 nt, Human
augccuggacugacaugcacug

SEQ ID NO: 230489 - RNA, 22 nt, Human
gaggagcugcagggggagucua

SEQ ID NO: 230490 - RNA, 22 nt, Human
ggucacaugcggggcuguagcc

SEQ ID NO: 230491 - RNA, 22 nt, Human
cacaggagagcugggaggugcc

SEQ ID NO: 230492 - RNA, 22 nt, Human
caauguaucaaccagaaaguuc

SEQ ID NO: 230493 - RNA, 20 nt, Human
gccacugugcuuacacugcu

SEQ ID NO: 230494 - RNA, 22 nt, Human
uucuccagacacaaaaucuaag

SEQ ID NO: 230495 - RNA, 22 nt, Human
gaauaauugugaugcuugaagu

SEQ ID NO: 230496 - RNA, 22 nt, Human
ccacaucugguggccagugcua

SEQ ID NO: 230497 - RNA, 22 nt, Human
uucaacuagauuuauacaauuc

SEQ ID NO: 230498 - RNA, 22 nt, Human
agcucccagcuccuuugagaga

SEQ ID NO: 230499 - RNA, 22 nt, Human
auuauucaauguuauuucagug

SEQ ID NO: 230500 - RNA, 19 nt, Human
ucuucccuggcugucaguc

SEQ ID NO: 230501 - RNA, 22 nt, Human
ugggaggaagugcuaaugggag

SEQ ID NO: 230502 - RNA, 22 nt, Human
acucagaggaaaguugagauug

SEQ ID NO: 230503 - RNA, 22 nt, Human
uuucucugcagagccccaagga

SEQ ID NO: 230504 - RNA, 18 nt, Human
caaauagcaugauguccu

SEQ ID NO: 230505 - RNA, 20 nt, Human
uccagggcuagggagcucau

SEQ ID NO: 230506 - RNA, 22 nt, Human
uggggaugaaacccaggcaucu

SEQ ID NO: 230507 - RNA, 22 nt, Human
ugggccagaggcauggagcuau

SEQ ID NO: 230508 - RNA, 22 nt, Human
uauuuugagguauuuuugagcu

SEQ ID NO: 230509 - RNA, 22 nt, Human
ucucaggcuaccuugcacaagg

SEQ ID NO: 230510 - RNA, 22 nt, Human
ucagagaaaugcugagcucaug

SEQ ID NO: 230511 - RNA, 22 nt, Human
caggaccuggaaugcuugugaa

SEQ ID NO: 230512 - RNA, 22 nt, Human
auuaauauacacuguuagcaug

SEQ ID NO: 230513 - RNA, 22 nt, Human
gaagggugcauggagggaaguc

SEQ ID NO: 230514 - RNA, 22 nt, Human
guuacucuugagaggcugaggu

SEQ ID NO: 230515 - RNA, 20 nt, Human
auguaaaagacagggaguag

SEQ ID NO: 230516 - RNA, 22 nt, Human
gaggggcagugcacccgggccc

SEQ ID NO: 230517 - RNA, 20 nt, Human
gcauccagacacccagcugc

SEQ ID NO: 230518 - RNA, 22 nt, Human
acauaucuuucccucuccugaa

SEQ ID NO: 230519 - RNA, 22 nt, Human
acuguacuguguauuguagaau

SEQ ID NO: 230520 - RNA, 22 nt, Human
uucuguauuucaaugucuuuau

SEQ ID NO: 230521 - RNA, 22 nt, Human
cugggccuugcaucccagagcc

SEQ ID NO: 230522 - RNA, 22 nt, Human
aauuuuguuuaagugaucugcu

SEQ ID NO: 230523 - RNA, 22 nt, Human
ucagacagcuugcagggaggug

SEQ ID NO: 230524 - RNA, 23 nt, Human
cuggggcucauugcaguagccau

SEQ ID NO: 230525 - RNA, 22 nt, Human
ggggaggaguguacagguuuau

SEQ ID NO: 230526 - RNA, 22 nt, Human
gcagaguuggagccagcccagg

SEQ ID NO: 230527 - RNA, 22 nt, Human
uucugggcauguuacauucugu

SEQ ID NO: 230528 - RNA, 22 nt, Human
acuugccuguuacauuucuagu

SEQ ID NO: 230529 - RNA, 23 nt, Human
uuguauuuuuaguagagacaggg

SEQ ID NO: 230530 - RNA, 22 nt, Human
uccagaggggcagcccugugcu

SEQ ID NO: 230531 - RNA, 23 nt, Human
cccaggcuacaaauuaugcucug

SEQ ID NO: 230532 - RNA, 22 nt, Human
cauuuguaguaucuguuuauau

SEQ ID NO: 230533 - RNA, 22 nt, Human
caggcacagugggguccucucu

SEQ ID NO: 230534 - RNA, 22 nt, Human
ggacauuuaguuucauugggca

SEQ ID NO: 230535 - RNA, 22 nt, Human
uauuuauaaucugccaaagaga

SEQ ID NO: 230536 - RNA, 22 nt, Human
acaaagcuuagaccuaagagau

SEQ ID NO: 230537 - RNA, 18 nt, Human
agcaggugcuguuucuuu

SEQ ID NO: 230538 - RNA, 22 nt, Human
ccuuuagaaagucaguaguugc

SEQ ID NO: 230539 - RNA, 22 nt, Human
ccagaggugagggggauucuug

SEQ ID NO: 230540 - RNA, 22 nt, Human
uagaucaggcugcuuagauaga

SEQ ID NO: 230541 - RNA, 22 nt, Human
agugucaguugccuugucauaa

SEQ ID NO: 230542 - RNA, 22 nt, Human
ugggucagaaucagagaguugc

SEQ ID NO: 230543 - RNA, 22 nt, Human
uuugacucaguggacguacuag

SEQ ID NO: 230544 - RNA, 22 nt, Human
accuccccauuaggucacccac

SEQ ID NO: 230545 - RNA, 22 nt, Human
uugaggcacacacagguugcau

SEQ ID NO: 230546 - RNA, 22 nt, Human
agguccagagguugaacggugg

SEQ ID NO: 230547 - RNA, 22 nt, Human
cucccuggaggugagcuggcac

SEQ ID NO: 230548 - RNA, 22 nt, Human
acaguguuuauguacagauugu

SEQ ID NO: 230549 - RNA, 22 nt, Human
ugagugaggcugggcagucccu

SEQ ID NO: 230550 - RNA, 22 nt, Human
caguccaggccuggaggagcca

SEQ ID NO: 230551 - RNA, 22 nt, Human
accaggagggacccugguggcc

SEQ ID NO: 230552 - RNA, 22 nt, Human
cugggcucuguguuucaguuuc

SEQ ID NO: 230553 - RNA, 22 nt, Human
uuggaaacuuucaagcauaaug

SEQ ID NO: 230554 - RNA, 22 nt, Human
agaaaugucaggaaagaagucc

SEQ ID NO: 230555 - RNA, 22 nt, Human
auaugagaauuggaaaauauca

SEQ ID NO: 230556 - RNA, 22 nt, Human
aguacuuuagcauaaagcaguu

SEQ ID NO: 230557 - RNA, 22 nt, Human
cagggagcaggcucuguccauc

SEQ ID NO: 230558 - RNA, 21 nt, Human
acagaugggaugagcacacug

SEQ ID NO: 230559 - RNA, 19 nt, Human
agcuguggggccuagcacc

SEQ ID NO: 230560 - RNA, 22 nt, Human
uuaguugacccccaguccuggc

SEQ ID NO: 230561 - RNA, 22 nt, Human
cugaggcaugaaugugggcuuu

SEQ ID NO: 230562 - RNA, 22 nt, Human
aagaaauuaaggaaugcaacga

SEQ ID NO: 230563 - RNA, 22 nt, Human
auugcugaaaguauuuuaugac

SEQ ID NO: 230564 - RNA, 22 nt, Human
agcacuuuagaauuuagaguug

SEQ ID NO: 230565 - RNA, 22 nt, Human
uuugacaucuaagaauucuuac

SEQ ID NO: 230566 - RNA, 22 nt, Human
aaaaaccuuucauugcaaaugu

SEQ ID NO: 230567 - RNA, 22 nt, Human
ggagucuggaguggggcccaag

SEQ ID NO: 230568 - RNA, 22 nt, Human
uggcacagggcuuggucgcuca

SEQ ID NO: 230569 - RNA, 22 nt, Human
uuuacaguuccaugugauaggc

SEQ ID NO: 230570 - RNA, 20 nt, Human
ggcaggcuuuauauggaggg

SEQ ID NO: 230571 - RNA, 22 nt, Human
gagcagugacuggagcaugaga

SEQ ID NO: 230572 - RNA, 22 nt, Human
uucugucaaauuugccauaugg

SEQ ID NO: 230573 - RNA, 22 nt, Human
cagaaucuguugggguugcaga

SEQ ID NO: 230574 - RNA, 22 nt, Human
ggaggaaaugaaaggaggguuu

SEQ ID NO: 230575 - RNA, 22 nt, Human
auggcuggauuugauccauggg

SEQ ID NO: 230576 - RNA, 22 nt, Human
gugugucccuccucuccugagu

SEQ ID NO: 230577 - RNA, 22 nt, Human
gacugagguauuaagauggcuu

SEQ ID NO: 230578 - RNA, 22 nt, Human
ucucaguguuguucugcagaug

SEQ ID NO: 230579 - RNA, 22 nt, Human
guacaaaugagaguucuguuuu

SEQ ID NO: 230580 - RNA, 22 nt, Human
ccucucaguauugaacuuuaua

SEQ ID NO: 230581 - RNA, 22 nt, Human
accaguuuauagcgaucuguca

SEQ ID NO: 230582 - RNA, 22 nt, Human
uccacagugguugaacuaguaa

SEQ ID NO: 230583 - RNA, 22 nt, Human
cagcaagaaucagacaaccuca

SEQ ID NO: 230584 - RNA, 22 nt, Human
aaagcagugcaccuuaauugau

SEQ ID NO: 230585 - RNA, 22 nt, Human
guucucuggagucccugggccc

SEQ ID NO: 230586 - RNA, 23 nt, Human
cagucucuccccggacagcaaaa

SEQ ID NO: 230587 - RNA, 22 nt, Human
uccugaggacuaacaggaagga

SEQ ID NO: 230588 - RNA, 22 nt, Human
cucccagauuccugcuguggga

SEQ ID NO: 230589 - RNA, 22 nt, Human
uccagguaauuuggaugcuagu

SEQ ID NO: 230590 - RNA, 22 nt, Human
aaugagaucagagauaacucaa

SEQ ID NO: 230591 - RNA, 22 nt, Human
aguuauuucaguaacauaauag

SEQ ID NO: 230592 - RNA, 17 nt, Human
agcagcuggcacaggag

SEQ ID NO: 230593 - RNA, 22 nt, Human
gaauagcuuccuuuuuuccaaa

SEQ ID NO: 230594 - RNA, 22 nt, Human
ucugaaauaagggagaagggaa

SEQ ID NO: 230595 - RNA, 22 nt, Human
cugcccugagggccuguguguu

SEQ ID NO: 230596 - RNA, 23 nt, Human
cugugggaagucggggagcgcgc

SEQ ID NO: 230597 - RNA, 22 nt, Human
ggaggggaacuaaucccgugac

SEQ ID NO: 230598 - RNA, 22 nt, Human
ggacuggguaggagcccagggc

SEQ ID NO: 230599 - RNA, 22 nt, Human
cuauguuuaucuguauuucugu

SEQ ID NO: 230600 - RNA, 22 nt, Human
ugauuacaguauuugagaucca

SEQ ID NO: 230601 - RNA, 17 nt, Human
cguggcugagccauaga

SEQ ID NO: 230602 - RNA, 22 nt, Human
uccugggaguggccauguaaug

SEQ ID NO: 230603 - RNA, 22 nt, Human
uccugguaggcuaugucauguc

SEQ ID NO: 230604 - RNA, 20 nt, Human
cugcuuccaggcucaccccc

SEQ ID NO: 230605 - RNA, 22 nt, Human
uucuggcuccagaugcuucugu

SEQ ID NO: 230606 - RNA, 22 nt, Human
acuguaacacucauacugaagu

SEQ ID NO: 230607 - RNA, 22 nt, Human
aggcuccuggguguggccgcca

SEQ ID NO: 230608 - RNA, 22 nt, Human
cuggauuuugaugagcaguuuu

SEQ ID NO: 230609 - RNA, 22 nt, Human
caggaagggggauccuuggaag

SEQ ID NO: 230610 - RNA, 22 nt, Human
ucagccugcuccaagugcugcc

SEQ ID NO: 230611 - RNA, 22 nt, Human
caucccugucugccacucugaa

SEQ ID NO: 230612 - RNA, 22 nt, Human
uuauuguuuaaagccauguaaa

SEQ ID NO: 230613 - RNA, 22 nt, Human
cauugcaggagaguaaauaaaa

SEQ ID NO: 230614 - RNA, 22 nt, Human
gcauucaggaaccggaagggua

SEQ ID NO: 230615 - RNA, 22 nt, Human
uuguccugugauuucagggccu

SEQ ID NO: 230616 - RNA, 22 nt, Human
aagcucagcagccaggcccugu

SEQ ID NO: 230617 - RNA, 22 nt, Human
ucaugcugaggaugcugugaag

SEQ ID NO: 230618 - RNA, 22 nt, Human
aagggcuggucuagaaagggag

SEQ ID NO: 230619 - RNA, 17 nt, Human
cccguucucuucgcugg

SEQ ID NO: 230620 - RNA, 19 nt, Human
cccucaggucugagcaguc

SEQ ID NO: 230621 - RNA, 22 nt, Human
cucuccaggagagcacuuugag

SEQ ID NO: 230622 - RNA, 22 nt, Human
ccaaaugcuccacugacuuugg

SEQ ID NO: 230623 - RNA, 22 nt, Human
ugguccuucuugaagagugagu

SEQ ID NO: 230624 - RNA, 22 nt, Human
aaaacuccugaaauuguuuccc

SEQ ID NO: 230625 - RNA, 22 nt, Human
aucuuuggucuugagugcaucu

SEQ ID NO: 230626 - RNA, 22 nt, Human
ugaggcucagugagcccugcag

SEQ ID NO: 230627 - RNA, 22 nt, Human
uagaguccauuaaugcaaguuu

SEQ ID NO: 230628 - RNA, 22 nt, Human
gcacauuguuacucuuacugug

SEQ ID NO: 230629 - RNA, 22 nt, Human
ucauaaauuagcugucuuugaa

SEQ ID NO: 230630 - RNA, 22 nt, Human
ucacagugaggaguuacaguuu

SEQ ID NO: 230631 - RNA, 22 nt, Human
ugcaggugugugcaagggaggg

SEQ ID NO: 230632 - RNA, 22 nt, Human
cauucccaugacuccugcucag

SEQ ID NO: 230633 - RNA, 22 nt, Human
acccuuuguccaauagaaauga

SEQ ID NO: 230634 - RNA, 22 nt, Human
agaggcugugcagagggagugc

SEQ ID NO: 230635 - RNA, 22 nt, Human
uuuucuauuaacucauuuugca

SEQ ID NO: 230636 - RNA, 22 nt, Human
ucaggaagggcucagucugugc

SEQ ID NO: 230637 - RNA, 22 nt, Human
acugggccuugugugucucauc

SEQ ID NO: 230638 - RNA, 22 nt, Human
agcccugucucucacuccaggu

SEQ ID NO: 230639 - RNA, 22 nt, Human
uaggaaagaaaugaguagugau

SEQ ID NO: 230640 - RNA, 22 nt, Human
uacauugcuuucuaauacaucu

SEQ ID NO: 230641 - RNA, 21 nt, Human
cugucgcaggucgccccaccc

SEQ ID NO: 230642 - RNA, 22 nt, Human
auuuuaucugcuuacuuucagg

SEQ ID NO: 230643 - RNA, 22 nt, Human
aaaugucagaaaacauggagug

SEQ ID NO: 230644 - RNA, 23 nt, Human
acacguguguguacauagauagu

SEQ ID NO: 230645 - RNA, 22 nt, Human
ccagugcuucuuugcuagcugg

SEQ ID NO: 230646 - RNA, 22 nt, Human
gauauuuuuaggugaugcaggc

SEQ ID NO: 230647 - RNA, 19 nt, Human
ccagcagacacagcugccc

SEQ ID NO: 230648 - RNA, 22 nt, Human
augaugaaauuuucuaucaugu

SEQ ID NO: 230649 - RNA, 21 nt, Human
cagacccucuagaggccaccu

SEQ ID NO: 230650 - RNA, 22 nt, Human
aaggugguugcaauuaccauaa

SEQ ID NO: 230651 - RNA, 22 nt, Human
aggaccagaccgaacuagcuaa

SEQ ID NO: 230652 - RNA, 19 nt, Human
gggcuccuugggccucucu

SEQ ID NO: 230653 - RNA, 22 nt, Human
ggcagugcaaggcagccuggau

SEQ ID NO: 230654 - RNA, 22 nt, Human
auuuggaaaaucugguuauaga

SEQ ID NO: 230655 - RNA, 22 nt, Human
aguuagaauauaauuauguuaa

SEQ ID NO: 230656 - RNA, 18 nt, Human
uuggcuuugagaacuggu

SEQ ID NO: 230657 - RNA, 22 nt, Human
uguuuagacucaaaauugaaag

SEQ ID NO: 230658 - RNA, 22 nt, Human
cacagcugccauggcugcacuu

SEQ ID NO: 230659 - RNA, 22 nt, Human
uggcacagaccuuaucuucucu

SEQ ID NO: 230660 - RNA, 22 nt, Human
cuguguccauuuaucauuguca

SEQ ID NO: 230661 - RNA, 22 nt, Human
ugucauuuaauagauaugaugg

SEQ ID NO: 230662 - RNA, 22 nt, Human
gguggcagagacauaggacaua

SEQ ID NO: 230663 - RNA, 22 nt, Human
aacuguugucauauggucuuaa

SEQ ID NO: 230664 - RNA, 22 nt, Human
cugguuggugccacaugguggc

SEQ ID NO: 230665 - RNA, 23 nt, Human
cuggcuccgaagacuccaggauc

SEQ ID NO: 230666 - RNA, 20 nt, Human
cugaggggucugacuuggac

SEQ ID NO: 230667 - RNA, 22 nt, Human
ucuuuagugacaguugugcaag

SEQ ID NO: 230668 - RNA, 22 nt, Human
uggcacuggaaucguagccuug

SEQ ID NO: 230669 - RNA, 22 nt, Human
gucaucuucgcagagugauuuu

SEQ ID NO: 230670 - RNA, 20 nt, Human
ucugcucagcccucaguggc

SEQ ID NO: 230671 - RNA, 22 nt, Human
uacaaacuuguuuuaaguaagu

SEQ ID NO: 230672 - RNA, 22 nt, Human
agagcugggacuuggacucaau

SEQ ID NO: 230673 - RNA, 22 nt, Human
cgcugggugcagugauuggcau

SEQ ID NO: 230674 - RNA, 19 nt, Human
uuccugggguuccauugug

SEQ ID NO: 230675 - RNA, 22 nt, Human
ucagugucuugaccugggugug

SEQ ID NO: 230676 - RNA, 22 nt, Human
ugugaauagugccgcaauaaac

SEQ ID NO: 230677 - RNA, 22 nt, Human
uuucaguucaguuuauuauauc

SEQ ID NO: 230678 - RNA, 22 nt, Human
uuccuggcucucuguugcacag

SEQ ID NO: 230679 - RNA, 22 nt, Human
ugggcucuagacuuuagugugg

SEQ ID NO: 230680 - RNA, 22 nt, Human
ccugugugcugaugacgacaga

SEQ ID NO: 230681 - RNA, 22 nt, Human
cugggaggcagucucucuagaa

SEQ ID NO: 230682 - RNA, 21 nt, Human
uuuucuggaguaugucuccuc

SEQ ID NO: 230683 - RNA, 22 nt, Human
cuggugccauucuguggccuag

SEQ ID NO: 230684 - RNA, 22 nt, Human
cagcuucuggcguggagccuga

SEQ ID NO: 230685 - RNA, 22 nt, Human
ucuaaagauuuggauucauuug

SEQ ID NO: 230686 - RNA, 22 nt, Human
ugguaccaugacaaaugucagg

SEQ ID NO: 230687 - RNA, 22 nt, Human
gcccagcacuaaaagcuuugcu

SEQ ID NO: 230688 - RNA, 22 nt, Human
cuuuggaauaaucaagcucuga

SEQ ID NO: 230689 - RNA, 22 nt, Human
uggaaccuggcauuagggacac

SEQ ID NO: 230690 - RNA, 22 nt, Human
acagugcaggucucaacaauua

SEQ ID NO: 230691 - RNA, 22 nt, Human
uaggccacaaauaagauccugu

SEQ ID NO: 230692 - RNA, 22 nt, Human
acacuguagcugagggcaugcg

SEQ ID NO: 230693 - RNA, 22 nt, Human
ccccaccagcacccucucuauc

SEQ ID NO: 230694 - RNA, 22 nt, Human
aguggcuggacgacaaggguga

SEQ ID NO: 230695 - RNA, 22 nt, Human
cuuucccugcuuagaaggauuu

SEQ ID NO: 230696 - RNA, 17 nt, Human
aggcaugaggcaucacu

SEQ ID NO: 230697 - RNA, 22 nt, Human
cugccucuguugggcauggucu

SEQ ID NO: 230698 - RNA, 22 nt, Human
uuaggagaugguccucuaggga

SEQ ID NO: 230699 - RNA, 22 nt, Human
ugaaugaugcaguauaaugaua

SEQ ID NO: 230700 - RNA, 22 nt, Human
ucaucaaagcgcuuggaguagg

SEQ ID NO: 230701 - RNA, 22 nt, Human
gggccugcuccccaucgcugcu

SEQ ID NO: 230702 - RNA, 22 nt, Human
cuucauuggcuuccauagaugc

SEQ ID NO: 230703 - RNA, 22 nt, Human
ggguuccaaugaugagcaagag

SEQ ID NO: 230704 - RNA, 23 nt, Human
gccuggguuguaacuagugcauc

SEQ ID NO: 230705 - RNA, 22 nt, Human
cauuagaaaagcagcugggacc

SEQ ID NO: 230706 - RNA, 22 nt, Human
uccaggcccacucagcugaaau

SEQ ID NO: 230707 - RNA, 22 nt, Human
uugaggaguagaagcuuugaau

SEQ ID NO: 230708 - RNA, 22 nt, Human
ggaagagccuggggugucaggc

SEQ ID NO: 230709 - RNA, 22 nt, Human
ucacaaaagcuuuugaauuugg

SEQ ID NO: 230710 - RNA, 22 nt, Human
uugcaaauugcaagaguuggau

SEQ ID NO: 230711 - RNA, 22 nt, Human
aacagcagguccuggcaugggu

SEQ ID NO: 230712 - RNA, 22 nt, Human
ugagcagaagcccuccuggacu

SEQ ID NO: 230713 - RNA, 22 nt, Human
gggcuucuacuugcaaaggaua

SEQ ID NO: 230714 - RNA, 22 nt, Human
gccuggcuuuugccucauguuc

SEQ ID NO: 230715 - RNA, 22 nt, Human
gggacagaggcaaacuagcaga

SEQ ID NO: 230716 - RNA, 22 nt, Human
ugcuuuaucugugagaaccuga

SEQ ID NO: 230717 - RNA, 22 nt, Human
ggcucagggaaugaggaagaau

SEQ ID NO: 230718 - RNA, 22 nt, Human
cagaugaagaucauagaauagu

SEQ ID NO: 230719 - RNA, 22 nt, Human
guucaaauucuaugaaauaugu

SEQ ID NO: 230720 - RNA, 22 nt, Human
aggcaacaugggccaggcagaa

SEQ ID NO: 230721 - RNA, 22 nt, Human
ccagcaucuaacgcuccuggga

SEQ ID NO: 230722 - RNA, 22 nt, Human
uuucaaagggaaguuaugaagu

SEQ ID NO: 230723 - RNA, 22 nt, Human
ggcccagcugggcggggacacg

SEQ ID NO: 230724 - RNA, 22 nt, Human
ugcauacauaaagugcuaucau

SEQ ID NO: 230725 - RNA, 22 nt, Human
agacacaucuuagguugucagg

SEQ ID NO: 230726 - RNA, 22 nt, Human
ucugccucuuucaggccuggca

SEQ ID NO: 230727 - RNA, 22 nt, Human
aagugauuguuccguugagugu

SEQ ID NO: 230728 - RNA, 22 nt, Human
acagagaugcaaguguguauuu

SEQ ID NO: 230729 - RNA, 22 nt, Human
ucaacaaugggucuguaaugga

SEQ ID NO: 230730 - RNA, 22 nt, Human
gcuuuacugagaugacacaggg

SEQ ID NO: 230731 - RNA, 22 nt, Human
gcucuuuucacaguccaaaaug

SEQ ID NO: 230732 - RNA, 21 nt, Human
uuuaauuugcauguaugacgc

SEQ ID NO: 230733 - RNA, 22 nt, Human
uuccuggccucuuccaccacca

SEQ ID NO: 230734 - RNA, 22 nt, Human
ccagagaaccaucugcuugagg

SEQ ID NO: 230735 - RNA, 17 nt, Human
ugacagacaucaugagc

SEQ ID NO: 230736 - RNA, 22 nt, Human
uugaaaaguuuugaaacacucu

SEQ ID NO: 230737 - RNA, 22 nt, Human
gcuagaaaaugaaagauaauuu

SEQ ID NO: 230738 - RNA, 22 nt, Human
uggccccauuuuacagaugaaa

SEQ ID NO: 230739 - RNA, 22 nt, Human
uuaacaguuaaacaauuggcua

SEQ ID NO: 230740 - RNA, 20 nt, Human
ggcugcagugcaccucaucu

SEQ ID NO: 230741 - RNA, 22 nt, Human
acacucacccucccacugccug

SEQ ID NO: 230742 - RNA, 22 nt, Human
gcaggcugccaccuucugaguu

SEQ ID NO: 230743 - RNA, 22 nt, Human
cucuccagucauauucucaguc

SEQ ID NO: 230744 - RNA, 22 nt, Human
ugucaacugugaugucaacacu

SEQ ID NO: 230745 - RNA, 22 nt, Human
uagcccagagagccaggggcuu

SEQ ID NO: 230746 - RNA, 18 nt, Human
uccagcccacauuuucug

SEQ ID NO: 230747 - RNA, 22 nt, Human
uauuucacucaguauaccauag

SEQ ID NO: 230748 - RNA, 21 nt, Human
ucagaagugcagcccaggaau

SEQ ID NO: 230749 - RNA, 22 nt, Human
aggacagagccugugcagaccg

SEQ ID NO: 230750 - RNA, 22 nt, Human
cugggagauugaggccauggug

SEQ ID NO: 230751 - RNA, 22 nt, Human
acaacacagcaaaaccccaucu

SEQ ID NO: 230752 - RNA, 22 nt, Human
ucugagagucuuucuucaagug

SEQ ID NO: 230753 - RNA, 22 nt, Human
uugguguugaacaaaacuaaau

SEQ ID NO: 230754 - RNA, 22 nt, Human
cuggaggaaucacagaaggcuu

SEQ ID NO: 230755 - RNA, 22 nt, Human
ugaggcaaucccuaggguaagg

SEQ ID NO: 230756 - RNA, 22 nt, Human
aggcuuguggggaaucugugug

SEQ ID NO: 230757 - RNA, 22 nt, Human
gccuuugcugugacaaugcugg

SEQ ID NO: 230758 - RNA, 22 nt, Human
gggcugcugggcaagaaacauu

SEQ ID NO: 230759 - RNA, 22 nt, Human
ugcucagccgugagcagagccg

SEQ ID NO: 230760 - RNA, 22 nt, Human
ucacucugagaggucacuggaa

SEQ ID NO: 230761 - RNA, 22 nt, Human
uacacauacaccaaugugguca

SEQ ID NO: 230762 - RNA, 22 nt, Human
ucccagaggucucugcugguuc

SEQ ID NO: 230763 - RNA, 22 nt, Human
agaagccaauccuugucucucu

SEQ ID NO: 230764 - RNA, 19 nt, Human
uacuuauuagaaauauggg

SEQ ID NO: 230765 - RNA, 22 nt, Human
acauguguggccgcuguagaca

SEQ ID NO: 230766 - RNA, 22 nt, Human
cuuggcuccaaucccagcucug

SEQ ID NO: 230767 - RNA, 22 nt, Human
gcugagggauagcugcucacug

SEQ ID NO: 230768 - RNA, 22 nt, Human
ucuuccaggagggugggcaaac

SEQ ID NO: 230769 - RNA, 22 nt, Human
aacagcuguucgcagauguagg

SEQ ID NO: 230770 - RNA, 22 nt, Human
acccaugaguguaucuuuaaaa

SEQ ID NO: 230771 - RNA, 22 nt, Human
guugcuuuacagcuggugacag

SEQ ID NO: 230772 - RNA, 22 nt, Human
cuguugcucugaacaggucuug

SEQ ID NO: 230773 - RNA, 22 nt, Human
cagaauuuagcacaauguaugg

SEQ ID NO: 230774 - RNA, 22 nt, Human
ggcaguuuuaacagagguagua

SEQ ID NO: 230775 - RNA, 22 nt, Human
uaauuccaaguugagacaugca

SEQ ID NO: 230776 - RNA, 22 nt, Human
auucaaacaggaagaaaucauu

SEQ ID NO: 230777 - RNA, 22 nt, Human
cccagggaagggcuaccugagg

SEQ ID NO: 230778 - RNA, 22 nt, Human
cuggcucccucucccugaguca

SEQ ID NO: 230779 - RNA, 22 nt, Human
cauuuguaguuaaaaaugucuc

SEQ ID NO: 230780 - RNA, 22 nt, Human
uucuuuggugggagauugaggu

SEQ ID NO: 230781 - RNA, 22 nt, Human
ucagcacugauguuucagaaga

SEQ ID NO: 230782 - RNA, 22 nt, Human
agcuucccaggagaaucaggga

SEQ ID NO: 230783 - RNA, 22 nt, Human
gggaccagaggcugugcacaau

SEQ ID NO: 230784 - RNA, 22 nt, Human
guucuucaggcugugcucuaga

SEQ ID NO: 230785 - RNA, 22 nt, Human
gggcauggccaggugagggguc

SEQ ID NO: 230786 - RNA, 22 nt, Human
ccugagagugagggccuccuua

SEQ ID NO: 230787 - RNA, 22 nt, Human
ucuugcacuucaugaauauguu

SEQ ID NO: 230788 - RNA, 18 nt, Human
uggaucuuuaugaggcug

SEQ ID NO: 230789 - RNA, 22 nt, Human
gacugaaggucucagcauguga

SEQ ID NO: 230790 - RNA, 22 nt, Human
gugaggagcucuuugacucacg

SEQ ID NO: 230791 - RNA, 19 nt, Human
ggcugccuucugcucaucu

SEQ ID NO: 230792 - RNA, 22 nt, Human
ucuuagcacagcuauauaaguu

SEQ ID NO: 230793 - RNA, 22 nt, Human
agugcaggagccuggccagagc

SEQ ID NO: 230794 - RNA, 22 nt, Human
aagcaggagaugcaggaaugua

SEQ ID NO: 230795 - RNA, 22 nt, Human
cuguguccugucuccuaaggug

SEQ ID NO: 230796 - RNA, 22 nt, Human
cuuaauuacuguccaauaugca

SEQ ID NO: 230797 - RNA, 22 nt, Human
ccagaggaaaaauaucucccua

SEQ ID NO: 230798 - RNA, 22 nt, Human
aagccaugcaagccacaaggug

SEQ ID NO: 230799 - RNA, 23 nt, Human
uaccuuucccugggagacugcuc

SEQ ID NO: 230800 - RNA, 22 nt, Human
ugggcaggugcuauuuuccaug

SEQ ID NO: 230801 - RNA, 22 nt, Human
gugugcaggggcuugguggagc

SEQ ID NO: 230802 - RNA, 22 nt, Human
ggaacuugcaaccucuggucac

SEQ ID NO: 230803 - RNA, 22 nt, Human
cuauuagguaugugguugcuau

SEQ ID NO: 230804 - RNA, 22 nt, Human
cagaggcacaagaaagcaaggc

SEQ ID NO: 230805 - RNA, 22 nt, Human
agcagcugagaugguaagauuc

SEQ ID NO: 230806 - RNA, 22 nt, Human
ugcaggagagcuggucuggccc

SEQ ID NO: 230807 - RNA, 22 nt, Human
guggcauucucggcaccaucug

SEQ ID NO: 230808 - RNA, 22 nt, Human
aggcuuccuggaggaagaggua

SEQ ID NO: 230809 - RNA, 22 nt, Human
cuccuucccuaccaucaauguu

SEQ ID NO: 230810 - RNA, 22 nt, Human
aguccuggcauauagguccuca

SEQ ID NO: 230811 - RNA, 22 nt, Human
aggggauggagcuggaaggcag

SEQ ID NO: 230812 - RNA, 22 nt, Human
cuuuccuaguuggucccagcac

SEQ ID NO: 230813 - RNA, 22 nt, Human
augacaauauagcuuugauuuu

SEQ ID NO: 230814 - RNA, 22 nt, Human
cacucuggggaugcaaggagag

SEQ ID NO: 230815 - RNA, 22 nt, Human
aggcagguuucccggcugucaa

SEQ ID NO: 230816 - RNA, 22 nt, Human
ucagaaguugagauauucaggg

SEQ ID NO: 230817 - RNA, 23 nt, Human
aggguccagggaucaccaggugu

SEQ ID NO: 230818 - RNA, 21 nt, Human
ugauacaggaaugguucuaug

SEQ ID NO: 230819 - RNA, 22 nt, Human
aaucacaugugcucaauuuuaa

SEQ ID NO: 230820 - RNA, 22 nt, Human
agaaguuaccacauacuucucu

SEQ ID NO: 230821 - RNA, 21 nt, Human
gcaugccugcaucuuaguguu

SEQ ID NO: 230822 - RNA, 22 nt, Human
uuucagaugcaauuaauuuuca

SEQ ID NO: 230823 - RNA, 21 nt, Human
uuccuccucuggagaagaaga

SEQ ID NO: 230824 - RNA, 22 nt, Human
ugagacagcccuucugcacagg

SEQ ID NO: 230825 - RNA, 22 nt, Human
uagaaacaucagcuaaccaaaa

SEQ ID NO: 230826 - RNA, 22 nt, Human
agcccugccucuccaaugccca

SEQ ID NO: 230827 - RNA, 22 nt, Human
auggcagcagcuuuagcugugg

SEQ ID NO: 230828 - RNA, 22 nt, Human
ugcugcagggaagucggggggu

SEQ ID NO: 230829 - RNA, 22 nt, Human
uggcccuauuuggaaauagagc

SEQ ID NO: 230830 - RNA, 22 nt, Human
gcacaguggugaaagcaugggu

SEQ ID NO: 230831 - RNA, 22 nt, Human
ugcuggagugcaguggcuuaac

SEQ ID NO: 230832 - RNA, 22 nt, Human
agauggugauagagcugggauu

SEQ ID NO: 230833 - RNA, 22 nt, Human
cuggcaggcggcagagcccagg

SEQ ID NO: 230834 - RNA, 22 nt, Human
uacaugcuuaaaaugcaauguu

SEQ ID NO: 230835 - RNA, 22 nt, Human
agagcugggugguggugacuca

SEQ ID NO: 230836 - RNA, 22 nt, Human
auaaucuuucuuuuccagauag

SEQ ID NO: 230837 - RNA, 22 nt, Human
uaucaacauuaauauuuucugg

SEQ ID NO: 230838 - RNA, 22 nt, Human
gcaaauggagugaagagcugga

SEQ ID NO: 230839 - RNA, 22 nt, Human
ucugcuguaaagaauuucugcc

SEQ ID NO: 230840 - RNA, 22 nt, Human
ccugggagguggagguugcagc

SEQ ID NO: 230841 - RNA, 22 nt, Human
gaggcuucuguaacccuguccu

SEQ ID NO: 230842 - RNA, 22 nt, Human
gacagacagggguucuccugga

SEQ ID NO: 230843 - RNA, 22 nt, Human
ugcauuggucuuaaucuucagg

SEQ ID NO: 230844 - RNA, 22 nt, Human
ccagucugcagccccuggggac

SEQ ID NO: 230845 - RNA, 22 nt, Human
ggcugggagccccacagaguca

SEQ ID NO: 230846 - RNA, 22 nt, Human
cugggccauggaagucucugcc

SEQ ID NO: 230847 - RNA, 22 nt, Human
gugaaguugauuguuaucguca

SEQ ID NO: 230848 - RNA, 22 nt, Human
uguuuguauggaccuguucuau

SEQ ID NO: 230849 - RNA, 22 nt, Human
gagggcagugaauuuugaagcu

SEQ ID NO: 230850 - RNA, 22 nt, Human
gauuugcauucugaaagcuacc

SEQ ID NO: 230851 - RNA, 22 nt, Human
cugcuuuagacaacugcuggga

SEQ ID NO: 230852 - RNA, 22 nt, Human
aggaaauaggaccagacaaagc

SEQ ID NO: 230853 - RNA, 22 nt, Human
gcagccagcccuagucccacuu

SEQ ID NO: 230854 - RNA, 22 nt, Human
acaucuuuuuggaaacggcuga

SEQ ID NO: 230855 - RNA, 22 nt, Human
accuacauacggaaauauuuac

SEQ ID NO: 230856 - RNA, 22 nt, Human
ccugaggaccagcacccaucug

SEQ ID NO: 230857 - RNA, 22 nt, Human
caucuaaauuugacuccaagga

SEQ ID NO: 230858 - RNA, 22 nt, Human
gcuguaggaagacagaaugcag

SEQ ID NO: 230859 - RNA, 22 nt, Human
augguauucucuaacucagcuu

SEQ ID NO: 230860 - RNA, 18 nt, Human
agucuuuauuucuuucau

SEQ ID NO: 230861 - RNA, 19 nt, Human
gcacacccugcaccaccau

SEQ ID NO: 230862 - RNA, 22 nt, Human
uccaguguuuuucuucacaggu

SEQ ID NO: 230863 - RNA, 22 nt, Human
cguauacaugaagacauugcug

SEQ ID NO: 230864 - RNA, 22 nt, Human
agugcagguuaaggaacuggcc

SEQ ID NO: 230865 - RNA, 22 nt, Human
auguuaaauaaucccuuaaagc

SEQ ID NO: 230866 - RNA, 22 nt, Human
ugaucaaagugcuggaauuaca

SEQ ID NO: 230867 - RNA, 22 nt, Human
aucuccagugcccaaaggaaau

SEQ ID NO: 230868 - RNA, 19 nt, Human
caguuuaacuaauuuuauc

SEQ ID NO: 230869 - RNA, 22 nt, Human
cagggagcagccccuagaagua

SEQ ID NO: 230870 - RNA, 22 nt, Human
cagggcagggauguugcggcag

SEQ ID NO: 230871 - RNA, 22 nt, Human
gccuuggacucggguggacuca

SEQ ID NO: 230872 - RNA, 22 nt, Human
gcacagaacacuggugaguccc

SEQ ID NO: 230873 - RNA, 22 nt, Human
cugaauauuagucaugucugau

SEQ ID NO: 230874 - RNA, 22 nt, Human
uaauugcuuuauccuguuagaa

SEQ ID NO: 230875 - RNA, 22 nt, Human
ugcugaaauauuuaugggucaa

SEQ ID NO: 230876 - RNA, 18 nt, Human
caggaugagugaugggga

SEQ ID NO: 230877 - RNA, 22 nt, Human
gccaggcagacaggucaucagg

SEQ ID NO: 230878 - RNA, 22 nt, Human
uggaaaggacaguugcugauag

SEQ ID NO: 230879 - RNA, 22 nt, Human
aaaguggucugcaucccuucug

SEQ ID NO: 230880 - RNA, 22 nt, Human
uuacauucuuggaaucuuguuu

SEQ ID NO: 230881 - RNA, 22 nt, Human
acuggaggauuccuggaaggcg

SEQ ID NO: 230882 - RNA, 22 nt, Human
uacauguggaguuuucuaguca

SEQ ID NO: 230883 - RNA, 22 nt, Human
agacagugcaagaagagcaggc

SEQ ID NO: 230884 - RNA, 22 nt, Human
uuauggaaaauacaauuauaag

SEQ ID NO: 230885 - RNA, 22 nt, Human
ucuccaaauaguuauauuuaga

SEQ ID NO: 230886 - RNA, 22 nt, Human
cuggaauugcauaauauguccu

SEQ ID NO: 230887 - RNA, 22 nt, Human
acacagccaggguaguaaggcu

SEQ ID NO: 230888 - RNA, 22 nt, Human
uggcucugcugaaccuagugca

SEQ ID NO: 230889 - RNA, 22 nt, Human
uggggugccgacagggagggca

SEQ ID NO: 230890 - RNA, 22 nt, Human
gucagaggggcagcugccaggc

SEQ ID NO: 230891 - RNA, 22 nt, Human
uccugugauauuguuuguuaua

SEQ ID NO: 230892 - RNA, 22 nt, Human
uagaaaucuacuuagacuuucu

SEQ ID NO: 230893 - RNA, 22 nt, Human
aaagccaguucuuagagaaagc

SEQ ID NO: 230894 - RNA, 22 nt, Human
gcugggcuucucaaugcugccu

SEQ ID NO: 230895 - RNA, 22 nt, Human
ucuaggaguaaugagcuagcac

SEQ ID NO: 230896 - RNA, 22 nt, Human
aggggcggccugccugaagcag

SEQ ID NO: 230897 - RNA, 22 nt, Human
gccugcacucaaacacucucuu

SEQ ID NO: 230898 - RNA, 22 nt, Human
gccuggcugguagagggggcuc

SEQ ID NO: 230899 - RNA, 22 nt, Human
agaaauguuuauggcugccuau

SEQ ID NO: 230900 - RNA, 22 nt, Human
agugcuuugguauagaacuauu

SEQ ID NO: 230901 - RNA, 22 nt, Human
uuuccagagcaugucugcucag

SEQ ID NO: 230902 - RNA, 22 nt, Human
accagcucuuucuuuucacuau

SEQ ID NO: 230903 - RNA, 22 nt, Human
augcaaaagacuauuuguugcu

SEQ ID NO: 230904 - RNA, 22 nt, Human
ccuucaaguuccuggucccugg

SEQ ID NO: 230905 - RNA, 22 nt, Human
acaaguaccaaaugcucaagua

SEQ ID NO: 230906 - RNA, 22 nt, Human
agguccagugaaacuuuauuug

SEQ ID NO: 230907 - RNA, 21 nt, Human
ugggccagaucugaguuucua

SEQ ID NO: 230908 - RNA, 22 nt, Human
cagcaacaugugguaguguagg

SEQ ID NO: 230909 - RNA, 21 nt, Human
uucaucuggccguauuccagg

SEQ ID NO: 230910 - RNA, 22 nt, Human
caggggagugagucccucucug

SEQ ID NO: 230911 - RNA, 22 nt, Human
ccucagagaaaugucuauucaa

SEQ ID NO: 230912 - RNA, 22 nt, Human
acauguuuggcucuaugcuaua

SEQ ID NO: 230913 - RNA, 22 nt, Human
ucagagaaguaagguggggugc

SEQ ID NO: 230914 - RNA, 22 nt, Human
aauauaguucuagaaauauuuu

SEQ ID NO: 230915 - RNA, 23 nt, Human
aacauacuguuuaauauucacag

SEQ ID NO: 230916 - RNA, 22 nt, Human
ugaaagcaaccuguaacaguga

SEQ ID NO: 230917 - RNA, 22 nt, Human
ggcuggcucagggcuugagaga

SEQ ID NO: 230918 - RNA, 22 nt, Human
cugccugccacguucagcugua

SEQ ID NO: 230919 - RNA, 22 nt, Human
agcauuccacacugaagucugc

SEQ ID NO: 230920 - RNA, 22 nt, Human
ucugcugugucccuggucuccu

SEQ ID NO: 230921 - RNA, 22 nt, Human
uggaugagauuaaagugagguu

SEQ ID NO: 230922 - RNA, 22 nt, Human
uguauauaagcauuuacuuguu

SEQ ID NO: 230923 - RNA, 22 nt, Human
agcuuaucuuguuaguuucauu

SEQ ID NO: 230924 - RNA, 22 nt, Human
acagcagagccugguacuuacu

SEQ ID NO: 230925 - RNA, 22 nt, Human
uucugucaaacucacaggccga

SEQ ID NO: 230926 - RNA, 22 nt, Human
uuaugcagucgacaucugauca

SEQ ID NO: 230927 - RNA, 22 nt, Human
ccacaggacacaacugcugacc

SEQ ID NO: 230928 - RNA, 23 nt, Human
uucuggguugcugugcuuggaau

SEQ ID NO: 230929 - RNA, 22 nt, Human
acaauacuauuuucaguauccu

SEQ ID NO: 230930 - RNA, 22 nt, Human
ggcugaucaggugcaaaugcau

SEQ ID NO: 230931 - RNA, 22 nt, Human
acauucuaugaagauaauuuua

SEQ ID NO: 230932 - RNA, 22 nt, Human
agucacauggacucaggaugac

SEQ ID NO: 230933 - RNA, 22 nt, Human
ggcugccuugacccuggcuccg

SEQ ID NO: 230934 - RNA, 22 nt, Human
ucacauucucagcaucuauaca

SEQ ID NO: 230935 - RNA, 22 nt, Human
acucagagucuguuugguaccu

SEQ ID NO: 230936 - RNA, 22 nt, Human
ucacagaagaugcuggauguug

SEQ ID NO: 230937 - RNA, 22 nt, Human
agcauuagguguguuucagagg

SEQ ID NO: 230938 - RNA, 22 nt, Human
ugcuggcucuaggcugagacag

SEQ ID NO: 230939 - RNA, 22 nt, Human
uauuugagcgaagcaguguuuu

SEQ ID NO: 230940 - RNA, 22 nt, Human
ugcuuauuaaacaugcauauuc

SEQ ID NO: 230941 - RNA, 22 nt, Human
aggcccugcauuguacugaggg

SEQ ID NO: 230942 - RNA, 22 nt, Human
aagggaaaauaguugaugacca

SEQ ID NO: 230943 - RNA, 22 nt, Human
ccagagaguaggaggcauuauu

SEQ ID NO: 230944 - RNA, 22 nt, Human
ucuccugugcacccucccugug

SEQ ID NO: 230945 - RNA, 22 nt, Human
gcaugcagacagucugagacca

SEQ ID NO: 230946 - RNA, 22 nt, Human
auguaauuguagcaaaaugaug

SEQ ID NO: 230947 - RNA, 22 nt, Human
ugacagaccacugcaacucugu

SEQ ID NO: 230948 - RNA, 22 nt, Human
ccccagccuuccaugggaauug

SEQ ID NO: 230949 - RNA, 22 nt, Human
uuccaggaaaacaguuggaagu

SEQ ID NO: 230950 - RNA, 22 nt, Human
cugccccaccccaaccugaggu

SEQ ID NO: 230951 - RNA, 21 nt, Human
aguguguguggaaugagaaua

SEQ ID NO: 230952 - RNA, 22 nt, Human
uucucuaagccuuaguuucuuc

SEQ ID NO: 230953 - RNA, 22 nt, Human
uagcugcuucucacaugggcaa

SEQ ID NO: 230954 - RNA, 22 nt, Human
ugcagggcuccuggcuccaauc

SEQ ID NO: 230955 - RNA, 22 nt, Human
caaagcaggaagaauauugaaa

SEQ ID NO: 230956 - RNA, 22 nt, Human
augcuaauguuuguggaagaua

SEQ ID NO: 230957 - RNA, 22 nt, Human
ucaauucuagagccuuacauug

SEQ ID NO: 230958 - RNA, 22 nt, Human
cuucaaguugucugaggguggg

SEQ ID NO: 230959 - RNA, 20 nt, Human
auacaguaggugcucaauau

SEQ ID NO: 230960 - RNA, 22 nt, Human
guucugccuguggcuucugugg

SEQ ID NO: 230961 - RNA, 22 nt, Human
ccaggaaggcguuguuccucuc

SEQ ID NO: 230962 - RNA, 23 nt, Human
gcaggacaacagagugggaaggc

SEQ ID NO: 230963 - RNA, 22 nt, Human
uugcaaaaacugcaauuacuuu

SEQ ID NO: 230964 - RNA, 22 nt, Human
ucuuuacaaucuaagcauaguu

SEQ ID NO: 230965 - RNA, 22 nt, Human
gcugcucagugggccugagccu

SEQ ID NO: 230966 - RNA, 22 nt, Human
uaccauuugagagagaacauaa

SEQ ID NO: 230967 - RNA, 22 nt, Human
gauggcagugggccucgagucc

SEQ ID NO: 230968 - RNA, 22 nt, Human
cucuccaggagcucagagucua

SEQ ID NO: 230969 - RNA, 22 nt, Human
uagaagaaaagcacuuagagau

SEQ ID NO: 230970 - RNA, 22 nt, Human
uucucaguuucauagcugagca

SEQ ID NO: 230971 - RNA, 22 nt, Human
gaucacauaauuuggaaacagc

SEQ ID NO: 230972 - RNA, 22 nt, Human
uugcccugcggguccugcgcaa

SEQ ID NO: 230973 - RNA, 22 nt, Human
guuuccuagaucaguguucuua

SEQ ID NO: 230974 - RNA, 20 nt, Human
ccaggccugggccugcucua

SEQ ID NO: 230975 - RNA, 22 nt, Human
uggcaauguuagcaaagcauuu

SEQ ID NO: 230976 - RNA, 22 nt, Human
ggcuccagggaguggagagaag

SEQ ID NO: 230977 - RNA, 22 nt, Human
agagucugaggcagcugcagcc

SEQ ID NO: 230978 - RNA, 22 nt, Human
gaccuuagaacgugacacaaga

SEQ ID NO: 230979 - RNA, 23 nt, Human
accccaggcaucgcauuccucuu

SEQ ID NO: 230980 - RNA, 20 nt, Human
uccagcauauaaacuccucu

SEQ ID NO: 230981 - RNA, 18 nt, Human
cguuuuuccgggauugca

SEQ ID NO: 230982 - RNA, 22 nt, Human
agagacaggaguucuguuucca

SEQ ID NO: 230983 - RNA, 22 nt, Human
aggcaacuugcaucucggcaag

SEQ ID NO: 230984 - RNA, 22 nt, Human
cacaugugcaaauacugaggcu

SEQ ID NO: 230985 - RNA, 22 nt, Human
cuccagucuuucagaugucccu

SEQ ID NO: 230986 - RNA, 22 nt, Human
augauguuaccaguacuuagag

SEQ ID NO: 230987 - RNA, 21 nt, Human
gagugcaggucugaugccauc

SEQ ID NO: 230988 - RNA, 22 nt, Human
gcagcagaugcuuucauggaca

SEQ ID NO: 230989 - RNA, 22 nt, Human
ucccagucuguguccuuuacag

SEQ ID NO: 230990 - RNA, 22 nt, Human
cccuggcugcuaccagguagcu

SEQ ID NO: 230991 - RNA, 22 nt, Human
augcuagaagggagcacuaugu

SEQ ID NO: 230992 - RNA, 19 nt, Human
uuucuguuugcuucugguu

SEQ ID NO: 230993 - RNA, 22 nt, Human
ccuggagcacagcccaguccca

SEQ ID NO: 230994 - RNA, 21 nt, Human
ugcagagauaucugaagcaga

SEQ ID NO: 230995 - RNA, 19 nt, Human
ccaggagcaguggugagcu

SEQ ID NO: 230996 - RNA, 16 nt, Human
gcuccugggcccucga

SEQ ID NO: 230997 - RNA, 22 nt, Human
cugggcagcuaccaccacugcu

SEQ ID NO: 230998 - RNA, 22 nt, Human
cacaggccaauacccucucucu

SEQ ID NO: 230999 - RNA, 22 nt, Human
ucccaggguccucuucuggaau

SEQ ID NO: 231000 - RNA, 22 nt, Human
cagucugggacugagcuccacc

SEQ ID NO: 231001 - RNA, 22 nt, Human
uuagacaucagugcuucucagc

SEQ ID NO: 231002 - RNA, 22 nt, Human
cagggccucauugucaguccug

SEQ ID NO: 231003 - RNA, 22 nt, Human
auuuaauuaaucauggugaauu

SEQ ID NO: 231004 - RNA, 22 nt, Human
agaacaucugaagauacaaagu

SEQ ID NO: 231005 - RNA, 22 nt, Human
cuguacaaaguagcugcuggga

SEQ ID NO: 231006 - RNA, 22 nt, Human
uuuugccugagauccgagucug

SEQ ID NO: 231007 - RNA, 22 nt, Human
ugcaaacaguuaagaugcaggc

SEQ ID NO: 231008 - RNA, 16 nt, Human
caggaaacuuaaagac

SEQ ID NO: 231009 - RNA, 22 nt, Human
auguauuucuauguagugaaga

SEQ ID NO: 231010 - RNA, 22 nt, Human
ccuucuucaccaguuuaccuga

SEQ ID NO: 231011 - RNA, 22 nt, Human
acuguucaaguuuuaugcugga

SEQ ID NO: 231012 - RNA, 22 nt, Human
uucacauucucacaagaggaaa

SEQ ID NO: 231013 - RNA, 22 nt, Human
uccaggcauuggagagauaaug

SEQ ID NO: 231014 - RNA, 22 nt, Human
gguccaggggguagauauguga

SEQ ID NO: 231015 - RNA, 22 nt, Human
ggugagaggcagaggacagcuu

SEQ ID NO: 231016 - RNA, 22 nt, Human
ugcugggggugucucaccaggc

SEQ ID NO: 231017 - RNA, 22 nt, Human
agacacaguauaagcacaacaa

SEQ ID NO: 231018 - RNA, 22 nt, Human
uaaaaguaggaaugaaacgcau

SEQ ID NO: 231019 - RNA, 22 nt, Human
uuuagacauagcugaaaucauu

SEQ ID NO: 231020 - RNA, 22 nt, Human
aaguguuaaaagauuaaaugcu

SEQ ID NO: 231021 - RNA, 22 nt, Human
ugcuggcuggaucagagauugg

SEQ ID NO: 231022 - RNA, 22 nt, Human
auucucaaacaagugguuugau

SEQ ID NO: 231023 - RNA, 22 nt, Human
cggaaacuugagaaccagccag

SEQ ID NO: 231024 - RNA, 22 nt, Human
gauaaacuggaaccauugccuc

SEQ ID NO: 231025 - RNA, 22 nt, Human
gcauggcuuacagaggcugcag

SEQ ID NO: 231026 - RNA, 22 nt, Human
ggagaaaggauaggaaugugcu

SEQ ID NO: 231027 - RNA, 22 nt, Human
acagagcuaaauuucaauccca

SEQ ID NO: 231028 - RNA, 22 nt, Human
uuagaacuuaagaauacugucu

SEQ ID NO: 231029 - RNA, 22 nt, Human
cagugccaugucugagccccua

SEQ ID NO: 231030 - RNA, 22 nt, Human
agagaggucucaggagaaacca

SEQ ID NO: 231031 - RNA, 22 nt, Human
gaggagcuggcugucgggaggc

SEQ ID NO: 231032 - RNA, 16 nt, Human
gcuggagggagggguu

SEQ ID NO: 231033 - RNA, 22 nt, Human
gccagccagaguccaucugaga

SEQ ID NO: 231034 - RNA, 22 nt, Human
caguauguacucuuaucaugua

SEQ ID NO: 231035 - RNA, 20 nt, Human
cucugcagcaaggccugggu

SEQ ID NO: 231036 - RNA, 21 nt, Human
gcucuggccuacuguucccuc

SEQ ID NO: 231037 - RNA, 22 nt, Human
cuacuguuauuauuaauaguaa

SEQ ID NO: 231038 - RNA, 22 nt, Human
uuagaaccacugaagacucaca

SEQ ID NO: 231039 - RNA, 22 nt, Human
ccuccuagaggaaccccagggc

SEQ ID NO: 231040 - RNA, 22 nt, Human
aguggcagaagccaagucugca

SEQ ID NO: 231041 - RNA, 22 nt, Human
gggcucaugauguaggcuggua

SEQ ID NO: 231042 - RNA, 22 nt, Human
agauauacagagaauuauucac

SEQ ID NO: 231043 - RNA, 22 nt, Human
gaagacauuuguaacacuugca

SEQ ID NO: 231044 - RNA, 22 nt, Human
ugcugaggagguggcugugcuu

SEQ ID NO: 231045 - RNA, 22 nt, Human
aggccuggcuuugguuugcuga

SEQ ID NO: 231046 - RNA, 22 nt, Human
ccuuccagguuuuggcuccauu

SEQ ID NO: 231047 - RNA, 22 nt, Human
uagaaaauagggccuguggagc

SEQ ID NO: 231048 - RNA, 22 nt, Human
cgcaauuaauucgggccacagu

SEQ ID NO: 231049 - RNA, 22 nt, Human
uugcauuuguuugaguagaaug

SEQ ID NO: 231050 - RNA, 22 nt, Human
agggcacaucugcugggaaugg

SEQ ID NO: 231051 - RNA, 19 nt, Human
uccagccugcuguuucucu

SEQ ID NO: 231052 - RNA, 22 nt, Human
aagcugaauuuucuaaaagaau

SEQ ID NO: 231053 - RNA, 22 nt, Human
cagcccugcagagggcgcuccu

SEQ ID NO: 231054 - RNA, 19 nt, Human
ugcugaggaugcaagaucc

SEQ ID NO: 231055 - RNA, 22 nt, Human
uguccagggggcuuaccuggag

SEQ ID NO: 231056 - RNA, 23 nt, Human
uugcaaaaugcaauugaguuaga

SEQ ID NO: 231057 - RNA, 22 nt, Human
gcacuugaagaauugaacugga

SEQ ID NO: 231058 - RNA, 19 nt, Human
ccauggcaaugaucugaug

SEQ ID NO: 231059 - RNA, 22 nt, Human
aacaguuuaugagauaugcuau

SEQ ID NO: 231060 - RNA, 22 nt, Human
ccaguauucgaucuggccaguu

SEQ ID NO: 231061 - RNA, 22 nt, Human
aguagcaguuuggcugaauuua

SEQ ID NO: 231062 - RNA, 22 nt, Human
gcucaggaaacagcagggcuug

SEQ ID NO: 231063 - RNA, 22 nt, Human
ucagucuuuaaaagcucaggaa

SEQ ID NO: 231064 - RNA, 20 nt, Human
ggcuucuucaggugucuauu

SEQ ID NO: 231065 - RNA, 22 nt, Human
gcaguaagauguuucccagagc

SEQ ID NO: 231066 - RNA, 20 nt, Human
aguguuuagaauacuauuau

SEQ ID NO: 231067 - RNA, 22 nt, Human
uuacuuacagacaguagacucu

SEQ ID NO: 231068 - RNA, 22 nt, Human
ugcaaccugcacucugucuuua

SEQ ID NO: 231069 - RNA, 20 nt, Human
uggaggcaccuguggagauc

SEQ ID NO: 231070 - RNA, 22 nt, Human
cuggcucacaggugagaugcau

SEQ ID NO: 231071 - RNA, 22 nt, Human
ggggcagcuaccggaaguaggg

SEQ ID NO: 231072 - RNA, 22 nt, Human
gagcaguguuuguggaccugga

SEQ ID NO: 231073 - RNA, 22 nt, Human
gagggugggcuccuaucugggu

SEQ ID NO: 231074 - RNA, 22 nt, Human
aguggcuucauuucugccagaa

SEQ ID NO: 231075 - RNA, 22 nt, Human
gcucccagacugaccagaggug

SEQ ID NO: 231076 - RNA, 20 nt, Human
ucaagacagacauggaguuu

SEQ ID NO: 231077 - RNA, 22 nt, Human
cucagauguagaaagauuguga

SEQ ID NO: 231078 - RNA, 21 nt, Human
acagcugucuuagcuugggcu

SEQ ID NO: 231079 - RNA, 22 nt, Human
ccagcagagcauggggaggaag

SEQ ID NO: 231080 - RNA, 22 nt, Human
uuucacauuuuauacuuaagcc

SEQ ID NO: 231081 - RNA, 22 nt, Human
cucagcacuuuggaaggcugau

SEQ ID NO: 231082 - RNA, 22 nt, Human
cuccugggaggaugcggacccg

SEQ ID NO: 231083 - RNA, 22 nt, Human
uagggcagauucgguggaguuu

SEQ ID NO: 231084 - RNA, 18 nt, Human
cugacuccuuugcugcca

SEQ ID NO: 231085 - RNA, 22 nt, Human
acugcaaaaaugggugcauuca

SEQ ID NO: 231086 - RNA, 22 nt, Human
cagggggcuguggcuguccagu

SEQ ID NO: 231087 - RNA, 22 nt, Human
uccccaggaguuuuacuuugca

SEQ ID NO: 231088 - RNA, 22 nt, Human
uauaucagcaaagcauuuaaaa

SEQ ID NO: 231089 - RNA, 22 nt, Human
ucuccacacuuucucucccagg

SEQ ID NO: 231090 - RNA, 22 nt, Human
auacacaucuauuuaagagaca

SEQ ID NO: 231091 - RNA, 22 nt, Human
guauuuuauggccuggggccua

SEQ ID NO: 231092 - RNA, 22 nt, Human
cucugggaugaggccuaggcac

SEQ ID NO: 231093 - RNA, 22 nt, Human
acaaauaugguacucggagaaa

SEQ ID NO: 231094 - RNA, 22 nt, Human
gauggucuuugucucugauaag

SEQ ID NO: 231095 - RNA, 22 nt, Human
auacaguaaccacauucuauag

SEQ ID NO: 231096 - RNA, 22 nt, Human
gcccugggcucccugcuccaca

SEQ ID NO: 231097 - RNA, 22 nt, Human
gcugagguggcugccuuaguaa

SEQ ID NO: 231098 - RNA, 22 nt, Human
agggauggcaaguuaaccugag

SEQ ID NO: 231099 - RNA, 22 nt, Human
caggauggagggagggcuguua

SEQ ID NO: 231100 - RNA, 22 nt, Human
ggacggggagcuggaaagggga

SEQ ID NO: 231101 - RNA, 22 nt, Human
ccacagcuucgcagucugcugc

SEQ ID NO: 231102 - RNA, 20 nt, Human
uagaaucuacuauuuggccc

SEQ ID NO: 231103 - RNA, 22 nt, Human
uuguauuucuccacuuucuguu

SEQ ID NO: 231104 - RNA, 22 nt, Human
caugcuuuuuucuaguauaaau

SEQ ID NO: 231105 - RNA, 22 nt, Human
agaacacucuccugaaaauuaa

SEQ ID NO: 231106 - RNA, 22 nt, Human
aagccaagugcuggccaugggc

SEQ ID NO: 231107 - RNA, 22 nt, Human
augcagcuauuugagcauguca

SEQ ID NO: 231108 - RNA, 19 nt, Human
uggcagguagugagcaguc

SEQ ID NO: 231109 - RNA, 22 nt, Human
aauacaaucaaauucacuagca

SEQ ID NO: 231110 - RNA, 22 nt, Human
caugccauuuacuuggaggaga

SEQ ID NO: 231111 - RNA, 22 nt, Human
gauaaacuuguggaguuuuggu

SEQ ID NO: 231112 - RNA, 22 nt, Human
gcagggcagccacaggcccccu

SEQ ID NO: 231113 - RNA, 22 nt, Human
gaagcacauggcugugagcaac

SEQ ID NO: 231114 - RNA, 23 nt, Human
auagacccaagaguaaaggcauc

SEQ ID NO: 231115 - RNA, 18 nt, Human
uuggcuucuuuccuuccu

SEQ ID NO: 231116 - RNA, 22 nt, Human
uacugagcugguccacugaggu

SEQ ID NO: 231117 - RNA, 22 nt, Human
auguuacagaaagcaaagauga

SEQ ID NO: 231118 - RNA, 22 nt, Human
gugugucccuuggaaccucagc

SEQ ID NO: 231119 - RNA, 22 nt, Human
caacaggcuuuauguuuaaagu

SEQ ID NO: 231120 - RNA, 20 nt, Human
ucauuacagugcuaagaugu

SEQ ID NO: 231121 - RNA, 17 nt, Human
ucugugauaguguagau

SEQ ID NO: 231122 - RNA, 22 nt, Human
acacauaugccauuacagcaaa

SEQ ID NO: 231123 - RNA, 22 nt, Human
auguaaauuguacugacacacg

SEQ ID NO: 231124 - RNA, 22 nt, Human
ggagccuuacuagaaugugagc

SEQ ID NO: 231125 - RNA, 22 nt, Human
guuacaauguccuuacaugaaa

SEQ ID NO: 231126 - RNA, 22 nt, Human
uguccuggaaaaauggagaguu

SEQ ID NO: 231127 - RNA, 22 nt, Human
uuucugauauacuguagaaucc

SEQ ID NO: 231128 - RNA, 22 nt, Human
uaggaaauucucuugcuaaguu

SEQ ID NO: 231129 - RNA, 22 nt, Human
aggguccacuuggacauugauc

SEQ ID NO: 231130 - RNA, 22 nt, Human
aaggguugcaaggucagaggaa

SEQ ID NO: 231131 - RNA, 22 nt, Human
uaggccagauuguuauccaugg

SEQ ID NO: 231132 - RNA, 21 nt, Human
ggcagagcuggggccuccagc

SEQ ID NO: 231133 - RNA, 22 nt, Human
uggccaggccucuuggugccca

SEQ ID NO: 231134 - RNA, 22 nt, Human
ugaugucuaguacauacaagag

SEQ ID NO: 231135 - RNA, 22 nt, Human
uuuccuaggagauugaucacau

SEQ ID NO: 231136 - RNA, 17 nt, Human
ucucaggggcuagcccu

SEQ ID NO: 231137 - RNA, 22 nt, Human
ugggaagccuagcagacagcug

SEQ ID NO: 231138 - RNA, 22 nt, Human
ugccacauggugcauuuccuag

SEQ ID NO: 231139 - RNA, 22 nt, Human
auauuuaacuggucccaauaua

SEQ ID NO: 231140 - RNA, 22 nt, Human
aguuuuugagaauuuacuaugu

SEQ ID NO: 231141 - RNA, 22 nt, Human
ugugaaaagggcuuuguacaaa

SEQ ID NO: 231142 - RNA, 22 nt, Human
agaaguuaauuccugaaauucu

SEQ ID NO: 231143 - RNA, 22 nt, Human
gaucaaugguguaacuuguccu

SEQ ID NO: 231144 - RNA, 22 nt, Human
ugcucccauguguggguacaga

SEQ ID NO: 231145 - RNA, 22 nt, Human
ggcuucugaaaucucugugcgu

SEQ ID NO: 231146 - RNA, 22 nt, Human
cuaucaaacagccauuaauaua

SEQ ID NO: 231147 - RNA, 22 nt, Human
agcaagcagaaaugccauggca

SEQ ID NO: 231148 - RNA, 22 nt, Human
ccaggagcuauguacacacuau

SEQ ID NO: 231149 - RNA, 22 nt, Human
gucuccaguguucaggugacug

SEQ ID NO: 231150 - RNA, 23 nt, Human
accaacaagccucuggagagugg

SEQ ID NO: 231151 - RNA, 22 nt, Human
ugcaggcuggggaggcagacuu

SEQ ID NO: 231152 - RNA, 21 nt, Human
ccauaaucuuaggaucaaaau

SEQ ID NO: 231153 - RNA, 19 nt, Human
ugcagagagaggcaaagaa

SEQ ID NO: 231154 - RNA, 22 nt, Human
uaggccagcccuuaguccuguc

SEQ ID NO: 231155 - RNA, 22 nt, Human
gcacaauaauuuuuuuaagagg

SEQ ID NO: 231156 - RNA, 22 nt, Human
ucugccuguggauacaugcucu

SEQ ID NO: 231157 - RNA, 22 nt, Human
cuguggcuaugguguacauacu

SEQ ID NO: 231158 - RNA, 22 nt, Human
uuacaugggccauuuagacaug

SEQ ID NO: 231159 - RNA, 22 nt, Human
uaaggccaauuaacaaccaggg

SEQ ID NO: 231160 - RNA, 22 nt, Human
aguauuuguggauuuguauugg

SEQ ID NO: 231161 - RNA, 22 nt, Human
uauuccuauuucuaaacauaug

SEQ ID NO: 231162 - RNA, 22 nt, Human
uuggcucuggaacuauuucuga

SEQ ID NO: 231163 - RNA, 22 nt, Human
agcccugcugcuucuuguauuu

SEQ ID NO: 231164 - RNA, 23 nt, Human
aggcccugccugucccucuuuuu

SEQ ID NO: 231165 - RNA, 22 nt, Human
ugacauguaguuagaaaauagg

SEQ ID NO: 231166 - RNA, 22 nt, Human
auuuugcacacuaugcagcuuu

SEQ ID NO: 231167 - RNA, 22 nt, Human
gacagacaggaggccaccugcu

SEQ ID NO: 231168 - RNA, 22 nt, Human
ccuguucaagguauuaauuauc

SEQ ID NO: 231169 - RNA, 22 nt, Human
uguaaucauuacaguacaugga

SEQ ID NO: 231170 - RNA, 22 nt, Human
aucucuguuagaucugcuuaaa

SEQ ID NO: 231171 - RNA, 22 nt, Human
uaaauuuacccaaggaacaugu

SEQ ID NO: 231172 - RNA, 20 nt, Human
agugucuggauuuuguaacc

SEQ ID NO: 231173 - RNA, 22 nt, Human
agccuccuggaguuucugggau

SEQ ID NO: 231174 - RNA, 22 nt, Human
gccuuagccugcacuuccuguu

SEQ ID NO: 231175 - RNA, 22 nt, Human
gcaggaggagcauuaacugagc

SEQ ID NO: 231176 - RNA, 22 nt, Human
aaauaguuuagcucucauuuca

SEQ ID NO: 231177 - RNA, 22 nt, Human
uucaacuuuaugcauauguauu

SEQ ID NO: 231178 - RNA, 20 nt, Human
agugugcauuuagagucugc

SEQ ID NO: 231179 - RNA, 22 nt, Human
gcccuggagggccagcgacugg

SEQ ID NO: 231180 - RNA, 22 nt, Human
acacacaugcaugcuugccauu

SEQ ID NO: 231181 - RNA, 22 nt, Human
agaucuuuugguuauuauaaga

SEQ ID NO: 231182 - RNA, 22 nt, Human
agguaaaauagauaguauuucu

SEQ ID NO: 231183 - RNA, 22 nt, Human
cugcugugcagacagacucucu

SEQ ID NO: 231184 - RNA, 22 nt, Human
acacaugaaauaauauuaugca

SEQ ID NO: 231185 - RNA, 22 nt, Human
uuuuggcucuugguaggucaga

SEQ ID NO: 231186 - RNA, 21 nt, Human
ggccacaguuagggcucagga

SEQ ID NO: 231187 - RNA, 22 nt, Human
cauccagugggacagagaaacc

SEQ ID NO: 231188 - RNA, 22 nt, Human
gcccagcaggggauggcagcuc

SEQ ID NO: 231189 - RNA, 21 nt, Human
gcucaggcucuugacagagca

SEQ ID NO: 231190 - RNA, 22 nt, Human
ugaaagcacucacuucugcucu

SEQ ID NO: 231191 - RNA, 20 nt, Human
caggcagaggaugcugacca

SEQ ID NO: 231192 - RNA, 22 nt, Human
augaggcagaaaaaagucggag

SEQ ID NO: 231193 - RNA, 20 nt, Human
gcagagcuguucugugggga

SEQ ID NO: 231194 - RNA, 22 nt, Human
agcauuuagucuuuauugcagc

SEQ ID NO: 231195 - RNA, 22 nt, Human
uauuaaagggaaguuaugcaug

SEQ ID NO: 231196 - RNA, 22 nt, Human
uguuauugucgcugcacuggga

SEQ ID NO: 231197 - RNA, 22 nt, Human
uauacacauuacaguuucagga

SEQ ID NO: 231198 - RNA, 22 nt, Human
ucuucaaacugaaaauuuagaa

SEQ ID NO: 231199 - RNA, 22 nt, Human
uuuuaccugaaccacacaguau

SEQ ID NO: 231200 - RNA, 22 nt, Human
cagcuuggcgaauguagguaug

SEQ ID NO: 231201 - RNA, 17 nt, Human
gcaggcacugcugccug

SEQ ID NO: 231202 - RNA, 22 nt, Human
agguuauucucuaucucauccc

SEQ ID NO: 231203 - RNA, 22 nt, Human
agagccagccuucucagcuuac

SEQ ID NO: 231204 - RNA, 19 nt, Human
guauaacuuacaccagcaa

SEQ ID NO: 231205 - RNA, 22 nt, Human
ccacaucucccuauugcucuuu

SEQ ID NO: 231206 - RNA, 22 nt, Human
agaaucuugggcaaauucaucu

SEQ ID NO: 231207 - RNA, 22 nt, Human
gucuuuauauuuacuaaagaau

SEQ ID NO: 231208 - RNA, 22 nt, Human
ggcccucccugagccagguggg

SEQ ID NO: 231209 - RNA, 22 nt, Human
cuggguggcgucuggggccagu

SEQ ID NO: 231210 - RNA, 22 nt, Human
gcugcccuaauaucacauguua

SEQ ID NO: 231211 - RNA, 18 nt, Human
gugccaggaggcgcagcc

SEQ ID NO: 231212 - RNA, 22 nt, Human
cugccugcuucugagccagagg

SEQ ID NO: 231213 - RNA, 22 nt, Human
caggcucagucagaaaauguau

SEQ ID NO: 231214 - RNA, 19 nt, Human
gaaaggcugcugcuaccug

SEQ ID NO: 231215 - RNA, 22 nt, Human
ugggggaguauagucuggccuc

SEQ ID NO: 231216 - RNA, 22 nt, Human
ggcagggaguggagacucccua

SEQ ID NO: 231217 - RNA, 20 nt, Human
gcucugggagggaugugaug

SEQ ID NO: 231218 - RNA, 22 nt, Human
acuacauuuccugaccccugug

SEQ ID NO: 231219 - RNA, 22 nt, Human
cuccugggcuucgaaggcuccc

SEQ ID NO: 231220 - RNA, 23 nt, Human
ucuauacauacugcagccucugg

SEQ ID NO: 231221 - RNA, 22 nt, Human
gcucagggccauggaccagcag

SEQ ID NO: 231222 - RNA, 22 nt, Human
ggcgcacaaugugcagguuugu

SEQ ID NO: 231223 - RNA, 22 nt, Human
ccucuggguuaguuuagggagc

SEQ ID NO: 231224 - RNA, 22 nt, Human
gaggguggccuuuagagcccau

SEQ ID NO: 231225 - RNA, 22 nt, Human
ccaggacuuauuacaguauaac

SEQ ID NO: 231226 - RNA, 20 nt, Human
ucucaggcccccuccuugcu

SEQ ID NO: 231227 - RNA, 22 nt, Human
ugacagaaagaauaugucaauc

SEQ ID NO: 231228 - RNA, 22 nt, Human
uugguaauuguguuuauuaaau

SEQ ID NO: 231229 - RNA, 22 nt, Human
uuaacugugacaguuucucaga

SEQ ID NO: 231230 - RNA, 22 nt, Human
aucuccaguauccuaguauugu

SEQ ID NO: 231231 - RNA, 19 nt, Human
ucucuacacuacauuucua

SEQ ID NO: 231232 - RNA, 22 nt, Human
auuuguaauuucuuaucugugu

SEQ ID NO: 231233 - RNA, 20 nt, Human
cugcaaaaugacauuaggaa

SEQ ID NO: 231234 - RNA, 22 nt, Human
acaaauuugaauccugacuucu

SEQ ID NO: 231235 - RNA, 22 nt, Human
cccaggcacagauuaucccaau

SEQ ID NO: 231236 - RNA, 22 nt, Human
agagagcagucuggaagaaaca

SEQ ID NO: 231237 - RNA, 22 nt, Human
ucagcccugggacccagggaug

SEQ ID NO: 231238 - RNA, 22 nt, Human
gagucagaugaagauaaaaggg

SEQ ID NO: 231239 - RNA, 22 nt, Human
uuguugccaaauguaaaauaug

SEQ ID NO: 231240 - RNA, 19 nt, Human
uccagaugauauggauuac

SEQ ID NO: 231241 - RNA, 22 nt, Human
agccuuccagguagauggcaca

SEQ ID NO: 231242 - RNA, 22 nt, Human
uaauguguugaauauuuguaca

SEQ ID NO: 231243 - RNA, 22 nt, Human
ucucugggaucguuuugggcuc

SEQ ID NO: 231244 - RNA, 21 nt, Human
auuauuauaaagaccacaggg

SEQ ID NO: 231245 - RNA, 22 nt, Human
ucaagaaggaguuauuuauuca

SEQ ID NO: 231246 - RNA, 22 nt, Human
aaugucuuuuaaauguugaggu

SEQ ID NO: 231247 - RNA, 22 nt, Human
uaccaugucuucaauaagucua

SEQ ID NO: 231248 - RNA, 22 nt, Human
uaaguauguuagaaaaucaagu

SEQ ID NO: 231249 - RNA, 22 nt, Human
caagaaauuucuuaagaacuaa

SEQ ID NO: 231250 - RNA, 22 nt, Human
uaccuagacaugaacacagaug

SEQ ID NO: 231251 - RNA, 22 nt, Human
uccuuccugcucuaacauucag

SEQ ID NO: 231252 - RNA, 22 nt, Human
ccagcuccaggacugggagcug

SEQ ID NO: 231253 - RNA, 22 nt, Human
ugcaaacaggcauuucacaaac

SEQ ID NO: 231254 - RNA, 22 nt, Human
gacugggguaaggugaggaggu

SEQ ID NO: 231255 - RNA, 22 nt, Human
gugcccaggggccagcugccgg

SEQ ID NO: 231256 - RNA, 21 nt, Human
acacaacaggcagucauuuuc

SEQ ID NO: 231257 - RNA, 22 nt, Human
auuuuguugaugguggaguagc

SEQ ID NO: 231258 - RNA, 22 nt, Human
uggcucaguuaggucagaaaca

SEQ ID NO: 231259 - RNA, 22 nt, Human
uuguguccccuguucuaccugu

SEQ ID NO: 231260 - RNA, 22 nt, Human
ccucauggccuugagcugaggg

SEQ ID NO: 231261 - RNA, 22 nt, Human
ggcaagugugagaagggacugg

SEQ ID NO: 231262 - RNA, 22 nt, Human
aggggcuccaaggaaguuuggg

SEQ ID NO: 231263 - RNA, 22 nt, Human
cccuggacuguucagggccuga

SEQ ID NO: 231264 - RNA, 22 nt, Human
agggaggauaguagucaguuua

SEQ ID NO: 231265 - RNA, 22 nt, Human
auggccuggggauuccugagca

SEQ ID NO: 231266 - RNA, 22 nt, Human
auauguauguacgcacauauuc

SEQ ID NO: 231267 - RNA, 22 nt, Human
uggccaguggacuaaguucuga

SEQ ID NO: 231268 - RNA, 22 nt, Human
gaggaaacauuguagaagcagu

SEQ ID NO: 231269 - RNA, 22 nt, Human
cuggcagccaagugggauacuc

SEQ ID NO: 231270 - RNA, 22 nt, Human
gcaggcucacucuguuuggcuc

SEQ ID NO: 231271 - RNA, 22 nt, Human
acagaugaguuagaauaggcag

SEQ ID NO: 231272 - RNA, 22 nt, Human
gaggcucccaaggggcuaggcc

SEQ ID NO: 231273 - RNA, 22 nt, Human
ugagcaggacucacugcagccu

SEQ ID NO: 231274 - RNA, 22 nt, Human
agagugaaguucaucgugcagc

SEQ ID NO: 231275 - RNA, 22 nt, Human
uggcuccuaaugcugcccagac

SEQ ID NO: 231276 - RNA, 22 nt, Human
guuaucuucccuuugaugauuu

SEQ ID NO: 231277 - RNA, 19 nt, Human
uuuuccuucuauauguuuc

SEQ ID NO: 231278 - RNA, 22 nt, Human
cuggcacaugcucccugagugg

SEQ ID NO: 231279 - RNA, 22 nt, Human
gggcccugggauucagagcaag

SEQ ID NO: 231280 - RNA, 22 nt, Human
uugcuuuacuuugccauucguu

SEQ ID NO: 231281 - RNA, 22 nt, Human
ucuccuggguaaaaggguugau

SEQ ID NO: 231282 - RNA, 22 nt, Human
ggaccaggccagccucccugcg

SEQ ID NO: 231283 - RNA, 22 nt, Human
auggaaauguaacuucugauuc

SEQ ID NO: 231284 - RNA, 22 nt, Human
ucuagauuuggggcaugaaguu

SEQ ID NO: 231285 - RNA, 22 nt, Human
uaguuuuuaaguguacaauuuc

SEQ ID NO: 231286 - RNA, 22 nt, Human
ggagcccuuggcaccuaguagg

SEQ ID NO: 231287 - RNA, 22 nt, Human
ccaggcagaugggccggcuuca

SEQ ID NO: 231288 - RNA, 22 nt, Human
gugcccaguccugccuugacag

SEQ ID NO: 231289 - RNA, 22 nt, Human
cagcuccuguuggucuugagga

SEQ ID NO: 231290 - RNA, 22 nt, Human
agauguaguagugggucuuuua

SEQ ID NO: 231291 - RNA, 22 nt, Human
uacacaugacaguggacugaga

SEQ ID NO: 231292 - RNA, 22 nt, Human
gcaggggaguccacucuaugca

SEQ ID NO: 231293 - RNA, 22 nt, Human
gaggcucauugcauugugcauu

SEQ ID NO: 231294 - RNA, 22 nt, Human
aggcucucacuauccuccuagc

SEQ ID NO: 231295 - RNA, 22 nt, Human
ccuccuucuggggccuucugcu

SEQ ID NO: 231296 - RNA, 22 nt, Human
gccuuguuucauuacacguggu

SEQ ID NO: 231297 - RNA, 23 nt, Human
gcaagcaaggcaggguaaagaga

SEQ ID NO: 231298 - RNA, 22 nt, Human
ucuggaggcaacuaaccuaguu

SEQ ID NO: 231299 - RNA, 19 nt, Human
ggagccagcuguggaaggc

SEQ ID NO: 231300 - RNA, 22 nt, Human
cagcccuuccuucuguuuauac

SEQ ID NO: 231301 - RNA, 22 nt, Human
uuuauuaagaugcgaaugcuga

SEQ ID NO: 231302 - RNA, 22 nt, Human
gcaggccucuaauucaccgcag

SEQ ID NO: 231303 - RNA, 22 nt, Human
cuucagcucuugguaaauguuu

SEQ ID NO: 231304 - RNA, 22 nt, Human
agauguggaacacuagacugcu

SEQ ID NO: 231305 - RNA, 22 nt, Human
cucucugaggcaggccuguggg

SEQ ID NO: 231306 - RNA, 22 nt, Human
ucuggcucuccagugcucuuag

SEQ ID NO: 231307 - RNA, 20 nt, Human
ucuuacaaucguuacaucca

SEQ ID NO: 231308 - RNA, 23 nt, Human
agcacaaaguguuuuccuuguag

SEQ ID NO: 231309 - RNA, 19 nt, Human
cucuuggguggcagaggcc

SEQ ID NO: 231310 - RNA, 18 nt, Human
acugcaggagaggugagg

SEQ ID NO: 231311 - RNA, 22 nt, Human
gugcagcugccgaucagauagg

SEQ ID NO: 231312 - RNA, 22 nt, Human
acagcagaguugaguaguugca

SEQ ID NO: 231313 - RNA, 22 nt, Human
uggacaugaccucgagcgagau

SEQ ID NO: 231314 - RNA, 22 nt, Human
ugggagcugggguuggacgucu

SEQ ID NO: 231315 - RNA, 22 nt, Human
cagauggcugccaagaugggcu

SEQ ID NO: 231316 - RNA, 22 nt, Human
gacauuuauuggauuuuacgag

SEQ ID NO: 231317 - RNA, 22 nt, Human
agacacagucugucuggaggag

SEQ ID NO: 231318 - RNA, 22 nt, Human
guaagccuggaauuuuugacuu

SEQ ID NO: 231319 - RNA, 22 nt, Human
guagcuuccagaaagugucuuu

SEQ ID NO: 231320 - RNA, 22 nt, Human
cagcucuacguuucuaugaauc

SEQ ID NO: 231321 - RNA, 22 nt, Human
caaggccuucgucuccuagcuu

SEQ ID NO: 231322 - RNA, 22 nt, Human
ucuaggaggcacacaaguaguu

SEQ ID NO: 231323 - RNA, 22 nt, Human
uucaggaaucaaccaagucauu

SEQ ID NO: 231324 - RNA, 20 nt, Human
agaaaauguuuucagcugga

SEQ ID NO: 231325 - RNA, 22 nt, Human
ggcagcucugaugaugcucugg

SEQ ID NO: 231326 - RNA, 20 nt, Human
aggaagcugagauguagagg

SEQ ID NO: 231327 - RNA, 22 nt, Human
gaucuagaccagaagcuguugu

SEQ ID NO: 231328 - RNA, 22 nt, Human
caugugguucaaguacuccaca

SEQ ID NO: 231329 - RNA, 22 nt, Human
ggugaggguaaacuaaaacauc

SEQ ID NO: 231330 - RNA, 22 nt, Human
guuuauuagaguuuucugucug

SEQ ID NO: 231331 - RNA, 22 nt, Human
agggauguucauuuuguggcug

SEQ ID NO: 231332 - RNA, 22 nt, Human
acaguuaucuuugaaauagaga

SEQ ID NO: 231333 - RNA, 22 nt, Human
ucaauaauggcaggauaaauuu

SEQ ID NO: 231334 - RNA, 22 nt, Human
gcuggguuuucuuccgggccua

SEQ ID NO: 231335 - RNA, 20 nt, Human
ucccucaguccuggcuuugu

SEQ ID NO: 231336 - RNA, 15 nt, Human
uugcuuuaagacaug

SEQ ID NO: 231337 - RNA, 22 nt, Human
cacauuucuguacuuagguaga

SEQ ID NO: 231338 - RNA, 22 nt, Human
cacagguaauagccuaggcuau

SEQ ID NO: 231339 - RNA, 22 nt, Human
ucaugccaguuaaaggcuguga

SEQ ID NO: 231340 - RNA, 22 nt, Human
ucccaggcugggggccugaagu

SEQ ID NO: 231341 - RNA, 22 nt, Human
cccagcuugcaaauggguugcu

SEQ ID NO: 231342 - RNA, 22 nt, Human
aauaaaaugaacugguagaguu

SEQ ID NO: 231343 - RNA, 22 nt, Human
uauuaugcauaggcaauaaugg

SEQ ID NO: 231344 - RNA, 22 nt, Human
uucagugugaagcuucugaaag

SEQ ID NO: 231345 - RNA, 22 nt, Human
uguacuauuaagaggccuaaau

SEQ ID NO: 231346 - RNA, 22 nt, Human
acucagagccucgagggacugc

SEQ ID NO: 231347 - RNA, 22 nt, Human
agaggccaggcagcccaaggug

SEQ ID NO: 231348 - RNA, 22 nt, Human
gcagagcucuguucuuaucucc

SEQ ID NO: 231349 - RNA, 22 nt, Human
cccucccaagcacucugacaua

SEQ ID NO: 231350 - RNA, 22 nt, Human
agucaggggaucuagacuugaa

SEQ ID NO: 231351 - RNA, 22 nt, Human
uucuggcaucugggggaggccu

SEQ ID NO: 231352 - RNA, 22 nt, Human
cugggcuuguguuagcugacaa

SEQ ID NO: 231353 - RNA, 22 nt, Human
aucuacauaaaacgaauacaua

SEQ ID NO: 231354 - RNA, 22 nt, Human
uauuuaaaauagugcuccagca

SEQ ID NO: 231355 - RNA, 22 nt, Human
uugcagggaccugcagaaagcu

SEQ ID NO: 231356 - RNA, 22 nt, Human
cuuuauguucaguacaaugcuu

SEQ ID NO: 231357 - RNA, 22 nt, Human
gcagccagguuugaggaccacu

SEQ ID NO: 231358 - RNA, 23 nt, Human
cuucucugagcuaggaaugcucu

SEQ ID NO: 231359 - RNA, 21 nt, Human
agugacucugaaccacuugaa

SEQ ID NO: 231360 - RNA, 22 nt, Human
ugcaggagcccuugggcucugg

SEQ ID NO: 231361 - RNA, 22 nt, Human
aaugaccugggugucauuucau

SEQ ID NO: 231362 - RNA, 18 nt, Human
aggaaagaaaggcaggug

SEQ ID NO: 231363 - RNA, 22 nt, Human
auaauggcuugugguguuauuc

SEQ ID NO: 231364 - RNA, 22 nt, Human
aaaucuaguaccuuuuugauua

SEQ ID NO: 231365 - RNA, 22 nt, Human
gucucugugccuucuccccacc

SEQ ID NO: 231366 - RNA, 22 nt, Human
ugcagagaguuagggcccguau

SEQ ID NO: 231367 - RNA, 19 nt, Human
cccagcuugaccaccugcu

SEQ ID NO: 231368 - RNA, 20 nt, Human
ggcugaaaguagaaaguauu

SEQ ID NO: 231369 - RNA, 22 nt, Human
ucaggcacugcuuucugauaug

SEQ ID NO: 231370 - RNA, 22 nt, Human
ugcuucucucuaggaagacgcu

SEQ ID NO: 231371 - RNA, 22 nt, Human
ucucugaauucugaugcaagug

SEQ ID NO: 231372 - RNA, 17 nt, Human
ccugucuuguuucugcc

SEQ ID NO: 231373 - RNA, 22 nt, Human
gcagaguugaugcaaguacuga

SEQ ID NO: 231374 - RNA, 22 nt, Human
ucuuuucuugcauuauugcacu

SEQ ID NO: 231375 - RNA, 22 nt, Human
uaaaugcaagggaaaggcaaga

SEQ ID NO: 231376 - RNA, 21 nt, Human
uugcuguuuucccaaugcagu

SEQ ID NO: 231377 - RNA, 22 nt, Human
gcagagcuaucuucuggauuug

SEQ ID NO: 231378 - RNA, 22 nt, Human
ugcugagguaaccauauccugc

SEQ ID NO: 231379 - RNA, 22 nt, Human
cuggcuggccaugcagcgccag

SEQ ID NO: 231380 - RNA, 22 nt, Human
cuguguagccucaugugggcuu

SEQ ID NO: 231381 - RNA, 22 nt, Human
cuagaaaaauacuuuauuguga

SEQ ID NO: 231382 - RNA, 19 nt, Human
ggagucugagcccagguau

SEQ ID NO: 231383 - RNA, 22 nt, Human
cagcuccucuggccagcccugc

SEQ ID NO: 231384 - RNA, 22 nt, Human
ucagaguuucugauuuaguagg

SEQ ID NO: 231385 - RNA, 22 nt, Human
aggugacaucccggcagcagag

SEQ ID NO: 231386 - RNA, 22 nt, Human
aacagcaguggcaggagaaggc

SEQ ID NO: 231387 - RNA, 22 nt, Human
gacagacuaaauggcuguagga

SEQ ID NO: 231388 - RNA, 21 nt, Human
augaggcaugagaggguuucu

SEQ ID NO: 231389 - RNA, 22 nt, Human
gcagguaagagaggcuggcuuc

SEQ ID NO: 231390 - RNA, 22 nt, Human
cauuugcaagagauaaauguuu

SEQ ID NO: 231391 - RNA, 22 nt, Human
gaauaauagcagaaauuagcag

SEQ ID NO: 231392 - RNA, 22 nt, Human
gcuggagaugcuaugcagaggg

SEQ ID NO: 231393 - RNA, 22 nt, Human
uacacaaugacuuaagauguca

SEQ ID NO: 231394 - RNA, 22 nt, Human
agaauaaaucaaauguccugag

SEQ ID NO: 231395 - RNA, 22 nt, Human
ucuggccuuaucuguccaagcc

SEQ ID NO: 231396 - RNA, 22 nt, Human
cgcuucucuacucccagccagu

SEQ ID NO: 231397 - RNA, 22 nt, Human
aaaaugugcaguuuuuaagcug

SEQ ID NO: 231398 - RNA, 22 nt, Human
cugcaauaguuuagaauaauug

SEQ ID NO: 231399 - RNA, 22 nt, Human
cuaaacuuuuauaacauugaga

SEQ ID NO: 231400 - RNA, 22 nt, Human
gcacaggcuguuggccuucaga

SEQ ID NO: 231401 - RNA, 22 nt, Human
caggcccucugcacccucgucu

SEQ ID NO: 231402 - RNA, 23 nt, Human
acaaugcacuuuaaaugguuccc

SEQ ID NO: 231403 - RNA, 22 nt, Human
acccuggguucccgcagcacca

SEQ ID NO: 231404 - RNA, 22 nt, Human
ugguccuggagaguguuccaua

SEQ ID NO: 231405 - RNA, 22 nt, Human
uuaguucacugcuauaucauca

SEQ ID NO: 231406 - RNA, 22 nt, Human
guucauguggaaauuuaaaaca

SEQ ID NO: 231407 - RNA, 20 nt, Human
uccugcaguuccuaggaggg

SEQ ID NO: 231408 - RNA, 22 nt, Human
ugugaauaccuugaauucauca

SEQ ID NO: 231409 - RNA, 22 nt, Human
aggcuagcuguuucagggcuag

SEQ ID NO: 231410 - RNA, 22 nt, Human
aagcaggagagccugggcgagc

SEQ ID NO: 231411 - RNA, 22 nt, Human
ggaaucuuuuucauaagccuca

SEQ ID NO: 231412 - RNA, 22 nt, Human
aaguuacaguuggaacugugaa

SEQ ID NO: 231413 - RNA, 22 nt, Human
aacuauuuuuggagcuaacucu

SEQ ID NO: 231414 - RNA, 22 nt, Human
gccuacauuucccaguugaaug

SEQ ID NO: 231415 - RNA, 22 nt, Human
ggcucuggggaagcucucuuca

SEQ ID NO: 231416 - RNA, 22 nt, Human
cugugagggucacagccaugcc

SEQ ID NO: 231417 - RNA, 22 nt, Human
uguucacaagcagauguugcuu

SEQ ID NO: 231418 - RNA, 22 nt, Human
aauucaaauuacaauaguuguu

SEQ ID NO: 231419 - RNA, 22 nt, Human
uggaucugguucccugagccuu

SEQ ID NO: 231420 - RNA, 22 nt, Human
acucaucugccauuccuguacc

SEQ ID NO: 231421 - RNA, 20 nt, Human
guguuucaugugauacaaug

SEQ ID NO: 231422 - RNA, 22 nt, Human
cugucuucccgaggcccuggag

SEQ ID NO: 231423 - RNA, 19 nt, Human
ucucaauucuccccacugc

SEQ ID NO: 231424 - RNA, 22 nt, Human
uuggcuuggagaguugaaaugu

SEQ ID NO: 231425 - RNA, 22 nt, Human
aagcaggcaucuuggaggucaa

SEQ ID NO: 231426 - RNA, 22 nt, Human
ugcuggggcucugaccacucca

SEQ ID NO: 231427 - RNA, 17 nt, Human
cagggcugucugccuag

SEQ ID NO: 231428 - RNA, 22 nt, Human
cauccugguuaccccauaguca

SEQ ID NO: 231429 - RNA, 22 nt, Human
guccugugaccugcauccugag

SEQ ID NO: 231430 - RNA, 22 nt, Human
ugcaauuacugggagguuuuau

SEQ ID NO: 231431 - RNA, 22 nt, Human
ugcacuuuaaaaaauggugaug

SEQ ID NO: 231432 - RNA, 22 nt, Human
agugaagguuuacagggccccu

SEQ ID NO: 231433 - RNA, 22 nt, Human
ugguuccucaagcgcuggcggc

SEQ ID NO: 231434 - RNA, 19 nt, Human
uccagacuguccaggcuau

SEQ ID NO: 231435 - RNA, 22 nt, Human
uucaguaaggauaauaaacaga

SEQ ID NO: 231436 - RNA, 22 nt, Human
acacaguuuuucagacagagau

SEQ ID NO: 231437 - RNA, 22 nt, Human
ugaaagcagugauuucuccuuc

SEQ ID NO: 231438 - RNA, 20 nt, Human
gcaguguguaugaauagcug

SEQ ID NO: 231439 - RNA, 22 nt, Human
caguguaucauuagugugauga

SEQ ID NO: 231440 - RNA, 22 nt, Human
ccaggagcagggcuggcugcac

SEQ ID NO: 231441 - RNA, 22 nt, Human
uuuccaauguagaugucucugg

SEQ ID NO: 231442 - RNA, 22 nt, Human
gcacaggcaauagauacagcua

SEQ ID NO: 231443 - RNA, 22 nt, Human
agcccuccucacaucagcgucc

SEQ ID NO: 231444 - RNA, 22 nt, Human
ggaacagacugacuucuugaau

SEQ ID NO: 231445 - RNA, 22 nt, Human
agucugugaaaagauaggaagu

SEQ ID NO: 231446 - RNA, 22 nt, Human
gcucccagcauugcugcugaau

SEQ ID NO: 231447 - RNA, 23 nt, Human
acagagacugccaagauauucuc

SEQ ID NO: 231448 - RNA, 22 nt, Human
ggaaaagacagaauucuagaau

SEQ ID NO: 231449 - RNA, 22 nt, Human
uuauccaagcagaagcugcaca

SEQ ID NO: 231450 - RNA, 23 nt, Human
aaguucaagucacagccugucuu

SEQ ID NO: 231451 - RNA, 22 nt, Human
ccucccuuuuggugucugcaua

SEQ ID NO: 231452 - RNA, 22 nt, Human
aguugcugauucugucugugau

SEQ ID NO: 231453 - RNA, 22 nt, Human
cagaaacuagauuuagacacaa

SEQ ID NO: 231454 - RNA, 20 nt, Human
gcuuggcauaggccacuuga

SEQ ID NO: 231455 - RNA, 22 nt, Human
ucccauggucuauauagaggca

SEQ ID NO: 231456 - RNA, 22 nt, Human
uacuauuuugacaugaaauuga

SEQ ID NO: 231457 - RNA, 22 nt, Human
gacucagugauuugacaugccu

SEQ ID NO: 231458 - RNA, 22 nt, Human
gagcaggaaggccagaaggguc

SEQ ID NO: 231459 - RNA, 22 nt, Human
augcuggggccucagaccagaa

SEQ ID NO: 231460 - RNA, 22 nt, Human
acuuucccucucagaacucuua

SEQ ID NO: 231461 - RNA, 22 nt, Human
uaacaagguggucuugguauuu

SEQ ID NO: 231462 - RNA, 22 nt, Human
uuuaaugugagucccuuucaag

SEQ ID NO: 231463 - RNA, 19 nt, Human
cacagggagaccacauguc

SEQ ID NO: 231464 - RNA, 22 nt, Human
ggcaguggaggacccugugucu

SEQ ID NO: 231465 - RNA, 22 nt, Human
aagaacauugacuaagaggggc

SEQ ID NO: 231466 - RNA, 22 nt, Human
aacauaauguggccaaagucac

SEQ ID NO: 231467 - RNA, 22 nt, Human
augcaaaaguaauugcaauuuu

SEQ ID NO: 231468 - RNA, 22 nt, Human
aaaacaguuuuugcuaacugcu

SEQ ID NO: 231469 - RNA, 22 nt, Human
agggaccagccugcccagggcu

SEQ ID NO: 231470 - RNA, 22 nt, Human
aaauuuaagaagugugugcgug

SEQ ID NO: 231471 - RNA, 22 nt, Human
auucuacaugauagaagggaga

SEQ ID NO: 231472 - RNA, 22 nt, Human
guaggcagugguuggaagagaa

SEQ ID NO: 231473 - RNA, 22 nt, Human
uccaucuggaugguauguguaa

SEQ ID NO: 231474 - RNA, 22 nt, Human
cagaagagaugaaauaguauua

SEQ ID NO: 231475 - RNA, 22 nt, Human
cacuguacccauuuaaauaaau

SEQ ID NO: 231476 - RNA, 22 nt, Human
gagggcuccucacauucucuau

SEQ ID NO: 231477 - RNA, 22 nt, Human
agcuggagcuucaagcagguaa

SEQ ID NO: 231478 - RNA, 21 nt, Human
agcaccaguuuuaugccaggc

SEQ ID NO: 231479 - RNA, 22 nt, Human
uuuggcauagcucuuuguuccu

SEQ ID NO: 231480 - RNA, 22 nt, Human
gagguccaggguggggccugag

SEQ ID NO: 231481 - RNA, 17 nt, Human
ccagaugcccugucucc

SEQ ID NO: 231482 - RNA, 22 nt, Human
aagggcucacccaacucacuuc

SEQ ID NO: 231483 - RNA, 22 nt, Human
uggaauguaaacucugugaggg

SEQ ID NO: 231484 - RNA, 22 nt, Human
ugcccagccaauuuguuauguu

SEQ ID NO: 231485 - RNA, 22 nt, Human
agugacagggaaggauaggauu

SEQ ID NO: 231486 - RNA, 22 nt, Human
cuucccaaguaaauuuguauuu

SEQ ID NO: 231487 - RNA, 22 nt, Human
cugggggcaagcagacagcugu

SEQ ID NO: 231488 - RNA, 22 nt, Human
uauucugugugauauguaaaug

SEQ ID NO: 231489 - RNA, 22 nt, Human
uuaauagugcuaaaccauugac

SEQ ID NO: 231490 - RNA, 22 nt, Human
cagaacugggcucgcucugguu

SEQ ID NO: 231491 - RNA, 22 nt, Human
cccaagggagugccuggucaac

SEQ ID NO: 231492 - RNA, 19 nt, Human
uggcagugugggguaugaa

SEQ ID NO: 231493 - RNA, 22 nt, Human
cucccuugcuucuggcauuuug

SEQ ID NO: 231494 - RNA, 19 nt, Human
ugucucugaaagaugagcu

SEQ ID NO: 231495 - RNA, 22 nt, Human
ccagcaggagagaacauuuccc

SEQ ID NO: 231496 - RNA, 22 nt, Human
ugccaggcugaacagggucuua

SEQ ID NO: 231497 - RNA, 22 nt, Human
guguuacugcuuuuaucuacca

SEQ ID NO: 231498 - RNA, 20 nt, Human
cuguagagcacaaguggagg

SEQ ID NO: 231499 - RNA, 22 nt, Human
acaguaacaaauggccugagga

SEQ ID NO: 231500 - RNA, 22 nt, Human
ucaguccaggggcugugauguc

SEQ ID NO: 231501 - RNA, 22 nt, Human
aaggcauaccugaauguuugug

SEQ ID NO: 231502 - RNA, 22 nt, Human
acaggucuggucugggugggac

SEQ ID NO: 231503 - RNA, 22 nt, Human
uaggaaguagauagguuguucu

SEQ ID NO: 231504 - RNA, 22 nt, Human
ugcuagaaaucugaaacuagca

SEQ ID NO: 231505 - RNA, 22 nt, Human
uguaggauguaaggcaggcauc

SEQ ID NO: 231506 - RNA, 22 nt, Human
cugugugugcuacaggcuucca

SEQ ID NO: 231507 - RNA, 22 nt, Human
aagcucaggaaagagucugguu

SEQ ID NO: 231508 - RNA, 22 nt, Human
caggccuuaguaggugcucccu

SEQ ID NO: 231509 - RNA, 22 nt, Human
uuuccucagaagugucuacuau

SEQ ID NO: 231510 - RNA, 22 nt, Human
cccacucccuacgacacgcucc

SEQ ID NO: 231511 - RNA, 18 nt, Human
caaagcaggugacagugu

SEQ ID NO: 231512 - RNA, 19 nt, Human
uagauacugaugaacucca

SEQ ID NO: 231513 - RNA, 20 nt, Human
agccaggcucaagcuccccc

SEQ ID NO: 231514 - RNA, 18 nt, Human
aagaacugagguccuaga

SEQ ID NO: 231515 - RNA, 22 nt, Human
ugcuagugugugagauguucaa

SEQ ID NO: 231516 - RNA, 22 nt, Human
gagcucugaaaaagcuugccuu

SEQ ID NO: 231517 - RNA, 22 nt, Human
aggcagcauuugaauccagguc

SEQ ID NO: 231518 - RNA, 22 nt, Human
cccagcagccuugucccuucuc

SEQ ID NO: 231519 - RNA, 22 nt, Human
uagggcaguuucauguuaucuu

SEQ ID NO: 231520 - RNA, 22 nt, Human
uacauuaucuuguuaucuuuca

SEQ ID NO: 231521 - RNA, 22 nt, Human
ucugcuguguccccugugcggg

SEQ ID NO: 231522 - RNA, 22 nt, Human
aaguacauauauuuaugauucu

SEQ ID NO: 231523 - RNA, 22 nt, Human
uucucuuauucuggauaugcag

SEQ ID NO: 231524 - RNA, 22 nt, Human
uaacagaaaggggacagaaaua

SEQ ID NO: 231525 - RNA, 22 nt, Human
cacaaaaucuuucucgauuauu

SEQ ID NO: 231526 - RNA, 22 nt, Human
ugaaaauggccugaagaagcaa

SEQ ID NO: 231527 - RNA, 22 nt, Human
aauucccauuugcagaaaauca

SEQ ID NO: 231528 - RNA, 22 nt, Human
cugggcagcuguaucagggagu

SEQ ID NO: 231529 - RNA, 22 nt, Human
uacaucuaucuagaugcucaga

SEQ ID NO: 231530 - RNA, 22 nt, Human
aaaacauguccauacagaaacu

SEQ ID NO: 231531 - RNA, 22 nt, Human
uagacacuguaugagcugggug

SEQ ID NO: 231532 - RNA, 22 nt, Human
uggaaaaucaggggacauugau

SEQ ID NO: 231533 - RNA, 22 nt, Human
ucucugcaugacccaaggcuga

SEQ ID NO: 231534 - RNA, 20 nt, Human
aggaaagccugugugagucu

SEQ ID NO: 231535 - RNA, 17 nt, Human
cagacaggcugucaccc

SEQ ID NO: 231536 - RNA, 22 nt, Human
cacaggcugggaagccuaggcc

SEQ ID NO: 231537 - RNA, 22 nt, Human
cauccugagaggucucucuacc

SEQ ID NO: 231538 - RNA, 20 nt, Human
gcaagcuuauuagugauauu

SEQ ID NO: 231539 - RNA, 20 nt, Human
uccuguccgcgccuugcguc

SEQ ID NO: 231540 - RNA, 22 nt, Human
uucacauugugguucaugugaa

SEQ ID NO: 231541 - RNA, 22 nt, Human
gcagggcaaacccagguguuca

SEQ ID NO: 231542 - RNA, 17 nt, Human
cuccucucuggguuacu

SEQ ID NO: 231543 - RNA, 22 nt, Human
acagagaaaguuccucucaggc

SEQ ID NO: 231544 - RNA, 22 nt, Human
gacacaguuuuucucacggugg

SEQ ID NO: 231545 - RNA, 22 nt, Human
cugcugcauuacucuucucaag

SEQ ID NO: 231546 - RNA, 22 nt, Human
aucaaaguaauuaacacugaga

SEQ ID NO: 231547 - RNA, 23 nt, Human
uuucuucagaagccuugcgaggc

SEQ ID NO: 231548 - RNA, 22 nt, Human
augagacuaccuguaauguggc

SEQ ID NO: 231549 - RNA, 18 nt, Human
uaugugucuguuacaacu

SEQ ID NO: 231550 - RNA, 22 nt, Human
ugggcagaggacagggaagauc

SEQ ID NO: 231551 - RNA, 22 nt, Human
aagguccuuuugcagugugauc

SEQ ID NO: 231552 - RNA, 22 nt, Human
cucucagugccugcccuaggcu

SEQ ID NO: 231553 - RNA, 22 nt, Human
ccaccagagggcagacugugau

SEQ ID NO: 231554 - RNA, 22 nt, Human
gucugccccacaggcucaguug

SEQ ID NO: 231555 - RNA, 22 nt, Human
guagggacaauauguuauuaga

SEQ ID NO: 231556 - RNA, 22 nt, Human
ucugaaagaaagauuuuguuuc

SEQ ID NO: 231557 - RNA, 22 nt, Human
caucuggguucucagauggaua

SEQ ID NO: 231558 - RNA, 22 nt, Human
cugcgugagcgugcccgucuug

SEQ ID NO: 231559 - RNA, 20 nt, Human
agagguucagucuggagaag

SEQ ID NO: 231560 - RNA, 22 nt, Human
ccucugaggugagcccagcugg

SEQ ID NO: 231561 - RNA, 22 nt, Human
ucucagcagccagauccagagc

SEQ ID NO: 231562 - RNA, 22 nt, Human
gacuucugaauuccuaucaggu

SEQ ID NO: 231563 - RNA, 22 nt, Human
ccagugucuucagaguaaaucu

SEQ ID NO: 231564 - RNA, 22 nt, Human
cagaauuuaaguggauuauucu

SEQ ID NO: 231565 - RNA, 22 nt, Human
gaugcugauaauucaugagaag

SEQ ID NO: 231566 - RNA, 22 nt, Human
caaaugcaggucagcagguguc

SEQ ID NO: 231567 - RNA, 22 nt, Human
uacaguguuucccccaggauag

SEQ ID NO: 231568 - RNA, 22 nt, Human
uucuuuuagaauuuccuaaggu

SEQ ID NO: 231569 - RNA, 22 nt, Human
uuggaauaucaugcagaauaaa

SEQ ID NO: 231570 - RNA, 22 nt, Human
auuugccuuucgaaucaacagg

SEQ ID NO: 231571 - RNA, 22 nt, Human
gccucccuguuuccugcuccaa

SEQ ID NO: 231572 - RNA, 22 nt, Human
auauggcagaccaauuagaagc

SEQ ID NO: 231573 - RNA, 22 nt, Human
ucgagcugcacgcccccgagcu

SEQ ID NO: 231574 - RNA, 22 nt, Human
agaauuacauaaauacaugaau

SEQ ID NO: 231575 - RNA, 22 nt, Human
auucaguuucaaucauuguagu

SEQ ID NO: 231576 - RNA, 22 nt, Human
aacagagcauucugcacuacaa

SEQ ID NO: 231577 - RNA, 22 nt, Human
caggagguuguaagagcaggcc

SEQ ID NO: 231578 - RNA, 22 nt, Human
ucaagcaacugaauucuaaaag

SEQ ID NO: 231579 - RNA, 22 nt, Human
cuaaaucuagucuuuacugauu

SEQ ID NO: 231580 - RNA, 22 nt, Human
gacagcaaccucaugagaaacu

SEQ ID NO: 231581 - RNA, 22 nt, Human
gucuggacuuuaucccaagguu

SEQ ID NO: 231582 - RNA, 22 nt, Human
agguacagcaauauaagagguc

SEQ ID NO: 231583 - RNA, 22 nt, Human
gcuuccaaaucuguucaaaaug

SEQ ID NO: 231584 - RNA, 21 nt, Human
aagugguuuagguuaccgggg

SEQ ID NO: 231585 - RNA, 23 nt, Human
aaagugcaguugaggaaucauag

SEQ ID NO: 231586 - RNA, 22 nt, Human
gcagaggguccugugccagcag

SEQ ID NO: 231587 - RNA, 22 nt, Human
uaacuuuaguguaugagguaag

SEQ ID NO: 231588 - RNA, 22 nt, Human
uuaaauuccagccucauaauag

SEQ ID NO: 231589 - RNA, 22 nt, Human
ggucagggggaucugugaggua

SEQ ID NO: 231590 - RNA, 22 nt, Human
auuacauauguuggcaacauuu

SEQ ID NO: 231591 - RNA, 22 nt, Human
gccaucuggcauugcagcaccu

SEQ ID NO: 231592 - RNA, 22 nt, Human
auggccagcccuucccgcagcu

SEQ ID NO: 231593 - RNA, 23 nt, Human
ugucucagacugagggguuuccc

SEQ ID NO: 231594 - RNA, 22 nt, Human
cugacuuuagaacccaaaaagu

SEQ ID NO: 231595 - RNA, 22 nt, Human
augaaauguauucagauaugua

SEQ ID NO: 231596 - RNA, 22 nt, Human
uuggagcccugaggaucuggau

SEQ ID NO: 231597 - RNA, 21 nt, Human
gagcugcaccuugaccuguuu

SEQ ID NO: 231598 - RNA, 22 nt, Human
accugcacagccccagaaugcc

SEQ ID NO: 231599 - RNA, 22 nt, Human
gaggugucaugagggccugcuc

SEQ ID NO: 231600 - RNA, 20 nt, Human
aacacagauaccaaagguug

SEQ ID NO: 231601 - RNA, 22 nt, Human
auguccucggcucugugcugcu

SEQ ID NO: 231602 - RNA, 22 nt, Human
cuguccagcuuggcuccugggg

SEQ ID NO: 231603 - RNA, 22 nt, Human
acauggcuggcaccuuaaauuu

SEQ ID NO: 231604 - RNA, 22 nt, Human
guauccuccccgcuggccuuca

SEQ ID NO: 231605 - RNA, 20 nt, Human
cuuagaaauuuuuacccugg

SEQ ID NO: 231606 - RNA, 22 nt, Human
gcaagcaaauuauuuauaggca

SEQ ID NO: 231607 - RNA, 22 nt, Human
guggccagugggaaugggcuca

SEQ ID NO: 231608 - RNA, 22 nt, Human
gaaugaagcaggucacacaguu

SEQ ID NO: 231609 - RNA, 22 nt, Human
acaggcaggcuucggccagagc

SEQ ID NO: 231610 - RNA, 20 nt, Human
uauaacaguguugggugugu

SEQ ID NO: 231611 - RNA, 22 nt, Human
aauauguuuauaagauaucuuc

SEQ ID NO: 231612 - RNA, 22 nt, Human
aaguuacagauugggagcagag

SEQ ID NO: 231613 - RNA, 22 nt, Human
agcuggugcucaggggcaugga

SEQ ID NO: 231614 - RNA, 20 nt, Human
ccuguucacugcgcaguuuc

SEQ ID NO: 231615 - RNA, 22 nt, Human
uugcugaucugaaacguuacug

SEQ ID NO: 231616 - RNA, 22 nt, Human
aucugguucuucuuaggcauca

SEQ ID NO: 231617 - RNA, 22 nt, Human
agaaucuaaguacacagacaga

SEQ ID NO: 231618 - RNA, 22 nt, Human
gacuuucugauguaaacauuua

SEQ ID NO: 231619 - RNA, 22 nt, Human
guccaugcagucaccuccagcu

SEQ ID NO: 231620 - RNA, 22 nt, Human
uugagucucugccaaaacacaa

SEQ ID NO: 231621 - RNA, 22 nt, Human
cccugccugugggcaucaacau

SEQ ID NO: 231622 - RNA, 19 nt, Human
ugucugcugaugacucuau

SEQ ID NO: 231623 - RNA, 22 nt, Human
aucagaaaucuaggauucagaa

SEQ ID NO: 231624 - RNA, 23 nt, Human
uggcucugagcuuccugguggcc

SEQ ID NO: 231625 - RNA, 22 nt, Human
ucccuggguucccguggaagug

SEQ ID NO: 231626 - RNA, 22 nt, Human
auaauuacauuauacuguuaga

SEQ ID NO: 231627 - RNA, 20 nt, Human
aacuagaaagcacccaugga

SEQ ID NO: 231628 - RNA, 22 nt, Human
aaggcugagggcuguaccuggc

SEQ ID NO: 231629 - RNA, 20 nt, Human
ucagacccagauuagcaggu

SEQ ID NO: 231630 - RNA, 22 nt, Human
uuagauaacaguagaauaucaa

SEQ ID NO: 231631 - RNA, 20 nt, Human
caguggcugauaacaaauua

SEQ ID NO: 231632 - RNA, 22 nt, Human
cugagccagggccacacaugga

SEQ ID NO: 231633 - RNA, 22 nt, Human
aauaccuuuccugccauucacu

SEQ ID NO: 231634 - RNA, 22 nt, Human
caugcagggagcagaggagaca

SEQ ID NO: 231635 - RNA, 22 nt, Human
gccuggcacaggaauuaggagg

SEQ ID NO: 231636 - RNA, 22 nt, Human
cucagauaaucuuugagucuuc

SEQ ID NO: 231637 - RNA, 22 nt, Human
aauguaguucacaauugguacu

SEQ ID NO: 231638 - RNA, 22 nt, Human
cuauuagguuggugcaaaagua

SEQ ID NO: 231639 - RNA, 22 nt, Human
agcugagguuaguauaaaugug

SEQ ID NO: 231640 - RNA, 22 nt, Human
acauuuaacccucagguuucug

SEQ ID NO: 231641 - RNA, 22 nt, Human
aauaggcugagccauuucaagu

SEQ ID NO: 231642 - RNA, 22 nt, Human
agggccugacacccuugccagc

SEQ ID NO: 231643 - RNA, 22 nt, Human
ugucuucaguaaaauacacuau

SEQ ID NO: 231644 - RNA, 22 nt, Human
aagugauuuucuucuuaguuau

SEQ ID NO: 231645 - RNA, 22 nt, Human
ccaaggcuccucagcuggucuu

SEQ ID NO: 231646 - RNA, 22 nt, Human
uaacuguaauauaaauaugagu

SEQ ID NO: 231647 - RNA, 18 nt, Human
gaaagugcggggcagggg

SEQ ID NO: 231648 - RNA, 22 nt, Human
aaaagcaagaggcuggauuaaa

SEQ ID NO: 231649 - RNA, 22 nt, Human
cuccuggaccaccuuguggcca

SEQ ID NO: 231650 - RNA, 23 nt, Human
agcuuggaacaaugcaaauacag

SEQ ID NO: 231651 - RNA, 22 nt, Human
auagauacuggguauggagaug

SEQ ID NO: 231652 - RNA, 22 nt, Human
auuagagguacaaaccuucacu

SEQ ID NO: 231653 - RNA, 22 nt, Human
acagccagugacuggacaagcu

SEQ ID NO: 231654 - RNA, 22 nt, Human
ugguccaguuuagcauugagug

SEQ ID NO: 231655 - RNA, 22 nt, Human
agauacauuaguaguuacuugu

SEQ ID NO: 231656 - RNA, 19 nt, Human
aaggacacaacagagauag

SEQ ID NO: 231657 - RNA, 22 nt, Human
acaucucuucuuaaggcuccag

SEQ ID NO: 231658 - RNA, 22 nt, Human
aaugcacuuaguaugaaugccu

SEQ ID NO: 231659 - RNA, 22 nt, Human
cauuuguugggacaaugaaaag

SEQ ID NO: 231660 - RNA, 22 nt, Human
gucacaaaggugagggacauga

SEQ ID NO: 231661 - RNA, 22 nt, Human
ugaauagauuuuuaacauauaa

SEQ ID NO: 231662 - RNA, 22 nt, Human
ugugcagcaaaauagaaucuuu

SEQ ID NO: 231663 - RNA, 22 nt, Human
cucucagggacccagccagccu

SEQ ID NO: 231664 - RNA, 22 nt, Human
ccugagaaauagcaucauuuuu

SEQ ID NO: 231665 - RNA, 22 nt, Human
agguuccaucaccugcagugga

SEQ ID NO: 231666 - RNA, 22 nt, Human
acauucaaaaagcaucugucac

SEQ ID NO: 231667 - RNA, 22 nt, Human
ucucugagggagauggccugcc

SEQ ID NO: 231668 - RNA, 22 nt, Human
cagucccuaguggagcucacag

SEQ ID NO: 231669 - RNA, 22 nt, Human
ccuuccuuugcaucauuucuag

SEQ ID NO: 231670 - RNA, 21 nt, Human
ugacugaggcuucuucacaca

SEQ ID NO: 231671 - RNA, 22 nt, Human
guccuuucuuaaauuccugcuu

SEQ ID NO: 231672 - RNA, 22 nt, Human
uugguauuuccucaggcauguc

SEQ ID NO: 231673 - RNA, 22 nt, Human
gcuccuucaggugguagcuguu

SEQ ID NO: 231674 - RNA, 22 nt, Human
ggcgccagcacugcagcgccuc

SEQ ID NO: 231675 - RNA, 22 nt, Human
cagaggcugacccugcuguugu

SEQ ID NO: 231676 - RNA, 22 nt, Human
aaacugaauucccaagggcaug

SEQ ID NO: 231677 - RNA, 22 nt, Human
ucaggaaggagcuggccugcca

SEQ ID NO: 231678 - RNA, 22 nt, Human
aauauccagguagaugucuucu

SEQ ID NO: 231679 - RNA, 22 nt, Human
gaugugucuauucaacaugaaa

SEQ ID NO: 231680 - RNA, 16 nt, Human
aaggaaugucauucug

SEQ ID NO: 231681 - RNA, 22 nt, Human
cccaaggccuucaagccagcuc

SEQ ID NO: 231682 - RNA, 22 nt, Human
aguauaauuuacauuugguauu

SEQ ID NO: 231683 - RNA, 22 nt, Human
cuaauuauguuguuauaaucaa

SEQ ID NO: 231684 - RNA, 21 nt, Human
agugccaguagguauggagga

SEQ ID NO: 231685 - RNA, 22 nt, Human
gugucugcacauaggaucucaa

SEQ ID NO: 231686 - RNA, 18 nt, Human
gccugccaacuccugauc

SEQ ID NO: 231687 - RNA, 22 nt, Human
augaggagcuguuuuaacugcu

SEQ ID NO: 231688 - RNA, 22 nt, Human
ggcugccuucagacuccagcuu

SEQ ID NO: 231689 - RNA, 22 nt, Human
ugcuuugccugcuuugacucau

SEQ ID NO: 231690 - RNA, 22 nt, Human
ugcccuguuccugccuccagcu

SEQ ID NO: 231691 - RNA, 22 nt, Human
uacauguuuacuccaagucagg

SEQ ID NO: 231692 - RNA, 22 nt, Human
gggguuaacaguauugcucaug

SEQ ID NO: 231693 - RNA, 22 nt, Human
ucacuaagugccgaguuuaguu

SEQ ID NO: 231694 - RNA, 22 nt, Human
acacaucuuagacugaaauaug

SEQ ID NO: 231695 - RNA, 18 nt, Human
caggucugucugccuccc

SEQ ID NO: 231696 - RNA, 22 nt, Human
guauucauuuauuuacucaucc

SEQ ID NO: 231697 - RNA, 22 nt, Human
aauaacuuguaugguuauucca

SEQ ID NO: 231698 - RNA, 22 nt, Human
ggacauguuccuuuucaucuuu

SEQ ID NO: 231699 - RNA, 21 nt, Human
ggcugguguuuagcugugaua

SEQ ID NO: 231700 - RNA, 22 nt, Human
guuguuuuuguucucuauagcu

SEQ ID NO: 231701 - RNA, 22 nt, Human
gaaugauaaauggaagcagcau

SEQ ID NO: 231702 - RNA, 22 nt, Human
ucuuguuaucaggaaaacagua

SEQ ID NO: 231703 - RNA, 19 nt, Human
ugcaaauguaggaagaaua

SEQ ID NO: 231704 - RNA, 22 nt, Human
ggccucagggucacucuguaga

SEQ ID NO: 231705 - RNA, 17 nt, Human
agccagcaguagcuggu

SEQ ID NO: 231706 - RNA, 18 nt, Human
ggcaggggugaaccacag

SEQ ID NO: 231707 - RNA, 22 nt, Human
ggaaaaguguuaagguguugau

SEQ ID NO: 231708 - RNA, 22 nt, Human
aguggcuguucauuuuacacaa

SEQ ID NO: 231709 - RNA, 22 nt, Human
acugcccuggcaccacacaugc

SEQ ID NO: 231710 - RNA, 21 nt, Human
agagcugguagguagguaggu

SEQ ID NO: 231711 - RNA, 19 nt, Human
ugguggcaaugucagcuaa

SEQ ID NO: 231712 - RNA, 22 nt, Human
cagguggggagaguguggagca

SEQ ID NO: 231713 - RNA, 21 nt, Human
ccugggagaucagcugccuuc

SEQ ID NO: 231714 - RNA, 22 nt, Human
ugaauagauggugacaguauga

SEQ ID NO: 231715 - RNA, 20 nt, Human
gccugggauuauccacuggu

SEQ ID NO: 231716 - RNA, 22 nt, Human
gccacuguugcuccucaggaaa

SEQ ID NO: 231717 - RNA, 22 nt, Human
uggagcugaggggaaugcugag

SEQ ID NO: 231718 - RNA, 22 nt, Human
aaagccagugguaugagagaaa

SEQ ID NO: 231719 - RNA, 22 nt, Human
agcaaaguuaagguuucucuuu

SEQ ID NO: 231720 - RNA, 22 nt, Human
aagcaaaggaaagcugacuuuu

SEQ ID NO: 231721 - RNA, 22 nt, Human
acauagaacuucgaugucuuuu

SEQ ID NO: 231722 - RNA, 22 nt, Human
ugagcagauuuguucuaggggu

SEQ ID NO: 231723 - RNA, 22 nt, Human
gcugccuucaguucugauucau

SEQ ID NO: 231724 - RNA, 22 nt, Human
uaugugaagagauuaaaaaaua

SEQ ID NO: 231725 - RNA, 22 nt, Human
caguguauaaacuuuaacauag

SEQ ID NO: 231726 - RNA, 22 nt, Human
agauggucuaguugaaccauau

SEQ ID NO: 231727 - RNA, 22 nt, Human
uucugugugucucagcaagcug

SEQ ID NO: 231728 - RNA, 22 nt, Human
ucacucugggcccuacugggcu

SEQ ID NO: 231729 - RNA, 22 nt, Human
aggucagguaucagcagguauu

SEQ ID NO: 231730 - RNA, 22 nt, Human
cccaggcuggagggcaguguca

SEQ ID NO: 231731 - RNA, 21 nt, Human
cugaggcagcacagcuaguca

SEQ ID NO: 231732 - RNA, 22 nt, Human
uuucuguauuuugucauaaccu

SEQ ID NO: 231733 - RNA, 22 nt, Human
uuacuuuggauggucaagaaag

SEQ ID NO: 231734 - RNA, 22 nt, Human
uucuucauggguucuuuuagga

SEQ ID NO: 231735 - RNA, 22 nt, Human
ugccugcugcuaagcucuuugu

SEQ ID NO: 231736 - RNA, 21 nt, Human
gaaggagaaagcaagugcugc

SEQ ID NO: 231737 - RNA, 22 nt, Human
uccagggacagcgcuggagcua

SEQ ID NO: 231738 - RNA, 22 nt, Human
gggagugguccuuuccuaucug

SEQ ID NO: 231739 - RNA, 21 nt, Human
cccagagccuagggagggcac

SEQ ID NO: 231740 - RNA, 22 nt, Human
aguucaaagcugcaguaaugga

SEQ ID NO: 231741 - RNA, 22 nt, Human
acagcucucccucagagaaaug

SEQ ID NO: 231742 - RNA, 22 nt, Human
uuccuggcacccuggacccggc

SEQ ID NO: 231743 - RNA, 22 nt, Human
cuuuauuguccuucuuaggugg

SEQ ID NO: 231744 - RNA, 23 nt, Human
uggcauuucuauacuggcaagug

SEQ ID NO: 231745 - RNA, 22 nt, Human
agucacaugaguuucucuuuau

SEQ ID NO: 231746 - RNA, 22 nt, Human
uaucuagauuucuuucucugug

SEQ ID NO: 231747 - RNA, 22 nt, Human
auuuagagugaaacauuaugca

SEQ ID NO: 231748 - RNA, 22 nt, Human
aagcacagacucccucugagug

SEQ ID NO: 231749 - RNA, 22 nt, Human
ccugugaccacucugguucugc

SEQ ID NO: 231750 - RNA, 22 nt, Human
cauggcucacaggaugggcuag

SEQ ID NO: 231751 - RNA, 22 nt, Human
gcucucugccauaugaggauac

SEQ ID NO: 231752 - RNA, 22 nt, Human
cggcuucugcccauucaguccu

SEQ ID NO: 231753 - RNA, 22 nt, Human
aaagccaagcugggaaggcagg

SEQ ID NO: 231754 - RNA, 22 nt, Human
uuuggaaaguguacaaauuuga

SEQ ID NO: 231755 - RNA, 22 nt, Human
ugcaggcucaccugccagggcc

SEQ ID NO: 231756 - RNA, 22 nt, Human
ggugggcaggcgaggcccaggu

SEQ ID NO: 231757 - RNA, 22 nt, Human
aucuccaggauuuucacacuca

SEQ ID NO: 231758 - RNA, 22 nt, Human
auucaacauauucugaguaaaa

SEQ ID NO: 231759 - RNA, 22 nt, Human
aaacucuuuugcauauuagagg

SEQ ID NO: 231760 - RNA, 22 nt, Human
agcgcugugggcgugcgaggag

SEQ ID NO: 231761 - RNA, 22 nt, Human
ugggccucaucuucaaugaguc

SEQ ID NO: 231762 - RNA, 22 nt, Human
caaauaagcaauuccauucuuc

SEQ ID NO: 231763 - RNA, 22 nt, Human
ggagcugaguucuucagccggg

SEQ ID NO: 231764 - RNA, 22 nt, Human
ccagcuccgggaguugcugcug

SEQ ID NO: 231765 - RNA, 22 nt, Human
caccugggcuaaacuaugcagg

SEQ ID NO: 231766 - RNA, 22 nt, Human
acagcagagugugagauagcca

SEQ ID NO: 231767 - RNA, 22 nt, Human
auccugaaaacuuacgaagugg

SEQ ID NO: 231768 - RNA, 22 nt, Human
aaaugccucauuuucucucacu

SEQ ID NO: 231769 - RNA, 22 nt, Human
auucaagauuaauucuauguca

SEQ ID NO: 231770 - RNA, 22 nt, Human
uccugagcugccgcaucagcag

SEQ ID NO: 231771 - RNA, 22 nt, Human
cugcucagucauguuggauugu

SEQ ID NO: 231772 - RNA, 22 nt, Human
cugcaucuuagucaaaaucugu

SEQ ID NO: 231773 - RNA, 22 nt, Human
gaggcuguaacuugggcacugg

SEQ ID NO: 231774 - RNA, 21 nt, Human
auuuuguacauagaauuuguc

SEQ ID NO: 231775 - RNA, 22 nt, Human
aagaaaugugaauauugaauag

SEQ ID NO: 231776 - RNA, 22 nt, Human
agagggaaauccaggagugcuu

SEQ ID NO: 231777 - RNA, 22 nt, Human
ucuuccagcccuucuaauggua

SEQ ID NO: 231778 - RNA, 22 nt, Human
ucucuguauucuucguaaugcc

SEQ ID NO: 231779 - RNA, 22 nt, Human
uagaaacuacuagaauaagaga

SEQ ID NO: 231780 - RNA, 22 nt, Human
gucccagcuucccacuagcagc

SEQ ID NO: 231781 - RNA, 22 nt, Human
ccagcccugucaccaacuggag

SEQ ID NO: 231782 - RNA, 22 nt, Human
ucagguguggaccgaggucaga

SEQ ID NO: 231783 - RNA, 22 nt, Human
cugagaggugacagcgugcugg

SEQ ID NO: 231784 - RNA, 22 nt, Human
ugacaauucauuauaucuacag

SEQ ID NO: 231785 - RNA, 22 nt, Human
ggagaggagcuauugggggcuc

SEQ ID NO: 231786 - RNA, 22 nt, Human
ucagggcauccauugccuguug

SEQ ID NO: 231787 - RNA, 22 nt, Human
acaugccaucuuugucaggagu

SEQ ID NO: 231788 - RNA, 22 nt, Human
auacacaugcacacaugugugu

SEQ ID NO: 231789 - RNA, 23 nt, Human
uugaggcaaacauguaaguagga

SEQ ID NO: 231790 - RNA, 22 nt, Human
gauuguaauucuacuuuccgcu

SEQ ID NO: 231791 - RNA, 22 nt, Human
guuccucaguuguaaaaaaugu

SEQ ID NO: 231792 - RNA, 22 nt, Human
agcccuugguauuuuccgaucc

SEQ ID NO: 231793 - RNA, 22 nt, Human
ucacagaaucucugauaagucu

SEQ ID NO: 231794 - RNA, 22 nt, Human
ccaggggccugugaaggugccc

SEQ ID NO: 231795 - RNA, 22 nt, Human
ggcccugcgauuagguggcagg

SEQ ID NO: 231796 - RNA, 22 nt, Human
cagcuugugcaaagguccuggg

SEQ ID NO: 231797 - RNA, 22 nt, Human
aaauucuuuggccuacuuugaa

SEQ ID NO: 231798 - RNA, 22 nt, Human
cuguuuauuacacuggauagca

SEQ ID NO: 231799 - RNA, 22 nt, Human
cacugucuucaguuucacugca

SEQ ID NO: 231800 - RNA, 22 nt, Human
ccugggagugugccaucucugu

SEQ ID NO: 231801 - RNA, 22 nt, Human
cuuccauacagacaaugcaaug

SEQ ID NO: 231802 - RNA, 22 nt, Human
agccuugaguucaagugcuggc

SEQ ID NO: 231803 - RNA, 18 nt, Human
agcugcuugcaggccuuc

SEQ ID NO: 231804 - RNA, 22 nt, Human
ucaguagcagaaagcaaugagu

SEQ ID NO: 231805 - RNA, 22 nt, Human
uucaguuuucccuccugcaggu

SEQ ID NO: 231806 - RNA, 22 nt, Human
auuauguauuugguauaguuug

SEQ ID NO: 231807 - RNA, 22 nt, Human
acagguguccaacauuuaccuu

SEQ ID NO: 231808 - RNA, 21 nt, Human
agaauucuuaaguauucuaau

SEQ ID NO: 231809 - RNA, 22 nt, Human
gccugggaaagaguagggaaau

SEQ ID NO: 231810 - RNA, 22 nt, Human
gucuguuaccuccaagaccauu

SEQ ID NO: 231811 - RNA, 22 nt, Human
gcuccaguggacugggggaggc

SEQ ID NO: 231812 - RNA, 22 nt, Human
gccagcugcuucuccagaauuu

SEQ ID NO: 231813 - RNA, 18 nt, Human
gcagcuuuugauucaccc

SEQ ID NO: 231814 - RNA, 22 nt, Human
gcuggguuuccagcaggcagga

SEQ ID NO: 231815 - RNA, 22 nt, Human
agucucuuuaaucacagugucu

SEQ ID NO: 231816 - RNA, 22 nt, Human
gugcuuuaguucuugcaacugg

SEQ ID NO: 231817 - RNA, 22 nt, Human
acccccacggaaggccguacgc

SEQ ID NO: 231818 - RNA, 22 nt, Human
ucagugucccgucucuuaacuc

SEQ ID NO: 231819 - RNA, 22 nt, Human
uuacagagggcuucucugaacu

SEQ ID NO: 231820 - RNA, 22 nt, Human
uaaccauauuuuccauuaaguu

SEQ ID NO: 231821 - RNA, 22 nt, Human
acaaaaguguaggaauuccuua

SEQ ID NO: 231822 - RNA, 22 nt, Human
ugcagugguugagagcccagac

SEQ ID NO: 231823 - RNA, 22 nt, Human
cugagaggcggagguugcagug

SEQ ID NO: 231824 - RNA, 22 nt, Human
ugauucaagccaccacauacug

SEQ ID NO: 231825 - RNA, 22 nt, Human
uacauguauguguuaauaucug

SEQ ID NO: 231826 - RNA, 22 nt, Human
ugcagcagagugggccugggug

SEQ ID NO: 231827 - RNA, 22 nt, Human
gcaggaguguauuugcauguaa

SEQ ID NO: 231828 - RNA, 22 nt, Human
uguucccacaccagccucagcc

SEQ ID NO: 231829 - RNA, 22 nt, Human
ucuuuugugauucuucaguuac

SEQ ID NO: 231830 - RNA, 22 nt, Human
uacuucuggauauucagaacuu

SEQ ID NO: 231831 - RNA, 22 nt, Human
guuguaaauacaguacugaaac

SEQ ID NO: 231832 - RNA, 22 nt, Human
ucaggcagaccaccgugggcag

SEQ ID NO: 231833 - RNA, 22 nt, Human
uuguuucuuugaaguuucuaga

SEQ ID NO: 231834 - RNA, 22 nt, Human
agagcuuuugggaauucaggua

SEQ ID NO: 231835 - RNA, 22 nt, Human
auucuucauuguugauucaugu

SEQ ID NO: 231836 - RNA, 21 nt, Human
uucucagaucgaguagugaga

SEQ ID NO: 231837 - RNA, 20 nt, Human
cucucccagcacagcuuccu

SEQ ID NO: 231838 - RNA, 22 nt, Human
ugaaggcaacugagaaaaagca

SEQ ID NO: 231839 - RNA, 22 nt, Human
cugcccaggaaggagaggaugg

SEQ ID NO: 231840 - RNA, 22 nt, Human
ggaaggcagaggugucgugggg

SEQ ID NO: 231841 - RNA, 22 nt, Human
auuucuguauccugcugucaga

SEQ ID NO: 231842 - RNA, 22 nt, Human
ggucuggccucgggcaccccca

SEQ ID NO: 231843 - RNA, 22 nt, Human
guucuucagaggggaaagaacc

SEQ ID NO: 231844 - RNA, 22 nt, Human
uaaauguuuagucuuauuuggg

SEQ ID NO: 231845 - RNA, 22 nt, Human
agcucagagauaaucaagagac

SEQ ID NO: 231846 - RNA, 22 nt, Human
gacauuuacugaauacugauua

SEQ ID NO: 231847 - RNA, 22 nt, Human
uuuugucuaagaacuuugcaaa

SEQ ID NO: 231848 - RNA, 22 nt, Human
uccugcagaccucagucagguc

SEQ ID NO: 231849 - RNA, 22 nt, Human
aaauugcagaugcuaaaugacu

SEQ ID NO: 231850 - RNA, 22 nt, Human
aaucucagcucaugcaauucca

SEQ ID NO: 231851 - RNA, 22 nt, Human
ccucuggggugagugggccacu

SEQ ID NO: 231852 - RNA, 22 nt, Human
cugggaggcacuauucaggagg

SEQ ID NO: 231853 - RNA, 22 nt, Human
gaauuauaaacuagugacuuca

SEQ ID NO: 231854 - RNA, 17 nt, Human
gcacugaacaauccugu

SEQ ID NO: 231855 - RNA, 22 nt, Human
ucaggccagcaccaucccuauc

SEQ ID NO: 231856 - RNA, 23 nt, Human
ccugccuguucuaacuccauuuc

SEQ ID NO: 231857 - RNA, 22 nt, Human
ccagcccucacugaggccucuc

SEQ ID NO: 231858 - RNA, 22 nt, Human
augcuuguacuaaaaaaauauu

SEQ ID NO: 231859 - RNA, 22 nt, Human
agaugguggacuaucugacuug

SEQ ID NO: 231860 - RNA, 22 nt, Human
uaaaaaacauuacucuguccug

SEQ ID NO: 231861 - RNA, 22 nt, Human
caggcuugugucucagcugcag

SEQ ID NO: 231862 - RNA, 22 nt, Human
agcuggcuucucugcagacauu

SEQ ID NO: 231863 - RNA, 18 nt, Human
caaauucagugcuggaag

SEQ ID NO: 231864 - RNA, 22 nt, Human
aagggcccauucucucagaaaa

SEQ ID NO: 231865 - RNA, 22 nt, Human
acggaaaacccugagcaaacuu

SEQ ID NO: 231866 - RNA, 22 nt, Human
uuuaaucauaagaaggaaaaua

SEQ ID NO: 231867 - RNA, 22 nt, Human
auucuacaacccaauaauaauu

SEQ ID NO: 231868 - RNA, 22 nt, Human
ucucagcaacgauccggaguaa

SEQ ID NO: 231869 - RNA, 22 nt, Human
gcucucugguuccagucaggaa

SEQ ID NO: 231870 - RNA, 22 nt, Human
aaguaagucuuacauucacauu

SEQ ID NO: 231871 - RNA, 22 nt, Human
uuccucuguaugcuuugcugcu

SEQ ID NO: 231872 - RNA, 22 nt, Human
augccaagcucuaucccugacc

SEQ ID NO: 231873 - RNA, 22 nt, Human
uggauuauuguaagacaaagua

SEQ ID NO: 231874 - RNA, 22 nt, Human
ucugagagcaucacugggguac

SEQ ID NO: 231875 - RNA, 22 nt, Human
cucagaaaggugccauuuaugu

SEQ ID NO: 231876 - RNA, 22 nt, Human
agagcccugaagcagagcuaaa

SEQ ID NO: 231877 - RNA, 22 nt, Human
gggugcugaggaagacagcagg

SEQ ID NO: 231878 - RNA, 22 nt, Human
cauaauuaaauucugggcaaga

SEQ ID NO: 231879 - RNA, 22 nt, Human
auuccaaagacagaagcagcug

SEQ ID NO: 231880 - RNA, 22 nt, Human
ccaaagucagugcucagucguc

SEQ ID NO: 231881 - RNA, 22 nt, Human
cagugggacaugggcacugggc

SEQ ID NO: 231882 - RNA, 21 nt, Human
uagagcuuggcacagaguaga

SEQ ID NO: 231883 - RNA, 22 nt, Human
ugcuucucccaaccagggccug

SEQ ID NO: 231884 - RNA, 22 nt, Human
uacuagaagcuguaauuuuuca

SEQ ID NO: 231885 - RNA, 22 nt, Human
gagacagcuuaauuggugguca

SEQ ID NO: 231886 - RNA, 22 nt, Human
cccccagaugcgagccauagcc

SEQ ID NO: 231887 - RNA, 22 nt, Human
ucaggcuuggugcuccagugcc

SEQ ID NO: 231888 - RNA, 22 nt, Human
ccugugccauccugagcauccc

SEQ ID NO: 231889 - RNA, 22 nt, Human
accagaggaagggaaucucaag

SEQ ID NO: 231890 - RNA, 22 nt, Human
gcugggacggcucaguaagaag

SEQ ID NO: 231891 - RNA, 20 nt, Human
ugcacagacaaugagcccag

SEQ ID NO: 231892 - RNA, 22 nt, Human
aucuccagaauggcuuguuaau

SEQ ID NO: 231893 - RNA, 22 nt, Human
ucuggcuuucucagcauggcau

SEQ ID NO: 231894 - RNA, 22 nt, Human
uccaggaacucuugauggugau

SEQ ID NO: 231895 - RNA, 22 nt, Human
ugccaggccaaugaaggcaggg

SEQ ID NO: 231896 - RNA, 21 nt, Human
aggaccuagaaaagugccuag

SEQ ID NO: 231897 - RNA, 22 nt, Human
ucuucagacuccaaauguuuua

SEQ ID NO: 231898 - RNA, 22 nt, Human
ugaaaucaucugccaauaaguu

SEQ ID NO: 231899 - RNA, 22 nt, Human
uuguacagauuuuccucggucu

SEQ ID NO: 231900 - RNA, 17 nt, Human
caggaaaauaugaguga

SEQ ID NO: 231901 - RNA, 20 nt, Human
caaggcuucuuugauggggu

SEQ ID NO: 231902 - RNA, 19 nt, Human
gccaggcucuuauucugug

SEQ ID NO: 231903 - RNA, 22 nt, Human
ucucaaaguagcucccacagau

SEQ ID NO: 231904 - RNA, 22 nt, Human
agcaguuauauuacucucaggu

SEQ ID NO: 231905 - RNA, 22 nt, Human
cucagccccaauuugcccucuu

SEQ ID NO: 231906 - RNA, 22 nt, Human
caucagugaaagugaauguucu

SEQ ID NO: 231907 - RNA, 22 nt, Human
auguacauacugcauuuucaaa

SEQ ID NO: 231908 - RNA, 22 nt, Human
uuucucugaggcuggccucccu

SEQ ID NO: 231909 - RNA, 22 nt, Human
uuuacagucugucuagcaaugu

SEQ ID NO: 231910 - RNA, 22 nt, Human
ugcucccagggacucuggcugg

SEQ ID NO: 231911 - RNA, 22 nt, Human
ggcagguggccaagugucuaag

SEQ ID NO: 231912 - RNA, 23 nt, Human
cacagguguuucaucuucucagu

SEQ ID NO: 231913 - RNA, 22 nt, Human
acccacccuacuagcagugucc

SEQ ID NO: 231914 - RNA, 22 nt, Human
cgguccagagcuaguucauugc

SEQ ID NO: 231915 - RNA, 22 nt, Human
cccacacucugagaaaugcuga

SEQ ID NO: 231916 - RNA, 22 nt, Human
agcugcugcggaaagaugccac

SEQ ID NO: 231917 - RNA, 22 nt, Human
uaucuagagcagugguucucaa

SEQ ID NO: 231918 - RNA, 22 nt, Human
uuugcugaauagauuguaaacu

SEQ ID NO: 231919 - RNA, 22 nt, Human
ugguuacauauccuuuggagcc

SEQ ID NO: 231920 - RNA, 22 nt, Human
ccuccagcauuacuggcccaug

SEQ ID NO: 231921 - RNA, 22 nt, Human
uagaauccaccuacacaagaga

SEQ ID NO: 231922 - RNA, 22 nt, Human
ggucagagggugggcugccugu

SEQ ID NO: 231923 - RNA, 22 nt, Human
acauuuuaauaugcuuagugug

SEQ ID NO: 231924 - RNA, 22 nt, Human
ucugcaggucacgcuccagccu

SEQ ID NO: 231925 - RNA, 22 nt, Human
agacagacugguuugaauuggu

SEQ ID NO: 231926 - RNA, 23 nt, Human
ugagcaucacaggagaaccaggc

SEQ ID NO: 231927 - RNA, 20 nt, Human
agggccugcucugugguguc

SEQ ID NO: 231928 - RNA, 22 nt, Human
ccgccaggauauuguggcuuuu

SEQ ID NO: 231929 - RNA, 22 nt, Human
aaacacuggcaauuucaugcac

SEQ ID NO: 231930 - RNA, 22 nt, Human
auuauuguacuuucaauaaggu

SEQ ID NO: 231931 - RNA, 22 nt, Human
cuuguuuauuaugcacuguaga

SEQ ID NO: 231932 - RNA, 22 nt, Human
caggcacaagaucggcuagaua

SEQ ID NO: 231933 - RNA, 22 nt, Human
ugaacagauggcccagcagagg

SEQ ID NO: 231934 - RNA, 22 nt, Human
agcaugcugguguucauggcag

SEQ ID NO: 231935 - RNA, 22 nt, Human
ucucagaacacccuucuauggu

SEQ ID NO: 231936 - RNA, 22 nt, Human
agcagggggccacagucacagc

SEQ ID NO: 231937 - RNA, 22 nt, Human
cacagcauaaugaaauauacuu

SEQ ID NO: 231938 - RNA, 22 nt, Human
uggccugggccggcagauauac

SEQ ID NO: 231939 - RNA, 22 nt, Human
ggcuccuggcaucuggugggua

SEQ ID NO: 231940 - RNA, 19 nt, Human
agucugucugcuuucccuc

SEQ ID NO: 231941 - RNA, 22 nt, Human
agcugcaaguguugccuccuac

SEQ ID NO: 231942 - RNA, 22 nt, Human
auuuugcugugguacauuagga

SEQ ID NO: 231943 - RNA, 22 nt, Human
uaguuauauccagucuuuaaaa

SEQ ID NO: 231944 - RNA, 22 nt, Human
uacaagugcuagcagauauugu

SEQ ID NO: 231945 - RNA, 22 nt, Human
gcccaagccgccuuccagagac

SEQ ID NO: 231946 - RNA, 22 nt, Human
augucacagcaggaguauucuu

SEQ ID NO: 231947 - RNA, 22 nt, Human
uccaggauugucagccagaagg

SEQ ID NO: 231948 - RNA, 22 nt, Human
gucuuucuaugaugaacuguug

SEQ ID NO: 231949 - RNA, 22 nt, Human
uggcaauuggcaauuucguaug

SEQ ID NO: 231950 - RNA, 22 nt, Human
gcccagugguaaaagcaggccu

SEQ ID NO: 231951 - RNA, 22 nt, Human
ugggcccugacuucaagcaucc

SEQ ID NO: 231952 - RNA, 18 nt, Human
cagaugagaugcaaucuc

SEQ ID NO: 231953 - RNA, 22 nt, Human
agcugccaggccccugagaacc

SEQ ID NO: 231954 - RNA, 22 nt, Human
cucccuggaggcccagaccugg

SEQ ID NO: 231955 - RNA, 22 nt, Human
aaggcagcucagcucauggcag

SEQ ID NO: 231956 - RNA, 22 nt, Human
agcuguggaagacugucagggu

SEQ ID NO: 231957 - RNA, 22 nt, Human
uggccugauacuuccagaguuc

SEQ ID NO: 231958 - RNA, 19 nt, Human
uauucuguuaaccuuuguc

SEQ ID NO: 231959 - RNA, 22 nt, Human
cuucugagauguuguuuuacag

SEQ ID NO: 231960 - RNA, 23 nt, Human
aggacugcucacuugaggcuucc

SEQ ID NO: 231961 - RNA, 22 nt, Human
cugucauuguacauguuauaca

SEQ ID NO: 231962 - RNA, 22 nt, Human
ugggaugauagguaaguaauua

SEQ ID NO: 231963 - RNA, 22 nt, Human
uuuuuuaucuaugguaguacca

SEQ ID NO: 231964 - RNA, 22 nt, Human
gcagggcuccccaggcccgagg

SEQ ID NO: 231965 - RNA, 22 nt, Human
cugagcucagucccagcucuac

SEQ ID NO: 231966 - RNA, 22 nt, Human
gcugaaaugccuuguaaauauu

SEQ ID NO: 231967 - RNA, 22 nt, Human
aagcugucaggagguuaccuuu

SEQ ID NO: 231968 - RNA, 22 nt, Human
ugggcugcugucugcacaugcu

SEQ ID NO: 231969 - RNA, 22 nt, Human
aguuagcaucuccuccagucua

SEQ ID NO: 231970 - RNA, 22 nt, Human
gggcucugaaucccaggucugc

SEQ ID NO: 231971 - RNA, 22 nt, Human
ugacagggggcagagguggcug

SEQ ID NO: 231972 - RNA, 22 nt, Human
ugaauaugugacuuugauuuca

SEQ ID NO: 231973 - RNA, 19 nt, Human
agcagcuguagauagacac

SEQ ID NO: 231974 - RNA, 22 nt, Human
gcaccagccugagccucuugca

SEQ ID NO: 231975 - RNA, 22 nt, Human
gugcagggcagccgaaugggcu

SEQ ID NO: 231976 - RNA, 22 nt, Human
agagcuuuguuugauugucaga

SEQ ID NO: 231977 - RNA, 22 nt, Human
ccagagcugcauccagcagguu

SEQ ID NO: 231978 - RNA, 22 nt, Human
ggagcugugcagugacuacaga

SEQ ID NO: 231979 - RNA, 22 nt, Human
ggaagaaaaugggcaacaggug

SEQ ID NO: 231980 - RNA, 22 nt, Human
ucuagaaaguacuagagcuggu

SEQ ID NO: 231981 - RNA, 22 nt, Human
aaacacugaagaccuaucuggu

SEQ ID NO: 231982 - RNA, 22 nt, Human
gggcuccaacuacaucagccuu

SEQ ID NO: 231983 - RNA, 22 nt, Human
uucugauauaacacucuagcua

SEQ ID NO: 231984 - RNA, 22 nt, Human
ugcagucuggauguccucagau

SEQ ID NO: 231985 - RNA, 22 nt, Human
gcaggucccagaaaguuaauuc

SEQ ID NO: 231986 - RNA, 22 nt, Human
gaaaauguuuguccggagcuga

SEQ ID NO: 231987 - RNA, 22 nt, Human
guggcugcagcggcuguggaga

SEQ ID NO: 231988 - RNA, 22 nt, Human
ucucugagcccaauguagcaau

SEQ ID NO: 231989 - RNA, 22 nt, Human
auguggcugccaccugccugaa

SEQ ID NO: 231990 - RNA, 22 nt, Human
auuacaagaugcauccauauuu

SEQ ID NO: 231991 - RNA, 22 nt, Human
aggggagagaacauaaggaagu

SEQ ID NO: 231992 - RNA, 22 nt, Human
cucagaauuacaucccauuuua

SEQ ID NO: 231993 - RNA, 22 nt, Human
uacaccagguguuauggucaau

SEQ ID NO: 231994 - RNA, 22 nt, Human
gggucagaguaagcaaggacaa

SEQ ID NO: 231995 - RNA, 22 nt, Human
aagcaucucuauguggagagug

SEQ ID NO: 231996 - RNA, 22 nt, Human
agacuuaggagcugacaucucu

SEQ ID NO: 231997 - RNA, 22 nt, Human
cugcucuucacacuacacccgu

SEQ ID NO: 231998 - RNA, 22 nt, Human
aaaguguuuuccaugcaaugaa

SEQ ID NO: 231999 - RNA, 22 nt, Human
auauuucacguagguuguuuuc

SEQ ID NO: 232000 - RNA, 22 nt, Human
gcccucucuucugcagccucca

SEQ ID NO: 232001 - RNA, 22 nt, Human
agaggcugucucauauuuugua

SEQ ID NO: 232002 - RNA, 22 nt, Human
ccauuuugucugacuucuugcu

SEQ ID NO: 232003 - RNA, 22 nt, Human
uagcugggaauuaucugguugc

SEQ ID NO: 232004 - RNA, 22 nt, Human
uauucaagauugaacuggcaga

SEQ ID NO: 232005 - RNA, 21 nt, Human
uccugggaagcacuggggugg

SEQ ID NO: 232006 - RNA, 22 nt, Human
gcaggccacugucuccucuggg

SEQ ID NO: 232007 - RNA, 22 nt, Human
ccuaccaguaggaggccagaga

SEQ ID NO: 232008 - RNA, 22 nt, Human
acaucuaagccaauuuugauuu

SEQ ID NO: 232009 - RNA, 18 nt, Human
uggcuucucaaagcccag

SEQ ID NO: 232010 - RNA, 19 nt, Human
uccucugaagguucuuuua

SEQ ID NO: 232011 - RNA, 22 nt, Human
uaccauuuugaaacauuucauc

SEQ ID NO: 232012 - RNA, 22 nt, Human
cugcccugucuuuuucugauga

SEQ ID NO: 232013 - RNA, 22 nt, Human
uagucaguaugaaauugcucaa

SEQ ID NO: 232014 - RNA, 22 nt, Human
aaucuacauuucaguuuugccc

SEQ ID NO: 232015 - RNA, 22 nt, Human
uuggaacuuaacccugauaggu

SEQ ID NO: 232016 - RNA, 20 nt, Human
ugcagaagaacguucugguu

SEQ ID NO: 232017 - RNA, 22 nt, Human
ucucuuggagguucuuccuguu

SEQ ID NO: 232018 - RNA, 22 nt, Human
aacuuauuccauaggcucacug

SEQ ID NO: 232019 - RNA, 22 nt, Human
acauuuuuauucaucaaagcag

SEQ ID NO: 232020 - RNA, 22 nt, Human
auucacaugauguauguagggc

SEQ ID NO: 232021 - RNA, 22 nt, Human
aagcccucauuagccauagccc

SEQ ID NO: 232022 - RNA, 22 nt, Human
cuuucccuuagccccauucuau

SEQ ID NO: 232023 - RNA, 17 nt, Human
ggucuggggccauuggc

SEQ ID NO: 232024 - RNA, 22 nt, Human
caugaaaaugucaaguucugcu

SEQ ID NO: 232025 - RNA, 22 nt, Human
augcaucauggaaaacucaguu

SEQ ID NO: 232026 - RNA, 23 nt, Human
cugaggggaaaagggcuucaggc

SEQ ID NO: 232027 - RNA, 22 nt, Human
gugagaagauaaguauugcaaa

SEQ ID NO: 232028 - RNA, 22 nt, Human
agggcacccucucugcaguacc

SEQ ID NO: 232029 - RNA, 22 nt, Human
augcagcaguuuacaaagcaau

SEQ ID NO: 232030 - RNA, 22 nt, Human
aaugaauucgagugaaggaaag

SEQ ID NO: 232031 - RNA, 22 nt, Human
agcuuugggauucaggcaggaa

SEQ ID NO: 232032 - RNA, 22 nt, Human
uggcugccgacuggcucuuggc

SEQ ID NO: 232033 - RNA, 22 nt, Human
cauuuauauaaaauguccagaa

SEQ ID NO: 232034 - RNA, 22 nt, Human
accuuccucuaagacauuuagc

SEQ ID NO: 232035 - RNA, 20 nt, Human
uaugugauuuucucaucaau

SEQ ID NO: 232036 - RNA, 22 nt, Human
uccauacucagaaaguauugca

SEQ ID NO: 232037 - RNA, 21 nt, Human
agagaucugaagaaccauuag

SEQ ID NO: 232038 - RNA, 21 nt, Human
cauuucaugauuauagaaaug

SEQ ID NO: 232039 - RNA, 22 nt, Human
ugcaaauauuccaugcuguuca

SEQ ID NO: 232040 - RNA, 22 nt, Human
gaaguuccagugauauaaaacu

SEQ ID NO: 232041 - RNA, 22 nt, Human
gggccccuugcugcucugcugg

SEQ ID NO: 232042 - RNA, 22 nt, Human
ugauuacacagcaguaauuuca

SEQ ID NO: 232043 - RNA, 22 nt, Human
gaguacuuaacuccaaauagga

SEQ ID NO: 232044 - RNA, 22 nt, Human
cuacaggaaggaucuugcucaa

SEQ ID NO: 232045 - RNA, 19 nt, Human
cucuuaaauugucucuugc

SEQ ID NO: 232046 - RNA, 22 nt, Human
uacaacauaacgggcauucagu

SEQ ID NO: 232047 - RNA, 22 nt, Human
aucccugugacgagcaucccua

SEQ ID NO: 232048 - RNA, 22 nt, Human
cuugccagcacuuggccagcug

SEQ ID NO: 232049 - RNA, 22 nt, Human
gggcucauggacagcucuccag

SEQ ID NO: 232050 - RNA, 22 nt, Human
acucagaguuccugugcauagu

SEQ ID NO: 232051 - RNA, 22 nt, Human
cauuuauugguuaggccagcag

SEQ ID NO: 232052 - RNA, 22 nt, Human
uagaagauucuaaaguggagag

SEQ ID NO: 232053 - RNA, 22 nt, Human
cccaaguauuccuccucugccc

SEQ ID NO: 232054 - RNA, 22 nt, Human
gagcccugauuugcagcauuug

SEQ ID NO: 232055 - RNA, 22 nt, Human
gugaauaacuuucuauguuaau

SEQ ID NO: 232056 - RNA, 22 nt, Human
uggguucuuucacuucucaguu

SEQ ID NO: 232057 - RNA, 22 nt, Human
ugcagaagauggucugagcacc

SEQ ID NO: 232058 - RNA, 22 nt, Human
ucuuuguuauugcuuuaucuau

SEQ ID NO: 232059 - RNA, 22 nt, Human
ccagcugggucccugcuggggc

SEQ ID NO: 232060 - RNA, 22 nt, Human
aagcugaggcccauggcaaggu

SEQ ID NO: 232061 - RNA, 22 nt, Human
ggggaggcugaugugggcaaag

SEQ ID NO: 232062 - RNA, 22 nt, Human
gcccaggggcagcgcauagugg

SEQ ID NO: 232063 - RNA, 22 nt, Human
auuccacagcuacaucaaucua

SEQ ID NO: 232064 - RNA, 21 nt, Human
acuggcugccaugauccaggg

SEQ ID NO: 232065 - RNA, 22 nt, Human
uagaaacucacguuaucauugc

SEQ ID NO: 232066 - RNA, 22 nt, Human
aggacaagcuaaaggacuuccu

SEQ ID NO: 232067 - RNA, 22 nt, Human
ucauggcuaaugcaguauauuc

SEQ ID NO: 232068 - RNA, 22 nt, Human
ucugggagagucacaggcauug

SEQ ID NO: 232069 - RNA, 22 nt, Human
ccagugccugugggcauggugc

SEQ ID NO: 232070 - RNA, 22 nt, Human
ggccuugggauguggcugcagc

SEQ ID NO: 232071 - RNA, 22 nt, Human
caguuuuucaaaauuacaugau

SEQ ID NO: 232072 - RNA, 22 nt, Human
acaacaaagacacuugaaauga

SEQ ID NO: 232073 - RNA, 22 nt, Human
caggcaggagccagggauucca

SEQ ID NO: 232074 - RNA, 22 nt, Human
uuaggcugggcuacaacaacug

SEQ ID NO: 232075 - RNA, 18 nt, Human
ucuuccaacacugacacc

SEQ ID NO: 232076 - RNA, 22 nt, Human
ugcuauuuggcacuuuugaccu

SEQ ID NO: 232077 - RNA, 22 nt, Human
uuggaaguaaugaagagguggg

SEQ ID NO: 232078 - RNA, 22 nt, Human
uaggaaauuuuacuggucuggg

SEQ ID NO: 232079 - RNA, 22 nt, Human
ucccugccugacagcacccacc

SEQ ID NO: 232080 - RNA, 22 nt, Human
gcagcuuuuuggaugucaguua

SEQ ID NO: 232081 - RNA, 22 nt, Human
uuuggaaugacagauaucaaua

SEQ ID NO: 232082 - RNA, 22 nt, Human
cuccccacauuucucccugucu

SEQ ID NO: 232083 - RNA, 22 nt, Human
acuguccauucacucauauuca

SEQ ID NO: 232084 - RNA, 22 nt, Human
auccagagagguuaggugacau

SEQ ID NO: 232085 - RNA, 20 nt, Human
uggggaaagccaucgaugag

SEQ ID NO: 232086 - RNA, 22 nt, Human
ucugcucuaguugcuuccugcc

SEQ ID NO: 232087 - RNA, 23 nt, Human
uccauacucuaaacauguuauuu

SEQ ID NO: 232088 - RNA, 22 nt, Human
aguuuuucuccccuggcuucau

SEQ ID NO: 232089 - RNA, 22 nt, Human
cuaaaugucagaguagcuugca

SEQ ID NO: 232090 - RNA, 20 nt, Human
agccucugcccuucccacug

SEQ ID NO: 232091 - RNA, 22 nt, Human
guugcacaguuccucaagcagg

SEQ ID NO: 232092 - RNA, 22 nt, Human
uagguauacagagauuucuggg

SEQ ID NO: 232093 - RNA, 22 nt, Human
cccugggcaagcccuauuuucc

SEQ ID NO: 232094 - RNA, 22 nt, Human
guuucacagucugcagaauuuu

SEQ ID NO: 232095 - RNA, 22 nt, Human
acuccuggguucuaaauuugaa

SEQ ID NO: 232096 - RNA, 22 nt, Human
agcagguggacagaggaagaaa

SEQ ID NO: 232097 - RNA, 22 nt, Human
ugcaggagcugugcggugaggg

SEQ ID NO: 232098 - RNA, 22 nt, Human
acauuugacuguagauacuugc

SEQ ID NO: 232099 - RNA, 22 nt, Human
ucaaagcagcacauucgcaagc

SEQ ID NO: 232100 - RNA, 22 nt, Human
uggcugcugcagacagacagga

SEQ ID NO: 232101 - RNA, 22 nt, Human
uuugaaaguguuuacuugggaa

SEQ ID NO: 232102 - RNA, 22 nt, Human
aaggccaggucccugcagugca

SEQ ID NO: 232103 - RNA, 22 nt, Human
guccuggggauacagaagugaa

SEQ ID NO: 232104 - RNA, 22 nt, Human
ugcuguccuguuuuggaguaau

SEQ ID NO: 232105 - RNA, 22 nt, Human
ugccuucaaucaggauggucuc

SEQ ID NO: 232106 - RNA, 21 nt, Human
acagaacuguauagugauaaa

SEQ ID NO: 232107 - RNA, 22 nt, Human
accuguuuacccugggcucccc

SEQ ID NO: 232108 - RNA, 22 nt, Human
ucugagcucaagugacaguuag

SEQ ID NO: 232109 - RNA, 21 nt, Human
uuucugucucugccacuaguu

SEQ ID NO: 232110 - RNA, 20 nt, Human
gcuccaggucagagaggacg

SEQ ID NO: 232111 - RNA, 22 nt, Human
gagucaggcuagggugacaggc

SEQ ID NO: 232112 - RNA, 22 nt, Human
uggguccauggaacagaggugc

SEQ ID NO: 232113 - RNA, 22 nt, Human
aaaaguguccagauuaugaaga

SEQ ID NO: 232114 - RNA, 22 nt, Human
caaaugugacuuuugggcuucu

SEQ ID NO: 232115 - RNA, 22 nt, Human
uccagaggugaacacccaggca

SEQ ID NO: 232116 - RNA, 22 nt, Human
agcuaucaguaggaccauguuc

SEQ ID NO: 232117 - RNA, 22 nt, Human
ccaaacaaauccccauucuuag

SEQ ID NO: 232118 - RNA, 21 nt, Human
aaggucuguaaagugacagga

SEQ ID NO: 232119 - RNA, 22 nt, Human
uggcccagcacuccaaguaggg

SEQ ID NO: 232120 - RNA, 19 nt, Human
uagacucuaauguuaagcu

SEQ ID NO: 232121 - RNA, 22 nt, Human
uucccauuugugguagugaauu

SEQ ID NO: 232122 - RNA, 22 nt, Human
cauuucaauacuaucugagaau

SEQ ID NO: 232123 - RNA, 22 nt, Human
acuaacuugcugagugaccaug

SEQ ID NO: 232124 - RNA, 21 nt, Human
agaaaaguagaguuuucagag

SEQ ID NO: 232125 - RNA, 22 nt, Human
aagcaagcuguuggcaauaggg

SEQ ID NO: 232126 - RNA, 22 nt, Human
aggaggccuacgcacaugucua

SEQ ID NO: 232127 - RNA, 22 nt, Human
gaugagcauuguuucauguguu

SEQ ID NO: 232128 - RNA, 22 nt, Human
ugccugucuuggaguccuggcc

SEQ ID NO: 232129 - RNA, 22 nt, Human
guuucucacuuaccaacacaug

SEQ ID NO: 232130 - RNA, 22 nt, Human
aagcuuguagaguuugacuucc

SEQ ID NO: 232131 - RNA, 22 nt, Human
cuagcuguguaaaccgagcugc

SEQ ID NO: 232132 - RNA, 22 nt, Human
ucuggcagaggaaggaggccug

SEQ ID NO: 232133 - RNA, 22 nt, Human
uuucacauuagauaugucauuu

SEQ ID NO: 232134 - RNA, 22 nt, Human
ucugggauuuuugacacugaag

SEQ ID NO: 232135 - RNA, 22 nt, Human
cuucaagagaaugcagggaugu

SEQ ID NO: 232136 - RNA, 22 nt, Human
cagagcaucgcgcagagagccu

SEQ ID NO: 232137 - RNA, 22 nt, Human
agcugccuucccucucauuagg

SEQ ID NO: 232138 - RNA, 22 nt, Human
aaccagcugagaaugcuucugc

SEQ ID NO: 232139 - RNA, 22 nt, Human
aauuaggaaaugagaguauuug

SEQ ID NO: 232140 - RNA, 20 nt, Human
aggcuccuguaccugaggaa

SEQ ID NO: 232141 - RNA, 22 nt, Human
aggcaggucuguaucuagucuc

SEQ ID NO: 232142 - RNA, 22 nt, Human
acaguuaacuggagagcgaguu

SEQ ID NO: 232143 - RNA, 22 nt, Human
ucuggcaggacaugcugaccau

SEQ ID NO: 232144 - RNA, 17 nt, Human
aggccucccuccaggcc

SEQ ID NO: 232145 - RNA, 18 nt, Human
gcucugcagcugaggcuu

SEQ ID NO: 232146 - RNA, 22 nt, Human
cuagaaauucugauucaguagg

SEQ ID NO: 232147 - RNA, 22 nt, Human
ucugagccacagauguccuguu

SEQ ID NO: 232148 - RNA, 22 nt, Human
uccaggccuaggccaagugauu

SEQ ID NO: 232149 - RNA, 22 nt, Human
agcucagcuuccucuccaugcu

SEQ ID NO: 232150 - RNA, 22 nt, Human
aacuagaaagaacauauuucca

SEQ ID NO: 232151 - RNA, 22 nt, Human
ugauuuccuaggucuggagaag

SEQ ID NO: 232152 - RNA, 18 nt, Human
uggcuucugcuagcugga

SEQ ID NO: 232153 - RNA, 20 nt, Human
cagagauuuuacuuccucac

SEQ ID NO: 232154 - RNA, 22 nt, Human
gacauuuauuagaaaacuauca

SEQ ID NO: 232155 - RNA, 22 nt, Human
gcuuucagggucacugucaaca

SEQ ID NO: 232156 - RNA, 22 nt, Human
cuggugccuccucucccagguc

SEQ ID NO: 232157 - RNA, 22 nt, Human
acucagagcuuggcuccuugcu

SEQ ID NO: 232158 - RNA, 22 nt, Human
uuagagaaguuuuacuuaagaa

SEQ ID NO: 232159 - RNA, 22 nt, Human
augugcaauggugucaccacau

SEQ ID NO: 232160 - RNA, 22 nt, Human
guguaaguaucuuuguaucuuu

SEQ ID NO: 232161 - RNA, 22 nt, Human
cugcuugaccuguuguucucac

SEQ ID NO: 232162 - RNA, 22 nt, Human
cacgggcagugagcacagccug

SEQ ID NO: 232163 - RNA, 22 nt, Human
caccagaguuguccaaaugauu

SEQ ID NO: 232164 - RNA, 22 nt, Human
cuuugggauuucaugagagcua

SEQ ID NO: 232165 - RNA, 22 nt, Human
cucauuuacuacucaugugacc

SEQ ID NO: 232166 - RNA, 22 nt, Human
agagagcaggacuucacugagc

SEQ ID NO: 232167 - RNA, 23 nt, Human
auucagaauuguguguuuguaua

SEQ ID NO: 232168 - RNA, 22 nt, Human
auaucuuucaaagccaaaagua

SEQ ID NO: 232169 - RNA, 22 nt, Human
ugcaaagugcuagcccacacca

SEQ ID NO: 232170 - RNA, 21 nt, Human
cccuugccugcacuccucggc

SEQ ID NO: 232171 - RNA, 22 nt, Human
ugagccaggcccagugggguca

SEQ ID NO: 232172 - RNA, 22 nt, Human
caggcuuuacuuucucucugaa

SEQ ID NO: 232173 - RNA, 22 nt, Human
uccugagcaccuaugccauggc

SEQ ID NO: 232174 - RNA, 18 nt, Human
acagaaauagcugugccu

SEQ ID NO: 232175 - RNA, 22 nt, Human
uucuguggucucccaugucugu

SEQ ID NO: 232176 - RNA, 22 nt, Human
guggagcaggacuagcugagaa

SEQ ID NO: 232177 - RNA, 22 nt, Human
gcagcaucagguucacugcgug

SEQ ID NO: 232178 - RNA, 22 nt, Human
ccugagcaaaggcccagaggga

SEQ ID NO: 232179 - RNA, 22 nt, Human
uuuugcaauauguuccugaaua

SEQ ID NO: 232180 - RNA, 21 nt, Human
aacugcaaaugaugcuggaga

SEQ ID NO: 232181 - RNA, 22 nt, Human
ucugggugcccuuugcucuguu

SEQ ID NO: 232182 - RNA, 22 nt, Human
gauuuuaucgucauccuucugg

SEQ ID NO: 232183 - RNA, 22 nt, Human
aaguggcaguucaggaagcaga

SEQ ID NO: 232184 - RNA, 22 nt, Human
ugcuggaguggcacuguguggc

SEQ ID NO: 232185 - RNA, 22 nt, Human
cugucuguuaucucaccagucc

SEQ ID NO: 232186 - RNA, 22 nt, Human
caugcauguuuacuacagugac

SEQ ID NO: 232187 - RNA, 22 nt, Human
augcagcugugggcaagaaaug

SEQ ID NO: 232188 - RNA, 22 nt, Human
gguggcugguuuuauaagaggu

SEQ ID NO: 232189 - RNA, 22 nt, Human
ccagcauccaugcucccucggg

SEQ ID NO: 232190 - RNA, 22 nt, Human
aauaccaugcagaaauaacaua

SEQ ID NO: 232191 - RNA, 22 nt, Human
gacaugugagcaagcgugcggc

SEQ ID NO: 232192 - RNA, 22 nt, Human
acaggacauggcuucugugacg

SEQ ID NO: 232193 - RNA, 22 nt, Human
auguagucucuuugggaaacuc

SEQ ID NO: 232194 - RNA, 22 nt, Human
cuuagcagaagcuucagcuuca

SEQ ID NO: 232195 - RNA, 19 nt, Human
uguuuucaagugggauuau

SEQ ID NO: 232196 - RNA, 22 nt, Human
aagucuuacagacaagcugaag

SEQ ID NO: 232197 - RNA, 22 nt, Human
ucucuggguauucacugccuuc

SEQ ID NO: 232198 - RNA, 22 nt, Human
acuuucuucuacuacuuggaga

SEQ ID NO: 232199 - RNA, 22 nt, Human
aauuucaguugcuaauaaguuc

SEQ ID NO: 232200 - RNA, 22 nt, Human
acacuuuagaaaaaagaauggu

SEQ ID NO: 232201 - RNA, 22 nt, Human
acuugguuguuuuaacuuggca

SEQ ID NO: 232202 - RNA, 22 nt, Human
cugauagguuauuuucagugag

SEQ ID NO: 232203 - RNA, 22 nt, Human
ugcaggggcuugucugggccug

SEQ ID NO: 232204 - RNA, 22 nt, Human
uguccucuuccagugcuccuuc

SEQ ID NO: 232205 - RNA, 22 nt, Human
aaacaguuuucucauuuagugu

SEQ ID NO: 232206 - RNA, 22 nt, Human
uccagaggcucugagggagagu

SEQ ID NO: 232207 - RNA, 20 nt, Human
aguguuugcucacagucucc

SEQ ID NO: 232208 - RNA, 22 nt, Human
agcagggcuggggcacgagcca

SEQ ID NO: 232209 - RNA, 18 nt, Human
ucugagguggacgaggag

SEQ ID NO: 232210 - RNA, 22 nt, Human
ugugugaguaaggcugagagag

SEQ ID NO: 232211 - RNA, 22 nt, Human
agcugccagcaucccggaaggg

SEQ ID NO: 232212 - RNA, 22 nt, Human
cagcccucugaagaggcgcuug

SEQ ID NO: 232213 - RNA, 22 nt, Human
gaaagcauguagccuguaucca

SEQ ID NO: 232214 - RNA, 22 nt, Human
uguccaggcucccuuggugcug

SEQ ID NO: 232215 - RNA, 22 nt, Human
acaguugacagggagaggguua

SEQ ID NO: 232216 - RNA, 22 nt, Human
aguaauaauagcuguaaagugc

SEQ ID NO: 232217 - RNA, 22 nt, Human
gaggcaguaauugugggcaaua

SEQ ID NO: 232218 - RNA, 22 nt, Human
uaaacagccuccccuuucacuc

SEQ ID NO: 232219 - RNA, 22 nt, Human
cugcccagaaucacucacucga

SEQ ID NO: 232220 - RNA, 22 nt, Human
gggugggcccagcccagagaag

SEQ ID NO: 232221 - RNA, 22 nt, Human
gcagggcaggauuugaacccag

SEQ ID NO: 232222 - RNA, 22 nt, Human
cucugccaucucacuggguccu

SEQ ID NO: 232223 - RNA, 22 nt, Human
ccagagaggcaaaacuccuucc

SEQ ID NO: 232224 - RNA, 23 nt, Human
uuuauacaagaaaccgcuggccu

SEQ ID NO: 232225 - RNA, 15 nt, Human
cagucccagggaccc

SEQ ID NO: 232226 - RNA, 17 nt, Human
ugagauggaagaagacu

SEQ ID NO: 232227 - RNA, 22 nt, Human
acugaaaugaaaucuaucaucu

SEQ ID NO: 232228 - RNA, 22 nt, Human
augucuuucuugugucccaaga

SEQ ID NO: 232229 - RNA, 22 nt, Human
aguauaauuagauaucaaaagu

SEQ ID NO: 232230 - RNA, 22 nt, Human
gcagugucagugccuggguggu

SEQ ID NO: 232231 - RNA, 22 nt, Human
cugguuuaaccauguauccugg

SEQ ID NO: 232232 - RNA, 22 nt, Human
acauggaaaacuaacugcuuuu

SEQ ID NO: 232233 - RNA, 22 nt, Human
auugucauuccagucauuguua

SEQ ID NO: 232234 - RNA, 22 nt, Human
uccuggcccacuaugccagcau

SEQ ID NO: 232235 - RNA, 22 nt, Human
aagcagaacugggaaguagugg

SEQ ID NO: 232236 - RNA, 22 nt, Human
gaggcaggcacuguuaucagca

SEQ ID NO: 232237 - RNA, 22 nt, Human
cagcucagucuggagagaugca

SEQ ID NO: 232238 - RNA, 22 nt, Human
ugugcacaaugugcagguuugu

SEQ ID NO: 232239 - RNA, 23 nt, Human
ucaguuaacuguguuaccugugc

SEQ ID NO: 232240 - RNA, 22 nt, Human
gagcuccagggaacagcagcua

SEQ ID NO: 232241 - RNA, 22 nt, Human
ggcuucugccacgagagggaag

SEQ ID NO: 232242 - RNA, 23 nt, Human
agaggcacagcacuuggcuggcc

SEQ ID NO: 232243 - RNA, 22 nt, Human
aagaaucucugaucaggcuuua

SEQ ID NO: 232244 - RNA, 19 nt, Human
ggcugccuuuccuuaccag

SEQ ID NO: 232245 - RNA, 22 nt, Human
gacaguuuuuaauccuuucaug

SEQ ID NO: 232246 - RNA, 22 nt, Human
cacagcuuagaaaagaagccau

SEQ ID NO: 232247 - RNA, 22 nt, Human
uugugacacaugccguccugag

SEQ ID NO: 232248 - RNA, 22 nt, Human
cugcuguacuuaggaagaggaa

SEQ ID NO: 232249 - RNA, 21 nt, Human
aaagaacaggcagauguucuu

SEQ ID NO: 232250 - RNA, 22 nt, Human
gggcagguggagggcccagcca

SEQ ID NO: 232251 - RNA, 22 nt, Human
cugggccuccagcucugccagc

SEQ ID NO: 232252 - RNA, 23 nt, Human
ccacuagcaccuguucaacuucu

SEQ ID NO: 232253 - RNA, 22 nt, Human
ugcagaaguauuccaggcccca

SEQ ID NO: 232254 - RNA, 22 nt, Human
ccaugaccccuggcauccaggg

SEQ ID NO: 232255 - RNA, 22 nt, Human
uuguacaacacauauucuacag

SEQ ID NO: 232256 - RNA, 22 nt, Human
aucugggccaauccuaguacca

SEQ ID NO: 232257 - RNA, 21 nt, Human
ucuuauacagcaauagaucug

SEQ ID NO: 232258 - RNA, 22 nt, Human
ugucaaaaccagcaauuuuguu

SEQ ID NO: 232259 - RNA, 22 nt, Human
cugcugccauuagggcacagac

SEQ ID NO: 232260 - RNA, 22 nt, Human
caacauucuuaucacuauaagc

SEQ ID NO: 232261 - RNA, 22 nt, Human
aaugaguuagaugagaaaauaa

SEQ ID NO: 232262 - RNA, 22 nt, Human
gaggagacauauuuuugaagca

SEQ ID NO: 232263 - RNA, 22 nt, Human
caggaagcuggguuuccauaca

SEQ ID NO: 232264 - RNA, 22 nt, Human
ccccagagaaagucagcagcau

SEQ ID NO: 232265 - RNA, 22 nt, Human
uugcuuuaaaauggcuaagucu

SEQ ID NO: 232266 - RNA, 23 nt, Human
uuaaaggcagauguugaguauua

SEQ ID NO: 232267 - RNA, 22 nt, Human
caggguagacaguaggugucug

SEQ ID NO: 232268 - RNA, 22 nt, Human
aaacauucacauuugcuaguaa

SEQ ID NO: 232269 - RNA, 22 nt, Human
ucucucuacuggggcacuagga

SEQ ID NO: 232270 - RNA, 22 nt, Human
aaaguauucuugacuguuuuuc

SEQ ID NO: 232271 - RNA, 22 nt, Human
ucauuucaaugauacuacuaag

SEQ ID NO: 232272 - RNA, 21 nt, Human
ucuuuuaacaccaggaauucc

SEQ ID NO: 232273 - RNA, 22 nt, Human
agcugacagugcauggagggac

SEQ ID NO: 232274 - RNA, 22 nt, Human
uagcaagauccuucccuggcgu

SEQ ID NO: 232275 - RNA, 19 nt, Human
cgcagguggaaggagccgc

SEQ ID NO: 232276 - RNA, 22 nt, Human
auuugccuguaagacaaggccu

SEQ ID NO: 232277 - RNA, 22 nt, Human
caggucccguuccccagagauu

SEQ ID NO: 232278 - RNA, 22 nt, Human
cacauucagggaacauuggagg

SEQ ID NO: 232279 - RNA, 22 nt, Human
aagaagcagagcuguggguguu

SEQ ID NO: 232280 - RNA, 18 nt, Human
cccaggcuuugugggucu

SEQ ID NO: 232281 - RNA, 22 nt, Human
cccacccugggaagcuaggcag

SEQ ID NO: 232282 - RNA, 22 nt, Human
gagcucagggcauugagcaaga

SEQ ID NO: 232283 - RNA, 22 nt, Human
gcuggcagaagagcugguucaa

SEQ ID NO: 232284 - RNA, 22 nt, Human
gcagaggccaggccaccagcaa

SEQ ID NO: 232285 - RNA, 22 nt, Human
ggcaggugggaacccuccccac

SEQ ID NO: 232286 - RNA, 22 nt, Human
acaacaguaggaaaacaugucu

SEQ ID NO: 232287 - RNA, 22 nt, Human
augaaauguaugagucuggguu

SEQ ID NO: 232288 - RNA, 22 nt, Human
aagauaauauucauuaacuaga

SEQ ID NO: 232289 - RNA, 22 nt, Human
agucaguugcaguuuauggaug

SEQ ID NO: 232290 - RNA, 22 nt, Human
guccaggcuaagucccuucugc

SEQ ID NO: 232291 - RNA, 22 nt, Human
agacaucucccaugcauuuuua

SEQ ID NO: 232292 - RNA, 22 nt, Human
uugauucaguaaagcuaaauuu

SEQ ID NO: 232293 - RNA, 22 nt, Human
gggagguaaagaugagcucagu

SEQ ID NO: 232294 - RNA, 22 nt, Human
ccagcuuuuccucucauugcuu

SEQ ID NO: 232295 - RNA, 22 nt, Human
accuagaauuuaaaacauugcu

SEQ ID NO: 232296 - RNA, 22 nt, Human
agcgccugcggugugagccugc

SEQ ID NO: 232297 - RNA, 22 nt, Human
ugcugcagcuaaggugaggugc

SEQ ID NO: 232298 - RNA, 22 nt, Human
gagccaugagauaguugguucg

SEQ ID NO: 232299 - RNA, 22 nt, Human
caagaauuguacaaacugggug

SEQ ID NO: 232300 - RNA, 22 nt, Human
ccuuccaggagucucugcaggu

SEQ ID NO: 232301 - RNA, 22 nt, Human
uucacugugauguuuaagagaa

SEQ ID NO: 232302 - RNA, 19 nt, Human
uccuggggaggggcauggc

SEQ ID NO: 232303 - RNA, 22 nt, Human
gauucacucauauuuuacguuu

SEQ ID NO: 232304 - RNA, 22 nt, Human
cagggauggagagacuacuggc

SEQ ID NO: 232305 - RNA, 22 nt, Human
aucuuuagagucaucugagugu

SEQ ID NO: 232306 - RNA, 22 nt, Human
aaagccauuacaaaauuucaua

SEQ ID NO: 232307 - RNA, 22 nt, Human
agccagcacggauuucccagga

SEQ ID NO: 232308 - RNA, 22 nt, Human
uucaaaaugcacaaagggcuag

SEQ ID NO: 232309 - RNA, 17 nt, Human
caggcuccuuccagauu

SEQ ID NO: 232310 - RNA, 21 nt, Human
ucauccagguccugcuucuuc

SEQ ID NO: 232311 - RNA, 20 nt, Human
gcagcagacagacaggggac

SEQ ID NO: 232312 - RNA, 22 nt, Human
agguggcaugccugagacauaa

SEQ ID NO: 232313 - RNA, 22 nt, Human
gccuggagaggaagccggugga

SEQ ID NO: 232314 - RNA, 22 nt, Human
auccagaacaccuguaucacca

SEQ ID NO: 232315 - RNA, 22 nt, Human
auauuacucugauuuaguaaau

SEQ ID NO: 232316 - RNA, 22 nt, Human
uccaguccuagaaacuggagag

SEQ ID NO: 232317 - RNA, 22 nt, Human
ccacugcuccugaccaagguca

SEQ ID NO: 232318 - RNA, 22 nt, Human
gauacauuucaaggaggacugg

SEQ ID NO: 232319 - RNA, 22 nt, Human
uuuuucauugcagccucucucc

SEQ ID NO: 232320 - RNA, 22 nt, Human
ugauuguuuuaguucccugaug

SEQ ID NO: 232321 - RNA, 22 nt, Human
aggugcugccccgagaaggaug

SEQ ID NO: 232322 - RNA, 22 nt, Human
acacugaauaauugagaguuga

SEQ ID NO: 232323 - RNA, 22 nt, Human
cagccaaaugagucauaaaugu

SEQ ID NO: 232324 - RNA, 22 nt, Human
ucaggugggcguuccggugcgg

SEQ ID NO: 232325 - RNA, 22 nt, Human
uagaacauaagucauucauuug

SEQ ID NO: 232326 - RNA, 22 nt, Human
caguuucuuagugacacaaauc

SEQ ID NO: 232327 - RNA, 22 nt, Human
ccuggcagcuccguggccuucc

SEQ ID NO: 232328 - RNA, 22 nt, Human
agcuggcaguaugacuggugac

SEQ ID NO: 232329 - RNA, 22 nt, Human
uuuguguuuaugaaguuauucu

SEQ ID NO: 232330 - RNA, 22 nt, Human
auauuaaaacuaugguuuucag

SEQ ID NO: 232331 - RNA, 22 nt, Human
ucucuugggaggaaagagagaa

SEQ ID NO: 232332 - RNA, 22 nt, Human
accauucuuuacacuuauuucu

SEQ ID NO: 232333 - RNA, 22 nt, Human
acuggaggccccucccagugaa

SEQ ID NO: 232334 - RNA, 23 nt, Human
aggaagcuaccaauuuuguaggc

SEQ ID NO: 232335 - RNA, 20 nt, Human
ugagaaggggucagcuguac

SEQ ID NO: 232336 - RNA, 22 nt, Human
cuuucucuucacugucaugauc

SEQ ID NO: 232337 - RNA, 22 nt, Human
caggccucuccuuagucuggca

SEQ ID NO: 232338 - RNA, 22 nt, Human
ucccugggcaaguuuacucuuc

SEQ ID NO: 232339 - RNA, 22 nt, Human
uucuuguucuccucauuuagag

SEQ ID NO: 232340 - RNA, 22 nt, Human
acaaauuguugcuucaugaaug

SEQ ID NO: 232341 - RNA, 22 nt, Human
guggucuggggucaggccugag

SEQ ID NO: 232342 - RNA, 22 nt, Human
cuggaaucuuuggagaaugugg

SEQ ID NO: 232343 - RNA, 19 nt, Human
ugcuggaacaucaguagcu

SEQ ID NO: 232344 - RNA, 22 nt, Human
uggcuuccuccagagcaggagg

SEQ ID NO: 232345 - RNA, 22 nt, Human
caauuagaggaggaagcucaua

SEQ ID NO: 232346 - RNA, 22 nt, Human
guguggucgaaguucucccgga

SEQ ID NO: 232347 - RNA, 22 nt, Human
ugaaagaguuugacaugauucu

SEQ ID NO: 232348 - RNA, 20 nt, Human
cagagaccaggccagguguc

SEQ ID NO: 232349 - RNA, 22 nt, Human
agaccuuuauuucaugauagga

SEQ ID NO: 232350 - RNA, 22 nt, Human
uuccugguccuauuauauacac

SEQ ID NO: 232351 - RNA, 22 nt, Human
acucuguguuuugguggcagca

SEQ ID NO: 232352 - RNA, 22 nt, Human
ggcuuccugggcauguguucua

SEQ ID NO: 232353 - RNA, 22 nt, Human
ggggucugcgccacugucugcg

SEQ ID NO: 232354 - RNA, 22 nt, Human
ccugugacucugucugaugguc

SEQ ID NO: 232355 - RNA, 22 nt, Human
gagcagagaauccagcuaagug

SEQ ID NO: 232356 - RNA, 22 nt, Human
agguucuuggugagcauuuggu

SEQ ID NO: 232357 - RNA, 22 nt, Human
guccaguuucagggucugcgcu

SEQ ID NO: 232358 - RNA, 22 nt, Human
uaaggccauuauggugggcccg

SEQ ID NO: 232359 - RNA, 22 nt, Human
ugcauugagucauuucaguaug

SEQ ID NO: 232360 - RNA, 22 nt, Human
cccuuagagauucugucagagu

SEQ ID NO: 232361 - RNA, 22 nt, Human
cuuucuagacuguccagaugau

SEQ ID NO: 232362 - RNA, 22 nt, Human
ucuuuuuauauugacaaaaggu

SEQ ID NO: 232363 - RNA, 22 nt, Human
gauuuuaucuuugugugcagua

SEQ ID NO: 232364 - RNA, 21 nt, Human
ugggcucagccccagcccugc

SEQ ID NO: 232365 - RNA, 22 nt, Human
uguguacuugaaagggcagguc

SEQ ID NO: 232366 - RNA, 22 nt, Human
cuuucaaaacgcucuguaugca

SEQ ID NO: 232367 - RNA, 22 nt, Human
uggaggcaugacagugucugga

SEQ ID NO: 232368 - RNA, 22 nt, Human
accccagcgcauauggucugcg

SEQ ID NO: 232369 - RNA, 22 nt, Human
cuuuaugaaggaacaaugcucc

SEQ ID NO: 232370 - RNA, 22 nt, Human
auguuauuucugaaagaucauu

SEQ ID NO: 232371 - RNA, 22 nt, Human
acagaacugagaauucucuauc

SEQ ID NO: 232372 - RNA, 22 nt, Human
ccagggcacguugggacaguac

SEQ ID NO: 232373 - RNA, 22 nt, Human
aauguguucaguuaaaugaacu

SEQ ID NO: 232374 - RNA, 22 nt, Human
gaauaacagcaaguuugcaggc

SEQ ID NO: 232375 - RNA, 22 nt, Human
guggauggauugaggcaguggg

SEQ ID NO: 232376 - RNA, 22 nt, Human
aaguagugugcuccagcgguga

SEQ ID NO: 232377 - RNA, 22 nt, Human
aguggcagaucucuggucugga

SEQ ID NO: 232378 - RNA, 22 nt, Human
caggcacacagcacauggccug

SEQ ID NO: 232379 - RNA, 22 nt, Human
ugguuauaaauugcuaugcaga

SEQ ID NO: 232380 - RNA, 22 nt, Human
gucacugccucuuaacuuuuuc

SEQ ID NO: 232381 - RNA, 22 nt, Human
agccaggaaugcaugcucugcu

SEQ ID NO: 232382 - RNA, 21 nt, Human
aguuugaugcaauuucugaga

SEQ ID NO: 232383 - RNA, 22 nt, Human
guggcauuuggaaagagcacua

SEQ ID NO: 232384 - RNA, 22 nt, Human
gggcaggggucaguggccccaa

SEQ ID NO: 232385 - RNA, 22 nt, Human
aaguuuaacuugaauucuuucu

SEQ ID NO: 232386 - RNA, 22 nt, Human
gaauacaugauuaaaguuugau

SEQ ID NO: 232387 - RNA, 18 nt, Human
acaggcuauugcaggaga

SEQ ID NO: 232388 - RNA, 22 nt, Human
ugauaacuuuaauuugaucuga

SEQ ID NO: 232389 - RNA, 22 nt, Human
uuagggaaauaaaauuaucagu

SEQ ID NO: 232390 - RNA, 22 nt, Human
uucucacaauucuuguauuugc

SEQ ID NO: 232391 - RNA, 22 nt, Human
agauacagccugccagguucuu

SEQ ID NO: 232392 - RNA, 22 nt, Human
agugcuccuauggaucaguugu

SEQ ID NO: 232393 - RNA, 22 nt, Human
agucugugaacuuggcagggaa

SEQ ID NO: 232394 - RNA, 22 nt, Human
uggcugagaaaaaagagcuaua

SEQ ID NO: 232395 - RNA, 22 nt, Human
agaaagugaacguguucaguuu

SEQ ID NO: 232396 - RNA, 22 nt, Human
ucugcacccacguaccuuggcu

SEQ ID NO: 232397 - RNA, 22 nt, Human
gggccaggucggugaaugguca

SEQ ID NO: 232398 - RNA, 22 nt, Human
gagacacaauuuccccauccua

SEQ ID NO: 232399 - RNA, 22 nt, Human
uuccaggaagcaguuagcagcc

SEQ ID NO: 232400 - RNA, 22 nt, Human
aaaguuugaaugauauauuagu

SEQ ID NO: 232401 - RNA, 22 nt, Human
aaaugccucccauucuacugac

SEQ ID NO: 232402 - RNA, 22 nt, Human
caggacagaaauaaggaauaua

SEQ ID NO: 232403 - RNA, 22 nt, Human
ggcugagccaugggcacugcag

SEQ ID NO: 232404 - RNA, 22 nt, Human
gcaccuggcugcccagguggag

SEQ ID NO: 232405 - RNA, 22 nt, Human
gccugggacuggauguguuugu

SEQ ID NO: 232406 - RNA, 22 nt, Human
aguuuacacuuuugauucuuau

SEQ ID NO: 232407 - RNA, 22 nt, Human
cagggcaguaacgggaacaucu

SEQ ID NO: 232408 - RNA, 21 nt, Human
uacaagauagagguaauauau

SEQ ID NO: 232409 - RNA, 22 nt, Human
gacagaggagaagaugcugugg

SEQ ID NO: 232410 - RNA, 22 nt, Human
caggcuccacuguaggcagcuc

SEQ ID NO: 232411 - RNA, 22 nt, Human
aauuuucuaaggugaugaucug

SEQ ID NO: 232412 - RNA, 22 nt, Human
guuuauaugaacuucauaccca

SEQ ID NO: 232413 - RNA, 22 nt, Human
ugcauuuuugagguuaacucaa

SEQ ID NO: 232414 - RNA, 20 nt, Human
aaacaagguugcucugagga

SEQ ID NO: 232415 - RNA, 23 nt, Human
cugaggucugcaauucuaguagu

SEQ ID NO: 232416 - RNA, 22 nt, Human
aaggaacugaugcucaaagaau

SEQ ID NO: 232417 - RNA, 22 nt, Human
ugccugccucuggagcccaucc

SEQ ID NO: 232418 - RNA, 22 nt, Human
ccugacaggagaagcgcagcau

SEQ ID NO: 232419 - RNA, 22 nt, Human
cuggaagacucaauggccugcc

SEQ ID NO: 232420 - RNA, 22 nt, Human
gggaaacuucugcuaaaaccag

SEQ ID NO: 232421 - RNA, 22 nt, Human
ccaugccagcugcuaggucaca

SEQ ID NO: 232422 - RNA, 22 nt, Human
ccuccugcggcguccgcgcucu

SEQ ID NO: 232423 - RNA, 22 nt, Human
aggcucuguaugaagguuuggg

SEQ ID NO: 232424 - RNA, 22 nt, Human
uuugcgucuaugugugagccuu

SEQ ID NO: 232425 - RNA, 22 nt, Human
aggcagcaugggcccagagucc

SEQ ID NO: 232426 - RNA, 22 nt, Human
ugccagccuggccugagucuuu

SEQ ID NO: 232427 - RNA, 22 nt, Human
cauucauuagaauagauaugua

SEQ ID NO: 232428 - RNA, 22 nt, Human
ugagaugguucacagagaaggc

SEQ ID NO: 232429 - RNA, 23 nt, Human
auguuacuuaaccucucugugcc

SEQ ID NO: 232430 - RNA, 22 nt, Human
guguaaaaacauacuauuucua

SEQ ID NO: 232431 - RNA, 22 nt, Human
uccaaauauucaucuacuucug

SEQ ID NO: 232432 - RNA, 22 nt, Human
aguguggggucaccggcccagg

SEQ ID NO: 232433 - RNA, 22 nt, Human
cugccuucaucucugagcuggg

SEQ ID NO: 232434 - RNA, 22 nt, Human
uuucuguaaggacuuaaugcaa

SEQ ID NO: 232435 - RNA, 22 nt, Human
ggcugcagaggcccccaguggg

SEQ ID NO: 232436 - RNA, 22 nt, Human
caggcuccaagcccucugaugu

SEQ ID NO: 232437 - RNA, 22 nt, Human
auugaguaguaggaaaauaacu

SEQ ID NO: 232438 - RNA, 19 nt, Human
caacaguacugguuugucc

SEQ ID NO: 232439 - RNA, 22 nt, Human
ucaagaacugugaagagucuga

SEQ ID NO: 232440 - RNA, 22 nt, Human
ccugcuggacguggaggagggg

SEQ ID NO: 232441 - RNA, 22 nt, Human
uuuauauuguaaaaaugguucu

SEQ ID NO: 232442 - RNA, 22 nt, Human
ugugacaugugucaucuuuucu

SEQ ID NO: 232443 - RNA, 22 nt, Human
cauguucuaauauugugacaua

SEQ ID NO: 232444 - RNA, 22 nt, Human
uguaugcuuuccaaaaaugcug

SEQ ID NO: 232445 - RNA, 22 nt, Human
agaagggccagcuggacaccug

SEQ ID NO: 232446 - RNA, 22 nt, Human
agcucuagggaagaaaggcaca

SEQ ID NO: 232447 - RNA, 22 nt, Human
auuuauuaugggauuuggcaca

SEQ ID NO: 232448 - RNA, 22 nt, Human
cuccccagcauucugacuuccu

SEQ ID NO: 232449 - RNA, 22 nt, Human
cuggcuggccggaggcaucccu

SEQ ID NO: 232450 - RNA, 22 nt, Human
gcuguguaccuacuaacugcuu

SEQ ID NO: 232451 - RNA, 22 nt, Human
uggcuggagcgcccuccucugc

SEQ ID NO: 232452 - RNA, 22 nt, Human
ucagagacaguucuggggcagg

SEQ ID NO: 232453 - RNA, 22 nt, Human
caaguaugagaaagcuauuacc

SEQ ID NO: 232454 - RNA, 22 nt, Human
ggucuuguuuauauaagguggu

SEQ ID NO: 232455 - RNA, 22 nt, Human
uacauguggagauaacugaagc

SEQ ID NO: 232456 - RNA, 22 nt, Human
acuguacugaaaaguaagcaag

SEQ ID NO: 232457 - RNA, 16 nt, Human
uccaggcauaucugag

SEQ ID NO: 232458 - RNA, 22 nt, Human
cccaguggcuuuugcccagguu

SEQ ID NO: 232459 - RNA, 18 nt, Human
uucuuuucaugugaucuc

SEQ ID NO: 232460 - RNA, 17 nt, Human
cucuuuauaaagaguua

SEQ ID NO: 232461 - RNA, 22 nt, Human
uuaacacuccuaacuacagucu

SEQ ID NO: 232462 - RNA, 22 nt, Human
ugggccugaguuugggaacugg

SEQ ID NO: 232463 - RNA, 22 nt, Human
ugaaucaugccacugagcuccc

SEQ ID NO: 232464 - RNA, 22 nt, Human
cacaggcaccccugacugcuca

SEQ ID NO: 232465 - RNA, 22 nt, Human
cuuaaucucaccugcaaagucc

SEQ ID NO: 232466 - RNA, 22 nt, Human
gcaguccauugacagaggucuu

SEQ ID NO: 232467 - RNA, 20 nt, Human
uuugcuguggguguaagaau

SEQ ID NO: 232468 - RNA, 22 nt, Human
uggugcagucauuggcccaggg

SEQ ID NO: 232469 - RNA, 22 nt, Human
uggcacaggagcacugcccugg

SEQ ID NO: 232470 - RNA, 22 nt, Human
cuuguggagauauccaugucug

SEQ ID NO: 232471 - RNA, 22 nt, Human
ucaggcagugguaaaugaguua

SEQ ID NO: 232472 - RNA, 22 nt, Human
cuugaucuacauagugaaaccc

SEQ ID NO: 232473 - RNA, 22 nt, Human
ugcagcugugaaagggaaccaa

SEQ ID NO: 232474 - RNA, 22 nt, Human
uggaaucucuuuggggacugaa

SEQ ID NO: 232475 - RNA, 22 nt, Human
uguaugcaaauuuauuagcaca

SEQ ID NO: 232476 - RNA, 22 nt, Human
ugcaaacaacuguuuaaugcug

SEQ ID NO: 232477 - RNA, 22 nt, Human
augguauuaagaacaauuccaa

SEQ ID NO: 232478 - RNA, 22 nt, Human
uucaaugucuauguacauuuua

SEQ ID NO: 232479 - RNA, 22 nt, Human
aagaguaaagcaaagcacuugu

SEQ ID NO: 232480 - RNA, 22 nt, Human
cuucuuuaauguauacaaaaga

SEQ ID NO: 232481 - RNA, 22 nt, Human
ucuuuggaaaugcuuugagaau

SEQ ID NO: 232482 - RNA, 22 nt, Human
uccuguguugauagagaugguu

SEQ ID NO: 232483 - RNA, 22 nt, Human
uuuaauuguuguggguacauag

SEQ ID NO: 232484 - RNA, 22 nt, Human
uuucagaaaucaaaaccagggu

SEQ ID NO: 232485 - RNA, 22 nt, Human
aacuuucugucugagcugcaga

SEQ ID NO: 232486 - RNA, 21 nt, Human
uuggaaucuuaggaguguggg

SEQ ID NO: 232487 - RNA, 22 nt, Human
gcuggggugugguggauaagcu

SEQ ID NO: 232488 - RNA, 22 nt, Human
ucaggaagcucuugcugauucu

SEQ ID NO: 232489 - RNA, 22 nt, Human
uggcagggccugcucaucaucc

SEQ ID NO: 232490 - RNA, 22 nt, Human
gggaucuggaauuuugguaugu

SEQ ID NO: 232491 - RNA, 22 nt, Human
gaaccuuuuuccaaguaaacaa

SEQ ID NO: 232492 - RNA, 22 nt, Human
uuaucugucuaucaagacuagc

SEQ ID NO: 232493 - RNA, 22 nt, Human
gacaugauggaaaaaaaugcuc

SEQ ID NO: 232494 - RNA, 21 nt, Human
uccuccuucaaguccuggccu

SEQ ID NO: 232495 - RNA, 22 nt, Human
uguuuaaucuauaaaauggaga

SEQ ID NO: 232496 - RNA, 19 nt, Human
auagaaaggguuaaagaca

SEQ ID NO: 232497 - RNA, 22 nt, Human
gcuggaguuggcaaggcaugua

SEQ ID NO: 232498 - RNA, 22 nt, Human
uggacacaucacugcagccacu

SEQ ID NO: 232499 - RNA, 22 nt, Human
ucuccaguaucuuuccaaugaa

SEQ ID NO: 232500 - RNA, 22 nt, Human
auucaagguuuauucaguuuag

SEQ ID NO: 232501 - RNA, 22 nt, Human
agagccuugccuggggcccugu

SEQ ID NO: 232502 - RNA, 22 nt, Human
acaguuugaauaauuuagauag

SEQ ID NO: 232503 - RNA, 22 nt, Human
cuagaaauguagauucuuagug

SEQ ID NO: 232504 - RNA, 20 nt, Human
uucgcugggaguggccaggc

SEQ ID NO: 232505 - RNA, 22 nt, Human
cgguccagggaacgcccccgcc

SEQ ID NO: 232506 - RNA, 22 nt, Human
ggcugccuucccugagccccgg

SEQ ID NO: 232507 - RNA, 22 nt, Human
uauagcaagcucuuuguaacca

SEQ ID NO: 232508 - RNA, 16 nt, Human
gaugagucuuaguggu

SEQ ID NO: 232509 - RNA, 22 nt, Human
ggagacacgggugcugaggacc

SEQ ID NO: 232510 - RNA, 22 nt, Human
augaggcaggaaaggcguaucu

SEQ ID NO: 232511 - RNA, 22 nt, Human
uguccaggcggccuugccuguu

SEQ ID NO: 232512 - RNA, 22 nt, Human
acuuguauggagacuuggaacc

SEQ ID NO: 232513 - RNA, 22 nt, Human
cugaaggagaaggccacuguuc

SEQ ID NO: 232514 - RNA, 22 nt, Human
ggaggccaaggcagguggauca

SEQ ID NO: 232515 - RNA, 22 nt, Human
agcuuuggcccuggagguuacu

SEQ ID NO: 232516 - RNA, 22 nt, Human
ucugcuguguugaaugauuggu

SEQ ID NO: 232517 - RNA, 22 nt, Human
gcugucccgaaccccugguaau

SEQ ID NO: 232518 - RNA, 22 nt, Human
uucuuuggcauuuccuguaugu

SEQ ID NO: 232519 - RNA, 22 nt, Human
ccugggucuggucacuaaguca

SEQ ID NO: 232520 - RNA, 22 nt, Human
gacuguggggggcggacacaag

SEQ ID NO: 232521 - RNA, 22 nt, Human
uguacauuuagagcucaauaga

SEQ ID NO: 232522 - RNA, 22 nt, Human
aauuuacaguugcugaugguac

SEQ ID NO: 232523 - RNA, 22 nt, Human
ggcugcaaaggaaaagugguga

SEQ ID NO: 232524 - RNA, 23 nt, Human
gccucagagaaacagcugcacac

SEQ ID NO: 232525 - RNA, 22 nt, Human
ugguaagauaagagccaggccu

SEQ ID NO: 232526 - RNA, 22 nt, Human
aggaauguggaagguggcggcg

SEQ ID NO: 232527 - RNA, 22 nt, Human
caauucaucuggguagguagcc

SEQ ID NO: 232528 - RNA, 22 nt, Human
cagagcuucugacagcugcugc

SEQ ID NO: 232529 - RNA, 22 nt, Human
ggaggacacuggcucugccuuc

SEQ ID NO: 232530 - RNA, 22 nt, Human
uuaauaggcuucuaacauagcu

SEQ ID NO: 232531 - RNA, 22 nt, Human
ccaacaguccagaugagauggu

SEQ ID NO: 232532 - RNA, 22 nt, Human
cucuuuuagagaugaaaauugg

SEQ ID NO: 232533 - RNA, 22 nt, Human
ugaagucucuguuuucucauuu

SEQ ID NO: 232534 - RNA, 22 nt, Human
uucucaguuucacugauaacag

SEQ ID NO: 232535 - RNA, 22 nt, Human
aagcaucuuagaccugaguucc

SEQ ID NO: 232536 - RNA, 22 nt, Human
cacauuucucuaccucacacaa

SEQ ID NO: 232537 - RNA, 21 nt, Human
cagagguggccugaccucuga

SEQ ID NO: 232538 - RNA, 22 nt, Human
guccuggggauuauagaguguu

SEQ ID NO: 232539 - RNA, 22 nt, Human
augcaugaaagaauccaagccu

SEQ ID NO: 232540 - RNA, 22 nt, Human
uguucaaaugaucuucuuaaau

SEQ ID NO: 232541 - RNA, 23 nt, Human
caggcaggaugaggacuacacuc

SEQ ID NO: 232542 - RNA, 22 nt, Human
aaagagcugggacuuaaagugc

SEQ ID NO: 232543 - RNA, 22 nt, Human
ccagcuuuucuuaucauuauaa

SEQ ID NO: 232544 - RNA, 22 nt, Human
ucaggacagacuagacuagcgu

SEQ ID NO: 232545 - RNA, 22 nt, Human
agcccuugaguguaucucaaau

SEQ ID NO: 232546 - RNA, 22 nt, Human
aggcuucuuagauuggcuggag

SEQ ID NO: 232547 - RNA, 22 nt, Human
cuucacagcaugagcuuuggag

SEQ ID NO: 232548 - RNA, 22 nt, Human
uaucuaagagagucaauauuua

SEQ ID NO: 232549 - RNA, 22 nt, Human
ggacucucaggcugucggcuuc

SEQ ID NO: 232550 - RNA, 22 nt, Human
uacagaggcacaugcaauuuuc

SEQ ID NO: 232551 - RNA, 22 nt, Human
ggacagaggguugacagaguau

SEQ ID NO: 232552 - RNA, 22 nt, Human
gcacagcucuccccaagacgaa

SEQ ID NO: 232553 - RNA, 22 nt, Human
ucugagguuacugcuuuguaga

SEQ ID NO: 232554 - RNA, 22 nt, Human
agaaguauaaagaauguuuaug

SEQ ID NO: 232555 - RNA, 22 nt, Human
aggcuucucuccuuggcuugca

SEQ ID NO: 232556 - RNA, 22 nt, Human
aggccucucuccuuggcuugua

SEQ ID NO: 232557 - RNA, 17 nt, Human
gaauccuucucuguucu

SEQ ID NO: 232558 - RNA, 22 nt, Human
aaagcugcuaugaacauucuau

SEQ ID NO: 232559 - RNA, 22 nt, Human
aucuccagugaggcagauucug

SEQ ID NO: 232560 - RNA, 22 nt, Human
ccagccagcugguuggacgccu

SEQ ID NO: 232561 - RNA, 22 nt, Human
uguuaaaaauucagcucuagau

SEQ ID NO: 232562 - RNA, 22 nt, Human
uaugacaagguggaguaugagu

SEQ ID NO: 232563 - RNA, 22 nt, Human
gcauucuugguaugaaggacag

SEQ ID NO: 232564 - RNA, 22 nt, Human
uuucugcaaguguagauaccca

SEQ ID NO: 232565 - RNA, 22 nt, Human
auacauacauguaugcacauac

SEQ ID NO: 232566 - RNA, 22 nt, Human
ucuggagcuggagggcaaggca

SEQ ID NO: 232567 - RNA, 22 nt, Human
auacaugaucacuguauuauaa

SEQ ID NO: 232568 - RNA, 22 nt, Human
cucugugggaggaggaguaggc

SEQ ID NO: 232569 - RNA, 22 nt, Human
gguaacugcagaaugugccuca

SEQ ID NO: 232570 - RNA, 22 nt, Human
agcugguccuaauugagccauu

SEQ ID NO: 232571 - RNA, 22 nt, Human
acacuuuaugucuagaucuggg

SEQ ID NO: 232572 - RNA, 22 nt, Human
ccugccuucccagcuuggcuuu

SEQ ID NO: 232573 - RNA, 20 nt, Human
guccagugggccuucauuuc

SEQ ID NO: 232574 - RNA, 22 nt, Human
acucagcauauggggccgcuug

SEQ ID NO: 232575 - RNA, 22 nt, Human
aucuaaacagguguucuuuaga

SEQ ID NO: 232576 - RNA, 22 nt, Human
ugagcuuccucccugcauccau

SEQ ID NO: 232577 - RNA, 22 nt, Human
cuauuuuucuguacccuaauuu

SEQ ID NO: 232578 - RNA, 22 nt, Human
uccuuucuuuucuaugggccca

SEQ ID NO: 232579 - RNA, 22 nt, Human
uuucuuucaauucuccuaaugc

SEQ ID NO: 232580 - RNA, 22 nt, Human
agcaguuauguucuauaaaguc

SEQ ID NO: 232581 - RNA, 22 nt, Human
auguacauuuuccuaauguuuu

SEQ ID NO: 232582 - RNA, 22 nt, Human
uguuuacuccagcugauggaac

SEQ ID NO: 232583 - RNA, 22 nt, Human
uguccuggggcgacuuggggcc

SEQ ID NO: 232584 - RNA, 22 nt, Human
ggcuggcagugugagagaggga

SEQ ID NO: 232585 - RNA, 22 nt, Human
caaauagacucuagaauuuauu

SEQ ID NO: 232586 - RNA, 23 nt, Human
ccacagagcugccaauuccugug

SEQ ID NO: 232587 - RNA, 22 nt, Human
cuuauguacacacauauauugu

SEQ ID NO: 232588 - RNA, 22 nt, Human
uaccaaaaccaagccauuaucu

SEQ ID NO: 232589 - RNA, 20 nt, Human
uaagaacaagacuaggaagc

SEQ ID NO: 232590 - RNA, 22 nt, Human
ucuggcugaaauuagaagguuc

SEQ ID NO: 232591 - RNA, 22 nt, Human
cagcugccugucuggaggcaau

SEQ ID NO: 232592 - RNA, 22 nt, Human
ugugcaacuccuuccacagaca

SEQ ID NO: 232593 - RNA, 22 nt, Human
uggucugaggaacaccagcacu

SEQ ID NO: 232594 - RNA, 22 nt, Human
gaggagggagaauuaggcuuaa

SEQ ID NO: 232595 - RNA, 22 nt, Human
ccuuuaugagauccugggguga

SEQ ID NO: 232596 - RNA, 22 nt, Human
gaaccuguuuauguuaccugcg

SEQ ID NO: 232597 - RNA, 22 nt, Human
ccagggaagauuagaagccacu

SEQ ID NO: 232598 - RNA, 22 nt, Human
acagaauuaacauuugaugaau

SEQ ID NO: 232599 - RNA, 22 nt, Human
aauacuuuugaacugaaaggca

SEQ ID NO: 232600 - RNA, 22 nt, Human
guuccacaaaaggucuaguuua

SEQ ID NO: 232601 - RNA, 22 nt, Human
agucuuugguuauaagagacag

SEQ ID NO: 232602 - RNA, 22 nt, Human
aagcaucuucuaucaguuagac

SEQ ID NO: 232603 - RNA, 22 nt, Human
acuucaugcagaagagagcugu

SEQ ID NO: 232604 - RNA, 22 nt, Human
ccacuuucugagggaacagcag

SEQ ID NO: 232605 - RNA, 22 nt, Human
uaaggcuagugccugacugggu

SEQ ID NO: 232606 - RNA, 22 nt, Human
ccaaggcaggggaucaaaguuu

SEQ ID NO: 232607 - RNA, 17 nt, Human
gcaguuaaauuaagaug

SEQ ID NO: 232608 - RNA, 22 nt, Human
cuucaguucuaaaguagaaugu

SEQ ID NO: 232609 - RNA, 22 nt, Human
cauaaguuggguaauauaauga

SEQ ID NO: 232610 - RNA, 22 nt, Human
gacuuuggcuuuuauucuaggu

SEQ ID NO: 232611 - RNA, 22 nt, Human
ucaggaagauuaguuuccuacc

SEQ ID NO: 232612 - RNA, 22 nt, Human
agaaaugcucaggucaacuuaa

SEQ ID NO: 232613 - RNA, 22 nt, Human
cccaggaggacauuccauaccc

SEQ ID NO: 232614 - RNA, 22 nt, Human
auucauaaguaaaugauuaccu

SEQ ID NO: 232615 - RNA, 22 nt, Human
aguucuguugucuagggaagcc

SEQ ID NO: 232616 - RNA, 22 nt, Human
gcacacuuaauacucacugugc

SEQ ID NO: 232617 - RNA, 22 nt, Human
uccaugagaacccuuggagaua

SEQ ID NO: 232618 - RNA, 22 nt, Human
ucagaggaagccuuggugggag

SEQ ID NO: 232619 - RNA, 22 nt, Human
ucugcuggucaaggcugggucc

SEQ ID NO: 232620 - RNA, 22 nt, Human
caggcuuuugcauagcacuggg

SEQ ID NO: 232621 - RNA, 22 nt, Human
agccuguggaucccugcacugg

SEQ ID NO: 232622 - RNA, 22 nt, Human
ucuagggaggcaauagcaaugu

SEQ ID NO: 232623 - RNA, 20 nt, Human
uaaauuagccuugaagauua

SEQ ID NO: 232624 - RNA, 22 nt, Human
auagugguuggauaugucagag

SEQ ID NO: 232625 - RNA, 22 nt, Human
cugaggcucugggugucacugu

SEQ ID NO: 232626 - RNA, 22 nt, Human
accuguuucucucugaguuacu

SEQ ID NO: 232627 - RNA, 22 nt, Human
aaaauauuuuagggccaggaga

SEQ ID NO: 232628 - RNA, 22 nt, Human
cccugccaaucccgucucucug

SEQ ID NO: 232629 - RNA, 23 nt, Human
ugccaggguuuguuugugguuca

SEQ ID NO: 232630 - RNA, 22 nt, Human
ucagcaguggcucucaugcagu

SEQ ID NO: 232631 - RNA, 22 nt, Human
ccagcucccauucuucaccugu

SEQ ID NO: 232632 - RNA, 22 nt, Human
aauucugaugaauaaaucaucc

SEQ ID NO: 232633 - RNA, 22 nt, Human
gagucuggugauggucauuguc

SEQ ID NO: 232634 - RNA, 22 nt, Human
ugaggccaggacccccagcagg

SEQ ID NO: 232635 - RNA, 22 nt, Human
uuuaacccaaauaaccacagga

SEQ ID NO: 232636 - RNA, 23 nt, Human
aguggcugagaguguuucauaug

SEQ ID NO: 232637 - RNA, 22 nt, Human
aaaugcugucaguguuauugga

SEQ ID NO: 232638 - RNA, 22 nt, Human
gccuacaugcuuuuaguguuuc

SEQ ID NO: 232639 - RNA, 22 nt, Human
gggcugcuuggaggaggcgcuc

SEQ ID NO: 232640 - RNA, 20 nt, Human
cccugagacgacugagcucc

SEQ ID NO: 232641 - RNA, 22 nt, Human
uggcagcugaggggaggcuuug

SEQ ID NO: 232642 - RNA, 22 nt, Human
cucucugaguggcuguacuuuc

SEQ ID NO: 232643 - RNA, 22 nt, Human
aaagccagguugugugcaggaa

SEQ ID NO: 232644 - RNA, 21 nt, Human
guagggacagagaguugguga

SEQ ID NO: 232645 - RNA, 22 nt, Human
aaaccugucugauuauggagac

SEQ ID NO: 232646 - RNA, 22 nt, Human
aagcacagggacucaggaccgg

SEQ ID NO: 232647 - RNA, 22 nt, Human
agugagguaauuagagcugcug

SEQ ID NO: 232648 - RNA, 22 nt, Human
ucaggagagaaagaauacaauu

SEQ ID NO: 232649 - RNA, 22 nt, Human
ccuguggcugccccgcuguugg

SEQ ID NO: 232650 - RNA, 22 nt, Human
uggcuccuucauucuccugcca

SEQ ID NO: 232651 - RNA, 22 nt, Human
ucaaaauucuagggagaauggu

SEQ ID NO: 232652 - RNA, 21 nt, Human
uagaacugacgauuucagagu

SEQ ID NO: 232653 - RNA, 22 nt, Human
cucuuuggcccccgaugauuca

SEQ ID NO: 232654 - RNA, 18 nt, Human
gggugcuggggccccuug

SEQ ID NO: 232655 - RNA, 22 nt, Human
ggacaucucuugccagggcugc

SEQ ID NO: 232656 - RNA, 22 nt, Human
ccacucaggccuccugcucucc

SEQ ID NO: 232657 - RNA, 22 nt, Human
caucccugcccucaugccuaua

SEQ ID NO: 232658 - RNA, 18 nt, Human
ugguccaguucagauaua

SEQ ID NO: 232659 - RNA, 22 nt, Human
ugaggccucauaaugagauuuc

SEQ ID NO: 232660 - RNA, 22 nt, Human
ucauuucuguugugcaucacug

SEQ ID NO: 232661 - RNA, 22 nt, Human
ucagaauggcccauaaauaguc

SEQ ID NO: 232662 - RNA, 22 nt, Human
aagaaucuccauuccuguuuua

SEQ ID NO: 232663 - RNA, 22 nt, Human
ugccaaauuagaguucccaggc

SEQ ID NO: 232664 - RNA, 23 nt, Human
acugccugugccgaucucucuca

SEQ ID NO: 232665 - RNA, 22 nt, Human
cagagaugugauccagcugucu

SEQ ID NO: 232666 - RNA, 20 nt, Human
gagcugugcucucaggagcc

SEQ ID NO: 232667 - RNA, 22 nt, Human
uccuggccaaguuacucucugc

SEQ ID NO: 232668 - RNA, 22 nt, Human
uggcaagggauuguggagaacu

SEQ ID NO: 232669 - RNA, 22 nt, Human
gacuguggcaggcucagcacug

SEQ ID NO: 232670 - RNA, 20 nt, Human
ugcacagcugugaauaggau

SEQ ID NO: 232671 - RNA, 22 nt, Human
caaaaguaauggcgguuuuuac

SEQ ID NO: 232672 - RNA, 19 nt, Human
ggacagacgcagagaucug

SEQ ID NO: 232673 - RNA, 22 nt, Human
cugcuaaaccucucugagagcu

SEQ ID NO: 232674 - RNA, 22 nt, Human
ggguuggauuacuuagggagaa

SEQ ID NO: 232675 - RNA, 20 nt, Human
caaagcaguaggauaaaaau

SEQ ID NO: 232676 - RNA, 22 nt, Human
uaauguaaacacagagacagaa

SEQ ID NO: 232677 - RNA, 22 nt, Human
gcccauggucagggaggcaggg

SEQ ID NO: 232678 - RNA, 22 nt, Human
agagggguuaagugcuaguccg

SEQ ID NO: 232679 - RNA, 22 nt, Human
cugcccugccuggccagugugg

SEQ ID NO: 232680 - RNA, 22 nt, Human
cauuugaauuguucugugggaa

SEQ ID NO: 232681 - RNA, 22 nt, Human
gagcuuuaccuuagguucuguu

SEQ ID NO: 232682 - RNA, 22 nt, Human
ugaggcaaaguucaagcugaaa

SEQ ID NO: 232683 - RNA, 22 nt, Human
gugcagcucaguugaaaugcag

SEQ ID NO: 232684 - RNA, 22 nt, Human
uugcagggcaucuaugucuggu

SEQ ID NO: 232685 - RNA, 22 nt, Human
gauccacagggcccuggcccag

SEQ ID NO: 232686 - RNA, 22 nt, Human
ggguagggugacuuaggcuggc

SEQ ID NO: 232687 - RNA, 22 nt, Human
uggcuaauggcauuuccugggu

SEQ ID NO: 232688 - RNA, 22 nt, Human
auacacacaaucagguuuugua

SEQ ID NO: 232689 - RNA, 22 nt, Human
acugggaggcaucuggagcuga

SEQ ID NO: 232690 - RNA, 22 nt, Human
gcuggcugccuuacuuugugga

SEQ ID NO: 232691 - RNA, 22 nt, Human
aaagccagaauucguccagccu

SEQ ID NO: 232692 - RNA, 21 nt, Human
uggagcugaauuuuuggcauc

SEQ ID NO: 232693 - RNA, 22 nt, Human
uauuugaugguucuaaaacagc

SEQ ID NO: 232694 - RNA, 22 nt, Human
acugcagagcuuuucaguugag

SEQ ID NO: 232695 - RNA, 22 nt, Human
ccuggcucgcugaccucagggg

SEQ ID NO: 232696 - RNA, 18 nt, Human
auguucauauuuuuaggg

SEQ ID NO: 232697 - RNA, 22 nt, Human
aaauuauaggugccaccuugga

SEQ ID NO: 232698 - RNA, 22 nt, Human
guaucuggugaggguuccccug

SEQ ID NO: 232699 - RNA, 22 nt, Human
ucucugggauaaacugggccag

SEQ ID NO: 232700 - RNA, 22 nt, Human
acuuccaggguagaggggaaga

SEQ ID NO: 232701 - RNA, 22 nt, Human
aagaugacuauuuaucuguaag

SEQ ID NO: 232702 - RNA, 22 nt, Human
gauggauacuauaggaggcaca

SEQ ID NO: 232703 - RNA, 22 nt, Human
gacucuuucaaacagaaagcca

SEQ ID NO: 232704 - RNA, 22 nt, Human
gagaaaugcuagcuuaggaauc

SEQ ID NO: 232705 - RNA, 22 nt, Human
aauaaugagcuugucuaauugu

SEQ ID NO: 232706 - RNA, 22 nt, Human
acaaggacauaggaaacuacaa

SEQ ID NO: 232707 - RNA, 22 nt, Human
caggcuugauuauucagacaau

SEQ ID NO: 232708 - RNA, 22 nt, Human
gucuagaaauagguuucagaaa

SEQ ID NO: 232709 - RNA, 22 nt, Human
ugaccugucacauuuugaugaa

SEQ ID NO: 232710 - RNA, 22 nt, Human
acagccagggucucaggaggcg

SEQ ID NO: 232711 - RNA, 22 nt, Human
cacuuuauauucuaagacggcc

SEQ ID NO: 232712 - RNA, 22 nt, Human
ugaaacuucuaauaugaauagu

SEQ ID NO: 232713 - RNA, 22 nt, Human
cagucccagacauaguaaggga

SEQ ID NO: 232714 - RNA, 22 nt, Human
aaccagaucgacuguuaacagc

SEQ ID NO: 232715 - RNA, 19 nt, Human
ccagaguuggcagagcagg

SEQ ID NO: 232716 - RNA, 22 nt, Human
guuuauucuucagcaacaucug

SEQ ID NO: 232717 - RNA, 22 nt, Human
uggagccagaagagccaguuca

SEQ ID NO: 232718 - RNA, 22 nt, Human
gggccacuggguccugcuggcc

SEQ ID NO: 232719 - RNA, 22 nt, Human
aucuagaaagccaggggccugc

SEQ ID NO: 232720 - RNA, 22 nt, Human
gagccuggauugucaccgacuu

SEQ ID NO: 232721 - RNA, 22 nt, Human
cacaugaguccugccagguaug

SEQ ID NO: 232722 - RNA, 22 nt, Human
aucugucuggaggccuggcaug

SEQ ID NO: 232723 - RNA, 22 nt, Human
ucccugggcuucuccagacuug

SEQ ID NO: 232724 - RNA, 22 nt, Human
aacagucuuccuacggccauua

SEQ ID NO: 232725 - RNA, 22 nt, Human
ggcuggcugauaaaggguugag

SEQ ID NO: 232726 - RNA, 20 nt, Human
ccuggcugcauucaggacgg

SEQ ID NO: 232727 - RNA, 19 nt, Human
gcagggcucucccagaugc

SEQ ID NO: 232728 - RNA, 22 nt, Human
cagcugcugauggccugacaga

SEQ ID NO: 232729 - RNA, 22 nt, Human
uuacaaucaucuaggauaaaga

SEQ ID NO: 232730 - RNA, 22 nt, Human
aucaaauauaauaauuuucgcu

SEQ ID NO: 232731 - RNA, 22 nt, Human
ggcuguggacacugagcucaga

SEQ ID NO: 232732 - RNA, 22 nt, Human
uuagaguuuuaucauugccuua

SEQ ID NO: 232733 - RNA, 22 nt, Human
gccugcaggcuguaguuuguga

SEQ ID NO: 232734 - RNA, 22 nt, Human
uugucucugccaugcuugaggg

SEQ ID NO: 232735 - RNA, 22 nt, Human
ugggccagcacugggugcucau

SEQ ID NO: 232736 - RNA, 22 nt, Human
auggacagagcugagcuccacc

SEQ ID NO: 232737 - RNA, 22 nt, Human
caguuagcugacaaguaggcua

SEQ ID NO: 232738 - RNA, 22 nt, Human
auucuucaguauguguggauug

SEQ ID NO: 232739 - RNA, 22 nt, Human
cuucauuaaugucuauaaguuu

SEQ ID NO: 232740 - RNA, 22 nt, Human
gugagcagccucaccugagggu

SEQ ID NO: 232741 - RNA, 22 nt, Human
uccucagucguuugagccaaaa

SEQ ID NO: 232742 - RNA, 22 nt, Human
aggccaaauguguauaaaacau

SEQ ID NO: 232743 - RNA, 22 nt, Human
ucuggcuuucauuuguuuaaag

SEQ ID NO: 232744 - RNA, 22 nt, Human
acgugcaggaucugguuggcga

SEQ ID NO: 232745 - RNA, 22 nt, Human
gaggcacauauauacagagccc

SEQ ID NO: 232746 - RNA, 22 nt, Human
cacacauuucagaugcuacaau

SEQ ID NO: 232747 - RNA, 22 nt, Human
cacauacaugcacaccuaaaua

SEQ ID NO: 232748 - RNA, 22 nt, Human
ucugcagaauucgaggaagaaa

SEQ ID NO: 232749 - RNA, 22 nt, Human
aggaagcacuggaagggguugg

SEQ ID NO: 232750 - RNA, 22 nt, Human
cugagggucaacuugauuguau

SEQ ID NO: 232751 - RNA, 22 nt, Human
aagcccuguucuuucucucacc

SEQ ID NO: 232752 - RNA, 22 nt, Human
aauauaaugcuguuuuaugcca

SEQ ID NO: 232753 - RNA, 22 nt, Human
ugcauacacaagcauacaugua

SEQ ID NO: 232754 - RNA, 22 nt, Human
ggaaggcuccacccaaggcgag

SEQ ID NO: 232755 - RNA, 22 nt, Human
ccuggcccagggacuuucgccu

SEQ ID NO: 232756 - RNA, 22 nt, Human
uaacaugaaacuccaaauggua

SEQ ID NO: 232757 - RNA, 22 nt, Human
uucuaacuaauuggaaauggaa

SEQ ID NO: 232758 - RNA, 17 nt, Human
cauguguaugugggagu

SEQ ID NO: 232759 - RNA, 22 nt, Human
ugcagguggacacgggagacgg

SEQ ID NO: 232760 - RNA, 22 nt, Human
aauaacuggcacauaucacaua

SEQ ID NO: 232761 - RNA, 22 nt, Human
uggcacagacauuuaauagccu

SEQ ID NO: 232762 - RNA, 22 nt, Human
uuccagaagauggcagcaaagg

SEQ ID NO: 232763 - RNA, 22 nt, Human
cucaagaucaucaauauaccaa

SEQ ID NO: 232764 - RNA, 21 nt, Human
uagcccucucugucuguguac

SEQ ID NO: 232765 - RNA, 22 nt, Human
ggcucagcaaugaugagccccu

SEQ ID NO: 232766 - RNA, 22 nt, Human
ccuggcaguggugaagaagagg

SEQ ID NO: 232767 - RNA, 22 nt, Human
cauuucuagggaucauaaagua

SEQ ID NO: 232768 - RNA, 22 nt, Human
auacauguuguaccauauguuu

SEQ ID NO: 232769 - RNA, 22 nt, Human
gacuuuauuuccuuauuuguga

SEQ ID NO: 232770 - RNA, 22 nt, Human
ggauuuacacaccugccuguca

SEQ ID NO: 232771 - RNA, 22 nt, Human
cuggccagacuacacaugugug

SEQ ID NO: 232772 - RNA, 22 nt, Human
ggaucuucagccagcaggugcc

SEQ ID NO: 232773 - RNA, 21 nt, Human
auaauguacaaaaacugucuu

SEQ ID NO: 232774 - RNA, 20 nt, Human
uucuacaaaacugauucuga

SEQ ID NO: 232775 - RNA, 22 nt, Human
agugcccuucaugaagcaagag

SEQ ID NO: 232776 - RNA, 22 nt, Human
cagcucccuauggugaggcgac

SEQ ID NO: 232777 - RNA, 22 nt, Human
ggcuucucucccccagcuccac

SEQ ID NO: 232778 - RNA, 22 nt, Human
uaugcuauucuucagaguguuc

SEQ ID NO: 232779 - RNA, 17 nt, Human
ucagcaggggccaagcu

SEQ ID NO: 232780 - RNA, 22 nt, Human
cagcugucuaaguugagcagga

SEQ ID NO: 232781 - RNA, 22 nt, Human
ucugggcuuggguagaaaucac

SEQ ID NO: 232782 - RNA, 22 nt, Human
ugcagggaaugcuugcagcaug

SEQ ID NO: 232783 - RNA, 19 nt, Human
ggcauccagaacuaccagu

SEQ ID NO: 232784 - RNA, 22 nt, Human
agugcauguaucuacagucaca

SEQ ID NO: 232785 - RNA, 22 nt, Human
cugccuggcuaaacucaagucg

SEQ ID NO: 232786 - RNA, 22 nt, Human
aggcaacaugacucacuugcac

SEQ ID NO: 232787 - RNA, 22 nt, Human
uaacacugugucugccauaucc

SEQ ID NO: 232788 - RNA, 17 nt, Human
ccacagccuggcacuug

SEQ ID NO: 232789 - RNA, 22 nt, Human
gugcccucacaaaguggaaaga

SEQ ID NO: 232790 - RNA, 22 nt, Human
agugcugaagacuggcuaggga

SEQ ID NO: 232791 - RNA, 22 nt, Human
guucuauuacucccugcuucuu

SEQ ID NO: 232792 - RNA, 22 nt, Human
ggcuguggccagcggggcugag

SEQ ID NO: 232793 - RNA, 22 nt, Human
cacauuuaaagguugaagcuga

SEQ ID NO: 232794 - RNA, 22 nt, Human
caguuaaacgggccaugugagu

SEQ ID NO: 232795 - RNA, 22 nt, Human
uuaaguaacuuguccaaaugag

SEQ ID NO: 232796 - RNA, 22 nt, Human
uuagaaaggagcuuauuucuuu

SEQ ID NO: 232797 - RNA, 22 nt, Human
ccucugugugugcaugcaugcg

SEQ ID NO: 232798 - RNA, 22 nt, Human
gacaauuucucaauauagaaac

SEQ ID NO: 232799 - RNA, 19 nt, Human
uccuggcaucuuccucccu

SEQ ID NO: 232800 - RNA, 22 nt, Human
agcuccagggaaagaguggauc

SEQ ID NO: 232801 - RNA, 22 nt, Human
gccaggcagcuagcaaccccug

SEQ ID NO: 232802 - RNA, 22 nt, Human
accaggacuuuguauucagcuu

SEQ ID NO: 232803 - RNA, 22 nt, Human
ugcaauaaguuguguuaucacu

SEQ ID NO: 232804 - RNA, 22 nt, Human
caggcaagcaaggggucuugaa

SEQ ID NO: 232805 - RNA, 22 nt, Human
acugagauuuacauguucuagu

SEQ ID NO: 232806 - RNA, 22 nt, Human
aggcccugagaaaaucccugca

SEQ ID NO: 232807 - RNA, 22 nt, Human
auucuucauguugaagcuguca

SEQ ID NO: 232808 - RNA, 22 nt, Human
acacagcuagugaguggcagag

SEQ ID NO: 232809 - RNA, 22 nt, Human
acuuccaaaacacagcauggca

SEQ ID NO: 232810 - RNA, 22 nt, Human
cuuuccuagauggccaucuuuc

SEQ ID NO: 232811 - RNA, 21 nt, Human
caaaagagacugauucuugga

SEQ ID NO: 232812 - RNA, 22 nt, Human
auucagugucuacuccauugcc

SEQ ID NO: 232813 - RNA, 21 nt, Human
agaggccaagucaucauuucc

SEQ ID NO: 232814 - RNA, 22 nt, Human
ucccucagagggcaagcgcaga

SEQ ID NO: 232815 - RNA, 22 nt, Human
uacacuuucguuuguggauuag

SEQ ID NO: 232816 - RNA, 21 nt, Human
agaugcaguuaugagaugcag

SEQ ID NO: 232817 - RNA, 22 nt, Human
aaugcuuauggguuccauaaua

SEQ ID NO: 232818 - RNA, 22 nt, Human
aaaguguaaaagcauguuaggg

SEQ ID NO: 232819 - RNA, 22 nt, Human
ucaggccugcaggcuuccugga

SEQ ID NO: 232820 - RNA, 22 nt, Human
gagcuuuagcugagaccugcuu

SEQ ID NO: 232821 - RNA, 22 nt, Human
auauauaugcugauggcugcca

SEQ ID NO: 232822 - RNA, 22 nt, Human
uuccugaggcucaucggagucg

SEQ ID NO: 232823 - RNA, 22 nt, Human
gagugcuuugucuuguaauucu

SEQ ID NO: 232824 - RNA, 22 nt, Human
cacuuuuaaauggguccguguu

SEQ ID NO: 232825 - RNA, 22 nt, Human
uuggaauagauuuguuagaaaa

SEQ ID NO: 232826 - RNA, 22 nt, Human
gagccaagggcgugcuggagag

SEQ ID NO: 232827 - RNA, 21 nt, Human
uccaggcuggaaggggcguug

SEQ ID NO: 232828 - RNA, 20 nt, Human
caugcaacagauuauuuccc

SEQ ID NO: 232829 - RNA, 22 nt, Human
caguauguucuuccaggacaga

SEQ ID NO: 232830 - RNA, 22 nt, Human
ucuguuuauucaauuucuauau

SEQ ID NO: 232831 - RNA, 22 nt, Human
gaugugucuccauacaccaccc

SEQ ID NO: 232832 - RNA, 22 nt, Human
acagccagaggagccaggcugg

SEQ ID NO: 232833 - RNA, 21 nt, Human
ccugagccuguuuauccagaa

SEQ ID NO: 232834 - RNA, 22 nt, Human
guccugucccccaaggcugugg

SEQ ID NO: 232835 - RNA, 19 nt, Human
ugccugucaguagaucuca

SEQ ID NO: 232836 - RNA, 22 nt, Human
ucugaaagagaguacauacagu

SEQ ID NO: 232837 - RNA, 22 nt, Human
acauggugugcugagaaugaca

SEQ ID NO: 232838 - RNA, 22 nt, Human
gucugcccggccuuccuccacc

SEQ ID NO: 232839 - RNA, 22 nt, Human
cagcagcugcgugcccaggccg

SEQ ID NO: 232840 - RNA, 22 nt, Human
caacaguguugcaaucugaaaa

SEQ ID NO: 232841 - RNA, 22 nt, Human
guccugggaggggcugguccug

SEQ ID NO: 232842 - RNA, 22 nt, Human
acucagaguagaaaauagguuc

SEQ ID NO: 232843 - RNA, 21 nt, Human
guccucagcugaugggagcug

SEQ ID NO: 232844 - RNA, 22 nt, Human
agcccuggguuagggugggagc

SEQ ID NO: 232845 - RNA, 23 nt, Human
uggagcugggcagcugggaaagu

SEQ ID NO: 232846 - RNA, 22 nt, Human
acuuuucuaagcaauggucuug

SEQ ID NO: 232847 - RNA, 22 nt, Human
uacaaagucccauugccaugga

SEQ ID NO: 232848 - RNA, 22 nt, Human
cugcagagaauuguggggcuuc

SEQ ID NO: 232849 - RNA, 22 nt, Human
aaaaugucugcuguugguuuau

SEQ ID NO: 232850 - RNA, 22 nt, Human
auuccuucuuugagaauaagca

SEQ ID NO: 232851 - RNA, 22 nt, Human
ccuucucuaccaugugaggaaa

SEQ ID NO: 232852 - RNA, 22 nt, Human
cagggagcuggcuggcgugagu

SEQ ID NO: 232853 - RNA, 22 nt, Human
ggcucaggcuggagugcagugg

SEQ ID NO: 232854 - RNA, 22 nt, Human
aggcccagcccguccucgugcu

SEQ ID NO: 232855 - RNA, 22 nt, Human
guaacucuggguagaacucaug

SEQ ID NO: 232856 - RNA, 22 nt, Human
cacugagguaucugucucuccu

SEQ ID NO: 232857 - RNA, 22 nt, Human
ucaggcucugagcugaugcuaa

SEQ ID NO: 232858 - RNA, 20 nt, Human
aauaaaagaagccuucaccc

SEQ ID NO: 232859 - RNA, 22 nt, Human
acaugugaggugugagugauac

SEQ ID NO: 232860 - RNA, 22 nt, Human
cuggccagcugacagcagggcu

SEQ ID NO: 232861 - RNA, 19 nt, Human
agcacagacaagaccagca

SEQ ID NO: 232862 - RNA, 22 nt, Human
uaaggcuuuccuugucaucuuu

SEQ ID NO: 232863 - RNA, 22 nt, Human
gucauucagagaugcagguaga

SEQ ID NO: 232864 - RNA, 22 nt, Human
caucuuuuggccuauucugagg

SEQ ID NO: 232865 - RNA, 21 nt, Human
aucauucuggaaaauucaagc

SEQ ID NO: 232866 - RNA, 22 nt, Human
aauuucaaacuaauaggaacca

SEQ ID NO: 232867 - RNA, 22 nt, Human
gggauggggucaacauguaccu

SEQ ID NO: 232868 - RNA, 22 nt, Human
uagaacuguccaagucugagcu

SEQ ID NO: 232869 - RNA, 22 nt, Human
aagugcauaauaacucccaagu

SEQ ID NO: 232870 - RNA, 22 nt, Human
gugcaggcaaaagggccaggcc

SEQ ID NO: 232871 - RNA, 22 nt, Human
acaaauugaccgcaagauucau

SEQ ID NO: 232872 - RNA, 22 nt, Human
uggcacagcccagagcucuuga

SEQ ID NO: 232873 - RNA, 22 nt, Human
uggcuuccacugugugcccccu

SEQ ID NO: 232874 - RNA, 22 nt, Human
agauguaaacucucaugucauu

SEQ ID NO: 232875 - RNA, 23 nt, Human
aguguucagcauguaguaaauac

SEQ ID NO: 232876 - RNA, 22 nt, Human
cauuaaguauuucaguuacugu

SEQ ID NO: 232877 - RNA, 22 nt, Human
acauuucuccuugcaggaguca

SEQ ID NO: 232878 - RNA, 22 nt, Human
aaaacagacagccaguguagag

SEQ ID NO: 232879 - RNA, 22 nt, Human
aagucacagaguuggaagucag

SEQ ID NO: 232880 - RNA, 22 nt, Human
cugagcugguggaagcaugcag

SEQ ID NO: 232881 - RNA, 22 nt, Human
cuuuuuguuguauaagcccuuu

SEQ ID NO: 232882 - RNA, 22 nt, Human
aguggcaguggcugggcagagc

SEQ ID NO: 232883 - RNA, 22 nt, Human
uuguuuucacagcuuugcccgg

SEQ ID NO: 232884 - RNA, 22 nt, Human
uuccagugacuaagcuucugcu

SEQ ID NO: 232885 - RNA, 22 nt, Human
aagggggcccagcacuaaguug

SEQ ID NO: 232886 - RNA, 22 nt, Human
uagaaauggguuacauuuagag

SEQ ID NO: 232887 - RNA, 22 nt, Human
acaguuaauuaacauuaagggg

SEQ ID NO: 232888 - RNA, 22 nt, Human
ggcacaggaaucugugaagugc

SEQ ID NO: 232889 - RNA, 22 nt, Human
cuucucccaaguaugcaguuug

SEQ ID NO: 232890 - RNA, 22 nt, Human
ucaggcugauaggaggaacuga

SEQ ID NO: 232891 - RNA, 22 nt, Human
uguacaaauucauugaacugua

SEQ ID NO: 232892 - RNA, 22 nt, Human
augaguguacgugaaaguagau

SEQ ID NO: 232893 - RNA, 22 nt, Human
uagcuuuaauaagcugcugaau

SEQ ID NO: 232894 - RNA, 22 nt, Human
gcuguguaucagaugccacggg

SEQ ID NO: 232895 - RNA, 22 nt, Human
agucagucaccauuuaagaaca

SEQ ID NO: 232896 - RNA, 22 nt, Human
aacauacauauuucagugucca

SEQ ID NO: 232897 - RNA, 22 nt, Human
uccuuggcaugccgucuucucc

SEQ ID NO: 232898 - RNA, 18 nt, Human
gcuccuggaccaggucac

SEQ ID NO: 232899 - RNA, 21 nt, Human
uuucugaaggcaacaucuauc

SEQ ID NO: 232900 - RNA, 22 nt, Human
caaagcuauaaauucagacaga

SEQ ID NO: 232901 - RNA, 22 nt, Human
ugucaaguuguggcaugucuaa

SEQ ID NO: 232902 - RNA, 22 nt, Human
cuggcccaguucugcguuuugc

SEQ ID NO: 232903 - RNA, 22 nt, Human
aguacauauaguaauuuagcca

SEQ ID NO: 232904 - RNA, 22 nt, Human
acacagccccacggugagcaaa

SEQ ID NO: 232905 - RNA, 22 nt, Human
aaaauaacuucuacuauuugca

SEQ ID NO: 232906 - RNA, 22 nt, Human
guguuuauacagcaaagagcau

SEQ ID NO: 232907 - RNA, 22 nt, Human
uaguaaaucucagaaaaagauc

SEQ ID NO: 232908 - RNA, 22 nt, Human
cugagcccuggcucgccuggag

SEQ ID NO: 232909 - RNA, 22 nt, Human
uaaaggcucagggaaccagauc

SEQ ID NO: 232910 - RNA, 22 nt, Human
augaguugaagcuacaagaggc

SEQ ID NO: 232911 - RNA, 22 nt, Human
uguugaguauauaccuacaagu

SEQ ID NO: 232912 - RNA, 22 nt, Human
gaggccugguuugcaugagaau

SEQ ID NO: 232913 - RNA, 19 nt, Human
ugaggggcucacagucuca

SEQ ID NO: 232914 - RNA, 21 nt, Human
acuccaaacaaguuaagcugu

SEQ ID NO: 232915 - RNA, 22 nt, Human
gcuugaaaaugacucuugugaa

SEQ ID NO: 232916 - RNA, 22 nt, Human
uugcaaaugguaccaagggucu

SEQ ID NO: 232917 - RNA, 22 nt, Human
uggcuguguuaccacuucaugu

SEQ ID NO: 232918 - RNA, 22 nt, Human
uccuggcucgauugcuaccaau

SEQ ID NO: 232919 - RNA, 23 nt, Human
gaaucaguggcuaacaaggaaac

SEQ ID NO: 232920 - RNA, 22 nt, Human
uugaccacugaaugguucugaa

SEQ ID NO: 232921 - RNA, 22 nt, Human
cuguuuucaaagagagagaaug

SEQ ID NO: 232922 - RNA, 22 nt, Human
uagugaaaugagaauguaugac

SEQ ID NO: 232923 - RNA, 22 nt, Human
gggcacuggaaggcucucaggc

SEQ ID NO: 232924 - RNA, 22 nt, Human
gguuucucaccuucagcacuac

SEQ ID NO: 232925 - RNA, 19 nt, Human
caugugcaugagcacagga

SEQ ID NO: 232926 - RNA, 22 nt, Human
ggcaggcacugugcuaggcgcu

SEQ ID NO: 232927 - RNA, 22 nt, Human
cagagcccuuggcuggagccca

SEQ ID NO: 232928 - RNA, 22 nt, Human
gcaaacaucuuuauuuggcaag

SEQ ID NO: 232929 - RNA, 22 nt, Human
gaagauuucuuuaugaaagaug

SEQ ID NO: 232930 - RNA, 22 nt, Human
uccacaggcugaggcccuucug

SEQ ID NO: 232931 - RNA, 22 nt, Human
uuguccuggagguuaauagagu

SEQ ID NO: 232932 - RNA, 19 nt, Human
gccuggcugggaugagccc

SEQ ID NO: 232933 - RNA, 22 nt, Human
agggucugacuccucuggcaag

SEQ ID NO: 232934 - RNA, 22 nt, Human
ccuccuggguucaagcgauucu

SEQ ID NO: 232935 - RNA, 22 nt, Human
aauaagaugugcuugaguuugg

SEQ ID NO: 232936 - RNA, 22 nt, Human
auucagugccaaggagaacuug

SEQ ID NO: 232937 - RNA, 22 nt, Human
ucagggagccuggacuucaagg

SEQ ID NO: 232938 - RNA, 21 nt, Human
agaauccauucagaccuucuc

SEQ ID NO: 232939 - RNA, 18 nt, Human
ugaacuggcaucagaauc

SEQ ID NO: 232940 - RNA, 22 nt, Human
gggagguucuguucgcacuuga

SEQ ID NO: 232941 - RNA, 22 nt, Human
ucugggagcagcucagcagauu

SEQ ID NO: 232942 - RNA, 21 nt, Human
ucugccagcugaagaggugga

SEQ ID NO: 232943 - RNA, 22 nt, Human
acugccuucaugcagaccccug

SEQ ID NO: 232944 - RNA, 22 nt, Human
aggcuucuuuuagaggggaugg

SEQ ID NO: 232945 - RNA, 20 nt, Human
gcuccuguccugguggaggg

SEQ ID NO: 232946 - RNA, 22 nt, Human
cuguuguauuauucaauauuau

SEQ ID NO: 232947 - RNA, 22 nt, Human
gagcucagcaaaggucugugug

SEQ ID NO: 232948 - RNA, 21 nt, Human
agaguggcaaaguguccaaga

SEQ ID NO: 232949 - RNA, 23 nt, Human
agagccaagcuucuuucucacau

SEQ ID NO: 232950 - RNA, 22 nt, Human
cacagguucaaauucaggucgc

SEQ ID NO: 232951 - RNA, 22 nt, Human
uaugaaagaaucucagagcaca

SEQ ID NO: 232952 - RNA, 22 nt, Human
agcauguucaucuucuguuggu

SEQ ID NO: 232953 - RNA, 22 nt, Human
ucagcuuuuaaaaacaagaagu

SEQ ID NO: 232954 - RNA, 22 nt, Human
caccaggcuggagugcagaggu

SEQ ID NO: 232955 - RNA, 22 nt, Human
gccuccuggaagucacauguuu

SEQ ID NO: 232956 - RNA, 22 nt, Human
cugcugagaaaagacugaggga

SEQ ID NO: 232957 - RNA, 22 nt, Human
cagacaggcaggugcugcuuug

SEQ ID NO: 232958 - RNA, 22 nt, Human
cugaggcugaagagggccuacg

SEQ ID NO: 232959 - RNA, 22 nt, Human
uuucaaguggcgagauaaggaa

SEQ ID NO: 232960 - RNA, 22 nt, Human
agggauggagcccagcuguucu

SEQ ID NO: 232961 - RNA, 22 nt, Human
gugggggacccaggugcugucc

SEQ ID NO: 232962 - RNA, 22 nt, Human
agcaggcuugguccccagccuc

SEQ ID NO: 232963 - RNA, 22 nt, Human
uccugcagccuugggcuggagc

SEQ ID NO: 232964 - RNA, 19 nt, Human
cucagucuggcucugccug

SEQ ID NO: 232965 - RNA, 22 nt, Human
caggaaagccgagugccauagg

SEQ ID NO: 232966 - RNA, 22 nt, Human
uguccagcugacauucccuucc

SEQ ID NO: 232967 - RNA, 22 nt, Human
acuuagcaccuauggcauuuuu

SEQ ID NO: 232968 - RNA, 22 nt, Human
cuccaguggcaaguccgggcgg

SEQ ID NO: 232969 - RNA, 22 nt, Human
aagggcacagggaaagagugca

SEQ ID NO: 232970 - RNA, 22 nt, Human
ucuuuuaaccuaacuagcuugg

SEQ ID NO: 232971 - RNA, 22 nt, Human
ucccugccuccuggcagugcca

SEQ ID NO: 232972 - RNA, 22 nt, Human
ucucagagugguggucccucug

SEQ ID NO: 232973 - RNA, 22 nt, Human
uuccggaagguucucuagaauu

SEQ ID NO: 232974 - RNA, 22 nt, Human
gcacuugucaaauauuauagua

SEQ ID NO: 232975 - RNA, 22 nt, Human
auuuagaaauuccaaaaguauu

SEQ ID NO: 232976 - RNA, 21 nt, Human
ugccaggccugagcugggguc

SEQ ID NO: 232977 - RNA, 22 nt, Human
ggagagagaugccgccuugcuc

SEQ ID NO: 232978 - RNA, 22 nt, Human
uccugggaccaggcaccuacug

SEQ ID NO: 232979 - RNA, 22 nt, Human
ucagugcacccaauucucucca

SEQ ID NO: 232980 - RNA, 22 nt, Human
aacuccugaggaaauggucuca

SEQ ID NO: 232981 - RNA, 22 nt, Human
uccagcccacaccugaagcugg

SEQ ID NO: 232982 - RNA, 22 nt, Human
cuucaauuuuugguaugaugga

SEQ ID NO: 232983 - RNA, 22 nt, Human
cugugcaaugccuaaucacaaa

SEQ ID NO: 232984 - RNA, 23 nt, Human
agcuuccuagugaccuggagucu

SEQ ID NO: 232985 - RNA, 22 nt, Human
cagcccaguaccaagcaguugg

SEQ ID NO: 232986 - RNA, 19 nt, Human
uccuuaaaaaagcaguucu

SEQ ID NO: 232987 - RNA, 22 nt, Human
gcacacauucuagccuuuugug

SEQ ID NO: 232988 - RNA, 22 nt, Human
caaaaguaauugugguuuuugc

SEQ ID NO: 232989 - RNA, 22 nt, Human
uaugugcauaugcauacacaca

SEQ ID NO: 232990 - RNA, 22 nt, Human
gccagccccagacauccuaucg

SEQ ID NO: 232991 - RNA, 22 nt, Human
agccagcaggugagugcagccu

SEQ ID NO: 232992 - RNA, 18 nt, Human
cugaaggcaccagggcag

SEQ ID NO: 232993 - RNA, 22 nt, Human
gcagggaugcugaggcucagug

SEQ ID NO: 232994 - RNA, 22 nt, Human
accuccccucaccaaucugguu

SEQ ID NO: 232995 - RNA, 22 nt, Human
gaggcauggccugaggcuagga

SEQ ID NO: 232996 - RNA, 22 nt, Human
gcugccuuccauaauguacgua

SEQ ID NO: 232997 - RNA, 21 nt, Human
accauucugcacaugcuguca

SEQ ID NO: 232998 - RNA, 22 nt, Human
uguguucaagauuaguucuagu

SEQ ID NO: 232999 - RNA, 20 nt, Human
gcagagugugagagggugaa

SEQ ID NO: 233000 - RNA, 20 nt, Human
cucugggucgagacagacuu

SEQ ID NO: 233001 - RNA, 22 nt, Human
gcccaggauggcuggaggugcu

SEQ ID NO: 233002 - RNA, 22 nt, Human
ugccuugcagguuuuaaauaca

SEQ ID NO: 233003 - RNA, 22 nt, Human
gacagacaggugugguaggcac

SEQ ID NO: 233004 - RNA, 22 nt, Human
ccaguuaguuaaaggcgcagua

SEQ ID NO: 233005 - RNA, 22 nt, Human
gcuucauagcauucauugccug

SEQ ID NO: 233006 - RNA, 22 nt, Human
ggcucaccauggccucccugcu

SEQ ID NO: 233007 - RNA, 22 nt, Human
cuccuggcaggcugagugaaau

SEQ ID NO: 233008 - RNA, 22 nt, Human
aguggcugccaagauauaauuc

SEQ ID NO: 233009 - RNA, 22 nt, Human
agagccaggaaguggcgugggg

SEQ ID NO: 233010 - RNA, 22 nt, Human
uuccuggguugugcauuguaca

SEQ ID NO: 233011 - RNA, 23 nt, Human
cccagaccuugugcugcccuugg

SEQ ID NO: 233012 - RNA, 22 nt, Human
auaguuacauacagaaauauuu

SEQ ID NO: 233013 - RNA, 20 nt, Human
agccaggguucuggaugcac

SEQ ID NO: 233014 - RNA, 23 nt, Human
uggagcuccugcccauccuggcu

SEQ ID NO: 233015 - RNA, 22 nt, Human
gagccagguuggaggcugcagu

SEQ ID NO: 233016 - RNA, 22 nt, Human
cagcagagacgguaagcagaac

SEQ ID NO: 233017 - RNA, 22 nt, Human
ccuuagaaaaucauggaauauu

SEQ ID NO: 233018 - RNA, 22 nt, Human
gggcuccaguuuggccaggaag

SEQ ID NO: 233019 - RNA, 22 nt, Human
ugugugcacaaagaguacaugg

SEQ ID NO: 233020 - RNA, 22 nt, Human
cccucagagccugaagcaagca

SEQ ID NO: 233021 - RNA, 19 nt, Human
ucccaggaagcaaauguca

SEQ ID NO: 233022 - RNA, 22 nt, Human
caggccucaugguguguccuuc

SEQ ID NO: 233023 - RNA, 18 nt, Human
ccagcccugcagcaccug

SEQ ID NO: 233024 - RNA, 22 nt, Human
uuccugggcugcagagagcacc

SEQ ID NO: 233025 - RNA, 22 nt, Human
ccauaaucauguaaguaaauuc

SEQ ID NO: 233026 - RNA, 22 nt, Human
gggaacuugccccagaggaauu

SEQ ID NO: 233027 - RNA, 22 nt, Human
ggagucuuggccugcugagaaa

SEQ ID NO: 233028 - RNA, 22 nt, Human
ugucuucaucucagacacaguu

SEQ ID NO: 233029 - RNA, 22 nt, Human
gauguacacucagaaaagucau

SEQ ID NO: 233030 - RNA, 22 nt, Human
ccagucccagcucugccaugcu

SEQ ID NO: 233031 - RNA, 22 nt, Human
cugcuucuccaaaguaggacuu

SEQ ID NO: 233032 - RNA, 22 nt, Human
cuuucauaaaggaaaugaugag

SEQ ID NO: 233033 - RNA, 22 nt, Human
uuucaguuuccagcuuugucau

SEQ ID NO: 233034 - RNA, 22 nt, Human
agcagcucccuccucagccacc

SEQ ID NO: 233035 - RNA, 22 nt, Human
gcugagagugggugcagugcuu

SEQ ID NO: 233036 - RNA, 22 nt, Human
uagaacagaguuccagugauca

SEQ ID NO: 233037 - RNA, 22 nt, Human
cggggcugcgcucuuccugccg

SEQ ID NO: 233038 - RNA, 22 nt, Human
caucucugguucagucucugug

SEQ ID NO: 233039 - RNA, 17 nt, Human
gccugcaggcccgcaga

SEQ ID NO: 233040 - RNA, 19 nt, Human
ccaggaaccccuagcuacc

SEQ ID NO: 233041 - RNA, 21 nt, Human
gcugggucagcagguccucug

SEQ ID NO: 233042 - RNA, 22 nt, Human
ugccaggcauauggccucuuug

SEQ ID NO: 233043 - RNA, 22 nt, Human
gcucuggcccaaacccuuucua

SEQ ID NO: 233044 - RNA, 22 nt, Human
uucuccaggggaggguucucca

SEQ ID NO: 233045 - RNA, 22 nt, Human
uagcgagguguuucuaggacug

SEQ ID NO: 233046 - RNA, 22 nt, Human
uaaaggauuuuguauaauauaa

SEQ ID NO: 233047 - RNA, 22 nt, Human
uccuguggcuuccacgaccuaa

SEQ ID NO: 233048 - RNA, 22 nt, Human
uuuaaguuccuuuucaacaacu

SEQ ID NO: 233049 - RNA, 22 nt, Human
gcagacaggauuggguuaauag

SEQ ID NO: 233050 - RNA, 22 nt, Human
uucuagaaccaugacuucaggg

SEQ ID NO: 233051 - RNA, 22 nt, Human
ccugacaggcggaggcugcagu

SEQ ID NO: 233052 - RNA, 22 nt, Human
cuguucuuuaguuccacugcaa

SEQ ID NO: 233053 - RNA, 22 nt, Human
aaagugcugagacagacuggga

SEQ ID NO: 233054 - RNA, 22 nt, Human
uucauuuaaucagaaucucuaa

SEQ ID NO: 233055 - RNA, 23 nt, Human
uugcacauuggagcuggucuucu

SEQ ID NO: 233056 - RNA, 22 nt, Human
caggucucggguucagcaguga

SEQ ID NO: 233057 - RNA, 22 nt, Human
gcucuguaucuuacaacagggu

SEQ ID NO: 233058 - RNA, 22 nt, Human
ucaaacacuguaacauggaaaa

SEQ ID NO: 233059 - RNA, 22 nt, Human
uuagcaccuugaacagacccug

SEQ ID NO: 233060 - RNA, 22 nt, Human
cugcaaaauuguucuuugcucc

SEQ ID NO: 233061 - RNA, 22 nt, Human
guuacaaaggaagcuucacugc

SEQ ID NO: 233062 - RNA, 22 nt, Human
gucuacacugaauuuccacaga

SEQ ID NO: 233063 - RNA, 22 nt, Human
ggcagccaugcuccaggugcag

SEQ ID NO: 233064 - RNA, 22 nt, Human
uuacauucuuaucucaguuauu

SEQ ID NO: 233065 - RNA, 22 nt, Human
uacaagaaacuacaugaaugca

SEQ ID NO: 233066 - RNA, 22 nt, Human
ggacccugggcuugcuccuggg

SEQ ID NO: 233067 - RNA, 22 nt, Human
cuggcccagagcucuggccuuu

SEQ ID NO: 233068 - RNA, 22 nt, Human
uagagagccaguugucauaguu

SEQ ID NO: 233069 - RNA, 21 nt, Human
ugaugaggucauagcacccuc

SEQ ID NO: 233070 - RNA, 22 nt, Human
uguauucagugauuucacaaua

SEQ ID NO: 233071 - RNA, 22 nt, Human
caaggcuguguuagcugcccuc

SEQ ID NO: 233072 - RNA, 22 nt, Human
aagacaaugaguccugauggga

SEQ ID NO: 233073 - RNA, 22 nt, Human
ucaaaaguuucacauagagaua

SEQ ID NO: 233074 - RNA, 22 nt, Human
uaggccaggaaucagcaagcuu

SEQ ID NO: 233075 - RNA, 22 nt, Human
agaugcagacuugguucaggca

SEQ ID NO: 233076 - RNA, 19 nt, Human
ucucacaucagcuccuagc

SEQ ID NO: 233077 - RNA, 22 nt, Human
ugugugcaggcacugugccaga

SEQ ID NO: 233078 - RNA, 22 nt, Human
ucccugagcugagcucaacagc

SEQ ID NO: 233079 - RNA, 22 nt, Human
agcucccagaaggcccugcgcc

SEQ ID NO: 233080 - RNA, 22 nt, Human
ugugaaagucaaauuaauugaa

SEQ ID NO: 233081 - RNA, 23 nt, Human
uugggaaauaguuaagacaugag

SEQ ID NO: 233082 - RNA, 22 nt, Human
ggagccagaguuuaauguggag

SEQ ID NO: 233083 - RNA, 22 nt, Human
gagcuggcuaauacugacuuau

SEQ ID NO: 233084 - RNA, 22 nt, Human
uauuaacaugaacugacuuuuc

SEQ ID NO: 233085 - RNA, 22 nt, Human
auugagcuguuuuguaggauaa

SEQ ID NO: 233086 - RNA, 22 nt, Human
aagcaauugguuuuaguaaaau

SEQ ID NO: 233087 - RNA, 22 nt, Human
aguguccuuguuauuacugcuc

SEQ ID NO: 233088 - RNA, 22 nt, Human
uccagccacucagcagggauug

SEQ ID NO: 233089 - RNA, 22 nt, Human
ugaaggcuuuuagcucugaaaa

SEQ ID NO: 233090 - RNA, 22 nt, Human
aauagaauguaaucuaauacau

SEQ ID NO: 233091 - RNA, 22 nt, Human
uuccuaacaaacuucagugaau

SEQ ID NO: 233092 - RNA, 20 nt, Human
auucagaauaggcauguaaa

SEQ ID NO: 233093 - RNA, 22 nt, Human
auggacaaugugaaacuacaag

SEQ ID NO: 233094 - RNA, 22 nt, Human
ugccaggccacguagcuucaag

SEQ ID NO: 233095 - RNA, 22 nt, Human
ucagcuggcaucggcucaccca

SEQ ID NO: 233096 - RNA, 22 nt, Human
gagguggcacugugaggagcac

SEQ ID NO: 233097 - RNA, 22 nt, Human
aagaacugugcuccaggcucca

SEQ ID NO: 233098 - RNA, 19 nt, Human
cgcaggcuucgggucgcuc

SEQ ID NO: 233099 - RNA, 22 nt, Human
caggcucuagguuaguaggaga

SEQ ID NO: 233100 - RNA, 22 nt, Human
aaggaagaugcuggccugggga

SEQ ID NO: 233101 - RNA, 22 nt, Human
uauuuccaggccccacucuaga

SEQ ID NO: 233102 - RNA, 22 nt, Human
ugcucagcagucaaggucauag

SEQ ID NO: 233103 - RNA, 22 nt, Human
guacuucuggccaggcuggcca

SEQ ID NO: 233104 - RNA, 22 nt, Human
aauuucuguaugaauagagaaa

SEQ ID NO: 233105 - RNA, 22 nt, Human
uucagugugugauaccugcugu

SEQ ID NO: 233106 - RNA, 22 nt, Human
agcagaugaaucccagauaaag

SEQ ID NO: 233107 - RNA, 20 nt, Human
accagaggaaagagcaguga

SEQ ID NO: 233108 - RNA, 22 nt, Human
cuggcuggucugagcagucgca

SEQ ID NO: 233109 - RNA, 19 nt, Human
uccugcagaccagaccugu

SEQ ID NO: 233110 - RNA, 22 nt, Human
uucucugguaaacacaugcgua

SEQ ID NO: 233111 - RNA, 22 nt, Human
aucuuacagcagcaaggaagua

SEQ ID NO: 233112 - RNA, 22 nt, Human
aauuccaaaucaacuagucuag

SEQ ID NO: 233113 - RNA, 22 nt, Human
caaaaugugagucccaccucaa

SEQ ID NO: 233114 - RNA, 23 nt, Human
cucccuggcccuugggagaccug

SEQ ID NO: 233115 - RNA, 22 nt, Human
cugcagagcagccaguccccca

SEQ ID NO: 233116 - RNA, 22 nt, Human
aaaggcuaugagauagaagaua

SEQ ID NO: 233117 - RNA, 22 nt, Human
cauuucuguacauguuuuggug

SEQ ID NO: 233118 - RNA, 22 nt, Human
agcuucucaucuuccaaaauug

SEQ ID NO: 233119 - RNA, 21 nt, Human
ugcagcagaguaagcagggga

SEQ ID NO: 233120 - RNA, 22 nt, Human
gcucagagagaggauauguuau

SEQ ID NO: 233121 - RNA, 22 nt, Human
cuccugggaauuuaguugugag

SEQ ID NO: 233122 - RNA, 22 nt, Human
uguacaugugucuguauaucuu

SEQ ID NO: 233123 - RNA, 22 nt, Human
guguuacuugccauacagaaaa

SEQ ID NO: 233124 - RNA, 22 nt, Human
uuuuagauaguuuaacugcacu

SEQ ID NO: 233125 - RNA, 22 nt, Human
uucuuguaauuuggagaaauga

SEQ ID NO: 233126 - RNA, 22 nt, Human
accuugggcaaguuggaaacug

SEQ ID NO: 233127 - RNA, 22 nt, Human
gcuggccaggaagagucucaga

SEQ ID NO: 233128 - RNA, 22 nt, Human
ugacagcaugaccacagggucu

SEQ ID NO: 233129 - RNA, 22 nt, Human
uaagacaccucucugcccuuca

SEQ ID NO: 233130 - RNA, 22 nt, Human
caggagaggaggcuacuucuua

SEQ ID NO: 233131 - RNA, 22 nt, Human
uaauugaacuaacaugcaaaca

SEQ ID NO: 233132 - RNA, 22 nt, Human
aaauguacugauacuuauuuua

SEQ ID NO: 233133 - RNA, 22 nt, Human
uauuuuaaagugaagggucuug

SEQ ID NO: 233134 - RNA, 22 nt, Human
ggguccagaaugagaaugggcu

SEQ ID NO: 233135 - RNA, 22 nt, Human
uauuauugaaucaguucuuuga

SEQ ID NO: 233136 - RNA, 22 nt, Human
cauggcaacaacucuuuauucc

SEQ ID NO: 233137 - RNA, 22 nt, Human
uguuuauaccuugguauaacca

SEQ ID NO: 233138 - RNA, 23 nt, Human
aauucaaauucagugugacuagg

SEQ ID NO: 233139 - RNA, 22 nt, Human
guacccuguggccagccagcca

SEQ ID NO: 233140 - RNA, 22 nt, Human
augguuuacaauguuuucaguu

SEQ ID NO: 233141 - RNA, 22 nt, Human
uauaugcaauuuuuuagugcaa

SEQ ID NO: 233142 - RNA, 21 nt, Human
aucuagaaucucucuccccac

SEQ ID NO: 233143 - RNA, 22 nt, Human
aagccagauuucacucuuaauu

SEQ ID NO: 233144 - RNA, 22 nt, Human
cucauuuaacagauuaaaaagu

SEQ ID NO: 233145 - RNA, 22 nt, Human
cccuccccacaaagcuucacac

SEQ ID NO: 233146 - RNA, 22 nt, Human
guacaaauugauacagguuuuc

SEQ ID NO: 233147 - RNA, 22 nt, Human
uuuauugacuucagugagucuu

SEQ ID NO: 233148 - RNA, 22 nt, Human
gagcagagcuucucaaaguaaa

SEQ ID NO: 233149 - RNA, 20 nt, Human
uaugaauucuggucccuggg

SEQ ID NO: 233150 - RNA, 19 nt, Human
cuuccuggaggagagccuc

SEQ ID NO: 233151 - RNA, 22 nt, Human
acagacagggcaccugccuccu

SEQ ID NO: 233152 - RNA, 22 nt, Human
cccagccucugggcucacccaa

SEQ ID NO: 233153 - RNA, 22 nt, Human
guauuuuaagugacuacuaggu

SEQ ID NO: 233154 - RNA, 20 nt, Human
aaagucuguuuaucucugga

SEQ ID NO: 233155 - RNA, 22 nt, Human
agucuggugagaacauaaauag

SEQ ID NO: 233156 - RNA, 22 nt, Human
ugccuugcuuaacaagauggca

SEQ ID NO: 233157 - RNA, 23 nt, Human
ccuccaugguaagaagcuuagag

SEQ ID NO: 233158 - RNA, 22 nt, Human
cacauuucuaggaaauuaaaug

SEQ ID NO: 233159 - RNA, 22 nt, Human
cagggcaguaccgcccucuggc

SEQ ID NO: 233160 - RNA, 22 nt, Human
ggagaaagggacugaucugcuc

SEQ ID NO: 233161 - RNA, 22 nt, Human
aggaaaggccucagcagaaacc

SEQ ID NO: 233162 - RNA, 22 nt, Human
uucaugugauaaaugugugacu

SEQ ID NO: 233163 - RNA, 22 nt, Human
cauaauaucuccgauuacuugc

SEQ ID NO: 233164 - RNA, 22 nt, Human
agugcauucaguauucauaggc

SEQ ID NO: 233165 - RNA, 22 nt, Human
uccagaccaugugagaggcgca

SEQ ID NO: 233166 - RNA, 22 nt, Human
gccaggcugccuuaucucuagc

SEQ ID NO: 233167 - RNA, 22 nt, Human
cagcuuuaggacucauaauaaa

SEQ ID NO: 233168 - RNA, 22 nt, Human
agacccugcaccucucgugggc

SEQ ID NO: 233169 - RNA, 22 nt, Human
uuagaguuuuuguaaguacaau

SEQ ID NO: 233170 - RNA, 22 nt, Human
ugaucuggaauucccuguggua

SEQ ID NO: 233171 - RNA, 22 nt, Human
aauaaaucaauccuauugguag

SEQ ID NO: 233172 - RNA, 22 nt, Human
ccacugaguacccgauggcugc

SEQ ID NO: 233173 - RNA, 22 nt, Human
uuccacuuuucucucucaugcc

SEQ ID NO: 233174 - RNA, 22 nt, Human
ccuggaucagucacuguugcug

SEQ ID NO: 233175 - RNA, 22 nt, Human
aacaggcacuaagcaugugggg

SEQ ID NO: 233176 - RNA, 22 nt, Human
uuuucucuauauugucugugaa

SEQ ID NO: 233177 - RNA, 22 nt, Human
uaauuucuggagggagaaagag

SEQ ID NO: 233178 - RNA, 22 nt, Human
gcucagagaaguuaaggaauuu

SEQ ID NO: 233179 - RNA, 22 nt, Human
ggcagaggaggggugaauuugc

SEQ ID NO: 233180 - RNA, 22 nt, Human
uccacccugcuuuugucuuuga

SEQ ID NO: 233181 - RNA, 22 nt, Human
uuugggaauaauugcacagauu

SEQ ID NO: 233182 - RNA, 22 nt, Human
gucucagauaacauguauucua

SEQ ID NO: 233183 - RNA, 22 nt, Human
ugguauguaauaaguguucuaa

SEQ ID NO: 233184 - RNA, 22 nt, Human
ucaacacaacagagaaaugcug

SEQ ID NO: 233185 - RNA, 22 nt, Human
uuuccaaaggaggaaccaguuu

SEQ ID NO: 233186 - RNA, 22 nt, Human
ugacuucugggugagccagcau

SEQ ID NO: 233187 - RNA, 18 nt, Human
cccacggugcuguagggc

SEQ ID NO: 233188 - RNA, 22 nt, Human
agaacuguccuuggaggagagu

SEQ ID NO: 233189 - RNA, 22 nt, Human
aucucuguuuuaggagauagug

SEQ ID NO: 233190 - RNA, 22 nt, Human
aucgugcauuuuuauuaacccu

SEQ ID NO: 233191 - RNA, 16 nt, Human
gcagguggggcgcgca

SEQ ID NO: 233192 - RNA, 22 nt, Human
auacaacagaaaaugauuauuc

SEQ ID NO: 233193 - RNA, 22 nt, Human
gccaggcaaauuaaggaaugca

SEQ ID NO: 233194 - RNA, 20 nt, Human
gccacugggcaccagcaggg

SEQ ID NO: 233195 - RNA, 20 nt, Human
gcucaguggagaaaugcacc

SEQ ID NO: 233196 - RNA, 22 nt, Human
acugggcccagugguguggcug

SEQ ID NO: 233197 - RNA, 22 nt, Human
agcagcuugggucucuccugcu

SEQ ID NO: 233198 - RNA, 22 nt, Human
aggucagaagugccagggaauu

SEQ ID NO: 233199 - RNA, 22 nt, Human
gaggcugguucugaaguacugu

SEQ ID NO: 233200 - RNA, 22 nt, Human
aaguguuuaacggugauugagc

SEQ ID NO: 233201 - RNA, 22 nt, Human
agauaugucccugucuaauauu

SEQ ID NO: 233202 - RNA, 22 nt, Human
acuguaaagaaguaaguauggg

SEQ ID NO: 233203 - RNA, 19 nt, Human
uguggccaugguucagcug

SEQ ID NO: 233204 - RNA, 22 nt, Human
uccugagcucccaugaacaggc

SEQ ID NO: 233205 - RNA, 20 nt, Human
uagaacuuuucaguauggau

SEQ ID NO: 233206 - RNA, 22 nt, Human
cccacaggugugagcuugcugg

SEQ ID NO: 233207 - RNA, 22 nt, Human
uagaagcacagguuaaaggcau

SEQ ID NO: 233208 - RNA, 22 nt, Human
aguggggcggacaggaccagga

SEQ ID NO: 233209 - RNA, 22 nt, Human
cuuccagucuagagcuaucugu

SEQ ID NO: 233210 - RNA, 23 nt, Human
ugggucucuaguacaggcaggca

SEQ ID NO: 233211 - RNA, 22 nt, Human
aggucaagggcaagagugaggu

SEQ ID NO: 233212 - RNA, 22 nt, Human
uccccaggaaauucugauucuu

SEQ ID NO: 233213 - RNA, 22 nt, Human
cucuucuuauggccguggcuga

SEQ ID NO: 233214 - RNA, 22 nt, Human
uggcucugagacacaggcucuc

SEQ ID NO: 233215 - RNA, 22 nt, Human
caacaauuucccaguuucccau

SEQ ID NO: 233216 - RNA, 22 nt, Human
cagaaacagacaugacgcagua

SEQ ID NO: 233217 - RNA, 22 nt, Human
gcaaggaccuuugagcgugcca

SEQ ID NO: 233218 - RNA, 22 nt, Human
aagcuguuuuggccuuaguuga

SEQ ID NO: 233219 - RNA, 20 nt, Human
ugggucugcuuggcuucagu

SEQ ID NO: 233220 - RNA, 22 nt, Human
acaaaagugagugugucucaga

SEQ ID NO: 233221 - RNA, 22 nt, Human
ggaaagcuuuguuuuccucacc

SEQ ID NO: 233222 - RNA, 22 nt, Human
uaguagaauccaaaccaacagu

SEQ ID NO: 233223 - RNA, 22 nt, Human
agucuuacaugagaaagaaccu

SEQ ID NO: 233224 - RNA, 22 nt, Human
agugcugagugauugcaaagga

SEQ ID NO: 233225 - RNA, 20 nt, Human
cagaggcaaggagacuugga

SEQ ID NO: 233226 - RNA, 23 nt, Human
uggccuggagagaaaagaugagu

SEQ ID NO: 233227 - RNA, 22 nt, Human
cagcagguauguuuguucagca

SEQ ID NO: 233228 - RNA, 22 nt, Human
uucucuaagaguuauaugaauu

SEQ ID NO: 233229 - RNA, 22 nt, Human
ucagucuucccuccagugcaac

SEQ ID NO: 233230 - RNA, 22 nt, Human
ccucugaguacagugauggauu

SEQ ID NO: 233231 - RNA, 22 nt, Human
ugcuggaacucagugaaucauu

SEQ ID NO: 233232 - RNA, 22 nt, Human
aagaacaguugggaggugagcc

SEQ ID NO: 233233 - RNA, 22 nt, Human
agucuguguacuggguuucugu

SEQ ID NO: 233234 - RNA, 22 nt, Human
aaaggcuucagugaguggguau

SEQ ID NO: 233235 - RNA, 21 nt, Human
caucacauuacucaaaguccu

SEQ ID NO: 233236 - RNA, 22 nt, Human
gugcagggcagguguccuucca

SEQ ID NO: 233237 - RNA, 20 nt, Human
gucugcaguaagagggaaua

SEQ ID NO: 233238 - RNA, 22 nt, Human
caagcaggguuuaugcauggag

SEQ ID NO: 233239 - RNA, 22 nt, Human
aucuagaggagggcugcuggau

SEQ ID NO: 233240 - RNA, 22 nt, Human
ugcauacacacauagguauggg

SEQ ID NO: 233241 - RNA, 22 nt, Human
cagugcuauuuggacacaggga

SEQ ID NO: 233242 - RNA, 22 nt, Human
aggagcucagcuaaguuggaga

SEQ ID NO: 233243 - RNA, 22 nt, Human
agguuuaugccuuggagcuggg

SEQ ID NO: 233244 - RNA, 22 nt, Human
ugcaggugcugauaccuacucc

SEQ ID NO: 233245 - RNA, 22 nt, Human
uuacaguagcuuuauuuggagu

SEQ ID NO: 233246 - RNA, 22 nt, Human
uagggaugaggauagauuuuuc

SEQ ID NO: 233247 - RNA, 22 nt, Human
ucugagcuggagcccaucaccu

SEQ ID NO: 233248 - RNA, 21 nt, Human
ugucacuuuaagcuagcucua

SEQ ID NO: 233249 - RNA, 23 nt, Human
acuggacagaguggacgaggcug

SEQ ID NO: 233250 - RNA, 22 nt, Human
acuuccuguuaugugugccucu

SEQ ID NO: 233251 - RNA, 22 nt, Human
cucaaagaagggagguauuugg

SEQ ID NO: 233252 - RNA, 22 nt, Human
cugggugaguugaugaaggaga

SEQ ID NO: 233253 - RNA, 22 nt, Human
gacaugugucugcaaguugauc

SEQ ID NO: 233254 - RNA, 22 nt, Human
uuagcuguggaagcuucagcca

SEQ ID NO: 233255 - RNA, 22 nt, Human
cugcaggggcaguccacuuccu

SEQ ID NO: 233256 - RNA, 22 nt, Human
gauagauaaaacuauauuuuca

SEQ ID NO: 233257 - RNA, 22 nt, Human
ugaaacacugcgauaaaauccu

SEQ ID NO: 233258 - RNA, 22 nt, Human
acuugagagaaucggaggaguc

SEQ ID NO: 233259 - RNA, 22 nt, Human
cuuaauuucaaacugcuaguga

SEQ ID NO: 233260 - RNA, 22 nt, Human
aacuguagugcuuauagacucu

SEQ ID NO: 233261 - RNA, 22 nt, Human
aaguggcucauguggcuucugc

SEQ ID NO: 233262 - RNA, 22 nt, Human
ccaaggcagaagauggcucuug

SEQ ID NO: 233263 - RNA, 22 nt, Human
gcagagugauggaaugugggug

SEQ ID NO: 233264 - RNA, 21 nt, Human
ggcaagaaacacaaucaagua

SEQ ID NO: 233265 - RNA, 22 nt, Human
uuugcauuguaauauuuaguuc

SEQ ID NO: 233266 - RNA, 22 nt, Human
uggccuugaaccaggucuccac

SEQ ID NO: 233267 - RNA, 22 nt, Human
aacaaugugaagugcuguucag

SEQ ID NO: 233268 - RNA, 22 nt, Human
gagcugcuugcccagaagcaga

SEQ ID NO: 233269 - RNA, 22 nt, Human
aaugcagugagccauuaaaugg

SEQ ID NO: 233270 - RNA, 22 nt, Human
gggagggaggugcugguucacg

SEQ ID NO: 233271 - RNA, 22 nt, Human
cuuuaacaguuccauucaauuu

SEQ ID NO: 233272 - RNA, 22 nt, Human
gaucuuuacuacugccuucucu

SEQ ID NO: 233273 - RNA, 22 nt, Human
aguuugaagaaggugagaugca

SEQ ID NO: 233274 - RNA, 22 nt, Human
gggaccugccauugcucacagg

SEQ ID NO: 233275 - RNA, 22 nt, Human
guggaggaaaagaaguugggug

SEQ ID NO: 233276 - RNA, 22 nt, Human
gucaggaaaacccggguugacu

SEQ ID NO: 233277 - RNA, 22 nt, Human
uauccacacugggauguuuuga

SEQ ID NO: 233278 - RNA, 22 nt, Human
ggaaggcucuguuccuugacuu

SEQ ID NO: 233279 - RNA, 22 nt, Human
uaggaaauugccaauauaugac

SEQ ID NO: 233280 - RNA, 22 nt, Human
ugcugggcuguuccuguccaug

SEQ ID NO: 233281 - RNA, 22 nt, Human
cauuuuguaagucucucuuguu

SEQ ID NO: 233282 - RNA, 22 nt, Human
cccuucagcugagugggacagc

SEQ ID NO: 233283 - RNA, 22 nt, Human
uuauucagucugucuagggagu

SEQ ID NO: 233284 - RNA, 22 nt, Human
acccuggccugguucaugugau

SEQ ID NO: 233285 - RNA, 22 nt, Human
aaggggaauagaguggguugug

SEQ ID NO: 233286 - RNA, 19 nt, Human
cacaacuucgcuugauucc

SEQ ID NO: 233287 - RNA, 22 nt, Human
gggggcuguccugugcauugua

SEQ ID NO: 233288 - RNA, 22 nt, Human
ugggagccuggcaggccagagg

SEQ ID NO: 233289 - RNA, 22 nt, Human
acuccaaaaccugcggcuuggu

SEQ ID NO: 233290 - RNA, 22 nt, Human
acucagagaaacagcagggugu

SEQ ID NO: 233291 - RNA, 22 nt, Human
agcagcucauggaguaggcacu

SEQ ID NO: 233292 - RNA, 22 nt, Human
gaacaguauuuccaggaauccc

SEQ ID NO: 233293 - RNA, 22 nt, Human
ucucaaucaaacaugucugacu

SEQ ID NO: 233294 - RNA, 17 nt, Human
uggcccuagacuccagc

SEQ ID NO: 233295 - RNA, 19 nt, Human
gcccugaguaagcuaggag

SEQ ID NO: 233296 - RNA, 22 nt, Human
gagagcugcagccgagaggggg

SEQ ID NO: 233297 - RNA, 22 nt, Human
ugcuccagugccugccccacag

SEQ ID NO: 233298 - RNA, 22 nt, Human
caguuggugaugaggcuaguag

SEQ ID NO: 233299 - RNA, 22 nt, Human
cagggccauuggaacaaagagg

SEQ ID NO: 233300 - RNA, 22 nt, Human
gagguucaguaaggaauacuga

SEQ ID NO: 233301 - RNA, 22 nt, Human
acaggacucucugaaaauguac

SEQ ID NO: 233302 - RNA, 22 nt, Human
ggcaggggugaggccacucuga

SEQ ID NO: 233303 - RNA, 19 nt, Human
uguuggugcggauguggag

SEQ ID NO: 233304 - RNA, 18 nt, Human
agcaccagucacuaacag

SEQ ID NO: 233305 - RNA, 22 nt, Human
caggggcuuaagugacagaagg

SEQ ID NO: 233306 - RNA, 22 nt, Human
aggaagaaacugagcucugaca

SEQ ID NO: 233307 - RNA, 22 nt, Human
ucucuggggguagaacucaggc

SEQ ID NO: 233308 - RNA, 22 nt, Human
augcaugcagggaagacaguag

SEQ ID NO: 233309 - RNA, 22 nt, Human
uaauacugagccaccagguagg

SEQ ID NO: 233310 - RNA, 22 nt, Human
cugucccuucauuauucacuac

SEQ ID NO: 233311 - RNA, 22 nt, Human
uauguacaagcacacaugugac

SEQ ID NO: 233312 - RNA, 22 nt, Human
ggcugaauguuggacacuuacg

SEQ ID NO: 233313 - RNA, 22 nt, Human
uagaaacccugccuuaguagcu

SEQ ID NO: 233314 - RNA, 21 nt, Human
gccugggaagagaaagguaag

SEQ ID NO: 233315 - RNA, 22 nt, Human
aaccagcuccagccuccauuca

SEQ ID NO: 233316 - RNA, 22 nt, Human
cuguccugucugcuuuuaauuu

SEQ ID NO: 233317 - RNA, 22 nt, Human
aaggagucugggccauucagag

SEQ ID NO: 233318 - RNA, 22 nt, Human
uugaaugaauaguugcuagaag

SEQ ID NO: 233319 - RNA, 22 nt, Human
ucagacuugacuuuguaaguuu

SEQ ID NO: 233320 - RNA, 23 nt, Human
agacacuguaaagaauugcaguu

SEQ ID NO: 233321 - RNA, 22 nt, Human
acagcuuuaucucagggaucag

SEQ ID NO: 233322 - RNA, 22 nt, Human
uuauacuaaaacgcauugaauu

SEQ ID NO: 233323 - RNA, 22 nt, Human
uagcauaauuuguagaaaauca

SEQ ID NO: 233324 - RNA, 22 nt, Human
cacagcauuaacugggacagcu

SEQ ID NO: 233325 - RNA, 22 nt, Human
aaccuagaaguuagaguaucau

SEQ ID NO: 233326 - RNA, 22 nt, Human
agaaaacugggaggagagcuuc

SEQ ID NO: 233327 - RNA, 22 nt, Human
gcaugcugcugaggcuggaaua

SEQ ID NO: 233328 - RNA, 22 nt, Human
ucuccccaaccauggcacucac

SEQ ID NO: 233329 - RNA, 22 nt, Human
gggcugcugcugccagcgacac

SEQ ID NO: 233330 - RNA, 22 nt, Human
acuuagaauuaguguagaauga

SEQ ID NO: 233331 - RNA, 22 nt, Human
aaaguguugaagaaaauguuca

SEQ ID NO: 233332 - RNA, 22 nt, Human
ugguuuugcuaaaauagaaaga

SEQ ID NO: 233333 - RNA, 22 nt, Human
aaaggcuacgggggccgugugc

SEQ ID NO: 233334 - RNA, 22 nt, Human
ugcuggcuccucgaggcuucgu

SEQ ID NO: 233335 - RNA, 21 nt, Human
gcaaguacuaucaucauuauc

SEQ ID NO: 233336 - RNA, 22 nt, Human
guguccaucucuguaugcugcu

SEQ ID NO: 233337 - RNA, 22 nt, Human
ucuggccccuggucucuggugu

SEQ ID NO: 233338 - RNA, 22 nt, Human
aaagaucaaguaggcauggccu

SEQ ID NO: 233339 - RNA, 22 nt, Human
ccuuagcaaauuggcaucuucu

SEQ ID NO: 233340 - RNA, 20 nt, Human
cagcccuccaguggaggcag

SEQ ID NO: 233341 - RNA, 18 nt, Human
aaauuauucuuccuuuuc

SEQ ID NO: 233342 - RNA, 22 nt, Human
uacacaguuccauuuaagccag

SEQ ID NO: 233343 - RNA, 22 nt, Human
aauccauugcugugcugccagg

SEQ ID NO: 233344 - RNA, 23 nt, Human
aggcuuccuaucuuagagcuggg

SEQ ID NO: 233345 - RNA, 22 nt, Human
gcacagaggaagcacagacucu

SEQ ID NO: 233346 - RNA, 22 nt, Human
cauuaaauuccuuguucucaaa

SEQ ID NO: 233347 - RNA, 22 nt, Human
ggcaggcauuagagauucccag

SEQ ID NO: 233348 - RNA, 22 nt, Human
uggggagcccacucaccucccc

SEQ ID NO: 233349 - RNA, 22 nt, Human
gcagcugggucugugugggcug

SEQ ID NO: 233350 - RNA, 22 nt, Human
cccagcugaacuugcauuccaa

SEQ ID NO: 233351 - RNA, 16 nt, Human
augaggcauaggcugc

SEQ ID NO: 233352 - RNA, 22 nt, Human
uggcugacaaauaggugcaguu

SEQ ID NO: 233353 - RNA, 22 nt, Human
aaagagcuuuccacacuaguca

SEQ ID NO: 233354 - RNA, 22 nt, Human
uggaggcugguuucugcugagg

SEQ ID NO: 233355 - RNA, 22 nt, Human
uucuagaggggagauacuagua

SEQ ID NO: 233356 - RNA, 22 nt, Human
uauuuguagaauggauuaaggg

SEQ ID NO: 233357 - RNA, 17 nt, Human
uccuccccgcaguugca

SEQ ID NO: 233358 - RNA, 22 nt, Human
gaacucuugguggucauuagau

SEQ ID NO: 233359 - RNA, 22 nt, Human
aaggugguuugcagacagaaua

SEQ ID NO: 233360 - RNA, 22 nt, Human
uuuacuguucaacuugcaagua

SEQ ID NO: 233361 - RNA, 22 nt, Human
aaaagucuacaagcuucaacaa

SEQ ID NO: 233362 - RNA, 22 nt, Human
agcuucuuaaguuccugcagca

SEQ ID NO: 233363 - RNA, 17 nt, Human
cauuugcugguuggcuc

SEQ ID NO: 233364 - RNA, 22 nt, Human
aagcacaucauguuguucagac

SEQ ID NO: 233365 - RNA, 22 nt, Human
ucccucagagaccguggugcag

SEQ ID NO: 233366 - RNA, 21 nt, Human
ugugucagucuuuggaagcaa

SEQ ID NO: 233367 - RNA, 22 nt, Human
cacagagaacugugggagugug

SEQ ID NO: 233368 - RNA, 22 nt, Human
guauuuuacuuacgcaugacuu

SEQ ID NO: 233369 - RNA, 22 nt, Human
uccuuagcacccaccaaggacu

SEQ ID NO: 233370 - RNA, 22 nt, Human
acaaagugugcggagcccaggg

SEQ ID NO: 233371 - RNA, 22 nt, Human
aaugcauucucgguuugugugu

SEQ ID NO: 233372 - RNA, 22 nt, Human
gcacaaguuucuucauuguuca

SEQ ID NO: 233373 - RNA, 22 nt, Human
agcauccacucacugggagagg

SEQ ID NO: 233374 - RNA, 22 nt, Human
ucacaggcuccagggccuggau

SEQ ID NO: 233375 - RNA, 21 nt, Human
uaacacauuuugguacuuugg

SEQ ID NO: 233376 - RNA, 22 nt, Human
aaaggacacacaggaggugucu

SEQ ID NO: 233377 - RNA, 22 nt, Human
gcucagugaaacaucaaauagu

SEQ ID NO: 233378 - RNA, 22 nt, Human
caguuuauaugucagagcugua

SEQ ID NO: 233379 - RNA, 22 nt, Human
accacuuaucaucacuaucuca

SEQ ID NO: 233380 - RNA, 22 nt, Human
ugaaagcauuagucuaagguag

SEQ ID NO: 233381 - RNA, 22 nt, Human
gcuaggcucggaagcagcaggg

SEQ ID NO: 233382 - RNA, 21 nt, Human
gcagaauagucucugucuuca

SEQ ID NO: 233383 - RNA, 22 nt, Human
ucugagacccauacaggcccac

SEQ ID NO: 233384 - RNA, 22 nt, Human
uucuuuucggccugugagaagg

SEQ ID NO: 233385 - RNA, 22 nt, Human
cggcuucuucaucaggucagca

SEQ ID NO: 233386 - RNA, 22 nt, Human
aauaagauccugaagauauguu

SEQ ID NO: 233387 - RNA, 22 nt, Human
augaguucccaggugauuugug

SEQ ID NO: 233388 - RNA, 22 nt, Human
aggggagcuaacaccagagccc

SEQ ID NO: 233389 - RNA, 22 nt, Human
gagguggguguaucacagguca

SEQ ID NO: 233390 - RNA, 22 nt, Human
cagggagcuggaguuggaguac

SEQ ID NO: 233391 - RNA, 22 nt, Human
aacauuguuuugcacaacucuu

SEQ ID NO: 233392 - RNA, 22 nt, Human
uacagucaacauugaugaugau

SEQ ID NO: 233393 - RNA, 22 nt, Human
uguaagaaaaguaaauagugac

SEQ ID NO: 233394 - RNA, 22 nt, Human
cucagagcccaggguacacccg

SEQ ID NO: 233395 - RNA, 22 nt, Human
gaggagcaugggaaggcucugg

SEQ ID NO: 233396 - RNA, 22 nt, Human
aggaggaagggaagacaaguaa

SEQ ID NO: 233397 - RNA, 22 nt, Human
cauuguuuugagaacaaccuga

SEQ ID NO: 233398 - RNA, 22 nt, Human
uggcucccgcagacccugugcu

SEQ ID NO: 233399 - RNA, 22 nt, Human
agggagaacaguugcagcagac

SEQ ID NO: 233400 - RNA, 22 nt, Human
cugccugugugugccugcagaa

SEQ ID NO: 233401 - RNA, 22 nt, Human
acacugugugacuucugagacu

SEQ ID NO: 233402 - RNA, 22 nt, Human
agcuggaggauaacucacuucu

SEQ ID NO: 233403 - RNA, 22 nt, Human
cagcuguguagaugcaggguca

SEQ ID NO: 233404 - RNA, 22 nt, Human
acagcaggaauuaacauauaag

SEQ ID NO: 233405 - RNA, 22 nt, Human
auuaaauuggaucugcauaguu

SEQ ID NO: 233406 - RNA, 22 nt, Human
uggcuggcuguccagcugggca

SEQ ID NO: 233407 - RNA, 22 nt, Human
agcuaaugaaauauuuucugau

SEQ ID NO: 233408 - RNA, 19 nt, Human
cauaauacaguggaucuga

SEQ ID NO: 233409 - RNA, 22 nt, Human
ugucccuggaacuauggcucca

SEQ ID NO: 233410 - RNA, 22 nt, Human
aaagcugcaagcuccugaggaa

SEQ ID NO: 233411 - RNA, 22 nt, Human
uucccagugauugaacaucccu

SEQ ID NO: 233412 - RNA, 22 nt, Human
cuagaaagauacuuaaaucaag

SEQ ID NO: 233413 - RNA, 22 nt, Human
ugcauugagauuuuaaaauuca

SEQ ID NO: 233414 - RNA, 18 nt, Human
gccucccuggcuacacuu

SEQ ID NO: 233415 - RNA, 22 nt, Human
ccugggcuugcaucugugcugg

SEQ ID NO: 233416 - RNA, 22 nt, Human
gcaggccucuguugagggccuu

SEQ ID NO: 233417 - RNA, 22 nt, Human
gauguacuuuaaaauacuucag

SEQ ID NO: 233418 - RNA, 22 nt, Human
ccauuuguuuucgcuaccaugg

SEQ ID NO: 233419 - RNA, 22 nt, Human
agcugguaaaggggaaagcaga

SEQ ID NO: 233420 - RNA, 22 nt, Human
cacaggagcccugaggccuccc

SEQ ID NO: 233421 - RNA, 22 nt, Human
ccagagccggauugugaagugc

SEQ ID NO: 233422 - RNA, 22 nt, Human
agggaaaucuuucaacacuuca

SEQ ID NO: 233423 - RNA, 21 nt, Human
aagucugguugauuccuuugc

SEQ ID NO: 233424 - RNA, 22 nt, Human
acacuuuuaagacuuuaaugaa

SEQ ID NO: 233425 - RNA, 22 nt, Human
aaauuucuaagcagccacuucc

SEQ ID NO: 233426 - RNA, 22 nt, Human
aggaaggcacauuguuggcuaa

SEQ ID NO: 233427 - RNA, 22 nt, Human
ccaggcugcagucaaggggcau

SEQ ID NO: 233428 - RNA, 22 nt, Human
acaguaaauaaugcauguugau

SEQ ID NO: 233429 - RNA, 22 nt, Human
uccagcccuguggcuuccaccc

SEQ ID NO: 233430 - RNA, 22 nt, Human
uaaccuacuaugauucugggaa

SEQ ID NO: 233431 - RNA, 22 nt, Human
ucuccgaucacagguuuucaau

SEQ ID NO: 233432 - RNA, 22 nt, Human
cauuagggccaccauaacaaaa

SEQ ID NO: 233433 - RNA, 23 nt, Human
ugcaacaaugaggaaagcuacug

SEQ ID NO: 233434 - RNA, 22 nt, Human
aaaguccuagcgauccacagaa

SEQ ID NO: 233435 - RNA, 22 nt, Human
ccagggcagggaccacgugucu

SEQ ID NO: 233436 - RNA, 20 nt, Human
aaagauacuuuuuguaaugg

SEQ ID NO: 233437 - RNA, 22 nt, Human
ccagggcagcgccccuccacgc

SEQ ID NO: 233438 - RNA, 22 nt, Human
agagccuugaagaucuggaaaa

SEQ ID NO: 233439 - RNA, 22 nt, Human
aagagagacaauagguagcauu

SEQ ID NO: 233440 - RNA, 22 nt, Human
uuuacaguccccaggugaggau

SEQ ID NO: 233441 - RNA, 20 nt, Human
cuugguggcucugggaagug

SEQ ID NO: 233442 - RNA, 22 nt, Human
gaaaugaugucugugcugccac

SEQ ID NO: 233443 - RNA, 22 nt, Human
cugccagguuggcgcucgcucu

SEQ ID NO: 233444 - RNA, 22 nt, Human
ucugacuuuucucacuguugug

SEQ ID NO: 233445 - RNA, 22 nt, Human
ggggaggagccauguaacuagu

SEQ ID NO: 233446 - RNA, 22 nt, Human
cuggcuggaacgccgaggcggc

SEQ ID NO: 233447 - RNA, 22 nt, Human
uauaucauggagauuaacauuc

SEQ ID NO: 233448 - RNA, 22 nt, Human
aauuuuacaagaaggccucgua

SEQ ID NO: 233449 - RNA, 22 nt, Human
cauuuccacuucugaaaacugg

SEQ ID NO: 233450 - RNA, 18 nt, Human
ggccucagccuggccgga

SEQ ID NO: 233451 - RNA, 22 nt, Human
gcaaguacaaacgcaucggcug

SEQ ID NO: 233452 - RNA, 22 nt, Human
ucagagaaaggccaaaauauca

SEQ ID NO: 233453 - RNA, 20 nt, Human
aaggaacucacccaugggcu

SEQ ID NO: 233454 - RNA, 22 nt, Human
acacauauauacauauuugugc

SEQ ID NO: 233455 - RNA, 22 nt, Human
cauuaugugggaaaauguucuu

SEQ ID NO: 233456 - RNA, 22 nt, Human
auguuuacaaaaaggaggcuug

SEQ ID NO: 233457 - RNA, 22 nt, Human
caucaguaaggcaacauagcuu

SEQ ID NO: 233458 - RNA, 18 nt, Human
uagaaucuguuauugccu

SEQ ID NO: 233459 - RNA, 23 nt, Human
augcccuguagaggcugcugacc

SEQ ID NO: 233460 - RNA, 22 nt, Human
acaugacaagguuuauaaggcu

SEQ ID NO: 233461 - RNA, 22 nt, Human
ucaggcugccuaucagacugug

SEQ ID NO: 233462 - RNA, 22 nt, Human
ggcugaaagcgcgacuugcccc

SEQ ID NO: 233463 - RNA, 22 nt, Human
ugccucugugugcaggugagca

SEQ ID NO: 233464 - RNA, 22 nt, Human
auaguacauggguguccucaca

SEQ ID NO: 233465 - RNA, 22 nt, Human
ucccagagucagagguggggcc

SEQ ID NO: 233466 - RNA, 22 nt, Human
gaggcugaaguguacaugggug

SEQ ID NO: 233467 - RNA, 20 nt, Human
ugccuuagagauaaaggcuu

SEQ ID NO: 233468 - RNA, 18 nt, Human
gccagagggaagcaggug

SEQ ID NO: 233469 - RNA, 22 nt, Human
ggcugagcuuauauaugugcug

SEQ ID NO: 233470 - RNA, 22 nt, Human
caaaaaacacagaugucugugu

SEQ ID NO: 233471 - RNA, 22 nt, Human
aucuacagugcacaggacagcc

SEQ ID NO: 233472 - RNA, 22 nt, Human
aaucaagagcugacuauauuuu

SEQ ID NO: 233473 - RNA, 22 nt, Human
aacaauguucuuuuagcuugaa

SEQ ID NO: 233474 - RNA, 22 nt, Human
uauugcugccauuuuccaaugu

SEQ ID NO: 233475 - RNA, 22 nt, Human
guucucucagcgauagugaugg

SEQ ID NO: 233476 - RNA, 22 nt, Human
aucuuggggaauccucugugua

SEQ ID NO: 233477 - RNA, 23 nt, Human
aguuucuuugagacuugcccugu

SEQ ID NO: 233478 - RNA, 19 nt, Human
ucucuggcaguucagagca

SEQ ID NO: 233479 - RNA, 22 nt, Human
gcugggagcaaagccaugcaua

SEQ ID NO: 233480 - RNA, 22 nt, Human
uacauguggccagaaauuugag

SEQ ID NO: 233481 - RNA, 22 nt, Human
augcugcacaagccacauguag

SEQ ID NO: 233482 - RNA, 22 nt, Human
guuauuuuaucucugagagguu

SEQ ID NO: 233483 - RNA, 22 nt, Human
uccuggcuuccacuccucuguu

SEQ ID NO: 233484 - RNA, 22 nt, Human
gcaacagcauucucauugacau

SEQ ID NO: 233485 - RNA, 22 nt, Human
uggcccaguagaaaagggaucg

SEQ ID NO: 233486 - RNA, 22 nt, Human
ccaggaggcagaaguugcagug

SEQ ID NO: 233487 - RNA, 22 nt, Human
auuggagaagaacaugaauuag

SEQ ID NO: 233488 - RNA, 22 nt, Human
agaggccagaaggcgcaccccg

SEQ ID NO: 233489 - RNA, 22 nt, Human
uuuggaaauacgcguaggcaga

SEQ ID NO: 233490 - RNA, 22 nt, Human
ggcuuuauguuuuucauguggu

SEQ ID NO: 233491 - RNA, 22 nt, Human
uucaguuuugcuuuuaaucaug

SEQ ID NO: 233492 - RNA, 22 nt, Human
ugcuggcuguauaugugagagu

SEQ ID NO: 233493 - RNA, 22 nt, Human
cuacuucugugaugaaacuaca

SEQ ID NO: 233494 - RNA, 22 nt, Human
uuucuucaauugcuaacaagga

SEQ ID NO: 233495 - RNA, 22 nt, Human
aaaaccacuuccuugcuauugg

SEQ ID NO: 233496 - RNA, 22 nt, Human
acagcagagaacuuuagagggu

SEQ ID NO: 233497 - RNA, 22 nt, Human
auuuccuucggacaguuugggu

SEQ ID NO: 233498 - RNA, 22 nt, Human
ggagaggagauuguggcauuuu

SEQ ID NO: 233499 - RNA, 19 nt, Human
aucuagauuauugagaagg

SEQ ID NO: 233500 - RNA, 22 nt, Human
uccaggcaaagggacuagcagg

SEQ ID NO: 233501 - RNA, 22 nt, Human
aaucuagagaacuguggggcag

SEQ ID NO: 233502 - RNA, 22 nt, Human
cuggugcacuacagccuggaac

SEQ ID NO: 233503 - RNA, 22 nt, Human
uaaaaucauucuggugucagua

SEQ ID NO: 233504 - RNA, 22 nt, Human
acagucuacaaagugaugugug

SEQ ID NO: 233505 - RNA, 22 nt, Human
agucuguguaccuuuggccuuc

SEQ ID NO: 233506 - RNA, 22 nt, Human
auggaaaaggcugauuucauua

SEQ ID NO: 233507 - RNA, 22 nt, Human
uugcugggucagaagccaggag

SEQ ID NO: 233508 - RNA, 22 nt, Human
aaggggauagagcagacacucc

SEQ ID NO: 233509 - RNA, 18 nt, Human
ucaaaauauuucugugga

SEQ ID NO: 233510 - RNA, 22 nt, Human
aggccaggggugagcacuucug

SEQ ID NO: 233511 - RNA, 22 nt, Human
uuuauguaauuucauaggugug

SEQ ID NO: 233512 - RNA, 21 nt, Human
aaugucuuuguccaugcucug

SEQ ID NO: 233513 - RNA, 22 nt, Human
cagaggaacguuuggauugauu

SEQ ID NO: 233514 - RNA, 22 nt, Human
ggaaggguuuggaaagccgaga

SEQ ID NO: 233515 - RNA, 22 nt, Human
gcagaugcagaacucagugggu

SEQ ID NO: 233516 - RNA, 22 nt, Human
ucuguacaugaguugagaauca

SEQ ID NO: 233517 - RNA, 21 nt, Human
ucccugaguucucugagcauc

SEQ ID NO: 233518 - RNA, 22 nt, Human
aaacucagauguggugaagacc

SEQ ID NO: 233519 - RNA, 22 nt, Human
uguacaggagaacaaugagaaa

SEQ ID NO: 233520 - RNA, 22 nt, Human
ugugggaagauguugcaggaga

SEQ ID NO: 233521 - RNA, 22 nt, Human
uggugcaguagagcugucuggg

SEQ ID NO: 233522 - RNA, 22 nt, Human
ucuucuccagugcuucugcaca

SEQ ID NO: 233523 - RNA, 22 nt, Human
uagcuauuuggaaaauuccaau

SEQ ID NO: 233524 - RNA, 22 nt, Human
ucccugaugccuugauccgugg

SEQ ID NO: 233525 - RNA, 22 nt, Human
uguggcaguauaagagcuagaa

SEQ ID NO: 233526 - RNA, 22 nt, Human
gauacauuccauuucuacuuaa

SEQ ID NO: 233527 - RNA, 22 nt, Human
ucuagaaaguuuguacugauuu

SEQ ID NO: 233528 - RNA, 22 nt, Human
acccagagucauggcacuuagc

SEQ ID NO: 233529 - RNA, 22 nt, Human
agcagcucaagacuuaaauuug

SEQ ID NO: 233530 - RNA, 22 nt, Human
ccagggugggguccaggaacca

SEQ ID NO: 233531 - RNA, 22 nt, Human
uuugggcucacuaugcugaaga

SEQ ID NO: 233532 - RNA, 20 nt, Human
ucagagagagggugccacuu

SEQ ID NO: 233533 - RNA, 22 nt, Human
cccacacauuuuucacuuaccg

SEQ ID NO: 233534 - RNA, 22 nt, Human
uuccuggcauagagagggcaca

SEQ ID NO: 233535 - RNA, 22 nt, Human
ccagguguuuggccugcaugau

SEQ ID NO: 233536 - RNA, 22 nt, Human
acucuguaaagcauaacguuug

SEQ ID NO: 233537 - RNA, 23 nt, Human
aauaucugcagcuccuggggagg

SEQ ID NO: 233538 - RNA, 22 nt, Human
ugucuccauggugaagcagggu

SEQ ID NO: 233539 - RNA, 22 nt, Human
auaagacacgccccacucacuc

SEQ ID NO: 233540 - RNA, 22 nt, Human
uuccuucuagcccaaguauugg

SEQ ID NO: 233541 - RNA, 22 nt, Human
caugucccaaaugcaggcaaag

SEQ ID NO: 233542 - RNA, 22 nt, Human
guuuuccuucucagccauugcc

SEQ ID NO: 233543 - RNA, 22 nt, Human
ucuacauuuucacaaggucucc

SEQ ID NO: 233544 - RNA, 19 nt, Human
cugcuuccuucccucacug

SEQ ID NO: 233545 - RNA, 22 nt, Human
augucuuugccauaguucauau

SEQ ID NO: 233546 - RNA, 22 nt, Human
gaucagaguggcuagagccuug

SEQ ID NO: 233547 - RNA, 22 nt, Human
ucaauaacuuuguuuagcauug

SEQ ID NO: 233548 - RNA, 22 nt, Human
auucuuggcaaggagauuuaaa

SEQ ID NO: 233549 - RNA, 22 nt, Human
gugcaggcucucguucuugaca

SEQ ID NO: 233550 - RNA, 22 nt, Human
gaggaguguauuccacaccacu

SEQ ID NO: 233551 - RNA, 22 nt, Human
agcuucucccuuuccuauuggu

SEQ ID NO: 233552 - RNA, 22 nt, Human
uccaggcaucuguauuuuuuaa

SEQ ID NO: 233553 - RNA, 22 nt, Human
ugaagggguucagcaugggggu

SEQ ID NO: 233554 - RNA, 22 nt, Human
ugcuggaggccugacuguguuu

SEQ ID NO: 233555 - RNA, 22 nt, Human
uugcaggguccuguggcucucc

SEQ ID NO: 233556 - RNA, 22 nt, Human
aggcaggcacacuuccuccagg

SEQ ID NO: 233557 - RNA, 20 nt, Human
ugggcucugcuuccuggagu

SEQ ID NO: 233558 - RNA, 22 nt, Human
ucaggaagcugaauuacaaaaa

SEQ ID NO: 233559 - RNA, 22 nt, Human
uaacagaagaugaaacuucuuu

SEQ ID NO: 233560 - RNA, 22 nt, Human
uaaagcugaaaugauuaugaca

SEQ ID NO: 233561 - RNA, 22 nt, Human
guacauuuacugaugaaaagua

SEQ ID NO: 233562 - RNA, 17 nt, Human
cccugcacccuacucuc

SEQ ID NO: 233563 - RNA, 22 nt, Human
acuucugauuaaggaugaaugc

SEQ ID NO: 233564 - RNA, 22 nt, Human
uguccagagucacagagcucaa

SEQ ID NO: 233565 - RNA, 22 nt, Human
uuuguuacaaagaaagaagagc

SEQ ID NO: 233566 - RNA, 22 nt, Human
aaccuggcugcaaagaagggga

SEQ ID NO: 233567 - RNA, 22 nt, Human
guggcagauugcucaccauggu

SEQ ID NO: 233568 - RNA, 22 nt, Human
augagcaauuaggaagaaaaca

SEQ ID NO: 233569 - RNA, 22 nt, Human
agaauuagucacaauuauagga

SEQ ID NO: 233570 - RNA, 23 nt, Human
uaacucugugaagggugacuggg

SEQ ID NO: 233571 - RNA, 19 nt, Human
aaaaacuuaguccagaaag

SEQ ID NO: 233572 - RNA, 22 nt, Human
caggaagaaggguggugagucc

SEQ ID NO: 233573 - RNA, 22 nt, Human
gggcuccaucacaggcuccauc

SEQ ID NO: 233574 - RNA, 22 nt, Human
agauguuuaaaaagaugacucu

SEQ ID NO: 233575 - RNA, 21 nt, Human
agcaggaggcagucacagcuc

SEQ ID NO: 233576 - RNA, 22 nt, Human
gcauaguaggcugucaaaaaug

SEQ ID NO: 233577 - RNA, 22 nt, Human
ccaguuucuuaaguaggaagaa

SEQ ID NO: 233578 - RNA, 20 nt, Human
uggaaguucuguugcauugg

SEQ ID NO: 233579 - RNA, 22 nt, Human
uggaacacacuucaaggagaaa

SEQ ID NO: 233580 - RNA, 22 nt, Human
cacaccuguaauccuagcacuu

SEQ ID NO: 233581 - RNA, 22 nt, Human
gugaaaauaaggcugguucuug

SEQ ID NO: 233582 - RNA, 22 nt, Human
acagcagcuaaccccugggcca

SEQ ID NO: 233583 - RNA, 22 nt, Human
auguacaaccugcaugacaguc

SEQ ID NO: 233584 - RNA, 22 nt, Human
ugcuugaagccuacauucguca

SEQ ID NO: 233585 - RNA, 22 nt, Human
ggcaagagguccaagaggucuc

SEQ ID NO: 233586 - RNA, 22 nt, Human
auguaacuguuauauuuuguug

SEQ ID NO: 233587 - RNA, 22 nt, Human
auuaguguguaggcuggaaaaa

SEQ ID NO: 233588 - RNA, 20 nt, Human
gccugcagagaaggucagag

SEQ ID NO: 233589 - RNA, 20 nt, Human
accagagauagcaauagugc

SEQ ID NO: 233590 - RNA, 22 nt, Human
cugcuuuugagcccagugcuca

SEQ ID NO: 233591 - RNA, 22 nt, Human
uaagacugugagcucagagacu

SEQ ID NO: 233592 - RNA, 22 nt, Human
caggcuugaugugucuauacuu

SEQ ID NO: 233593 - RNA, 22 nt, Human
aggcccaguuauccuacuuguu

SEQ ID NO: 233594 - RNA, 22 nt, Human
ggucagaggggauuccuuggga

SEQ ID NO: 233595 - RNA, 22 nt, Human
aggcugcugaggccaccacgcu

SEQ ID NO: 233596 - RNA, 22 nt, Human
gcugguuagaaaacagagcuca

SEQ ID NO: 233597 - RNA, 22 nt, Human
cccagcauccucagggagcggg

SEQ ID NO: 233598 - RNA, 22 nt, Human
caggcagaaggaaguaccaggc

SEQ ID NO: 233599 - RNA, 22 nt, Human
uaacuggugaguaggauuuaua

SEQ ID NO: 233600 - RNA, 22 nt, Human
ccagggagcggggcugggucuc

SEQ ID NO: 233601 - RNA, 22 nt, Human
cucuucuugccugaugaggcag

SEQ ID NO: 233602 - RNA, 22 nt, Human
gcccccucuuuggagccagcca

SEQ ID NO: 233603 - RNA, 22 nt, Human
gcaugcaggaagggcuugggga

SEQ ID NO: 233604 - RNA, 22 nt, Human
ucccugagaaagcccaggaggu

SEQ ID NO: 233605 - RNA, 22 nt, Human
acagacauauuuggcccauagc

SEQ ID NO: 233606 - RNA, 22 nt, Human
uggcagagguaauucaaauccc

SEQ ID NO: 233607 - RNA, 22 nt, Human
ccagagggagccaccagggugu

SEQ ID NO: 233608 - RNA, 22 nt, Human
aauguaaacagcaagagaaggg

SEQ ID NO: 233609 - RNA, 22 nt, Human
gagggcugccacguugggcgag

SEQ ID NO: 233610 - RNA, 22 nt, Human
ucaccagggcuccagccagccu

SEQ ID NO: 233611 - RNA, 22 nt, Human
uaaauuacucaaugcacauaaa

SEQ ID NO: 233612 - RNA, 22 nt, Human
ugacagagccaagaucaguacu

SEQ ID NO: 233613 - RNA, 22 nt, Human
agaaaaaucuuggcgcuugucu

SEQ ID NO: 233614 - RNA, 22 nt, Human
cuguccccgcgaguccagagcu

SEQ ID NO: 233615 - RNA, 22 nt, Human
agagccuguuuugugggagaug

SEQ ID NO: 233616 - RNA, 22 nt, Human
gaggcuccgugcugcugcccug

SEQ ID NO: 233617 - RNA, 23 nt, Human
aggagacagggaagugccuggcu

SEQ ID NO: 233618 - RNA, 22 nt, Human
cugcccugggccaggaagcggc

SEQ ID NO: 233619 - RNA, 22 nt, Human
ugcagugugagguccacaucug

SEQ ID NO: 233620 - RNA, 21 nt, Human
uuugccuucacgaagcauccu

SEQ ID NO: 233621 - RNA, 22 nt, Human
ccagacuggggcuccuugaggg

SEQ ID NO: 233622 - RNA, 22 nt, Human
ugggcucucuuuaccucauaac

SEQ ID NO: 233623 - RNA, 21 nt, Human
ucugagaacuucugcugcagc

SEQ ID NO: 233624 - RNA, 22 nt, Human
ggacaguccaccucagugaaga

SEQ ID NO: 233625 - RNA, 22 nt, Human
aaguuuuugauucuaagagaga

SEQ ID NO: 233626 - RNA, 23 nt, Human
gcaaagacucugccaaaaacugc

SEQ ID NO: 233627 - RNA, 22 nt, Human
uaauuuugucacagugacaugc

SEQ ID NO: 233628 - RNA, 22 nt, Human
ugacacaugcaccagucuuuaa

SEQ ID NO: 233629 - RNA, 22 nt, Human
cuuggcugucauaagguccugg

SEQ ID NO: 233630 - RNA, 22 nt, Human
gccuggguuccaugaucuccag

SEQ ID NO: 233631 - RNA, 22 nt, Human
ccagcaggagacuagcaacaua

SEQ ID NO: 233632 - RNA, 15 nt, Human
gggcaggucuggggc

SEQ ID NO: 233633 - RNA, 23 nt, Human
uaagacacccgacuccagagaug

SEQ ID NO: 233634 - RNA, 22 nt, Human
cugaggccucacuguagucccu

SEQ ID NO: 233635 - RNA, 22 nt, Human
ugauugauacaacucaauccaa

SEQ ID NO: 233636 - RNA, 22 nt, Human
uggcuuccagaacugagcaaca

SEQ ID NO: 233637 - RNA, 22 nt, Human
uuuaauuugaaaugaguaaccc

SEQ ID NO: 233638 - RNA, 23 nt, Human
cuacugccuugcacaggcuagau

SEQ ID NO: 233639 - RNA, 22 nt, Human
agcaaagcaccauauggcaguu

SEQ ID NO: 233640 - RNA, 22 nt, Human
ucuaaugaguuagauaauuuug

SEQ ID NO: 233641 - RNA, 22 nt, Human
gaugauggguugaugugaaggg

SEQ ID NO: 233642 - RNA, 22 nt, Human
gucuuuaugguaugaaaacuga

SEQ ID NO: 233643 - RNA, 22 nt, Human
uuccuccuacgcuuaucacuuu

SEQ ID NO: 233644 - RNA, 22 nt, Human
uaggcugggcugagcuggacgg

SEQ ID NO: 233645 - RNA, 22 nt, Human
auacaguagggaccaugucuga

SEQ ID NO: 233646 - RNA, 22 nt, Human
agcugaaaggguguuggagugu

SEQ ID NO: 233647 - RNA, 19 nt, Human
cugcucuccuugacuugga

SEQ ID NO: 233648 - RNA, 22 nt, Human
gggcuguguaaugugcucuuuu

SEQ ID NO: 233649 - RNA, 22 nt, Human
gcugcagggaauguauggauuu

SEQ ID NO: 233650 - RNA, 22 nt, Human
gcuguauuccugcacuguauag

SEQ ID NO: 233651 - RNA, 22 nt, Human
cagugcagaacacauggaaaau

SEQ ID NO: 233652 - RNA, 22 nt, Human
ugagcaguggggccugcauucu

SEQ ID NO: 233653 - RNA, 22 nt, Human
auauuacauaaacaugagugaa

SEQ ID NO: 233654 - RNA, 22 nt, Human
augaaggcuguguggagccccc

SEQ ID NO: 233655 - RNA, 22 nt, Human
agguguccaggaagaugcuggc

SEQ ID NO: 233656 - RNA, 22 nt, Human
ccaaaagcagcugucugugaau

SEQ ID NO: 233657 - RNA, 22 nt, Human
gggaccugccaaggccacccag

SEQ ID NO: 233658 - RNA, 22 nt, Human
ccuucucucugaagaccccaaa

SEQ ID NO: 233659 - RNA, 22 nt, Human
guugggaaggugaacaugaugc

SEQ ID NO: 233660 - RNA, 22 nt, Human
ucccauauaugcaaaaauguaa

SEQ ID NO: 233661 - RNA, 22 nt, Human
aguauuucuucauaugauuacu

SEQ ID NO: 233662 - RNA, 22 nt, Human
uggagagcaagucgcagacaug

SEQ ID NO: 233663 - RNA, 22 nt, Human
aauauguugagucuaucuuuau

SEQ ID NO: 233664 - RNA, 21 nt, Human
aaggaaaagcuuggucucuga

SEQ ID NO: 233665 - RNA, 22 nt, Human
agcauggggcaaugcaugugcu

SEQ ID NO: 233666 - RNA, 22 nt, Human
aauaugaauuauuguuacaagu

SEQ ID NO: 233667 - RNA, 22 nt, Human
accaagugaguacuuggcagaa

SEQ ID NO: 233668 - RNA, 22 nt, Human
ugaauucuuuuagaauucagug

SEQ ID NO: 233669 - RNA, 22 nt, Human
gcacagaaguaaaauacaaguc

SEQ ID NO: 233670 - RNA, 21 nt, Human
gcugcccaacccugcaucucc

SEQ ID NO: 233671 - RNA, 22 nt, Human
uaacauuagguagacauaagcc

SEQ ID NO: 233672 - RNA, 22 nt, Human
agcucccauuaucuucugaaac

SEQ ID NO: 233673 - RNA, 22 nt, Human
gugaggugguacaauauuaacu

SEQ ID NO: 233674 - RNA, 22 nt, Human
ggaggccuggacuuccugaugg

SEQ ID NO: 233675 - RNA, 19 nt, Human
uuucugucuguguuuugcc

SEQ ID NO: 233676 - RNA, 22 nt, Human
uggcccagggucuacagccuca

SEQ ID NO: 233677 - RNA, 22 nt, Human
aucuuucaguuucauaccaauu

SEQ ID NO: 233678 - RNA, 22 nt, Human
ccaggaaggccuggaugccccc

SEQ ID NO: 233679 - RNA, 22 nt, Human
ccagccacgaagcucccuucau

SEQ ID NO: 233680 - RNA, 23 nt, Human
uggauaaaauacuuacauucaac

SEQ ID NO: 233681 - RNA, 22 nt, Human
agcuuuguggcuuugcaagacu

SEQ ID NO: 233682 - RNA, 22 nt, Human
uucugggcuuggcuguuuccau

SEQ ID NO: 233683 - RNA, 21 nt, Human
accaggcuugugggagggagc

SEQ ID NO: 233684 - RNA, 22 nt, Human
aagagcaggcugcuguggagua

SEQ ID NO: 233685 - RNA, 22 nt, Human
cagagccagggcuaggaacugg

SEQ ID NO: 233686 - RNA, 22 nt, Human
uuacacagugcacaagcagagu

SEQ ID NO: 233687 - RNA, 22 nt, Human
auacagaagaacuauagccacu

SEQ ID NO: 233688 - RNA, 22 nt, Human
gggcagguacuggguggugagc

SEQ ID NO: 233689 - RNA, 22 nt, Human
augacaagggaggguccugcua

SEQ ID NO: 233690 - RNA, 22 nt, Human
cagagacaggcuugcccuccac

SEQ ID NO: 233691 - RNA, 22 nt, Human
auauuagggucucuaaauucua

SEQ ID NO: 233692 - RNA, 22 nt, Human
ccagugacuggcuuucuggugu

SEQ ID NO: 233693 - RNA, 22 nt, Human
uuucauugagacuauagacauc

SEQ ID NO: 233694 - RNA, 22 nt, Human
gcuggggccugaacagucagcu

SEQ ID NO: 233695 - RNA, 22 nt, Human
acccugccaaggauggccccga

SEQ ID NO: 233696 - RNA, 22 nt, Human
gugugcagggaugagugcaggu

SEQ ID NO: 233697 - RNA, 22 nt, Human
aggaaugugaccacuagacucu

SEQ ID NO: 233698 - RNA, 22 nt, Human
auuuaaaugcuuaagaggguuu

SEQ ID NO: 233699 - RNA, 22 nt, Human
uuagauaaaaguguucaauaaa

SEQ ID NO: 233700 - RNA, 22 nt, Human
auuucagaugaccaaauggaaa

SEQ ID NO: 233701 - RNA, 22 nt, Human
auguucauuagucaacauuucu

SEQ ID NO: 233702 - RNA, 20 nt, Human
ccugcuguuuccauggggcc

SEQ ID NO: 233703 - RNA, 22 nt, Human
ggcugaaagguaguaguaggcu

SEQ ID NO: 233704 - RNA, 22 nt, Human
gcauccuggcucuaggugucau

SEQ ID NO: 233705 - RNA, 22 nt, Human
caggggcucugggugaugugag

SEQ ID NO: 233706 - RNA, 19 nt, Human
aaggcagcaguagcaucca

SEQ ID NO: 233707 - RNA, 22 nt, Human
cccaggcagccccagaagcuug

SEQ ID NO: 233708 - RNA, 22 nt, Human
augaggcaggagcggggacccu

SEQ ID NO: 233709 - RNA, 22 nt, Human
gcaggcaucucuguagccaggg

SEQ ID NO: 233710 - RNA, 22 nt, Human
ccagagccuggcaucugcauaa

SEQ ID NO: 233711 - RNA, 22 nt, Human
cuggccccaggcagccugcugg

SEQ ID NO: 233712 - RNA, 21 nt, Human
agaugcugaugcugcaggucc

SEQ ID NO: 233713 - RNA, 22 nt, Human
augaagggugucccugugagca

SEQ ID NO: 233714 - RNA, 22 nt, Human
uguuucuuacguuuuuagaggc

SEQ ID NO: 233715 - RNA, 22 nt, Human
uggaauuuaguuaauuccauuu

SEQ ID NO: 233716 - RNA, 22 nt, Human
agugcaggcucgcuugugaggc

SEQ ID NO: 233717 - RNA, 22 nt, Human
gggaccaggucagggcucugac

SEQ ID NO: 233718 - RNA, 21 nt, Human
cauuucuaagccuggcuauag

SEQ ID NO: 233719 - RNA, 22 nt, Human
uugcuaauaaaguuuuuaugug

SEQ ID NO: 233720 - RNA, 22 nt, Human
cuugagaagcauuaagagguag

SEQ ID NO: 233721 - RNA, 22 nt, Human
cacaggcuuuuuuggcugaugu

SEQ ID NO: 233722 - RNA, 22 nt, Human
acaggcagugauuuccucuggu

SEQ ID NO: 233723 - RNA, 22 nt, Human
ucaaaugcuguauuguaguaau

SEQ ID NO: 233724 - RNA, 22 nt, Human
ucuggagccuuggaugggaaag

SEQ ID NO: 233725 - RNA, 22 nt, Human
cuuuacagaaagagaacucugg

SEQ ID NO: 233726 - RNA, 22 nt, Human
ucuaacuugaacucaugacugu

SEQ ID NO: 233727 - RNA, 21 nt, Human
ccuccaggagcagagcccuga

SEQ ID NO: 233728 - RNA, 22 nt, Human
gcaggcuccaacuggaggaguu

SEQ ID NO: 233729 - RNA, 21 nt, Human
agugaaaugaaguguaugcuc

SEQ ID NO: 233730 - RNA, 22 nt, Human
auuuuacuacuccaauuaauga

SEQ ID NO: 233731 - RNA, 22 nt, Human
caggcugagcucuggccugggc

SEQ ID NO: 233732 - RNA, 21 nt, Human
aacauuucaggauccaaauug

SEQ ID NO: 233733 - RNA, 22 nt, Human
uauucccugauguacacuggca

SEQ ID NO: 233734 - RNA, 22 nt, Human
gaaagugccucaguccucuuau

SEQ ID NO: 233735 - RNA, 22 nt, Human
cucaaaaugguuaauuuuaaua

SEQ ID NO: 233736 - RNA, 22 nt, Human
cugguccuugacgcgugggagg

SEQ ID NO: 233737 - RNA, 22 nt, Human
ggugcuggacacguggcacucc

SEQ ID NO: 233738 - RNA, 22 nt, Human
ugccuuaggguaccuggugcuu

SEQ ID NO: 233739 - RNA, 22 nt, Human
uuaagggccauuauggaugggu

SEQ ID NO: 233740 - RNA, 22 nt, Human
ucagcacugaaauucuucacau

SEQ ID NO: 233741 - RNA, 22 nt, Human
ucugggucucagagugaccaug

SEQ ID NO: 233742 - RNA, 22 nt, Human
aguuuuauguagacaauucauu

SEQ ID NO: 233743 - RNA, 22 nt, Human
ucacuccucaggcuagcaucau

SEQ ID NO: 233744 - RNA, 22 nt, Human
aggaggaauugacacagaagcc

SEQ ID NO: 233745 - RNA, 15 nt, Human
ucccucagcuaaaga

SEQ ID NO: 233746 - RNA, 22 nt, Human
gagguucugggggucugccugg

SEQ ID NO: 233747 - RNA, 22 nt, Human
uuuauugucuaugaacugcuug

SEQ ID NO: 233748 - RNA, 22 nt, Human
auucugauaucuuauucuagcu

SEQ ID NO: 233749 - RNA, 22 nt, Human
cacugagaccagagucccugac

SEQ ID NO: 233750 - RNA, 22 nt, Human
ucaggagcugcauuauccugug

SEQ ID NO: 233751 - RNA, 22 nt, Human
cugcccuggcagccuaccaugg

SEQ ID NO: 233752 - RNA, 22 nt, Human
ucugcaagaucauuaaagcaga

SEQ ID NO: 233753 - RNA, 22 nt, Human
ucaggccuagggagccacacca

SEQ ID NO: 233754 - RNA, 22 nt, Human
aggcagguuuacucuuauuugg

SEQ ID NO: 233755 - RNA, 22 nt, Human
uuguauuuuuuccuggcggugg

SEQ ID NO: 233756 - RNA, 22 nt, Human
uccuggcacaacccuuuaccag

SEQ ID NO: 233757 - RNA, 22 nt, Human
gccucuccgagccacugccucu

SEQ ID NO: 233758 - RNA, 22 nt, Human
cagcagugacaagacuaagaag

SEQ ID NO: 233759 - RNA, 22 nt, Human
acaauacaggcuucuggacuua

SEQ ID NO: 233760 - RNA, 22 nt, Human
guccucuggccuuucccaggac

SEQ ID NO: 233761 - RNA, 22 nt, Human
auucuacauuuggagugauguc

SEQ ID NO: 233762 - RNA, 22 nt, Human
auuggcuuugauaucuaaaggg

SEQ ID NO: 233763 - RNA, 17 nt, Human
acagaggcaggagugga

SEQ ID NO: 233764 - RNA, 22 nt, Human
uugcuuugguagcagcuauaga

SEQ ID NO: 233765 - RNA, 19 nt, Human
ugcuguccucagaguaagu

SEQ ID NO: 233766 - RNA, 22 nt, Human
acagucuaggccuaggucaaaa

SEQ ID NO: 233767 - RNA, 22 nt, Human
uacacaugugcacgcguguccu

SEQ ID NO: 233768 - RNA, 20 nt, Human
uuaaaaagagucacaggaga

SEQ ID NO: 233769 - RNA, 22 nt, Human
gcauguguggaggagaugugcu

SEQ ID NO: 233770 - RNA, 22 nt, Human
ucaggcagaauuaucaaaagau

SEQ ID NO: 233771 - RNA, 22 nt, Human
aaugugacugaauauuuacucu

SEQ ID NO: 233772 - RNA, 22 nt, Human
gugcccugcaugccccggguau

SEQ ID NO: 233773 - RNA, 22 nt, Human
ugagacaggagaggccccuccu

SEQ ID NO: 233774 - RNA, 22 nt, Human
uucuuucuguccauaaugagac

SEQ ID NO: 233775 - RNA, 22 nt, Human
ucucuguaauaucuuuuacaac

SEQ ID NO: 233776 - RNA, 22 nt, Human
uuucacauuggcuucuauuucu

SEQ ID NO: 233777 - RNA, 22 nt, Human
cagugcucccgcugccgcugug

SEQ ID NO: 233778 - RNA, 22 nt, Human
ugaggccucuugguauggugug

SEQ ID NO: 233779 - RNA, 21 nt, Human
gggcagaggggccuccugggu

SEQ ID NO: 233780 - RNA, 22 nt, Human
uuuccucaacugucaaaugggg

SEQ ID NO: 233781 - RNA, 22 nt, Human
aggagccaggccccauggggcu

SEQ ID NO: 233782 - RNA, 22 nt, Human
aggcugagucaaguuaggguga

SEQ ID NO: 233783 - RNA, 22 nt, Human
acaggcaccugccaccacaucu

SEQ ID NO: 233784 - RNA, 22 nt, Human
cucaggcugugccaccugugug

SEQ ID NO: 233785 - RNA, 22 nt, Human
uucuccagccuauuggccuauc

SEQ ID NO: 233786 - RNA, 22 nt, Human
uguagcaccagucaccagccca

SEQ ID NO: 233787 - RNA, 22 nt, Human
ggcagcuguaagaugagugaau

SEQ ID NO: 233788 - RNA, 22 nt, Human
aauagcauccuguaucucuucc

SEQ ID NO: 233789 - RNA, 22 nt, Human
agggccugucuguagaacugaa

SEQ ID NO: 233790 - RNA, 22 nt, Human
uaacacugugcccagaguccca

SEQ ID NO: 233791 - RNA, 21 nt, Human
gcuuuuuguauggcccaggaa

SEQ ID NO: 233792 - RNA, 22 nt, Human
ugaaugauauauugggaauaau

SEQ ID NO: 233793 - RNA, 21 nt, Human
ucucuggcgguguuuggcucc

SEQ ID NO: 233794 - RNA, 22 nt, Human
aggauucagaauguaugcagug

SEQ ID NO: 233795 - RNA, 22 nt, Human
auauuguuaguaauauuucgaa

SEQ ID NO: 233796 - RNA, 22 nt, Human
gcgugcaacagccucuuccauu

SEQ ID NO: 233797 - RNA, 22 nt, Human
aggagagagaacacuugggucc

SEQ ID NO: 233798 - RNA, 22 nt, Human
ucagugcuugccucuggaggag

SEQ ID NO: 233799 - RNA, 22 nt, Human
ucuuuggauggaaaauguauuc

SEQ ID NO: 233800 - RNA, 22 nt, Human
guauaucaccccaagcagcuga

SEQ ID NO: 233801 - RNA, 22 nt, Human
cuguccccauuguuugaggguu

SEQ ID NO: 233802 - RNA, 22 nt, Human
uucauuuaauuuguguauuaac

SEQ ID NO: 233803 - RNA, 22 nt, Human
cagagccagagaccugcugugc

SEQ ID NO: 233804 - RNA, 22 nt, Human
agcagggccaacaguaaacacc

SEQ ID NO: 233805 - RNA, 22 nt, Human
gcaguccaaaguggcucucacc

SEQ ID NO: 233806 - RNA, 22 nt, Human
ucagugucaucacuuaauauaa

SEQ ID NO: 233807 - RNA, 22 nt, Human
aggaaaagugugaaguauggag

SEQ ID NO: 233808 - RNA, 19 nt, Human
agcagcuggagguggagug

SEQ ID NO: 233809 - RNA, 22 nt, Human
acauucuucuugugaauuuacu

SEQ ID NO: 233810 - RNA, 20 nt, Human
ccugcugggaacccucugaa

SEQ ID NO: 233811 - RNA, 21 nt, Human
auggaaaaacagguagagcau

SEQ ID NO: 233812 - RNA, 22 nt, Human
uguuuuuccaugugcagaacaa

SEQ ID NO: 233813 - RNA, 22 nt, Human
ugcaggguagacaggugagguc

SEQ ID NO: 233814 - RNA, 22 nt, Human
cuggauguccagguagaaguuu

SEQ ID NO: 233815 - RNA, 22 nt, Human
uuggccaguggaaagaggagga

SEQ ID NO: 233816 - RNA, 22 nt, Human
ggagaaggguauguguggcgga

SEQ ID NO: 233817 - RNA, 22 nt, Human
uacugaggguaugaagccaagg

SEQ ID NO: 233818 - RNA, 22 nt, Human
uacaucaaaucaauguuccagu

SEQ ID NO: 233819 - RNA, 22 nt, Human
uuucaacagcucucaaaugauc

SEQ ID NO: 233820 - RNA, 22 nt, Human
ccagacagcaguuaaaggacau

SEQ ID NO: 233821 - RNA, 22 nt, Human
auuuauuaagcaucugcuaugu

SEQ ID NO: 233822 - RNA, 22 nt, Human
cccuccuuucuaggcuuccagc

SEQ ID NO: 233823 - RNA, 21 nt, Human
aggaggaacccguggcugggc

SEQ ID NO: 233824 - RNA, 22 nt, Human
aucuauuucugcuaauaacaau

SEQ ID NO: 233825 - RNA, 22 nt, Human
uuaauaaaguaugaauuggaaa

SEQ ID NO: 233826 - RNA, 17 nt, Human
caggcacaugaagccag

SEQ ID NO: 233827 - RNA, 18 nt, Human
ucuggcucaggacugaac

SEQ ID NO: 233828 - RNA, 22 nt, Human
acuuugcaaaaggaaaucaccu

SEQ ID NO: 233829 - RNA, 22 nt, Human
cuguugcugagguucaaggguc

SEQ ID NO: 233830 - RNA, 22 nt, Human
gcugucuugaugauuggaugcu

SEQ ID NO: 233831 - RNA, 20 nt, Human
ucauccaggacaggaguggc

SEQ ID NO: 233832 - RNA, 23 nt, Human
guguuacuaaagaugaacauuua

SEQ ID NO: 233833 - RNA, 22 nt, Human
uuucaaaguggagaauuagaca

SEQ ID NO: 233834 - RNA, 18 nt, Human
gaugggagcaagagaaga

SEQ ID NO: 233835 - RNA, 22 nt, Human
acugaagaacgcaucagugguu

SEQ ID NO: 233836 - RNA, 22 nt, Human
agaaguuuguuauguaaacaaa

SEQ ID NO: 233837 - RNA, 22 nt, Human
ccuguacagugaaugaauguga

SEQ ID NO: 233838 - RNA, 21 nt, Human
agguggucugcagcagcugaa

SEQ ID NO: 233839 - RNA, 22 nt, Human
uaugaagacaaugauagcauga

SEQ ID NO: 233840 - RNA, 22 nt, Human
uagaagcagcaggaguaaaggc

SEQ ID NO: 233841 - RNA, 22 nt, Human
ccagggcugcugugggacucca

SEQ ID NO: 233842 - RNA, 22 nt, Human
aaacaguacucgauuuuuguag

SEQ ID NO: 233843 - RNA, 22 nt, Human
uaugcaacaucugguagaaauc

SEQ ID NO: 233844 - RNA, 22 nt, Human
uacuucaaccuucucuauuaga

SEQ ID NO: 233845 - RNA, 22 nt, Human
acaggugugcggaaagcuguga

SEQ ID NO: 233846 - RNA, 22 nt, Human
ucuggccccuggcaguccugga

SEQ ID NO: 233847 - RNA, 22 nt, Human
gcagcagcucucaaaguggucu

SEQ ID NO: 233848 - RNA, 22 nt, Human
agaaaagguugaaaguaggauu

SEQ ID NO: 233849 - RNA, 22 nt, Human
cccaggcuccuacuguauucug

SEQ ID NO: 233850 - RNA, 22 nt, Human
cccuuagaauuuuguaguuauu

SEQ ID NO: 233851 - RNA, 22 nt, Human
augaaacugaaggacaaccaga

SEQ ID NO: 233852 - RNA, 22 nt, Human
ucagagcuuaucucuugcugga

SEQ ID NO: 233853 - RNA, 22 nt, Human
ucagcuuuugucagaaauugua

SEQ ID NO: 233854 - RNA, 22 nt, Human
cagggaggcugucuuaugccug

SEQ ID NO: 233855 - RNA, 22 nt, Human
aagaauaaauuaagauacuuag

SEQ ID NO: 233856 - RNA, 22 nt, Human
aacuauacauauuuacauagac

SEQ ID NO: 233857 - RNA, 22 nt, Human
ccauuuguuguguauuaauauu

SEQ ID NO: 233858 - RNA, 22 nt, Human
gaagauuugaaacacauagaca

SEQ ID NO: 233859 - RNA, 22 nt, Human
augcacgccccacacuggugug

SEQ ID NO: 233860 - RNA, 22 nt, Human
gcagcuuuguaaaguaugaagc

SEQ ID NO: 233861 - RNA, 19 nt, Human
augcaacaaaaguguaaga

SEQ ID NO: 233862 - RNA, 22 nt, Human
agaggggcucauauccugucau

SEQ ID NO: 233863 - RNA, 22 nt, Human
uugagaacaggaguguucuuuu

SEQ ID NO: 233864 - RNA, 22 nt, Human
cuggguucucugcuuagggccu

SEQ ID NO: 233865 - RNA, 18 nt, Human
cccugaggcuagcaugcu

SEQ ID NO: 233866 - RNA, 22 nt, Human
caauaguauuuauugaacaccu

SEQ ID NO: 233867 - RNA, 22 nt, Human
ucucuguauucugauauucacu

SEQ ID NO: 233868 - RNA, 22 nt, Human
acacacagcgccuaccaugugc

SEQ ID NO: 233869 - RNA, 22 nt, Human
uugcagggcaaauggucagaua

SEQ ID NO: 233870 - RNA, 22 nt, Human
ucucaaauaggccuugguccug

SEQ ID NO: 233871 - RNA, 22 nt, Human
ugcaggaccggaaccaugggau

SEQ ID NO: 233872 - RNA, 22 nt, Human
aguccuggcucuacgggcuuca

SEQ ID NO: 233873 - RNA, 22 nt, Human
acaucucuccaaaggaaggugc

SEQ ID NO: 233874 - RNA, 22 nt, Human
gauugcuggggcaggcuguagc

SEQ ID NO: 233875 - RNA, 22 nt, Human
guggcugcagagggcacagcau

SEQ ID NO: 233876 - RNA, 22 nt, Human
agaauccuguuuuacuucauca

SEQ ID NO: 233877 - RNA, 22 nt, Human
aauggcaagagccacagaggcg

SEQ ID NO: 233878 - RNA, 22 nt, Human
cucugggaccacgugacucugc

SEQ ID NO: 233879 - RNA, 22 nt, Human
uccaggcacagaguuggucagu

SEQ ID NO: 233880 - RNA, 23 nt, Human
ugcuggcuguguuauugccaaca

SEQ ID NO: 233881 - RNA, 22 nt, Human
ggcuucuugugugucaggcucu

SEQ ID NO: 233882 - RNA, 22 nt, Human
ucaucugagguuugaggcaguu

SEQ ID NO: 233883 - RNA, 22 nt, Human
uaacaguagccuuauguggucu

SEQ ID NO: 233884 - RNA, 23 nt, Human
acuccccagucucuucuugccaa

SEQ ID NO: 233885 - RNA, 22 nt, Human
acauguaaaagauaaauuaaca

SEQ ID NO: 233886 - RNA, 22 nt, Human
uauaaaugcacuuuugaaauau

SEQ ID NO: 233887 - RNA, 22 nt, Human
gccagccaguuugcugauggcu

SEQ ID NO: 233888 - RNA, 22 nt, Human
uuaauacaacuguugucacugg

SEQ ID NO: 233889 - RNA, 22 nt, Human
uuuauauccaucuuugaaguaa

SEQ ID NO: 233890 - RNA, 22 nt, Human
ucuuccugcuuggugugucugg

SEQ ID NO: 233891 - RNA, 22 nt, Human
gccagcagccacagaagucacu

SEQ ID NO: 233892 - RNA, 22 nt, Human
gugagcuucugccucucagucc

SEQ ID NO: 233893 - RNA, 22 nt, Human
auguggcacagcacaguaagag

SEQ ID NO: 233894 - RNA, 18 nt, Human
agucaguugauggggacc

SEQ ID NO: 233895 - RNA, 21 nt, Human
ccucaaagaugaugggguuuc

SEQ ID NO: 233896 - RNA, 21 nt, Human
aaauacagaaacuuguuuuca

SEQ ID NO: 233897 - RNA, 22 nt, Human
uagcuguggagcagaggucucc

SEQ ID NO: 233898 - RNA, 22 nt, Human
auuuugacugcauuacagaaca

SEQ ID NO: 233899 - RNA, 22 nt, Human
uuucaguuuaugucuugaauua

SEQ ID NO: 233900 - RNA, 22 nt, Human
cugccuggccugaucuccacgc

SEQ ID NO: 233901 - RNA, 22 nt, Human
ucagugcaggaaucucuagcca

SEQ ID NO: 233902 - RNA, 22 nt, Human
auaucuaggcugaauguaaaau

SEQ ID NO: 233903 - RNA, 22 nt, Human
uuugaaagaaaccagugaguga

SEQ ID NO: 233904 - RNA, 22 nt, Human
caaaugaaguccaaagggcuua

SEQ ID NO: 233905 - RNA, 22 nt, Human
gaaaauguuagcuucauaguca

SEQ ID NO: 233906 - RNA, 22 nt, Human
ggcuuucuaugaacucaaaggc

SEQ ID NO: 233907 - RNA, 22 nt, Human
agugcuuuuauuauauacagga

SEQ ID NO: 233908 - RNA, 22 nt, Human
agcauuuauuucuuagaaauug

SEQ ID NO: 233909 - RNA, 22 nt, Human
guccuucucaaauccuguguuu

SEQ ID NO: 233910 - RNA, 22 nt, Human
ccaguccacgucaagaagaggu

SEQ ID NO: 233911 - RNA, 22 nt, Human
guucaguuuugaaauguuaauu

SEQ ID NO: 233912 - RNA, 23 nt, Human
agaaaccacugaagagauccagu

SEQ ID NO: 233913 - RNA, 22 nt, Human
gaaagcaguauuuaguucuguu

SEQ ID NO: 233914 - RNA, 22 nt, Human
gcucagagaaaacuggggcuug

SEQ ID NO: 233915 - RNA, 22 nt, Human
uuuuuauaccaccucucacuua

SEQ ID NO: 233916 - RNA, 22 nt, Human
aacaguuugcuuuaagaggcac

SEQ ID NO: 233917 - RNA, 22 nt, Human
uccagcacagaauuuccuagcu

SEQ ID NO: 233918 - RNA, 22 nt, Human
uggcccugacacgugguacugg

SEQ ID NO: 233919 - RNA, 18 nt, Human
cccagcccaccauuucuc

SEQ ID NO: 233920 - RNA, 22 nt, Human
ucugcuguugagcacaagugaa

SEQ ID NO: 233921 - RNA, 22 nt, Human
auuauacauuuuguguagagau

SEQ ID NO: 233922 - RNA, 22 nt, Human
uguuaaauguauuauguguucu

SEQ ID NO: 233923 - RNA, 22 nt, Human
ugccugccaugcagaaagcuga

SEQ ID NO: 233924 - RNA, 22 nt, Human
ucccagccugacagugcaucaa

SEQ ID NO: 233925 - RNA, 22 nt, Human
acagugcuuagcacagaguaga

SEQ ID NO: 233926 - RNA, 22 nt, Human
uacaaggaggcuaaugaugaca

SEQ ID NO: 233927 - RNA, 22 nt, Human
uguaaacaguaggacuaaagag

SEQ ID NO: 233928 - RNA, 22 nt, Human
cuggcagacuuaccaucagaca

SEQ ID NO: 233929 - RNA, 22 nt, Human
cuuacaagcaaaacaacuguag

SEQ ID NO: 233930 - RNA, 22 nt, Human
uuuguuuacaaaaauaagcagu

SEQ ID NO: 233931 - RNA, 22 nt, Human
aaaggcuugacuagaagggaga

SEQ ID NO: 233932 - RNA, 22 nt, Human
uacaugcaugauacaaaguugc

SEQ ID NO: 233933 - RNA, 22 nt, Human
uucuacaaauauuuacuguucc

SEQ ID NO: 233934 - RNA, 22 nt, Human
ugcaagagcagaaagaacugag

SEQ ID NO: 233935 - RNA, 22 nt, Human
aguguccuccucugggagccag

SEQ ID NO: 233936 - RNA, 22 nt, Human
aucuguggcagugaugagucuu

SEQ ID NO: 233937 - RNA, 22 nt, Human
ccaggagacaaagaugacugcu

SEQ ID NO: 233938 - RNA, 22 nt, Human
cagcuacaaauacuuuuguaug

SEQ ID NO: 233939 - RNA, 22 nt, Human
aaacugcacacgaugugccuga

SEQ ID NO: 233940 - RNA, 22 nt, Human
uugcuucaguagcucuuuaaag

SEQ ID NO: 233941 - RNA, 22 nt, Human
uccugggaugaggaaacaagga

SEQ ID NO: 233942 - RNA, 22 nt, Human
gauucucugcuaucuaucaccu

SEQ ID NO: 233943 - RNA, 22 nt, Human
cagagcaugaauaaaaguuaca

SEQ ID NO: 233944 - RNA, 22 nt, Human
uacagaauguuaugaagcauag

SEQ ID NO: 233945 - RNA, 22 nt, Human
agacacagaacacaaaagcaua

SEQ ID NO: 233946 - RNA, 22 nt, Human
aggcccucucauuccagaggca

SEQ ID NO: 233947 - RNA, 21 nt, Human
aagaaagauaauuaaggaccc

SEQ ID NO: 233948 - RNA, 22 nt, Human
ggccaagguguucugauaugcc

SEQ ID NO: 233949 - RNA, 22 nt, Human
auacuuucugaccaauuaauug

SEQ ID NO: 233950 - RNA, 22 nt, Human
caggaagcacagugaggagacc

SEQ ID NO: 233951 - RNA, 22 nt, Human
uauuguacauuucaaaguagcu

SEQ ID NO: 233952 - RNA, 22 nt, Human
uucacugugaacucauauucag

SEQ ID NO: 233953 - RNA, 22 nt, Human
ucacagaauaaauugagaagac

SEQ ID NO: 233954 - RNA, 22 nt, Human
gguagcacauugcauuaggaga

SEQ ID NO: 233955 - RNA, 22 nt, Human
agagaaaacucauugagguguc

SEQ ID NO: 233956 - RNA, 22 nt, Human
agaaaggguucucugaggugcu

SEQ ID NO: 233957 - RNA, 20 nt, Human
uauugaguaccuacuguaua

SEQ ID NO: 233958 - RNA, 22 nt, Human
acacauuucucuuuuuguaagu

SEQ ID NO: 233959 - RNA, 23 nt, Human
agcuucugguucaggucaagcag

SEQ ID NO: 233960 - RNA, 19 nt, Human
ggcaggcuggauagagagg

SEQ ID NO: 233961 - RNA, 22 nt, Human
aaaaacugguaacuauucccca

SEQ ID NO: 233962 - RNA, 22 nt, Human
uguucucuucucauugaacaug

SEQ ID NO: 233963 - RNA, 22 nt, Human
cugcuuuaauuuagacaaggca

SEQ ID NO: 233964 - RNA, 22 nt, Human
uuacauguggugugaagaagag

SEQ ID NO: 233965 - RNA, 22 nt, Human
agaggccucuguuguucagacg

SEQ ID NO: 233966 - RNA, 22 nt, Human
uuuuuagauuacucagccacca

SEQ ID NO: 233967 - RNA, 22 nt, Human
agcuuguuaaggaugcauauua

SEQ ID NO: 233968 - RNA, 22 nt, Human
aaacucuagggcuccacauucc

SEQ ID NO: 233969 - RNA, 22 nt, Human
aagaguuuucuauaaucuuggc

SEQ ID NO: 233970 - RNA, 22 nt, Human
cuggggaacgcagcgagcagcg

SEQ ID NO: 233971 - RNA, 22 nt, Human
gggccugucucacucccugguu

SEQ ID NO: 233972 - RNA, 22 nt, Human
ccugugccaaaaggcugcuuau

SEQ ID NO: 233973 - RNA, 22 nt, Human
ucaggcaggacaauuauuuagg

SEQ ID NO: 233974 - RNA, 22 nt, Human
ggucagcagugcagggcagagc

SEQ ID NO: 233975 - RNA, 22 nt, Human
ugcagccugguggucacuggag

SEQ ID NO: 233976 - RNA, 20 nt, Human
agaaggcaggagacaaaagg

SEQ ID NO: 233977 - RNA, 22 nt, Human
ccuuccuuuuacugucuccgga

SEQ ID NO: 233978 - RNA, 22 nt, Human
aaaaugaugcuguaauuuggca

SEQ ID NO: 233979 - RNA, 18 nt, Human
ucugagggugcgggagcu

SEQ ID NO: 233980 - RNA, 22 nt, Human
guucuggguagauguaucuuuu

SEQ ID NO: 233981 - RNA, 22 nt, Human
ccaccccugggugcagggagcg

SEQ ID NO: 233982 - RNA, 22 nt, Human
gaacaguacaguugaguaguug

SEQ ID NO: 233983 - RNA, 22 nt, Human
uuacagugcucuucaagacuuc

SEQ ID NO: 233984 - RNA, 22 nt, Human
uauuagguuggugcaacaguaa

SEQ ID NO: 233985 - RNA, 22 nt, Human
ugggaccugaagcagguuggca

SEQ ID NO: 233986 - RNA, 22 nt, Human
ugaugguuuuauuaauaggacc

SEQ ID NO: 233987 - RNA, 22 nt, Human
gcuggcuuuaucgucagacucc

SEQ ID NO: 233988 - RNA, 22 nt, Human
gacacagguagaauaaaguacu

SEQ ID NO: 233989 - RNA, 22 nt, Human
aucucugggcuuugaguuuguu

SEQ ID NO: 233990 - RNA, 22 nt, Human
aggagcucugggcagggccucc

SEQ ID NO: 233991 - RNA, 22 nt, Human
uggccuggaaaaaugcagaugg

SEQ ID NO: 233992 - RNA, 22 nt, Human
agcuggcuuugagcugggaggu

SEQ ID NO: 233993 - RNA, 22 nt, Human
acacaaaguuggaugacaaaau

SEQ ID NO: 233994 - RNA, 22 nt, Human
aagcacuggggccacagacacg

SEQ ID NO: 233995 - RNA, 22 nt, Human
aagaguuauaccuauuucuaac

SEQ ID NO: 233996 - RNA, 22 nt, Human
auuuucacccugaauauauuga

SEQ ID NO: 233997 - RNA, 22 nt, Human
uauguugagcauucagugaucu

SEQ ID NO: 233998 - RNA, 22 nt, Human
gcuccagcucguggcucccagc

SEQ ID NO: 233999 - RNA, 22 nt, Human
agugauggcagugaauaaggcu

SEQ ID NO: 234000 - RNA, 22 nt, Human
ugcugaaaacucaaccauugug

SEQ ID NO: 234001 - RNA, 22 nt, Human
auguggccagucauguaguaac

SEQ ID NO: 234002 - RNA, 22 nt, Human
caggguggcccuguggucucau

SEQ ID NO: 234003 - RNA, 22 nt, Human
uuacagugagggugacauuuac

SEQ ID NO: 234004 - RNA, 22 nt, Human
uggaaugucauaccauaaaaga

SEQ ID NO: 234005 - RNA, 22 nt, Human
ccuggcauucucuccagagaga

SEQ ID NO: 234006 - RNA, 22 nt, Human
aguccaggaagcaucauggucu

SEQ ID NO: 234007 - RNA, 22 nt, Human
aucuggaauuaagagaaaguga

SEQ ID NO: 234008 - RNA, 22 nt, Human
gcugauuauuacaugucugugg

SEQ ID NO: 234009 - RNA, 22 nt, Human
uauauucacuuguguccaacca

SEQ ID NO: 234010 - RNA, 22 nt, Human
cuggggcugcagcgaucuucau

SEQ ID NO: 234011 - RNA, 22 nt, Human
ucccauugccauagauaggaca

SEQ ID NO: 234012 - RNA, 22 nt, Human
gcacagaacccuaucuuucgga

SEQ ID NO: 234013 - RNA, 22 nt, Human
auauuuugguagcucucaauga

SEQ ID NO: 234014 - RNA, 22 nt, Human
uuuccuaagguagugauaauuu

SEQ ID NO: 234015 - RNA, 22 nt, Human
aagaagcaggucacagacaggg

SEQ ID NO: 234016 - RNA, 22 nt, Human
acauuucagcgugcaugacaug

SEQ ID NO: 234017 - RNA, 22 nt, Human
uuugcuuguucaagauuucugu

SEQ ID NO: 234018 - RNA, 19 nt, Human
ccugccugagcugucccuc

SEQ ID NO: 234019 - RNA, 22 nt, Human
agccccaggcccggacgccucu

SEQ ID NO: 234020 - RNA, 22 nt, Human
uugcuugacuuuguguaccugu

SEQ ID NO: 234021 - RNA, 22 nt, Human
gcaucuaauccaguccagcauc

SEQ ID NO: 234022 - RNA, 22 nt, Human
agguccugucuuaucucuguaa

SEQ ID NO: 234023 - RNA, 22 nt, Human
cuaaaauuaucaagauaauucc

SEQ ID NO: 234024 - RNA, 22 nt, Human
aaaaugagcauauugauccuuu

SEQ ID NO: 234025 - RNA, 22 nt, Human
uggucuggggaccgaggguuac

SEQ ID NO: 234026 - RNA, 22 nt, Human
aggacaguccgggguccuccac

SEQ ID NO: 234027 - RNA, 22 nt, Human
guuauauauaguauuucucuga

SEQ ID NO: 234028 - RNA, 22 nt, Human
acagacuggagugagagaaaua

SEQ ID NO: 234029 - RNA, 22 nt, Human
ucuggguggcagugauggcgug

SEQ ID NO: 234030 - RNA, 22 nt, Human
ucuuguuucuguauauaaugac

SEQ ID NO: 234031 - RNA, 22 nt, Human
cuccaggcucguccaagaucga

SEQ ID NO: 234032 - RNA, 22 nt, Human
aacagcaguuacuuuugcauca

SEQ ID NO: 234033 - RNA, 21 nt, Human
uucaauacuauuucaauaguc

SEQ ID NO: 234034 - RNA, 22 nt, Human
aauucuaaauguaauuuagaau

SEQ ID NO: 234035 - RNA, 22 nt, Human
ucagaaagcuuuuacuuaaaca

SEQ ID NO: 234036 - RNA, 23 nt, Human
aaugaacugagaaucuguacagu

SEQ ID NO: 234037 - RNA, 22 nt, Human
agagccucugucauggagagaa

SEQ ID NO: 234038 - RNA, 22 nt, Human
auuucucacugagcagauaaaa

SEQ ID NO: 234039 - RNA, 22 nt, Human
ggagcugagaguagucccuuuu

SEQ ID NO: 234040 - RNA, 22 nt, Human
uuuucaguuacuguuuauguga

SEQ ID NO: 234041 - RNA, 20 nt, Human
ggaaaaaugcaugcucaaga

SEQ ID NO: 234042 - RNA, 22 nt, Human
aauaucagcacuuuugugguau

SEQ ID NO: 234043 - RNA, 22 nt, Human
guccaagagucaagaagggggc

SEQ ID NO: 234044 - RNA, 22 nt, Human
uccuccuuguuuuccuguuuac

SEQ ID NO: 234045 - RNA, 22 nt, Human
ucuaaccuuugaaacugcuuuc

SEQ ID NO: 234046 - RNA, 22 nt, Human
ccuggaaggcaggcauggauug

SEQ ID NO: 234047 - RNA, 22 nt, Human
uguggugguaaugagccagaug

SEQ ID NO: 234048 - RNA, 19 nt, Human
uaucuuuaugcaguggugg

SEQ ID NO: 234049 - RNA, 22 nt, Human
uuucagaagucaacuagguaaa

SEQ ID NO: 234050 - RNA, 22 nt, Human
uuuuaauacugcuauuguagga

SEQ ID NO: 234051 - RNA, 22 nt, Human
ucugugcuagcacgcagcaagg

SEQ ID NO: 234052 - RNA, 22 nt, Human
uccaggucugguuggacagguu

SEQ ID NO: 234053 - RNA, 22 nt, Human
ggacaugugcaacuucuuugga

SEQ ID NO: 234054 - RNA, 22 nt, Human
ugggcucucgucccugcagaag

SEQ ID NO: 234055 - RNA, 22 nt, Human
guacaacaugauuuuacucucu

SEQ ID NO: 234056 - RNA, 22 nt, Human
cauuuagacauuugauuugggg

SEQ ID NO: 234057 - RNA, 22 nt, Human
uccugggcuuaagugauccucc

SEQ ID NO: 234058 - RNA, 22 nt, Human
agcuccaagguugaggagugag

SEQ ID NO: 234059 - RNA, 22 nt, Human
gggccagagcacagaggauguu

SEQ ID NO: 234060 - RNA, 22 nt, Human
guguccugggcauuaggcuuag

SEQ ID NO: 234061 - RNA, 22 nt, Human
acuguucugccaacuuugguua

SEQ ID NO: 234062 - RNA, 22 nt, Human
ccagccuggagggcaguggugg

SEQ ID NO: 234063 - RNA, 22 nt, Human
cauaacaguggcuucagcaagu

SEQ ID NO: 234064 - RNA, 22 nt, Human
uauagaaguaagcauugugaug

SEQ ID NO: 234065 - RNA, 22 nt, Human
auuuuuucuguaaacuggccuu

SEQ ID NO: 234066 - RNA, 22 nt, Human
ucugucuuugagaucucagccu

SEQ ID NO: 234067 - RNA, 22 nt, Human
cagggucaggaggaucuggcuu

SEQ ID NO: 234068 - RNA, 22 nt, Human
uuuuuaagcuccuuugauguca

SEQ ID NO: 234069 - RNA, 22 nt, Human
gcaagcuguccuuuugcauggc

SEQ ID NO: 234070 - RNA, 22 nt, Human
cagaacagaaucguguggugag

SEQ ID NO: 234071 - RNA, 22 nt, Human
gaggcacaucacuuggugcauu

SEQ ID NO: 234072 - RNA, 22 nt, Human
acuugucuggcagaucaugcaa

SEQ ID NO: 234073 - RNA, 22 nt, Human
ugaaaacuccaaguuucaucag

SEQ ID NO: 234074 - RNA, 22 nt, Human
cuuguuuaagccgcuguuaagc

SEQ ID NO: 234075 - RNA, 22 nt, Human
gggauggggucgggacccugcu

SEQ ID NO: 234076 - RNA, 22 nt, Human
aguggcuguccuggcucuaacu

SEQ ID NO: 234077 - RNA, 22 nt, Human
agacauccuggggagggcaaug

SEQ ID NO: 234078 - RNA, 23 nt, Human
ugacaggcuuugcuccuucugcc

SEQ ID NO: 234079 - RNA, 22 nt, Human
auccaguucuuggaagcacagg

SEQ ID NO: 234080 - RNA, 22 nt, Human
ccugugagucaaccccuccuug

SEQ ID NO: 234081 - RNA, 22 nt, Human
cugagcaguagagggucucuuu

SEQ ID NO: 234082 - RNA, 22 nt, Human
gccuguuugacuggucucugcu

SEQ ID NO: 234083 - RNA, 22 nt, Human
uggcaaagacgcuagcuaagau

SEQ ID NO: 234084 - RNA, 22 nt, Human
aggcuuucgaugaacgcuugcu

SEQ ID NO: 234085 - RNA, 21 nt, Human
uggccaaaaccauauuauuaa

SEQ ID NO: 234086 - RNA, 22 nt, Human
cucuuuccucagccacagucua

SEQ ID NO: 234087 - RNA, 22 nt, Human
uagaacaugggauagaguuuuu

SEQ ID NO: 234088 - RNA, 22 nt, Human
aaggucaaagacaguaacuuuu

SEQ ID NO: 234089 - RNA, 22 nt, Human
cagagguaccagcagccucugg

SEQ ID NO: 234090 - RNA, 22 nt, Human
uucuguacuucaggggcucugu

SEQ ID NO: 234091 - RNA, 22 nt, Human
cugggccuuugggaguucggug

SEQ ID NO: 234092 - RNA, 22 nt, Human
cccugggauugccuuggccuug

SEQ ID NO: 234093 - RNA, 17 nt, Human
agcugagcuggccaggg

SEQ ID NO: 234094 - RNA, 22 nt, Human
ucaacugguucuugaauguaua

SEQ ID NO: 234095 - RNA, 23 nt, Human
acaaaguaauuccugcuuccaaa

SEQ ID NO: 234096 - RNA, 22 nt, Human
gucccugggucuaaggcaguaa

SEQ ID NO: 234097 - RNA, 22 nt, Human
caaaugaagggagcugaagucu

SEQ ID NO: 234098 - RNA, 22 nt, Human
aaaaaugaaacggcugguuggc

SEQ ID NO: 234099 - RNA, 22 nt, Human
ucucaucuauucacauuaacug

SEQ ID NO: 234100 - RNA, 22 nt, Human
gagccagcugagcugcacuguc

SEQ ID NO: 234101 - RNA, 22 nt, Human
gcaagcugcucuuauguggagg

SEQ ID NO: 234102 - RNA, 22 nt, Human
uggcccuuugguuuaugacuga

SEQ ID NO: 234103 - RNA, 22 nt, Human
gcucucagcccacugaggggaa

SEQ ID NO: 234104 - RNA, 22 nt, Human
cuagagaauugucuugagaguu

SEQ ID NO: 234105 - RNA, 22 nt, Human
ucuuuagagccuuuccucccga

SEQ ID NO: 234106 - RNA, 22 nt, Human
aggcuaggcaugugcuaccaca

SEQ ID NO: 234107 - RNA, 22 nt, Human
caggcauugugacgaguguucu

SEQ ID NO: 234108 - RNA, 22 nt, Human
augagagguuucgucagaggaa

SEQ ID NO: 234109 - RNA, 20 nt, Human
ugacuucugggauuuguggu

SEQ ID NO: 234110 - RNA, 22 nt, Human
uugaauuauauguauguccuuu

SEQ ID NO: 234111 - RNA, 22 nt, Human
gcugcucugugacagccuccgg

SEQ ID NO: 234112 - RNA, 22 nt, Human
gggcuaggucugaucagagaag

SEQ ID NO: 234113 - RNA, 22 nt, Human
agcacguucuucauuacuucac

SEQ ID NO: 234114 - RNA, 22 nt, Human
ucugggcugugguuccacuccg

SEQ ID NO: 234115 - RNA, 22 nt, Human
uagguucacuuagcugugggaa

SEQ ID NO: 234116 - RNA, 22 nt, Human
ggcuuccuccuuccugcuguca

SEQ ID NO: 234117 - RNA, 22 nt, Human
ucuguagguuaaaaguagacaa

SEQ ID NO: 234118 - RNA, 22 nt, Human
ggguaggcugcuccuggggccc

SEQ ID NO: 234119 - RNA, 22 nt, Human
auguuucuacagcguccacuga

SEQ ID NO: 234120 - RNA, 22 nt, Human
uaugugucaaaccauucaucug

SEQ ID NO: 234121 - RNA, 22 nt, Human
uaaucacagaaacagacuguuu

SEQ ID NO: 234122 - RNA, 22 nt, Human
agaggggguguuccagaagcau

SEQ ID NO: 234123 - RNA, 22 nt, Human
ugacaggcagugcugggcaugu

SEQ ID NO: 234124 - RNA, 21 nt, Human
aaagauguuucaucugagaaa

SEQ ID NO: 234125 - RNA, 22 nt, Human
cugggcugcaggaguggggcaa

SEQ ID NO: 234126 - RNA, 20 nt, Human
aggccugagagaugacuggg

SEQ ID NO: 234127 - RNA, 21 nt, Human
acauaggcgaauguucgggag

SEQ ID NO: 234128 - RNA, 22 nt, Human
ccugugucagccccugccucca

SEQ ID NO: 234129 - RNA, 22 nt, Human
uggucugauaccggauuccagu

SEQ ID NO: 234130 - RNA, 22 nt, Human
agcagagcauggugggaagggc

SEQ ID NO: 234131 - RNA, 22 nt, Human
aaguuacaggagaaagagauca

SEQ ID NO: 234132 - RNA, 22 nt, Human
acuggccaggcagcaguagcuu

SEQ ID NO: 234133 - RNA, 22 nt, Human
caggaaauguauaauuuuauaa

SEQ ID NO: 234134 - RNA, 22 nt, Human
acuacaguaagggaggcagcau

SEQ ID NO: 234135 - RNA, 22 nt, Human
acacauuuauggaucgcagaaa

SEQ ID NO: 234136 - RNA, 23 nt, Human
acagaaaguucugcuggacagag

SEQ ID NO: 234137 - RNA, 22 nt, Human
cagagacauguggccugcacgu

SEQ ID NO: 234138 - RNA, 22 nt, Human
ggcugccuucauagaccauggg

SEQ ID NO: 234139 - RNA, 22 nt, Human
uugcaggguuaaaguaagguag

SEQ ID NO: 234140 - RNA, 20 nt, Human
auauuucuuaagaacuuuca

SEQ ID NO: 234141 - RNA, 22 nt, Human
auucacaguucauuagcuguaa

SEQ ID NO: 234142 - RNA, 22 nt, Human
gaauagcuugacaauuauuuuu

SEQ ID NO: 234143 - RNA, 22 nt, Human
ccaggcuccgcauagaccccac

SEQ ID NO: 234144 - RNA, 22 nt, Human
caggccagaguccaacuccaga

SEQ ID NO: 234145 - RNA, 22 nt, Human
uccuggcucugcugccuccuag

SEQ ID NO: 234146 - RNA, 22 nt, Human
caguuuuauacacugcagcucc

SEQ ID NO: 234147 - RNA, 22 nt, Human
cuccaguaucuguaggaaaagg

SEQ ID NO: 234148 - RNA, 22 nt, Human
cuaauacucauuucuguaacuc

SEQ ID NO: 234149 - RNA, 22 nt, Human
cagcugugcugauugcucagua

SEQ ID NO: 234150 - RNA, 19 nt, Human
aggagaaguagcagaaauu

SEQ ID NO: 234151 - RNA, 22 nt, Human
ucuggaauagguccugaguauu

SEQ ID NO: 234152 - RNA, 22 nt, Human
cuucugugguaaacuuuguugu

SEQ ID NO: 234153 - RNA, 22 nt, Human
ucugaaagcauuacaguuuauu

SEQ ID NO: 234154 - RNA, 22 nt, Human
aaguucaaggcagguccugagg

SEQ ID NO: 234155 - RNA, 22 nt, Human
caaguacugugauagcugaagu

SEQ ID NO: 234156 - RNA, 22 nt, Human
ggcuuugacaugcugaauuaaa

SEQ ID NO: 234157 - RNA, 22 nt, Human
uuucuuaugggguaguccuuua

SEQ ID NO: 234158 - RNA, 22 nt, Human
cauuugaaugagauugcuguaa

SEQ ID NO: 234159 - RNA, 22 nt, Human
uuguuuacacugcagaauuggg

SEQ ID NO: 234160 - RNA, 22 nt, Human
uuucucagaggagccagacggu

SEQ ID NO: 234161 - RNA, 22 nt, Human
gcaugugugagaccuuuuagca

SEQ ID NO: 234162 - RNA, 22 nt, Human
gacaggaaacaagaaggcagga

SEQ ID NO: 234163 - RNA, 22 nt, Human
ccaaguacagauuccuccacug

SEQ ID NO: 234164 - RNA, 22 nt, Human
uucauuccuucccuaagcaacu

SEQ ID NO: 234165 - RNA, 22 nt, Human
agggccugaggcugacggggag

SEQ ID NO: 234166 - RNA, 22 nt, Human
uuaaaagagacuuccuuuguuu

SEQ ID NO: 234167 - RNA, 22 nt, Human
aggacagcagccauuggcaguc

SEQ ID NO: 234168 - RNA, 22 nt, Human
gcccagggugcuuagaacccau

SEQ ID NO: 234169 - RNA, 22 nt, Human
ccuggcagggcugcaguaaugg

SEQ ID NO: 234170 - RNA, 22 nt, Human
auacaagacaguaggaaacuga

SEQ ID NO: 234171 - RNA, 22 nt, Human
aaaucacuguuauugaucuuaa

SEQ ID NO: 234172 - RNA, 22 nt, Human
ucugggucuauuccuacuguga

SEQ ID NO: 234173 - RNA, 22 nt, Human
ucagacagaggagcucgugcag

SEQ ID NO: 234174 - RNA, 22 nt, Human
gggcuggaucuccugcaggcag

SEQ ID NO: 234175 - RNA, 22 nt, Human
ucuuugguauucacuugugaag

SEQ ID NO: 234176 - RNA, 22 nt, Human
agaaucuuucugaaugacugug

SEQ ID NO: 234177 - RNA, 22 nt, Human
agucugucucugcuaaucacua

SEQ ID NO: 234178 - RNA, 22 nt, Human
acugagcaggguuccgcaugga

SEQ ID NO: 234179 - RNA, 22 nt, Human
cugaggaggcuaauuugaggau

SEQ ID NO: 234180 - RNA, 22 nt, Human
cagggcuguuagcugcugcucu

SEQ ID NO: 234181 - RNA, 22 nt, Human
ggccucagaccggagcuggcca

SEQ ID NO: 234182 - RNA, 22 nt, Human
cuggagggagauucaaaggagg

SEQ ID NO: 234183 - RNA, 22 nt, Human
ucaggaagggugguccacaggg

SEQ ID NO: 234184 - RNA, 22 nt, Human
aguugacauccagagacauucu

SEQ ID NO: 234185 - RNA, 22 nt, Human
caggucagagucccccuguccu

SEQ ID NO: 234186 - RNA, 22 nt, Human
gugguccaucaugcagagcucc

SEQ ID NO: 234187 - RNA, 22 nt, Human
gcaaggcuuugugaauuuuaaa

SEQ ID NO: 234188 - RNA, 17 nt, Human
gcaaccagcccccaucu

SEQ ID NO: 234189 - RNA, 22 nt, Human
caaaacugucuagagagagaag

SEQ ID NO: 234190 - RNA, 22 nt, Human
uccuccuucgggacugcuugac

SEQ ID NO: 234191 - RNA, 22 nt, Human
gauguuuggcucaaacgagugu

SEQ ID NO: 234192 - RNA, 22 nt, Human
agcaacagcaacgacauuucuc

SEQ ID NO: 234193 - RNA, 22 nt, Human
aucuagaacuuaaagucaguca

SEQ ID NO: 234194 - RNA, 22 nt, Human
agagccagguguagucucggag

SEQ ID NO: 234195 - RNA, 22 nt, Human
uuuccuuccuugcuagccugag

SEQ ID NO: 234196 - RNA, 22 nt, Human
uuauguacucugcaauguuuga

SEQ ID NO: 234197 - RNA, 22 nt, Human
uuccagaaaaaaauguauaucu

SEQ ID NO: 234198 - RNA, 22 nt, Human
uucacauuaagccuccuccuac

SEQ ID NO: 234199 - RNA, 22 nt, Human
agggcuccgggccaccggccug

SEQ ID NO: 234200 - RNA, 22 nt, Human
cuggccugaucucaugcugucc

SEQ ID NO: 234201 - RNA, 18 nt, Human
accuccccauuuucugaa

SEQ ID NO: 234202 - RNA, 22 nt, Human
ugcauuccauguguuuccugag

SEQ ID NO: 234203 - RNA, 22 nt, Human
gucccaggcuccauggcagcca

SEQ ID NO: 234204 - RNA, 19 nt, Human
uguguccuagcagccaguc

SEQ ID NO: 234205 - RNA, 22 nt, Human
uuuaagcuaaugucauaauuag

SEQ ID NO: 234206 - RNA, 19 nt, Human
aguggcugggcagaagcaa

SEQ ID NO: 234207 - RNA, 22 nt, Human
ggaauguuuuucauugcucucu

SEQ ID NO: 234208 - RNA, 22 nt, Human
uuagagcuucccaauuaaaacg

SEQ ID NO: 234209 - RNA, 22 nt, Human
gauggcuuguuuucuggcugaa

SEQ ID NO: 234210 - RNA, 22 nt, Human
gcuuucugaugagcuuaagaaa

SEQ ID NO: 234211 - RNA, 22 nt, Human
cuccugugcaugcaucucccua

SEQ ID NO: 234212 - RNA, 22 nt, Human
augcacaagaggcuagaaaaga

SEQ ID NO: 234213 - RNA, 23 nt, Human
cauuucugggagauuuauaaaau

SEQ ID NO: 234214 - RNA, 22 nt, Human
gcugccccagcugggggcugga

SEQ ID NO: 234215 - RNA, 22 nt, Human
acacuuuacagaauguuuugau

SEQ ID NO: 234216 - RNA, 22 nt, Human
acaagguuguucugaggauuua

SEQ ID NO: 234217 - RNA, 22 nt, Human
gacaugcuaauuacugguucaa

SEQ ID NO: 234218 - RNA, 22 nt, Human
ucagaaguugaaggcucuuuuu

SEQ ID NO: 234219 - RNA, 21 nt, Human
cuguccaguaauuccuggcac

SEQ ID NO: 234220 - RNA, 22 nt, Human
uguaauuauuucugugcaguca

SEQ ID NO: 234221 - RNA, 22 nt, Human
acacaagaaguuaaugggcaaa

SEQ ID NO: 234222 - RNA, 22 nt, Human
ucuggcaguaauaggggagaga

SEQ ID NO: 234223 - RNA, 22 nt, Human
uaacacuuuggauuaaaauucu

SEQ ID NO: 234224 - RNA, 23 nt, Human
uggcagagacccagaaucuacau

SEQ ID NO: 234225 - RNA, 22 nt, Human
cugggccuccacgggccaucac

SEQ ID NO: 234226 - RNA, 22 nt, Human
gcucuguauguaguucuugcuu

SEQ ID NO: 234227 - RNA, 23 nt, Human
caugacaaaggaucucaugggcc

SEQ ID NO: 234228 - RNA, 22 nt, Human
uagaaucauugagaauaacagg

SEQ ID NO: 234229 - RNA, 22 nt, Human
ucaggagacuuaugucacagug

SEQ ID NO: 234230 - RNA, 22 nt, Human
gcauggcuauuaugaggcagaa

SEQ ID NO: 234231 - RNA, 22 nt, Human
uuuccaaguacugagcugucaa

SEQ ID NO: 234232 - RNA, 22 nt, Human
aucaggaaagaaaagcuuggcg

SEQ ID NO: 234233 - RNA, 22 nt, Human
cucagcuucuaccuccugagug

SEQ ID NO: 234234 - RNA, 22 nt, Human
cuuuccaacucuagugaaauuu

SEQ ID NO: 234235 - RNA, 22 nt, Human
agcugagggcaggaugggguga

SEQ ID NO: 234236 - RNA, 22 nt, Human
cuccaggacugaggacagagcu

SEQ ID NO: 234237 - RNA, 22 nt, Human
ugguccuggucaucugggcugg

SEQ ID NO: 234238 - RNA, 22 nt, Human
ucugggggcgaccagggacugc

SEQ ID NO: 234239 - RNA, 22 nt, Human
ugagaaugaaucuuuugcuuuc

SEQ ID NO: 234240 - RNA, 22 nt, Human
acauggaagcaaaguucuauuu

SEQ ID NO: 234241 - RNA, 20 nt, Human
uuucaccaucuuggccaggc

SEQ ID NO: 234242 - RNA, 22 nt, Human
ucacagaaaucuguuuuuucua

SEQ ID NO: 234243 - RNA, 19 nt, Human
gccagcagaaugaugaggc

SEQ ID NO: 234244 - RNA, 22 nt, Human
ccagagcaugaagggcaaugac

SEQ ID NO: 234245 - RNA, 22 nt, Human
ggucccaguugcccaggucagg

SEQ ID NO: 234246 - RNA, 18 nt, Human
uacuguuuaauugauuac

SEQ ID NO: 234247 - RNA, 22 nt, Human
acuggcagcuguaggaugcaug

SEQ ID NO: 234248 - RNA, 22 nt, Human
uucuggguaguaugguuaguuu

SEQ ID NO: 234249 - RNA, 22 nt, Human
acccaggccauuggcaagaguc

SEQ ID NO: 234250 - RNA, 22 nt, Human
aacaggcuauuucuuuacaaac

SEQ ID NO: 234251 - RNA, 22 nt, Human
caugaaggaccauuucacgguc

SEQ ID NO: 234252 - RNA, 22 nt, Human
ucuuauugucuagauugagaug

SEQ ID NO: 234253 - RNA, 17 nt, Human
ggcuuccagguggcucu

SEQ ID NO: 234254 - RNA, 22 nt, Human
ucagaggaauaaugcugcauuu

SEQ ID NO: 234255 - RNA, 22 nt, Human
caggugagaggcgguccugcau

SEQ ID NO: 234256 - RNA, 22 nt, Human
gcagguguggauuugcauccag

SEQ ID NO: 234257 - RNA, 22 nt, Human
uccuggcuucugucuccuuauu

SEQ ID NO: 234258 - RNA, 22 nt, Human
accugaggaagggcgagaagcu

SEQ ID NO: 234259 - RNA, 22 nt, Human
agacaugucaccaauucuuacu

SEQ ID NO: 234260 - RNA, 22 nt, Human
ucugggcuauauggucucugcu

SEQ ID NO: 234261 - RNA, 22 nt, Human
aauaugaugccaaauugcuaca

SEQ ID NO: 234262 - RNA, 22 nt, Human
cggccgcagcagugucggccca

SEQ ID NO: 234263 - RNA, 22 nt, Human
augucacagucugacucaguga

SEQ ID NO: 234264 - RNA, 22 nt, Human
acagaacugcagacagugccaa

SEQ ID NO: 234265 - RNA, 22 nt, Human
acauguguaagaugugauauau

SEQ ID NO: 234266 - RNA, 22 nt, Human
auggcuggcaugugcauaacgg

SEQ ID NO: 234267 - RNA, 22 nt, Human
guuccucaaaaaggagagcccc

SEQ ID NO: 234268 - RNA, 22 nt, Human
uuugcaaugugaaauuaaagaa

SEQ ID NO: 234269 - RNA, 19 nt, Human
uccagcagugcuugaaauc

SEQ ID NO: 234270 - RNA, 22 nt, Human
cucugaaaaugugguggggaaa

SEQ ID NO: 234271 - RNA, 22 nt, Human
gggcuggcuaagacuuuucugu

SEQ ID NO: 234272 - RNA, 22 nt, Human
uguggcugacuccuggucccca

SEQ ID NO: 234273 - RNA, 16 nt, Human
ucacacauuuguuggu

SEQ ID NO: 234274 - RNA, 22 nt, Human
aaacuguaaacacagcaguaca

SEQ ID NO: 234275 - RNA, 22 nt, Human
ugaggggagcuagcaugccuug

SEQ ID NO: 234276 - RNA, 22 nt, Human
ucauggggcucuucaaguggag

SEQ ID NO: 234277 - RNA, 22 nt, Human
auuuauugaacacugacuaugu

SEQ ID NO: 234278 - RNA, 22 nt, Human
auagcaaaaaugaacaaagcuu

SEQ ID NO: 234279 - RNA, 22 nt, Human
accacugcccauggugaaaacu

SEQ ID NO: 234280 - RNA, 22 nt, Human
ggugagacuuuagaagagccag

SEQ ID NO: 234281 - RNA, 22 nt, Human
cuuucucuguguuucacaugcu

SEQ ID NO: 234282 - RNA, 22 nt, Human
agucaagauucuggcacuagca

SEQ ID NO: 234283 - RNA, 22 nt, Human
ugcaggugguccauuugggaac

SEQ ID NO: 234284 - RNA, 22 nt, Human
guauucagaaggaugaucuagu

SEQ ID NO: 234285 - RNA, 22 nt, Human
ggcccagugcuguucacccagu

SEQ ID NO: 234286 - RNA, 21 nt, Human
aaggcugagacaacucaggag

SEQ ID NO: 234287 - RNA, 22 nt, Human
uccccaccuaagauacccaucu

SEQ ID NO: 234288 - RNA, 22 nt, Human
cuggcugccagcauuuggggga

SEQ ID NO: 234289 - RNA, 23 nt, Human
uuguuuaccguaggacuuuuaac

SEQ ID NO: 234290 - RNA, 22 nt, Human
gaccagcugguccuguccuggg

SEQ ID NO: 234291 - RNA, 22 nt, Human
cuugagaaucuugaugucuacc

SEQ ID NO: 234292 - RNA, 21 nt, Human
agucuuaggcacagcuguguc

SEQ ID NO: 234293 - RNA, 22 nt, Human
gaaucucauucuaacuaguagg

SEQ ID NO: 234294 - RNA, 22 nt, Human
ucuuacgaauucuuagaggaca

SEQ ID NO: 234295 - RNA, 22 nt, Human
uucuuucugucaugguguacug

SEQ ID NO: 234296 - RNA, 22 nt, Human
guauuacauuuaguaauuaggc

SEQ ID NO: 234297 - RNA, 22 nt, Human
auuguacagguuggaggaagug

SEQ ID NO: 234298 - RNA, 22 nt, Human
agaggugggagccuggucacau

SEQ ID NO: 234299 - RNA, 22 nt, Human
auauuguugacuauaagaguaa

SEQ ID NO: 234300 - RNA, 22 nt, Human
agaacugugaaguaugugaaau

SEQ ID NO: 234301 - RNA, 22 nt, Human
ccugagaagagcuuaugaguga

SEQ ID NO: 234302 - RNA, 19 nt, Human
agagacacagguaaguagg

SEQ ID NO: 234303 - RNA, 22 nt, Human
acccucagcuggagauugaauu

SEQ ID NO: 234304 - RNA, 22 nt, Human
gcugggcaugugaccaacagaa

SEQ ID NO: 234305 - RNA, 22 nt, Human
aaucuuucccuauuaaaugugg

SEQ ID NO: 234306 - RNA, 22 nt, Human
acaaaugccauauauaaauucu

SEQ ID NO: 234307 - RNA, 22 nt, Human
ugucagcucccagucagagaga

SEQ ID NO: 234308 - RNA, 22 nt, Human
guagggacaugccauuaucuca

SEQ ID NO: 234309 - RNA, 22 nt, Human
gagaaggauguggcucauagcu

SEQ ID NO: 234310 - RNA, 22 nt, Human
uauuuccugcauggugauguaa

SEQ ID NO: 234311 - RNA, 22 nt, Human
ucuuuaucaggugaagagggac

SEQ ID NO: 234312 - RNA, 22 nt, Human
aggcugugacagggucauggag

SEQ ID NO: 234313 - RNA, 22 nt, Human
agcucagguagacucagcaucu

SEQ ID NO: 234314 - RNA, 22 nt, Human
auuugcaaagucguaucuguga

SEQ ID NO: 234315 - RNA, 22 nt, Human
agggccacaguggggccugaga

SEQ ID NO: 234316 - RNA, 20 nt, Human
ucacaggagggaaggcaggu

SEQ ID NO: 234317 - RNA, 22 nt, Human
agauuuauguggucacacucag

SEQ ID NO: 234318 - RNA, 16 nt, Human
ucccugggaguggugg

SEQ ID NO: 234319 - RNA, 22 nt, Human
ugcuggcugcagugcugucaaa

SEQ ID NO: 234320 - RNA, 22 nt, Human
gcccaggggaguagucaauuua

SEQ ID NO: 234321 - RNA, 23 nt, Human
acaucaugauagccaacuuggga

SEQ ID NO: 234322 - RNA, 22 nt, Human
uggccugccuucgcugagcuga

SEQ ID NO: 234323 - RNA, 22 nt, Human
agcaggugacagggcuguggug

SEQ ID NO: 234324 - RNA, 22 nt, Human
cacccagggcugugccugccca

SEQ ID NO: 234325 - RNA, 21 nt, Human
ugaaguucgcgggcaagauua

SEQ ID NO: 234326 - RNA, 22 nt, Human
ggcucuggaaaguguccuugau

SEQ ID NO: 234327 - RNA, 20 nt, Human
uacaaauuuuccauguuucc

SEQ ID NO: 234328 - RNA, 22 nt, Human
acagugcauuauugcugaaugc

SEQ ID NO: 234329 - RNA, 22 nt, Human
aagacaaugcauuacuaagaag

SEQ ID NO: 234330 - RNA, 22 nt, Human
acuucucucauucagacauagc

SEQ ID NO: 234331 - RNA, 22 nt, Human
aagaaagggagaaggauggugu

SEQ ID NO: 234332 - RNA, 23 nt, Human
ugggguugaauuguagcugugcc

SEQ ID NO: 234333 - RNA, 21 nt, Human
ggcuuuaugcucacccagccu

SEQ ID NO: 234334 - RNA, 20 nt, Human
ucccaggcugggcuccagcu

SEQ ID NO: 234335 - RNA, 22 nt, Human
gaugccuguggugagcacacau

SEQ ID NO: 234336 - RNA, 22 nt, Human
aagccaaguuggaagacugaau

SEQ ID NO: 234337 - RNA, 19 nt, Human
acagggcucuggacgccau

SEQ ID NO: 234338 - RNA, 22 nt, Human
uaagugguaccaagcucaguga

SEQ ID NO: 234339 - RNA, 22 nt, Human
ucugaaauggcagcgggaauga

SEQ ID NO: 234340 - RNA, 22 nt, Human
uccugagugguuguuuucuucc

SEQ ID NO: 234341 - RNA, 22 nt, Human
ugccaaaauggccaaaagcuag

SEQ ID NO: 234342 - RNA, 22 nt, Human
gagaaagacguaggcugggagg

SEQ ID NO: 234343 - RNA, 19 nt, Human
uucuccagccugaccugag

SEQ ID NO: 234344 - RNA, 22 nt, Human
aaaggcaugcauggucugcucc

SEQ ID NO: 234345 - RNA, 22 nt, Human
cagcugaauggcucccugcuaa

SEQ ID NO: 234346 - RNA, 22 nt, Human
uucuggaacauagcaagaaguu

SEQ ID NO: 234347 - RNA, 22 nt, Human
ccucaggcccugucccugcgcc

SEQ ID NO: 234348 - RNA, 22 nt, Human
aggcuggcugacuucugaagca

SEQ ID NO: 234349 - RNA, 22 nt, Human
uucacaagucauuagcugcaua

SEQ ID NO: 234350 - RNA, 22 nt, Human
ugucaggcaaaggaagguauuu

SEQ ID NO: 234351 - RNA, 22 nt, Human
ugguccugucucaaggagccuu

SEQ ID NO: 234352 - RNA, 22 nt, Human
gccuucccacccugcgaggcug

SEQ ID NO: 234353 - RNA, 22 nt, Human
aguauacaguaaugacauaucu

SEQ ID NO: 234354 - RNA, 22 nt, Human
gccuggcugcuuagccuacuuc

SEQ ID NO: 234355 - RNA, 22 nt, Human
ccagcuuucugggugguuucug

SEQ ID NO: 234356 - RNA, 22 nt, Human
ggaagaaaguagaaaaccgugg

SEQ ID NO: 234357 - RNA, 22 nt, Human
cccuggagaucgggagaggaag

SEQ ID NO: 234358 - RNA, 22 nt, Human
cccugccuugggguccacaccg

SEQ ID NO: 234359 - RNA, 22 nt, Human
ugucuucagcagucaucugggg

SEQ ID NO: 234360 - RNA, 22 nt, Human
aaacacaucauucaugucguca

SEQ ID NO: 234361 - RNA, 22 nt, Human
agauggucaaggauacuguuca

SEQ ID NO: 234362 - RNA, 22 nt, Human
gagcacagggaauagacagaua

SEQ ID NO: 234363 - RNA, 22 nt, Human
cccagguguuuguggcagaggu

SEQ ID NO: 234364 - RNA, 22 nt, Human
aagcagaggccacagagugggc

SEQ ID NO: 234365 - RNA, 22 nt, Human
aggcucucaauaugauccaguc

SEQ ID NO: 234366 - RNA, 22 nt, Human
ugaggagcgggcagggaugcag

SEQ ID NO: 234367 - RNA, 21 nt, Human
ccuggccaaucugauaggguu

SEQ ID NO: 234368 - RNA, 22 nt, Human
gggcaggagaagguggaugucc

SEQ ID NO: 234369 - RNA, 22 nt, Human
uuuccaagacuccaguucuccc

SEQ ID NO: 234370 - RNA, 22 nt, Human
aaauggcacuuugacagccugc

SEQ ID NO: 234371 - RNA, 22 nt, Human
cuggcucccagcuuucagggag

SEQ ID NO: 234372 - RNA, 22 nt, Human
ugcacuucaaaaaugucacuga

SEQ ID NO: 234373 - RNA, 22 nt, Human
uucauugagcuguacacuuagg

SEQ ID NO: 234374 - RNA, 22 nt, Human
auucacaauuagaaguagauaa

SEQ ID NO: 234375 - RNA, 22 nt, Human
augaugcaccauuauaagaguu

SEQ ID NO: 234376 - RNA, 22 nt, Human
gcagccuuuggaauuagagacu

SEQ ID NO: 234377 - RNA, 22 nt, Human
aaaaaguuucaacugccaacuc

SEQ ID NO: 234378 - RNA, 22 nt, Human
uuaucguacgcuucagaaauuu

SEQ ID NO: 234379 - RNA, 22 nt, Human
guucuggguucaaaccccggcc

SEQ ID NO: 234380 - RNA, 21 nt, Human
gcagccacugccuucaacaau

SEQ ID NO: 234381 - RNA, 22 nt, Human
ggcucugcuccuggugccagug

SEQ ID NO: 234382 - RNA, 15 nt, Human
uguuaacagcuggga

SEQ ID NO: 234383 - RNA, 22 nt, Human
aacacagaguauuugaagcauu

SEQ ID NO: 234384 - RNA, 22 nt, Human
acaggcugguuuguaaaagaug

SEQ ID NO: 234385 - RNA, 22 nt, Human
agauauguuuguauauauuugu

SEQ ID NO: 234386 - RNA, 22 nt, Human
gagucuuugguaaagucugcug

SEQ ID NO: 234387 - RNA, 22 nt, Human
uuuauucaucaucuguucauau

SEQ ID NO: 234388 - RNA, 22 nt, Human
gauuagaauggauagaucccca

SEQ ID NO: 234389 - RNA, 22 nt, Human
cugccguugugaagcucuuaga

SEQ ID NO: 234390 - RNA, 22 nt, Human
aucaguuuauacuuauaaaucu

SEQ ID NO: 234391 - RNA, 22 nt, Human
uuucucugugggcuuuaugcau

SEQ ID NO: 234392 - RNA, 20 nt, Human
auugacagaaaguguucacc

SEQ ID NO: 234393 - RNA, 22 nt, Human
agaguguuucagucuuccuaga

SEQ ID NO: 234394 - RNA, 22 nt, Human
cuggcauucuuguuucuggaaa

SEQ ID NO: 234395 - RNA, 22 nt, Human
caggcuugcuagaggagccaaa

SEQ ID NO: 234396 - RNA, 22 nt, Human
ccugggcugggcgucucauggg

SEQ ID NO: 234397 - RNA, 22 nt, Human
ucuuuccacauucucuguuuag

SEQ ID NO: 234398 - RNA, 22 nt, Human
uccugagcugacacuuggggag

SEQ ID NO: 234399 - RNA, 22 nt, Human
cugccugcacugccuggcucca

SEQ ID NO: 234400 - RNA, 22 nt, Human
auauauacuuugacacauucug

SEQ ID NO: 234401 - RNA, 22 nt, Human
ccugagggucaaggagcccuag

SEQ ID NO: 234402 - RNA, 23 nt, Human
aguguugguugggaagccaagca

SEQ ID NO: 234403 - RNA, 22 nt, Human
gcuccuggucuggagcuucaag

SEQ ID NO: 234404 - RNA, 22 nt, Human
ucuuagucacagaggugagaaa

SEQ ID NO: 234405 - RNA, 22 nt, Human
gaggcaugcagagcuggagcag

SEQ ID NO: 234406 - RNA, 22 nt, Human
auuaguguuguggcuucauggc

SEQ ID NO: 234407 - RNA, 22 nt, Human
cuccagugcacccagaggauuu

SEQ ID NO: 234408 - RNA, 22 nt, Human
ccaaauuaaaucauacagacag

SEQ ID NO: 234409 - RNA, 22 nt, Human
ccuugggagaaauugcagaguc

SEQ ID NO: 234410 - RNA, 22 nt, Human
ugcugggcuggagcugccaggg

SEQ ID NO: 234411 - RNA, 22 nt, Human
gugggugucaguaucuuuaacg

SEQ ID NO: 234412 - RNA, 22 nt, Human
agcagcucuuaacaaagcaugg

SEQ ID NO: 234413 - RNA, 22 nt, Human
cacccaggcagguggcugagaa

SEQ ID NO: 234414 - RNA, 22 nt, Human
aaaauucucuugaucuugacag

SEQ ID NO: 234415 - RNA, 22 nt, Human
uucauagguuugcugugaacau

SEQ ID NO: 234416 - RNA, 21 nt, Human
uuagcaaagcaaacacaugcu

SEQ ID NO: 234417 - RNA, 22 nt, Human
ggcaguggcuguagucucuugg

SEQ ID NO: 234418 - RNA, 22 nt, Human
cugucaggaagcugggcaucca

SEQ ID NO: 234419 - RNA, 22 nt, Human
ccugccugcggcccgcggggag

SEQ ID NO: 234420 - RNA, 22 nt, Human
aaguuuuucacauugcuguugu

SEQ ID NO: 234421 - RNA, 22 nt, Human
gaauucugggagagaucugaca

SEQ ID NO: 234422 - RNA, 22 nt, Human
uagcugaagaggguauuguagg

SEQ ID NO: 234423 - RNA, 22 nt, Human
ugaaauuauucuuaccaaggug

SEQ ID NO: 234424 - RNA, 22 nt, Human
cagcuuggaggaggaucuaaga

SEQ ID NO: 234425 - RNA, 22 nt, Human
ccucugagugcuuugagggaga

SEQ ID NO: 234426 - RNA, 22 nt, Human
cagaaagugauuugcuauucca

SEQ ID NO: 234427 - RNA, 22 nt, Human
cauguaaaaagaagaaucugga

SEQ ID NO: 234428 - RNA, 18 nt, Human
uguuuauuuuucucuuac

SEQ ID NO: 234429 - RNA, 17 nt, Human
aguggcaggcagauggg

SEQ ID NO: 234430 - RNA, 22 nt, Human
aucucuggccccugggguccga

SEQ ID NO: 234431 - RNA, 22 nt, Human
gcuccuggcucuggccaaggga

SEQ ID NO: 234432 - RNA, 22 nt, Human
ccagcccuugagauggaaggga

SEQ ID NO: 234433 - RNA, 19 nt, Human
gcaggucauuaggcuaggu

SEQ ID NO: 234434 - RNA, 22 nt, Human
agucagaaucugcauuuuaacc

SEQ ID NO: 234435 - RNA, 22 nt, Human
augaggcagucuggccugaggg

SEQ ID NO: 234436 - RNA, 22 nt, Human
uccaaaacagaacucugugaau

SEQ ID NO: 234437 - RNA, 22 nt, Human
uacacuuuauggauccuacuuu

SEQ ID NO: 234438 - RNA, 22 nt, Human
agcugccaccucugccuuuggg

SEQ ID NO: 234439 - RNA, 22 nt, Human
gccaggagcccugggcaaguuc

SEQ ID NO: 234440 - RNA, 22 nt, Human
ggcgcucaguguugccccagag

SEQ ID NO: 234441 - RNA, 16 nt, Human
gcugggagggagaggu

SEQ ID NO: 234442 - RNA, 22 nt, Human
uuacaguuuaagaggaaacaaa

SEQ ID NO: 234443 - RNA, 22 nt, Human
ugugggaggauucagaauuggg

SEQ ID NO: 234444 - RNA, 22 nt, Human
cuucugagaggggcuaggagca

SEQ ID NO: 234445 - RNA, 18 nt, Human
acagaggcagacauguau

SEQ ID NO: 234446 - RNA, 22 nt, Human
aggaagagcccgggugacauaa

SEQ ID NO: 234447 - RNA, 23 nt, Human
ggguccagagaagccauuagggc

SEQ ID NO: 234448 - RNA, 22 nt, Human
cuggcaugaaauggcaucucau

SEQ ID NO: 234449 - RNA, 23 nt, Human
ucucaggcaaaccaggacaaguu

SEQ ID NO: 234450 - RNA, 19 nt, Human
cacacccaugcuugccaag

SEQ ID NO: 234451 - RNA, 22 nt, Human
uuggcugccuucaccccuggcc

SEQ ID NO: 234452 - RNA, 22 nt, Human
auuagaaugacagaaaugaggc

SEQ ID NO: 234453 - RNA, 22 nt, Human
cuccucaaggucucaggaauaa

SEQ ID NO: 234454 - RNA, 22 nt, Human
acagccacucaaagggccgaag

SEQ ID NO: 234455 - RNA, 18 nt, Human
cucagagaugcccuuauu

SEQ ID NO: 234456 - RNA, 22 nt, Human
uuugacuccuuugugaaaagag

SEQ ID NO: 234457 - RNA, 22 nt, Human
uacugagggcaaagagugaagc

SEQ ID NO: 234458 - RNA, 22 nt, Human
cugcauaugauagaugccuugc

SEQ ID NO: 234459 - RNA, 22 nt, Human
cacagucuuaucccaaccacca

SEQ ID NO: 234460 - RNA, 22 nt, Human
ggguccaguuucaucugagguu

SEQ ID NO: 234461 - RNA, 18 nt, Human
uggcucugcagccagaug

SEQ ID NO: 234462 - RNA, 22 nt, Human
uagcaagacaacuuuucucagu

SEQ ID NO: 234463 - RNA, 22 nt, Human
cacaguuaugggaaacguaguu

SEQ ID NO: 234464 - RNA, 22 nt, Human
cccugcuugucaccccuggguc

SEQ ID NO: 234465 - RNA, 22 nt, Human
auuuccuucaguguuuaauacu

SEQ ID NO: 234466 - RNA, 22 nt, Human
cuuagaacauacuuagugugau

SEQ ID NO: 234467 - RNA, 22 nt, Human
uccugagcccuggggucagugu

SEQ ID NO: 234468 - RNA, 22 nt, Human
aggccagguggucaugcuugcu

SEQ ID NO: 234469 - RNA, 22 nt, Human
uaggccaggagucagacagauu

SEQ ID NO: 234470 - RNA, 22 nt, Human
ccaggagcuggcauguggagag

SEQ ID NO: 234471 - RNA, 22 nt, Human
uacaggcugcagggcuagaggg

SEQ ID NO: 234472 - RNA, 22 nt, Human
ugcuuugacagggaugacauga

SEQ ID NO: 234473 - RNA, 22 nt, Human
uucuguauguaugccagagcau

SEQ ID NO: 234474 - RNA, 22 nt, Human
ccauuugugauguggcagcauc

SEQ ID NO: 234475 - RNA, 22 nt, Human
gagcaguugggcucuaggaagu

SEQ ID NO: 234476 - RNA, 20 nt, Human
cuguggugagcaggagagua

SEQ ID NO: 234477 - RNA, 22 nt, Human
aaggcagccgugugacugcaug

SEQ ID NO: 234478 - RNA, 22 nt, Human
ugaaggaaugagggaguggguc

SEQ ID NO: 234479 - RNA, 22 nt, Human
ucucccccagucucuacagcag

SEQ ID NO: 234480 - RNA, 22 nt, Human
cuuaagaagcaagucucagcaa

SEQ ID NO: 234481 - RNA, 18 nt, Human
cagaaaucacaccagcac

SEQ ID NO: 234482 - RNA, 18 nt, Human
cuguucagcugaacuaca

SEQ ID NO: 234483 - RNA, 22 nt, Human
ggguggcacaggugcagagggu

SEQ ID NO: 234484 - RNA, 17 nt, Human
gcaagggaugggagauu

SEQ ID NO: 234485 - RNA, 22 nt, Human
auguaguuagaagauucaaaca

SEQ ID NO: 234486 - RNA, 18 nt, Human
ucagcuuuugaaaaccaa

SEQ ID NO: 234487 - RNA, 22 nt, Human
aucuuccuucacuuucucccac

SEQ ID NO: 234488 - RNA, 22 nt, Human
gcugccuguggcccuucugggu

SEQ ID NO: 234489 - RNA, 22 nt, Human
uucuggcucuccccugcugggu

SEQ ID NO: 234490 - RNA, 22 nt, Human
uguuuauagauggccacaauga

SEQ ID NO: 234491 - RNA, 22 nt, Human
uaacugaugugaacuuaccauu

SEQ ID NO: 234492 - RNA, 22 nt, Human
gaagauuuaagcacaauagucu

SEQ ID NO: 234493 - RNA, 22 nt, Human
auacuuuagagcuagauugccu

SEQ ID NO: 234494 - RNA, 22 nt, Human
uuauucacaugggcucauucua

SEQ ID NO: 234495 - RNA, 22 nt, Human
ugacaugcuaagauuauguuau

SEQ ID NO: 234496 - RNA, 22 nt, Human
ucuggccagugaaaugcagaau

SEQ ID NO: 234497 - RNA, 22 nt, Human
aaucugagggaacuugaacucc

SEQ ID NO: 234498 - RNA, 22 nt, Human
acuguucuccagcauggcugua

SEQ ID NO: 234499 - RNA, 22 nt, Human
ucuuucuuuaucaccugauaug

SEQ ID NO: 234500 - RNA, 22 nt, Human
agccugggcaacaacacagcga

SEQ ID NO: 234501 - RNA, 22 nt, Human
acuuucauuugugaagacugua

SEQ ID NO: 234502 - RNA, 22 nt, Human
gccucagaaagcuuuuauucau

SEQ ID NO: 234503 - RNA, 22 nt, Human
gagggugcaggaggaugguagu

SEQ ID NO: 234504 - RNA, 22 nt, Human
agcuuuaccugccuuggggcac

SEQ ID NO: 234505 - RNA, 22 nt, Human
aagcccugggguugcacaaggc

SEQ ID NO: 234506 - RNA, 22 nt, Human
ugcuggccaagcagaggucaau

SEQ ID NO: 234507 - RNA, 20 nt, Human
cugucuugugggcuuccccu

SEQ ID NO: 234508 - RNA, 22 nt, Human
cccucaccaggcuccaggcaug

SEQ ID NO: 234509 - RNA, 22 nt, Human
gaauuacagaguuguuaaguca

SEQ ID NO: 234510 - RNA, 22 nt, Human
gaaaggcugcaucucgccucag

SEQ ID NO: 234511 - RNA, 22 nt, Human
acaucuuuauacuaguccuuga

SEQ ID NO: 234512 - RNA, 22 nt, Human
ggcacccuuggggggccacagc

SEQ ID NO: 234513 - RNA, 22 nt, Human
augauuucuauauaaacuuaaa

SEQ ID NO: 234514 - RNA, 23 nt, Human
aagauccauucaaauuauguauc

SEQ ID NO: 234515 - RNA, 22 nt, Human
aucauucuauuguugagcugcc

SEQ ID NO: 234516 - RNA, 22 nt, Human
aggaauguaaaucuagauuuua

SEQ ID NO: 234517 - RNA, 22 nt, Human
gagaggcugcauaugcacacug

SEQ ID NO: 234518 - RNA, 22 nt, Human
uaaaucuucuacaucaucauaa

SEQ ID NO: 234519 - RNA, 23 nt, Human
uugcaaauuucaguuaguucaug

SEQ ID NO: 234520 - RNA, 22 nt, Human
uuuaguagaauaguauaucaaa

SEQ ID NO: 234521 - RNA, 22 nt, Human
aaaguaguccuuggagcgaaau

SEQ ID NO: 234522 - RNA, 22 nt, Human
ugaagcaaauuuuucucagagu

SEQ ID NO: 234523 - RNA, 22 nt, Human
uaaggcuucuuggaauacugca

SEQ ID NO: 234524 - RNA, 22 nt, Human
agugcagggccugcccagcagg

SEQ ID NO: 234525 - RNA, 22 nt, Human
uucaaugcuuauauggacuaau

SEQ ID NO: 234526 - RNA, 21 nt, Human
uuuuaacaaggauuucccuag

SEQ ID NO: 234527 - RNA, 22 nt, Human
aaguaucaaaugguagcauaug

SEQ ID NO: 234528 - RNA, 21 nt, Human
augucaaaugcuuuauuuuau

SEQ ID NO: 234529 - RNA, 22 nt, Human
aauccauagaauaaaauugcag

SEQ ID NO: 234530 - RNA, 22 nt, Human
cagcccucucugggccccaagg

SEQ ID NO: 234531 - RNA, 22 nt, Human
uuagcaauguaugauuaaaaua

SEQ ID NO: 234532 - RNA, 22 nt, Human
acagauaauuagcauaaaugcu

SEQ ID NO: 234533 - RNA, 22 nt, Human
uuuaguguaagcauaaagaaca

SEQ ID NO: 234534 - RNA, 22 nt, Human
ccagagcuccagggcuacagaa

SEQ ID NO: 234535 - RNA, 22 nt, Human
aauugcuucccaagggaggucu

SEQ ID NO: 234536 - RNA, 22 nt, Human
aacacagacauagugauuacag

SEQ ID NO: 234537 - RNA, 22 nt, Human
ucaacuaacucuauuauuugaa

SEQ ID NO: 234538 - RNA, 22 nt, Human
cagcagcuuugccaagucagcc

SEQ ID NO: 234539 - RNA, 22 nt, Human
ugcugccagccaggccauggag

SEQ ID NO: 234540 - RNA, 22 nt, Human
agagcuggccagggaucacucu

SEQ ID NO: 234541 - RNA, 22 nt, Human
uacauuucagagcuccucucug

SEQ ID NO: 234542 - RNA, 23 nt, Human
gggagaugggaaaugaaggcucu

SEQ ID NO: 234543 - RNA, 22 nt, Human
gggauggaggguagagcaagug

SEQ ID NO: 234544 - RNA, 22 nt, Human
aacaugaaaagcccagagaggu

SEQ ID NO: 234545 - RNA, 22 nt, Human
ccacaucugcauuuaauguaua

SEQ ID NO: 234546 - RNA, 21 nt, Human
aacuacaguuguuccuucauu

SEQ ID NO: 234547 - RNA, 22 nt, Human
ugggaagguacacgggaaagag

SEQ ID NO: 234548 - RNA, 22 nt, Human
ccauacacacaccaaauuugua

SEQ ID NO: 234549 - RNA, 22 nt, Human
ggcaucugagcuguguaugguu

SEQ ID NO: 234550 - RNA, 22 nt, Human
agaacgcuauucagaacacugg

SEQ ID NO: 234551 - RNA, 21 nt, Human
ugaaagaaggugcagucugaa

SEQ ID NO: 234552 - RNA, 22 nt, Human
uauuagaaaggcuauugcauag

SEQ ID NO: 234553 - RNA, 23 nt, Human
acagggcauugcuggccucgagg

SEQ ID NO: 234554 - RNA, 17 nt, Human
aggcaggagauuggaga

SEQ ID NO: 234555 - RNA, 22 nt, Human
gucuagagccugaugaggauga

SEQ ID NO: 234556 - RNA, 22 nt, Human
gggagcugguuccugcccucca

SEQ ID NO: 234557 - RNA, 22 nt, Human
uagggcucacugagaugaauau

SEQ ID NO: 234558 - RNA, 22 nt, Human
aaguacaacgcauacagagaaa

SEQ ID NO: 234559 - RNA, 22 nt, Human
uuugacauuaaggaacauauau

SEQ ID NO: 234560 - RNA, 22 nt, Human
cauuucuagacaaguccuggag

SEQ ID NO: 234561 - RNA, 22 nt, Human
aaguuuauguugguaagauauc

SEQ ID NO: 234562 - RNA, 22 nt, Human
aaaauacuguggaguguugaaa

SEQ ID NO: 234563 - RNA, 21 nt, Human
auucaguuugacaucuagcag

SEQ ID NO: 234564 - RNA, 17 nt, Human
gccuucucugcccucac

SEQ ID NO: 234565 - RNA, 22 nt, Human
uugcucauuugccuuuagguuu

SEQ ID NO: 234566 - RNA, 22 nt, Human
ggaggcuccaugagcuccugca

SEQ ID NO: 234567 - RNA, 22 nt, Human
gcacaguuaaagggucauguga

SEQ ID NO: 234568 - RNA, 22 nt, Human
augaagucucuuuuucaugaga

SEQ ID NO: 234569 - RNA, 22 nt, Human
gacuaggcucucauagagguag

SEQ ID NO: 234570 - RNA, 22 nt, Human
uaguuuaauggucaacuaauga

SEQ ID NO: 234571 - RNA, 22 nt, Human
ccagcagagggucuuggccauu

SEQ ID NO: 234572 - RNA, 22 nt, Human
gacaggcuauuuucuuacgggu

SEQ ID NO: 234573 - RNA, 23 nt, Human
agggcugaugccauugcagcucu

SEQ ID NO: 234574 - RNA, 22 nt, Human
ucaggagugauaccauuuguca

SEQ ID NO: 234575 - RNA, 22 nt, Human
aggcccugcugaggccucccuc

SEQ ID NO: 234576 - RNA, 22 nt, Human
uagucagugaucaguggaguug

SEQ ID NO: 234577 - RNA, 22 nt, Human
gcuggagguuucaccugaguuu

SEQ ID NO: 234578 - RNA, 22 nt, Human
cagccagagaggaaggaaugca

SEQ ID NO: 234579 - RNA, 22 nt, Human
cauauuuauucuucugccagug

SEQ ID NO: 234580 - RNA, 19 nt, Human
agcugcuggcccagggacc

SEQ ID NO: 234581 - RNA, 22 nt, Human
cuggccuggucuggccucucca

SEQ ID NO: 234582 - RNA, 22 nt, Human
ugcuucuccauugaugcuaagu

SEQ ID NO: 234583 - RNA, 22 nt, Human
agguacaguagacagacaguua

SEQ ID NO: 234584 - RNA, 22 nt, Human
cugacagaugcugcuggcagua

SEQ ID NO: 234585 - RNA, 22 nt, Human
aguaacucauguaaaccucaca

SEQ ID NO: 234586 - RNA, 22 nt, Human
ucagaggccaaacugagcaggg

SEQ ID NO: 234587 - RNA, 22 nt, Human
uuucuccugaguuccacgcuac

SEQ ID NO: 234588 - RNA, 18 nt, Human
gucucugugggaauuggc

SEQ ID NO: 234589 - RNA, 21 nt, Human
aaugugugcuauuuaucuuuu

SEQ ID NO: 234590 - RNA, 22 nt, Human
gcaggaagcauagaagaaugcc

SEQ ID NO: 234591 - RNA, 22 nt, Human
cagaugugauucuucccucagc

SEQ ID NO: 234592 - RNA, 22 nt, Human
ugugaaaagcaggcuacuuucu

SEQ ID NO: 234593 - RNA, 22 nt, Human
gaaggcuugcagcucuguggca

SEQ ID NO: 234594 - RNA, 22 nt, Human
agcugugcuguggucaucuggg

SEQ ID NO: 234595 - RNA, 22 nt, Human
cauuggucuucuaacagagaga

SEQ ID NO: 234596 - RNA, 22 nt, Human
cagucuaaguuaauuuccacaa

SEQ ID NO: 234597 - RNA, 22 nt, Human
gggggcagaauguacucuuguc

SEQ ID NO: 234598 - RNA, 22 nt, Human
ggccagagaagucagacccuug

SEQ ID NO: 234599 - RNA, 22 nt, Human
gaaaguauuuaaguccauauuu

SEQ ID NO: 234600 - RNA, 22 nt, Human
aggguggccaccaaguauguca

SEQ ID NO: 234601 - RNA, 22 nt, Human
gcacugccaucaaugcaugaca

SEQ ID NO: 234602 - RNA, 22 nt, Human
gacagcuuagugaaaauguaaa

SEQ ID NO: 234603 - RNA, 22 nt, Human
auuaaugacgcagauaauaauu

SEQ ID NO: 234604 - RNA, 22 nt, Human
caagagcucaccggagagcauu

SEQ ID NO: 234605 - RNA, 22 nt, Human
ugauuucccucaucauaacaga

SEQ ID NO: 234606 - RNA, 22 nt, Human
aucaagagaaggggaagaugaa

SEQ ID NO: 234607 - RNA, 22 nt, Human
gcuguucauagaaauggucuca

SEQ ID NO: 234608 - RNA, 22 nt, Human
cugcuggcccccauuucagggu

SEQ ID NO: 234609 - RNA, 22 nt, Human
ccuuccaagugcugcuuuuucc

SEQ ID NO: 234610 - RNA, 22 nt, Human
gcagacagacugcagugauuuu

SEQ ID NO: 234611 - RNA, 22 nt, Human
caggcccuggcagggcugaguc

SEQ ID NO: 234612 - RNA, 22 nt, Human
caugugugaaucuugugaucau

SEQ ID NO: 234613 - RNA, 21 nt, Human
acuguuauucccauuuucacc

SEQ ID NO: 234614 - RNA, 22 nt, Human
cacagggcuaaaugaaggguug

SEQ ID NO: 234615 - RNA, 22 nt, Human
acagcagggucacauucccucu

SEQ ID NO: 234616 - RNA, 23 nt, Human
gcugucugucaucucugcgggag

SEQ ID NO: 234617 - RNA, 22 nt, Human
cugacaggguagacagagggca

SEQ ID NO: 234618 - RNA, 22 nt, Human
ggucaaagugaggagucagguu

SEQ ID NO: 234619 - RNA, 22 nt, Human
ggagaagggacagacucagcuu

SEQ ID NO: 234620 - RNA, 23 nt, Human
uagaacaucggugucuuggagca

SEQ ID NO: 234621 - RNA, 22 nt, Human
cugcugagguauacuaugugac

SEQ ID NO: 234622 - RNA, 22 nt, Human
aggaagcuggugugaggaugaa

SEQ ID NO: 234623 - RNA, 22 nt, Human
ugcaaggguguuugagcugccc

SEQ ID NO: 234624 - RNA, 19 nt, Human
acauugaauuuucuucuuu

SEQ ID NO: 234625 - RNA, 22 nt, Human
cuguuacuguuggcccagggug

SEQ ID NO: 234626 - RNA, 22 nt, Human
cugagggaaggcagucaguugg

SEQ ID NO: 234627 - RNA, 22 nt, Human
cccuccagcucaaagcaaccgg

SEQ ID NO: 234628 - RNA, 21 nt, Human
ucagcaaaauaagcaaaugga

SEQ ID NO: 234629 - RNA, 22 nt, Human
gcccagcacagcuggaagaguc

SEQ ID NO: 234630 - RNA, 22 nt, Human
auguuaaagauggugggaaauu

SEQ ID NO: 234631 - RNA, 22 nt, Human
gcagggcuguggacacuuuggu

SEQ ID NO: 234632 - RNA, 22 nt, Human
cauuugugcuuuuauaaaauag

SEQ ID NO: 234633 - RNA, 22 nt, Human
aagacacagcgaaauguuccug

SEQ ID NO: 234634 - RNA, 22 nt, Human
uggaggcauuucuuuuuggucg

SEQ ID NO: 234635 - RNA, 22 nt, Human
cuggcugguaauggaacgacag

SEQ ID NO: 234636 - RNA, 22 nt, Human
gaggcagcaugguaccuuggag

SEQ ID NO: 234637 - RNA, 22 nt, Human
aaggccaucuacuuacggaauu

SEQ ID NO: 234638 - RNA, 22 nt, Human
ccagcugcuugggaaaaugucu

SEQ ID NO: 234639 - RNA, 22 nt, Human
ugggccuggagcccuggagagu

SEQ ID NO: 234640 - RNA, 22 nt, Human
gcagaggcacagccccagauga

SEQ ID NO: 234641 - RNA, 21 nt, Human
ggcagcccgcccucuccuggc

SEQ ID NO: 234642 - RNA, 22 nt, Human
cucugugcgggccauggucagg

SEQ ID NO: 234643 - RNA, 23 nt, Human
uaucaguaagcaucccugaaccc

SEQ ID NO: 234644 - RNA, 22 nt, Human
uuaaauauuauguugucugcaa

SEQ ID NO: 234645 - RNA, 22 nt, Human
accuuagaaagugacaaacgaa

SEQ ID NO: 234646 - RNA, 22 nt, Human
gaaucagauacugauuucaguc

SEQ ID NO: 234647 - RNA, 22 nt, Human
gagaaccucuccacaagucugg

SEQ ID NO: 234648 - RNA, 17 nt, Human
auggaggcagacagguc

SEQ ID NO: 234649 - RNA, 22 nt, Human
acauaauagguaccugaauaau

SEQ ID NO: 234650 - RNA, 22 nt, Human
agucacuuugcuacucugccuu

SEQ ID NO: 234651 - RNA, 22 nt, Human
aacaugaaacccaaacagaaua

SEQ ID NO: 234652 - RNA, 22 nt, Human
ugggcagagucguggggaauag

SEQ ID NO: 234653 - RNA, 22 nt, Human
ucuucuguuaccacagcgauga

SEQ ID NO: 234654 - RNA, 22 nt, Human
agugauugcuugcuuaaggaca

SEQ ID NO: 234655 - RNA, 17 nt, Human
agcuacaaggcaguuca

SEQ ID NO: 234656 - RNA, 18 nt, Human
gaugggguccaggcauag

SEQ ID NO: 234657 - RNA, 22 nt, Human
ugcugggcggugggcucauccc

SEQ ID NO: 234658 - RNA, 22 nt, Human
agguggggugagcugcagacua

SEQ ID NO: 234659 - RNA, 22 nt, Human
agagcacagccaccauuuacaa

SEQ ID NO: 234660 - RNA, 22 nt, Human
ugccugggaaccaauccuggcu

SEQ ID NO: 234661 - RNA, 22 nt, Human
uacaaagagguaauugcauaua

SEQ ID NO: 234662 - RNA, 22 nt, Human
uuuggacugcaugaugaucugg

SEQ ID NO: 234663 - RNA, 22 nt, Human
ccaggacucaaugaccacaggg

SEQ ID NO: 234664 - RNA, 22 nt, Human
acaaagauguuuaaagcauuua

SEQ ID NO: 234665 - RNA, 22 nt, Human
ccucccucuguuagagcugucu

SEQ ID NO: 234666 - RNA, 22 nt, Human
cuggcacaacuccaccucagcg

SEQ ID NO: 234667 - RNA, 19 nt, Human
cauacaauuaccauaggau

SEQ ID NO: 234668 - RNA, 20 nt, Human
gucucagaauggauuugcau

SEQ ID NO: 234669 - RNA, 22 nt, Human
uagugcagaggaggagccucug

SEQ ID NO: 234670 - RNA, 22 nt, Human
uaggugucagguauagaauuua

SEQ ID NO: 234671 - RNA, 22 nt, Human
caggacacaggguguggcugau

SEQ ID NO: 234672 - RNA, 20 nt, Human
uaucuaaaugcuuacauuac

SEQ ID NO: 234673 - RNA, 22 nt, Human
aaauuuuaguaaggaaguugag

SEQ ID NO: 234674 - RNA, 22 nt, Human
cagguucugaggauggugccug

SEQ ID NO: 234675 - RNA, 22 nt, Human
gcacccagugggaugcuuagca

SEQ ID NO: 234676 - RNA, 22 nt, Human
gccucugcucucagguagccuc

SEQ ID NO: 234677 - RNA, 22 nt, Human
ccacagcaggacuggagccgcc

SEQ ID NO: 234678 - RNA, 22 nt, Human
uccuggcuccuggagaccugcu

SEQ ID NO: 234679 - RNA, 22 nt, Human
uagggacacugcucaugaguuc

SEQ ID NO: 234680 - RNA, 22 nt, Human
cuccagcucgcgagcucugcuc

SEQ ID NO: 234681 - RNA, 22 nt, Human
ugagccagccucagaagucacg

SEQ ID NO: 234682 - RNA, 22 nt, Human
ccaggagccacucaggcccaca

SEQ ID NO: 234683 - RNA, 22 nt, Human
cugagaagaggguauguggcgc

SEQ ID NO: 234684 - RNA, 22 nt, Human
ugauuuacaauuguaaaaguuu

SEQ ID NO: 234685 - RNA, 22 nt, Human
augcuuuuccuaaaaugaugcc

SEQ ID NO: 234686 - RNA, 22 nt, Human
agagggcugccucagucagcua

SEQ ID NO: 234687 - RNA, 22 nt, Human
guuuagaaugaaacuuuugagc

SEQ ID NO: 234688 - RNA, 22 nt, Human
gugaauauucuuugugcaguau

SEQ ID NO: 234689 - RNA, 22 nt, Human
ucuauugcagauggaugcccuc

SEQ ID NO: 234690 - RNA, 22 nt, Human
gcaguggggaaugcuggggaga

SEQ ID NO: 234691 - RNA, 22 nt, Human
uugaaaucuuccacagcccaag

SEQ ID NO: 234692 - RNA, 22 nt, Human
gccaccaggagcccaguccaaa

SEQ ID NO: 234693 - RNA, 19 nt, Human
gcucagagacaccuguugc

SEQ ID NO: 234694 - RNA, 22 nt, Human
cuacaggcucagggagcccucu

SEQ ID NO: 234695 - RNA, 22 nt, Human
aaaaagggauuugugauccagg

SEQ ID NO: 234696 - RNA, 23 nt, Human
aaaugcagggucgcagguuacag

SEQ ID NO: 234697 - RNA, 21 nt, Human
acagucuccccagaucucucc

SEQ ID NO: 234698 - RNA, 22 nt, Human
cccagcccaucucaaaggucua

SEQ ID NO: 234699 - RNA, 22 nt, Human
gaauacacgaauagagcauggu

SEQ ID NO: 234700 - RNA, 22 nt, Human
cuaaagcucaacaggcacuauu

SEQ ID NO: 234701 - RNA, 22 nt, Human
ucucagagaugucaagagucua

SEQ ID NO: 234702 - RNA, 22 nt, Human
uggcucaguuucugcccagcug

SEQ ID NO: 234703 - RNA, 22 nt, Human
ucacuggggccuuuggucagga

SEQ ID NO: 234704 - RNA, 20 nt, Human
aguacaauguaugauucaga

SEQ ID NO: 234705 - RNA, 19 nt, Human
uucuccaggcugcagaggg

SEQ ID NO: 234706 - RNA, 22 nt, Human
acagagcacugcccugugccgc

SEQ ID NO: 234707 - RNA, 19 nt, Human
guccuggcgccgccacacc

SEQ ID NO: 234708 - RNA, 22 nt, Human
guugugcaaccaucaccaccau

SEQ ID NO: 234709 - RNA, 21 nt, Human
gaaggcuucugccuggaggag

SEQ ID NO: 234710 - RNA, 22 nt, Human
ucuccaggcacuuggcugcuac

SEQ ID NO: 234711 - RNA, 22 nt, Human
agacagcuagggcugcagggac

SEQ ID NO: 234712 - RNA, 22 nt, Human
cuggcugcuuguuuugaugggu

SEQ ID NO: 234713 - RNA, 22 nt, Human
gcagccaggaagcccaggacac

SEQ ID NO: 234714 - RNA, 22 nt, Human
gagcuccacuuagcaaggccac

SEQ ID NO: 234715 - RNA, 22 nt, Human
ucuucagaaaauuaucacuugu

SEQ ID NO: 234716 - RNA, 22 nt, Human
cuggcugcaggaugaggcugcc

SEQ ID NO: 234717 - RNA, 22 nt, Human
aggccaguguggcuggagcaca

SEQ ID NO: 234718 - RNA, 22 nt, Human
ggaaagcucagaucuuguugga

SEQ ID NO: 234719 - RNA, 22 nt, Human
uguucacauguacaugaauauu

SEQ ID NO: 234720 - RNA, 22 nt, Human
auggcuuggcaccaucuccuug

SEQ ID NO: 234721 - RNA, 22 nt, Human
ugguaucagagccaucuguauu

SEQ ID NO: 234722 - RNA, 22 nt, Human
acugggaggcaaagagcaagga

SEQ ID NO: 234723 - RNA, 22 nt, Human
cauguacauucuguagauggag

SEQ ID NO: 234724 - RNA, 22 nt, Human
uggcugacaauguagcaguaac

SEQ ID NO: 234725 - RNA, 17 nt, Human
ucagagggaugagcagg

SEQ ID NO: 234726 - RNA, 20 nt, Human
agagugcuggacugaggagc

SEQ ID NO: 234727 - RNA, 22 nt, Human
ugcagggagggcccagcaaucu

SEQ ID NO: 234728 - RNA, 22 nt, Human
agcacaguuuucauugcagggu

SEQ ID NO: 234729 - RNA, 22 nt, Human
uggggcuccuccuggcaggagg

SEQ ID NO: 234730 - RNA, 22 nt, Human
caguaaacacuagcauucuugg

SEQ ID NO: 234731 - RNA, 22 nt, Human
cagcucugggagucccaccccu

SEQ ID NO: 234732 - RNA, 22 nt, Human
uggcaggagguuuucuccagga

SEQ ID NO: 234733 - RNA, 22 nt, Human
uagggaggaggguuuucaaauc

SEQ ID NO: 234734 - RNA, 22 nt, Human
ugggggcagaggauucaggaau

SEQ ID NO: 234735 - RNA, 22 nt, Human
uaggaacaaagagccucacauu

SEQ ID NO: 234736 - RNA, 22 nt, Human
ggagcuggcuacagagaacucc

SEQ ID NO: 234737 - RNA, 22 nt, Human
ucauggcuggaagcucaguuag

SEQ ID NO: 234738 - RNA, 20 nt, Human
gcacaucugcuuuggauuuc

SEQ ID NO: 234739 - RNA, 22 nt, Human
uucuuacuaugauuugagccuc

SEQ ID NO: 234740 - RNA, 23 nt, Human
ccagcugugccuggcccaggagc

SEQ ID NO: 234741 - RNA, 22 nt, Human
cucagcaauuaccugugucucu

SEQ ID NO: 234742 - RNA, 22 nt, Human
gugaggcauugaagaccggaau

SEQ ID NO: 234743 - RNA, 22 nt, Human
gcagggaccuaugacgauggaa

SEQ ID NO: 234744 - RNA, 22 nt, Human
cuguccugugucagccugaaau

SEQ ID NO: 234745 - RNA, 22 nt, Human
ugagaucucugccuauauggau

SEQ ID NO: 234746 - RNA, 20 nt, Human
agcaguguggggagacugug

SEQ ID NO: 234747 - RNA, 22 nt, Human
uauggcuucuuuugcaacuacu

SEQ ID NO: 234748 - RNA, 21 nt, Human
cuggaggcagguggugccagg

SEQ ID NO: 234749 - RNA, 22 nt, Human
gcuucugucuuagcuaccuccc

SEQ ID NO: 234750 - RNA, 22 nt, Human
ccacagaaagccugggaagugg

SEQ ID NO: 234751 - RNA, 22 nt, Human
aggcagguuggggaaaagcacu

SEQ ID NO: 234752 - RNA, 22 nt, Human
gugcaaaaguaauuacaguuuu

SEQ ID NO: 234753 - RNA, 22 nt, Human
gugaggagcugacacuggggug

SEQ ID NO: 234754 - RNA, 22 nt, Human
ugucuuuuuacuauguucaauc

SEQ ID NO: 234755 - RNA, 22 nt, Human
cucacucagacauccagugcag

SEQ ID NO: 234756 - RNA, 22 nt, Human
ucugaaaugaacucuugaacuu

SEQ ID NO: 234757 - RNA, 22 nt, Human
gcuggcuggcgggugcguccuc

SEQ ID NO: 234758 - RNA, 22 nt, Human
agcauuuaguuaguaaauguuu

SEQ ID NO: 234759 - RNA, 22 nt, Human
acauucuauucugcaggacaag

SEQ ID NO: 234760 - RNA, 22 nt, Human
ggauuuuagaguaccuaagugu

SEQ ID NO: 234761 - RNA, 22 nt, Human
gccaccugcgggccguggugga

SEQ ID NO: 234762 - RNA, 22 nt, Human
uuuuccuauaugcaaagaaugc

SEQ ID NO: 234763 - RNA, 22 nt, Human
cacuucaaggaauaucuagaaa

SEQ ID NO: 234764 - RNA, 22 nt, Human
ucaggccuuucuucagagcuuc

SEQ ID NO: 234765 - RNA, 22 nt, Human
uaaauuagagccagguaaguuu

SEQ ID NO: 234766 - RNA, 22 nt, Human
uacuguacugucuuuuuugcug

SEQ ID NO: 234767 - RNA, 22 nt, Human
agucucagccacacagaccuau

SEQ ID NO: 234768 - RNA, 22 nt, Human
gaaaacuuggaucucuagaaug

SEQ ID NO: 234769 - RNA, 22 nt, Human
agcaacaguguauaucauaggc

SEQ ID NO: 234770 - RNA, 22 nt, Human
ugaguucuuuccguuagguaug

SEQ ID NO: 234771 - RNA, 22 nt, Human
uucacaguggcccucucugagu

SEQ ID NO: 234772 - RNA, 22 nt, Human
cuggcagucugccucuucacug

SEQ ID NO: 234773 - RNA, 22 nt, Human
uccugugagcagcacagagaca

SEQ ID NO: 234774 - RNA, 22 nt, Human
caguggcugguuagggacagga

SEQ ID NO: 234775 - RNA, 22 nt, Human
gucucaagggggaacucacugu

SEQ ID NO: 234776 - RNA, 22 nt, Human
aauuuuaugccuugcacguugg

SEQ ID NO: 234777 - RNA, 22 nt, Human
uccaggccccagaccguacugc

SEQ ID NO: 234778 - RNA, 22 nt, Human
agaagggcuacacgggcucucc

SEQ ID NO: 234779 - RNA, 22 nt, Human
uugccuggacucugcugguauu

SEQ ID NO: 234780 - RNA, 22 nt, Human
ucugugcagauguagaccaguu

SEQ ID NO: 234781 - RNA, 22 nt, Human
uggaaagucucuuuugacugua

SEQ ID NO: 234782 - RNA, 19 nt, Human
ugagccagggaggccaugc

SEQ ID NO: 234783 - RNA, 22 nt, Human
caggcuucagcauccacuuagu

SEQ ID NO: 234784 - RNA, 22 nt, Human
agcagggacugagccaguggga

SEQ ID NO: 234785 - RNA, 22 nt, Human
cuagaauugcauucuaugaaua

SEQ ID NO: 234786 - RNA, 22 nt, Human
auuugcucuagcugcagugaau

SEQ ID NO: 234787 - RNA, 20 nt, Human
aaaguguaagcauauaauua

SEQ ID NO: 234788 - RNA, 22 nt, Human
ccuuuucuauguaccagcagug

SEQ ID NO: 234789 - RNA, 22 nt, Human
ccuccccacagcccaggagacu

SEQ ID NO: 234790 - RNA, 22 nt, Human
agaucuggaaaaucacaggugc

SEQ ID NO: 234791 - RNA, 22 nt, Human
gcauaggcacuuuccuccuccu

SEQ ID NO: 234792 - RNA, 19 nt, Human
gaagaagcuugagaaguag

SEQ ID NO: 234793 - RNA, 22 nt, Human
cuuuucugugaugcugacaguc

SEQ ID NO: 234794 - RNA, 22 nt, Human
acagagcuuaauucaggagcuu

SEQ ID NO: 234795 - RNA, 22 nt, Human
uggcuuccgccgcgggccucgg

SEQ ID NO: 234796 - RNA, 22 nt, Human
cuagagaaaaagcuuagguacg

SEQ ID NO: 234797 - RNA, 22 nt, Human
auaguuuuauagauauugugua

SEQ ID NO: 234798 - RNA, 22 nt, Human
ggcucuggggggaagucuguug

SEQ ID NO: 234799 - RNA, 22 nt, Human
agaguuuguacuuuacccugag

SEQ ID NO: 234800 - RNA, 20 nt, Human
gcuguucacauuauuaguag

SEQ ID NO: 234801 - RNA, 22 nt, Human
aaggccaggaaauuaucccuau

SEQ ID NO: 234802 - RNA, 22 nt, Human
aaagcagugcugugagaacacu

SEQ ID NO: 234803 - RNA, 22 nt, Human
agucacauucugggguacuggg

SEQ ID NO: 234804 - RNA, 22 nt, Human
uuacaguaauguauuauuuaac

SEQ ID NO: 234805 - RNA, 22 nt, Human
cagagcaguccuugucaaucag

SEQ ID NO: 234806 - RNA, 20 nt, Human
gcuuggaagccaccuguauu

SEQ ID NO: 234807 - RNA, 22 nt, Human
uccagcccugugucugggagag

SEQ ID NO: 234808 - RNA, 20 nt, Human
uucuuaaagaccucacuuug

SEQ ID NO: 234809 - RNA, 22 nt, Human
uccugugcuguuaauagugaua

SEQ ID NO: 234810 - RNA, 22 nt, Human
aaucugucccuuaacuagucau

SEQ ID NO: 234811 - RNA, 22 nt, Human
ucucagagagaugaaacuucca

SEQ ID NO: 234812 - RNA, 22 nt, Human
uuucuccuccagagagacacag

SEQ ID NO: 234813 - RNA, 22 nt, Human
ucccugggagaugaugaugagg

SEQ ID NO: 234814 - RNA, 22 nt, Human
gcagagaccccgcagugaggcc

SEQ ID NO: 234815 - RNA, 22 nt, Human
auggcagacgaggcagcagggg

SEQ ID NO: 234816 - RNA, 22 nt, Human
uggucuggaacuccuggcuuca

SEQ ID NO: 234817 - RNA, 18 nt, Human
ggucugagaucguuuuuc

SEQ ID NO: 234818 - RNA, 22 nt, Human
cauggccaaggaugcucaacca

SEQ ID NO: 234819 - RNA, 19 nt, Human
uggaccugugcccauggcu

SEQ ID NO: 234820 - RNA, 22 nt, Human
ggcuucugucucaagcaccagc

SEQ ID NO: 234821 - RNA, 22 nt, Human
agcugcaaguaagcuugcuccu

SEQ ID NO: 234822 - RNA, 23 nt, Human
ugcugggguaguuuguggcacag

SEQ ID NO: 234823 - RNA, 22 nt, Human
uucuuuauagcuauuggaugag

SEQ ID NO: 234824 - RNA, 22 nt, Human
ucccaggaagaucccagggacc

SEQ ID NO: 234825 - RNA, 22 nt, Human
cagaauuuuucgaauguacugu

SEQ ID NO: 234826 - RNA, 22 nt, Human
cuccugagcugcagccuugugu

SEQ ID NO: 234827 - RNA, 22 nt, Human
agcagguguauauaaggcugag

SEQ ID NO: 234828 - RNA, 22 nt, Human
uuggaacagaaacagacaaaua

SEQ ID NO: 234829 - RNA, 22 nt, Human
cuuuuuauagcuauguccuaug

SEQ ID NO: 234830 - RNA, 22 nt, Human
aggcuggcgacaucuggcgggc

SEQ ID NO: 234831 - RNA, 22 nt, Human
uaucauaaguuaauuaaacagu

SEQ ID NO: 234832 - RNA, 22 nt, Human
aagucucuuuggguacuuuauu

SEQ ID NO: 234833 - RNA, 22 nt, Human
uuucuguuguauggcuucugca

SEQ ID NO: 234834 - RNA, 22 nt, Human
acagucuacuugagcuuguaua

SEQ ID NO: 234835 - RNA, 22 nt, Human
gacauuuagcuguuuugcauuu

SEQ ID NO: 234836 - RNA, 20 nt, Human
aggucucagagcaagagccc

SEQ ID NO: 234837 - RNA, 22 nt, Human
cuuuacugaagugaagaccugg

SEQ ID NO: 234838 - RNA, 22 nt, Human
guggucaggcagugggagagaa

SEQ ID NO: 234839 - RNA, 22 nt, Human
gugcacagagcccagggccgcg

SEQ ID NO: 234840 - RNA, 22 nt, Human
aguucuguggcugugcccugua

SEQ ID NO: 234841 - RNA, 22 nt, Human
gaaggcuucaaaagguguaauu

SEQ ID NO: 234842 - RNA, 22 nt, Human
cagggagaaaucuccaggaggu

SEQ ID NO: 234843 - RNA, 22 nt, Human
ugguccagaugccuuggcuuua

SEQ ID NO: 234844 - RNA, 23 nt, Human
augccaggcugccuggccagccu

SEQ ID NO: 234845 - RNA, 22 nt, Human
ccuggugggcaggagugagacc

SEQ ID NO: 234846 - RNA, 22 nt, Human
ccagcccuuugugguucacuga

SEQ ID NO: 234847 - RNA, 22 nt, Human
ucucagagcuucaguuauuuuc

SEQ ID NO: 234848 - RNA, 22 nt, Human
ugaugaggagacuguggcuugg

SEQ ID NO: 234849 - RNA, 22 nt, Human
gccagauguagauagcaaggua

SEQ ID NO: 234850 - RNA, 22 nt, Human
ucaugugucugcugcagcuguu

SEQ ID NO: 234851 - RNA, 22 nt, Human
aauaucuucuaaggauagaacu

SEQ ID NO: 234852 - RNA, 22 nt, Human
aauugcuuugaagaagggagcg

SEQ ID NO: 234853 - RNA, 21 nt, Human
ggcuguggagccaugacucac

SEQ ID NO: 234854 - RNA, 22 nt, Human
uuggaggaugucggcauauuua

SEQ ID NO: 234855 - RNA, 20 nt, Human
agcaguuuccuaacucagcu

SEQ ID NO: 234856 - RNA, 17 nt, Human
uaaguuauagcagaaga

SEQ ID NO: 234857 - RNA, 22 nt, Human
gccagagcuucccccgagugug

SEQ ID NO: 234858 - RNA, 22 nt, Human
gggaccugcgccacucacuguc

SEQ ID NO: 234859 - RNA, 22 nt, Human
uauuaaauauaucuguuaguug

SEQ ID NO: 234860 - RNA, 22 nt, Human
ucuguaggggccggcggagccc

SEQ ID NO: 234861 - RNA, 22 nt, Human
ucaggaaguugaggcguagaga

SEQ ID NO: 234862 - RNA, 22 nt, Human
gucagucauauuguacagauau

SEQ ID NO: 234863 - RNA, 22 nt, Human
uuuagaaauugcagagugggug

SEQ ID NO: 234864 - RNA, 22 nt, Human
ggaagcuggacaggcuuugagu

SEQ ID NO: 234865 - RNA, 22 nt, Human
auugugcaaaaccucaggccuc

SEQ ID NO: 234866 - RNA, 22 nt, Human
ugcaggaaauuccaggguggcc

SEQ ID NO: 234867 - RNA, 22 nt, Human
uucugugaggacuucucaagga

SEQ ID NO: 234868 - RNA, 22 nt, Human
uugaauggcuucuagguucucc

SEQ ID NO: 234869 - RNA, 22 nt, Human
uugggagguaauggagccaagu

SEQ ID NO: 234870 - RNA, 22 nt, Human
cuccuuccugcagaucugagau

SEQ ID NO: 234871 - RNA, 22 nt, Human
ucuguagcaucuuaaauguagu

SEQ ID NO: 234872 - RNA, 22 nt, Human
cagucuccaaaucagucugaau

SEQ ID NO: 234873 - RNA, 22 nt, Human
agggcucugggguggcagagau

SEQ ID NO: 234874 - RNA, 22 nt, Human
aggcugagcaaagggccuuacc

SEQ ID NO: 234875 - RNA, 22 nt, Human
cagcagccucuugugccugugg

SEQ ID NO: 234876 - RNA, 22 nt, Human
acguguaaugaucaccacaauc

SEQ ID NO: 234877 - RNA, 22 nt, Human
cuuaggaacgcucugccuagug

SEQ ID NO: 234878 - RNA, 22 nt, Human
ucuggaggcaggcugccaggau

SEQ ID NO: 234879 - RNA, 22 nt, Human
acugccuucuuggccuucaaaa

SEQ ID NO: 234880 - RNA, 22 nt, Human
uucuguuucuggggucucugac

SEQ ID NO: 234881 - RNA, 22 nt, Human
cagaggaagagauacaagcccu

SEQ ID NO: 234882 - RNA, 22 nt, Human
auugagaaaauaaguauggaua

SEQ ID NO: 234883 - RNA, 22 nt, Human
gugcagcugcccaagccugagc

SEQ ID NO: 234884 - RNA, 22 nt, Human
aucuuuaaagacaugugaacuu

SEQ ID NO: 234885 - RNA, 22 nt, Human
uucugagguccaugcaguacug

SEQ ID NO: 234886 - RNA, 22 nt, Human
gcaggagcaauggccuaucaga

SEQ ID NO: 234887 - RNA, 20 nt, Human
cuguccugaucuuuucagaa

SEQ ID NO: 234888 - RNA, 22 nt, Human
uucuucaaugugcccuguuuuc

SEQ ID NO: 234889 - RNA, 22 nt, Human
gcccucaguggauucuuauugu

SEQ ID NO: 234890 - RNA, 22 nt, Human
ucuguggagugaccugggcuuu

SEQ ID NO: 234891 - RNA, 22 nt, Human
uggcuucaaagguagcauacaa

SEQ ID NO: 234892 - RNA, 22 nt, Human
auguccaauuucagagucucau

SEQ ID NO: 234893 - RNA, 22 nt, Human
aaggccagcccuaaugaugcuc

SEQ ID NO: 234894 - RNA, 22 nt, Human
aggccuuggaagccagggagcc

SEQ ID NO: 234895 - RNA, 22 nt, Human
ggcucuggagacauguggagag

SEQ ID NO: 234896 - RNA, 22 nt, Human
aagagacuauggugucuaugaa

SEQ ID NO: 234897 - RNA, 22 nt, Human
cucuggaguucuucaagcuacu

SEQ ID NO: 234898 - RNA, 22 nt, Human
gaaggggaaaguugagcaaaua

SEQ ID NO: 234899 - RNA, 23 nt, Human
cuguccuguaguucacguuggcc

SEQ ID NO: 234900 - RNA, 22 nt, Human
uucauguagcuuagcagagagg

SEQ ID NO: 234901 - RNA, 21 nt, Human
acauuuucuguuuuaggaagu

SEQ ID NO: 234902 - RNA, 22 nt, Human
gaggggcuggguagggcaaccc

SEQ ID NO: 234903 - RNA, 22 nt, Human
cuggcccauugccuucucucuc

SEQ ID NO: 234904 - RNA, 22 nt, Human
uccugggcagcgggacgcucag

SEQ ID NO: 234905 - RNA, 22 nt, Human
ugccuggcacuccuggagcuca

SEQ ID NO: 234906 - RNA, 17 nt, Human
aaguccagaguugagca

SEQ ID NO: 234907 - RNA, 20 nt, Human
ucccagucagccagagugag

SEQ ID NO: 234908 - RNA, 22 nt, Human
auggcugggucaccaucagggu

SEQ ID NO: 234909 - RNA, 22 nt, Human
uaauacauguauuccagagagu

SEQ ID NO: 234910 - RNA, 22 nt, Human
ucuucagacccuuagcugugau

SEQ ID NO: 234911 - RNA, 22 nt, Human
ccagcugggauuaagggaaaau

SEQ ID NO: 234912 - RNA, 22 nt, Human
gcagggaagacccggagcagcg

SEQ ID NO: 234913 - RNA, 22 nt, Human
uaguaagccucuccagagacag

SEQ ID NO: 234914 - RNA, 22 nt, Human
cgguccaggauggcuggcaagc

SEQ ID NO: 234915 - RNA, 22 nt, Human
auucagcagccauggcuucuga

SEQ ID NO: 234916 - RNA, 22 nt, Human
gcugucuuuuccuggcaguaaa

SEQ ID NO: 234917 - RNA, 22 nt, Human
aaggucagagcaggaaggaguc

SEQ ID NO: 234918 - RNA, 22 nt, Human
gcugggcaggccucgugagggc

SEQ ID NO: 234919 - RNA, 22 nt, Human
aggcugagaaagugggaagaug

SEQ ID NO: 234920 - RNA, 22 nt, Human
agaugccugccaguuauuuagc

SEQ ID NO: 234921 - RNA, 22 nt, Human
cuauugaaaguguacaauucaa

SEQ ID NO: 234922 - RNA, 22 nt, Human
uuucauguaaucauuuaggugg

SEQ ID NO: 234923 - RNA, 22 nt, Human
ucuggcccaucuucugccacca

SEQ ID NO: 234924 - RNA, 22 nt, Human
ucuuucugaugggaagggucaa

SEQ ID NO: 234925 - RNA, 22 nt, Human
aagcaugguggaugauacagug

SEQ ID NO: 234926 - RNA, 22 nt, Human
uuuacuaagcccaguuauaugc

SEQ ID NO: 234927 - RNA, 22 nt, Human
aaucuagagugcuaggucugug

SEQ ID NO: 234928 - RNA, 22 nt, Human
gaugaguaauagcuaaugguuc

SEQ ID NO: 234929 - RNA, 21 nt, Human
cucuggagucaagagcuucca

SEQ ID NO: 234930 - RNA, 22 nt, Human
ggaagugaggaaauauuuuguu

SEQ ID NO: 234931 - RNA, 22 nt, Human
ucuggaaggaacccuuagagga

SEQ ID NO: 234932 - RNA, 22 nt, Human
gaggagacggggugccuggagc

SEQ ID NO: 234933 - RNA, 22 nt, Human
uaacacuggcuuuugcugaggc

SEQ ID NO: 234934 - RNA, 22 nt, Human
uaugugaauacagcaguggaug

SEQ ID NO: 234935 - RNA, 22 nt, Human
uaguuaacucuugguaauaggu

SEQ ID NO: 234936 - RNA, 22 nt, Human
uggcagcuguguccagguagaa

SEQ ID NO: 234937 - RNA, 22 nt, Human
aguggguguagucuuccuccug

SEQ ID NO: 234938 - RNA, 21 nt, Human
ccaggaaggacugagcucccu

SEQ ID NO: 234939 - RNA, 22 nt, Human
uuucauuucauagaauuguguu

SEQ ID NO: 234940 - RNA, 22 nt, Human
agcacagauucugaagaguccu

SEQ ID NO: 234941 - RNA, 22 nt, Human
cugcugagguccuugcucagac

SEQ ID NO: 234942 - RNA, 22 nt, Human
acagauccugguuacagccauu

SEQ ID NO: 234943 - RNA, 21 nt, Human
aauuuugaaggaagauuaagg

SEQ ID NO: 234944 - RNA, 22 nt, Human
ccugcccuguguuuggggacua

SEQ ID NO: 234945 - RNA, 22 nt, Human
auagaagcaagaacagaaugga

SEQ ID NO: 234946 - RNA, 22 nt, Human
ucuguucagguuucagagaacu

SEQ ID NO: 234947 - RNA, 22 nt, Human
gugcccugacacaccuggugug

SEQ ID NO: 234948 - RNA, 22 nt, Human
uaucuagauauuuggauaaaug

SEQ ID NO: 234949 - RNA, 22 nt, Human
uguucuugagccuuuagaccua

SEQ ID NO: 234950 - RNA, 22 nt, Human
gagugucagugcuuggggcuac

SEQ ID NO: 234951 - RNA, 22 nt, Human
gagggagggaaaguuuaacacu

SEQ ID NO: 234952 - RNA, 22 nt, Human
gccagaaacauacacaucacuu

SEQ ID NO: 234953 - RNA, 22 nt, Human
agaaggaaggaagcauucuguu

SEQ ID NO: 234954 - RNA, 21 nt, Human
agcuuccagagcacauuccau

SEQ ID NO: 234955 - RNA, 22 nt, Human
agaaaauuacuccagagacaag

SEQ ID NO: 234956 - RNA, 22 nt, Human
acuuccuuuugggaaacuguuu

SEQ ID NO: 234957 - RNA, 22 nt, Human
uaacagucaugugcuacugcua

SEQ ID NO: 234958 - RNA, 22 nt, Human
uaaaaggcaauacuagaugagu

SEQ ID NO: 234959 - RNA, 22 nt, Human
caggcaagcacggugaaccugg

SEQ ID NO: 234960 - RNA, 22 nt, Human
ucugucauugcaauaaaauuuc

SEQ ID NO: 234961 - RNA, 22 nt, Human
cucuccaggcugggacaggacc

SEQ ID NO: 234962 - RNA, 22 nt, Human
cccacccugggcuacacaucca

SEQ ID NO: 234963 - RNA, 22 nt, Human
agauaucuuacacuuugaaguu

SEQ ID NO: 234964 - RNA, 22 nt, Human
gaguccuugucauaauucagug

SEQ ID NO: 234965 - RNA, 22 nt, Human
aggcuaagauguggucugagca

SEQ ID NO: 234966 - RNA, 20 nt, Human
uuuucugugccaagaaaacu

SEQ ID NO: 234967 - RNA, 22 nt, Human
agguggcagagcuggcccagcg

SEQ ID NO: 234968 - RNA, 22 nt, Human
ugcauuaauuuuugccagguuc

SEQ ID NO: 234969 - RNA, 22 nt, Human
auuugccuugugaauuggauau

SEQ ID NO: 234970 - RNA, 22 nt, Human
aacugcaauaacuugugcacca

SEQ ID NO: 234971 - RNA, 22 nt, Human
uguuuacuuuccuucucacagg

SEQ ID NO: 234972 - RNA, 22 nt, Human
gucauuuaucaucagaagucau

SEQ ID NO: 234973 - RNA, 22 nt, Human
caggcuacauuugcucugagaa

SEQ ID NO: 234974 - RNA, 22 nt, Human
cugucuaguuaggaugccagca

SEQ ID NO: 234975 - RNA, 22 nt, Human
aacacugagaacaauacagagu

SEQ ID NO: 234976 - RNA, 22 nt, Human
agccuuagaggaaaacauuagu

SEQ ID NO: 234977 - RNA, 22 nt, Human
gucuagaaaaugccgagggaug

SEQ ID NO: 234978 - RNA, 22 nt, Human
gcucagagaaucagcagacacc

SEQ ID NO: 234979 - RNA, 22 nt, Human
agaauacaauuguucaguaaua

SEQ ID NO: 234980 - RNA, 22 nt, Human
gggugaggagcugccagucaug

SEQ ID NO: 234981 - RNA, 22 nt, Human
agguccaucguggaugaacugc

SEQ ID NO: 234982 - RNA, 17 nt, Human
gcugaacaaggaaaaua

SEQ ID NO: 234983 - RNA, 22 nt, Human
uggcagagcaaaaagauagaau

SEQ ID NO: 234984 - RNA, 22 nt, Human
cucugggccaugcuacugcucu

SEQ ID NO: 234985 - RNA, 22 nt, Human
aaugauaagacaugaguagagg

SEQ ID NO: 234986 - RNA, 22 nt, Human
ucucaacaccacuugcugaaga

SEQ ID NO: 234987 - RNA, 22 nt, Human
ucacaucacaugacaguaggcc

SEQ ID NO: 234988 - RNA, 23 nt, Human
ucugggcugcuuaaggaucaagg

SEQ ID NO: 234989 - RNA, 22 nt, Human
ccaggcuggagugcaguagugu

SEQ ID NO: 234990 - RNA, 22 nt, Human
ggaaggggagcuggaaagggua

SEQ ID NO: 234991 - RNA, 22 nt, Human
gggaauguaaucauggaaugcu

SEQ ID NO: 234992 - RNA, 22 nt, Human
auugcuugaauuaccauguaau

SEQ ID NO: 234993 - RNA, 22 nt, Human
agggcgacaauggagagcguuu

SEQ ID NO: 234994 - RNA, 22 nt, Human
gcccacaguacgaggcucaggc

SEQ ID NO: 234995 - RNA, 22 nt, Human
auuuuucucuccacuccauuaa

SEQ ID NO: 234996 - RNA, 22 nt, Human
uggcugccuucccugcuggagg

SEQ ID NO: 234997 - RNA, 22 nt, Human
ugaguucuucacauuaccuacg

SEQ ID NO: 234998 - RNA, 22 nt, Human
uauuuucaucuuguccuuggau

SEQ ID NO: 234999 - RNA, 21 nt, Human
agcugcaaaaacauacaguuc

SEQ ID NO: 235000 - RNA, 22 nt, Human
uccccagucccggcggugggug

SEQ ID NO: 235001 - RNA, 18 nt, Human
gagagcccagcagguggu

SEQ ID NO: 235002 - RNA, 22 nt, Human
gguuacucaagccugccuucuc

SEQ ID NO: 235003 - RNA, 22 nt, Human
uucucuggcgguguguuuuccu

SEQ ID NO: 235004 - RNA, 22 nt, Human
caauuacuuuugcaccaauaua

SEQ ID NO: 235005 - RNA, 22 nt, Human
ggauucugccuuguugcuucaa

SEQ ID NO: 235006 - RNA, 22 nt, Human
ucugaauucugacaauuugaau

SEQ ID NO: 235007 - RNA, 22 nt, Human
uggcaggaaaaagggccagagg

SEQ ID NO: 235008 - RNA, 22 nt, Human
ucagggcucagugggauagguc

SEQ ID NO: 235009 - RNA, 22 nt, Human
gaggcugucuguuagccuggga

SEQ ID NO: 235010 - RNA, 20 nt, Human
uggaagaagaacucaggcuu

SEQ ID NO: 235011 - RNA, 22 nt, Human
cccaggcagcggggucuccuug

SEQ ID NO: 235012 - RNA, 19 nt, Human
gucagcuggaacucugaaa

SEQ ID NO: 235013 - RNA, 22 nt, Human
acagacaguaugguggggcuga

SEQ ID NO: 235014 - RNA, 19 nt, Human
ggcuggagaaaggaaucag

SEQ ID NO: 235015 - RNA, 22 nt, Human
gcugaaauuagacugcagaagu

SEQ ID NO: 235016 - RNA, 22 nt, Human
ccacugucuuuuccaggcugaa

SEQ ID NO: 235017 - RNA, 22 nt, Human
augcuucuguguauguuucagg

SEQ ID NO: 235018 - RNA, 21 nt, Human
aaugcugcccaguaagauggc

SEQ ID NO: 235019 - RNA, 22 nt, Human
gagggaugugccugaaggcagg

SEQ ID NO: 235020 - RNA, 22 nt, Human
aacauguuuccaguguaaggcc

SEQ ID NO: 235021 - RNA, 22 nt, Human
ucuuucuugguauaaagcaggg

SEQ ID NO: 235022 - RNA, 22 nt, Human
caugagauaauuuuucuccagu

SEQ ID NO: 235023 - RNA, 22 nt, Human
uccuuggaagagcauucccagg

SEQ ID NO: 235024 - RNA, 22 nt, Human
aggccuggcaugagaccugaga

SEQ ID NO: 235025 - RNA, 22 nt, Human
aggacacaugcacacccugcgu

SEQ ID NO: 235026 - RNA, 22 nt, Human
ucugggcucugucagcaccucu

SEQ ID NO: 235027 - RNA, 22 nt, Human
cucaggcugucuaauggauuag

SEQ ID NO: 235028 - RNA, 20 nt, Human
acagaauaugcugguugugg

SEQ ID NO: 235029 - RNA, 22 nt, Human
cuguggcuguauuuggccagag

SEQ ID NO: 235030 - RNA, 22 nt, Human
guauuuuuaguagagucggggu

SEQ ID NO: 235031 - RNA, 22 nt, Human
aaagcauuauucuguggaaaaa

SEQ ID NO: 235032 - RNA, 22 nt, Human
gagucuuuguauuuacuuccca

SEQ ID NO: 235033 - RNA, 22 nt, Human
uacaguuaaaaaguucaauggu

SEQ ID NO: 235034 - RNA, 22 nt, Human
aucagcagaugcucaaugaaca

SEQ ID NO: 235035 - RNA, 22 nt, Human
acugugcacacaaaaauagauu

SEQ ID NO: 235036 - RNA, 22 nt, Human
uguggggacccaugccaugggc

SEQ ID NO: 235037 - RNA, 22 nt, Human
auugcagcucagggugaugacu

SEQ ID NO: 235038 - RNA, 21 nt, Human
uuaagacacacagauuaagga

SEQ ID NO: 235039 - RNA, 21 nt, Human
gcaggggauagaaauggucug

SEQ ID NO: 235040 - RNA, 22 nt, Human
ugaggagcuucuggaaagugca

SEQ ID NO: 235041 - RNA, 22 nt, Human
caggucuccagcucagggucca

SEQ ID NO: 235042 - RNA, 22 nt, Human
uugaaugagaaguuauugccau

SEQ ID NO: 235043 - RNA, 19 nt, Human
augucuguugaauuucaua

SEQ ID NO: 235044 - RNA, 20 nt, Human
ugcuccaggaacacuggccg

SEQ ID NO: 235045 - RNA, 20 nt, Human
agaaauauugaguucagagg

SEQ ID NO: 235046 - RNA, 22 nt, Human
cgcgguggcggccuccagcgcc

SEQ ID NO: 235047 - RNA, 22 nt, Human
uucccuccuaugcccacugaaa

SEQ ID NO: 235048 - RNA, 22 nt, Human
gaauuucagagguaacaucauc

SEQ ID NO: 235049 - RNA, 22 nt, Human
uuucucaguaguaauggcaguc

SEQ ID NO: 235050 - RNA, 22 nt, Human
cuuagaaaucgaacucagguua

SEQ ID NO: 235051 - RNA, 22 nt, Human
aucagaaaaacauaauguuauu

SEQ ID NO: 235052 - RNA, 22 nt, Human
agauacaacuguuuaaacauua

SEQ ID NO: 235053 - RNA, 22 nt, Human
ucugagacaacuuagcccucga

SEQ ID NO: 235054 - RNA, 22 nt, Human
uggcuggcgccgggcuagccac

SEQ ID NO: 235055 - RNA, 22 nt, Human
cuggagaggccccaagauauuu

SEQ ID NO: 235056 - RNA, 22 nt, Human
uccagcagccugacuucccucu

SEQ ID NO: 235057 - RNA, 22 nt, Human
gugagcagggcaggacugggga

SEQ ID NO: 235058 - RNA, 22 nt, Human
gcuggccauggccugcgccauc

SEQ ID NO: 235059 - RNA, 22 nt, Human
cagcacuucaaugagcauuuca

SEQ ID NO: 235060 - RNA, 22 nt, Human
aacuuucugaaaagcuugauca

SEQ ID NO: 235061 - RNA, 19 nt, Human
accaggccucagaggcccu

SEQ ID NO: 235062 - RNA, 22 nt, Human
uugucuguaaagacggccacca

SEQ ID NO: 235063 - RNA, 20 nt, Human
ggcauggguggggcucccag

SEQ ID NO: 235064 - RNA, 22 nt, Human
auuaguguuguaagaagcugcc

SEQ ID NO: 235065 - RNA, 22 nt, Human
ucuccugggcuugguugaaguu

SEQ ID NO: 235066 - RNA, 22 nt, Human
caucauuucacuuagaugaagu

SEQ ID NO: 235067 - RNA, 22 nt, Human
cugccagcuagcuccuaguuga

SEQ ID NO: 235068 - RNA, 22 nt, Human
auuaagagccuacuaugugccg

SEQ ID NO: 235069 - RNA, 21 nt, Human
acacuucaguuuuuaaaggga

SEQ ID NO: 235070 - RNA, 19 nt, Human
uggcccagaugguccuggg

SEQ ID NO: 235071 - RNA, 22 nt, Human
ucucugaagauauuuauuauua

SEQ ID NO: 235072 - RNA, 22 nt, Human
cuuuggaaaaauaccuggcaua

SEQ ID NO: 235073 - RNA, 22 nt, Human
uacaaaguagaaauucaguaaa

SEQ ID NO: 235074 - RNA, 22 nt, Human
agcugccagcaaguuucaaaca

SEQ ID NO: 235075 - RNA, 22 nt, Human
caauuucaauacaaaauacauu

SEQ ID NO: 235076 - RNA, 22 nt, Human
uaacuguauauuaagguggccc

SEQ ID NO: 235077 - RNA, 22 nt, Human
uaagugaugaaagcagaugucu

SEQ ID NO: 235078 - RNA, 17 nt, Human
gcucugccaggaaagag

SEQ ID NO: 235079 - RNA, 23 nt, Human
aggaagcuaaguguggcugcgga

SEQ ID NO: 235080 - RNA, 22 nt, Human
auuucagagugagagugcucaa

SEQ ID NO: 235081 - RNA, 22 nt, Human
auccauucuaugugaaaugucc

SEQ ID NO: 235082 - RNA, 22 nt, Human
gcucaggccuggcccaugggac

SEQ ID NO: 235083 - RNA, 22 nt, Human
auugguggugaggacaugccag

SEQ ID NO: 235084 - RNA, 22 nt, Human
cagucccagaagagccugggag

SEQ ID NO: 235085 - RNA, 22 nt, Human
agucaguuaaacuuuguaaagu

SEQ ID NO: 235086 - RNA, 22 nt, Human
uggaaacuaggauggaagaaau

SEQ ID NO: 235087 - RNA, 22 nt, Human
agacuguugccugaacuuagcc

SEQ ID NO: 235088 - RNA, 22 nt, Human
ucuuggagaauggcagagaagc

SEQ ID NO: 235089 - RNA, 22 nt, Human
gaaauaauacagugcucuucuc

SEQ ID NO: 235090 - RNA, 22 nt, Human
gcaggcuucucucuucccuacc

SEQ ID NO: 235091 - RNA, 22 nt, Human
acugggccuugccauggcagcc

SEQ ID NO: 235092 - RNA, 22 nt, Human
agagagccugaguggcagcuau

SEQ ID NO: 235093 - RNA, 22 nt, Human
uugcaaaaccauccuaaguaaa

SEQ ID NO: 235094 - RNA, 22 nt, Human
gcucagaccccacccuggcaga

SEQ ID NO: 235095 - RNA, 22 nt, Human
gauuucuaguaagucaugaagg

SEQ ID NO: 235096 - RNA, 22 nt, Human
gagggcugaugcuuacuuauuu

SEQ ID NO: 235097 - RNA, 22 nt, Human
ugaggcagauauuuauuggguu

SEQ ID NO: 235098 - RNA, 18 nt, Human
auugcuuuuguaccaacc

SEQ ID NO: 235099 - RNA, 22 nt, Human
cagaaucucugggaguggauca

SEQ ID NO: 235100 - RNA, 22 nt, Human
aaauucuguccugaaugccauu

SEQ ID NO: 235101 - RNA, 22 nt, Human
gcacucuccuggcugccacagu

SEQ ID NO: 235102 - RNA, 21 nt, Human
gauuuuaaagagacugccaca

SEQ ID NO: 235103 - RNA, 22 nt, Human
uugaaauagaugcgucagagau

SEQ ID NO: 235104 - RNA, 23 nt, Human
aaauauucuuuuuuaguaagugc

SEQ ID NO: 235105 - RNA, 22 nt, Human
aauguuaaaaccuucagugcuu

SEQ ID NO: 235106 - RNA, 22 nt, Human
ugaauucccugcaggcauccuc

SEQ ID NO: 235107 - RNA, 22 nt, Human
agaggguagaagacaggguugc

SEQ ID NO: 235108 - RNA, 22 nt, Human
agcaguuauauugaaauaaaaa

SEQ ID NO: 235109 - RNA, 22 nt, Human
aaaugaacaguugcauucucug

SEQ ID NO: 235110 - RNA, 22 nt, Human
ggaacugagaagcagcuaugcc

SEQ ID NO: 235111 - RNA, 22 nt, Human
augaaaauugacagcggaagua

SEQ ID NO: 235112 - RNA, 22 nt, Human
aaauaaacugaagcacagagag

SEQ ID NO: 235113 - RNA, 22 nt, Human
gaaucuuaaaucggaaucuuaa

SEQ ID NO: 235114 - RNA, 22 nt, Human
guacaguuuucaguguucacug

SEQ ID NO: 235115 - RNA, 22 nt, Human
uugugcaaaggggguuaaucau

SEQ ID NO: 235116 - RNA, 22 nt, Human
ucacugcuuucaaaaauuauug

SEQ ID NO: 235117 - RNA, 22 nt, Human
gggcucauucaucugggcuugg

SEQ ID NO: 235118 - RNA, 21 nt, Human
uuggaaucucuucaucucugc

SEQ ID NO: 235119 - RNA, 22 nt, Human
caaggacacugauguucauccu

SEQ ID NO: 235120 - RNA, 22 nt, Human
uaaaugauaauaaugcuagugu

SEQ ID NO: 235121 - RNA, 22 nt, Human
aggucaaaaucaggcagggaag

SEQ ID NO: 235122 - RNA, 22 nt, Human
ucagauggcauagguuggaauu

SEQ ID NO: 235123 - RNA, 22 nt, Human
agaaaucuuggagucuguggua

SEQ ID NO: 235124 - RNA, 22 nt, Human
aaagcaauaguaaugguaauag

SEQ ID NO: 235125 - RNA, 22 nt, Human
ggagcugaggcugaggccucac

SEQ ID NO: 235126 - RNA, 22 nt, Human
acaugucuaaguacucaacaaa

SEQ ID NO: 235127 - RNA, 22 nt, Human
aaucagacaguucuggauucaa

SEQ ID NO: 235128 - RNA, 20 nt, Human
uccucagaagacauuugggg

SEQ ID NO: 235129 - RNA, 22 nt, Human
guguuuuggccauuagugugau

SEQ ID NO: 235130 - RNA, 22 nt, Human
gcuggagaaacaggaggaggaa

SEQ ID NO: 235131 - RNA, 22 nt, Human
aucuuuagugugaauuuauuga

SEQ ID NO: 235132 - RNA, 22 nt, Human
ucuggcuccacaccucacugca

SEQ ID NO: 235133 - RNA, 18 nt, Human
ggguccugugggagacag

SEQ ID NO: 235134 - RNA, 22 nt, Human
cugugcugauucagcacaggcc

SEQ ID NO: 235135 - RNA, 22 nt, Human
gaauguuacuuugauuuugucc

SEQ ID NO: 235136 - RNA, 22 nt, Human
gggcuccaacggugagcaugga

SEQ ID NO: 235137 - RNA, 22 nt, Human
auccuggcccagguguggaggg

SEQ ID NO: 235138 - RNA, 22 nt, Human
agucugggugugaaugaacuug

SEQ ID NO: 235139 - RNA, 22 nt, Human
cuggcuuugaaaugcauuucag

SEQ ID NO: 235140 - RNA, 22 nt, Human
cucuccagggguagaugccuuc

SEQ ID NO: 235141 - RNA, 22 nt, Human
aacuugguaccaccuucugaag

SEQ ID NO: 235142 - RNA, 22 nt, Human
uguguccuuuggaggaucagcg

SEQ ID NO: 235143 - RNA, 22 nt, Human
ccaggaaguaugacccaacaga

SEQ ID NO: 235144 - RNA, 22 nt, Human
ucuggcuguuuuagaugagcuc

SEQ ID NO: 235145 - RNA, 22 nt, Human
cucugugggggagaggcagcug

SEQ ID NO: 235146 - RNA, 22 nt, Human
gaaaguuuucauauauaccaaa

SEQ ID NO: 235147 - RNA, 22 nt, Human
aacuaaaagugugucucuugua

SEQ ID NO: 235148 - RNA, 22 nt, Human
agugaccaaucacugaaugauu

SEQ ID NO: 235149 - RNA, 22 nt, Human
cagcaugguuggguucugggga

SEQ ID NO: 235150 - RNA, 22 nt, Human
uucccagaccuguaggaucaga

SEQ ID NO: 235151 - RNA, 22 nt, Human
ccagaggcagacuuacacucca

SEQ ID NO: 235152 - RNA, 22 nt, Human
cugccuggguucaaguccuguu

SEQ ID NO: 235153 - RNA, 22 nt, Human
uuugacucuagucauagaagug

SEQ ID NO: 235154 - RNA, 17 nt, Human
aggcagguaagaguuau

SEQ ID NO: 235155 - RNA, 22 nt, Human
uccaggcagggcagccaucaag

SEQ ID NO: 235156 - RNA, 21 nt, Human
ucucuucccaucaggacacua

SEQ ID NO: 235157 - RNA, 22 nt, Human
gaguccuuuugugccacaggga

SEQ ID NO: 235158 - RNA, 21 nt, Human
caaggcuuaaacauuaaucua

SEQ ID NO: 235159 - RNA, 22 nt, Human
ucagaauauauucauguuguca

SEQ ID NO: 235160 - RNA, 22 nt, Human
gagcugguucuguccagggaau

SEQ ID NO: 235161 - RNA, 22 nt, Human
cauuuuacgacauagggcaggc

SEQ ID NO: 235162 - RNA, 22 nt, Human
uucucugugagggugcuggauu

SEQ ID NO: 235163 - RNA, 22 nt, Human
cugcaucaguggauaugauggu

SEQ ID NO: 235164 - RNA, 22 nt, Human
acugggauuacaggugggaguc

SEQ ID NO: 235165 - RNA, 22 nt, Human
ucagcagggcauacugagccua

SEQ ID NO: 235166 - RNA, 22 nt, Human
uguuuagaggaacuggaaucag

SEQ ID NO: 235167 - RNA, 22 nt, Human
ugcagggaugcuagagguaaga

SEQ ID NO: 235168 - RNA, 22 nt, Human
guuccacaaaauguacccaguu

SEQ ID NO: 235169 - RNA, 22 nt, Human
ccugaggcuccaccuccagaga

SEQ ID NO: 235170 - RNA, 22 nt, Human
ccucgagcagcgaccccuccac

SEQ ID NO: 235171 - RNA, 22 nt, Human
agggcucuguuggggucagcac

SEQ ID NO: 235172 - RNA, 20 nt, Human
cagagcuaucccuuuauuua

SEQ ID NO: 235173 - RNA, 22 nt, Human
gcucugagagcuacacagggua

SEQ ID NO: 235174 - RNA, 22 nt, Human
cucuccagccacagaagcugcu

SEQ ID NO: 235175 - RNA, 22 nt, Human
aaggugucggcagagccgcuuc

SEQ ID NO: 235176 - RNA, 22 nt, Human
acaggccauaaaggcaggcccu

SEQ ID NO: 235177 - RNA, 22 nt, Human
caguccugggagacuuacccag

SEQ ID NO: 235178 - RNA, 22 nt, Human
uucuguuacuguuggucauaac

SEQ ID NO: 235179 - RNA, 22 nt, Human
gagcucccuggagguucagaua

SEQ ID NO: 235180 - RNA, 22 nt, Human
gucacuguauccagguuccagc

SEQ ID NO: 235181 - RNA, 20 nt, Human
accugggaaaaccuuuuccu

SEQ ID NO: 235182 - RNA, 22 nt, Human
agagggcugcugcacagugcuc

SEQ ID NO: 235183 - RNA, 23 nt, Human
ucucuguacagaugaggacacac

SEQ ID NO: 235184 - RNA, 22 nt, Human
agugcauguccaguaguuuaug

SEQ ID NO: 235185 - RNA, 20 nt, Human
uuacaaguuucuaauaacca

SEQ ID NO: 235186 - RNA, 22 nt, Human
uggccaugggauagugcagggg

SEQ ID NO: 235187 - RNA, 22 nt, Human
auaacuuauuagauuggagcug

SEQ ID NO: 235188 - RNA, 22 nt, Human
ccagguguggccacauggcugg

SEQ ID NO: 235189 - RNA, 22 nt, Human
uggcucaggggucuggcucugu

SEQ ID NO: 235190 - RNA, 22 nt, Human
gccuugccaaggggcagcagag

SEQ ID NO: 235191 - RNA, 22 nt, Human
uugcagggaaacaguuuaggaa

SEQ ID NO: 235192 - RNA, 22 nt, Human
gugaacaggagaaagugaugga

SEQ ID NO: 235193 - RNA, 22 nt, Human
uuccugggacuggagcagccca

SEQ ID NO: 235194 - RNA, 22 nt, Human
ugcccuccacaguggcuccacc

SEQ ID NO: 235195 - RNA, 22 nt, Human
uguguguguuucugcucauaca

SEQ ID NO: 235196 - RNA, 22 nt, Human
uaagacuucauuaguaauaugg

SEQ ID NO: 235197 - RNA, 22 nt, Human
aggucaagggagcugagggcca

SEQ ID NO: 235198 - RNA, 22 nt, Human
ugaggugacaauucauucucca

SEQ ID NO: 235199 - RNA, 22 nt, Human
ggcuaggcgggcacauggugga

SEQ ID NO: 235200 - RNA, 20 nt, Human
uugaagaggauauaucgcuc

SEQ ID NO: 235201 - RNA, 22 nt, Human
auuauauaggacuugcccuucc

SEQ ID NO: 235202 - RNA, 22 nt, Human
cagagcugguaagugguagagg

SEQ ID NO: 235203 - RNA, 19 nt, Human
agguggucuaggcuggaga

SEQ ID NO: 235204 - RNA, 22 nt, Human
accacagcuuugcaccaggugu

SEQ ID NO: 235205 - RNA, 23 nt, Human
ugcuguagucucuacagcugguc

SEQ ID NO: 235206 - RNA, 22 nt, Human
gagauuuaauuggauuaacuua

SEQ ID NO: 235207 - RNA, 23 nt, Human
gguccaggaaaggcagcagcacc

SEQ ID NO: 235208 - RNA, 22 nt, Human
uagcacaguucacuaugauaca

SEQ ID NO: 235209 - RNA, 19 nt, Human
cugagccucaguuuccuag

SEQ ID NO: 235210 - RNA, 21 nt, Human
agucucucuaauaaaugcuug

SEQ ID NO: 235211 - RNA, 23 nt, Human
uguauuacagaugcaucagugau

SEQ ID NO: 235212 - RNA, 22 nt, Human
cucugaggcuuguucuauguau

SEQ ID NO: 235213 - RNA, 22 nt, Human
gagugguaaugagcagauuagg

SEQ ID NO: 235214 - RNA, 22 nt, Human
cgaggcaggcaggcggaggaua

SEQ ID NO: 235215 - RNA, 22 nt, Human
cagggcaguuugugccuaugag

SEQ ID NO: 235216 - RNA, 22 nt, Human
ggagggaaugucuagcauucuu

SEQ ID NO: 235217 - RNA, 22 nt, Human
gagaugagugggggaucucuca

SEQ ID NO: 235218 - RNA, 22 nt, Human
ugaaggcuuuuuaaagcauuug

SEQ ID NO: 235219 - RNA, 22 nt, Human
cuauucaguugugggcaacaau

SEQ ID NO: 235220 - RNA, 22 nt, Human
gacaccagaagacauaagcaga

SEQ ID NO: 235221 - RNA, 22 nt, Human
uaacagcacuggcaggcacugu

SEQ ID NO: 235222 - RNA, 22 nt, Human
uccaagcucucuaugccaugau

SEQ ID NO: 235223 - RNA, 22 nt, Human
cacagagcuggaaaggcugggc

SEQ ID NO: 235224 - RNA, 22 nt, Human
gggcuggaccgcucgccucccu

SEQ ID NO: 235225 - RNA, 22 nt, Human
uugcagcucugauccagggacc

SEQ ID NO: 235226 - RNA, 22 nt, Human
agcaugaaagcauaggacaguc

SEQ ID NO: 235227 - RNA, 22 nt, Human
acccaggcagcaggagcuaaag

SEQ ID NO: 235228 - RNA, 22 nt, Human
gcuggcccagcgcccagggcag

SEQ ID NO: 235229 - RNA, 22 nt, Human
agaggaggcagcuuaacucagu

SEQ ID NO: 235230 - RNA, 22 nt, Human
uggcccugcacccagagcaguu

SEQ ID NO: 235231 - RNA, 22 nt, Human
aucccagauagugacccucagg

SEQ ID NO: 235232 - RNA, 22 nt, Human
agcaccagcgugggggccguug

SEQ ID NO: 235233 - RNA, 22 nt, Human
agcaacaggaaauagcugauua

SEQ ID NO: 235234 - RNA, 22 nt, Human
uuugucaaaucaaaccacauuc

SEQ ID NO: 235235 - RNA, 22 nt, Human
aguggcugccaagagcaaugcu

SEQ ID NO: 235236 - RNA, 22 nt, Human
gcucccugcacucugcagcccu

SEQ ID NO: 235237 - RNA, 22 nt, Human
ccuugggguguuggaggcagcc

SEQ ID NO: 235238 - RNA, 22 nt, Human
uucuucuuuccuauaauuaauu

SEQ ID NO: 235239 - RNA, 22 nt, Human
caucuuuaguagguucuggaga

SEQ ID NO: 235240 - RNA, 22 nt, Human
auuugcuuuaagguauaaaagg

SEQ ID NO: 235241 - RNA, 17 nt, Human
ugcucaaauacuuuuga

SEQ ID NO: 235242 - RNA, 22 nt, Human
gagcucagauucuggugucaga

SEQ ID NO: 235243 - RNA, 22 nt, Human
aaugucugccagaacugaucau

SEQ ID NO: 235244 - RNA, 22 nt, Human
aaaugcuguguuuuaacauaga

SEQ ID NO: 235245 - RNA, 22 nt, Human
acugucaugaucgaagauguca

SEQ ID NO: 235246 - RNA, 22 nt, Human
ggcuccuucaaagcaccuggcu

SEQ ID NO: 235247 - RNA, 22 nt, Human
uauuuuacaaaugggaaugcug

SEQ ID NO: 235248 - RNA, 22 nt, Human
guugacagugacccugaaagca

SEQ ID NO: 235249 - RNA, 22 nt, Human
cucugagguucccuggguccca

SEQ ID NO: 235250 - RNA, 22 nt, Human
aaauccuaaugacaaguuuagu

SEQ ID NO: 235251 - RNA, 22 nt, Human
gggaucugaguaggcagaagcu

SEQ ID NO: 235252 - RNA, 22 nt, Human
caggaagccacaggacagguag

SEQ ID NO: 235253 - RNA, 22 nt, Human
uucaugaagggugaauauaguc

SEQ ID NO: 235254 - RNA, 22 nt, Human
cuggcagcugcccgagaugccc

SEQ ID NO: 235255 - RNA, 22 nt, Human
agucugaguuaguggaaaugua

SEQ ID NO: 235256 - RNA, 21 nt, Human
ucuuuaugacuugcccauuug

SEQ ID NO: 235257 - RNA, 22 nt, Human
cuguccagucuuuagcaagcug

SEQ ID NO: 235258 - RNA, 22 nt, Human
ucugucaauauaugugcugcag

SEQ ID NO: 235259 - RNA, 22 nt, Human
guggccucugugcuccugccua

SEQ ID NO: 235260 - RNA, 22 nt, Human
accacaggaauugcucuguggu

SEQ ID NO: 235261 - RNA, 22 nt, Human
cucugggucaccaucggggauu

SEQ ID NO: 235262 - RNA, 22 nt, Human
ucccagagcagaugugcuaaag

SEQ ID NO: 235263 - RNA, 22 nt, Human
gccagcauuccuuggcuccugg

SEQ ID NO: 235264 - RNA, 22 nt, Human
caguuaaaugaugugcccuaga

SEQ ID NO: 235265 - RNA, 23 nt, Human
agguuaugauuauagagcgagga

SEQ ID NO: 235266 - RNA, 22 nt, Human
augggaaagaagccacugccca

SEQ ID NO: 235267 - RNA, 21 nt, Human
gcucagagaggguaauuaacc

SEQ ID NO: 235268 - RNA, 22 nt, Human
gugagucuguggaccgggcacu

SEQ ID NO: 235269 - RNA, 22 nt, Human
ccugaaauuugaagaccugaau

SEQ ID NO: 235270 - RNA, 22 nt, Human
aaucuugguugcaguauauccg

SEQ ID NO: 235271 - RNA, 22 nt, Human
uauauuuaaauccagguugaaa

SEQ ID NO: 235272 - RNA, 22 nt, Human
uuggcugaaugaggucaccuuu

SEQ ID NO: 235273 - RNA, 22 nt, Human
uuucucuuucaaucugcaguac

SEQ ID NO: 235274 - RNA, 19 nt, Human
auggcagcagcagcucucc

SEQ ID NO: 235275 - RNA, 22 nt, Human
agacacugaaucagagggacau

SEQ ID NO: 235276 - RNA, 22 nt, Human
gcucacagccggcuggcagggg

SEQ ID NO: 235277 - RNA, 22 nt, Human
uaagagcagagguugaauaaau

SEQ ID NO: 235278 - RNA, 22 nt, Human
gggcaaagugguggaggcaguu

SEQ ID NO: 235279 - RNA, 22 nt, Human
uagcccagcuuggccuauuucu

SEQ ID NO: 235280 - RNA, 22 nt, Human
cagcugucuuugcacaguuuag

SEQ ID NO: 235281 - RNA, 22 nt, Human
aauucacugaacuucucugaga

SEQ ID NO: 235282 - RNA, 22 nt, Human
agcugguuagcaaucuaaguga

SEQ ID NO: 235283 - RNA, 22 nt, Human
uagucagauauaugacuuacgu

SEQ ID NO: 235284 - RNA, 22 nt, Human
accuccagcuuuuuagagacau

SEQ ID NO: 235285 - RNA, 22 nt, Human
ccagagggcuugguuugggcca

SEQ ID NO: 235286 - RNA, 21 nt, Human
aacauuucugggagaacucac

SEQ ID NO: 235287 - RNA, 22 nt, Human
gaggcugauucggggaacagca

SEQ ID NO: 235288 - RNA, 22 nt, Human
agggcagccucucagccuaggu

SEQ ID NO: 235289 - RNA, 22 nt, Human
cugccaggggccucacaggcca

SEQ ID NO: 235290 - RNA, 22 nt, Human
aaaugcuuauuagugucacaaa

SEQ ID NO: 235291 - RNA, 22 nt, Human
uggaacugcuccaaaaccucca

SEQ ID NO: 235292 - RNA, 22 nt, Human
uauuucuugagacucgucuucc

SEQ ID NO: 235293 - RNA, 22 nt, Human
aagcaagccaaucuguuuuguu

SEQ ID NO: 235294 - RNA, 22 nt, Human
aauguacaaggguuccaguuuu

SEQ ID NO: 235295 - RNA, 22 nt, Human
gcucugggccauccuggccggg

SEQ ID NO: 235296 - RNA, 22 nt, Human
ccuggcagaauauuaaagugca

SEQ ID NO: 235297 - RNA, 22 nt, Human
gagcuggucaguuucagggcca

SEQ ID NO: 235298 - RNA, 22 nt, Human
uagggcuguuaguaauucucag

SEQ ID NO: 235299 - RNA, 22 nt, Human
ugacauuuaaucccuaaauauu

SEQ ID NO: 235300 - RNA, 22 nt, Human
ucacaucaacauuauagcauga

SEQ ID NO: 235301 - RNA, 22 nt, Human
uauuuauauucugccuucugcu

SEQ ID NO: 235302 - RNA, 22 nt, Human
gucuuagauuucaccgauaaug

SEQ ID NO: 235303 - RNA, 22 nt, Human
aauaauuuugagagccuggaaa

SEQ ID NO: 235304 - RNA, 22 nt, Human
ggccagaggccacagcuguguc

SEQ ID NO: 235305 - RNA, 22 nt, Human
ucaggccaagguagacaugacu

SEQ ID NO: 235306 - RNA, 22 nt, Human
ugccuugcacauaauauacauu

SEQ ID NO: 235307 - RNA, 22 nt, Human
cagauucuccaggggcugcaga

SEQ ID NO: 235308 - RNA, 22 nt, Human
auccaaagcccuaaguuaacug

SEQ ID NO: 235309 - RNA, 22 nt, Human
cagaggcauauaauugcugggg

SEQ ID NO: 235310 - RNA, 22 nt, Human
cuccaaguccgagggcucucaa

SEQ ID NO: 235311 - RNA, 22 nt, Human
aauuuguuacacagcaauauaa

SEQ ID NO: 235312 - RNA, 22 nt, Human
uccugcccagagcucuccacuc

SEQ ID NO: 235313 - RNA, 22 nt, Human
ugggggcacuucgaggucgccu

SEQ ID NO: 235314 - RNA, 22 nt, Human
ggaggagucaguugggcugcuu

SEQ ID NO: 235315 - RNA, 22 nt, Human
cacaucuacugauauuccagga

SEQ ID NO: 235316 - RNA, 22 nt, Human
cuuuacaaacuauaaagugcgg

SEQ ID NO: 235317 - RNA, 22 nt, Human
uucaaguuaccuuuaaacagcu

SEQ ID NO: 235318 - RNA, 23 nt, Human
aaggccagaauuucaauggugcc

SEQ ID NO: 235319 - RNA, 22 nt, Human
uacuuuggggacaauauggaau

SEQ ID NO: 235320 - RNA, 22 nt, Human
uguucauuaguggaaguaaguu

SEQ ID NO: 235321 - RNA, 22 nt, Human
gagcucuguucucguccugcug

SEQ ID NO: 235322 - RNA, 22 nt, Human
guauuucacauauggauaugcu

SEQ ID NO: 235323 - RNA, 22 nt, Human
cuggcccagguggucguugagg

SEQ ID NO: 235324 - RNA, 22 nt, Human
gauucuuuggccuuuauugaca

SEQ ID NO: 235325 - RNA, 22 nt, Human
ugaugaggggcucagaggucag

SEQ ID NO: 235326 - RNA, 22 nt, Human
ugcaggaguccaaucaggagac

SEQ ID NO: 235327 - RNA, 21 nt, Human
ugacccuucuagcagaacaca

SEQ ID NO: 235328 - RNA, 22 nt, Human
cauggaaagcacucagcccagu

SEQ ID NO: 235329 - RNA, 22 nt, Human
agaggcuuggaggugcaagguu

SEQ ID NO: 235330 - RNA, 22 nt, Human
agccuuccacccagauccccuu

SEQ ID NO: 235331 - RNA, 22 nt, Human
gcucaguguguucaagggcuca

SEQ ID NO: 235332 - RNA, 22 nt, Human
cguuuauuuugaagauuccacu

SEQ ID NO: 235333 - RNA, 22 nt, Human
agaaaaguuuaaaucuuggcac

SEQ ID NO: 235334 - RNA, 22 nt, Human
cucagaggggaugcuuggagaa

SEQ ID NO: 235335 - RNA, 22 nt, Human
uauucaugggaggucacaacuu

SEQ ID NO: 235336 - RNA, 18 nt, Human
auacagagaccucaagga

SEQ ID NO: 235337 - RNA, 22 nt, Human
cugaagcagggagugaugaagu

SEQ ID NO: 235338 - RNA, 22 nt, Human
cugucccucaguucugggcaaa

SEQ ID NO: 235339 - RNA, 22 nt, Human
uguccuagaguacauuccacug

SEQ ID NO: 235340 - RNA, 23 nt, Human
ggacccuguggagggugagaguc

SEQ ID NO: 235341 - RNA, 22 nt, Human
uugagcaggauggcuaugcaca

SEQ ID NO: 235342 - RNA, 22 nt, Human
uuucacagcuggguggcagagu

SEQ ID NO: 235343 - RNA, 22 nt, Human
uuuuagaaguucaugugggauu

SEQ ID NO: 235344 - RNA, 22 nt, Human
gugucccagcagcacauuggcu

SEQ ID NO: 235345 - RNA, 22 nt, Human
uuacagucagugaauggaaggg

SEQ ID NO: 235346 - RNA, 22 nt, Human
aagugguuugagcacagugcug

SEQ ID NO: 235347 - RNA, 22 nt, Human
ucuaggaauguucuuagggauu

SEQ ID NO: 235348 - RNA, 22 nt, Human
ugugugcuaauguaugcucuaa

SEQ ID NO: 235349 - RNA, 22 nt, Human
ucagccaguuuguuuauuccgg

SEQ ID NO: 235350 - RNA, 22 nt, Human
acugucugcuggccccugguua

SEQ ID NO: 235351 - RNA, 19 nt, Human
gguggcucagggcccagcc

SEQ ID NO: 235352 - RNA, 22 nt, Human
agguccugaagauuuuacuaga

SEQ ID NO: 235353 - RNA, 22 nt, Human
ggagcugagcagcgauggcgga

SEQ ID NO: 235354 - RNA, 22 nt, Human
cuauucagguguccauuaaucc

SEQ ID NO: 235355 - RNA, 22 nt, Human
gaaccugcuuccuuuuauauua

SEQ ID NO: 235356 - RNA, 22 nt, Human
ugugcaggugcaggaagggggc

SEQ ID NO: 235357 - RNA, 22 nt, Human
gcuuuauagcccuauuacauga

SEQ ID NO: 235358 - RNA, 22 nt, Human
uauuccaagcacagcaacccag

SEQ ID NO: 235359 - RNA, 22 nt, Human
uuaaggagcagaaugcuuggac

SEQ ID NO: 235360 - RNA, 22 nt, Human
acaggugguagaguggaaagag

SEQ ID NO: 235361 - RNA, 22 nt, Human
agcccagaggcugggcgugcau

SEQ ID NO: 235362 - RNA, 23 nt, Human
ugaaauauucuuuugcaugagcu

SEQ ID NO: 235363 - RNA, 20 nt, Human
ccugcugugcuuuccaugga

SEQ ID NO: 235364 - RNA, 19 nt, Human
ccugugugggguagagauc

SEQ ID NO: 235365 - RNA, 22 nt, Human
acauucaaggccuucugacaca

SEQ ID NO: 235366 - RNA, 22 nt, Human
ggaacauuuccuggcagagagg

SEQ ID NO: 235367 - RNA, 22 nt, Human
uuagaagcaucaccuguucugg

SEQ ID NO: 235368 - RNA, 22 nt, Human
caauuucuuguuaauucucagg

SEQ ID NO: 235369 - RNA, 22 nt, Human
aacacugaccucuacccucagu

SEQ ID NO: 235370 - RNA, 22 nt, Human
uguaggucacagucccuauccc

SEQ ID NO: 235371 - RNA, 22 nt, Human
gggccaccuggauuccaugugu

SEQ ID NO: 235372 - RNA, 22 nt, Human
agagcugggaccgucuggaagu

SEQ ID NO: 235373 - RNA, 19 nt, Human
cacagccacagccaaccuc

SEQ ID NO: 235374 - RNA, 22 nt, Human
gaauguuauguauccagucaca

SEQ ID NO: 235375 - RNA, 23 nt, Human
agccuucaggcaaugucaguaga

SEQ ID NO: 235376 - RNA, 22 nt, Human
uguuugcuauauccuacuucau

SEQ ID NO: 235377 - RNA, 22 nt, Human
aagcaguguucccagcuggccc

SEQ ID NO: 235378 - RNA, 22 nt, Human
agaagccuguugagagggccgu

SEQ ID NO: 235379 - RNA, 22 nt, Human
ucccugggcaucacguugcuuc

SEQ ID NO: 235380 - RNA, 22 nt, Human
acaggcuggaggaggaccaaga

SEQ ID NO: 235381 - RNA, 22 nt, Human
auagaugucauugucauccauc

SEQ ID NO: 235382 - RNA, 22 nt, Human
cagaaagcaguugucaaugggc

SEQ ID NO: 235383 - RNA, 22 nt, Human
uuaaaauuuccccaccauguau

SEQ ID NO: 235384 - RNA, 22 nt, Human
caguuucucucaauaagcaucg

SEQ ID NO: 235385 - RNA, 18 nt, Human
gcagagcugggauuccca

SEQ ID NO: 235386 - RNA, 22 nt, Human
acacauuaugagcaguugucuu

SEQ ID NO: 235387 - RNA, 22 nt, Human
agaugggccuucgagcaugccc

SEQ ID NO: 235388 - RNA, 22 nt, Human
ccuggccaggcuccaaguacug

SEQ ID NO: 235389 - RNA, 22 nt, Human
agauuucaaugugagcauuagu

SEQ ID NO: 235390 - RNA, 22 nt, Human
auuuaucaccaguuagcugacu

SEQ ID NO: 235391 - RNA, 20 nt, Human
uuacuugucucagcauggag

SEQ ID NO: 235392 - RNA, 22 nt, Human
uucauucagugcauuugggaga

SEQ ID NO: 235393 - RNA, 22 nt, Human
caguccagagcccaccagagga

SEQ ID NO: 235394 - RNA, 23 nt, Human
uccuccaaccagcagcugcauaa

SEQ ID NO: 235395 - RNA, 22 nt, Human
ucaaagcaauuucaccagugcc

SEQ ID NO: 235396 - RNA, 22 nt, Human
uaaaagacccucuagaguccca

SEQ ID NO: 235397 - RNA, 22 nt, Human
gaaguuuucugaggcuguagcu

SEQ ID NO: 235398 - RNA, 22 nt, Human
agccagccccugacuguguccu

SEQ ID NO: 235399 - RNA, 20 nt, Human
agcaucuugcaucuucaagu

SEQ ID NO: 235400 - RNA, 22 nt, Human
aagucuuuugcuaagaguaaug

SEQ ID NO: 235401 - RNA, 22 nt, Human
ccauuugugcuucuucaaagca

SEQ ID NO: 235402 - RNA, 22 nt, Human
ggcuccagaugucuccuggcaa

SEQ ID NO: 235403 - RNA, 22 nt, Human
caucaaaucugacuuuucuucc

SEQ ID NO: 235404 - RNA, 22 nt, Human
uuacacuuaggguuugucagag

SEQ ID NO: 235405 - RNA, 22 nt, Human
cugaggcucccucgggucugcu

SEQ ID NO: 235406 - RNA, 22 nt, Human
gcugccuuaacuucuucgcugu

SEQ ID NO: 235407 - RNA, 22 nt, Human
uaaaugcaguuaguacuugcca

SEQ ID NO: 235408 - RNA, 22 nt, Human
uaucuagaacuccagaauguag

SEQ ID NO: 235409 - RNA, 22 nt, Human
gagcuuuaagggauaaaaugau

SEQ ID NO: 235410 - RNA, 22 nt, Human
agcccagcggagcgggcccggg

SEQ ID NO: 235411 - RNA, 22 nt, Human
ucucucccaaaucugcagauag

SEQ ID NO: 235412 - RNA, 22 nt, Human
uagucagucuuacauauuugaa

SEQ ID NO: 235413 - RNA, 22 nt, Human
uaucuuuguaucaaucuccauu

SEQ ID NO: 235414 - RNA, 22 nt, Human
ucugggccugucucagagcugg

SEQ ID NO: 235415 - RNA, 22 nt, Human
aagcagggcucccuggggacuc

SEQ ID NO: 235416 - RNA, 22 nt, Human
uucugaaagccaauucauugaa

SEQ ID NO: 235417 - RNA, 22 nt, Human
uuguuucuucaggcuuuuagga

SEQ ID NO: 235418 - RNA, 22 nt, Human
cacaugcuagaauaaaucucca

SEQ ID NO: 235419 - RNA, 22 nt, Human
uuaauacagucuccagaaguaa

SEQ ID NO: 235420 - RNA, 22 nt, Human
auaccuguguauccacaagcgu

SEQ ID NO: 235421 - RNA, 22 nt, Human
uagcaucuguuucucuuuguga

SEQ ID NO: 235422 - RNA, 22 nt, Human
auuaaauacugcaggcuaagca

SEQ ID NO: 235423 - RNA, 22 nt, Human
acugaggagaaauuugagugaa

SEQ ID NO: 235424 - RNA, 22 nt, Human
aagaacagguucuagaaccauu

SEQ ID NO: 235425 - RNA, 22 nt, Human
gcagggcuugcagcagcuagac

SEQ ID NO: 235426 - RNA, 22 nt, Human
auucuaaagcuuguggagcuua

SEQ ID NO: 235427 - RNA, 20 nt, Human
ggccucugaggacaaggaga

SEQ ID NO: 235428 - RNA, 21 nt, Human
caguguggugaccagggucuc

SEQ ID NO: 235429 - RNA, 22 nt, Human
cuggcugggguaccaguugaac

SEQ ID NO: 235430 - RNA, 22 nt, Human
cuucuguguuaaaugagucuuu

SEQ ID NO: 235431 - RNA, 22 nt, Human
ucccagccaggcucuaccacuu

SEQ ID NO: 235432 - RNA, 22 nt, Human
gaggacagugugaucugccagc

SEQ ID NO: 235433 - RNA, 19 nt, Human
uucuuuccacaucuucucu

SEQ ID NO: 235434 - RNA, 22 nt, Human
cauuauguucaguagcuuaaaa

SEQ ID NO: 235435 - RNA, 22 nt, Human
auguuuaaaggguugagaaaua

SEQ ID NO: 235436 - RNA, 22 nt, Human
cagcugccccgcuggcugacca

SEQ ID NO: 235437 - RNA, 23 nt, Human
ugcaggugauuaauccaguuuca

SEQ ID NO: 235438 - RNA, 22 nt, Human
acagcucuucuucaagccuggc

SEQ ID NO: 235439 - RNA, 22 nt, Human
agauguggccuuugggagauua

SEQ ID NO: 235440 - RNA, 22 nt, Human
ugcuccagaaaaacuugagacu

SEQ ID NO: 235441 - RNA, 22 nt, Human
aguuacagcacucaaaguuuuc

SEQ ID NO: 235442 - RNA, 22 nt, Human
uaguuacauaaaguggacuguu

SEQ ID NO: 235443 - RNA, 22 nt, Human
agcaggugaucgcgugugcucc

SEQ ID NO: 235444 - RNA, 22 nt, Human
cuggcagcagcuucuggaucga

SEQ ID NO: 235445 - RNA, 22 nt, Human
uucuaaauuuuggaagaugcag

SEQ ID NO: 235446 - RNA, 22 nt, Human
agagucaaguagggcaugggcu

SEQ ID NO: 235447 - RNA, 22 nt, Human
uucuacagguacugaaguacau

SEQ ID NO: 235448 - RNA, 22 nt, Human
cagaguggugcaagggcagugu

SEQ ID NO: 235449 - RNA, 22 nt, Human
aucacaaaggguuuucucugag

SEQ ID NO: 235450 - RNA, 22 nt, Human
uggggucccacucagcuccccu

SEQ ID NO: 235451 - RNA, 21 nt, Human
cccaggaggcugagaagagca

SEQ ID NO: 235452 - RNA, 22 nt, Human
ggcccugcugaagccgggucua

SEQ ID NO: 235453 - RNA, 22 nt, Human
uucucuggacagugaagagagg

SEQ ID NO: 235454 - RNA, 22 nt, Human
aaggggcacaauuguacccaag

SEQ ID NO: 235455 - RNA, 22 nt, Human
cuguccugcaguugggggcagg

SEQ ID NO: 235456 - RNA, 22 nt, Human
cuacagcagagcuacacuaacu

SEQ ID NO: 235457 - RNA, 22 nt, Human
acacuguaaauugagugcguga

SEQ ID NO: 235458 - RNA, 22 nt, Human
gccucagggggagaggccagcu

SEQ ID NO: 235459 - RNA, 22 nt, Human
uaaaggcucacuggcuuggggu

SEQ ID NO: 235460 - RNA, 22 nt, Human
ugcaagaggaauucuagaagca

SEQ ID NO: 235461 - RNA, 22 nt, Human
gccacauccuucagaaagcuuu

SEQ ID NO: 235462 - RNA, 22 nt, Human
gcuggccauauauuuugcuguu

SEQ ID NO: 235463 - RNA, 22 nt, Human
ucagcaggcaggaggcaugcca

SEQ ID NO: 235464 - RNA, 22 nt, Human
gcuggagucuggaggugugcca

SEQ ID NO: 235465 - RNA, 22 nt, Human
agcccugaagcuggccaugucc

SEQ ID NO: 235466 - RNA, 22 nt, Human
guuuuucuagacugggaguuug

SEQ ID NO: 235467 - RNA, 22 nt, Human
agcaggcccaagcuggggggaa

SEQ ID NO: 235468 - RNA, 22 nt, Human
gcucagagaaauuauaggaauu

SEQ ID NO: 235469 - RNA, 22 nt, Human
cagguggcagaggucucuggaa

SEQ ID NO: 235470 - RNA, 22 nt, Human
gagcccaggcugggguucagag

SEQ ID NO: 235471 - RNA, 22 nt, Human
acaugaaugaagacuuuacaau

SEQ ID NO: 235472 - RNA, 22 nt, Human
gccuuccugcagcucugagcgu

SEQ ID NO: 235473 - RNA, 22 nt, Human
gggcccaguacccucugccaag

SEQ ID NO: 235474 - RNA, 22 nt, Human
ucagguggagaccuccuuggcc

SEQ ID NO: 235475 - RNA, 22 nt, Human
ggcccaucucuugcucuggguu

SEQ ID NO: 235476 - RNA, 22 nt, Human
aaagaaaccuaucagccacaug

SEQ ID NO: 235477 - RNA, 22 nt, Human
uggguagggagcuggaauccua

SEQ ID NO: 235478 - RNA, 22 nt, Human
ucuuagauggcagcuagagcuc

SEQ ID NO: 235479 - RNA, 22 nt, Human
gcaguggccacauggaggagga

SEQ ID NO: 235480 - RNA, 22 nt, Human
cccugugcauuggaggguguuu

SEQ ID NO: 235481 - RNA, 22 nt, Human
gauggaaugaauggcagauaca

SEQ ID NO: 235482 - RNA, 21 nt, Human
ugagucucccuuagcccacgc

SEQ ID NO: 235483 - RNA, 22 nt, Human
acaugagagaaaaguauucuga

SEQ ID NO: 235484 - RNA, 22 nt, Human
acaaaguauuuuuagguuugua

SEQ ID NO: 235485 - RNA, 21 nt, Human
guguggauaugugacaggugg

SEQ ID NO: 235486 - RNA, 22 nt, Human
aggaagcuagagccaccggacu

SEQ ID NO: 235487 - RNA, 22 nt, Human
ucagaggguggcugggagcauc

SEQ ID NO: 235488 - RNA, 22 nt, Human
gugcagagugucuguggacuga

SEQ ID NO: 235489 - RNA, 22 nt, Human
agagaacagacagaugcaauga

SEQ ID NO: 235490 - RNA, 22 nt, Human
ggcugcugggaauaugccagcu

SEQ ID NO: 235491 - RNA, 22 nt, Human
ucaugcuuuguuaauguggcac

SEQ ID NO: 235492 - RNA, 22 nt, Human
cauauauucugguuuucacugg

SEQ ID NO: 235493 - RNA, 22 nt, Human
gcugggagugggcaagaugaga

SEQ ID NO: 235494 - RNA, 22 nt, Human
aaauuccauuaugauaauuucg

SEQ ID NO: 235495 - RNA, 20 nt, Human
uggcagguggccucaguucc

SEQ ID NO: 235496 - RNA, 22 nt, Human
aggucccugcagcagacugcca

SEQ ID NO: 235497 - RNA, 22 nt, Human
uaguuuuacaucagccauuguu

SEQ ID NO: 235498 - RNA, 22 nt, Human
ucagggcaccaaaaaagaugcc

SEQ ID NO: 235499 - RNA, 17 nt, Human
ucauuuguugugacuag

SEQ ID NO: 235500 - RNA, 22 nt, Human
ucugggcuuuuccaugccugug

SEQ ID NO: 235501 - RNA, 22 nt, Human
uagcugugaaacagcagaagag

SEQ ID NO: 235502 - RNA, 22 nt, Human
cccagugucuccaacaucagau

SEQ ID NO: 235503 - RNA, 23 nt, Human
uaagugauuagaauuugcuguca

SEQ ID NO: 235504 - RNA, 22 nt, Human
gcucagcuaucaguguuccuga

SEQ ID NO: 235505 - RNA, 22 nt, Human
acaggcauugggauggagguug

SEQ ID NO: 235506 - RNA, 22 nt, Human
uggcagaauuucuagcagauuc

SEQ ID NO: 235507 - RNA, 22 nt, Human
ccuggcuccgugucacgugccc

SEQ ID NO: 235508 - RNA, 22 nt, Human
uucuuguuuauuaagauauaaa

SEQ ID NO: 235509 - RNA, 22 nt, Human
caaaugcuaugauuuugaguuu

SEQ ID NO: 235510 - RNA, 22 nt, Human
uauuucaccuaaaagugucaaa

SEQ ID NO: 235511 - RNA, 22 nt, Human
aagugcuguacaguguguaaau

SEQ ID NO: 235512 - RNA, 22 nt, Human
ggcacagcucaggucccagcuc

SEQ ID NO: 235513 - RNA, 22 nt, Human
gccacacuuauucucaugcaca

SEQ ID NO: 235514 - RNA, 22 nt, Human
cuggcugcaaaaucuauucacu

SEQ ID NO: 235515 - RNA, 22 nt, Human
aaguucaauggaaaagcuuuag

SEQ ID NO: 235516 - RNA, 22 nt, Human
ggcagccagcggguggacgcgc

SEQ ID NO: 235517 - RNA, 22 nt, Human
ggacagagggcaggagcccaga

SEQ ID NO: 235518 - RNA, 22 nt, Human
gaaacauuguguucuacagauu

SEQ ID NO: 235519 - RNA, 22 nt, Human
uggagaauucuauguugagggg

SEQ ID NO: 235520 - RNA, 22 nt, Human
uccuggaguugugcagugcaca

SEQ ID NO: 235521 - RNA, 22 nt, Human
gagcucagagccuauaguuggu

SEQ ID NO: 235522 - RNA, 22 nt, Human
gaauuacagccagaagaaugaa

SEQ ID NO: 235523 - RNA, 18 nt, Human
ccuggaccugucuccuuu

SEQ ID NO: 235524 - RNA, 22 nt, Human
caaggcaguuccccagagggcu

SEQ ID NO: 235525 - RNA, 22 nt, Human
cuccagugagcgcggggcaugg

SEQ ID NO: 235526 - RNA, 21 nt, Human
cauauuaaaucggugccuuua

SEQ ID NO: 235527 - RNA, 22 nt, Human
agugugggcccccagguuagcc

SEQ ID NO: 235528 - RNA, 22 nt, Human
agcaggugaugugagucuggaa

SEQ ID NO: 235529 - RNA, 22 nt, Human
cugugaaugcuaguaagagugc

SEQ ID NO: 235530 - RNA, 22 nt, Human
ggccucucuagcauccagccug

SEQ ID NO: 235531 - RNA, 20 nt, Human
guuaaaagaguaauuugagg

SEQ ID NO: 235532 - RNA, 17 nt, Human
uccauuccuaaggcccu

SEQ ID NO: 235533 - RNA, 22 nt, Human
acuuuagaccaucuuccacagu

SEQ ID NO: 235534 - RNA, 22 nt, Human
agcagcaguguguggucauguu

SEQ ID NO: 235535 - RNA, 21 nt, Human
uaauaauuccacuacagagua

SEQ ID NO: 235536 - RNA, 20 nt, Human
cuagaagugccucaucuaga

SEQ ID NO: 235537 - RNA, 22 nt, Human
aguuuguaaguucauuaugagu

SEQ ID NO: 235538 - RNA, 22 nt, Human
ggcugcaggcagaggcugucug

SEQ ID NO: 235539 - RNA, 18 nt, Human
uuauuggugcugcuguuc

SEQ ID NO: 235540 - RNA, 22 nt, Human
aggcaaaagaaugucauaaaug

SEQ ID NO: 235541 - RNA, 21 nt, Human
uaucuacuggugucuuucaga

SEQ ID NO: 235542 - RNA, 22 nt, Human
cagccucugagccuuggcagau

SEQ ID NO: 235543 - RNA, 22 nt, Human
aagcacaauuuaggacugaaau

SEQ ID NO: 235544 - RNA, 22 nt, Human
uuacaaguucagauuuucucau

SEQ ID NO: 235545 - RNA, 22 nt, Human
aagagcuggucacagguccauu

SEQ ID NO: 235546 - RNA, 22 nt, Human
cagcagaaaauaccuguaacuc

SEQ ID NO: 235547 - RNA, 22 nt, Human
gggagcucucccugaggccugg

SEQ ID NO: 235548 - RNA, 22 nt, Human
ugcagguguaaauuuucaagag

SEQ ID NO: 235549 - RNA, 22 nt, Human
cagagcugugauaaauagauau

SEQ ID NO: 235550 - RNA, 22 nt, Human
gaggcacagagcccuaggagcu

SEQ ID NO: 235551 - RNA, 22 nt, Human
gcagggcagggcaagaacuggg

SEQ ID NO: 235552 - RNA, 22 nt, Human
cauuugaagacuuagaagagga

SEQ ID NO: 235553 - RNA, 22 nt, Human
uaucuguauucugacagucacu

SEQ ID NO: 235554 - RNA, 22 nt, Human
gauugcugaagaaagugaguga

SEQ ID NO: 235555 - RNA, 22 nt, Human
aaggccugggaggccucucuuc

SEQ ID NO: 235556 - RNA, 22 nt, Human
gcaggcugagaguccaagaagg

SEQ ID NO: 235557 - RNA, 21 nt, Human
uucaguaugcgucaugcuguu

SEQ ID NO: 235558 - RNA, 22 nt, Human
aaggcuuuuaaacugucaagga

SEQ ID NO: 235559 - RNA, 22 nt, Human
acacagagcuucucaacuggga

SEQ ID NO: 235560 - RNA, 22 nt, Human
gaggcugggaaguccaagacca

SEQ ID NO: 235561 - RNA, 22 nt, Human
gugagcagagaucgcgugauug

SEQ ID NO: 235562 - RNA, 22 nt, Human
caucucuguguccccagagcuu

SEQ ID NO: 235563 - RNA, 22 nt, Human
uggcugagugaacauguccauu

SEQ ID NO: 235564 - RNA, 18 nt, Human
uggcuucuugagcuaaca

SEQ ID NO: 235565 - RNA, 22 nt, Human
caugaacauuuguuuacaucug

SEQ ID NO: 235566 - RNA, 22 nt, Human
gcagcagugucucccaucuugc

SEQ ID NO: 235567 - RNA, 22 nt, Human
ucacagaaaagcugagcaucag

SEQ ID NO: 235568 - RNA, 22 nt, Human
uggccaguagagcucagauagu

SEQ ID NO: 235569 - RNA, 20 nt, Human
ugcaggugggcccuucuggg

SEQ ID NO: 235570 - RNA, 22 nt, Human
aguacaaauuauagcgcuugga

SEQ ID NO: 235571 - RNA, 22 nt, Human
uugcaaauaauagccugaaacu

SEQ ID NO: 235572 - RNA, 22 nt, Human
cugagguguuuaguaggggcgg

SEQ ID NO: 235573 - RNA, 22 nt, Human
augagcaggaagagcacaaaga

SEQ ID NO: 235574 - RNA, 22 nt, Human
guguugacacagccaucuuguc

SEQ ID NO: 235575 - RNA, 22 nt, Human
ucauuuuuugcauaccuguguc

SEQ ID NO: 235576 - RNA, 22 nt, Human
cccugccuuguuggagccuaug

SEQ ID NO: 235577 - RNA, 22 nt, Human
uagaacuuucagaaauuccaaa

SEQ ID NO: 235578 - RNA, 22 nt, Human
agaggcggagguugcagugagc

SEQ ID NO: 235579 - RNA, 20 nt, Human
auacacauucauagaaaaau

SEQ ID NO: 235580 - RNA, 22 nt, Human
uccacagguauuucuccuugcu

SEQ ID NO: 235581 - RNA, 22 nt, Human
cuggcuccaucuuugcuuccug

SEQ ID NO: 235582 - RNA, 22 nt, Human
auacagcagugaauaagauaaa

SEQ ID NO: 235583 - RNA, 20 nt, Human
agcaaacaggcuccaccaga

SEQ ID NO: 235584 - RNA, 22 nt, Human
cacugcccaccaaguggcuggu

SEQ ID NO: 235585 - RNA, 19 nt, Human
acauucccaucagcaaugu

SEQ ID NO: 235586 - RNA, 22 nt, Human
ggaguguggagaggacaugggu

SEQ ID NO: 235587 - RNA, 22 nt, Human
ugcaaauucagaagaacugccc

SEQ ID NO: 235588 - RNA, 21 nt, Human
cagagccagacugcugaauuu

SEQ ID NO: 235589 - RNA, 21 nt, Human
ggcacagccugaaaugccuca

SEQ ID NO: 235590 - RNA, 22 nt, Human
gagagucuaggaaccucauaua

SEQ ID NO: 235591 - RNA, 22 nt, Human
gagucagaaaguagugugccua

SEQ ID NO: 235592 - RNA, 19 nt, Human
augauacaggugaaaauug

SEQ ID NO: 235593 - RNA, 22 nt, Human
ucuggcaggucaaucauucuuu

SEQ ID NO: 235594 - RNA, 22 nt, Human
gcagagucagguccaaggacug

SEQ ID NO: 235595 - RNA, 22 nt, Human
ugaaccaucuggcuccagaaga

SEQ ID NO: 235596 - RNA, 22 nt, Human
gggcugugcugaguaggaggug

SEQ ID NO: 235597 - RNA, 22 nt, Human
cugguuuauaaaucuguggcca

SEQ ID NO: 235598 - RNA, 22 nt, Human
aauuaaaaaaggagagcuugcu

SEQ ID NO: 235599 - RNA, 22 nt, Human
acuuguuucaacuguacucucc

SEQ ID NO: 235600 - RNA, 22 nt, Human
auagcaaauauuuuaaugagca

SEQ ID NO: 235601 - RNA, 22 nt, Human
uugcauggaggaacauggccca

SEQ ID NO: 235602 - RNA, 22 nt, Human
gcacauggcggccagcagguga

SEQ ID NO: 235603 - RNA, 22 nt, Human
ucuuugcaaauguuauuaucuu

SEQ ID NO: 235604 - RNA, 22 nt, Human
ccacaugaugaggaagcugaac

SEQ ID NO: 235605 - RNA, 17 nt, Human
uaaagccagucaaguca

SEQ ID NO: 235606 - RNA, 22 nt, Human
ucucuguagcagcuuccuuccu

SEQ ID NO: 235607 - RNA, 22 nt, Human
caacugccauacagcuccaugg

SEQ ID NO: 235608 - RNA, 22 nt, Human
guagcacaugauuuugauaugu

SEQ ID NO: 235609 - RNA, 22 nt, Human
uccauacauaaaauguuuaaug

SEQ ID NO: 235610 - RNA, 22 nt, Human
ggaggccuagaaaagugguucu

SEQ ID NO: 235611 - RNA, 22 nt, Human
aaggaagagcaaagaauuaugu

SEQ ID NO: 235612 - RNA, 22 nt, Human
caucuucugggacuucucaguu

SEQ ID NO: 235613 - RNA, 17 nt, Human
ugcauguccuuuguucc

SEQ ID NO: 235614 - RNA, 22 nt, Human
ggcccagccuggcaacaaugac

SEQ ID NO: 235615 - RNA, 22 nt, Human
uugguaaaaucauagugguaac

SEQ ID NO: 235616 - RNA, 22 nt, Human
ucauuauuuuggacuggagugu

SEQ ID NO: 235617 - RNA, 22 nt, Human
ggugcugauaguaacaauaaua

SEQ ID NO: 235618 - RNA, 22 nt, Human
uagguggugugcgaagagcgug

SEQ ID NO: 235619 - RNA, 22 nt, Human
gugaaaaaugauuuguuaacug

SEQ ID NO: 235620 - RNA, 22 nt, Human
aaaggcuuguuugaggacuggu

SEQ ID NO: 235621 - RNA, 22 nt, Human
gcuccaggagagggaagcagau

SEQ ID NO: 235622 - RNA, 22 nt, Human
cuggcuccacucccugccugac

SEQ ID NO: 235623 - RNA, 22 nt, Human
ggugggaaggggccagugugcg

SEQ ID NO: 235624 - RNA, 21 nt, Human
uuccuggggaaggagcugccu

SEQ ID NO: 235625 - RNA, 22 nt, Human
ucaaacugaauuaaacacuugu

SEQ ID NO: 235626 - RNA, 19 nt, Human
uaacugguuaaaaagcuug

SEQ ID NO: 235627 - RNA, 22 nt, Human
augguuauuacugcuguuccag

SEQ ID NO: 235628 - RNA, 22 nt, Human
gauaauuauaggcuaagccacu

SEQ ID NO: 235629 - RNA, 22 nt, Human
ugugcugggagauagagggagg

SEQ ID NO: 235630 - RNA, 22 nt, Human
uucacagugagcuaugucuugu

SEQ ID NO: 235631 - RNA, 22 nt, Human
cccaggugcugaaggaggccgc

SEQ ID NO: 235632 - RNA, 22 nt, Human
gcaaaauuuacacuccuucuuc

SEQ ID NO: 235633 - RNA, 22 nt, Human
ucuggaauaggacaaaaccaaa

SEQ ID NO: 235634 - RNA, 22 nt, Human
ggcccagagggguugagcaucu

SEQ ID NO: 235635 - RNA, 22 nt, Human
cugggccugugggcacacggac

SEQ ID NO: 235636 - RNA, 22 nt, Human
caagagcugaggcuggagaggu

SEQ ID NO: 235637 - RNA, 22 nt, Human
uaauaauuggcuaacccuggga

SEQ ID NO: 235638 - RNA, 22 nt, Human
uuacaaagaaaauuaggcauuu

SEQ ID NO: 235639 - RNA, 22 nt, Human
uuuguacauauaaaucuuguau

SEQ ID NO: 235640 - RNA, 22 nt, Human
acuggcuggccgcgcucuucgc

SEQ ID NO: 235641 - RNA, 22 nt, Human
uuucuacaugucaguaacugau

SEQ ID NO: 235642 - RNA, 22 nt, Human
ccucacccacuacacucaaggg

SEQ ID NO: 235643 - RNA, 22 nt, Human
ggcuguauauacuguauacagu

SEQ ID NO: 235644 - RNA, 22 nt, Human
uucucucugagagcaucuggaa

SEQ ID NO: 235645 - RNA, 23 nt, Human
ccaaaagcgagucuguuguuccc

SEQ ID NO: 235646 - RNA, 22 nt, Human
ugucagcuggagauggcauggg

SEQ ID NO: 235647 - RNA, 22 nt, Human
ccagggcaauaggaacacuuuu

SEQ ID NO: 235648 - RNA, 22 nt, Human
ugcuuucagauaucuguuucaa

SEQ ID NO: 235649 - RNA, 22 nt, Human
ugccagguacacaaguagccag

SEQ ID NO: 235650 - RNA, 22 nt, Human
ggccuugcggaacgcucaggcg

SEQ ID NO: 235651 - RNA, 22 nt, Human
auggaaauacacaagagguuuc

SEQ ID NO: 235652 - RNA, 21 nt, Human
uguucagaccaacuuggacug

SEQ ID NO: 235653 - RNA, 22 nt, Human
guacauguaugagauaugugua

SEQ ID NO: 235654 - RNA, 22 nt, Human
uggaaaacauugagauaccaag

SEQ ID NO: 235655 - RNA, 22 nt, Human
ugucacuuuggggagaguuuug

SEQ ID NO: 235656 - RNA, 22 nt, Human
ugcuuccuauccacacaaugcc

SEQ ID NO: 235657 - RNA, 22 nt, Human
gucugcagacaacuuagaagca

SEQ ID NO: 235658 - RNA, 22 nt, Human
aauuagggaaaacauuugcuuu

SEQ ID NO: 235659 - RNA, 22 nt, Human
uuacuacaagauucuguuuuau

SEQ ID NO: 235660 - RNA, 22 nt, Human
cuuauucagcaaguuuggguac

SEQ ID NO: 235661 - RNA, 22 nt, Human
aacaguaaagacagaauuuauc

SEQ ID NO: 235662 - RNA, 22 nt, Human
auugcuggcaucagugacaaua

SEQ ID NO: 235663 - RNA, 22 nt, Human
ccuccaggccuugcagguuaac

SEQ ID NO: 235664 - RNA, 18 nt, Human
cugccacuuaauguggug

SEQ ID NO: 235665 - RNA, 22 nt, Human
gacacaggauuccuggcucugc

SEQ ID NO: 235666 - RNA, 22 nt, Human
uagagguguucauucucuccau

SEQ ID NO: 235667 - RNA, 22 nt, Human
ucaggcuugucucuagagcaau

SEQ ID NO: 235668 - RNA, 22 nt, Human
guuuuggagucaggcuuagaug

SEQ ID NO: 235669 - RNA, 22 nt, Human
cuguacagaccuauuagcccag

SEQ ID NO: 235670 - RNA, 22 nt, Human
gcugaagguguguggagagagg

SEQ ID NO: 235671 - RNA, 22 nt, Human
uagacaggguggcuuagaaaca

SEQ ID NO: 235672 - RNA, 22 nt, Human
uucuuagaagaaacaucuaaaa

SEQ ID NO: 235673 - RNA, 23 nt, Human
acugagcauuaguauuuuuauaa

SEQ ID NO: 235674 - RNA, 22 nt, Human
aggcuccugcaggugaggugcu

SEQ ID NO: 235675 - RNA, 22 nt, Human
ugaaaucuuauacuuugguagu

SEQ ID NO: 235676 - RNA, 22 nt, Human
ucugagagauacaaggaggcaa

SEQ ID NO: 235677 - RNA, 22 nt, Human
gauguuuauaucuaacuuaagu

SEQ ID NO: 235678 - RNA, 22 nt, Human
agacauaggauuccacauagca

SEQ ID NO: 235679 - RNA, 18 nt, Human
cccuuagccuuuccucuc

SEQ ID NO: 235680 - RNA, 22 nt, Human
gcucagaggaggccuuuaccua

SEQ ID NO: 235681 - RNA, 22 nt, Human
ugcugaggaaagaggauaaaag

SEQ ID NO: 235682 - RNA, 22 nt, Human
acacagaugauguuccaggaac

SEQ ID NO: 235683 - RNA, 22 nt, Human
ugagcucucagggacagacuau

SEQ ID NO: 235684 - RNA, 22 nt, Human
uucugagaugugaaucugucaa

SEQ ID NO: 235685 - RNA, 22 nt, Human
agggaaggcuuuugacauuucc

SEQ ID NO: 235686 - RNA, 22 nt, Human
aacaagaacaccuacaguucua

SEQ ID NO: 235687 - RNA, 22 nt, Human
uuucuucuugauuuaaacaggg

SEQ ID NO: 235688 - RNA, 22 nt, Human
agggcaugcuggaggagagaca

SEQ ID NO: 235689 - RNA, 22 nt, Human
acauauauuuucacacaugguu

SEQ ID NO: 235690 - RNA, 22 nt, Human
agaggggaaggaugugauguga

SEQ ID NO: 235691 - RNA, 18 nt, Human
ccucagaggcaaauuguu

SEQ ID NO: 235692 - RNA, 21 nt, Human
agcugggccucagccugcagu

SEQ ID NO: 235693 - RNA, 22 nt, Human
uggcccuguucuguaccucaua

SEQ ID NO: 235694 - RNA, 22 nt, Human
cuucccuuuuuaugucuucagc

SEQ ID NO: 235695 - RNA, 22 nt, Human
ugagcuggaggacaggagggua

SEQ ID NO: 235696 - RNA, 22 nt, Human
aacugcauuuaacaaauacucu

SEQ ID NO: 235697 - RNA, 22 nt, Human
cuuugaaaaaugguuuccuaga

SEQ ID NO: 235698 - RNA, 19 nt, Human
ccaggccuggcgucuccgc

SEQ ID NO: 235699 - RNA, 22 nt, Human
cacagagcugaaccugggucau

SEQ ID NO: 235700 - RNA, 22 nt, Human
gagccaccuucaacucaggaau

SEQ ID NO: 235701 - RNA, 22 nt, Human
ucugaagagaaugcugcugaac

SEQ ID NO: 235702 - RNA, 22 nt, Human
ugagcagugaugcguuuuguuu

SEQ ID NO: 235703 - RNA, 22 nt, Human
cagcacugcugcuguacacaca

SEQ ID NO: 235704 - RNA, 22 nt, Human
uugaaugaccaugaugcaaggg

SEQ ID NO: 235705 - RNA, 22 nt, Human
gaugaugagauaaggauaacuu

SEQ ID NO: 235706 - RNA, 22 nt, Human
gccuuuaucccuguacaaggug

SEQ ID NO: 235707 - RNA, 22 nt, Human
uaauaagcguagaagguauauc

SEQ ID NO: 235708 - RNA, 22 nt, Human
ucuccagggcccccgagcguug

SEQ ID NO: 235709 - RNA, 22 nt, Human
uggcagauaaaauaauagggaa

SEQ ID NO: 235710 - RNA, 22 nt, Human
auuucccuccagggaaagcuua

SEQ ID NO: 235711 - RNA, 22 nt, Human
gcccaggaguuggaggcugcag

SEQ ID NO: 235712 - RNA, 23 nt, Human
acuugauuauuguugauagauuc

SEQ ID NO: 235713 - RNA, 22 nt, Human
gaggcgagaagcuggagauggu

SEQ ID NO: 235714 - RNA, 22 nt, Human
ccacaguuauucauuugugaca

SEQ ID NO: 235715 - RNA, 22 nt, Human
caggcuggagugcaauggugcu

SEQ ID NO: 235716 - RNA, 22 nt, Human
ugcugcaggaauucucaaggga

SEQ ID NO: 235717 - RNA, 22 nt, Human
uaacacugauuuguucucaggg

SEQ ID NO: 235718 - RNA, 22 nt, Human
aaaguguuaacacuggcuacuu

SEQ ID NO: 235719 - RNA, 22 nt, Human
auuccaguuggguucuaauaca

SEQ ID NO: 235720 - RNA, 22 nt, Human
gauaauuuuagucugaaaauug

SEQ ID NO: 235721 - RNA, 22 nt, Human
cagcuugggucaggugccugcu

SEQ ID NO: 235722 - RNA, 22 nt, Human
uaguguauguucagcuuauaug

SEQ ID NO: 235723 - RNA, 22 nt, Human
ugauuuacccguccaggcccua

SEQ ID NO: 235724 - RNA, 22 nt, Human
ucagucuucuaaagggaugcaa

SEQ ID NO: 235725 - RNA, 22 nt, Human
gagcugugaaaagugccugggg

SEQ ID NO: 235726 - RNA, 22 nt, Human
ugggcagcagcaaagccagacu

SEQ ID NO: 235727 - RNA, 22 nt, Human
agaacagaugugggcagaccug

SEQ ID NO: 235728 - RNA, 22 nt, Human
aaaguaguauaaaauucaugug

SEQ ID NO: 235729 - RNA, 22 nt, Human
uggcugagagucauccugugug

SEQ ID NO: 235730 - RNA, 22 nt, Human
aguggcuggaauugcaggugcg

SEQ ID NO: 235731 - RNA, 22 nt, Human
cagauaauaauaugacuucacu

SEQ ID NO: 235732 - RNA, 22 nt, Human
ccucaggcuuaacuugucuuga

SEQ ID NO: 235733 - RNA, 22 nt, Human
aagaaaugcagaaaugugcugg

SEQ ID NO: 235734 - RNA, 22 nt, Human
auugcugguagucagugucccu

SEQ ID NO: 235735 - RNA, 22 nt, Human
aaacugguuucugagauggaac

SEQ ID NO: 235736 - RNA, 18 nt, Human
agcuucccucugagaggg

SEQ ID NO: 235737 - RNA, 19 nt, Human
auggaaaaugccagacuga

SEQ ID NO: 235738 - RNA, 22 nt, Human
uucuaaaauaaguuuaucuggu

SEQ ID NO: 235739 - RNA, 22 nt, Human
uagcagcacauggugguuuuau

SEQ ID NO: 235740 - RNA, 22 nt, Human
caaggccacuccagagacuggu

SEQ ID NO: 235741 - RNA, 22 nt, Human
uuuuaauuuuagcccuucuggu

SEQ ID NO: 235742 - RNA, 22 nt, Human
ugcccugugugugcaagcacug

SEQ ID NO: 235743 - RNA, 22 nt, Human
aguccucugcugugcgucuuug

SEQ ID NO: 235744 - RNA, 22 nt, Human
cuggcaugcuaauacagccugu

SEQ ID NO: 235745 - RNA, 22 nt, Human
cuuguuaaauuauauaagcaga

SEQ ID NO: 235746 - RNA, 21 nt, Human
acugccuggggugcuggccaa

SEQ ID NO: 235747 - RNA, 22 nt, Human
ggcccagaauacuuuguaaaau

SEQ ID NO: 235748 - RNA, 22 nt, Human
gaggguccccaugcagagcuca

SEQ ID NO: 235749 - RNA, 19 nt, Human
cuggugaggguuauugaua

SEQ ID NO: 235750 - RNA, 22 nt, Human
ucuggagagcagaugccucugg

SEQ ID NO: 235751 - RNA, 22 nt, Human
cauaaucccccauuugugacau

SEQ ID NO: 235752 - RNA, 22 nt, Human
cucccugcuuguuucccuucag

SEQ ID NO: 235753 - RNA, 22 nt, Human
guguacagauaucucacguucu

SEQ ID NO: 235754 - RNA, 22 nt, Human
agguccagacuguguacccuag

SEQ ID NO: 235755 - RNA, 22 nt, Human
ccccuggguccaggcuucucug

SEQ ID NO: 235756 - RNA, 22 nt, Human
cccaggcuccuagaggcccaga

SEQ ID NO: 235757 - RNA, 22 nt, Human
auucagcauaaucaguagcuug

SEQ ID NO: 235758 - RNA, 22 nt, Human
ggcuguugacagacauagguuu

SEQ ID NO: 235759 - RNA, 22 nt, Human
uguucauuccggggagggcuaa

SEQ ID NO: 235760 - RNA, 22 nt, Human
auuuccuaauuuagggauagac

SEQ ID NO: 235761 - RNA, 22 nt, Human
caguuucuacgacuuaagcaca

SEQ ID NO: 235762 - RNA, 22 nt, Human
gccaggacuagagggaggugag

SEQ ID NO: 235763 - RNA, 18 nt, Human
cagagcaguaugaauguu

SEQ ID NO: 235764 - RNA, 22 nt, Human
aggcucuggaguuagccaggca

SEQ ID NO: 235765 - RNA, 22 nt, Human
auauuacacacgguaucacggg

SEQ ID NO: 235766 - RNA, 22 nt, Human
cacccccaccugugggcuccug

SEQ ID NO: 235767 - RNA, 22 nt, Human
augacagaugcuguggggaggu

SEQ ID NO: 235768 - RNA, 22 nt, Human
ugcuccuggcaucucugcgucc

SEQ ID NO: 235769 - RNA, 23 nt, Human
ggagaggggugugggcaucuuua

SEQ ID NO: 235770 - RNA, 22 nt, Human
gacaauuagguuaagagcaaga

SEQ ID NO: 235771 - RNA, 22 nt, Human
uaguuuagcauacaucuucagg

SEQ ID NO: 235772 - RNA, 22 nt, Human
cacauacauacguauguauaca

SEQ ID NO: 235773 - RNA, 22 nt, Human
cacuugaagugaauugcucacc

SEQ ID NO: 235774 - RNA, 22 nt, Human
auauuaaugagcaaguaaguga

SEQ ID NO: 235775 - RNA, 22 nt, Human
uucuucaauuuuccauauacug

SEQ ID NO: 235776 - RNA, 22 nt, Human
caucaguggauauagauuagcg

SEQ ID NO: 235777 - RNA, 22 nt, Human
acccugggaccuggagguggau

SEQ ID NO: 235778 - RNA, 22 nt, Human
cagggaugcuguuaaacauccu

SEQ ID NO: 235779 - RNA, 22 nt, Human
ugcacacacaugaaguagcaug

SEQ ID NO: 235780 - RNA, 22 nt, Human
auugacaaaucugaacauacgg

SEQ ID NO: 235781 - RNA, 22 nt, Human
gauacagcucuggccagaugug

SEQ ID NO: 235782 - RNA, 22 nt, Human
aaagucuuucucauuggccaug

SEQ ID NO: 235783 - RNA, 22 nt, Human
gcacaggaggccgaugcucaug

SEQ ID NO: 235784 - RNA, 22 nt, Human
ucaggaaagaguguauccauca

SEQ ID NO: 235785 - RNA, 22 nt, Human
agagcccaucaguggcagugga

SEQ ID NO: 235786 - RNA, 22 nt, Human
ccuuaauuucuguccuucagau

SEQ ID NO: 235787 - RNA, 22 nt, Human
uuccuucucuguggggaaggca

SEQ ID NO: 235788 - RNA, 21 nt, Human
guggagagugauuuugaugca

SEQ ID NO: 235789 - RNA, 22 nt, Human
ucauguguugcacugaggaccu

SEQ ID NO: 235790 - RNA, 22 nt, Human
gaagacacaauuggugggucca

SEQ ID NO: 235791 - RNA, 22 nt, Human
gacacagaugaucaggugugga

SEQ ID NO: 235792 - RNA, 22 nt, Human
gaacuguaguuaauacuacaca

SEQ ID NO: 235793 - RNA, 21 nt, Human
cggaaacucggcucugguucc

SEQ ID NO: 235794 - RNA, 22 nt, Human
ggaucaaagggaaccuguuagg

SEQ ID NO: 235795 - RNA, 22 nt, Human
acucaggcuguuuuuuccuugu

SEQ ID NO: 235796 - RNA, 22 nt, Human
ggcuggucucagugcuggguuc

SEQ ID NO: 235797 - RNA, 21 nt, Human
gacacaaaggguaguaauggu

SEQ ID NO: 235798 - RNA, 22 nt, Human
gagacucuugcuuuaauagccc

SEQ ID NO: 235799 - RNA, 22 nt, Human
auucagcaguuccugcuucagu

SEQ ID NO: 235800 - RNA, 22 nt, Human
acacagaguauuuagaaggggu

SEQ ID NO: 235801 - RNA, 22 nt, Human
ugcugaaaaugcguaucuucca

SEQ ID NO: 235802 - RNA, 22 nt, Human
uuaggaauauuuucugaguagu

SEQ ID NO: 235803 - RNA, 22 nt, Human
uaugcauaugaccccaagcuug

SEQ ID NO: 235804 - RNA, 22 nt, Human
aagcuguagcuuuucaaaacgu

SEQ ID NO: 235805 - RNA, 22 nt, Human
aagggugguguaggagaucaaa

SEQ ID NO: 235806 - RNA, 22 nt, Human
uagaaagugguugagaguuuag

SEQ ID NO: 235807 - RNA, 22 nt, Human
aucuccagcuggcugugauaaa

SEQ ID NO: 235808 - RNA, 22 nt, Human
uaccagccugacccugucugac

SEQ ID NO: 235809 - RNA, 22 nt, Human
uaguuaaagauucuguuaagag

SEQ ID NO: 235810 - RNA, 22 nt, Human
cuggaggccacuguacagauug

SEQ ID NO: 235811 - RNA, 22 nt, Human
gcccaagguauaucagagacag

SEQ ID NO: 235812 - RNA, 22 nt, Human
uacacaggggagcaugguugac

SEQ ID NO: 235813 - RNA, 22 nt, Human
gcugauagacugaauguuggga

SEQ ID NO: 235814 - RNA, 22 nt, Human
cagaggcugcucuggguggcau

SEQ ID NO: 235815 - RNA, 22 nt, Human
aauugcuugucuucuucccuac

SEQ ID NO: 235816 - RNA, 22 nt, Human
gggagugguugauggugaaaau

SEQ ID NO: 235817 - RNA, 22 nt, Human
uuuuacagucagucaaacucag

SEQ ID NO: 235818 - RNA, 22 nt, Human
cagagcaggaauaggguguuga

SEQ ID NO: 235819 - RNA, 22 nt, Human
uuugcagaagaaaacaugaaca

SEQ ID NO: 235820 - RNA, 22 nt, Human
ucuggguccccgaggaaggaga

SEQ ID NO: 235821 - RNA, 22 nt, Human
uaaucuaucaagcaacaaagug

SEQ ID NO: 235822 - RNA, 22 nt, Human
uggcagguggagacagcagagc

SEQ ID NO: 235823 - RNA, 22 nt, Human
acucuggcacuggguaccucag

SEQ ID NO: 235824 - RNA, 22 nt, Human
uggccucugggaaagcagauuc

SEQ ID NO: 235825 - RNA, 22 nt, Human
cagcccucagguccucagcagc

SEQ ID NO: 235826 - RNA, 22 nt, Human
ugugaggguuuuaagggaauga

SEQ ID NO: 235827 - RNA, 21 nt, Human
uccaggacuugagaauuccag

SEQ ID NO: 235828 - RNA, 22 nt, Human
uucacauuccgcggcuauuuuc

SEQ ID NO: 235829 - RNA, 22 nt, Human
caggcuucaugaauuaugcacc

SEQ ID NO: 235830 - RNA, 22 nt, Human
ccccacucucggccagauaggc

SEQ ID NO: 235831 - RNA, 22 nt, Human
acaaguauuuaagguuaguaua

SEQ ID NO: 235832 - RNA, 22 nt, Human
gaggccaggaggaucucucuaa

SEQ ID NO: 235833 - RNA, 22 nt, Human
uauguacacuuaaguuugagaa

SEQ ID NO: 235834 - RNA, 22 nt, Human
agagaccuuuguuauucuagga

SEQ ID NO: 235835 - RNA, 22 nt, Human
cuuccauaaucuuguuuauuua

SEQ ID NO: 235836 - RNA, 22 nt, Human
acacaugauaagaaaguuuaaa

SEQ ID NO: 235837 - RNA, 22 nt, Human
aacuuuaucggaacagguacuc

SEQ ID NO: 235838 - RNA, 22 nt, Human
ggggaaagugaauuguguagug

SEQ ID NO: 235839 - RNA, 19 nt, Human
ucagggccaugagcgccac

SEQ ID NO: 235840 - RNA, 22 nt, Human
auuggucuaaaguuaagaagau

SEQ ID NO: 235841 - RNA, 22 nt, Human
uugaaaggugaacaugaugcac

SEQ ID NO: 235842 - RNA, 22 nt, Human
uaguuacagugcauagcaagau

SEQ ID NO: 235843 - RNA, 22 nt, Human
ggggugggguuacucauugugc

SEQ ID NO: 235844 - RNA, 22 nt, Human
ugccuucaagacccauccucca

SEQ ID NO: 235845 - RNA, 22 nt, Human
agaggcuccgucaucccucuuu

SEQ ID NO: 235846 - RNA, 22 nt, Human
gucuucuguuuacuuugaaguu

SEQ ID NO: 235847 - RNA, 22 nt, Human
ucucuggcugauauuccucugc

SEQ ID NO: 235848 - RNA, 22 nt, Human
aucuagaagccugagccaagau

SEQ ID NO: 235849 - RNA, 21 nt, Human
uuggcugccugagauuagaau

SEQ ID NO: 235850 - RNA, 22 nt, Human
uuaacaugucuugacuucaucu

SEQ ID NO: 235851 - RNA, 21 nt, Human
aacagugcuuaguagauguuc

SEQ ID NO: 235852 - RNA, 22 nt, Human
ugaaacaauuagaauguaauga

SEQ ID NO: 235853 - RNA, 22 nt, Human
aguaggcagaaguggcauucgg

SEQ ID NO: 235854 - RNA, 20 nt, Human
uugcagcagugaggugaagg

SEQ ID NO: 235855 - RNA, 22 nt, Human
ugaaucuuuuuggaaauaaaga

SEQ ID NO: 235856 - RNA, 22 nt, Human
cccuucaagcucucuggguuuu

SEQ ID NO: 235857 - RNA, 22 nt, Human
uuguuucagcuguaugcuaugu

SEQ ID NO: 235858 - RNA, 22 nt, Human
gaggcccaaggacucugucccg

SEQ ID NO: 235859 - RNA, 22 nt, Human
gagcugggacuuggaauccaca

SEQ ID NO: 235860 - RNA, 22 nt, Human
uuucauguggcgaugucucugg

SEQ ID NO: 235861 - RNA, 22 nt, Human
uacaccagaaucucugugggga

SEQ ID NO: 235862 - RNA, 21 nt, Human
agagaagggacucuuccaguc

SEQ ID NO: 235863 - RNA, 22 nt, Human
agcccugcccugccauguggca

SEQ ID NO: 235864 - RNA, 22 nt, Human
cacagcaaagacacucucaacu

SEQ ID NO: 235865 - RNA, 22 nt, Human
uugguggagucauuggcauaug

SEQ ID NO: 235866 - RNA, 17 nt, Human
cugucugcgcaugaggu

SEQ ID NO: 235867 - RNA, 22 nt, Human
ugaggcagugauguuuaagcac

SEQ ID NO: 235868 - RNA, 22 nt, Human
caaaugaagguggugggucauu

SEQ ID NO: 235869 - RNA, 22 nt, Human
acaguguuuucuuaaggagaaa

SEQ ID NO: 235870 - RNA, 22 nt, Human
ggggugggagugccauccuuga

SEQ ID NO: 235871 - RNA, 22 nt, Human
caagauuuauauuuucacacaa

SEQ ID NO: 235872 - RNA, 22 nt, Human
gucuguagaauaaauaugagua

SEQ ID NO: 235873 - RNA, 20 nt, Human
gcccaggaucucugaggcau

SEQ ID NO: 235874 - RNA, 20 nt, Human
aauuuuaucuccauccuuug

SEQ ID NO: 235875 - RNA, 22 nt, Human
ggaaaggagauauuggagagug

SEQ ID NO: 235876 - RNA, 22 nt, Human
cuccccgagagagguuguccgc

SEQ ID NO: 235877 - RNA, 22 nt, Human
gaacaguagaugagaugcuaga

SEQ ID NO: 235878 - RNA, 22 nt, Human
gauggugcaggugaagugcugg

SEQ ID NO: 235879 - RNA, 22 nt, Human
gccucuggucccucaugcugug

SEQ ID NO: 235880 - RNA, 22 nt, Human
gucaaaaugagcuuuguuauug

SEQ ID NO: 235881 - RNA, 22 nt, Human
uguuacagugacuaauguuuua

SEQ ID NO: 235882 - RNA, 22 nt, Human
gggucuucugauauagguccag

SEQ ID NO: 235883 - RNA, 22 nt, Human
uacaacgugggacuuuguuucu

SEQ ID NO: 235884 - RNA, 22 nt, Human
aaacuggguuguggucaguggu

SEQ ID NO: 235885 - RNA, 22 nt, Human
guacucaguaauauaacauauu

SEQ ID NO: 235886 - RNA, 22 nt, Human
agauguggaaagaaguuagaag

SEQ ID NO: 235887 - RNA, 22 nt, Human
uucaauacaaagaaaggaauuu

SEQ ID NO: 235888 - RNA, 22 nt, Human
uccugggaugcauaaaauaugu

SEQ ID NO: 235889 - RNA, 22 nt, Human
uaaggcaaagaaccauaguaau

SEQ ID NO: 235890 - RNA, 22 nt, Human
uccaggcuacuuggauuccugg

SEQ ID NO: 235891 - RNA, 22 nt, Human
cagguggugccuccucccuucc

SEQ ID NO: 235892 - RNA, 22 nt, Human
uccuggcugucacucggguuga

SEQ ID NO: 235893 - RNA, 22 nt, Human
cuguccagcugaccagagcagc

SEQ ID NO: 235894 - RNA, 22 nt, Human
ugaggaggugggcacacagagu

SEQ ID NO: 235895 - RNA, 22 nt, Human
uuguaacagcugcuuaauagag

SEQ ID NO: 235896 - RNA, 18 nt, Human
uguuuccuccuggaggcu

SEQ ID NO: 235897 - RNA, 22 nt, Human
uucuguaggcauggaacaggga

SEQ ID NO: 235898 - RNA, 19 nt, Human
ugcuagaaauucugugacu

SEQ ID NO: 235899 - RNA, 22 nt, Human
uggcccugacagguccugggca

SEQ ID NO: 235900 - RNA, 22 nt, Human
gcagagcugggauuuguacugg

SEQ ID NO: 235901 - RNA, 22 nt, Human
aagcagcuuaaauuagagccug

SEQ ID NO: 235902 - RNA, 23 nt, Human
aacugcaagguugcugggaagua

SEQ ID NO: 235903 - RNA, 22 nt, Human
ccaggccccagggcuggcuuuc

SEQ ID NO: 235904 - RNA, 22 nt, Human
uauuacagcuuugauuaucugg

SEQ ID NO: 235905 - RNA, 22 nt, Human
acagcuuugggcaaugcuauga

SEQ ID NO: 235906 - RNA, 22 nt, Human
uuguggcaugugagaacuagaa

SEQ ID NO: 235907 - RNA, 22 nt, Human
cuggcucaggguggucuggguc

SEQ ID NO: 235908 - RNA, 22 nt, Human
agcaacaggaauauuauggcaa

SEQ ID NO: 235909 - RNA, 22 nt, Human
ugaucuuugguaguacgauaau

SEQ ID NO: 235910 - RNA, 22 nt, Human
gcuggggcugggcugaggaaga

SEQ ID NO: 235911 - RNA, 22 nt, Human
acccagggaccccgcugacgcc

SEQ ID NO: 235912 - RNA, 22 nt, Human
gucauuuuaugggaacagauuu

SEQ ID NO: 235913 - RNA, 22 nt, Human
cccagaugcagguucaagagua

SEQ ID NO: 235914 - RNA, 22 nt, Human
cagaagcaagggccaaagucuu

SEQ ID NO: 235915 - RNA, 22 nt, Human
cugggugaguauaggaaaggga

SEQ ID NO: 235916 - RNA, 22 nt, Human
caugaaggcugccagcaggcau

SEQ ID NO: 235917 - RNA, 22 nt, Human
cagagggcuguguaaggauguu

SEQ ID NO: 235918 - RNA, 22 nt, Human
aaacacauuagcccuguggaaa

SEQ ID NO: 235919 - RNA, 22 nt, Human
ugauuauauuaacuauguuccu

SEQ ID NO: 235920 - RNA, 22 nt, Human
acaauuagugaucagugaugcc

SEQ ID NO: 235921 - RNA, 22 nt, Human
gccaugaguaaacuggaaagcc

SEQ ID NO: 235922 - RNA, 22 nt, Human
gguaggaguauuuugcagcagu

SEQ ID NO: 235923 - RNA, 22 nt, Human
ggcuuugcuuaacgugcuucua

SEQ ID NO: 235924 - RNA, 22 nt, Human
ccuggcucccccaucauagcug

SEQ ID NO: 235925 - RNA, 22 nt, Human
uuggaggaaauugcuuuugugg

SEQ ID NO: 235926 - RNA, 22 nt, Human
ggccugagcuugggcagcguau

SEQ ID NO: 235927 - RNA, 22 nt, Human
agacaucuaccuuucauucaaa

SEQ ID NO: 235928 - RNA, 22 nt, Human
gcaggaguuaggcgucguggau

SEQ ID NO: 235929 - RNA, 22 nt, Human
agucuuuccuuuuggaagaaaa

SEQ ID NO: 235930 - RNA, 22 nt, Human
agaccacuuggauaagaaacag

SEQ ID NO: 235931 - RNA, 22 nt, Human
caggcacgguggcucaugccug

SEQ ID NO: 235932 - RNA, 18 nt, Human
ggcagccuggacaugcuc

SEQ ID NO: 235933 - RNA, 22 nt, Human
aaagcaaugcuuguggaaugua

SEQ ID NO: 235934 - RNA, 22 nt, Human
cuucuuuagggaucucuugcug

SEQ ID NO: 235935 - RNA, 22 nt, Human
cuagcacuuagggauuguuaug

SEQ ID NO: 235936 - RNA, 22 nt, Human
gggcucagccuccucacuucga

SEQ ID NO: 235937 - RNA, 22 nt, Human
guccagugacaaguagcuggcc

SEQ ID NO: 235938 - RNA, 22 nt, Human
cuggguguucaggagcugggcu

SEQ ID NO: 235939 - RNA, 22 nt, Human
caggcuccacaggggaauccgg

SEQ ID NO: 235940 - RNA, 22 nt, Human
uggauuugcuaccuucugauau

SEQ ID NO: 235941 - RNA, 22 nt, Human
ucugcuguuuacugugugauau

SEQ ID NO: 235942 - RNA, 22 nt, Human
uugguuuaucuguggaucucuu

SEQ ID NO: 235943 - RNA, 22 nt, Human
cuggugcauguggccuugcucu

SEQ ID NO: 235944 - RNA, 22 nt, Human
ucuuuccacagcauguccaugc

SEQ ID NO: 235945 - RNA, 22 nt, Human
gaaaggcaucuucagucucuga

SEQ ID NO: 235946 - RNA, 22 nt, Human
agucugucagucauucuaacaa

SEQ ID NO: 235947 - RNA, 22 nt, Human
uuggaggauaaggauauugauu

SEQ ID NO: 235948 - RNA, 20 nt, Human
agccugcuguagaaguuugg

SEQ ID NO: 235949 - RNA, 22 nt, Human
cauggaaugguugaaugacgaa

SEQ ID NO: 235950 - RNA, 22 nt, Human
aaccagcuaacauguggaauga

SEQ ID NO: 235951 - RNA, 22 nt, Human
ugcauaaacagauacuucaugu

SEQ ID NO: 235952 - RNA, 22 nt, Human
uuaagcauggaagugaaauaau

SEQ ID NO: 235953 - RNA, 22 nt, Human
agcaggcuccuuccuucucugg

SEQ ID NO: 235954 - RNA, 22 nt, Human
ggacacaaaagugaauaaaaua

SEQ ID NO: 235955 - RNA, 22 nt, Human
gcuuagcaaacaucuguagucc

SEQ ID NO: 235956 - RNA, 22 nt, Human
uugcaugcuagaaagauugauu

SEQ ID NO: 235957 - RNA, 22 nt, Human
cagcuggcagaaccugcaucca

SEQ ID NO: 235958 - RNA, 20 nt, Human
ucccaggcuccacccuagac

SEQ ID NO: 235959 - RNA, 23 nt, Human
gagcucugcacuaggcccuggga

SEQ ID NO: 235960 - RNA, 22 nt, Human
agccugugugcuuuggacaggg

SEQ ID NO: 235961 - RNA, 22 nt, Human
auuuuccuagucaugugcuucu

SEQ ID NO: 235962 - RNA, 17 nt, Human
gggugggcacugcuggc

SEQ ID NO: 235963 - RNA, 22 nt, Human
gaaaggcuugagacauugauga

SEQ ID NO: 235964 - RNA, 22 nt, Human
ugcuuuauagacaaggaaguag

SEQ ID NO: 235965 - RNA, 17 nt, Human
uuacagagguaauuaag

SEQ ID NO: 235966 - RNA, 22 nt, Human
guaucuuucccaccaaucacaa

SEQ ID NO: 235967 - RNA, 22 nt, Human
ugccuggcaaugccagaagcca

SEQ ID NO: 235968 - RNA, 23 nt, Human
ucagggcucacacguuuucuggc

SEQ ID NO: 235969 - RNA, 23 nt, Human
augcccugugcagaaauguggaa

SEQ ID NO: 235970 - RNA, 22 nt, Human
uugcaauuaguuacaaaagugg

SEQ ID NO: 235971 - RNA, 22 nt, Human
aguucgagaucugcugaugaga

SEQ ID NO: 235972 - RNA, 22 nt, Human
ucagaaccugcaagucuaaccu

SEQ ID NO: 235973 - RNA, 14 nt, Human
gcaggcagaucacc

SEQ ID NO: 235974 - RNA, 22 nt, Human
ucucccagaaguccucaguaca

SEQ ID NO: 235975 - RNA, 21 nt, Human
ugcaggcuguuuaagaggcaa

SEQ ID NO: 235976 - RNA, 22 nt, Human
augaaagcaagaagugaguuga

SEQ ID NO: 235977 - RNA, 22 nt, Human
gccuguuuccaucaacacaugc

SEQ ID NO: 235978 - RNA, 22 nt, Human
acauugaugugaugcagaagug

SEQ ID NO: 235979 - RNA, 22 nt, Human
uggaggcaggggauacagguca

SEQ ID NO: 235980 - RNA, 22 nt, Human
gacagcagcauaauacaugaac

SEQ ID NO: 235981 - RNA, 22 nt, Human
ccauucuuucagugucucaugu

SEQ ID NO: 235982 - RNA, 22 nt, Human
aggccuuuguggagcucauggc

SEQ ID NO: 235983 - RNA, 22 nt, Human
gaggccuggcugggaggaggug

SEQ ID NO: 235984 - RNA, 22 nt, Human
augguuuaaagaguaugacuuu

SEQ ID NO: 235985 - RNA, 20 nt, Human
aguggggagucaggagugcc

SEQ ID NO: 235986 - RNA, 22 nt, Human
cuuaggaauauccacagcaggu

SEQ ID NO: 235987 - RNA, 22 nt, Human
ucugcacccugaccucuguuuc

SEQ ID NO: 235988 - RNA, 19 nt, Human
agugcauuuuauguuucaa

SEQ ID NO: 235989 - RNA, 22 nt, Human
gagugucacuugaugcagggca

SEQ ID NO: 235990 - RNA, 22 nt, Human
uccugggcuugcuccuccagcu

SEQ ID NO: 235991 - RNA, 22 nt, Human
acagauauaaacuauaguagug

SEQ ID NO: 235992 - RNA, 22 nt, Human
ugaggcucaagaauagacagua

SEQ ID NO: 235993 - RNA, 22 nt, Human
aagaugcuuccacugcaguggc

SEQ ID NO: 235994 - RNA, 21 nt, Human
uucuagaaaaguaugggacug

SEQ ID NO: 235995 - RNA, 22 nt, Human
uccugccuugccugggacauca

SEQ ID NO: 235996 - RNA, 19 nt, Human
aaauaucagagagaugaua

SEQ ID NO: 235997 - RNA, 22 nt, Human
uggagguguggagucaaaggga

SEQ ID NO: 235998 - RNA, 22 nt, Human
ggacacaguggaagacagcuug

SEQ ID NO: 235999 - RNA, 22 nt, Human
aagucucucauggcugacagca

SEQ ID NO: 236000 - RNA, 22 nt, Human
gugguacagcugaaaggcuugc

SEQ ID NO: 236001 - RNA, 20 nt, Human
auaaaauaacugccacaaga

SEQ ID NO: 236002 - RNA, 22 nt, Human
aggaaacuaaggcucagugaag

SEQ ID NO: 236003 - RNA, 22 nt, Human
ccaggcccugccugugguuccu

SEQ ID NO: 236004 - RNA, 22 nt, Human
uucaaacuaguuaaaagucaga

SEQ ID NO: 236005 - RNA, 22 nt, Human
uguccuuuguucccugucucug

SEQ ID NO: 236006 - RNA, 22 nt, Human
gccacaugcaauugcagcacgu

SEQ ID NO: 236007 - RNA, 22 nt, Human
cagucuuuguucccauuacuga

SEQ ID NO: 236008 - RNA, 19 nt, Human
agagucugugcucuuccua

SEQ ID NO: 236009 - RNA, 22 nt, Human
cuggguguucacccgaggcgcu

SEQ ID NO: 236010 - RNA, 22 nt, Human
caguuacagcugcaccagagcc

SEQ ID NO: 236011 - RNA, 22 nt, Human
auuccacagccgauaccaugac

SEQ ID NO: 236012 - RNA, 22 nt, Human
uggagccuuuuacccacaggag

SEQ ID NO: 236013 - RNA, 22 nt, Human
aggccugggcaagaaggggcgu

SEQ ID NO: 236014 - RNA, 22 nt, Human
aggcauggauggauccagggcu

SEQ ID NO: 236015 - RNA, 22 nt, Human
uggcagagaacacacaugauuc

SEQ ID NO: 236016 - RNA, 22 nt, Human
gccugcuuccuagccuuccaag

SEQ ID NO: 236017 - RNA, 21 nt, Human
aaagagguuaauauuguaagu

SEQ ID NO: 236018 - RNA, 22 nt, Human
aucuaaaguguuucaugaaaga

SEQ ID NO: 236019 - RNA, 22 nt, Human
gucauaaagcuuguugcauuua

SEQ ID NO: 236020 - RNA, 22 nt, Human
uaguuugcgaaauuccugccuc

SEQ ID NO: 236021 - RNA, 22 nt, Human
uucugagaugcguuagaaauuu

SEQ ID NO: 236022 - RNA, 22 nt, Human
aauccauuuacucuuuacaaga

SEQ ID NO: 236023 - RNA, 22 nt, Human
augaggcaucuaacauugcaaa

SEQ ID NO: 236024 - RNA, 22 nt, Human
gccaggcuccaggcccuccuga

SEQ ID NO: 236025 - RNA, 22 nt, Human
gagagcacggucuugggcaugg

SEQ ID NO: 236026 - RNA, 22 nt, Human
gccuugguuggccagcaggucc

SEQ ID NO: 236027 - RNA, 22 nt, Human
guagggcaacaugggcacuagg

SEQ ID NO: 236028 - RNA, 22 nt, Human
cagcaucuaaucuucaugccgg

SEQ ID NO: 236029 - RNA, 20 nt, Human
ccagacagcaccugccuggu

SEQ ID NO: 236030 - RNA, 22 nt, Human
gggagggauuaguucugccugg

SEQ ID NO: 236031 - RNA, 22 nt, Human
gggcaagaagcuggaagcauuc

SEQ ID NO: 236032 - RNA, 22 nt, Human
ucugagcugcuagguaugcauu

SEQ ID NO: 236033 - RNA, 22 nt, Human
ucagcaggugaacaucaugcca

SEQ ID NO: 236034 - RNA, 22 nt, Human
aaagugcaaucaguuagaccau

SEQ ID NO: 236035 - RNA, 22 nt, Human
auuacagaaauauggucaaaga

SEQ ID NO: 236036 - RNA, 22 nt, Human
ucuggggugcagccuggacaua

SEQ ID NO: 236037 - RNA, 22 nt, Human
ccuuuccccgcgggaggugcca

SEQ ID NO: 236038 - RNA, 22 nt, Human
uuaugggagcaauuggggaggu

SEQ ID NO: 236039 - RNA, 22 nt, Human
gauccacagcccgcuugggccc

SEQ ID NO: 236040 - RNA, 18 nt, Human
ccuggagcuccacagcaa

SEQ ID NO: 236041 - RNA, 22 nt, Human
uauuacaauuuacauugcacuu

SEQ ID NO: 236042 - RNA, 22 nt, Human
ccugggucuguauugguaggua

SEQ ID NO: 236043 - RNA, 22 nt, Human
accauuugacucucuaaggaua

SEQ ID NO: 236044 - RNA, 23 nt, Human
agaguuuguuucuaaugagugag

SEQ ID NO: 236045 - RNA, 22 nt, Human
uuuauaucuuaugucauuucaa

SEQ ID NO: 236046 - RNA, 22 nt, Human
caaagcugauacucagcaagua

SEQ ID NO: 236047 - RNA, 22 nt, Human
uuagauauguuuuugcuaaugc

SEQ ID NO: 236048 - RNA, 22 nt, Human
aagcaguuacuauuuacuauua

SEQ ID NO: 236049 - RNA, 22 nt, Human
ugcaggguguccggaggaucac

SEQ ID NO: 236050 - RNA, 22 nt, Human
auguuaacugaagccauucucg

SEQ ID NO: 236051 - RNA, 22 nt, Human
uugauguacagaauuguucaca

SEQ ID NO: 236052 - RNA, 22 nt, Human
gcagagcuguuaauggagcuga

SEQ ID NO: 236053 - RNA, 22 nt, Human
ucaaugagguaaucagucaccc

SEQ ID NO: 236054 - RNA, 22 nt, Human
auuagguaaucuuuagauacac

SEQ ID NO: 236055 - RNA, 22 nt, Human
gagcagugaagacagaaguaca

SEQ ID NO: 236056 - RNA, 22 nt, Human
caaaagaagcucuuggggcuag

SEQ ID NO: 236057 - RNA, 22 nt, Human
ucaucuguuaugggaguuuuug

SEQ ID NO: 236058 - RNA, 22 nt, Human
aaaugcauguagaauaauagag

SEQ ID NO: 236059 - RNA, 22 nt, Human
gccaggcacugcucuaagcccu

SEQ ID NO: 236060 - RNA, 23 nt, Human
uucugucuugcugucagcuuucu

SEQ ID NO: 236061 - RNA, 22 nt, Human
uugcaaauuauuuuagucccuu

SEQ ID NO: 236062 - RNA, 22 nt, Human
uuuuauucucaagacaauggga

SEQ ID NO: 236063 - RNA, 22 nt, Human
acccaggggcagccuugcugug

SEQ ID NO: 236064 - RNA, 22 nt, Human
gggcccagcgugguuccaucug

SEQ ID NO: 236065 - RNA, 22 nt, Human
cagggccucgaagccucugggc

SEQ ID NO: 236066 - RNA, 22 nt, Human
gcaagcaguuguggcuucugag

SEQ ID NO: 236067 - RNA, 22 nt, Human
aaggcuggguaaccuguccacu

SEQ ID NO: 236068 - RNA, 22 nt, Human
agcaggggcuccuccacagcca

SEQ ID NO: 236069 - RNA, 22 nt, Human
ucuuuauguuugaaaguacaau

SEQ ID NO: 236070 - RNA, 22 nt, Human
augauauuuuaguaaagugaua

SEQ ID NO: 236071 - RNA, 22 nt, Human
agacauaagugcuaugacauug

SEQ ID NO: 236072 - RNA, 22 nt, Human
uucugcuccaccacuuccagca

SEQ ID NO: 236073 - RNA, 22 nt, Human
uuuagacagcggcucugaacca

SEQ ID NO: 236074 - RNA, 22 nt, Human
uuggaacuggauuucauguagc

SEQ ID NO: 236075 - RNA, 22 nt, Human
ucauugaagugacugaaagauu

SEQ ID NO: 236076 - RNA, 22 nt, Human
ccucucuguguggccucuccau

SEQ ID NO: 236077 - RNA, 19 nt, Human
uccugaaaacuucuggaau

SEQ ID NO: 236078 - RNA, 22 nt, Human
uuccuggcagaggccccgacag

SEQ ID NO: 236079 - RNA, 22 nt, Human
uaagugaugagcacaguaauua

SEQ ID NO: 236080 - RNA, 22 nt, Human
agaagcugcguuuauuuaaauc

SEQ ID NO: 236081 - RNA, 22 nt, Human
cuuaaaaucuggcaguuagcua

SEQ ID NO: 236082 - RNA, 22 nt, Human
agacccagagggcugcugggag

SEQ ID NO: 236083 - RNA, 22 nt, Human
uggaagccaggcccgcuccuaa

SEQ ID NO: 236084 - RNA, 22 nt, Human
augcacaauuaggauauagcuu

SEQ ID NO: 236085 - RNA, 22 nt, Human
guuacaaagcacuucaagugaa

SEQ ID NO: 236086 - RNA, 22 nt, Human
gcuccagggucagcucagaacu

SEQ ID NO: 236087 - RNA, 22 nt, Human
agagcagccucagcucccugug

SEQ ID NO: 236088 - RNA, 19 nt, Human
aagcuccagcagauccuuu

SEQ ID NO: 236089 - RNA, 22 nt, Human
cugcagguuaggagcacuccuu

SEQ ID NO: 236090 - RNA, 23 nt, Human
ggguccagccaauuccaaggaaa

SEQ ID NO: 236091 - RNA, 23 nt, Human
agguucccccgccaggacccugc

SEQ ID NO: 236092 - RNA, 22 nt, Human
caucccugacuucuaggugaca

SEQ ID NO: 236093 - RNA, 22 nt, Human
aaggcugguuccaucccuggug

SEQ ID NO: 236094 - RNA, 22 nt, Human
cacacagugggaaaaccugaag

SEQ ID NO: 236095 - RNA, 22 nt, Human
gugaaaagagagccugugucag

SEQ ID NO: 236096 - RNA, 22 nt, Human
agaaugauaaugccaugaugga

SEQ ID NO: 236097 - RNA, 22 nt, Human
ggcucccugccuguccucaguc

SEQ ID NO: 236098 - RNA, 22 nt, Human
caaagggcucuagacucagcag

SEQ ID NO: 236099 - RNA, 22 nt, Human
auaaugcauuuagaauaauuca

SEQ ID NO: 236100 - RNA, 23 nt, Human
guguguggaaagugcaugggccu

SEQ ID NO: 236101 - RNA, 22 nt, Human
gcuggggagcaagaguagugag

SEQ ID NO: 236102 - RNA, 22 nt, Human
uauauuaaacccucucuguagg

SEQ ID NO: 236103 - RNA, 22 nt, Human
uuauauuucugguagccuucag

SEQ ID NO: 236104 - RNA, 22 nt, Human
acugagguaauugugaggauua

SEQ ID NO: 236105 - RNA, 22 nt, Human
aauucaaagacuagaauuuugc

SEQ ID NO: 236106 - RNA, 22 nt, Human
gacaccaguaaauauucaaaag

SEQ ID NO: 236107 - RNA, 22 nt, Human
ugccuguguggggucugccgcc

SEQ ID NO: 236108 - RNA, 23 nt, Human
gaguggggagaaauugguuaaac

SEQ ID NO: 236109 - RNA, 22 nt, Human
gaguuaaaagcccucucagcag

SEQ ID NO: 236110 - RNA, 22 nt, Human
uaugcuaaugacacucuagaaa

SEQ ID NO: 236111 - RNA, 22 nt, Human
aauauucauuugcagaagaagu

SEQ ID NO: 236112 - RNA, 22 nt, Human
cugucucugauaagcucgaggg

SEQ ID NO: 236113 - RNA, 22 nt, Human
uggcugcagaucaagggcaggc

SEQ ID NO: 236114 - RNA, 22 nt, Human
auaauguagguauguguauuua

SEQ ID NO: 236115 - RNA, 22 nt, Human
gaaaggcucacuuuagaucaug

SEQ ID NO: 236116 - RNA, 22 nt, Human
cuuuuugucucuguccugauga

SEQ ID NO: 236117 - RNA, 22 nt, Human
caacuaauccuuugaaaagaag

SEQ ID NO: 236118 - RNA, 22 nt, Human
gcuccaggagcucacagcucgc

SEQ ID NO: 236119 - RNA, 22 nt, Human
guuaacaagaauuacucuggaa

SEQ ID NO: 236120 - RNA, 22 nt, Human
aguuaagagugugaaaauguua

SEQ ID NO: 236121 - RNA, 22 nt, Human
ugucuaaaugaaaagagaugcc

SEQ ID NO: 236122 - RNA, 22 nt, Human
caugugucuaaucuacuaauau

SEQ ID NO: 236123 - RNA, 22 nt, Human
ucugggcuggugcucaugaauu

SEQ ID NO: 236124 - RNA, 22 nt, Human
agaaagacaaaaugcaguggcu

SEQ ID NO: 236125 - RNA, 22 nt, Human
caucaagauggaagagcaaaua

SEQ ID NO: 236126 - RNA, 22 nt, Human
gcuggcagacugggggcagaac

SEQ ID NO: 236127 - RNA, 22 nt, Human
ccugucuggaacauggccuguu

SEQ ID NO: 236128 - RNA, 22 nt, Human
aaagccauugaacuguacuuua

SEQ ID NO: 236129 - RNA, 22 nt, Human
caggaggacauacuggcucaca

SEQ ID NO: 236130 - RNA, 23 nt, Human
gcuggcuggcaguaaagguuguu

SEQ ID NO: 236131 - RNA, 22 nt, Human
ccuguucuguggcucucaaagg

SEQ ID NO: 236132 - RNA, 18 nt, Human
uggagggcuugcugcagc

SEQ ID NO: 236133 - RNA, 22 nt, Human
auuaaauuggacgcugggggaa

SEQ ID NO: 236134 - RNA, 22 nt, Human
uggugagaccuuguuccuuaug

SEQ ID NO: 236135 - RNA, 22 nt, Human
cauuguuaauugguaucuuaca

SEQ ID NO: 236136 - RNA, 22 nt, Human
cugcacccugcagguaccccug

SEQ ID NO: 236137 - RNA, 22 nt, Human
ccucuggcaacuucacagccca

SEQ ID NO: 236138 - RNA, 22 nt, Human
uaucuguauccccaucuagcua

SEQ ID NO: 236139 - RNA, 20 nt, Human
acugacagggaacuaaggcu

SEQ ID NO: 236140 - RNA, 22 nt, Human
aaacagagagauguauguggag

SEQ ID NO: 236141 - RNA, 22 nt, Human
aagguugcuguuuugcuucaaa

SEQ ID NO: 236142 - RNA, 22 nt, Human
gcccuucaguuacuccuugaug

SEQ ID NO: 236143 - RNA, 22 nt, Human
gcuuguuugugccucugcagaa

SEQ ID NO: 236144 - RNA, 21 nt, Human
cuuugcauacagaugccaauu

SEQ ID NO: 236145 - RNA, 22 nt, Human
ucagcaaccaggggcacagucc

SEQ ID NO: 236146 - RNA, 22 nt, Human
uguguauucagcaagcgaaaca

SEQ ID NO: 236147 - RNA, 22 nt, Human
cagcagccacuagagggcucac

SEQ ID NO: 236148 - RNA, 22 nt, Human
ccaaggcuggagugcaguggcg

SEQ ID NO: 236149 - RNA, 22 nt, Human
uaccaaaagcuuguuucauaca

SEQ ID NO: 236150 - RNA, 22 nt, Human
auggcauuauagcaaugguuug

SEQ ID NO: 236151 - RNA, 22 nt, Human
uccaggccacgaccuccuggau

SEQ ID NO: 236152 - RNA, 22 nt, Human
gccacugcacuccagcccaggc

SEQ ID NO: 236153 - RNA, 22 nt, Human
uugauucuacuuaaaacauaug

SEQ ID NO: 236154 - RNA, 22 nt, Human
gcagugguggagcuuacauauc

SEQ ID NO: 236155 - RNA, 22 nt, Human
uuucugaaaucucuuuugagga

SEQ ID NO: 236156 - RNA, 22 nt, Human
gauuuucauuauagcuaguuuc

SEQ ID NO: 236157 - RNA, 22 nt, Human
gcccaggaguugaagggcugac

SEQ ID NO: 236158 - RNA, 22 nt, Human
uacuagaaauuaccuucucacu

SEQ ID NO: 236159 - RNA, 22 nt, Human
gucuccagcccacucuagauau

SEQ ID NO: 236160 - RNA, 22 nt, Human
ucacuugccuagcccaguucag

SEQ ID NO: 236161 - RNA, 22 nt, Human
ccuuucugguauuuaaccaaag

SEQ ID NO: 236162 - RNA, 22 nt, Human
uugggaucuacauagcuaugua

SEQ ID NO: 236163 - RNA, 22 nt, Human
gucuggaggaggaagaaggcac

SEQ ID NO: 236164 - RNA, 22 nt, Human
aaggucugugaggcuguuuguc

SEQ ID NO: 236165 - RNA, 22 nt, Human
aguggcaguaacauuccacaau

SEQ ID NO: 236166 - RNA, 22 nt, Human
gagacagaguuucacucuuguu

SEQ ID NO: 236167 - RNA, 22 nt, Human
ugcagaggagcuggaaggcugg

SEQ ID NO: 236168 - RNA, 23 nt, Human
cuggccuccgacacuggccaaga

SEQ ID NO: 236169 - RNA, 22 nt, Human
uagaacugcucucauacuugcu

SEQ ID NO: 236170 - RNA, 22 nt, Human
uccuggacucaggaccacagga

SEQ ID NO: 236171 - RNA, 23 nt, Human
aacuuuuagaguuuaacaguguu

SEQ ID NO: 236172 - RNA, 22 nt, Human
ucucuuaggagaaauucauaaa

SEQ ID NO: 236173 - RNA, 22 nt, Human
uggccaccccuuucucugcacu

SEQ ID NO: 236174 - RNA, 22 nt, Human
ugaaagcagcaccaauaccauu

SEQ ID NO: 236175 - RNA, 22 nt, Human
cuuuguugugccugagugcacc

SEQ ID NO: 236176 - RNA, 21 nt, Human
agaggaagugauuggucuggc

SEQ ID NO: 236177 - RNA, 22 nt, Human
uuuguuagagugugggaggcug

SEQ ID NO: 236178 - RNA, 22 nt, Human
acaaguuucauuguuuagaacc

SEQ ID NO: 236179 - RNA, 22 nt, Human
gccugaaguuucaugccucuau

SEQ ID NO: 236180 - RNA, 22 nt, Human
gcaggcuggucugaccaucccu

SEQ ID NO: 236181 - RNA, 22 nt, Human
uuauuauagauuaugcaagauu

SEQ ID NO: 236182 - RNA, 22 nt, Human
aacugcaauuacuuuugcacca

SEQ ID NO: 236183 - RNA, 22 nt, Human
gcaucugauccaauagauauau

SEQ ID NO: 236184 - RNA, 22 nt, Human
gcugcaggggggucuggacuug

SEQ ID NO: 236185 - RNA, 22 nt, Human
ucugcccucaggguaaugauca

SEQ ID NO: 236186 - RNA, 22 nt, Human
agcuaggggaccaagguggccc

SEQ ID NO: 236187 - RNA, 22 nt, Human
agggcacuuuacccauagcuug

SEQ ID NO: 236188 - RNA, 22 nt, Human
uuccucagcuguuugggcucau

SEQ ID NO: 236189 - RNA, 22 nt, Human
uccuuggagguguucaucugcc

SEQ ID NO: 236190 - RNA, 17 nt, Human
gcauccaguaacaugcc

SEQ ID NO: 236191 - RNA, 22 nt, Human
uggguucuagagggaccagaac

SEQ ID NO: 236192 - RNA, 22 nt, Human
gucuuuggaggcacuguugagu

SEQ ID NO: 236193 - RNA, 22 nt, Human
cugggcaauaugcugggccugg

SEQ ID NO: 236194 - RNA, 22 nt, Human
agaucuuuaaaaguuauuauua

SEQ ID NO: 236195 - RNA, 22 nt, Human
aaugcuuuaauugcauguagug

SEQ ID NO: 236196 - RNA, 22 nt, Human
uauggguguuaauggugagaga

SEQ ID NO: 236197 - RNA, 22 nt, Human
accuucaaugaaaauaauaguc

SEQ ID NO: 236198 - RNA, 22 nt, Human
gggagcuggcggauuccccagg

SEQ ID NO: 236199 - RNA, 22 nt, Human
ggccucugcccucacuccuguc

SEQ ID NO: 236200 - RNA, 22 nt, Human
uagauucuuaguuucauagaau

SEQ ID NO: 236201 - RNA, 22 nt, Human
aaguaguugucccugaggaacg

SEQ ID NO: 236202 - RNA, 22 nt, Human
cagugcuguugggcccagagag

SEQ ID NO: 236203 - RNA, 22 nt, Human
uucuuucccaguagaugugaaa

SEQ ID NO: 236204 - RNA, 22 nt, Human
aguucacagggaagguuauugu

SEQ ID NO: 236205 - RNA, 23 nt, Human
uuguuucuuuguauugucucuau

SEQ ID NO: 236206 - RNA, 22 nt, Human
aaugcuagugugauauguaagg

SEQ ID NO: 236207 - RNA, 22 nt, Human
aaucaagaggcgauggauggaa

SEQ ID NO: 236208 - RNA, 22 nt, Human
ggcaaaguuuucaucucauaac

SEQ ID NO: 236209 - RNA, 22 nt, Human
uauaaagaaaugauuuccagaa

SEQ ID NO: 236210 - RNA, 22 nt, Human
acauuucagugagcuauugaag

SEQ ID NO: 236211 - RNA, 23 nt, Human
uuagagaugauuaaaaaaucuug

SEQ ID NO: 236212 - RNA, 22 nt, Human
uaagaugaccuuauaaagagca

SEQ ID NO: 236213 - RNA, 20 nt, Human
cugagcccccagccugcagg

SEQ ID NO: 236214 - RNA, 22 nt, Human
gacuuuaaaaguuugugcuugg

SEQ ID NO: 236215 - RNA, 22 nt, Human
cagaagcagaacacuagauuua

SEQ ID NO: 236216 - RNA, 22 nt, Human
guguuuacagauaaagugagcu

SEQ ID NO: 236217 - RNA, 21 nt, Human
uccugcagggcagcagagugg

SEQ ID NO: 236218 - RNA, 22 nt, Human
gggcagcuagcccucuagccca

SEQ ID NO: 236219 - RNA, 22 nt, Human
ccagaaaaggagcugcaggaug

SEQ ID NO: 236220 - RNA, 22 nt, Human
ccugcuggacagggguguucau

SEQ ID NO: 236221 - RNA, 22 nt, Human
cuccauauguucaguuaugcag

SEQ ID NO: 236222 - RNA, 22 nt, Human
gaggcuaagcacuggcauuucu

SEQ ID NO: 236223 - RNA, 22 nt, Human
ggcaggcacauuugggggccgu

SEQ ID NO: 236224 - RNA, 22 nt, Human
uacacauccauguuuugacuuu

SEQ ID NO: 236225 - RNA, 22 nt, Human
uugcuuccucuaguuucuugaa

SEQ ID NO: 236226 - RNA, 22 nt, Human
cuguggcagggaagaggccaug

SEQ ID NO: 236227 - RNA, 22 nt, Human
ucuagaaaaaaacugcugugga

SEQ ID NO: 236228 - RNA, 22 nt, Human
aagggcucugugugccucccca

SEQ ID NO: 236229 - RNA, 22 nt, Human
aagcuuucagagcagaauguga

SEQ ID NO: 236230 - RNA, 22 nt, Human
aaagcaguaugaaaggcaauaa

SEQ ID NO: 236231 - RNA, 22 nt, Human
auccauuucaguguuccacuug

SEQ ID NO: 236232 - RNA, 17 nt, Human
cugcuuugugcaacgcu

SEQ ID NO: 236233 - RNA, 20 nt, Human
gcccucagucuugucuuuau

SEQ ID NO: 236234 - RNA, 23 nt, Human
uagagcaguagaucaccauggga

SEQ ID NO: 236235 - RNA, 22 nt, Human
agcuuguuagaaauguagacuc

SEQ ID NO: 236236 - RNA, 22 nt, Human
uagaaauaaaucugcagcuggg

SEQ ID NO: 236237 - RNA, 22 nt, Human
auauuauuuucccuggaguugu

SEQ ID NO: 236238 - RNA, 22 nt, Human
ccagaagucaggaaugagucuu

SEQ ID NO: 236239 - RNA, 22 nt, Human
auuuccaagaaagcuuuaggau

SEQ ID NO: 236240 - RNA, 22 nt, Human
agcugccauccgaggugucaga

SEQ ID NO: 236241 - RNA, 22 nt, Human
uagggcucagaguccaguuucu

SEQ ID NO: 236242 - RNA, 22 nt, Human
uaaugaugcaguuacugucuca

SEQ ID NO: 236243 - RNA, 22 nt, Human
gaugauuuugaugcaguaaaga

SEQ ID NO: 236244 - RNA, 22 nt, Human
ucuugggauugcccugcaguuc

SEQ ID NO: 236245 - RNA, 20 nt, Human
agcugcagaacccacuggac

SEQ ID NO: 236246 - RNA, 22 nt, Human
cagugcaggaagugagaugccu

SEQ ID NO: 236247 - RNA, 22 nt, Human
cucccugggccucaguuucucu

SEQ ID NO: 236248 - RNA, 20 nt, Human
uggguccugcuucuuccuga

SEQ ID NO: 236249 - RNA, 22 nt, Human
agcagacaauugccuggaugga

SEQ ID NO: 236250 - RNA, 22 nt, Human
gggaagcaggugcagcucgccu

SEQ ID NO: 236251 - RNA, 22 nt, Human
cacugugucagaguaugaugau

SEQ ID NO: 236252 - RNA, 22 nt, Human
cagcuggcuggucagugcacaa

SEQ ID NO: 236253 - RNA, 22 nt, Human
aaaugcauuucacuaauguuuc

SEQ ID NO: 236254 - RNA, 23 nt, Human
auaagccuuuucuuucugcccca

SEQ ID NO: 236255 - RNA, 22 nt, Human
ggcagccagagggcagcuggau

SEQ ID NO: 236256 - RNA, 22 nt, Human
gcuuagaaguuccuauaaaaug

SEQ ID NO: 236257 - RNA, 22 nt, Human
acaguuuacagggauuugagcu

SEQ ID NO: 236258 - RNA, 22 nt, Human
uagauauaagguccuuagaaca

SEQ ID NO: 236259 - RNA, 22 nt, Human
cugaguccagggacagaggcgu

SEQ ID NO: 236260 - RNA, 22 nt, Human
ugucucaguauacgaaacacuu

SEQ ID NO: 236261 - RNA, 22 nt, Human
aagcagcacagcaaugacucua

SEQ ID NO: 236262 - RNA, 22 nt, Human
cccaggagaugcacuccauugg

SEQ ID NO: 236263 - RNA, 20 nt, Human
ucaugcagguguucuagguu

SEQ ID NO: 236264 - RNA, 22 nt, Human
acuuuuaaggggccuugauuua

SEQ ID NO: 236265 - RNA, 22 nt, Human
acaugugugacaacagagguga

SEQ ID NO: 236266 - RNA, 22 nt, Human
aggcuccuugcucacaggcuca

SEQ ID NO: 236267 - RNA, 22 nt, Human
gaugagguguguggccacuaga

SEQ ID NO: 236268 - RNA, 23 nt, Human
ucugccagugugugccaggagcc

SEQ ID NO: 236269 - RNA, 18 nt, Human
aucaaggaggggaagguc

SEQ ID NO: 236270 - RNA, 22 nt, Human
auguaaaguaaucugucgauca

SEQ ID NO: 236271 - RNA, 22 nt, Human
gagcaaaauaaauucugacaaa

SEQ ID NO: 236272 - RNA, 22 nt, Human
ugagggcugcuuccagagcuag

SEQ ID NO: 236273 - RNA, 22 nt, Human
aguuucucuuugacaccaaaau

SEQ ID NO: 236274 - RNA, 22 nt, Human
uugagauggagccucagucuug

SEQ ID NO: 236275 - RNA, 22 nt, Human
acagucuuuaauuucuuugugg

SEQ ID NO: 236276 - RNA, 22 nt, Human
caacuucuuggcuuccuaaugg

SEQ ID NO: 236277 - RNA, 22 nt, Human
agcuuugugacuuugagcuagu

SEQ ID NO: 236278 - RNA, 23 nt, Human
gagauguggguuuguucaguguc

SEQ ID NO: 236279 - RNA, 22 nt, Human
aguaaggcauuuuucauguuua

SEQ ID NO: 236280 - RNA, 22 nt, Human
cuccaccacacaucuguccacc

SEQ ID NO: 236281 - RNA, 22 nt, Human
uuggcagaauuaaccacugaag

SEQ ID NO: 236282 - RNA, 22 nt, Human
uggcuccagaucugucuccugu

SEQ ID NO: 236283 - RNA, 22 nt, Human
gguuccagagugggcugggaaa

SEQ ID NO: 236284 - RNA, 22 nt, Human
ucuaaacacuaagucuugaugc

SEQ ID NO: 236285 - RNA, 22 nt, Human
uggaagcaaaauauccuuuaau

SEQ ID NO: 236286 - RNA, 22 nt, Human
aaauauuguuuugguaagcuuc

SEQ ID NO: 236287 - RNA, 22 nt, Human
agcaccagcucaaggugcaccu

SEQ ID NO: 236288 - RNA, 22 nt, Human
cacauccuucauacucagcucu

SEQ ID NO: 236289 - RNA, 22 nt, Human
ucagaacuacauggacauguua

SEQ ID NO: 236290 - RNA, 22 nt, Human
gagaguucuugccuggguauua

SEQ ID NO: 236291 - RNA, 22 nt, Human
gcaucucuuuagaaucagaugg

SEQ ID NO: 236292 - RNA, 22 nt, Human
aaaaggcauggagguugauagu

SEQ ID NO: 236293 - RNA, 22 nt, Human
ccaggagcagaguagguguuca

SEQ ID NO: 236294 - RNA, 22 nt, Human
cacaccucacaccucgcaugcu

SEQ ID NO: 236295 - RNA, 22 nt, Human
aauguuguuuuucugcaugucu

SEQ ID NO: 236296 - RNA, 22 nt, Human
acugggcuguggacacccagcg

SEQ ID NO: 236297 - RNA, 22 nt, Human
ccugcccuucuuuccccagcau

SEQ ID NO: 236298 - RNA, 23 nt, Human
aaagacugcugagaauuuuagga

SEQ ID NO: 236299 - RNA, 22 nt, Human
cuguugcugggaacgcauguca

SEQ ID NO: 236300 - RNA, 22 nt, Human
uaguauuuccuguaagcuauag

SEQ ID NO: 236301 - RNA, 22 nt, Human
auaugacagcggauucacauau

SEQ ID NO: 236302 - RNA, 22 nt, Human
auccucagcaucuagcaugaag

SEQ ID NO: 236303 - RNA, 22 nt, Human
ccagcccuugaggucuguccau

SEQ ID NO: 236304 - RNA, 22 nt, Human
cugaggcacccaucuucuccug

SEQ ID NO: 236305 - RNA, 22 nt, Human
auaauaaaccaggaugggucug

SEQ ID NO: 236306 - RNA, 23 nt, Human
auauuagggagauuagcccucua

SEQ ID NO: 236307 - RNA, 22 nt, Human
caggugcuguccugcacauguc

SEQ ID NO: 236308 - RNA, 17 nt, Human
cccaugagcccacuccc

SEQ ID NO: 236309 - RNA, 22 nt, Human
ugaguggagaacagaggcucuc

SEQ ID NO: 236310 - RNA, 22 nt, Human
uccuccaggucuaggguggcuu

SEQ ID NO: 236311 - RNA, 22 nt, Human
uuuaaauguguucuuaguagcu

SEQ ID NO: 236312 - RNA, 22 nt, Human
ucucugggcucaggagcccggc

SEQ ID NO: 236313 - RNA, 22 nt, Human
ugagacuuggcacugaggaacu

SEQ ID NO: 236314 - RNA, 22 nt, Human
augaugaagaguaacaggcuga

SEQ ID NO: 236315 - RNA, 22 nt, Human
ucaguuuaauacccagaugccu

SEQ ID NO: 236316 - RNA, 22 nt, Human
cguccuuugaauugaggucuuu

SEQ ID NO: 236317 - RNA, 22 nt, Human
acuugaauucaaagcgaaagca

SEQ ID NO: 236318 - RNA, 22 nt, Human
acaguuugcccugacauucucc

SEQ ID NO: 236319 - RNA, 22 nt, Human
cagcuuuccagagaccugcccc

SEQ ID NO: 236320 - RNA, 22 nt, Human
gccaggcaggccacgcuguguu

SEQ ID NO: 236321 - RNA, 22 nt, Human
cuuucugaaguuuaaguucuaa

SEQ ID NO: 236322 - RNA, 22 nt, Human
cuuggcccggagccccaugaag

SEQ ID NO: 236323 - RNA, 22 nt, Human
ggguggagaggcuaaguccagu

SEQ ID NO: 236324 - RNA, 22 nt, Human
ccucuggccuaggccgggagag

SEQ ID NO: 236325 - RNA, 22 nt, Human
gcaggugucaguccccaaggug

SEQ ID NO: 236326 - RNA, 22 nt, Human
aagccuugcucuugaaaaaguu

SEQ ID NO: 236327 - RNA, 22 nt, Human
auuccucagcaggccuuuuguu

SEQ ID NO: 236328 - RNA, 22 nt, Human
cugugccacugcccugccacgc

SEQ ID NO: 236329 - RNA, 22 nt, Human
augaggagcccucauuuagguu

SEQ ID NO: 236330 - RNA, 22 nt, Human
auuguuggguaguuuguucagc

SEQ ID NO: 236331 - RNA, 22 nt, Human
uagagacaccaguaccauucug

SEQ ID NO: 236332 - RNA, 22 nt, Human
acaaugcaccagcaucuucacc

SEQ ID NO: 236333 - RNA, 22 nt, Human
ucugcacccuucuggguuggaa

SEQ ID NO: 236334 - RNA, 22 nt, Human
uauucauaguaaacaaaagugg

SEQ ID NO: 236335 - RNA, 22 nt, Human
agaagucagccacagugggaga

SEQ ID NO: 236336 - RNA, 22 nt, Human
agggcugccugacuccagagcc

SEQ ID NO: 236337 - RNA, 21 nt, Human
agaaaaacacgauauaagccc

SEQ ID NO: 236338 - RNA, 22 nt, Human
uauauuaucauaaaaccauuca

SEQ ID NO: 236339 - RNA, 22 nt, Human
agccagagauccaucccuagga

SEQ ID NO: 236340 - RNA, 22 nt, Human
auauuuagauaaaaaugggcuu

SEQ ID NO: 236341 - RNA, 22 nt, Human
caacagaggaguggccugaucc

SEQ ID NO: 236342 - RNA, 22 nt, Human
ugcaggcuccaugaggacaggc

SEQ ID NO: 236343 - RNA, 22 nt, Human
cugcagcuccugagcucagaga

SEQ ID NO: 236344 - RNA, 22 nt, Human
aaguucuaauuuugcauucagg

SEQ ID NO: 236345 - RNA, 22 nt, Human
cagacagguagggacagaacau

SEQ ID NO: 236346 - RNA, 22 nt, Human
uccuggagcuuccuucauggua

SEQ ID NO: 236347 - RNA, 22 nt, Human
aaaucccacucagaaacugcca

SEQ ID NO: 236348 - RNA, 22 nt, Human
ugccaggggaccuagggauguc

SEQ ID NO: 236349 - RNA, 22 nt, Human
aacuagaaaaagacuuucugag

SEQ ID NO: 236350 - RNA, 22 nt, Human
ccugggcagggagaccaggcuc

SEQ ID NO: 236351 - RNA, 22 nt, Human
uaauuucaccguugcuagaaau

SEQ ID NO: 236352 - RNA, 22 nt, Human
ggccaugcuguugccugcuggu

SEQ ID NO: 236353 - RNA, 22 nt, Human
aaacagugacugguacauaaua

SEQ ID NO: 236354 - RNA, 22 nt, Human
ugugauauuugaguauugucaa

SEQ ID NO: 236355 - RNA, 22 nt, Human
ggcagcccaccagcccacgucu

SEQ ID NO: 236356 - RNA, 22 nt, Human
cauuguuauagcauuacacacc

SEQ ID NO: 236357 - RNA, 22 nt, Human
caggcuuuuucugcuguccucu

SEQ ID NO: 236358 - RNA, 22 nt, Human
guguuugugagcuaggugacau

SEQ ID NO: 236359 - RNA, 21 nt, Human
ucuggguguaaaucuuauuug

SEQ ID NO: 236360 - RNA, 22 nt, Human
ccugggcuucugucuagauguu

SEQ ID NO: 236361 - RNA, 22 nt, Human
ucuauuuuguuuccagcucuac

SEQ ID NO: 236362 - RNA, 22 nt, Human
ugcagcuguuacggacccuguc

SEQ ID NO: 236363 - RNA, 22 nt, Human
cagcagcuagaggaagggcaga

SEQ ID NO: 236364 - RNA, 18 nt, Human
cuuagaacaucauuccuu

SEQ ID NO: 236365 - RNA, 22 nt, Human
auuuccuauggauacaggcaga

SEQ ID NO: 236366 - RNA, 22 nt, Human
gcagggggucauucacgcuggc

SEQ ID NO: 236367 - RNA, 22 nt, Human
aggccagaugucgggcuagaag

SEQ ID NO: 236368 - RNA, 22 nt, Human
acaggugucuaaggcagacagc

SEQ ID NO: 236369 - RNA, 22 nt, Human
uuggaacacagcagcugauuuu

SEQ ID NO: 236370 - RNA, 22 nt, Human
gccuguguccuucccagugggg

SEQ ID NO: 236371 - RNA, 22 nt, Human
agaagccauagucugggaggca

SEQ ID NO: 236372 - RNA, 22 nt, Human
uugagcccuaccucagacuuuc

SEQ ID NO: 236373 - RNA, 22 nt, Human
aaaggcauuuuaauucuaaaga

SEQ ID NO: 236374 - RNA, 22 nt, Human
ucucuggcacauaauaaggucu

SEQ ID NO: 236375 - RNA, 21 nt, Human
guccagagagccggcuccuga

SEQ ID NO: 236376 - RNA, 22 nt, Human
aagaugaaucaguauguguccu

SEQ ID NO: 236377 - RNA, 23 nt, Human
gccugggacucaggaggagcuca

SEQ ID NO: 236378 - RNA, 22 nt, Human
uucacaaaaaugcugaacaguu

SEQ ID NO: 236379 - RNA, 22 nt, Human
cacugguaguuucagcaaccag

SEQ ID NO: 236380 - RNA, 22 nt, Human
aagagcaucgguggagccccca

SEQ ID NO: 236381 - RNA, 22 nt, Human
uuguauucuuccuuagcaguac

SEQ ID NO: 236382 - RNA, 22 nt, Human
ugcccagcuucuuacuuuuaaa

SEQ ID NO: 236383 - RNA, 22 nt, Human
cucuccaguuaccuaggucuga

SEQ ID NO: 236384 - RNA, 22 nt, Human
gaugcugacugaccaaaaggau

SEQ ID NO: 236385 - RNA, 23 nt, Human
ucagagaaguuguaggcugggga

SEQ ID NO: 236386 - RNA, 22 nt, Human
aaggcugacucaacagggggcc

SEQ ID NO: 236387 - RNA, 22 nt, Human
uucacauuggugauauguuucu

SEQ ID NO: 236388 - RNA, 22 nt, Human
caguuacagagccaguuagaga

SEQ ID NO: 236389 - RNA, 22 nt, Human
ugucacauaggcaaaauguuuu

SEQ ID NO: 236390 - RNA, 22 nt, Human
cuaugaaaugucagauucugca

SEQ ID NO: 236391 - RNA, 21 nt, Human
ggaauagcuuaaagugagggg

SEQ ID NO: 236392 - RNA, 22 nt, Human
ugacccauggucugaucauagg

SEQ ID NO: 236393 - RNA, 22 nt, Human
ugcaggagggaggguuacaguu

SEQ ID NO: 236394 - RNA, 22 nt, Human
guuuccuauaacucaggcacca

SEQ ID NO: 236395 - RNA, 22 nt, Human
uaucuagauaccaagaagcaca

SEQ ID NO: 236396 - RNA, 19 nt, Human
gggaccugacuaauuggca

SEQ ID NO: 236397 - RNA, 22 nt, Human
cugagggagacagugcggacua

SEQ ID NO: 236398 - RNA, 22 nt, Human
acauucaagaugcauucacuua

SEQ ID NO: 236399 - RNA, 22 nt, Human
guucaucuuccucccagugccu

SEQ ID NO: 236400 - RNA, 22 nt, Human
uaacucuagucccaggcaugaa

SEQ ID NO: 236401 - RNA, 22 nt, Human
ggcuggagugggcuccagaguu

SEQ ID NO: 236402 - RNA, 22 nt, Human
uucuuuaaaugaauucucugua

SEQ ID NO: 236403 - RNA, 22 nt, Human
agaaaacagaaagucauuggug

SEQ ID NO: 236404 - RNA, 22 nt, Human
ggcucucuggaggagcucaccc

SEQ ID NO: 236405 - RNA, 22 nt, Human
ugcagaguagugaggggacaga

SEQ ID NO: 236406 - RNA, 22 nt, Human
uuggaauuugcuucagcuaaua

SEQ ID NO: 236407 - RNA, 22 nt, Human
gcccugcuucuggcaugcagaa

SEQ ID NO: 236408 - RNA, 22 nt, Human
ccacccagccagaugcaggaag

SEQ ID NO: 236409 - RNA, 22 nt, Human
ugggagaaacugucucucccac

SEQ ID NO: 236410 - RNA, 22 nt, Human
auucgcacauuaacacucauau

SEQ ID NO: 236411 - RNA, 22 nt, Human
uuucuuuuacaguguggcuauu

SEQ ID NO: 236412 - RNA, 22 nt, Human
agugcuuuuauaucauuaaucc

SEQ ID NO: 236413 - RNA, 22 nt, Human
ccugggcucacagccaaggcuc

SEQ ID NO: 236414 - RNA, 22 nt, Human
aguuugaaggaguugaaucacc

SEQ ID NO: 236415 - RNA, 22 nt, Human
guaaauauaaaugcuagcugcc

SEQ ID NO: 236416 - RNA, 22 nt, Human
aggcugcuauaaacauucccgu

SEQ ID NO: 236417 - RNA, 22 nt, Human
uuccugagaacauggcagcuua

SEQ ID NO: 236418 - RNA, 22 nt, Human
uacacuuguucaaacagcaaaa

SEQ ID NO: 236419 - RNA, 22 nt, Human
uauaaagaaguguaaacaggaa

SEQ ID NO: 236420 - RNA, 19 nt, Human
auccuggguccuccagcug

SEQ ID NO: 236421 - RNA, 22 nt, Human
acauuguauaaugauuaucaca

SEQ ID NO: 236422 - RNA, 20 nt, Human
uauuuugcaauuaugguuca

SEQ ID NO: 236423 - RNA, 22 nt, Human
uucucuggggacugucucuauu

SEQ ID NO: 236424 - RNA, 22 nt, Human
uccaaaguaauuucacuucugu

SEQ ID NO: 236425 - RNA, 22 nt, Human
accacaucgggcggacacuggg

SEQ ID NO: 236426 - RNA, 22 nt, Human
ccagccccgggaaccuggccgu

SEQ ID NO: 236427 - RNA, 22 nt, Human
uggcccaggccaaagcccugga

SEQ ID NO: 236428 - RNA, 21 nt, Human
aaagcaucacgaacauuuggg

SEQ ID NO: 236429 - RNA, 22 nt, Human
uugugcaauaguuuucucauga

SEQ ID NO: 236430 - RNA, 22 nt, Human
cagggcucaggaaaucagacgu

SEQ ID NO: 236431 - RNA, 22 nt, Human
uuuccagauuaagauaccacuu

SEQ ID NO: 236432 - RNA, 22 nt, Human
gaacauaacuauugugaauagu

SEQ ID NO: 236433 - RNA, 18 nt, Human
uuuguuggguugccuuua

SEQ ID NO: 236434 - RNA, 22 nt, Human
gcaggucuggagggcacugggg

SEQ ID NO: 236435 - RNA, 22 nt, Human
uaggcugagcuaagagagcuua

SEQ ID NO: 236436 - RNA, 22 nt, Human
aguaaaaucuuaagcacagugg

SEQ ID NO: 236437 - RNA, 22 nt, Human
uacgugcacucauaccugaaau

SEQ ID NO: 236438 - RNA, 22 nt, Human
aucuguggcgcaaacaaaggcu

SEQ ID NO: 236439 - RNA, 22 nt, Human
cuagagaacaacauucauaugg

SEQ ID NO: 236440 - RNA, 22 nt, Human
gaacagaagaggcuggugccac

SEQ ID NO: 236441 - RNA, 22 nt, Human
ugugugcacgcugggagcugga

SEQ ID NO: 236442 - RNA, 22 nt, Human
auaagugacugcagggaauuca

SEQ ID NO: 236443 - RNA, 21 nt, Human
acacaggcagugucccgaggu

SEQ ID NO: 236444 - RNA, 22 nt, Human
uauaauuuggggaaaguggugu

SEQ ID NO: 236445 - RNA, 17 nt, Human
uggggaagcucagauuu

SEQ ID NO: 236446 - RNA, 22 nt, Human
cugggcccugaagacagucagg

SEQ ID NO: 236447 - RNA, 22 nt, Human
auacuuauacuaagaauguacu

SEQ ID NO: 236448 - RNA, 23 nt, Human
ggcaugcaauggacagagcugga

SEQ ID NO: 236449 - RNA, 22 nt, Human
cugcugugagugguucuugccu

SEQ ID NO: 236450 - RNA, 22 nt, Human
ggacccugcguguauccacacu

SEQ ID NO: 236451 - RNA, 23 nt, Human
aagugguuuugaacccggacccu

SEQ ID NO: 236452 - RNA, 22 nt, Human
ugugaggauguuaaggggauga

SEQ ID NO: 236453 - RNA, 22 nt, Human
gucuccuaaaccauccugguac

SEQ ID NO: 236454 - RNA, 22 nt, Human
aacaucuagguucucaucgaua

SEQ ID NO: 236455 - RNA, 22 nt, Human
aagaggaaaugauugacuauau

SEQ ID NO: 236456 - RNA, 22 nt, Human
cagaggcuaagaguguccaaag

SEQ ID NO: 236457 - RNA, 22 nt, Human
ugagcccuugacaucgcccacu

SEQ ID NO: 236458 - RNA, 19 nt, Human
augagcaauaguuuuaauc

SEQ ID NO: 236459 - RNA, 22 nt, Human
agcugcccccagggcugugcuu

SEQ ID NO: 236460 - RNA, 22 nt, Human
gcugaaggcccggaggacaggg

SEQ ID NO: 236461 - RNA, 22 nt, Human
agagcuggcugugggugacuuu

SEQ ID NO: 236462 - RNA, 22 nt, Human
cuggcugguuggggagaagaca

SEQ ID NO: 236463 - RNA, 22 nt, Human
agccuacagagggcagguggag

SEQ ID NO: 236464 - RNA, 22 nt, Human
ucugccagaagccagggucugg

SEQ ID NO: 236465 - RNA, 22 nt, Human
uucagaacaauaugaacagaac

SEQ ID NO: 236466 - RNA, 22 nt, Human
auacaugugugugcauacaugu

SEQ ID NO: 236467 - RNA, 22 nt, Human
gaagccucaacaucucugcguc

SEQ ID NO: 236468 - RNA, 22 nt, Human
gcagcaggacugccguuaaagu

SEQ ID NO: 236469 - RNA, 22 nt, Human
cuaucucuccacaaugccagug

SEQ ID NO: 236470 - RNA, 22 nt, Human
ggcucagaaaccucuggugucu

SEQ ID NO: 236471 - RNA, 22 nt, Human
cagcuucuucaguccuggagcu

SEQ ID NO: 236472 - RNA, 22 nt, Human
aaacaguucuccaggaagccag

SEQ ID NO: 236473 - RNA, 22 nt, Human
ucaguucuaacaguuuagaaca

SEQ ID NO: 236474 - RNA, 22 nt, Human
ugcuuucauugugauaggaagc

SEQ ID NO: 236475 - RNA, 22 nt, Human
gagcccucgggcgagcccgcgc

SEQ ID NO: 236476 - RNA, 22 nt, Human
cugugugagcaucacuucagau

SEQ ID NO: 236477 - RNA, 22 nt, Human
uguccucaggaccuggcacagu

SEQ ID NO: 236478 - RNA, 22 nt, Human
gccgggaccaaggccacggagc

SEQ ID NO: 236479 - RNA, 21 nt, Human
uaggaacuguucugagugguc

SEQ ID NO: 236480 - RNA, 22 nt, Human
uucugcugguaacuauguuuca

SEQ ID NO: 236481 - RNA, 22 nt, Human
auuuacagaugaugcuauuuga

SEQ ID NO: 236482 - RNA, 22 nt, Human
uacaugaagaugaauguauggc

SEQ ID NO: 236483 - RNA, 22 nt, Human
ucagugcaguagaacuuuaguu

SEQ ID NO: 236484 - RNA, 22 nt, Human
uacugucucugcccuggccagg

SEQ ID NO: 236485 - RNA, 22 nt, Human
uuccaaaguuauucaagcagua

SEQ ID NO: 236486 - RNA, 22 nt, Human
uuguacagggaaguaauacaag

SEQ ID NO: 236487 - RNA, 22 nt, Human
guaggucagacauaagaggaca

SEQ ID NO: 236488 - RNA, 22 nt, Human
guuauguacuuuuuaaaucuug

SEQ ID NO: 236489 - RNA, 19 nt, Human
uagaagcacuaggcaaacu

SEQ ID NO: 236490 - RNA, 22 nt, Human
aaugguuuaacauaugcuugag

SEQ ID NO: 236491 - RNA, 22 nt, Human
agcaccaggucgcuggcacgcu

SEQ ID NO: 236492 - RNA, 22 nt, Human
gacuauugcacacuucucucac

SEQ ID NO: 236493 - RNA, 22 nt, Human
auauuuacugcuguggugaagg

SEQ ID NO: 236494 - RNA, 22 nt, Human
aucuguagucacugcacagcuc

SEQ ID NO: 236495 - RNA, 22 nt, Human
ucacacagugagaaagugcgga

SEQ ID NO: 236496 - RNA, 18 nt, Human
ugaggccagagugggcau

SEQ ID NO: 236497 - RNA, 22 nt, Human
ucugugucugguugggccagua

SEQ ID NO: 236498 - RNA, 22 nt, Human
aacaagauguuuugauauaugu

SEQ ID NO: 236499 - RNA, 22 nt, Human
aagagggagggcaaaggcacug

SEQ ID NO: 236500 - RNA, 22 nt, Human
cugggugcgugagcgcaugcgu

SEQ ID NO: 236501 - RNA, 22 nt, Human
uuuuaauucaaagugaauagug

SEQ ID NO: 236502 - RNA, 22 nt, Human
ugucuguggcaauuguggguaa

SEQ ID NO: 236503 - RNA, 22 nt, Human
acagccaaggaauuaggaaggg

SEQ ID NO: 236504 - RNA, 22 nt, Human
caaagacugcauaacacaugaa

SEQ ID NO: 236505 - RNA, 22 nt, Human
ccacaggacggaggucuggccg

SEQ ID NO: 236506 - RNA, 22 nt, Human
uccuuggcaagcugcaauggga

SEQ ID NO: 236507 - RNA, 22 nt, Human
acaugacaccucuggcugggug

SEQ ID NO: 236508 - RNA, 22 nt, Human
acaagagauuaucuacagauga

SEQ ID NO: 236509 - RNA, 22 nt, Human
agcaguguuuaggcauucagua

SEQ ID NO: 236510 - RNA, 22 nt, Human
caccagcucuccaccagguuuc

SEQ ID NO: 236511 - RNA, 22 nt, Human
uauguguuugacacccugcaag

SEQ ID NO: 236512 - RNA, 22 nt, Human
uccuuucugucuuuacucugga

SEQ ID NO: 236513 - RNA, 22 nt, Human
aauugcuuaguugcaacuaugc

SEQ ID NO: 236514 - RNA, 19 nt, Human
ucagucuaggaaugagcua

SEQ ID NO: 236515 - RNA, 22 nt, Human
ugcaacaaggccucauuucuug

SEQ ID NO: 236516 - RNA, 22 nt, Human
gaggucaggcuugcagcagggu

SEQ ID NO: 236517 - RNA, 22 nt, Human
uagcaguggaaucuuuugucca

SEQ ID NO: 236518 - RNA, 20 nt, Human
auaauuauuuacuuuugugc

SEQ ID NO: 236519 - RNA, 22 nt, Human
ucuaccagggucacagaggccc

SEQ ID NO: 236520 - RNA, 22 nt, Human
acugcaggaugugcuccuauug

SEQ ID NO: 236521 - RNA, 22 nt, Human
caguuaaacagauugaguguua

SEQ ID NO: 236522 - RNA, 22 nt, Human
auuacagaagauaugcucaaca

SEQ ID NO: 236523 - RNA, 20 nt, Human
caccacagaauuggggacag

SEQ ID NO: 236524 - RNA, 22 nt, Human
cagcccagaacucacgucucca

SEQ ID NO: 236525 - RNA, 22 nt, Human
aucucagacauguuguccauga

SEQ ID NO: 236526 - RNA, 22 nt, Human
uuggcuucuuauaaugcaauag

SEQ ID NO: 236527 - RNA, 22 nt, Human
agcagcugauggggaaggaguu

SEQ ID NO: 236528 - RNA, 22 nt, Human
ugucccugguggaggcuggcag

SEQ ID NO: 236529 - RNA, 22 nt, Human
ccagggcucaggcucccagugg

SEQ ID NO: 236530 - RNA, 22 nt, Human
auacaacuuuacaugcaauucc

SEQ ID NO: 236531 - RNA, 22 nt, Human
uucucaggccccugccuggacu

SEQ ID NO: 236532 - RNA, 22 nt, Human
cuggcugguuuuuaaagcuagg

SEQ ID NO: 236533 - RNA, 22 nt, Human
agcacagggcccagccuaggcc

SEQ ID NO: 236534 - RNA, 22 nt, Human
uagguguccauauaugugugua

SEQ ID NO: 236535 - RNA, 22 nt, Human
cuucuuuucauggcuugggaag

SEQ ID NO: 236536 - RNA, 22 nt, Human
cuguugcucccagggagagggu

SEQ ID NO: 236537 - RNA, 22 nt, Human
cacaggcucuccagggccugga

SEQ ID NO: 236538 - RNA, 22 nt, Human
aaauuauucaaaaagcuguguu

SEQ ID NO: 236539 - RNA, 22 nt, Human
guguuacuaaaauuugauucuu

SEQ ID NO: 236540 - RNA, 20 nt, Human
uccaggagaacugggagccg

SEQ ID NO: 236541 - RNA, 22 nt, Human
gcucaaagaccagacagaggag

SEQ ID NO: 236542 - RNA, 22 nt, Human
ugcuacacucaaucagugcuau

SEQ ID NO: 236543 - RNA, 22 nt, Human
augcuauuuaccacacaucauu

SEQ ID NO: 236544 - RNA, 22 nt, Human
gcucccuggaauguuggcugcc

SEQ ID NO: 236545 - RNA, 22 nt, Human
gugagguagcagagacagugaa

SEQ ID NO: 236546 - RNA, 21 nt, Human
aagugccacccacagaugcau

SEQ ID NO: 236547 - RNA, 22 nt, Human
aaaucagaaaauauggagagga

SEQ ID NO: 236548 - RNA, 22 nt, Human
ggcucaggagaggggcuaaaag

SEQ ID NO: 236549 - RNA, 22 nt, Human
gacagcauggugucuguucagg

SEQ ID NO: 236550 - RNA, 22 nt, Human
auucaagagcuggcuuugaaau

SEQ ID NO: 236551 - RNA, 22 nt, Human
aaagccaguucuuuuauauugg

SEQ ID NO: 236552 - RNA, 19 nt, Human
agcucaggcccaucguccc

SEQ ID NO: 236553 - RNA, 22 nt, Human
agcugcugagccaggcugaugu

SEQ ID NO: 236554 - RNA, 22 nt, Human
cugagguguugaugaccuaugc

SEQ ID NO: 236555 - RNA, 22 nt, Human
agaaucaaagagaaauacuuug

SEQ ID NO: 236556 - RNA, 22 nt, Human
uacauucucuucccauugucuc

SEQ ID NO: 236557 - RNA, 21 nt, Human
uggcugaguggaugcaugaau

SEQ ID NO: 236558 - RNA, 22 nt, Human
ccuggcugcuuccucugccaug

SEQ ID NO: 236559 - RNA, 22 nt, Human
ugucuuuuaguuugugagaucu

SEQ ID NO: 236560 - RNA, 22 nt, Human
guccuaaucucuucuuauaagg

SEQ ID NO: 236561 - RNA, 22 nt, Human
gugcaagacuuccuaagcaaua

SEQ ID NO: 236562 - RNA, 22 nt, Human
agcaggccucaugcaccagcua

SEQ ID NO: 236563 - RNA, 22 nt, Human
aaggugguaggcuauaucagua

SEQ ID NO: 236564 - RNA, 22 nt, Human
uccugggagacccagcugugga

SEQ ID NO: 236565 - RNA, 22 nt, Human
uuauguaccugaauuaguaaag

SEQ ID NO: 236566 - RNA, 22 nt, Human
gggagccaugcuggucuucuuu

SEQ ID NO: 236567 - RNA, 22 nt, Human
cugcaaaagucauugugguuuu

SEQ ID NO: 236568 - RNA, 22 nt, Human
gagacagaugcugcuggagcau

SEQ ID NO: 236569 - RNA, 19 nt, Human
ggccccucucacaggaguu

SEQ ID NO: 236570 - RNA, 22 nt, Human
cucccaggggaacuaucaagua

SEQ ID NO: 236571 - RNA, 23 nt, Human
cucagaggccuguccaggguggu

SEQ ID NO: 236572 - RNA, 22 nt, Human
agcugaggcauggacaggcugc

SEQ ID NO: 236573 - RNA, 22 nt, Human
ugaaugauuugggugcauucag

SEQ ID NO: 236574 - RNA, 22 nt, Human
uucaaagugcuuuuaaccuuua

SEQ ID NO: 236575 - RNA, 17 nt, Human
aaucucaguggcuuaag

SEQ ID NO: 236576 - RNA, 22 nt, Human
caggauccuggcugcauggacg

SEQ ID NO: 236577 - RNA, 22 nt, Human
uuuaguagaaugauacagggca

SEQ ID NO: 236578 - RNA, 22 nt, Human
acccugagggguauagcagaag

SEQ ID NO: 236579 - RNA, 22 nt, Human
uagaugcuuauaaagagcauau

SEQ ID NO: 236580 - RNA, 22 nt, Human
ugggugcucugcuucccugcac

SEQ ID NO: 236581 - RNA, 22 nt, Human
guaaaggcucugauaaguacug

SEQ ID NO: 236582 - RNA, 22 nt, Human
aggcugucucagccugcuugca

SEQ ID NO: 236583 - RNA, 22 nt, Human
aucuuucagggccauuuguauu

SEQ ID NO: 236584 - RNA, 22 nt, Human
ucugucugccuugugagggcac

SEQ ID NO: 236585 - RNA, 22 nt, Human
gguguuaacuuguuuaugacaa

SEQ ID NO: 236586 - RNA, 22 nt, Human
ucccugggaauuaauauuugga

SEQ ID NO: 236587 - RNA, 23 nt, Human
aggcugagcucucccagcuucag

SEQ ID NO: 236588 - RNA, 22 nt, Human
caguggcugagaguggacacug

SEQ ID NO: 236589 - RNA, 22 nt, Human
gcuguagguucagucuccaugc

SEQ ID NO: 236590 - RNA, 22 nt, Human
uuccauauguauauagcuguua

SEQ ID NO: 236591 - RNA, 22 nt, Human
gcucuguaaagaagagaaaugc

SEQ ID NO: 236592 - RNA, 22 nt, Human
cagcaggauuugaaaggaagag

SEQ ID NO: 236593 - RNA, 22 nt, Human
agcuugauuucucugcagugug

SEQ ID NO: 236594 - RNA, 22 nt, Human
aguuaacucauuuuauaaugcc

SEQ ID NO: 236595 - RNA, 22 nt, Human
aacuugguuguuggcaauuugc

SEQ ID NO: 236596 - RNA, 22 nt, Human
ccaggccagccuggagcauggc

SEQ ID NO: 236597 - RNA, 22 nt, Human
aagucucuuuaccucuccaggc

SEQ ID NO: 236598 - RNA, 19 nt, Human
ucucuggggacacuuucac

SEQ ID NO: 236599 - RNA, 19 nt, Human
aagcauggugccucaccuc

SEQ ID NO: 236600 - RNA, 22 nt, Human
gaaauacagaaagggcugaaug

SEQ ID NO: 236601 - RNA, 22 nt, Human
cuccagauguauacuuuccaag

SEQ ID NO: 236602 - RNA, 22 nt, Human
uaauuuuaauaguauguggcau

SEQ ID NO: 236603 - RNA, 22 nt, Human
cuuagcccugagaguucugagc

SEQ ID NO: 236604 - RNA, 22 nt, Human
caggcccaucugcucccaggcu

SEQ ID NO: 236605 - RNA, 22 nt, Human
caggaagaaagaggugaggugu

SEQ ID NO: 236606 - RNA, 22 nt, Human
gcugccuucugagaaguuaaau

SEQ ID NO: 236607 - RNA, 22 nt, Human
caguggggaggccaggauagaa

SEQ ID NO: 236608 - RNA, 22 nt, Human
aagggcucugggcuacgcacug

SEQ ID NO: 236609 - RNA, 22 nt, Human
cuucacauguuggaguccuuug

SEQ ID NO: 236610 - RNA, 22 nt, Human
ggcaggcuccaagcauccuaug

SEQ ID NO: 236611 - RNA, 16 nt, Human
agcagguguauagugu

SEQ ID NO: 236612 - RNA, 22 nt, Human
cagcaucaacauucucagcucu

SEQ ID NO: 236613 - RNA, 18 nt, Human
gcuggcuugcuggguuug

SEQ ID NO: 236614 - RNA, 22 nt, Human
agacauuggcuaaaaguagugu

SEQ ID NO: 236615 - RNA, 22 nt, Human
ccugaggcucgcgcgccccugg

SEQ ID NO: 236616 - RNA, 22 nt, Human
ugucccagcacuuugggagucu

SEQ ID NO: 236617 - RNA, 22 nt, Human
ucugggucuaugaucucacuuc

SEQ ID NO: 236618 - RNA, 22 nt, Human
cuuagaaaugcagauucucagg

SEQ ID NO: 236619 - RNA, 22 nt, Human
agacaggcuuugcuguauauca

SEQ ID NO: 236620 - RNA, 22 nt, Human
aauuaguaaccuaauuccaucu

SEQ ID NO: 236621 - RNA, 22 nt, Human
ggccucgcggcuucugguggcu

SEQ ID NO: 236622 - RNA, 22 nt, Human
ucuuuacaucacaauuguaugg

SEQ ID NO: 236623 - RNA, 22 nt, Human
ucuccugcuucaacugauggac

SEQ ID NO: 236624 - RNA, 22 nt, Human
acagggcagaaauguugcaucu

SEQ ID NO: 236625 - RNA, 22 nt, Human
gaagccaacauuccaaguagaa

SEQ ID NO: 236626 - RNA, 22 nt, Human
auggcuucgaguauauacauag

SEQ ID NO: 236627 - RNA, 22 nt, Human
auguaauaggguaacauaacau

SEQ ID NO: 236628 - RNA, 22 nt, Human
ccuggggagagaaagcccagcc

SEQ ID NO: 236629 - RNA, 22 nt, Human
ccugcaagagcggagaagccag

SEQ ID NO: 236630 - RNA, 22 nt, Human
ugcuccagggccuccagugggg

SEQ ID NO: 236631 - RNA, 22 nt, Human
gcucaggcaccauaugaugugu

SEQ ID NO: 236632 - RNA, 22 nt, Human
aguaacaucuuugacauuuguu

SEQ ID NO: 236633 - RNA, 22 nt, Human
cagcccacgucagggccacuca

SEQ ID NO: 236634 - RNA, 22 nt, Human
caggagguugguagcaguagau

SEQ ID NO: 236635 - RNA, 17 nt, Human
ucagacccugugucagg

SEQ ID NO: 236636 - RNA, 19 nt, Human
cuggccuguguccugugcu

SEQ ID NO: 236637 - RNA, 23 nt, Human
cucugggcgggcaggucagccuc

SEQ ID NO: 236638 - RNA, 22 nt, Human
cauuuauucauuugcuagggcu

SEQ ID NO: 236639 - RNA, 22 nt, Human
ugucuccucaacucaugcucga

SEQ ID NO: 236640 - RNA, 22 nt, Human
ucuuuuauccuacauuuagcuc

SEQ ID NO: 236641 - RNA, 22 nt, Human
ccccagcccacaagcauauuaa

SEQ ID NO: 236642 - RNA, 23 nt, Human
auuuacagguuaaaugaaaucag

SEQ ID NO: 236643 - RNA, 22 nt, Human
gaaugacauugaaaagacauug

SEQ ID NO: 236644 - RNA, 21 nt, Human
gagcugggcgaggcuccgggg

SEQ ID NO: 236645 - RNA, 22 nt, Human
ugcugaaacaauaacauacugg

SEQ ID NO: 236646 - RNA, 22 nt, Human
cagaaagccgacuuacaaugga

SEQ ID NO: 236647 - RNA, 22 nt, Human
ucuuuccucugagcuccuguag

SEQ ID NO: 236648 - RNA, 22 nt, Human
caugacccauuuuucuugcugu

SEQ ID NO: 236649 - RNA, 22 nt, Human
acaguggcaguauuagggcaga

SEQ ID NO: 236650 - RNA, 22 nt, Human
agcugaaauucuuuguccucag

SEQ ID NO: 236651 - RNA, 22 nt, Human
ccauuagaagauguaauagaga

SEQ ID NO: 236652 - RNA, 19 nt, Human
gagaaaccccgucuuuagg

SEQ ID NO: 236653 - RNA, 22 nt, Human
ccauccagaccaguccaugggu

SEQ ID NO: 236654 - RNA, 22 nt, Human
ugcaauaacccaugagauagaa

SEQ ID NO: 236655 - RNA, 22 nt, Human
augcaggggccgccuggccagg

SEQ ID NO: 236656 - RNA, 22 nt, Human
gugagucugccuagcacaucac

SEQ ID NO: 236657 - RNA, 22 nt, Human
uugcagggcuggaacauggaau

SEQ ID NO: 236658 - RNA, 22 nt, Human
ugggaagaugaggugccauggg

SEQ ID NO: 236659 - RNA, 22 nt, Human
caggccugucugcacaugaggc

SEQ ID NO: 236660 - RNA, 22 nt, Human
gccagaagacuggagucagcug

SEQ ID NO: 236661 - RNA, 22 nt, Human
aacuuucuugugacauuugggg

SEQ ID NO: 236662 - RNA, 22 nt, Human
gcuggcugguccagcaggggcu

SEQ ID NO: 236663 - RNA, 22 nt, Human
cagcuuuuaggacugugagaaa

SEQ ID NO: 236664 - RNA, 22 nt, Human
gggcucuggggucagacagccu

SEQ ID NO: 236665 - RNA, 22 nt, Human
cagaggagaauugcgggaucau

SEQ ID NO: 236666 - RNA, 22 nt, Human
ucaacaguucuguccaauuaau

SEQ ID NO: 236667 - RNA, 22 nt, Human
gcaggcuucaagcacagcuuuu

SEQ ID NO: 236668 - RNA, 22 nt, Human
aaguauuauuuaacaaauuugu

SEQ ID NO: 236669 - RNA, 22 nt, Human
acuguucuuguaacacuuaaau

SEQ ID NO: 236670 - RNA, 22 nt, Human
ccaggcucaggccugcucguug

SEQ ID NO: 236671 - RNA, 22 nt, Human
ugaaaauucaucucauagcaga

SEQ ID NO: 236672 - RNA, 22 nt, Human
uuucuauaaucuaccaugccag

SEQ ID NO: 236673 - RNA, 22 nt, Human
gggucagagccguaacaggacu

SEQ ID NO: 236674 - RNA, 20 nt, Human
aucaaaauccuauugagguu

SEQ ID NO: 236675 - RNA, 22 nt, Human
uuuguacaauuagcagaggcua

SEQ ID NO: 236676 - RNA, 22 nt, Human
acaaugaugcagaugaguaaga

SEQ ID NO: 236677 - RNA, 22 nt, Human
uauauucauuuuaaagccaucu

SEQ ID NO: 236678 - RNA, 22 nt, Human
cccuccucaacucuggcuucca

SEQ ID NO: 236679 - RNA, 22 nt, Human
aggcuucuccuuccuaccuucc

SEQ ID NO: 236680 - RNA, 22 nt, Human
aggcugugcacagggcaccugc

SEQ ID NO: 236681 - RNA, 22 nt, Human
gacaacugccccauuuuaaaug

SEQ ID NO: 236682 - RNA, 22 nt, Human
aggccuuaccauagcuguagca

SEQ ID NO: 236683 - RNA, 22 nt, Human
uuuauagucgucucaguaauaa

SEQ ID NO: 236684 - RNA, 22 nt, Human
aacuccauuucccugccuccug

SEQ ID NO: 236685 - RNA, 22 nt, Human
aaauuucaguuaccuuuacguu

SEQ ID NO: 236686 - RNA, 22 nt, Human
cuaucuuuuguucauuuugagu

SEQ ID NO: 236687 - RNA, 22 nt, Human
ucagugucuugggcuugaaugc

SEQ ID NO: 236688 - RNA, 22 nt, Human
ugguacaagcagacucagcaga

SEQ ID NO: 236689 - RNA, 22 nt, Human
augucugguggucgaugcuaca

SEQ ID NO: 236690 - RNA, 22 nt, Human
agacaaaugaacaaauauguga

SEQ ID NO: 236691 - RNA, 22 nt, Human
uuaagagguggucgugucugug

SEQ ID NO: 236692 - RNA, 22 nt, Human
gaacugguuacagagggauguu

SEQ ID NO: 236693 - RNA, 18 nt, Human
uuugcaaaggaaguaugg

SEQ ID NO: 236694 - RNA, 22 nt, Human
uuacaaacaagaucuuauucuu

SEQ ID NO: 236695 - RNA, 22 nt, Human
acagaauauuuuauuuagauca

SEQ ID NO: 236696 - RNA, 22 nt, Human
cugaggagaaagaugguccaag

SEQ ID NO: 236697 - RNA, 22 nt, Human
uacauucacaguuguucaucuc

SEQ ID NO: 236698 - RNA, 22 nt, Human
guuccacagagucucacuauga

SEQ ID NO: 236699 - RNA, 22 nt, Human
cagcaugaauguguucguaggg

SEQ ID NO: 236700 - RNA, 22 nt, Human
accuguuuuccuaucuagauug

SEQ ID NO: 236701 - RNA, 22 nt, Human
cuguggaaaauuuguauguaau

SEQ ID NO: 236702 - RNA, 22 nt, Human
acagguguagaaaacagauuau

SEQ ID NO: 236703 - RNA, 22 nt, Human
uucuugaaucacuuuagagaua

SEQ ID NO: 236704 - RNA, 18 nt, Human
ccaggcuacuucuuggcc

SEQ ID NO: 236705 - RNA, 22 nt, Human
caaggcagucccuacucccugc

SEQ ID NO: 236706 - RNA, 22 nt, Human
cuccccaccuucgcggucccug

SEQ ID NO: 236707 - RNA, 22 nt, Human
agcuguguaagucauguaggug

SEQ ID NO: 236708 - RNA, 22 nt, Human
cucagugugaaugcucaguaaa

SEQ ID NO: 236709 - RNA, 22 nt, Human
acagcacuuuacuucucaguga

SEQ ID NO: 236710 - RNA, 22 nt, Human
uggcuucuaguuugaggaaaaa

SEQ ID NO: 236711 - RNA, 22 nt, Human
ugcauuggaaaacuauggcuca

SEQ ID NO: 236712 - RNA, 22 nt, Human
gccagccaagauugagaaggua

SEQ ID NO: 236713 - RNA, 23 nt, Human
aaaggcaggccuaggacauauug

SEQ ID NO: 236714 - RNA, 22 nt, Human
cucaggcugcccugacagcccc

SEQ ID NO: 236715 - RNA, 22 nt, Human
guuagagggaaaaaucauuugc

SEQ ID NO: 236716 - RNA, 22 nt, Human
agggcacaggcuggcaggaucu

SEQ ID NO: 236717 - RNA, 22 nt, Human
caggcuccuuaucuuacaacuu

SEQ ID NO: 236718 - RNA, 18 nt, Human
gcucugcaggugcucggu

SEQ ID NO: 236719 - RNA, 22 nt, Human
ccaaugauggugcccacgauga

SEQ ID NO: 236720 - RNA, 22 nt, Human
aggcccaguagugcugccuuua

SEQ ID NO: 236721 - RNA, 22 nt, Human
ucaacacuggcuacaguuaugc

SEQ ID NO: 236722 - RNA, 22 nt, Human
uaggcagcgcuuggcugugcuu

SEQ ID NO: 236723 - RNA, 22 nt, Human
ucugggcugucuacagguuggc

SEQ ID NO: 236724 - RNA, 22 nt, Human
agucacugaauaccuuaauguu

SEQ ID NO: 236725 - RNA, 22 nt, Human
gacaguuuugcugaaauugagc

SEQ ID NO: 236726 - RNA, 22 nt, Human
ugucugaguggugcaaggcuga

SEQ ID NO: 236727 - RNA, 22 nt, Human
ucagggcccuggacaacccucc

SEQ ID NO: 236728 - RNA, 22 nt, Human
ugcaguggaagagguggagauc

SEQ ID NO: 236729 - RNA, 22 nt, Human
aucaaaguaggcauauguuuuu

SEQ ID NO: 236730 - RNA, 22 nt, Human
ucaggaagugguaaaggauguu

SEQ ID NO: 236731 - RNA, 22 nt, Human
cugggcagagcuaacaccugag

SEQ ID NO: 236732 - RNA, 22 nt, Human
agggucagguuaagggagucau

SEQ ID NO: 236733 - RNA, 22 nt, Human
uaagaaucugcauuuuaacaag

SEQ ID NO: 236734 - RNA, 22 nt, Human
gcaccaugauggagccucauua

SEQ ID NO: 236735 - RNA, 22 nt, Human
aucagagacaaaaccagcacuu

SEQ ID NO: 236736 - RNA, 22 nt, Human
ugugacugagcugcagaguguc

SEQ ID NO: 236737 - RNA, 22 nt, Human
agaggcuccuucacucuggcac

SEQ ID NO: 236738 - RNA, 22 nt, Human
uuuacuucugcauuuccccuag

SEQ ID NO: 236739 - RNA, 22 nt, Human
uugccauuaaaacauguuaucu

SEQ ID NO: 236740 - RNA, 22 nt, Human
aauaucuguuguucuaagccac

SEQ ID NO: 236741 - RNA, 18 nt, Human
gcauuuuaaucugaggca

SEQ ID NO: 236742 - RNA, 22 nt, Human
cugaagcaugcguuuguaaacu

SEQ ID NO: 236743 - RNA, 22 nt, Human
ucuuagaauugaagucagaggg

SEQ ID NO: 236744 - RNA, 22 nt, Human
ucccuggggcaguggcucggag

SEQ ID NO: 236745 - RNA, 22 nt, Human
guccuggggaauacagaagccg

SEQ ID NO: 236746 - RNA, 22 nt, Human
agaagaaaugugaaggccacug

SEQ ID NO: 236747 - RNA, 22 nt, Human
uuucagugaaagcuacuguuag

SEQ ID NO: 236748 - RNA, 21 nt, Human
uuguguccuucuaaagggcca

SEQ ID NO: 236749 - RNA, 22 nt, Human
cuuggaggaaaggcagggagac

SEQ ID NO: 236750 - RNA, 22 nt, Human
gguggcagggagugucccuggg

SEQ ID NO: 236751 - RNA, 22 nt, Human
gcccaagggcaucaaguucuac

SEQ ID NO: 236752 - RNA, 22 nt, Human
uauuggucuucuguucccuauu

SEQ ID NO: 236753 - RNA, 22 nt, Human
agcccccucccuagugacugga

SEQ ID NO: 236754 - RNA, 22 nt, Human
acugccuugucucuugccuguu

SEQ ID NO: 236755 - RNA, 22 nt, Human
uccagccccgaggccggcgacg

SEQ ID NO: 236756 - RNA, 23 nt, Human
uuguccucuggaucgguuugguu

SEQ ID NO: 236757 - RNA, 22 nt, Human
uucuuuggaauaagucaagcug

SEQ ID NO: 236758 - RNA, 23 nt, Human
cauccaggagcugagucugacug

SEQ ID NO: 236759 - RNA, 22 nt, Human
cuccuggcacucaguguggaag

SEQ ID NO: 236760 - RNA, 22 nt, Human
cugauaggauuuaguuucuguu

SEQ ID NO: 236761 - RNA, 19 nt, Human
aggcaugggaagagaaguc

SEQ ID NO: 236762 - RNA, 22 nt, Human
gaaggcugcugggaaguguggu

SEQ ID NO: 236763 - RNA, 22 nt, Human
uuucauugaugggugauagaaa

SEQ ID NO: 236764 - RNA, 22 nt, Human
gagcugggccucagaacacagu

SEQ ID NO: 236765 - RNA, 22 nt, Human
cugcugagcaucagggcugccc

SEQ ID NO: 236766 - RNA, 22 nt, Human
gcagggugaaggucacauagaa

SEQ ID NO: 236767 - RNA, 22 nt, Human
aauuaugguauguucaacaacu

SEQ ID NO: 236768 - RNA, 21 nt, Human
ucagcagcuuuugcagucccu

SEQ ID NO: 236769 - RNA, 22 nt, Human
ucuuuucugccacagccugagc

SEQ ID NO: 236770 - RNA, 22 nt, Human
ugcagggaauccagucuagggu

SEQ ID NO: 236771 - RNA, 22 nt, Human
acagacugugaguaugcauagu

SEQ ID NO: 236772 - RNA, 22 nt, Human
acacauuaggcagugcuuaaau

SEQ ID NO: 236773 - RNA, 22 nt, Human
gcuuuuggccagauggggaaac

SEQ ID NO: 236774 - RNA, 22 nt, Human
ccaggggcucucagggugugug

SEQ ID NO: 236775 - RNA, 22 nt, Human
uucagagcaucucuaaagccag

SEQ ID NO: 236776 - RNA, 22 nt, Human
agccagcuaagggaagcaugau

SEQ ID NO: 236777 - RNA, 23 nt, Human
cuccccaguguccucaugcaucu

SEQ ID NO: 236778 - RNA, 22 nt, Human
guucugcugugucucagcaggu

SEQ ID NO: 236779 - RNA, 23 nt, Human
acugagggccacuuccaucguga

SEQ ID NO: 236780 - RNA, 22 nt, Human
ugacagacauggaagccagagu

SEQ ID NO: 236781 - RNA, 22 nt, Human
caguucuggaggauagaagucu

SEQ ID NO: 236782 - RNA, 22 nt, Human
aaguaaugguuaaauaauucua

SEQ ID NO: 236783 - RNA, 22 nt, Human
aggugaguccugggcacaggua

SEQ ID NO: 236784 - RNA, 22 nt, Human
cuucuuucuuuugaucacaggu

SEQ ID NO: 236785 - RNA, 22 nt, Human
auaaggcaagcugucaguuugu

SEQ ID NO: 236786 - RNA, 22 nt, Human
uuccaggaauucagcucucagu

SEQ ID NO: 236787 - RNA, 22 nt, Human
aaaaaugucauuauggaacuga

SEQ ID NO: 236788 - RNA, 22 nt, Human
cacuuuggaugccacuggucua

SEQ ID NO: 236789 - RNA, 22 nt, Human
cugcaaauaggggugugaauaa

SEQ ID NO: 236790 - RNA, 22 nt, Human
cucaggccauucuuccagcugc

SEQ ID NO: 236791 - RNA, 22 nt, Human
gauacacacccuugauaggacu

SEQ ID NO: 236792 - RNA, 22 nt, Human
uuucccacacaguccacugcag

SEQ ID NO: 236793 - RNA, 19 nt, Human
cuggggcuuugguacugcc

SEQ ID NO: 236794 - RNA, 22 nt, Human
caggagcuuucuucccaaacuu

SEQ ID NO: 236795 - RNA, 22 nt, Human
ucccugggaacaaaggaugaga

SEQ ID NO: 236796 - RNA, 22 nt, Human
uaacacuggagaguugguugug

SEQ ID NO: 236797 - RNA, 22 nt, Human
guuuacaguacucacuugcauu

SEQ ID NO: 236798 - RNA, 22 nt, Human
uguguacacacagauauauaca

SEQ ID NO: 236799 - RNA, 22 nt, Human
gccugcagcugcuuccacacac

SEQ ID NO: 236800 - RNA, 22 nt, Human
agugcaauagcaaagaacaaca

SEQ ID NO: 236801 - RNA, 22 nt, Human
ucuuuggcuuugccacacccaa

SEQ ID NO: 236802 - RNA, 22 nt, Human
cugcccugcuugaugacagcga

SEQ ID NO: 236803 - RNA, 22 nt, Human
cuggaggggcuggcaugguagc

SEQ ID NO: 236804 - RNA, 22 nt, Human
ccuccccaugacccggugcugg

SEQ ID NO: 236805 - RNA, 22 nt, Human
ccuggcuuauuuuuauagcagu

SEQ ID NO: 236806 - RNA, 17 nt, Human
aagcauuuaauuugcua

SEQ ID NO: 236807 - RNA, 22 nt, Human
caguaacauuucaagguagagg

SEQ ID NO: 236808 - RNA, 22 nt, Human
augguauuccuuuauguagaag

SEQ ID NO: 236809 - RNA, 23 nt, Human
aggguggcuugcuuugcuuccuu

SEQ ID NO: 236810 - RNA, 22 nt, Human
cuugaaucuucugaguauuugc

SEQ ID NO: 236811 - RNA, 22 nt, Human
gcuucuggaggagcugggcuga

SEQ ID NO: 236812 - RNA, 22 nt, Human
uaaggcuuggggaaaagugagg

SEQ ID NO: 236813 - RNA, 22 nt, Human
cuugaaagaagggucuuuuaau

SEQ ID NO: 236814 - RNA, 23 nt, Human
uggcugagguccagguaguuuca

SEQ ID NO: 236815 - RNA, 22 nt, Human
agagauuaagucacuuggucag

SEQ ID NO: 236816 - RNA, 22 nt, Human
guauaagcccauucucagagac

SEQ ID NO: 236817 - RNA, 22 nt, Human
cagcuuuuggcaggaugaccag

SEQ ID NO: 236818 - RNA, 18 nt, Human
ggcugcuuaaggagaucc

SEQ ID NO: 236819 - RNA, 19 nt, Human
aagaagcaauaagcuguga

SEQ ID NO: 236820 - RNA, 22 nt, Human
auguguccauuaucaguucugg

SEQ ID NO: 236821 - RNA, 22 nt, Human
uuucuacauguuuucuauugaa

SEQ ID NO: 236822 - RNA, 22 nt, Human
cagcaggcucugaguggcugcc

SEQ ID NO: 236823 - RNA, 22 nt, Human
ccagccugaaaugccucauccu

SEQ ID NO: 236824 - RNA, 22 nt, Human
aaucagaaccuugggucauaac

SEQ ID NO: 236825 - RNA, 22 nt, Human
agcuccaggugcaagucauggu

SEQ ID NO: 236826 - RNA, 22 nt, Human
gcugguucaccuggcuccuccc

SEQ ID NO: 236827 - RNA, 21 nt, Human
cuggacugaggagacagucgc

SEQ ID NO: 236828 - RNA, 22 nt, Human
gcaccauugcugggcuaguucc

SEQ ID NO: 236829 - RNA, 22 nt, Human
cuuauucaaugcuggaaauguu

SEQ ID NO: 236830 - RNA, 22 nt, Human
uauuucuuuucgugacuuauug

SEQ ID NO: 236831 - RNA, 22 nt, Human
aaacucuguagcuaaacauaau

SEQ ID NO: 236832 - RNA, 22 nt, Human
uucuggaaguguuagaaucugg

SEQ ID NO: 236833 - RNA, 19 nt, Human
agugcaugggcgaggugca

SEQ ID NO: 236834 - RNA, 22 nt, Human
aaaagcagguacucagcuuggg

SEQ ID NO: 236835 - RNA, 22 nt, Human
ccagggcugguggcugcagagg

SEQ ID NO: 236836 - RNA, 22 nt, Human
gaaggauuugagauuauccuag

SEQ ID NO: 236837 - RNA, 22 nt, Human
ccucuggggucuagcaauagca

SEQ ID NO: 236838 - RNA, 22 nt, Human
agaucuuuagugaagcuaaauc

SEQ ID NO: 236839 - RNA, 22 nt, Human
acuaaauauuugagagguguag

SEQ ID NO: 236840 - RNA, 22 nt, Human
auuucuguugcuuauaaauuac

SEQ ID NO: 236841 - RNA, 22 nt, Human
gcucagcuacuuacagguggcu

SEQ ID NO: 236842 - RNA, 22 nt, Human
gggccggagcugggucccgcgc

SEQ ID NO: 236843 - RNA, 22 nt, Human
ugcuuagaaucuggacuuguug

SEQ ID NO: 236844 - RNA, 22 nt, Human
aguccaaagcagaugagggcca

SEQ ID NO: 236845 - RNA, 22 nt, Human
guuauguaugggggccuuauga

SEQ ID NO: 236846 - RNA, 22 nt, Human
gagaggccugggcccgugagcu

SEQ ID NO: 236847 - RNA, 22 nt, Human
aagcugugcaggaacugcuugc

SEQ ID NO: 236848 - RNA, 22 nt, Human
uccaggccccacugaagccccu

SEQ ID NO: 236849 - RNA, 19 nt, Human
agaaucaggucaggugaca

SEQ ID NO: 236850 - RNA, 20 nt, Human
cuggguggcaagcaaggggg

SEQ ID NO: 236851 - RNA, 22 nt, Human
gagaaccuacuguauacuauau

SEQ ID NO: 236852 - RNA, 22 nt, Human
cuuucacacacauacauuugga

SEQ ID NO: 236853 - RNA, 18 nt, Human
cuuccucaucgcucuccc

SEQ ID NO: 236854 - RNA, 22 nt, Human
augaauugaggaaaacagucgu

SEQ ID NO: 236855 - RNA, 20 nt, Human
ucuguccuuucugcuaaggc

SEQ ID NO: 236856 - RNA, 17 nt, Human
ggcaggugacagacacc

SEQ ID NO: 236857 - RNA, 22 nt, Human
ugcucaggccagccggacagag

SEQ ID NO: 236858 - RNA, 22 nt, Human
ggagaaugauauauagcucagu

SEQ ID NO: 236859 - RNA, 22 nt, Human
caagauguggugggcugaguuu

SEQ ID NO: 236860 - RNA, 22 nt, Human
auucaugugccacuggugaaca

SEQ ID NO: 236861 - RNA, 22 nt, Human
guuauuuucauuggcucagacu

SEQ ID NO: 236862 - RNA, 22 nt, Human
ccaggugcucuugccagggcug

SEQ ID NO: 236863 - RNA, 22 nt, Human
ugaaauguuuggguccagaagu

SEQ ID NO: 236864 - RNA, 16 nt, Human
gcaggcagaucacaug

SEQ ID NO: 236865 - RNA, 19 nt, Human
gagggcucauuugaacaau

SEQ ID NO: 236866 - RNA, 21 nt, Human
agaaggcaaaagcagacaucu

SEQ ID NO: 236867 - RNA, 22 nt, Human
auuuucaugacuaccuuaaaua

SEQ ID NO: 236868 - RNA, 22 nt, Human
uggcccagcccugcucuagggc

SEQ ID NO: 236869 - RNA, 22 nt, Human
uagcccagaaagcaaaugucuc

SEQ ID NO: 236870 - RNA, 22 nt, Human
acagcugcauucuuaacaggaa

SEQ ID NO: 236871 - RNA, 22 nt, Human
uuuacaaggcagaacugauuaa

SEQ ID NO: 236872 - RNA, 22 nt, Human
aaacaccagucccaguauacac

SEQ ID NO: 236873 - RNA, 22 nt, Human
cagggagggaggaaaauuugcu

SEQ ID NO: 236874 - RNA, 22 nt, Human
uagcagaguaauacuuuggagc

SEQ ID NO: 236875 - RNA, 22 nt, Human
aacuuucuuggaugucucaaca

SEQ ID NO: 236876 - RNA, 22 nt, Human
auguuuauguugggcuauauuu

SEQ ID NO: 236877 - RNA, 22 nt, Human
uacaaaugaguuguaugaacca

SEQ ID NO: 236878 - RNA, 22 nt, Human
cuguuuaucuaggaguugcagg

SEQ ID NO: 236879 - RNA, 22 nt, Human
gacuucuucaugucuuuuccac

SEQ ID NO: 236880 - RNA, 22 nt, Human
aucuccagcucgcagagcuccu

SEQ ID NO: 236881 - RNA, 22 nt, Human
cagcaugagaaaaugaaucaga

SEQ ID NO: 236882 - RNA, 22 nt, Human
cucaugucggcaggacucgccc

SEQ ID NO: 236883 - RNA, 22 nt, Human
caagcuuuauccgccauguagg

SEQ ID NO: 236884 - RNA, 22 nt, Human
cagagccaucccagccuguggu

SEQ ID NO: 236885 - RNA, 22 nt, Human
uagcugaugaauaauuauucuu

SEQ ID NO: 236886 - RNA, 22 nt, Human
uucuauguggcaucaagcucag

SEQ ID NO: 236887 - RNA, 22 nt, Human
uaacagaguuguacaguuacgu

SEQ ID NO: 236888 - RNA, 22 nt, Human
ggucagaagugcaaaaucaguu

SEQ ID NO: 236889 - RNA, 22 nt, Human
gcccugcugaguccggcucaga

SEQ ID NO: 236890 - RNA, 22 nt, Human
caucuccagguuuagggagcac

SEQ ID NO: 236891 - RNA, 22 nt, Human
aagggcucccugccugaggugg

SEQ ID NO: 236892 - RNA, 22 nt, Human
acauaucuuuacucaucaucuc

SEQ ID NO: 236893 - RNA, 22 nt, Human
uuucuguuguuggugucuggcu

SEQ ID NO: 236894 - RNA, 22 nt, Human
gucuccagauauccuacacaac

SEQ ID NO: 236895 - RNA, 22 nt, Human
ugcaggcucaucucaagaguag

SEQ ID NO: 236896 - RNA, 22 nt, Human
cagcuguccuuccuggugggcg

SEQ ID NO: 236897 - RNA, 22 nt, Human
caaagcagagaacugucucauu

SEQ ID NO: 236898 - RNA, 22 nt, Human
cugcugggccuggucucugagg

SEQ ID NO: 236899 - RNA, 22 nt, Human
cacagguucaccucagguaggu

SEQ ID NO: 236900 - RNA, 22 nt, Human
aagggaugcaggaaagaagguu

SEQ ID NO: 236901 - RNA, 22 nt, Human
caggucucuuuugucacaccac

SEQ ID NO: 236902 - RNA, 22 nt, Human
gugggaguggggaagcagagug

SEQ ID NO: 236903 - RNA, 22 nt, Human
guuuguaugaauguuuuaugcu

SEQ ID NO: 236904 - RNA, 22 nt, Human
agacuggcuugcuuuacaagga

SEQ ID NO: 236905 - RNA, 20 nt, Human
cagcagagacccauggggag

SEQ ID NO: 236906 - RNA, 22 nt, Human
ccagcuggagccaagguggacu

SEQ ID NO: 236907 - RNA, 22 nt, Human
cuguggccuuggaccagcaucu

SEQ ID NO: 236908 - RNA, 22 nt, Human
ucugagaacuccggguuagauc

SEQ ID NO: 236909 - RNA, 22 nt, Human
gacauuuaaggcagucacuuaa

SEQ ID NO: 236910 - RNA, 22 nt, Human
cagcugaagaaagagugguuag

SEQ ID NO: 236911 - RNA, 22 nt, Human
uuaauuaaauucaugagcauug

SEQ ID NO: 236912 - RNA, 22 nt, Human
acagcuuuuaugggaccagcca

SEQ ID NO: 236913 - RNA, 19 nt, Human
ggcuccuguggcugcagcc

SEQ ID NO: 236914 - RNA, 22 nt, Human
uguguuucagaaccuucuuuca

SEQ ID NO: 236915 - RNA, 20 nt, Human
ccucugccuuucuagucuga

SEQ ID NO: 236916 - RNA, 22 nt, Human
guucauucugaaaagcagcuug

SEQ ID NO: 236917 - RNA, 22 nt, Human
caauguguuugcauauuaaaau

SEQ ID NO: 236918 - RNA, 22 nt, Human
gagaccccagcucagccuccag

SEQ ID NO: 236919 - RNA, 22 nt, Human
gcagugggaagguuggcacaug

SEQ ID NO: 236920 - RNA, 22 nt, Human
gggcugagagcuggaaucugag

SEQ ID NO: 236921 - RNA, 22 nt, Human
auauaauacaaccugcuaagug

SEQ ID NO: 236922 - RNA, 19 nt, Human
ugccuuggcugccaggaaa

SEQ ID NO: 236923 - RNA, 22 nt, Human
gcuuccuggagggagagagcug

SEQ ID NO: 236924 - RNA, 22 nt, Human
ggguacagagagaugagguaac

SEQ ID NO: 236925 - RNA, 22 nt, Human
ugaguacuuuauguuaguuauu

SEQ ID NO: 236926 - RNA, 22 nt, Human
guaggcagggcuguggggagaa

SEQ ID NO: 236927 - RNA, 22 nt, Human
cuccuucugaggcucuggguuc

SEQ ID NO: 236928 - RNA, 22 nt, Human
uugcaaauguuauacugccagu

SEQ ID NO: 236929 - RNA, 22 nt, Human
uuuggagagcagcuaggcccuu

SEQ ID NO: 236930 - RNA, 22 nt, Human
uguucuucuagauugccuuuua

SEQ ID NO: 236931 - RNA, 22 nt, Human
aaugggaaaagaguaugauuua

SEQ ID NO: 236932 - RNA, 22 nt, Human
uuguuucagcccagaucuuuac

SEQ ID NO: 236933 - RNA, 22 nt, Human
ucauuuguucucauucucuacu

SEQ ID NO: 236934 - RNA, 22 nt, Human
ugggcagugagaaaggucaggu

SEQ ID NO: 236935 - RNA, 22 nt, Human
uacagaauuagauuauuagaga

SEQ ID NO: 236936 - RNA, 22 nt, Human
uguccuauuucucugugcauga

SEQ ID NO: 236937 - RNA, 22 nt, Human
uuacagcagcagggacagacua

SEQ ID NO: 236938 - RNA, 22 nt, Human
ugcugggcacugucucugggga

SEQ ID NO: 236939 - RNA, 22 nt, Human
ugcagggaagcaaggguggcuc

SEQ ID NO: 236940 - RNA, 22 nt, Human
caggaaguggcugggcuggguu

SEQ ID NO: 236941 - RNA, 22 nt, Human
uccauagaaugcaguguaaauu

SEQ ID NO: 236942 - RNA, 22 nt, Human
accugcaggggugcucucuggg

SEQ ID NO: 236943 - RNA, 22 nt, Human
agcagaaagcuuauuuugacug

SEQ ID NO: 236944 - RNA, 22 nt, Human
aggcuacaauaauucccaugca

SEQ ID NO: 236945 - RNA, 22 nt, Human
aaguccagugauacuggcagga

SEQ ID NO: 236946 - RNA, 22 nt, Human
guuauaaauaccuaauaggauu

SEQ ID NO: 236947 - RNA, 22 nt, Human
uggucaggggcuucugagcugu

SEQ ID NO: 236948 - RNA, 19 nt, Human
guaacaguggacauuuuag

SEQ ID NO: 236949 - RNA, 22 nt, Human
cuguuuauacucaaaagauaca

SEQ ID NO: 236950 - RNA, 22 nt, Human
gcucuucuaaagaauguacagg

SEQ ID NO: 236951 - RNA, 22 nt, Human
cauuuuacugacucuugaauua

SEQ ID NO: 236952 - RNA, 22 nt, Human
cagcccugcagccauggccugu

SEQ ID NO: 236953 - RNA, 22 nt, Human
uuacuacauuguaacacaguac

SEQ ID NO: 236954 - RNA, 18 nt, Human
ggccucuggacuggcagc

SEQ ID NO: 236955 - RNA, 22 nt, Human
uggaggaaucagggcuuaggcu

SEQ ID NO: 236956 - RNA, 22 nt, Human
auugaaauugaugaaauucuug

SEQ ID NO: 236957 - RNA, 22 nt, Human
ugaggacauuggucaggacaug

SEQ ID NO: 236958 - RNA, 22 nt, Human
agcucccagggcugggcaaguu

SEQ ID NO: 236959 - RNA, 21 nt, Human
uucaguuucuuccucaucuau

SEQ ID NO: 236960 - RNA, 22 nt, Human
cuggauccaacagaguuggguu

SEQ ID NO: 236961 - RNA, 22 nt, Human
uugcucuguccagccagcaggu

SEQ ID NO: 236962 - RNA, 22 nt, Human
caaaguauauuggauugaaugg

SEQ ID NO: 236963 - RNA, 22 nt, Human
aggcugaguuucucauucucgc

SEQ ID NO: 236964 - RNA, 22 nt, Human
auguguccuuauaagaagaaga

SEQ ID NO: 236965 - RNA, 22 nt, Human
gcugaggcugggagcagccugu

SEQ ID NO: 236966 - RNA, 22 nt, Human
ugaggccugaagccugaaguga

SEQ ID NO: 236967 - RNA, 22 nt, Human
ccuguauucaauuuugugugau

SEQ ID NO: 236968 - RNA, 22 nt, Human
gguggccuccagggcauaggug

SEQ ID NO: 236969 - RNA, 22 nt, Human
cagggcuccccagagagccucu

SEQ ID NO: 236970 - RNA, 22 nt, Human
uaacaacaugcaauuuaaccuu

SEQ ID NO: 236971 - RNA, 22 nt, Human
uccugagagucaagaaugcagg

SEQ ID NO: 236972 - RNA, 22 nt, Human
cucaggcuccagacuuccgucc

SEQ ID NO: 236973 - RNA, 22 nt, Human
caaauacugaguuuauuuucaa

SEQ ID NO: 236974 - RNA, 22 nt, Human
aggccacagguggaagccagag

SEQ ID NO: 236975 - RNA, 22 nt, Human
ugaauuguggcuuuuuccaauu

SEQ ID NO: 236976 - RNA, 22 nt, Human
uguuuacuaugauguaaccuau

SEQ ID NO: 236977 - RNA, 22 nt, Human
gccucccuggcccacagcagcg

SEQ ID NO: 236978 - RNA, 23 nt, Human
ugguccugguugaggugggcccc

SEQ ID NO: 236979 - RNA, 22 nt, Human
uaaaugaaaggguuuaauuuau

SEQ ID NO: 236980 - RNA, 22 nt, Human
agauacacagcccugccaucac

SEQ ID NO: 236981 - RNA, 18 nt, Human
ugcuuuaugcuuauauaa

SEQ ID NO: 236982 - RNA, 22 nt, Human
cugugcucugagcgugggguug

SEQ ID NO: 236983 - RNA, 22 nt, Human
ccaaggcugucauucaguagcu

SEQ ID NO: 236984 - RNA, 23 nt, Human
acagggcuagcugacagugguau

SEQ ID NO: 236985 - RNA, 22 nt, Human
ggcaaaaaccauaauuacuuuu

SEQ ID NO: 236986 - RNA, 22 nt, Human
augauucagcccaauuuuucua

SEQ ID NO: 236987 - RNA, 22 nt, Human
guagaauuaccucucuaugucc

SEQ ID NO: 236988 - RNA, 22 nt, Human
aaaagaguguuucaacuuuggc

SEQ ID NO: 236989 - RNA, 22 nt, Human
gccaugcuugguaugcugugag

SEQ ID NO: 236990 - RNA, 22 nt, Human
ccacaagaugcaaacucuaaca

SEQ ID NO: 236991 - RNA, 22 nt, Human
uuacauuagacccacuuucaug

SEQ ID NO: 236992 - RNA, 22 nt, Human
aggaaaugcugaugcuccugga

SEQ ID NO: 236993 - RNA, 23 nt, Human
gggaaaggauaugauccuagggg

SEQ ID NO: 236994 - RNA, 22 nt, Human
aaggcuuccacuuuguuggguc

SEQ ID NO: 236995 - RNA, 22 nt, Human
uccucccuaaauccuagacugu

SEQ ID NO: 236996 - RNA, 22 nt, Human
ucugugcuaaugcuucacaaua

SEQ ID NO: 236997 - RNA, 22 nt, Human
ucucagcugccugcccugcucc

SEQ ID NO: 236998 - RNA, 21 nt, Human
cacaagacacauaggguguuu

SEQ ID NO: 236999 - RNA, 22 nt, Human
cuuuggcucaugguuuuaucca

SEQ ID NO: 237000 - RNA, 22 nt, Human
gaggcuggugguuaguuccauu

SEQ ID NO: 237001 - RNA, 22 nt, Human
ucugggcuugccugguugugca

SEQ ID NO: 237002 - RNA, 22 nt, Human
uuagugcaauucagagaacaau

SEQ ID NO: 237003 - RNA, 22 nt, Human
uuugggaagugggagcaaggug

SEQ ID NO: 237004 - RNA, 22 nt, Human
uuacaaagauuauauucaguua

SEQ ID NO: 237005 - RNA, 22 nt, Human
caggcccugaggauucggcggg

SEQ ID NO: 237006 - RNA, 22 nt, Human
uaagacagggucuauucuuagu

SEQ ID NO: 237007 - RNA, 22 nt, Human
uaaaacugcuugguauggucua

SEQ ID NO: 237008 - RNA, 22 nt, Human
gcaguaagaaagucaagcaguu

SEQ ID NO: 237009 - RNA, 22 nt, Human
gugaaacacccuccaaugcaca

SEQ ID NO: 237010 - RNA, 21 nt, Human
gcccagaguccucccacucca

SEQ ID NO: 237011 - RNA, 22 nt, Human
ggcuagggagacagagggcaug

SEQ ID NO: 237012 - RNA, 22 nt, Human
uuggguuuugauacaugucuaa

SEQ ID NO: 237013 - RNA, 22 nt, Human
cuacaacauagucuucuacaga

SEQ ID NO: 237014 - RNA, 22 nt, Human
cagguuuagguggacgugcagg

SEQ ID NO: 237015 - RNA, 22 nt, Human
auguuaaauagccauuuguuug

SEQ ID NO: 237016 - RNA, 22 nt, Human
aguguccuuaguuagcuuuggg

SEQ ID NO: 237017 - RNA, 22 nt, Human
gcaggcccagagucgcuggccu

SEQ ID NO: 237018 - RNA, 23 nt, Human
ucucaaaucuuugcguuguaucu

SEQ ID NO: 237019 - RNA, 22 nt, Human
aggcugcuggaggauuuaugcc

SEQ ID NO: 237020 - RNA, 19 nt, Human
cugguccugacugaggggu

SEQ ID NO: 237021 - RNA, 22 nt, Human
agcagguuuaaacucuaaugca

SEQ ID NO: 237022 - RNA, 22 nt, Human
ucuggguggugucuuccaagac

SEQ ID NO: 237023 - RNA, 22 nt, Human
uagcaacugcucuauucuagga

SEQ ID NO: 237024 - RNA, 22 nt, Human
accaggaaacucucgucuaguu

SEQ ID NO: 237025 - RNA, 22 nt, Human
auguucauuugacaaguaguga

SEQ ID NO: 237026 - RNA, 22 nt, Human
gcauucuuuuugacuccugguu

SEQ ID NO: 237027 - RNA, 22 nt, Human
cuaauacacccuauugcuuguu

SEQ ID NO: 237028 - RNA, 22 nt, Human
uacaaggcaaauccaugauguc

SEQ ID NO: 237029 - RNA, 22 nt, Human
agcuccuccugagugucuggga

SEQ ID NO: 237030 - RNA, 22 nt, Human
acuucuuuucaaaucaugcaaa

SEQ ID NO: 237031 - RNA, 22 nt, Human
agagaaacaggucagcugggag

SEQ ID NO: 237032 - RNA, 22 nt, Human
uguaaagauccuuagcaacauc

SEQ ID NO: 237033 - RNA, 18 nt, Human
caggaauggaugggauuu

SEQ ID NO: 237034 - RNA, 22 nt, Human
ggccacugccuccgccauggcu

SEQ ID NO: 237035 - RNA, 22 nt, Human
caaugacacucugcacagugcu

SEQ ID NO: 237036 - RNA, 22 nt, Human
aagccuuggggcuccucuguau

SEQ ID NO: 237037 - RNA, 22 nt, Human
agcagcagugugguuuggggaa

SEQ ID NO: 237038 - RNA, 22 nt, Human
accaggacuucauuagguucuu

SEQ ID NO: 237039 - RNA, 23 nt, Human
agcuccuguaagguggucgucac

SEQ ID NO: 237040 - RNA, 22 nt, Human
aagugcuguuucugaugaaugc

SEQ ID NO: 237041 - RNA, 22 nt, Human
uccuucuuugacaaguggcaga

SEQ ID NO: 237042 - RNA, 22 nt, Human
uccuuggagucaugauggaggu

SEQ ID NO: 237043 - RNA, 22 nt, Human
cucuggcacacuccuuccaggu

SEQ ID NO: 237044 - RNA, 22 nt, Human
agauguuaucauucagaguagc

SEQ ID NO: 237045 - RNA, 22 nt, Human
cuccaggaccagggcuccugga

SEQ ID NO: 237046 - RNA, 20 nt, Human
aggcucaggguguuuaggaa

SEQ ID NO: 237047 - RNA, 22 nt, Human
gaaacuuuggcuaaaagccaga

SEQ ID NO: 237048 - RNA, 22 nt, Human
auuaucuugauaaaauggcagu

SEQ ID NO: 237049 - RNA, 22 nt, Human
agaggaguuugcuggugugugc

SEQ ID NO: 237050 - RNA, 22 nt, Human
aucuagguuuggaagauagagu

SEQ ID NO: 237051 - RNA, 19 nt, Human
ggcugagcgccuuggcugc

SEQ ID NO: 237052 - RNA, 22 nt, Human
gucuucuuuucagucugcuugu

SEQ ID NO: 237053 - RNA, 22 nt, Human
uaggcuuccgagucuugguauc

SEQ ID NO: 237054 - RNA, 20 nt, Human
gcacagagaugagcaaagua

SEQ ID NO: 237055 - RNA, 22 nt, Human
cugagggaguuccugagcccac

SEQ ID NO: 237056 - RNA, 22 nt, Human
cugggccugucccugauugagg

SEQ ID NO: 237057 - RNA, 18 nt, Human
caguuacaccuucauuca

SEQ ID NO: 237058 - RNA, 22 nt, Human
gagggcugaaguguuuuaugag

SEQ ID NO: 237059 - RNA, 18 nt, Human
aaagcuguuauuccagaa

SEQ ID NO: 237060 - RNA, 22 nt, Human
aaauuccauuuugugacuauuc

SEQ ID NO: 237061 - RNA, 22 nt, Human
cacagaacugguuaauagcaga

SEQ ID NO: 237062 - RNA, 19 nt, Human
guguacagcucagugaauu

SEQ ID NO: 237063 - RNA, 22 nt, Human
uugguacauguuaaggaagagu

SEQ ID NO: 237064 - RNA, 19 nt, Human
uaggaauguagaauccuag

SEQ ID NO: 237065 - RNA, 22 nt, Human
aaucuucauaaaaaucuaguag

SEQ ID NO: 237066 - RNA, 22 nt, Human
ggcuggcuaucugugguugccu

SEQ ID NO: 237067 - RNA, 22 nt, Human
uuuuucaugagacuagaaguca

SEQ ID NO: 237068 - RNA, 17 nt, Human
gcccugccugcugcccu

SEQ ID NO: 237069 - RNA, 22 nt, Human
aauuguaagugcugaguuaagg

SEQ ID NO: 237070 - RNA, 22 nt, Human
uguggcucuccuccugcugccc

SEQ ID NO: 237071 - RNA, 22 nt, Human
cacugggucaggauagagccca

SEQ ID NO: 237072 - RNA, 22 nt, Human
ucagggacagggugcugcugcg

SEQ ID NO: 237073 - RNA, 22 nt, Human
ugcaugcugcacacaugcguag

SEQ ID NO: 237074 - RNA, 17 nt, Human
uagcauuuaucuuccuu

SEQ ID NO: 237075 - RNA, 22 nt, Human
acaagaaagguaggauucaggu

SEQ ID NO: 237076 - RNA, 21 nt, Human
aggagcucuccaaggacaaag

SEQ ID NO: 237077 - RNA, 22 nt, Human
cuggaggugggggcaagagugu

SEQ ID NO: 237078 - RNA, 23 nt, Human
ugguggggucuuggagacagcac

SEQ ID NO: 237079 - RNA, 21 nt, Human
agggucaggaaccaggguacc

SEQ ID NO: 237080 - RNA, 22 nt, Human
gcuccuggugcuguagagauuu

SEQ ID NO: 237081 - RNA, 22 nt, Human
uuacaugggcuugugaguccuu

SEQ ID NO: 237082 - RNA, 22 nt, Human
ggcuucccagcagagggcgcac

SEQ ID NO: 237083 - RNA, 22 nt, Human
cuuauuagaguuguguucuguu

SEQ ID NO: 237084 - RNA, 22 nt, Human
uccugggaacucggaaagcucu

SEQ ID NO: 237085 - RNA, 22 nt, Human
ggcaaaaaccgcaauaacuucu

SEQ ID NO: 237086 - RNA, 22 nt, Human
uuuauauaacagagacugcuau

SEQ ID NO: 237087 - RNA, 22 nt, Human
guguacaugagaaaucaacuuu

SEQ ID NO: 237088 - RNA, 22 nt, Human
ccaggacccugcaaacccuguu

SEQ ID NO: 237089 - RNA, 22 nt, Human
cuguaacagcugucagagcagg

SEQ ID NO: 237090 - RNA, 22 nt, Human
agggcagcuggaagguggcuuc

SEQ ID NO: 237091 - RNA, 22 nt, Human
guagcugccuuucuggcccagg

SEQ ID NO: 237092 - RNA, 22 nt, Human
aggucaggaggccucugccauu

SEQ ID NO: 237093 - RNA, 22 nt, Human
gaggcugaugcugccucacaga

SEQ ID NO: 237094 - RNA, 19 nt, Human
gggagcugaggucuuuggu

SEQ ID NO: 237095 - RNA, 22 nt, Human
augauucuggugagaaugagga

SEQ ID NO: 237096 - RNA, 22 nt, Human
cucuccagggaagcaguguacu

SEQ ID NO: 237097 - RNA, 22 nt, Human
gaaaaaugagcugaugucaggg

SEQ ID NO: 237098 - RNA, 22 nt, Human
uuccuggggggauagauuucac

SEQ ID NO: 237099 - RNA, 22 nt, Human
aauauugagaaccagcauguuu

SEQ ID NO: 237100 - RNA, 22 nt, Human
uagcacagcuucuugaugucac

SEQ ID NO: 237101 - RNA, 22 nt, Human
gaggcaagcccagugggucuaa

SEQ ID NO: 237102 - RNA, 22 nt, Human
uggccuagagaagccaaaagau

SEQ ID NO: 237103 - RNA, 22 nt, Human
gccaacuggcugaucucaaagc

SEQ ID NO: 237104 - RNA, 22 nt, Human
accccuuggaguccgcgcccag

SEQ ID NO: 237105 - RNA, 20 nt, Human
gggcuggcucaacuggaucc

SEQ ID NO: 237106 - RNA, 19 nt, Human
ggauucugcaguuuucaca

SEQ ID NO: 237107 - RNA, 22 nt, Human
acagaauugggguucuugggga

SEQ ID NO: 237108 - RNA, 22 nt, Human
agaggauguucuaggcacucau

SEQ ID NO: 237109 - RNA, 22 nt, Human
auaaugaggauuugcauauuag

SEQ ID NO: 237110 - RNA, 22 nt, Human
ugcuggcauuucaggacucacc

SEQ ID NO: 237111 - RNA, 22 nt, Human
ugagacuuaagaggucauguug

SEQ ID NO: 237112 - RNA, 22 nt, Human
uaggcuccaguguguggcgagu

SEQ ID NO: 237113 - RNA, 22 nt, Human
uccuagggauucaacacugaac

SEQ ID NO: 237114 - RNA, 22 nt, Human
aagcaucuauauuccacuguga

SEQ ID NO: 237115 - RNA, 22 nt, Human
gcuggcucccagaggccccagc

SEQ ID NO: 237116 - RNA, 23 nt, Human
ucucugaguuguacuuucccuug

SEQ ID NO: 237117 - RNA, 22 nt, Human
cucuguauagaaaggaaacauu

SEQ ID NO: 237118 - RNA, 22 nt, Human
agaggcaaggcaggauucuucu

SEQ ID NO: 237119 - RNA, 22 nt, Human
uccagcauucuuagaccucuau

SEQ ID NO: 237120 - RNA, 22 nt, Human
uccaggaggaggaaggcugcca

SEQ ID NO: 237121 - RNA, 22 nt, Human
uauugcuggaaaauggugugau

SEQ ID NO: 237122 - RNA, 22 nt, Human
aagggcagcuuaaauugguagc

SEQ ID NO: 237123 - RNA, 22 nt, Human
aguuuguaucaauuugcuuuau

SEQ ID NO: 237124 - RNA, 20 nt, Human
ugguggagagaagcuauuug

SEQ ID NO: 237125 - RNA, 22 nt, Human
gauuuuucaguauaaaauauau

SEQ ID NO: 237126 - RNA, 22 nt, Human
ugcuguuauacuuagcugguua

SEQ ID NO: 237127 - RNA, 20 nt, Human
uagacuuuucaucaaccuua

SEQ ID NO: 237128 - RNA, 22 nt, Human
ccagcacugcucucagacugag

SEQ ID NO: 237129 - RNA, 22 nt, Human
uaugaacacacuuuggaaguga

SEQ ID NO: 237130 - RNA, 22 nt, Human
uuauucagauuggcuacaggau

SEQ ID NO: 237131 - RNA, 22 nt, Human
gcacuucacaugccuuuuccug

SEQ ID NO: 237132 - RNA, 22 nt, Human
augccagaccauccaguuggga

SEQ ID NO: 237133 - RNA, 22 nt, Human
gggaaugugaaacaguaaggga

SEQ ID NO: 237134 - RNA, 22 nt, Human
ucucuguggguuucaccagcgc

SEQ ID NO: 237135 - RNA, 22 nt, Human
uguggcagauuuuauaaauugc

SEQ ID NO: 237136 - RNA, 22 nt, Human
ugcccauggaccaagcaagggg

SEQ ID NO: 237137 - RNA, 22 nt, Human
cucuuccuuucccuugagggug

SEQ ID NO: 237138 - RNA, 22 nt, Human
ugacugugccuguugaaugaau

SEQ ID NO: 237139 - RNA, 22 nt, Human
gcaaagcaagauucagauguag

SEQ ID NO: 237140 - RNA, 22 nt, Human
agccacagagcaggagaccuuu

SEQ ID NO: 237141 - RNA, 22 nt, Human
uggcagcaguggagguagaaag

SEQ ID NO: 237142 - RNA, 22 nt, Human
uuaucaguuguguguauacacg

SEQ ID NO: 237143 - RNA, 22 nt, Human
agugccaguuaauaagaaaugg

SEQ ID NO: 237144 - RNA, 22 nt, Human
gggggagaagauucugcugcuu

SEQ ID NO: 237145 - RNA, 22 nt, Human
agugauuuuaucaauuuacuca

SEQ ID NO: 237146 - RNA, 19 nt, Human
uguggcugagcacuccuua

SEQ ID NO: 237147 - RNA, 22 nt, Human
cugagcaggauauucacagcag

SEQ ID NO: 237148 - RNA, 22 nt, Human
uagcaggguuuugaagaggguu

SEQ ID NO: 237149 - RNA, 22 nt, Human
caaagcaguuuuaaucaaguag

SEQ ID NO: 237150 - RNA, 22 nt, Human
gggggcugaggcuguucugagg

SEQ ID NO: 237151 - RNA, 22 nt, Human
guggaggacaaaagaagccuuu

SEQ ID NO: 237152 - RNA, 22 nt, Human
ugcauguggaccccuggugccu

SEQ ID NO: 237153 - RNA, 22 nt, Human
cuguauuuaguuaaaaugcuaa

SEQ ID NO: 237154 - RNA, 22 nt, Human
acugaaguccacacauguagga

SEQ ID NO: 237155 - RNA, 22 nt, Human
uagcuacacugaggcugcuuaa

SEQ ID NO: 237156 - RNA, 22 nt, Human
gccuggaggggacagucucugg

SEQ ID NO: 237157 - RNA, 22 nt, Human
cugagguagccauggcccaagu

SEQ ID NO: 237158 - RNA, 22 nt, Human
aggcaggucacaugcuuggcga

SEQ ID NO: 237159 - RNA, 22 nt, Human
cagugucuacaguggcuggagg

SEQ ID NO: 237160 - RNA, 20 nt, Human
uuuggagagaaagaaguagu

SEQ ID NO: 237161 - RNA, 22 nt, Human
uuccaugacaccgagggaaguc

SEQ ID NO: 237162 - RNA, 22 nt, Human
uucagcacuguuauggauuugc

SEQ ID NO: 237163 - RNA, 21 nt, Human
ucaggcaggucccacugaaca

SEQ ID NO: 237164 - RNA, 22 nt, Human
agcaucugcuuaauggcuuaac

SEQ ID NO: 237165 - RNA, 22 nt, Human
agaugcugaagcugaggcaaca

SEQ ID NO: 237166 - RNA, 22 nt, Human
auacaaguuaaugagaaugaca

SEQ ID NO: 237167 - RNA, 22 nt, Human
cuguccagaaagggggcaacaa

SEQ ID NO: 237168 - RNA, 22 nt, Human
ggagacaggguugaaccacgca

SEQ ID NO: 237169 - RNA, 22 nt, Human
uagaaaugauuuugaugcuuca

SEQ ID NO: 237170 - RNA, 22 nt, Human
agcaggcaccagggcucguccu

SEQ ID NO: 237171 - RNA, 22 nt, Human
aauguguuuuaugagagaauau

SEQ ID NO: 237172 - RNA, 22 nt, Human
agcaaggccgagaggaugcuau

SEQ ID NO: 237173 - RNA, 22 nt, Human
cuucuugacuucugggugcccu

SEQ ID NO: 237174 - RNA, 22 nt, Human
cugccagggcauccuguggugg

SEQ ID NO: 237175 - RNA, 22 nt, Human
aauguacaaaccuucuuuguag

SEQ ID NO: 237176 - RNA, 22 nt, Human
ggaggagcacuugacggggucu

SEQ ID NO: 237177 - RNA, 22 nt, Human
agauuuacuggagucuuuggug

SEQ ID NO: 237178 - RNA, 22 nt, Human
guuuacaaauauuuuaaauggu

SEQ ID NO: 237179 - RNA, 22 nt, Human
ggaacugaaugucucgguauaa

SEQ ID NO: 237180 - RNA, 22 nt, Human
gagggaguaacguacuacagug

SEQ ID NO: 237181 - RNA, 22 nt, Human
gcugcccucccagggcaagcuu

SEQ ID NO: 237182 - RNA, 22 nt, Human
aggagcucagccugcagggagc

SEQ ID NO: 237183 - RNA, 22 nt, Human
uugacaggagccaaaauaggau

SEQ ID NO: 237184 - RNA, 22 nt, Human
aaguucuuagacaagcuugugg

SEQ ID NO: 237185 - RNA, 22 nt, Human
uggcuucucccuccccaucuag

SEQ ID NO: 237186 - RNA, 22 nt, Human
cuccugggcuaugucugcuugg

SEQ ID NO: 237187 - RNA, 22 nt, Human
agucaccuugaaaugucuugaa

SEQ ID NO: 237188 - RNA, 22 nt, Human
cuggaaguauaggggagaugau

SEQ ID NO: 237189 - RNA, 22 nt, Human
ggcuucuccuggaaguacagag

SEQ ID NO: 237190 - RNA, 22 nt, Human
ucagcagccgcagcugacucag

SEQ ID NO: 237191 - RNA, 22 nt, Human
ugcagacaagugcaucuaaccc

SEQ ID NO: 237192 - RNA, 22 nt, Human
aucauuucccuuuagaucacaa

SEQ ID NO: 237193 - RNA, 22 nt, Human
acucuggagauggaugucagga

SEQ ID NO: 237194 - RNA, 22 nt, Human
cggcugagcagugcugauggaa

SEQ ID NO: 237195 - RNA, 22 nt, Human
gagcuacagaguuugguguuca

SEQ ID NO: 237196 - RNA, 22 nt, Human
ucagggcaucaucaugaauaua

SEQ ID NO: 237197 - RNA, 22 nt, Human
caggaaauaucucaacacuuua

SEQ ID NO: 237198 - RNA, 22 nt, Human
accacuguacuauuugaguggc

SEQ ID NO: 237199 - RNA, 22 nt, Human
uggccucugaggcaccuuugcc

SEQ ID NO: 237200 - RNA, 22 nt, Human
gacugagaaacaguacauuacc

SEQ ID NO: 237201 - RNA, 22 nt, Human
gucugggaguuuggugcugccg

SEQ ID NO: 237202 - RNA, 22 nt, Human
uccaaaaaacguuugaauaguu

SEQ ID NO: 237203 - RNA, 22 nt, Human
caaagaguuuuuucauauaaug

SEQ ID NO: 237204 - RNA, 22 nt, Human
gcccacaggggaccugguggcu

SEQ ID NO: 237205 - RNA, 22 nt, Human
gucuauauauugcuugaauaau

SEQ ID NO: 237206 - RNA, 22 nt, Human
accagcucuggacaggcauuuc

SEQ ID NO: 237207 - RNA, 22 nt, Human
agccacagggggugagggacaa

SEQ ID NO: 237208 - RNA, 22 nt, Human
cucaacaugccuacucagucug

SEQ ID NO: 237209 - RNA, 22 nt, Human
aaauacauacacuguacguggc

SEQ ID NO: 237210 - RNA, 23 nt, Human
caugucugcuuucaugcuacaac

SEQ ID NO: 237211 - RNA, 23 nt, Human
gcagccaagagaccagggcaggc

SEQ ID NO: 237212 - RNA, 22 nt, Human
aacugucuuaauaacaaaagcu

SEQ ID NO: 237213 - RNA, 22 nt, Human
gcuccuggccagcacagggccc

SEQ ID NO: 237214 - RNA, 22 nt, Human
uuccaggcuauucccuuuggag

SEQ ID NO: 237215 - RNA, 22 nt, Human
cuguaggcuuagcuagaaguga

SEQ ID NO: 237216 - RNA, 22 nt, Human
acacaggcaaugugagugggag

SEQ ID NO: 237217 - RNA, 22 nt, Human
aauaacuucaucuucaggauag

SEQ ID NO: 237218 - RNA, 22 nt, Human
uccagcccucuggcccgcggug

SEQ ID NO: 237219 - RNA, 22 nt, Human
agagccaguuguuaagcacuua

SEQ ID NO: 237220 - RNA, 22 nt, Human
aguaaacauuuucauauuuucu

SEQ ID NO: 237221 - RNA, 22 nt, Human
uggccugggcaugaagcaucgu

SEQ ID NO: 237222 - RNA, 21 nt, Human
aggccaaguuggauuucuuca

SEQ ID NO: 237223 - RNA, 22 nt, Human
ucccaguguggcaggccaugga

SEQ ID NO: 237224 - RNA, 22 nt, Human
uccugggauacuaagaaauuuu

SEQ ID NO: 237225 - RNA, 22 nt, Human
cuucucagcaugguuacuguga

SEQ ID NO: 237226 - RNA, 22 nt, Human
gcagaaguggauucuacaauuu

SEQ ID NO: 237227 - RNA, 22 nt, Human
gggcugaccaaugccuugcuuu

SEQ ID NO: 237228 - RNA, 23 nt, Human
ugugggaauguuggagaggaaac

SEQ ID NO: 237229 - RNA, 19 nt, Human
cgguggcuugcagggaggu

SEQ ID NO: 237230 - RNA, 22 nt, Human
ugugugacacauugauaugugc

SEQ ID NO: 237231 - RNA, 22 nt, Human
cugggcagaguccggaagaugg

SEQ ID NO: 237232 - RNA, 22 nt, Human
acauacauguaaaggaaauuau

SEQ ID NO: 237233 - RNA, 22 nt, Human
caggggaagaugccaagggaga

SEQ ID NO: 237234 - RNA, 22 nt, Human
augacagaggagugcaggugau

SEQ ID NO: 237235 - RNA, 22 nt, Human
uccuucagggggccgccugcac

SEQ ID NO: 237236 - RNA, 22 nt, Human
gcaccagcugcuggguucuaga

SEQ ID NO: 237237 - RNA, 22 nt, Human
ccagaaagaaugaacugaaccc

SEQ ID NO: 237238 - RNA, 22 nt, Human
cuagaaccuaggaguacuaaag

SEQ ID NO: 237239 - RNA, 22 nt, Human
agcuccugucucaagggagccu

SEQ ID NO: 237240 - RNA, 22 nt, Human
uaggaacaguccuagaaaucug

SEQ ID NO: 237241 - RNA, 22 nt, Human
ucaggugucuaucuaaccuggu

SEQ ID NO: 237242 - RNA, 22 nt, Human
uucagagcuuagaauggacuac

SEQ ID NO: 237243 - RNA, 22 nt, Human
accugcagcugagaaaaugacu

SEQ ID NO: 237244 - RNA, 22 nt, Human
gcugggucucucccugguccug

SEQ ID NO: 237245 - RNA, 22 nt, Human
ccaguccugugugacccugcac

SEQ ID NO: 237246 - RNA, 22 nt, Human
uagaaacauguucuguucuguu

SEQ ID NO: 237247 - RNA, 22 nt, Human
gucugcuguagguaggacagca

SEQ ID NO: 237248 - RNA, 22 nt, Human
aagcacaugagcuauucaugcu

SEQ ID NO: 237249 - RNA, 22 nt, Human
cuuuuacaguggaccugccauu

SEQ ID NO: 237250 - RNA, 22 nt, Human
cugaaacuuuaguucugcaaca

SEQ ID NO: 237251 - RNA, 22 nt, Human
aagucugggccuccuucccaga

SEQ ID NO: 237252 - RNA, 22 nt, Human
cucucuggucccagauuccaga

SEQ ID NO: 237253 - RNA, 22 nt, Human
cacauguccuggcgcugagccc

SEQ ID NO: 237254 - RNA, 22 nt, Human
uccugcagcugauaaauacagu

SEQ ID NO: 237255 - RNA, 21 nt, Human
ucacguggucacaugagcuuu

SEQ ID NO: 237256 - RNA, 21 nt, Human
gcuggcugucccagggaagca

SEQ ID NO: 237257 - RNA, 19 nt, Human
uccugcugugugaagggga

SEQ ID NO: 237258 - RNA, 22 nt, Human
uuauucaccgcaggugcuuccc

SEQ ID NO: 237259 - RNA, 22 nt, Human
auguguucacgugcacaugugc

SEQ ID NO: 237260 - RNA, 22 nt, Human
agcugcaauucuggacauaguc

SEQ ID NO: 237261 - RNA, 22 nt, Human
cccccugcgcccggcacgucau

SEQ ID NO: 237262 - RNA, 22 nt, Human
aggguggcugaguagauggaag

SEQ ID NO: 237263 - RNA, 22 nt, Human
cugcccugcagcuccacggacu

SEQ ID NO: 237264 - RNA, 21 nt, Human
ggguccugggaugggauccag

SEQ ID NO: 237265 - RNA, 22 nt, Human
ucucagagauucagggagaagu

SEQ ID NO: 237266 - RNA, 22 nt, Human
aagcauuuggcaugaaacucuu

SEQ ID NO: 237267 - RNA, 22 nt, Human
gagggccaggcagcaagaaggc

SEQ ID NO: 237268 - RNA, 22 nt, Human
uggugagagcugaccgugcgag

SEQ ID NO: 237269 - RNA, 22 nt, Human
gucccuggagcugagcagugcu

SEQ ID NO: 237270 - RNA, 22 nt, Human
acucuggcaagcuuccacuucc

SEQ ID NO: 237271 - RNA, 22 nt, Human
agcccagcaguaagauuagaga

SEQ ID NO: 237272 - RNA, 22 nt, Human
auuagaaaaucuggaggugggg

SEQ ID NO: 237273 - RNA, 22 nt, Human
ccuggcugacagcuuaauucca

SEQ ID NO: 237274 - RNA, 22 nt, Human
ugaggaagccaaacagcuacac

SEQ ID NO: 237275 - RNA, 22 nt, Human
ugaggcucacgaacagaagacu

SEQ ID NO: 237276 - RNA, 22 nt, Human
gccuucaguaguauccucauga

SEQ ID NO: 237277 - RNA, 22 nt, Human
auguguuuaccaggggaacaug

SEQ ID NO: 237278 - RNA, 22 nt, Human
cucugggaaagauugugcaggc

SEQ ID NO: 237279 - RNA, 22 nt, Human
ucuuuauuuaagucuguuguaa

SEQ ID NO: 237280 - RNA, 22 nt, Human
uuuuaagaaauguaugacuguc

SEQ ID NO: 237281 - RNA, 22 nt, Human
agcaggcuaagggaccuguuua

SEQ ID NO: 237282 - RNA, 22 nt, Human
gagaggcugaaaucacaggagc

SEQ ID NO: 237283 - RNA, 22 nt, Human
cuccuggcuaugacuacauuuc

SEQ ID NO: 237284 - RNA, 22 nt, Human
aacuucauuccuuuuuaugacu

SEQ ID NO: 237285 - RNA, 22 nt, Human
uggcugagggcacuaugaagcc

SEQ ID NO: 237286 - RNA, 22 nt, Human
auauagaaggugcuauuuacau

SEQ ID NO: 237287 - RNA, 22 nt, Human
uuagaaaggaaucuucauuuca

SEQ ID NO: 237288 - RNA, 22 nt, Human
uccaguaugacugauguccuuc

SEQ ID NO: 237289 - RNA, 22 nt, Human
gcaggcauggucgcugccaggu

SEQ ID NO: 237290 - RNA, 22 nt, Human
cuuauuuugcugaugacccagg

SEQ ID NO: 237291 - RNA, 20 nt, Human
gauacacagcacagagggcc

SEQ ID NO: 237292 - RNA, 22 nt, Human
aaacacugugggacaucuuacu

SEQ ID NO: 237293 - RNA, 22 nt, Human
cagccagggagcaaagaguuga

SEQ ID NO: 237294 - RNA, 22 nt, Human
uaaaggcagccacugagcucaa

SEQ ID NO: 237295 - RNA, 22 nt, Human
gaacagugccagcacacaauaa

SEQ ID NO: 237296 - RNA, 22 nt, Human
caaaaaacaccugugugaguau

SEQ ID NO: 237297 - RNA, 22 nt, Human
uccauacacauuuauuuggccu

SEQ ID NO: 237298 - RNA, 22 nt, Human
uaugcagugguaucauuuuaaa

SEQ ID NO: 237299 - RNA, 22 nt, Human
gcuuugugaauuauuacucaca

SEQ ID NO: 237300 - RNA, 22 nt, Human
agccagucucucucccuggaga

SEQ ID NO: 237301 - RNA, 22 nt, Human
cccagugucaccaacaggacac

SEQ ID NO: 237302 - RNA, 21 nt, Human
ucaauacaggugcaugugucu

SEQ ID NO: 237303 - RNA, 22 nt, Human
gugcaaaaugauauccugaagc

SEQ ID NO: 237304 - RNA, 22 nt, Human
gagcucagccugaggccuggcu

SEQ ID NO: 237305 - RNA, 22 nt, Human
uaagcacuuuauaugcuuuauc

SEQ ID NO: 237306 - RNA, 22 nt, Human
cucaggccuugaagucuuuucu

SEQ ID NO: 237307 - RNA, 22 nt, Human
uaggcuccugaggacuccaugc

SEQ ID NO: 237308 - RNA, 22 nt, Human
aggagcugcauggauaccuggu

SEQ ID NO: 237309 - RNA, 22 nt, Human
ggugccaggcuguagucagggu

SEQ ID NO: 237310 - RNA, 22 nt, Human
caaauaguaugagcaaugauuc

SEQ ID NO: 237311 - RNA, 22 nt, Human
ggucacugagcuguaauucugu

SEQ ID NO: 237312 - RNA, 22 nt, Human
caugcaaaauguauuuuauuag

SEQ ID NO: 237313 - RNA, 20 nt, Human
ucucugagcuucucuugggg

SEQ ID NO: 237314 - RNA, 22 nt, Human
uccuggccuugcgucuugggag

SEQ ID NO: 237315 - RNA, 22 nt, Human
uucacauuuacugguuuguccg

SEQ ID NO: 237316 - RNA, 22 nt, Human
aggcccuguuaugagccacugu

SEQ ID NO: 237317 - RNA, 22 nt, Human
acugugcacaauucuaaguccu

SEQ ID NO: 237318 - RNA, 22 nt, Human
aagcaccugcaguugacaaaaa

SEQ ID NO: 237319 - RNA, 22 nt, Human
aaugcuuauaccuaaugaucuu

SEQ ID NO: 237320 - RNA, 22 nt, Human
gcugggagcaaguacucaucuu

SEQ ID NO: 237321 - RNA, 22 nt, Human
auagcaaaacccacugcauuac

SEQ ID NO: 237322 - RNA, 22 nt, Human
gcgugggcuggacugggaugaa

SEQ ID NO: 237323 - RNA, 21 nt, Human
uaggagcugauggggaaguag

SEQ ID NO: 237324 - RNA, 22 nt, Human
gugagagggcugggcucaugau

SEQ ID NO: 237325 - RNA, 22 nt, Human
uguccuuuguguaucuauagua

SEQ ID NO: 237326 - RNA, 22 nt, Human
uguagaaauuaguaagaucaac

SEQ ID NO: 237327 - RNA, 22 nt, Human
aagacauuggcauugacuguaa

SEQ ID NO: 237328 - RNA, 22 nt, Human
gaccuuuagugucauguuauau

SEQ ID NO: 237329 - RNA, 22 nt, Human
aaugucaaucucagagaacaca

SEQ ID NO: 237330 - RNA, 22 nt, Human
gcaccuuucuauauucaguggc

SEQ ID NO: 237331 - RNA, 22 nt, Human
gccaggcacaguucuaggugcu

SEQ ID NO: 237332 - RNA, 22 nt, Human
ugucacauucugaugugaggug

SEQ ID NO: 237333 - RNA, 19 nt, Human
aucugaggccucaucuggg

SEQ ID NO: 237334 - RNA, 22 nt, Human
uuuuguuuaaaauccuggaugg

SEQ ID NO: 237335 - RNA, 22 nt, Human
aguaccaugcuuccugacuggu

SEQ ID NO: 237336 - RNA, 22 nt, Human
ggaauaggauuuaccucuguaa

SEQ ID NO: 237337 - RNA, 22 nt, Human
cagaaagaccugggcucaagag

SEQ ID NO: 237338 - RNA, 22 nt, Human
auguggaucacagggguguguc

SEQ ID NO: 237339 - RNA, 22 nt, Human
cuucacagucuuuauuuccucc

SEQ ID NO: 237340 - RNA, 22 nt, Human
ugcucaggaaauaaugucugug

SEQ ID NO: 237341 - RNA, 22 nt, Human
gaggccaggggagucagcgucc

SEQ ID NO: 237342 - RNA, 22 nt, Human
auauggcauucuuuuuaagggu

SEQ ID NO: 237343 - RNA, 22 nt, Human
gcauaucaugacuucuaucuua

SEQ ID NO: 237344 - RNA, 22 nt, Human
uaccagcucacacaaucuuugu

SEQ ID NO: 237345 - RNA, 22 nt, Human
ugcugugagguugagaaggaag

SEQ ID NO: 237346 - RNA, 22 nt, Human
agcaggugggaucaagcuggca

SEQ ID NO: 237347 - RNA, 22 nt, Human
auacuacaaucauaauuguaca

SEQ ID NO: 237348 - RNA, 22 nt, Human
uggcagauuguaggcaguuagg

SEQ ID NO: 237349 - RNA, 22 nt, Human
gaaugcacacgugugugcaugc

SEQ ID NO: 237350 - RNA, 22 nt, Human
gcuggggacuccccaccauagc

SEQ ID NO: 237351 - RNA, 19 nt, Human
gugagcuucuuguaagagg

SEQ ID NO: 237352 - RNA, 22 nt, Human
gguguucuuaguggcacuggca

SEQ ID NO: 237353 - RNA, 22 nt, Human
gccaggcuggucuugaacuccu

SEQ ID NO: 237354 - RNA, 22 nt, Human
augcaaucauauggcauacagc

SEQ ID NO: 237355 - RNA, 22 nt, Human
ugcccuggggagcccagccagg

SEQ ID NO: 237356 - RNA, 22 nt, Human
ugugcuauuugacuguuugcua

SEQ ID NO: 237357 - RNA, 22 nt, Human
aggacagcaguuggugagguuc

SEQ ID NO: 237358 - RNA, 22 nt, Human
guacuaaacagagaaccaauau

SEQ ID NO: 237359 - RNA, 22 nt, Human
ugggcuucuggaguggggcaga

SEQ ID NO: 237360 - RNA, 22 nt, Human
agcugcagccgcagcuguggcc

SEQ ID NO: 237361 - RNA, 22 nt, Human
ggccagagucuauaugcagaca

SEQ ID NO: 237362 - RNA, 22 nt, Human
cuuaacaugggggguaagucug

SEQ ID NO: 237363 - RNA, 22 nt, Human
cagggacaauggcagagccuga

SEQ ID NO: 237364 - RNA, 22 nt, Human
acuguucaucucuuagaaagua

SEQ ID NO: 237365 - RNA, 18 nt, Human
aggagccuuugcacugga

SEQ ID NO: 237366 - RNA, 22 nt, Human
ucagugugaggucuuccacccg

SEQ ID NO: 237367 - RNA, 22 nt, Human
cuuuggaaaagcauaccaagga

SEQ ID NO: 237368 - RNA, 22 nt, Human
aauggcucugauguuguuguga

SEQ ID NO: 237369 - RNA, 22 nt, Human
gaaggcuuaugugugacuuucg

SEQ ID NO: 237370 - RNA, 22 nt, Human
uuauugagcaccuacuaugugu

SEQ ID NO: 237371 - RNA, 22 nt, Human
aggccucuucagggagcaugga

SEQ ID NO: 237372 - RNA, 22 nt, Human
cagacaucuuuuaucuucagga

SEQ ID NO: 237373 - RNA, 22 nt, Human
cuaggaaaugaauacaguacac

SEQ ID NO: 237374 - RNA, 22 nt, Human
gcgagaaacuaagugcccuuug

SEQ ID NO: 237375 - RNA, 22 nt, Human
acugugcaugaaccgaaacaaa

SEQ ID NO: 237376 - RNA, 22 nt, Human
aaguuacagucugcuugcugac

SEQ ID NO: 237377 - RNA, 20 nt, Human
uggagcuccagcguccaugu

SEQ ID NO: 237378 - RNA, 22 nt, Human
uguccuuuuccccaaauucacu

SEQ ID NO: 237379 - RNA, 22 nt, Human
ugcacaguaaacaugacuggag

SEQ ID NO: 237380 - RNA, 22 nt, Human
gccaggcucuuccauuuggguc

SEQ ID NO: 237381 - RNA, 22 nt, Human
ugcuucucagccugucuggaaa

SEQ ID NO: 237382 - RNA, 22 nt, Human
uagagcuuggacugcauuuucg

SEQ ID NO: 237383 - RNA, 20 nt, Human
acuaacauuugcaaggggcu

SEQ ID NO: 237384 - RNA, 22 nt, Human
aagggcaggagaagacggauau

SEQ ID NO: 237385 - RNA, 22 nt, Human
agugcagcucccucaccugcuu

SEQ ID NO: 237386 - RNA, 22 nt, Human
cugagccaugagccugcgccca

SEQ ID NO: 237387 - RNA, 22 nt, Human
ugcagcccaggcgucagguggu

SEQ ID NO: 237388 - RNA, 22 nt, Human
aacagucuuacagaaguagcca

SEQ ID NO: 237389 - RNA, 22 nt, Human
agaaugcuccagagcugaaaga

SEQ ID NO: 237390 - RNA, 22 nt, Human
uggguggaauaaaucaguucug

SEQ ID NO: 237391 - RNA, 22 nt, Human
cagucuggaucugugcugcugu

SEQ ID NO: 237392 - RNA, 22 nt, Human
ugaggccacaggaaagggcccg

SEQ ID NO: 237393 - RNA, 22 nt, Human
auuucccaugugaaucaauugg

SEQ ID NO: 237394 - RNA, 22 nt, Human
caaggccaguccauuuuggaag

SEQ ID NO: 237395 - RNA, 22 nt, Human
ggaauaaagaaucugguucccc

SEQ ID NO: 237396 - RNA, 22 nt, Human
caggaaugauauucgaggagau

SEQ ID NO: 237397 - RNA, 22 nt, Human
uucaugaaacuuaacuguuggg

SEQ ID NO: 237398 - RNA, 22 nt, Human
auuuccuguugcuuuugccacu

SEQ ID NO: 237399 - RNA, 22 nt, Human
aauuccucuaucuuucuucaag

SEQ ID NO: 237400 - RNA, 22 nt, Human
gaggacacaaaguggcugagau

SEQ ID NO: 237401 - RNA, 21 nt, Human
ugggagagcguugcuguccuc

SEQ ID NO: 237402 - RNA, 22 nt, Human
uccagccccggcuuccuuacag

SEQ ID NO: 237403 - RNA, 19 nt, Human
ggccaucucugccccagca

SEQ ID NO: 237404 - RNA, 22 nt, Human
uuugaaugcaggacauacagaa

SEQ ID NO: 237405 - RNA, 22 nt, Human
aaauauugguaggaugcuuguu

SEQ ID NO: 237406 - RNA, 22 nt, Human
aaaugcaucagcucauaagaga

SEQ ID NO: 237407 - RNA, 22 nt, Human
uuccuuuagugucauauacuuu

SEQ ID NO: 237408 - RNA, 22 nt, Human
ccagggugagugucauggguua

SEQ ID NO: 237409 - RNA, 22 nt, Human
ucaggacuucauuaccucaggu

SEQ ID NO: 237410 - RNA, 22 nt, Human
aggggcuggaguucgagguuac

SEQ ID NO: 237411 - RNA, 22 nt, Human
ucagggcucagcaucuggcauu

SEQ ID NO: 237412 - RNA, 22 nt, Human
ucccucucuagccuguucagua

SEQ ID NO: 237413 - RNA, 22 nt, Human
uucauguauuuaucauguaaau

SEQ ID NO: 237414 - RNA, 22 nt, Human
cuuuggcagccucugcuauuga

SEQ ID NO: 237415 - RNA, 22 nt, Human
agcccagcagaaaguccagccu

SEQ ID NO: 237416 - RNA, 17 nt, Human
aucugcauuucuaauga

SEQ ID NO: 237417 - RNA, 22 nt, Human
ucuccaggacugagcuccagcc

SEQ ID NO: 237418 - RNA, 22 nt, Human
cagagccauccaggugccuguu

SEQ ID NO: 237419 - RNA, 22 nt, Human
uucucuggccugaggcgaggcc

SEQ ID NO: 237420 - RNA, 22 nt, Human
caauucauguuaaacagaagca

SEQ ID NO: 237421 - RNA, 22 nt, Human
agcccuugcagacugucagcau

SEQ ID NO: 237422 - RNA, 22 nt, Human
gucugggguacuuucaucugau

SEQ ID NO: 237423 - RNA, 22 nt, Human
ggccugacuugaucggcucucu

SEQ ID NO: 237424 - RNA, 22 nt, Human
ggcaggcacaguaauacauguu

SEQ ID NO: 237425 - RNA, 22 nt, Human
agcgggucugcaagccuucccu

SEQ ID NO: 237426 - RNA, 22 nt, Human
uuugaaaaaggccuuugguaug

SEQ ID NO: 237427 - RNA, 22 nt, Human
gugcugggauuacaggugugag

SEQ ID NO: 237428 - RNA, 22 nt, Human
aagcucuuaugauauuuauuua

SEQ ID NO: 237429 - RNA, 22 nt, Human
uuuggaauagcauagaagcuca

SEQ ID NO: 237430 - RNA, 22 nt, Human
uuacagguuguguauucaguga

SEQ ID NO: 237431 - RNA, 22 nt, Human
aucuauuaugcugagaaacugu

SEQ ID NO: 237432 - RNA, 22 nt, Human
ucaagcugcaucagugcaguga

SEQ ID NO: 237433 - RNA, 22 nt, Human
ucaucugaagauugcuguucaa

SEQ ID NO: 237434 - RNA, 21 nt, Human
aggagggcacaaggccaggaa

SEQ ID NO: 237435 - RNA, 22 nt, Human
agcccuggcucccagcagcgcu

SEQ ID NO: 237436 - RNA, 22 nt, Human
agagcacugcugauuuacaguc

SEQ ID NO: 237437 - RNA, 22 nt, Human
cagcccuggccccagguggucu

SEQ ID NO: 237438 - RNA, 22 nt, Human
ccagagcccgggaccuggacuu

SEQ ID NO: 237439 - RNA, 22 nt, Human
cucaggcucuggccauccaagg

SEQ ID NO: 237440 - RNA, 22 nt, Human
ccugugggagcccaggcagaua

SEQ ID NO: 237441 - RNA, 22 nt, Human
ccagaugagaccacacugcugg

SEQ ID NO: 237442 - RNA, 22 nt, Human
cuaaaggcuaggucugaacuca

SEQ ID NO: 237443 - RNA, 19 nt, Human
uucacauuggaagaaguag

SEQ ID NO: 237444 - RNA, 22 nt, Human
caaguggggcagauucucuucc

SEQ ID NO: 237445 - RNA, 22 nt, Human
uuuccuacugcccuauacacac

SEQ ID NO: 237446 - RNA, 22 nt, Human
agggcacuggcuugcaaacuca

SEQ ID NO: 237447 - RNA, 22 nt, Human
gaaggcuaaaggggcagagguu

SEQ ID NO: 237448 - RNA, 22 nt, Human
ucccugggguuccuccagccac

SEQ ID NO: 237449 - RNA, 22 nt, Human
uauucacuuugggagagccauu

SEQ ID NO: 237450 - RNA, 22 nt, Human
aucuuauuuaacacagcaaaac

SEQ ID NO: 237451 - RNA, 18 nt, Human
aagcugcccucaggcagg

SEQ ID NO: 237452 - RNA, 22 nt, Human
aaggacuaaugaauagaugaau

SEQ ID NO: 237453 - RNA, 22 nt, Human
aauaacuugaagaucucuucca

SEQ ID NO: 237454 - RNA, 22 nt, Human
caaauacuaaacauaagauuuu

SEQ ID NO: 237455 - RNA, 22 nt, Human
uauuccuaagucccaacuacau

SEQ ID NO: 237456 - RNA, 20 nt, Human
uccaugaguuagagacuaua

SEQ ID NO: 237457 - RNA, 23 nt, Human
ucagagcaagaugauguaugagc

SEQ ID NO: 237458 - RNA, 22 nt, Human
cuggcuuuaaaaugcuccugga

SEQ ID NO: 237459 - RNA, 22 nt, Human
ugcaaauaaauuucuguucauu

SEQ ID NO: 237460 - RNA, 20 nt, Human
uagauacccaaugcucauca

SEQ ID NO: 237461 - RNA, 22 nt, Human
agauggcuuccuucucacugug

SEQ ID NO: 237462 - RNA, 22 nt, Human
guuaucuucuauuucucauacu

SEQ ID NO: 237463 - RNA, 20 nt, Human
uaagaugagcuauaagaagu

SEQ ID NO: 237464 - RNA, 22 nt, Human
ggaagagaauuucucucuuuuu

SEQ ID NO: 237465 - RNA, 22 nt, Human
ugcugaggucacggcggccaga

SEQ ID NO: 237466 - RNA, 22 nt, Human
gcugccuuugugagccaagggg

SEQ ID NO: 237467 - RNA, 22 nt, Human
gaacaaggauucccaaagaaga

SEQ ID NO: 237468 - RNA, 22 nt, Human
aauauccacacugugucccugc

SEQ ID NO: 237469 - RNA, 22 nt, Human
uuuccucugagugagcugggag

SEQ ID NO: 237470 - RNA, 22 nt, Human
gcucucccgcagccuggugggc

SEQ ID NO: 237471 - RNA, 22 nt, Human
uggcccagcucagggugggcgg

SEQ ID NO: 237472 - RNA, 22 nt, Human
acagguguagguacauuugcau

SEQ ID NO: 237473 - RNA, 22 nt, Human
uuuauucaagaugagguucaug

SEQ ID NO: 237474 - RNA, 22 nt, Human
aggacaguggacacuagucccu

SEQ ID NO: 237475 - RNA, 23 nt, Human
aacacauugcuaauuacauucaa

SEQ ID NO: 237476 - RNA, 22 nt, Human
ccuuggcugugcugcccuuugc

SEQ ID NO: 237477 - RNA, 22 nt, Human
caguccuuaaggaaacauuugu

SEQ ID NO: 237478 - RNA, 19 nt, Human
gcagagugggguggagggu

SEQ ID NO: 237479 - RNA, 22 nt, Human
agagccaaggccucagucucaa

SEQ ID NO: 237480 - RNA, 22 nt, Human
gaugaggaaaccaaggcucagg

SEQ ID NO: 237481 - RNA, 22 nt, Human
ucaggcuguauaucuugcacuc

SEQ ID NO: 237482 - RNA, 22 nt, Human
cuucucagucuugguuagagag

SEQ ID NO: 237483 - RNA, 22 nt, Human
gggucagggcugccugggcuca

SEQ ID NO: 237484 - RNA, 22 nt, Human
gcuugggagaggcuuccucuuu

SEQ ID NO: 237485 - RNA, 22 nt, Human
cacacaguaggcacucauuaau

SEQ ID NO: 237486 - RNA, 22 nt, Human
ggguggggcccaggaaaucuau

SEQ ID NO: 237487 - RNA, 22 nt, Human
ugacauguccugagaagauggc

SEQ ID NO: 237488 - RNA, 22 nt, Human
auaaagauuucuuuuucucuac

SEQ ID NO: 237489 - RNA, 22 nt, Human
acaaguuuuggaagucuuaagg

SEQ ID NO: 237490 - RNA, 22 nt, Human
guggcuauauuugaggauacgu

SEQ ID NO: 237491 - RNA, 22 nt, Human
ggugcccuguaaaagccaugca

SEQ ID NO: 237492 - RNA, 22 nt, Human
aguaucaaggaucuccagcacc

SEQ ID NO: 237493 - RNA, 22 nt, Human
ucaggagcuugguagugugauu

SEQ ID NO: 237494 - RNA, 22 nt, Human
accuuggaaaugcccauugccu

SEQ ID NO: 237495 - RNA, 21 nt, Human
cucugggacauuucuuagcag

SEQ ID NO: 237496 - RNA, 22 nt, Human
uccagagagaaaaacaagcuuu

SEQ ID NO: 237497 - RNA, 22 nt, Human
uaggccauucuuggagcuuacu

SEQ ID NO: 237498 - RNA, 22 nt, Human
agucucuuuugguuccaaaaau

SEQ ID NO: 237499 - RNA, 22 nt, Human
auaaauggcuuucauuccuagg

SEQ ID NO: 237500 - RNA, 22 nt, Human
uguguccucaugagguuugcag

SEQ ID NO: 237501 - RNA, 22 nt, Human
gggagcuggccuacuauuagau

SEQ ID NO: 237502 - RNA, 19 nt, Human
ggucagagagauccaggcu

SEQ ID NO: 237503 - RNA, 22 nt, Human
acagugucugacacguaggaag

SEQ ID NO: 237504 - RNA, 22 nt, Human
aagugugggacuagggcuccag

SEQ ID NO: 237505 - RNA, 22 nt, Human
gccaggaggggagaguguguca

SEQ ID NO: 237506 - RNA, 21 nt, Human
agcugccugcucuggaccugg

SEQ ID NO: 237507 - RNA, 22 nt, Human
aauggcugggaguguauuuugg

SEQ ID NO: 237508 - RNA, 22 nt, Human
uugcagcuuagugauguuaucu

SEQ ID NO: 237509 - RNA, 22 nt, Human
cuagugagucugaaugaguugc

SEQ ID NO: 237510 - RNA, 22 nt, Human
cuccuggcuucugaaaucgugg

SEQ ID NO: 237511 - RNA, 22 nt, Human
aaacugccacaagagggacauc

SEQ ID NO: 237512 - RNA, 22 nt, Human
uaugacaaaugauauauuuggc

SEQ ID NO: 237513 - RNA, 22 nt, Human
uaaauccagcuucuaauuuaga

SEQ ID NO: 237514 - RNA, 22 nt, Human
ccugggcagggcuggacucuca

SEQ ID NO: 237515 - RNA, 22 nt, Human
aggcaagcauugggaacagggc

SEQ ID NO: 237516 - RNA, 18 nt, Human
uuacuguuaucaaaacag

SEQ ID NO: 237517 - RNA, 22 nt, Human
uucaucuggaaguucccaaggc

SEQ ID NO: 237518 - RNA, 22 nt, Human
aaggcugguggauuaugagguc

SEQ ID NO: 237519 - RNA, 22 nt, Human
ugagcagaaaagaaugcugagc

SEQ ID NO: 237520 - RNA, 19 nt, Human
gcuuuuuguugucaaaggu

SEQ ID NO: 237521 - RNA, 22 nt, Human
caggccuuugcacgugcaguug

SEQ ID NO: 237522 - RNA, 22 nt, Human
gagcaccgccuccacgaugccc

SEQ ID NO: 237523 - RNA, 22 nt, Human
ucuucucuccugcuuggcagaa

SEQ ID NO: 237524 - RNA, 22 nt, Human
caggaaggggcucacucuggcc

SEQ ID NO: 237525 - RNA, 21 nt, Human
ggccucugccuugccccacuc

SEQ ID NO: 237526 - RNA, 22 nt, Human
ggcugugggugugacaggccuc

SEQ ID NO: 237527 - RNA, 22 nt, Human
auuucauugaaguuaauucuuc

SEQ ID NO: 237528 - RNA, 22 nt, Human
cugagggagagaauggggcaaa

SEQ ID NO: 237529 - RNA, 22 nt, Human
aaaugaguuuccucaauguccu

SEQ ID NO: 237530 - RNA, 22 nt, Human
uccuguuucaacccuuacacug

SEQ ID NO: 237531 - RNA, 22 nt, Human
ucucaggcaucuguguggcaca

SEQ ID NO: 237532 - RNA, 22 nt, Human
aagaaucucucuacuuuauuac

SEQ ID NO: 237533 - RNA, 22 nt, Human
cacaugugugcugaggacugug

SEQ ID NO: 237534 - RNA, 22 nt, Human
acuuuccuggcccuguccucug

SEQ ID NO: 237535 - RNA, 22 nt, Human
aauggcaguaguugcaugagag

SEQ ID NO: 237536 - RNA, 22 nt, Human
gaggcugacggcaccaucuucu

SEQ ID NO: 237537 - RNA, 22 nt, Human
gaggugccuggcgaugucucug

SEQ ID NO: 237538 - RNA, 22 nt, Human
gggcugacaccacccaggcgca

SEQ ID NO: 237539 - RNA, 22 nt, Human
uagcugaaugccuuggauuuuu

SEQ ID NO: 237540 - RNA, 21 nt, Human
ucauuuuuauugcuaccuugc

SEQ ID NO: 237541 - RNA, 22 nt, Human
cagcugcaggcugugcaggaag

SEQ ID NO: 237542 - RNA, 22 nt, Human
gcccugaggcaaaagaacaguc

SEQ ID NO: 237543 - RNA, 22 nt, Human
ucacuucuucccuugcacauau

SEQ ID NO: 237544 - RNA, 22 nt, Human
cugggaagcuucgagcaggaaa

SEQ ID NO: 237545 - RNA, 22 nt, Human
caauucuuggagaagaagcaua

SEQ ID NO: 237546 - RNA, 22 nt, Human
ggggagaauuaccaaaagcgcu

SEQ ID NO: 237547 - RNA, 22 nt, Human
ccuccuggcccugggccuggaa

SEQ ID NO: 237548 - RNA, 22 nt, Human
ccugugggcuugaguguagggu

SEQ ID NO: 237549 - RNA, 22 nt, Human
gccugaugagcuuccagcugag

SEQ ID NO: 237550 - RNA, 21 nt, Human
uauaacacacuucagcuucuc

SEQ ID NO: 237551 - RNA, 22 nt, Human
ugaaaguuacaggaaaacagau

SEQ ID NO: 237552 - RNA, 22 nt, Human
uucaaaccuucacuugcagagu

SEQ ID NO: 237553 - RNA, 22 nt, Human
ugcuggcuuccugugcacagca

SEQ ID NO: 237554 - RNA, 22 nt, Human
agcugagcauuugauccaccuc

SEQ ID NO: 237555 - RNA, 22 nt, Human
ugauacagucagcucacaauug

SEQ ID NO: 237556 - RNA, 22 nt, Human
ugccuggcacagagcagguggc

SEQ ID NO: 237557 - RNA, 22 nt, Human
uaaucguauguguaucaaauca

SEQ ID NO: 237558 - RNA, 22 nt, Human
gcaacaaguguaaacaugcauu

SEQ ID NO: 237559 - RNA, 22 nt, Human
ucagagucuuggcaauagguua

SEQ ID NO: 237560 - RNA, 22 nt, Human
guugugcagggcgaggaccuga

SEQ ID NO: 237561 - RNA, 22 nt, Human
uagauccagcuguuauguuaug

SEQ ID NO: 237562 - RNA, 22 nt, Human
uaauagaauaguggaaacauug

SEQ ID NO: 237563 - RNA, 22 nt, Human
cuacauuuguucaaauaagcug

SEQ ID NO: 237564 - RNA, 22 nt, Human
uccuuaccucaagcuugugguc

SEQ ID NO: 237565 - RNA, 22 nt, Human
ucagugcaaaaaaugggcuaga

SEQ ID NO: 237566 - RNA, 22 nt, Human
uaccaggcagcugcacagaggc

SEQ ID NO: 237567 - RNA, 22 nt, Human
ucugaauucaguauggucuuuc

SEQ ID NO: 237568 - RNA, 22 nt, Human
ugucugggauguaauuccugcc

SEQ ID NO: 237569 - RNA, 22 nt, Human
uauuccaaaauaguuaagcacu

SEQ ID NO: 237570 - RNA, 22 nt, Human
cagcaaauacuacuaguuuuua

SEQ ID NO: 237571 - RNA, 22 nt, Human
uccuucaaagcuccuagugagc

SEQ ID NO: 237572 - RNA, 22 nt, Human
guccacagagggcugggcaggc

SEQ ID NO: 237573 - RNA, 22 nt, Human
cuucugaagagguuaucauaga

SEQ ID NO: 237574 - RNA, 22 nt, Human
gcuggcugccugguuaugccuu

SEQ ID NO: 237575 - RNA, 22 nt, Human
aaggcauugcugauccucaggu

SEQ ID NO: 237576 - RNA, 22 nt, Human
aauaccuuuucagugcacaaaa

SEQ ID NO: 237577 - RNA, 22 nt, Human
uuuauaaaauagacugggucua

SEQ ID NO: 237578 - RNA, 22 nt, Human
agcccuggaagccacaguccua

SEQ ID NO: 237579 - RNA, 22 nt, Human
cagugagggcauucagugcugg

SEQ ID NO: 237580 - RNA, 22 nt, Human
guuguuuuauaauugauugcaa

SEQ ID NO: 237581 - RNA, 22 nt, Human
aagucagagcaacugagacauu

SEQ ID NO: 237582 - RNA, 23 nt, Human
aagguguucuguauuuaacucag

SEQ ID NO: 237583 - RNA, 19 nt, Human
acauuugucaagagaaggu

SEQ ID NO: 237584 - RNA, 22 nt, Human
ugcugggcacugucuagguacu

SEQ ID NO: 237585 - RNA, 22 nt, Human
gcuccuggcucucugagggcug

SEQ ID NO: 237586 - RNA, 20 nt, Human
ugcccagcaagagugcaguu

SEQ ID NO: 237587 - RNA, 19 nt, Human
ucucagagcccuagaggcc

SEQ ID NO: 237588 - RNA, 22 nt, Human
ucugcagauuuaucagcagcug

SEQ ID NO: 237589 - RNA, 22 nt, Human
uuauuucauugauuucuaagac

SEQ ID NO: 237590 - RNA, 22 nt, Human
caguauuuauggcuugaguauu

SEQ ID NO: 237591 - RNA, 22 nt, Human
gcagcugguuaaugggagaauu

SEQ ID NO: 237592 - RNA, 23 nt, Human
cggcugcucggccgaguccucgg

SEQ ID NO: 237593 - RNA, 22 nt, Human
uuaggaaagcauuguguaaaag

SEQ ID NO: 237594 - RNA, 22 nt, Human
gucaguuauucaauugguuuaa

SEQ ID NO: 237595 - RNA, 22 nt, Human
cccagcuggccagguggcuuug

SEQ ID NO: 237596 - RNA, 22 nt, Human
auuucuggauuuuggaugcugc

SEQ ID NO: 237597 - RNA, 22 nt, Human
uuauuagcugggcuucagggug

SEQ ID NO: 237598 - RNA, 22 nt, Human
acugagguuuacuugaaggaga

SEQ ID NO: 237599 - RNA, 22 nt, Human
ucugcccacaguccaauaguug

SEQ ID NO: 237600 - RNA, 22 nt, Human
gccugggacugcagauccccag

SEQ ID NO: 237601 - RNA, 22 nt, Human
aggccugccuggagccuggcug

SEQ ID NO: 237602 - RNA, 22 nt, Human
uucaauucugcucugaucuuag

SEQ ID NO: 237603 - RNA, 22 nt, Human
cagcuauuuucucauuaaggau

SEQ ID NO: 237604 - RNA, 22 nt, Human
cauagaaacuugcagcaagcac

SEQ ID NO: 237605 - RNA, 22 nt, Human
auauuuucacugaaccaaagua

SEQ ID NO: 237606 - RNA, 19 nt, Human
ugagacagggauucaggug

SEQ ID NO: 237607 - RNA, 22 nt, Human
cuggauguucuucugcaauuau

SEQ ID NO: 237608 - RNA, 22 nt, Human
ccauccuuggcucgcucucugu

SEQ ID NO: 237609 - RNA, 21 nt, Human
uuucuggguggcugcauagug

SEQ ID NO: 237610 - RNA, 22 nt, Human
guucacaucccagaaagagcau

SEQ ID NO: 237611 - RNA, 22 nt, Human
aucuagaaaguguugaagauca

SEQ ID NO: 237612 - RNA, 22 nt, Human
uucaaguaugagaaaggggacu

SEQ ID NO: 237613 - RNA, 22 nt, Human
gugcaauccucauagaacucau

SEQ ID NO: 237614 - RNA, 22 nt, Human
aagggcucucugcauugaaauu

SEQ ID NO: 237615 - RNA, 22 nt, Human
uugaggagcacuagucagguau

SEQ ID NO: 237616 - RNA, 22 nt, Human
uuacaaguuucuggcuucaucc

SEQ ID NO: 237617 - RNA, 22 nt, Human
cacacuguugaggacgagaugu

SEQ ID NO: 237618 - RNA, 22 nt, Human
ucuuugucugaacagggacauu

SEQ ID NO: 237619 - RNA, 22 nt, Human
auugaagagaagcuaaauagag

SEQ ID NO: 237620 - RNA, 22 nt, Human
acuuagauaacaaaccuguggu

SEQ ID NO: 237621 - RNA, 22 nt, Human
gaccucagugaauggucaugua

SEQ ID NO: 237622 - RNA, 22 nt, Human
cuuuggaaagugguucagguga

SEQ ID NO: 237623 - RNA, 22 nt, Human
uccagaauacucugaaaucauu

SEQ ID NO: 237624 - RNA, 22 nt, Human
augauacaucuuguuuauuuca

SEQ ID NO: 237625 - RNA, 22 nt, Human
ugcagaagugagucaugaggaa

SEQ ID NO: 237626 - RNA, 22 nt, Human
uucuccagagguggcuagaguu

SEQ ID NO: 237627 - RNA, 22 nt, Human
aaguguguauuguuuaugcugc

SEQ ID NO: 237628 - RNA, 22 nt, Human
gggagcaggacauaauagcaau

SEQ ID NO: 237629 - RNA, 22 nt, Human
uauuucuguaugcauaaaagga

SEQ ID NO: 237630 - RNA, 22 nt, Human
aaaggccaagcaugagguggac

SEQ ID NO: 237631 - RNA, 22 nt, Human
uuuagaguugaguauucauugg

SEQ ID NO: 237632 - RNA, 22 nt, Human
uaaugaaugagaauauaacaga

SEQ ID NO: 237633 - RNA, 21 nt, Human
augcaggcugcucagaagcaa

SEQ ID NO: 237634 - RNA, 21 nt, Human
uggcucugcucagagcagucc

SEQ ID NO: 237635 - RNA, 22 nt, Human
uaacacauaucuacaacaugug

SEQ ID NO: 237636 - RNA, 22 nt, Human
ccagauguuccccuggaggccu

SEQ ID NO: 237637 - RNA, 22 nt, Human
acagaauacucauaagaagggg

SEQ ID NO: 237638 - RNA, 22 nt, Human
uuuucauugagcaccugaguaa

SEQ ID NO: 237639 - RNA, 22 nt, Human
guggaauguccuugaucauaag

SEQ ID NO: 237640 - RNA, 22 nt, Human
ugcaggaguuccccucugccug

SEQ ID NO: 237641 - RNA, 22 nt, Human
cagguugguauucaucuccaca

SEQ ID NO: 237642 - RNA, 22 nt, Human
ucagguggaauuaauuaagaga

SEQ ID NO: 237643 - RNA, 22 nt, Human
augagggaggcaaggagaugcu

SEQ ID NO: 237644 - RNA, 22 nt, Human
aggcuggcauacauuuguucuu

SEQ ID NO: 237645 - RNA, 22 nt, Human
ucaggcugguggucagauggcu

SEQ ID NO: 237646 - RNA, 22 nt, Human
aaggugucaccagauuggcagg

SEQ ID NO: 237647 - RNA, 22 nt, Human
ccauguguugauucucugcaga

SEQ ID NO: 237648 - RNA, 22 nt, Human
auaauaaugaaagccacugugu

SEQ ID NO: 237649 - RNA, 22 nt, Human
aagauucacagagugaaugaaa

SEQ ID NO: 237650 - RNA, 22 nt, Human
ugauucaaauauuguguaugau

SEQ ID NO: 237651 - RNA, 22 nt, Human
cuaguuuaaagcagcugaaagg

SEQ ID NO: 237652 - RNA, 22 nt, Human
caguggcagagccguugccauc

SEQ ID NO: 237653 - RNA, 19 nt, Human
ccccaggguaggcuagggg

SEQ ID NO: 237654 - RNA, 22 nt, Human
aauucacaaaaccagauugcuu

SEQ ID NO: 237655 - RNA, 22 nt, Human
cuagaaggaagcccagcacuuc

SEQ ID NO: 237656 - RNA, 22 nt, Human
gccuggagaagauggaacuagc

SEQ ID NO: 237657 - RNA, 22 nt, Human
agagggggugucagcacugcag

SEQ ID NO: 237658 - RNA, 22 nt, Human
gcuuaaaucccaaugcuagacc

SEQ ID NO: 237659 - RNA, 22 nt, Human
auuuccaguccuaaugaucugg

SEQ ID NO: 237660 - RNA, 22 nt, Human
agggcaugugggagaggagccu

SEQ ID NO: 237661 - RNA, 22 nt, Human
auaugugugaugcauggacuaa

SEQ ID NO: 237662 - RNA, 22 nt, Human
guauuuucaagagcaguaguau

SEQ ID NO: 237663 - RNA, 22 nt, Human
aucccauuuccuaguacaucau

SEQ ID NO: 237664 - RNA, 22 nt, Human
cagugcagaggccagggaggau

SEQ ID NO: 237665 - RNA, 22 nt, Human
cauuguuucuggagggaucugu

SEQ ID NO: 237666 - RNA, 22 nt, Human
acguaauauaagaaaguguggu

SEQ ID NO: 237667 - RNA, 22 nt, Human
acagcuggaggucugugagcac

SEQ ID NO: 237668 - RNA, 22 nt, Human
gccucagaaucauuuaucaucu

SEQ ID NO: 237669 - RNA, 22 nt, Human
uggcuucucaaaauaacugguu

SEQ ID NO: 237670 - RNA, 22 nt, Human
ucauuugugugagugauuugac

SEQ ID NO: 237671 - RNA, 22 nt, Human
aucauacauguaacuaaguaaa

SEQ ID NO: 237672 - RNA, 22 nt, Human
ucagugcagaauagugaugcau

SEQ ID NO: 237673 - RNA, 22 nt, Human
ugagaugucauaguucaguuca

SEQ ID NO: 237674 - RNA, 22 nt, Human
acagggccucagccagggcaga

SEQ ID NO: 237675 - RNA, 22 nt, Human
uggcuucccauagcuugcuagu

SEQ ID NO: 237676 - RNA, 22 nt, Human
cacagagaauucccauauguga

SEQ ID NO: 237677 - RNA, 22 nt, Human
uguggcugaucaaagcgcucag

SEQ ID NO: 237678 - RNA, 22 nt, Human
uggcucaguaaucgagucuccu

SEQ ID NO: 237679 - RNA, 22 nt, Human
augguguagcaugugauaugac

SEQ ID NO: 237680 - RNA, 22 nt, Human
ggcaggugaccuggccucccag

SEQ ID NO: 237681 - RNA, 22 nt, Human
gcacagaauaacacucugggcu

SEQ ID NO: 237682 - RNA, 22 nt, Human
gugcucugccuggggucauggc

SEQ ID NO: 237683 - RNA, 22 nt, Human
ucuguuuaaugggaaugauacu

SEQ ID NO: 237684 - RNA, 22 nt, Human
agccaacaacucugagcccagu

SEQ ID NO: 237685 - RNA, 22 nt, Human
caggaaaugaacaggaaugaac

SEQ ID NO: 237686 - RNA, 23 nt, Human
uaaauuaccuuuccagugcaggg

SEQ ID NO: 237687 - RNA, 22 nt, Human
uacaucauaauaauacuuagaa

SEQ ID NO: 237688 - RNA, 22 nt, Human
uggcuucucgccugucaucccg

SEQ ID NO: 237689 - RNA, 22 nt, Human
auuuacuggaaaaacuaugagc

SEQ ID NO: 237690 - RNA, 22 nt, Human
uauuccagguauucuucaagag

SEQ ID NO: 237691 - RNA, 22 nt, Human
agcaggagcugugggaagaugg

SEQ ID NO: 237692 - RNA, 22 nt, Human
ucuaucagaguagaaggcaacg

SEQ ID NO: 237693 - RNA, 23 nt, Human
caggaaaucaauucuuccagcau

SEQ ID NO: 237694 - RNA, 22 nt, Human
acauacaucaaguaucacaaga

SEQ ID NO: 237695 - RNA, 22 nt, Human
ggacauuuuucuuccuacaaug

SEQ ID NO: 237696 - RNA, 22 nt, Human
guggauggacaugggcaagagg

SEQ ID NO: 237697 - RNA, 22 nt, Human
cuguaacuuaaugagaggcaga

SEQ ID NO: 237698 - RNA, 19 nt, Human
agcccagcuuauuugucag

SEQ ID NO: 237699 - RNA, 23 nt, Human
augguuuaugucacacuuuugau

SEQ ID NO: 237700 - RNA, 22 nt, Human
gccuugggggugaaagaggcua

SEQ ID NO: 237701 - RNA, 22 nt, Human
uucaguuucagucuugcaaaaa

SEQ ID NO: 237702 - RNA, 22 nt, Human
agacaaguucugugggucaccu

SEQ ID NO: 237703 - RNA, 22 nt, Human
cugcaggcuuccagggcugugg

SEQ ID NO: 237704 - RNA, 22 nt, Human
ggacugggaaucagggagaugc

SEQ ID NO: 237705 - RNA, 22 nt, Human
guguguggaaaguuuuccaugg

SEQ ID NO: 237706 - RNA, 22 nt, Human
cagggcuggcucaugaaaaguu

SEQ ID NO: 237707 - RNA, 22 nt, Human
ugaggccugcccuggggaaguu

SEQ ID NO: 237708 - RNA, 22 nt, Human
aggaggccugcagcugccauuc

SEQ ID NO: 237709 - RNA, 22 nt, Human
uuucaaauaccauaaaccuaau

SEQ ID NO: 237710 - RNA, 22 nt, Human
ucuucucuacaccagcagcccc

SEQ ID NO: 237711 - RNA, 22 nt, Human
aguauguugacuuauucuugga

SEQ ID NO: 237712 - RNA, 22 nt, Human
aucagagcccugaugacagacu

SEQ ID NO: 237713 - RNA, 22 nt, Human
cuuguauucugccuaaccuuca

SEQ ID NO: 237714 - RNA, 22 nt, Human
gcagcuggccccuuuccuuguu

SEQ ID NO: 237715 - RNA, 22 nt, Human
aguggcugaagcaucaaaggca

SEQ ID NO: 237716 - RNA, 22 nt, Human
auuuguagugaagugaaaauaa

SEQ ID NO: 237717 - RNA, 22 nt, Human
gugaccagugaugcugaggagu

SEQ ID NO: 237718 - RNA, 22 nt, Human
ugucuucagcaaaugccuuucu

SEQ ID NO: 237719 - RNA, 22 nt, Human
uggugcagguguugaugcagga

SEQ ID NO: 237720 - RNA, 22 nt, Human
gcuguaggaaugacauguaccu

SEQ ID NO: 237721 - RNA, 22 nt, Human
uccugcugccauuucaagugcu

SEQ ID NO: 237722 - RNA, 22 nt, Human
augcuaaauccagaagcaguca

SEQ ID NO: 237723 - RNA, 22 nt, Human
gccuguuuuccugcugugguug

SEQ ID NO: 237724 - RNA, 22 nt, Human
aggaguuauggcagaaucaaau

SEQ ID NO: 237725 - RNA, 22 nt, Human
aggagaggcaucaagaaaaucg

SEQ ID NO: 237726 - RNA, 18 nt, Human
aguguucucguuuuauaa

SEQ ID NO: 237727 - RNA, 22 nt, Human
uuucuuugagucucaguuugcu

SEQ ID NO: 237728 - RNA, 22 nt, Human
cagggggugguccaggcugcgc

SEQ ID NO: 237729 - RNA, 22 nt, Human
agccugccucagacucaggaua

SEQ ID NO: 237730 - RNA, 22 nt, Human
gggaaagaagaagagccauuuu

SEQ ID NO: 237731 - RNA, 22 nt, Human
gcuggaguccaguggcaugauc

SEQ ID NO: 237732 - RNA, 20 nt, Human
acaaagacuggaaaagcaag

SEQ ID NO: 237733 - RNA, 22 nt, Human
uguucuuucaguuagacacagu

SEQ ID NO: 237734 - RNA, 22 nt, Human
uccaggaccugacugggccugc

SEQ ID NO: 237735 - RNA, 22 nt, Human
uuccugggauuauugucaagca

SEQ ID NO: 237736 - RNA, 22 nt, Human
uuucuuuauccuccuuugcaca

SEQ ID NO: 237737 - RNA, 21 nt, Human
agcacagcauauccaauguca

SEQ ID NO: 237738 - RNA, 20 nt, Human
uuugagaccagucugcccaa

SEQ ID NO: 237739 - RNA, 22 nt, Human
ccuggcucugaaguccacauca

SEQ ID NO: 237740 - RNA, 22 nt, Human
uguggcagaggaggcagcgucc

SEQ ID NO: 237741 - RNA, 22 nt, Human
gagagacagcacacaguguggg

SEQ ID NO: 237742 - RNA, 22 nt, Human
uuuggcgucucucaggagcuca

SEQ ID NO: 237743 - RNA, 22 nt, Human
gagcccaggcagagguugcagu

SEQ ID NO: 237744 - RNA, 22 nt, Human
uuuaacagaugcuaugucuacc

SEQ ID NO: 237745 - RNA, 22 nt, Human
auauuaguuuggagacuacaau

SEQ ID NO: 237746 - RNA, 22 nt, Human
uugcuuauuugauuaaaugucu

SEQ ID NO: 237747 - RNA, 22 nt, Human
cugggagaucuccugagggcag

SEQ ID NO: 237748 - RNA, 22 nt, Human
uugcugagcuuuggcaaggaag

SEQ ID NO: 237749 - RNA, 22 nt, Human
aagcuacaguuuacccaugguu

SEQ ID NO: 237750 - RNA, 22 nt, Human
ugaaggcacuugccuaggggca

SEQ ID NO: 237751 - RNA, 22 nt, Human
uucaagucaaggaaagaggucu

SEQ ID NO: 237752 - RNA, 22 nt, Human
ggaaggcuccauacacaaagca

SEQ ID NO: 237753 - RNA, 22 nt, Human
ucaugugucugccaguguuuau

SEQ ID NO: 237754 - RNA, 22 nt, Human
gagaaggcuuccaaauucugug

SEQ ID NO: 237755 - RNA, 19 nt, Human
cugguuuagguagugaguc

SEQ ID NO: 237756 - RNA, 22 nt, Human
gaacacagucaagggcugcugu

SEQ ID NO: 237757 - RNA, 22 nt, Human
aaucuagaauuuuagggguaua

SEQ ID NO: 237758 - RNA, 22 nt, Human
ugagaauuuuuugucaugcauu

SEQ ID NO: 237759 - RNA, 22 nt, Human
ggccuuagcugucuuuccuuug

SEQ ID NO: 237760 - RNA, 22 nt, Human
guagggacccacagucuauauu

SEQ ID NO: 237761 - RNA, 22 nt, Human
cugcugggaaggucugcucagu

SEQ ID NO: 237762 - RNA, 22 nt, Human
gugcuucuuucuccucaagccu

SEQ ID NO: 237763 - RNA, 22 nt, Human
aaauuuuagaccaggcaaaacu

SEQ ID NO: 237764 - RNA, 22 nt, Human
aaguguuuggggaucauuuuaa

SEQ ID NO: 237765 - RNA, 22 nt, Human
aucuaacugggcuauuuuauug

SEQ ID NO: 237766 - RNA, 22 nt, Human
ucaaaaauaagauauucuggac

SEQ ID NO: 237767 - RNA, 22 nt, Human
uggaggacaggacuggacagcc

SEQ ID NO: 237768 - RNA, 21 nt, Human
ggcaucucuuaguaucaccau

SEQ ID NO: 237769 - RNA, 22 nt, Human
cccuuccucaaggagcuguguu

SEQ ID NO: 237770 - RNA, 22 nt, Human
gucugagcacccuggccuguca

SEQ ID NO: 237771 - RNA, 22 nt, Human
augcacauguaucuauauacaa

SEQ ID NO: 237772 - RNA, 22 nt, Human
agggagcuaggauccugaaggu

SEQ ID NO: 237773 - RNA, 22 nt, Human
gggcucugcgcucagcuccagc

SEQ ID NO: 237774 - RNA, 23 nt, Human
cucaacccuaguaagggaguagg

SEQ ID NO: 237775 - RNA, 22 nt, Human
uagggcaguuauaacauuagug

SEQ ID NO: 237776 - RNA, 22 nt, Human
agaaaguacagaugagacacuu

SEQ ID NO: 237777 - RNA, 21 nt, Human
ccagugcuacagcugccugac

SEQ ID NO: 237778 - RNA, 22 nt, Human
gugcaggggccuccccuugcug

SEQ ID NO: 237779 - RNA, 22 nt, Human
ccaggcagagugcuccagaaag

SEQ ID NO: 237780 - RNA, 22 nt, Human
agucaaauaucuuaaaaggcua

SEQ ID NO: 237781 - RNA, 22 nt, Human
ggcagccuccagggcacuggug

SEQ ID NO: 237782 - RNA, 22 nt, Human
cagagccaugguaugggcuugu

SEQ ID NO: 237783 - RNA, 22 nt, Human
aauuucaauuacuuuugcacca

SEQ ID NO: 237784 - RNA, 22 nt, Human
cuggcucauagagcagcuccaa

SEQ ID NO: 237785 - RNA, 22 nt, Human
aggaggccauucucucaguagc

SEQ ID NO: 237786 - RNA, 22 nt, Human
acaaggccaagcauucuagcaa

SEQ ID NO: 237787 - RNA, 22 nt, Human
caggcugccaaggcuggggagg

SEQ ID NO: 237788 - RNA, 22 nt, Human
ggccugagggugggcucucagu

SEQ ID NO: 237789 - RNA, 22 nt, Human
gccagacacuccccugggcagg

SEQ ID NO: 237790 - RNA, 22 nt, Human
agcucuuccugcaccuguggcu

SEQ ID NO: 237791 - RNA, 22 nt, Human
augaccccuaaaauuuacuguc

SEQ ID NO: 237792 - RNA, 22 nt, Human
acagggcagagggcaguuggua

SEQ ID NO: 237793 - RNA, 22 nt, Human
gcaaauacauguugagcaccua

SEQ ID NO: 237794 - RNA, 22 nt, Human
agggccaguucuaccucugaau

SEQ ID NO: 237795 - RNA, 21 nt, Human
ccuucuccauuacaguaagcu

SEQ ID NO: 237796 - RNA, 22 nt, Human
accagaaaggaauaauagaauu

SEQ ID NO: 237797 - RNA, 22 nt, Human
auauauacaacuagauuaaaag

SEQ ID NO: 237798 - RNA, 22 nt, Human
uucucaugaaacucgcuuccuc

SEQ ID NO: 237799 - RNA, 22 nt, Human
gcugccuugguagugaccaucu

SEQ ID NO: 237800 - RNA, 22 nt, Human
ugacagaggagcuggaaugauu

SEQ ID NO: 237801 - RNA, 22 nt, Human
cagaaauguuuauauguggugu

SEQ ID NO: 237802 - RNA, 22 nt, Human
uucaggaagguccuauagcaga

SEQ ID NO: 237803 - RNA, 22 nt, Human
uaucucagcuggaucaguggaa

SEQ ID NO: 237804 - RNA, 22 nt, Human
agccugagagccaagcugugca

SEQ ID NO: 237805 - RNA, 22 nt, Human
ugggagaggcugccaucuugca

SEQ ID NO: 237806 - RNA, 22 nt, Human
cagcaaaugaguggcagggcag

SEQ ID NO: 237807 - RNA, 22 nt, Human
ugacuucucuggccuggugcag

SEQ ID NO: 237808 - RNA, 23 nt, Human
ccuccucauaucuuugacuagug

SEQ ID NO: 237809 - RNA, 22 nt, Human
uuuauuggaacacagccaugac

SEQ ID NO: 237810 - RNA, 22 nt, Human
aggccuguuccuuccugggcac

SEQ ID NO: 237811 - RNA, 22 nt, Human
ugcucuggggagcuccucugcg

SEQ ID NO: 237812 - RNA, 22 nt, Human
uucagaaugcuauuucugaaau

SEQ ID NO: 237813 - RNA, 22 nt, Human
uggagcaggacggggaguggua

SEQ ID NO: 237814 - RNA, 22 nt, Human
uucuucaaauagcagggaguca

SEQ ID NO: 237815 - RNA, 22 nt, Human
aagucucugguugcuugcaugg

SEQ ID NO: 237816 - RNA, 21 nt, Human
aggcugcaugcaugagugugg

SEQ ID NO: 237817 - RNA, 22 nt, Human
acaggugguaaaauggacuguc

SEQ ID NO: 237818 - RNA, 22 nt, Human
gcuuuggaaggggcugguggag

SEQ ID NO: 237819 - RNA, 22 nt, Human
ucugacaggucauuuucuauag

SEQ ID NO: 237820 - RNA, 22 nt, Human
agucacagaaacccaggugugg

SEQ ID NO: 237821 - RNA, 22 nt, Human
ugcccuggagucaguggcuauu

SEQ ID NO: 237822 - RNA, 22 nt, Human
cuuauguaugcuacuuuguggu

SEQ ID NO: 237823 - RNA, 22 nt, Human
acauauguauauguacacaguc

SEQ ID NO: 237824 - RNA, 21 nt, Human
agagcuggccugccaggcccu

SEQ ID NO: 237825 - RNA, 22 nt, Human
acccucaguaaucgugcaguuu

SEQ ID NO: 237826 - RNA, 22 nt, Human
uaucuagaaauuucuuuuguug

SEQ ID NO: 237827 - RNA, 22 nt, Human
uagggcugcuuuguauucugcu

SEQ ID NO: 237828 - RNA, 22 nt, Human
aagcccucauccccaugggcgu

SEQ ID NO: 237829 - RNA, 22 nt, Human
cagcacuucagcauucagauuu

SEQ ID NO: 237830 - RNA, 19 nt, Human
gggcacagccuccccccag

SEQ ID NO: 237831 - RNA, 22 nt, Human
aagaguuucuuacuggcaucua

SEQ ID NO: 237832 - RNA, 22 nt, Human
augauucucauuuuauaaacuu

SEQ ID NO: 237833 - RNA, 22 nt, Human
aggcacaggaggugguaagaag

SEQ ID NO: 237834 - RNA, 22 nt, Human
uauacaguuaaguuucuucagu

SEQ ID NO: 237835 - RNA, 22 nt, Human
uucagcaaggcaugugcaggag

SEQ ID NO: 237836 - RNA, 22 nt, Human
uugcuuuaccugugguauauuu

SEQ ID NO: 237837 - RNA, 22 nt, Human
uauuucagggagaauaaauuug

SEQ ID NO: 237838 - RNA, 22 nt, Human
uuuagaacagauauuguaacuu

SEQ ID NO: 237839 - RNA, 22 nt, Human
cuucaguuaguuucaugugagc

SEQ ID NO: 237840 - RNA, 22 nt, Human
aguuagaauggauguugagagc

SEQ ID NO: 237841 - RNA, 22 nt, Human
uuggaacaaucacauccuugcu

SEQ ID NO: 237842 - RNA, 18 nt, Human
gauauauaggaggaaagu

SEQ ID NO: 237843 - RNA, 22 nt, Human
aagggcagcugacagaugcuua

SEQ ID NO: 237844 - RNA, 22 nt, Human
agggcagcaauuugguuccugg

SEQ ID NO: 237845 - RNA, 22 nt, Human
ugagccagauaagggcucacgc

SEQ ID NO: 237846 - RNA, 22 nt, Human
ggacagacuuuacagccccggg

SEQ ID NO: 237847 - RNA, 22 nt, Human
caauacuuccuuguuagaggca

SEQ ID NO: 237848 - RNA, 22 nt, Human
uuuagggaauagaagaucugaa

SEQ ID NO: 237849 - RNA, 22 nt, Human
uuggcugcucuguguuuaguau

SEQ ID NO: 237850 - RNA, 23 nt, Human
acagcuguugaaauuucaguggg

SEQ ID NO: 237851 - RNA, 22 nt, Human
cugccagcagaggccagcgcug

SEQ ID NO: 237852 - RNA, 22 nt, Human
uacagaaacagcgugguuagaa

SEQ ID NO: 237853 - RNA, 22 nt, Human
uccaagagaauacuggagagua

SEQ ID NO: 237854 - RNA, 22 nt, Human
uggcuucuugaucuuggacuug

SEQ ID NO: 237855 - RNA, 22 nt, Human
ucugagccaauuucugugucca

SEQ ID NO: 237856 - RNA, 22 nt, Human
uagacagauuuaaaggaaugga

SEQ ID NO: 237857 - RNA, 22 nt, Human
gugccugggguugagcuaugaa

SEQ ID NO: 237858 - RNA, 22 nt, Human
cugugggcauuugagugugggu

SEQ ID NO: 237859 - RNA, 22 nt, Human
uuucacaucagagguagauuag

SEQ ID NO: 237860 - RNA, 22 nt, Human
cacuguacuggguugaaggacg

SEQ ID NO: 237861 - RNA, 22 nt, Human
aaaauucauuccucagacugcc

SEQ ID NO: 237862 - RNA, 18 nt, Human
cuguugagauguggcuga

SEQ ID NO: 237863 - RNA, 22 nt, Human
ggcugcucggcagcuccugagc

SEQ ID NO: 237864 - RNA, 22 nt, Human
ucagggcaggcgagcagcugcu

SEQ ID NO: 237865 - RNA, 22 nt, Human
uugugaguagugccgcaauaaa

SEQ ID NO: 237866 - RNA, 22 nt, Human
guuuucuuccugcaauuggcau

SEQ ID NO: 237867 - RNA, 22 nt, Human
uugaaauacugcauuguucagu

SEQ ID NO: 237868 - RNA, 22 nt, Human
gcuuagaacauguggauugcaa

SEQ ID NO: 237869 - RNA, 22 nt, Human
cagagagcuuagugugcugcau

SEQ ID NO: 237870 - RNA, 22 nt, Human
aauaacaggcucaucagaugcu

SEQ ID NO: 237871 - RNA, 22 nt, Human
acaacauuauacauagaaagcu

SEQ ID NO: 237872 - RNA, 22 nt, Human
uagauucuuugcuagaucauug

SEQ ID NO: 237873 - RNA, 19 nt, Human
ccuuccuccccagggccau

SEQ ID NO: 237874 - RNA, 22 nt, Human
ugguggcacaagggagagaauc

SEQ ID NO: 237875 - RNA, 22 nt, Human
uccaggagucuagccucaggcc

SEQ ID NO: 237876 - RNA, 22 nt, Human
uggcaggaaccaggaggcucuc

SEQ ID NO: 237877 - RNA, 22 nt, Human
ugguacuuggaggcagaaaaau

SEQ ID NO: 237878 - RNA, 22 nt, Human
gcacaauaacagccaagguuau

SEQ ID NO: 237879 - RNA, 22 nt, Human
cagggcucaccacugggauccu

SEQ ID NO: 237880 - RNA, 22 nt, Human
ugcauuaucuuuaauguucuca

SEQ ID NO: 237881 - RNA, 22 nt, Human
augugcaaauccaaugugaaug

SEQ ID NO: 237882 - RNA, 19 nt, Human
gcugcucugggucucaucu

SEQ ID NO: 237883 - RNA, 22 nt, Human
aggcagugcucaagacagcagc

SEQ ID NO: 237884 - RNA, 22 nt, Human
ccaggucuuugacuaauaugcu

SEQ ID NO: 237885 - RNA, 22 nt, Human
ugauaaacuuagaaagaauguu

SEQ ID NO: 237886 - RNA, 22 nt, Human
cuucaguguccucucuaguaga

SEQ ID NO: 237887 - RNA, 22 nt, Human
uguuuucauggagaugguggcg

SEQ ID NO: 237888 - RNA, 22 nt, Human
ugacaggaggcuugaggccagg

SEQ ID NO: 237889 - RNA, 22 nt, Human
auuucuagcaaaggcucugcua

SEQ ID NO: 237890 - RNA, 22 nt, Human
ggccugagucacaucaggagag

SEQ ID NO: 237891 - RNA, 19 nt, Human
acaaauaguuacauauccu

SEQ ID NO: 237892 - RNA, 22 nt, Human
uaaugcuuuuccuucaaauaag

SEQ ID NO: 237893 - RNA, 22 nt, Human
gcugucuguggugucagcugac

SEQ ID NO: 237894 - RNA, 22 nt, Human
gaaaugcagaaccugagaccau

SEQ ID NO: 237895 - RNA, 22 nt, Human
ccuggccaggcucucagcacug

SEQ ID NO: 237896 - RNA, 22 nt, Human
auucugaguccaugggggcagg

SEQ ID NO: 237897 - RNA, 22 nt, Human
gcugccuucuggaggaagugaa

SEQ ID NO: 237898 - RNA, 22 nt, Human
uucuucuaaaugugcuuauuaa

SEQ ID NO: 237899 - RNA, 20 nt, Human
ucuggcucuuugcuccuccc

SEQ ID NO: 237900 - RNA, 22 nt, Human
ucaggcagaguuaauuugcucc

SEQ ID NO: 237901 - RNA, 22 nt, Human
uuaaaagggauguuaucuguaa

SEQ ID NO: 237902 - RNA, 18 nt, Human
ucauggcuuuagucccuc

SEQ ID NO: 237903 - RNA, 22 nt, Human
ccuggcaccuucacagacuacu

SEQ ID NO: 237904 - RNA, 16 nt, Human
gaccucagugcuggcu

SEQ ID NO: 237905 - RNA, 22 nt, Human
cugcaccauccuucaugcucug

SEQ ID NO: 237906 - RNA, 22 nt, Human
uaguaucuauuaguaacaagag

SEQ ID NO: 237907 - RNA, 22 nt, Human
uaaaugugucuauggacccgcc

SEQ ID NO: 237908 - RNA, 22 nt, Human
cagcuggccugaucccuguggc

SEQ ID NO: 237909 - RNA, 22 nt, Human
ccuucucuacuccugaugcaug

SEQ ID NO: 237910 - RNA, 22 nt, Human
ucauagaagcaccagaagauau

SEQ ID NO: 237911 - RNA, 22 nt, Human
uccuuaggcaauuugggagagu

SEQ ID NO: 237912 - RNA, 22 nt, Human
uccaggagacacaagguacaua

SEQ ID NO: 237913 - RNA, 22 nt, Human
ggggugugaguagagcugggga

SEQ ID NO: 237914 - RNA, 22 nt, Human
uacagaggguaauugaucaagg

SEQ ID NO: 237915 - RNA, 20 nt, Human
cuuccaccagggccgcugau

SEQ ID NO: 237916 - RNA, 22 nt, Human
uaucuauuccaaauaucagcgu

SEQ ID NO: 237917 - RNA, 22 nt, Human
ugccaggcuaaguggaggacuu

SEQ ID NO: 237918 - RNA, 22 nt, Human
ucugagacugcagugagccgcu

SEQ ID NO: 237919 - RNA, 22 nt, Human
uaccuucaccagcgaauguuug

SEQ ID NO: 237920 - RNA, 22 nt, Human
aaacucuguugagauaauauuu

SEQ ID NO: 237921 - RNA, 22 nt, Human
aguggcacaauuuugacucccc

SEQ ID NO: 237922 - RNA, 22 nt, Human
guagacagguuauaaaucagug

SEQ ID NO: 237923 - RNA, 22 nt, Human
gcaagcugaugugauagugaaa

SEQ ID NO: 237924 - RNA, 22 nt, Human
aacagacauauuuuuaauaugc

SEQ ID NO: 237925 - RNA, 22 nt, Human
ugugcacauucuaggacuagua

SEQ ID NO: 237926 - RNA, 22 nt, Human
agggcuccaggggaccaucagu

SEQ ID NO: 237927 - RNA, 22 nt, Human
ucagauauggagucuaaaacca

SEQ ID NO: 237928 - RNA, 22 nt, Human
ccugggagagucuguggucucc

SEQ ID NO: 237929 - RNA, 22 nt, Human
aacagauauaggcagaacuuug

SEQ ID NO: 237930 - RNA, 22 nt, Human
augaggcucucaggggagcugu

SEQ ID NO: 237931 - RNA, 22 nt, Human
accaugugaucaaaacaaaucc

SEQ ID NO: 237932 - RNA, 22 nt, Human
cugggccuuaugaguaccugga

SEQ ID NO: 237933 - RNA, 22 nt, Human
uguagaaggcuauagacuagga

SEQ ID NO: 237934 - RNA, 22 nt, Human
acucugugccaggcacuuuggg

SEQ ID NO: 237935 - RNA, 22 nt, Human
aucauguacuugacaaauaugu

SEQ ID NO: 237936 - RNA, 22 nt, Human
accaggaggaaguguuaaugau

SEQ ID NO: 237937 - RNA, 22 nt, Human
gugagggagguagauuucauca

SEQ ID NO: 237938 - RNA, 22 nt, Human
aagugagguuucugcuuucaga

SEQ ID NO: 237939 - RNA, 22 nt, Human
acagggagauaucuucaauauc

SEQ ID NO: 237940 - RNA, 22 nt, Human
caggagccagaggcggauggag

SEQ ID NO: 237941 - RNA, 22 nt, Human
gcucaggcuucuucuauaaaga

SEQ ID NO: 237942 - RNA, 22 nt, Human
cuguggcucuccaauggaggga

SEQ ID NO: 237943 - RNA, 19 nt, Human
uucugcuguuccuaggcug

SEQ ID NO: 237944 - RNA, 22 nt, Human
cacaguaucuuuugaguaagca

SEQ ID NO: 237945 - RNA, 22 nt, Human
agcuucucuggucuucugccaa

SEQ ID NO: 237946 - RNA, 22 nt, Human
uuggcagggcaucagacacgug

SEQ ID NO: 237947 - RNA, 22 nt, Human
gcaggcugauagaggauuccau

SEQ ID NO: 237948 - RNA, 22 nt, Human
aagagacuggaaacuaggguca

SEQ ID NO: 237949 - RNA, 22 nt, Human
gucuggcauucuuccuggagaa

SEQ ID NO: 237950 - RNA, 22 nt, Human
caggaaaaaugccaggagucag

SEQ ID NO: 237951 - RNA, 22 nt, Human
uaucacuacacuucagcuuuaa

SEQ ID NO: 237952 - RNA, 22 nt, Human
gcugcaccagcugcacccagua

SEQ ID NO: 237953 - RNA, 22 nt, Human
gcugggcucuuaucaccuguac

SEQ ID NO: 237954 - RNA, 22 nt, Human
auguguagaacuguaaugccca

SEQ ID NO: 237955 - RNA, 22 nt, Human
auugcuggcagcuggaucugca

SEQ ID NO: 237956 - RNA, 22 nt, Human
acucuggggugaugucucugag

SEQ ID NO: 237957 - RNA, 22 nt, Human
guuuauaauccaacucugcucc

SEQ ID NO: 237958 - RNA, 22 nt, Human
uucaguuucccuaaagccaauu

SEQ ID NO: 237959 - RNA, 21 nt, Human
cacagaggcgcuguauggcug

SEQ ID NO: 237960 - RNA, 22 nt, Human
ugaaaucauugccaaguauuga

SEQ ID NO: 237961 - RNA, 22 nt, Human
cagaggggauaacagguguaga

SEQ ID NO: 237962 - RNA, 22 nt, Human
gaggcagcauucgcauagacag

SEQ ID NO: 237963 - RNA, 22 nt, Human
aaaaacuguaauuacuuuugca

SEQ ID NO: 237964 - RNA, 22 nt, Human
uuugauuuacuggauauucuca

SEQ ID NO: 237965 - RNA, 22 nt, Human
ucuggacuaacagcagccucag

SEQ ID NO: 237966 - RNA, 22 nt, Human
ggaggccucaguaccuugcuuu

SEQ ID NO: 237967 - RNA, 20 nt, Human
auacacauauucuugcaacu

SEQ ID NO: 237968 - RNA, 23 nt, Human
uggggagaguuacccuggaagcg

SEQ ID NO: 237969 - RNA, 22 nt, Human
gcaggcagagaaggaacauuua

SEQ ID NO: 237970 - RNA, 22 nt, Human
gcagagccaggagagacccuug

SEQ ID NO: 237971 - RNA, 22 nt, Human
aaauauacggucccuaacaguc

SEQ ID NO: 237972 - RNA, 18 nt, Human
ucaagacaucaugaaaua

SEQ ID NO: 237973 - RNA, 22 nt, Human
aaaauccuuagccgagugaggu

SEQ ID NO: 237974 - RNA, 22 nt, Human
cuccugugcaccuccagcggca

SEQ ID NO: 237975 - RNA, 22 nt, Human
acuuucugccuuacaggagucc

SEQ ID NO: 237976 - RNA, 22 nt, Human
agagucugaaugcucagaguug

SEQ ID NO: 237977 - RNA, 22 nt, Human
cagacagaaggcuccuugaggu

SEQ ID NO: 237978 - RNA, 22 nt, Human
uccuuucuaucuuggguaucua

SEQ ID NO: 237979 - RNA, 23 nt, Human
acagacauuccauaauguacacc

SEQ ID NO: 237980 - RNA, 22 nt, Human
accuuucugcaaguucugggac

SEQ ID NO: 237981 - RNA, 22 nt, Human
acucaggccuccuucuguccuu

SEQ ID NO: 237982 - RNA, 22 nt, Human
gaacaguaaauuuaugcagcac

SEQ ID NO: 237983 - RNA, 22 nt, Human
cagcuuuaccaauauuuggaaa

SEQ ID NO: 237984 - RNA, 22 nt, Human
aguauucagcaaacgugaacag

SEQ ID NO: 237985 - RNA, 22 nt, Human
agaauccugaugaaaaggagag

SEQ ID NO: 237986 - RNA, 22 nt, Human
cucuggaaaauugugugggggu

SEQ ID NO: 237987 - RNA, 22 nt, Human
uggccacacugcccccacuggg

SEQ ID NO: 237988 - RNA, 22 nt, Human
uaaagugcuuaugauaaccaag

SEQ ID NO: 237989 - RNA, 22 nt, Human
ggcuggcugugcccuguacucu

SEQ ID NO: 237990 - RNA, 18 nt, Human
aucuuguuuuuggauuaa

SEQ ID NO: 237991 - RNA, 22 nt, Human
uugccagggccagugggggugu

SEQ ID NO: 237992 - RNA, 22 nt, Human
ucuccaggagaaauaugaagga

SEQ ID NO: 237993 - RNA, 22 nt, Human
guuccagguggucacagagcuc

SEQ ID NO: 237994 - RNA, 19 nt, Human
cuucuucuuggcagccaag

SEQ ID NO: 237995 - RNA, 22 nt, Human
gucuggaaggaggagauggagc

SEQ ID NO: 237996 - RNA, 22 nt, Human
aguguucucagcuacuagagag

SEQ ID NO: 237997 - RNA, 22 nt, Human
uggcagguggcacagccuggga

SEQ ID NO: 237998 - RNA, 22 nt, Human
guccagagagaucuucugauag

SEQ ID NO: 237999 - RNA, 22 nt, Human
ccacucagcacaguggaugcag

SEQ ID NO: 238000 - RNA, 22 nt, Human
ccucagucuugaauuagccaga

SEQ ID NO: 238001 - RNA, 22 nt, Human
gaggauggaggugugagcuaug

SEQ ID NO: 238002 - RNA, 22 nt, Human
aagauuuacuagcauaauagcu

SEQ ID NO: 238003 - RNA, 22 nt, Human
auccccuuaucccaggcugagc

SEQ ID NO: 238004 - RNA, 22 nt, Human
uagaaucugauggcccgucugg

SEQ ID NO: 238005 - RNA, 22 nt, Human
auggcugcccacguuggugcuu

SEQ ID NO: 238006 - RNA, 22 nt, Human
uggcuucagacuucugcuacgu

SEQ ID NO: 238007 - RNA, 22 nt, Human
uggcucaguuuagcagcucagu

SEQ ID NO: 238008 - RNA, 22 nt, Human
agugcuaaugugcaauauagag

SEQ ID NO: 238009 - RNA, 22 nt, Human
guggcccagcccuacagaggac

SEQ ID NO: 238010 - RNA, 22 nt, Human
gaaucuaaaaacgggcuugguu

SEQ ID NO: 238011 - RNA, 22 nt, Human
caguauguuugggagacaugac

SEQ ID NO: 238012 - RNA, 22 nt, Human
gaauugcuaaccaauucaaaau

SEQ ID NO: 238013 - RNA, 22 nt, Human
caucuccuggcagcuguuagga

SEQ ID NO: 238014 - RNA, 22 nt, Human
uuuuaauugcaauuaugguccc

SEQ ID NO: 238015 - RNA, 22 nt, Human
uuggaagcaguguacacuguac

SEQ ID NO: 238016 - RNA, 22 nt, Human
gagaguggauggagcugcgaag

SEQ ID NO: 238017 - RNA, 22 nt, Human
cugcuuuagguggaauguucua

SEQ ID NO: 238018 - RNA, 22 nt, Human
aaaauucauggcuugggaaaag

SEQ ID NO: 238019 - RNA, 22 nt, Human
ugcuggagugagugguuucuua

SEQ ID NO: 238020 - RNA, 22 nt, Human
cuccucagaacagccuuggcug

SEQ ID NO: 238021 - RNA, 22 nt, Human
aguccagaccccggcagcuggu

SEQ ID NO: 238022 - RNA, 22 nt, Human
aggaggcagaugcuuggcugua

SEQ ID NO: 238023 - RNA, 22 nt, Human
ucucagagcaucauuuucuuag

SEQ ID NO: 238024 - RNA, 22 nt, Human
aaauagcuacaugaucucuagg

SEQ ID NO: 238025 - RNA, 22 nt, Human
ugucaguuuggcucuaaaguuu

SEQ ID NO: 238026 - RNA, 22 nt, Human
gagucaggaugcaaggggaugg

SEQ ID NO: 238027 - RNA, 22 nt, Human
aggguggcuuaauuccaaaggg

SEQ ID NO: 238028 - RNA, 22 nt, Human
auuauuauuguugauguuaggg

SEQ ID NO: 238029 - RNA, 22 nt, Human
gggcaugccugcgcagugcaug

SEQ ID NO: 238030 - RNA, 22 nt, Human
ugaugaguaaauaagguugagu

SEQ ID NO: 238031 - RNA, 22 nt, Human
cagcuggccaaucagggcgccc

SEQ ID NO: 238032 - RNA, 22 nt, Human
cagcuggcgccuggggaccaga

SEQ ID NO: 238033 - RNA, 22 nt, Human
uagugucaucguugcagcugag

SEQ ID NO: 238034 - RNA, 22 nt, Human
ugggacacaaaccagaccagga

SEQ ID NO: 238035 - RNA, 22 nt, Human
auugcaaagcauugugagcgca

SEQ ID NO: 238036 - RNA, 22 nt, Human
cuguagcaguguuccagcauug

SEQ ID NO: 238037 - RNA, 22 nt, Human
agguagagcuccaguagaaaau

SEQ ID NO: 238038 - RNA, 22 nt, Human
ucauuugugcaauguagaugaa

SEQ ID NO: 238039 - RNA, 22 nt, Human
uucuguggguaauaccucauac

SEQ ID NO: 238040 - RNA, 22 nt, Human
gcuuuaaugaagucacgcaaag

SEQ ID NO: 238041 - RNA, 22 nt, Human
ggugugggcccugaugucagca

SEQ ID NO: 238042 - RNA, 22 nt, Human
acaaugcaauaggagcuagaaa

SEQ ID NO: 238043 - RNA, 22 nt, Human
gcucccagcaauugaggcagcc

SEQ ID NO: 238044 - RNA, 22 nt, Human
gcucugaggcugugaggugcug

SEQ ID NO: 238045 - RNA, 22 nt, Human
agcaaacaguuucuggggaucu

SEQ ID NO: 238046 - RNA, 19 nt, Human
augagcaggcaagacaagc

SEQ ID NO: 238047 - RNA, 23 nt, Human
uagaggaggaugugaugcauauu

SEQ ID NO: 238048 - RNA, 21 nt, Human
cccagggaagccgcagucacc

SEQ ID NO: 238049 - RNA, 22 nt, Human
ccauggcucuuaccuuguuaua

SEQ ID NO: 238050 - RNA, 21 nt, Human
gcagccagccgagaccaugcc

SEQ ID NO: 238051 - RNA, 16 nt, Human
ccugggcucuguugga

SEQ ID NO: 238052 - RNA, 22 nt, Human
acacauguauggcacuuacauu

SEQ ID NO: 238053 - RNA, 22 nt, Human
ggcuccuggggaggugagcuug

SEQ ID NO: 238054 - RNA, 22 nt, Human
uggugcagaugcaggucacugg

SEQ ID NO: 238055 - RNA, 22 nt, Human
auuugcugugugcuuuagagac

SEQ ID NO: 238056 - RNA, 22 nt, Human
uguggcaggcauucugaggcug

SEQ ID NO: 238057 - RNA, 22 nt, Human
ugucuccagaaagcaccaggag

SEQ ID NO: 238058 - RNA, 22 nt, Human
agaaagugaccuugaaaacugg

SEQ ID NO: 238059 - RNA, 17 nt, Human
ccugcccagagacagau

SEQ ID NO: 238060 - RNA, 22 nt, Human
cuggcaguuggcauuggcaucu

SEQ ID NO: 238061 - RNA, 22 nt, Human
uuaccaaaucccgugcacauuc

SEQ ID NO: 238062 - RNA, 19 nt, Human
acagagggcaacugagaaa

SEQ ID NO: 238063 - RNA, 22 nt, Human
ucccugaguguauguggugaac

SEQ ID NO: 238064 - RNA, 22 nt, Human
cccaggccuggucugggccagu

SEQ ID NO: 238065 - RNA, 22 nt, Human
ugguauguaaauuguaacucaa

SEQ ID NO: 238066 - RNA, 22 nt, Human
uguagaaagcucuucugaaauc

SEQ ID NO: 238067 - RNA, 22 nt, Human
ccuggcucuucagagguuccua

SEQ ID NO: 238068 - RNA, 22 nt, Human
auauguuacucuuucaagcaga

SEQ ID NO: 238069 - RNA, 22 nt, Human
cuuauauuugucaacuuuacaa

SEQ ID NO: 238070 - RNA, 22 nt, Human
gacaggguccaaaggcagggga

SEQ ID NO: 238071 - RNA, 22 nt, Human
ggcauauguagcguguguucug

SEQ ID NO: 238072 - RNA, 22 nt, Human
ccccuuccuuccucagacagcc

SEQ ID NO: 238073 - RNA, 22 nt, Human
ucugggaacacacgucacuuca

SEQ ID NO: 238074 - RNA, 22 nt, Human
gucucagaguccuacuuauucc

SEQ ID NO: 238075 - RNA, 22 nt, Human
uuaaaaaccaucuuccuuuccu

SEQ ID NO: 238076 - RNA, 22 nt, Human
auuauccagcaccaaugucaga

SEQ ID NO: 238077 - RNA, 22 nt, Human
agccacaggccaugagauacca

SEQ ID NO: 238078 - RNA, 22 nt, Human
cucuguaccuggcauagcaacc

SEQ ID NO: 238079 - RNA, 22 nt, Human
uccugagcccuguaggacccug

SEQ ID NO: 238080 - RNA, 22 nt, Human
ucucauuguagaaagacugauu

SEQ ID NO: 238081 - RNA, 22 nt, Human
ggaagcucuguggcuuggaguc

SEQ ID NO: 238082 - RNA, 22 nt, Human
ggcaggcaggagcgugcuuggg

SEQ ID NO: 238083 - RNA, 22 nt, Human
aaagcucuuauagcagagugug

SEQ ID NO: 238084 - RNA, 22 nt, Human
gccuggugcuaugagggccagc

SEQ ID NO: 238085 - RNA, 22 nt, Human
agaaccuuccaucacucccuac

SEQ ID NO: 238086 - RNA, 21 nt, Human
ucccugagcccaaggggcucc

SEQ ID NO: 238087 - RNA, 21 nt, Human
gggggaagaggaguugcuagu

SEQ ID NO: 238088 - RNA, 22 nt, Human
aucaaguuuucuuaguugacug

SEQ ID NO: 238089 - RNA, 22 nt, Human
aggacccugagcgggcaugccg

SEQ ID NO: 238090 - RNA, 22 nt, Human
cugcagagcuugucuggaugug

SEQ ID NO: 238091 - RNA, 22 nt, Human
aucugggccagccccaagagac

SEQ ID NO: 238092 - RNA, 22 nt, Human
gcuguggcuguacagagaccau

SEQ ID NO: 238093 - RNA, 22 nt, Human
cuggagagauccuccugaaaaa

SEQ ID NO: 238094 - RNA, 22 nt, Human
uaugaacugugagugugauggg

SEQ ID NO: 238095 - RNA, 22 nt, Human
caaaggcugccacuguggcugu

SEQ ID NO: 238096 - RNA, 22 nt, Human
ucacaggagucaaggaauagua

SEQ ID NO: 238097 - RNA, 22 nt, Human
acuuccuugucaggugcaucau

SEQ ID NO: 238098 - RNA, 22 nt, Human
uagaauaugugguguauacuuu

SEQ ID NO: 238099 - RNA, 20 nt, Human
aagcagaagcugcucucagc

SEQ ID NO: 238100 - RNA, 22 nt, Human
ccaggaggcggaagguacagug

SEQ ID NO: 238101 - RNA, 22 nt, Human
cuggacucagggugcuccagcg

SEQ ID NO: 238102 - RNA, 22 nt, Human
gcucugggugaacuuggagcaa

SEQ ID NO: 238103 - RNA, 22 nt, Human
ucaggaagcuacugccagcagc

SEQ ID NO: 238104 - RNA, 22 nt, Human
cuguacuaauugcuuuacaugu

SEQ ID NO: 238105 - RNA, 22 nt, Human
agggccagaugaagccacaagc

SEQ ID NO: 238106 - RNA, 22 nt, Human
ucacauucauggugcuaauaaa

SEQ ID NO: 238107 - RNA, 22 nt, Human
ggcugcuggggacgugggagag

SEQ ID NO: 238108 - RNA, 22 nt, Human
agcguaugaauauuugaagaga

SEQ ID NO: 238109 - RNA, 21 nt, Human
ggugcucgcugaugaggagug

SEQ ID NO: 238110 - RNA, 22 nt, Human
cuccugugguacucccagggcc

SEQ ID NO: 238111 - RNA, 22 nt, Human
agugcacagcgugauguauugg

SEQ ID NO: 238112 - RNA, 22 nt, Human
cuuggcaguuucggaaggauga

SEQ ID NO: 238113 - RNA, 22 nt, Human
uuuuucuugugcuggaucuaau

SEQ ID NO: 238114 - RNA, 22 nt, Human
cagagccaaaugcugugguuau

SEQ ID NO: 238115 - RNA, 22 nt, Human
ucccagccuggacccugccagu

SEQ ID NO: 238116 - RNA, 22 nt, Human
gacauaaaccuugagauauuaa

SEQ ID NO: 238117 - RNA, 22 nt, Human
ucaguuacucaacagaggugga

SEQ ID NO: 238118 - RNA, 21 nt, Human
aaaaugugagcgugaugcuua

SEQ ID NO: 238119 - RNA, 22 nt, Human
uggcugcaguucacaggagcaa

SEQ ID NO: 238120 - RNA, 22 nt, Human
ccugagagugagugccuccuua

SEQ ID NO: 238121 - RNA, 22 nt, Human
caccaggaugggcagguagguc

SEQ ID NO: 238122 - RNA, 19 nt, Human
agaaucuaaauuauuucug

SEQ ID NO: 238123 - RNA, 22 nt, Human
uaaacagaaagcagauguacuu

SEQ ID NO: 238124 - RNA, 22 nt, Human
ccagagcaauucucacagaacu

SEQ ID NO: 238125 - RNA, 22 nt, Human
uacuacaaggccgaagcucuca

SEQ ID NO: 238126 - RNA, 22 nt, Human
gcuggucccaauguguuuccuu

SEQ ID NO: 238127 - RNA, 22 nt, Human
uaucaucugcaaagcacaucua

SEQ ID NO: 238128 - RNA, 23 nt, Human
uccuugggccugcccagaguggu

SEQ ID NO: 238129 - RNA, 22 nt, Human
agggaccuugauggguuuggga

SEQ ID NO: 238130 - RNA, 22 nt, Human
cagugccuggauagcaacauga

SEQ ID NO: 238131 - RNA, 22 nt, Human
acagcugauaguuaccucuguc

SEQ ID NO: 238132 - RNA, 22 nt, Human
accucagaacggcguucuugaa

SEQ ID NO: 238133 - RNA, 22 nt, Human
ucacagugaugacgugggagca

SEQ ID NO: 238134 - RNA, 22 nt, Human
cuuuggaaugcacagaggugua

SEQ ID NO: 238135 - RNA, 22 nt, Human
aagguggucuuacugaugguau

SEQ ID NO: 238136 - RNA, 22 nt, Human
uguugacugguaacuuuaaaca

SEQ ID NO: 238137 - RNA, 22 nt, Human
acagaaaugauguuuggcaaua

SEQ ID NO: 238138 - RNA, 22 nt, Human
caggaugguggcaugaucagaa

SEQ ID NO: 238139 - RNA, 22 nt, Human
guggagcuggacccaggccucu

SEQ ID NO: 238140 - RNA, 22 nt, Human
agagccuggaccugagcuacaa

SEQ ID NO: 238141 - RNA, 22 nt, Human
gucugggcaucagacugcgggc

SEQ ID NO: 238142 - RNA, 22 nt, Human
uuucauugagaauauaagauuu

SEQ ID NO: 238143 - RNA, 22 nt, Human
uccuggcaggucagcaggagca

SEQ ID NO: 238144 - RNA, 21 nt, Human
auuuucauuaauucagugugg

SEQ ID NO: 238145 - RNA, 22 nt, Human
aacagcagcuuucaggaucauc

SEQ ID NO: 238146 - RNA, 22 nt, Human
uuguagaaaauuagaugcaugg

SEQ ID NO: 238147 - RNA, 22 nt, Human
guucuacaguuccuauuacuua

SEQ ID NO: 238148 - RNA, 23 nt, Human
agccccucauggugucuagacag

SEQ ID NO: 238149 - RNA, 22 nt, Human
uauaacaguuuaggugguguca

SEQ ID NO: 238150 - RNA, 22 nt, Human
ucccagcaagaaaggggguggc

SEQ ID NO: 238151 - RNA, 22 nt, Human
cugggccugggaggccaggucu

SEQ ID NO: 238152 - RNA, 22 nt, Human
ucucuggaauuggcugaggcaa

SEQ ID NO: 238153 - RNA, 22 nt, Human
ugcagcagguuccaaaggguua

SEQ ID NO: 238154 - RNA, 22 nt, Human
uggagaagauuggucaccauuc

SEQ ID NO: 238155 - RNA, 22 nt, Human
ugcuggguguuccgcacuugac

SEQ ID NO: 238156 - RNA, 22 nt, Human
ugcaaaaacugcaauugcuuuu

SEQ ID NO: 238157 - RNA, 22 nt, Human
ggaagggguuaggggucccuga

SEQ ID NO: 238158 - RNA, 22 nt, Human
uggcccaggugcaagagacaga

SEQ ID NO: 238159 - RNA, 22 nt, Human
gagguguccuagaaguauucag

SEQ ID NO: 238160 - RNA, 19 nt, Human
caguuacagcagcuaagac

SEQ ID NO: 238161 - RNA, 22 nt, Human
cugggccuagaggaagcugaca

SEQ ID NO: 238162 - RNA, 22 nt, Human
gaacaaacacaucccagcagug

SEQ ID NO: 238163 - RNA, 22 nt, Human
ugauuaaaauuuaacuuaguua

SEQ ID NO: 238164 - RNA, 22 nt, Human
uuuaauuuuccucuuccuggag

SEQ ID NO: 238165 - RNA, 22 nt, Human
agacuacauuaugacagcauuu

SEQ ID NO: 238166 - RNA, 22 nt, Human
uccacagucuauuuuuagucua

SEQ ID NO: 238167 - RNA, 19 nt, Human
aaaguugagaaacaaugga

SEQ ID NO: 238168 - RNA, 23 nt, Human
gucucuagaguguggagcaaaga

SEQ ID NO: 238169 - RNA, 22 nt, Human
augcacaaacccacaauuaguc

SEQ ID NO: 238170 - RNA, 22 nt, Human
uaucacaauuccuauaguuugu

SEQ ID NO: 238171 - RNA, 22 nt, Human
ggcuggcuuggugagcugucac

SEQ ID NO: 238172 - RNA, 22 nt, Human
ugucuagacaagaaguauugcc

SEQ ID NO: 238173 - RNA, 21 nt, Human
ccugucuuggacugaggcacc

SEQ ID NO: 238174 - RNA, 22 nt, Human
gcaucuaaaucacuuuaaugua

SEQ ID NO: 238175 - RNA, 22 nt, Human
cagcugaacauguagagcaucu

SEQ ID NO: 238176 - RNA, 22 nt, Human
ucaagagacaggacguguuuca

SEQ ID NO: 238177 - RNA, 22 nt, Human
ucuuagcauuucauaacaacug

SEQ ID NO: 238178 - RNA, 22 nt, Human
cuguuacuaaucuuuucugcua

SEQ ID NO: 238179 - RNA, 22 nt, Human
augucaaaugcugcaaacucau

SEQ ID NO: 238180 - RNA, 22 nt, Human
uuugaaaauuagacacaggcua

SEQ ID NO: 238181 - RNA, 22 nt, Human
uuggggaagcuuugaaauacuu

SEQ ID NO: 238182 - RNA, 19 nt, Human
ggcuggaguggccaucugu

SEQ ID NO: 238183 - RNA, 22 nt, Human
caagcagguuugcuauuuucuu

SEQ ID NO: 238184 - RNA, 22 nt, Human
ccuggcuccugcacagaucuuu

SEQ ID NO: 238185 - RNA, 22 nt, Human
guaaaugugcuucuuuuaacuu

SEQ ID NO: 238186 - RNA, 18 nt, Human
uccugguggagaaguggu

SEQ ID NO: 238187 - RNA, 22 nt, Human
cagaggcauuacugaaaaggug

SEQ ID NO: 238188 - RNA, 22 nt, Human
uuacaacaaaggcacgugcaug

SEQ ID NO: 238189 - RNA, 22 nt, Human
guguguccucuuaacuauuaug

SEQ ID NO: 238190 - RNA, 23 nt, Human
uaauuagauguugauuccugaga

SEQ ID NO: 238191 - RNA, 22 nt, Human
gagcccuguaggaaucucucaa

SEQ ID NO: 238192 - RNA, 22 nt, Human
agaaagaggaugcagaucucau

SEQ ID NO: 238193 - RNA, 22 nt, Human
cucacagcacuugugucauugg

SEQ ID NO: 238194 - RNA, 22 nt, Human
aagcagaaguugaucuaccaua

SEQ ID NO: 238195 - RNA, 22 nt, Human
uccaggucuuccuauuccaggu

SEQ ID NO: 238196 - RNA, 22 nt, Human
cagagacagcaaguugauuucc

SEQ ID NO: 238197 - RNA, 22 nt, Human
aucuggcucgcuaggcucuggg

SEQ ID NO: 238198 - RNA, 22 nt, Human
uuggcuucucuuaacccuaaag

SEQ ID NO: 238199 - RNA, 22 nt, Human
cccugagaagaucauugccacg

SEQ ID NO: 238200 - RNA, 17 nt, Human
ucugaagccagucugcu

SEQ ID NO: 238201 - RNA, 21 nt, Human
cucagacagggaggcucuggg

SEQ ID NO: 238202 - RNA, 22 nt, Human
aagcugaggucaaguagcuagu

SEQ ID NO: 238203 - RNA, 22 nt, Human
aucuccgccaucgcgaacgccu

SEQ ID NO: 238204 - RNA, 22 nt, Human
uguuuauaccugcaaccuguca

SEQ ID NO: 238205 - RNA, 22 nt, Human
auaugcuuaugaugucucaagu

SEQ ID NO: 238206 - RNA, 22 nt, Human
uuagaaaucugcugccaugcaa

SEQ ID NO: 238207 - RNA, 22 nt, Human
cugacaaaggcaaggcaggggg

SEQ ID NO: 238208 - RNA, 22 nt, Human
ccagccccuauccucgcuccac

SEQ ID NO: 238209 - RNA, 23 nt, Human
ucuccaggccuuacuccaggccu

SEQ ID NO: 238210 - RNA, 22 nt, Human
ccuuagaaggcugaauaauucu

SEQ ID NO: 238211 - RNA, 22 nt, Human
aauguuaaguuuagauuauaac

SEQ ID NO: 238212 - RNA, 19 nt, Human
guugaaaguaggugagggu

SEQ ID NO: 238213 - RNA, 22 nt, Human
acccuggagcaauaaucccugg

SEQ ID NO: 238214 - RNA, 22 nt, Human
acaggcaggcgggacagcccga

SEQ ID NO: 238215 - RNA, 23 nt, Human
ugagcugguauuguccaucucca

SEQ ID NO: 238216 - RNA, 22 nt, Human
aggaaggagggcagauauuaag

SEQ ID NO: 238217 - RNA, 22 nt, Human
uuauugaguaucugcuuggugu

SEQ ID NO: 238218 - RNA, 22 nt, Human
uugucaaguaaggcugacauuu

SEQ ID NO: 238219 - RNA, 22 nt, Human
uuccauauuagacuaugugggg

SEQ ID NO: 238220 - RNA, 22 nt, Human
gaaaucuacuuagugucuggau

SEQ ID NO: 238221 - RNA, 22 nt, Human
ggcuccucucuggccgcucccg

SEQ ID NO: 238222 - RNA, 22 nt, Human
uaacagaaguuguucauugugg

SEQ ID NO: 238223 - RNA, 22 nt, Human
uucuaguccuagaaacuacaug

SEQ ID NO: 238224 - RNA, 22 nt, Human
gaggagaaauuuggggaccuga

SEQ ID NO: 238225 - RNA, 22 nt, Human
aggcagugcagaguccucuucu

SEQ ID NO: 238226 - RNA, 22 nt, Human
uccucugggcucccugcaacag

SEQ ID NO: 238227 - RNA, 22 nt, Human
aagcugaaauaauaucuauguu

SEQ ID NO: 238228 - RNA, 23 nt, Human
ccaggaagaggccauccacaguc

SEQ ID NO: 238229 - RNA, 20 nt, Human
acaacaaacuugcuuaagga

SEQ ID NO: 238230 - RNA, 22 nt, Human
aagacacuuucuaaauagaagu

SEQ ID NO: 238231 - RNA, 22 nt, Human
caugaaugcuggguucauguaa

SEQ ID NO: 238232 - RNA, 22 nt, Human
gugaccaucagagaauaacaaa

SEQ ID NO: 238233 - RNA, 22 nt, Human
ugaaagcaggcgggcuacuuua

SEQ ID NO: 238234 - RNA, 22 nt, Human
cacagggagaggaacagcgcag

SEQ ID NO: 238235 - RNA, 23 nt, Human
uccaggcugaaggagcagauuuu

SEQ ID NO: 238236 - RNA, 22 nt, Human
aguggcaaugggaguggagaca

SEQ ID NO: 238237 - RNA, 22 nt, Human
ccaaaguccauaguuuacauua

SEQ ID NO: 238238 - RNA, 22 nt, Human
uuucuaaaugguggcugcauug

SEQ ID NO: 238239 - RNA, 22 nt, Human
uucacauaaugauacaaagcuu

SEQ ID NO: 238240 - RNA, 22 nt, Human
auaacauuuugacaacugguga

SEQ ID NO: 238241 - RNA, 22 nt, Human
uuugacucaagccuuucuuuag

SEQ ID NO: 238242 - RNA, 20 nt, Human
gcugaggucauuaugccuca

SEQ ID NO: 238243 - RNA, 22 nt, Human
guacaaauugauacagauuuga

SEQ ID NO: 238244 - RNA, 22 nt, Human
gacaggcuucauccucagaguu

SEQ ID NO: 238245 - RNA, 22 nt, Human
aagcugaggauacaugaagccu

SEQ ID NO: 238246 - RNA, 22 nt, Human
ugucagagcaaugagguucagc

SEQ ID NO: 238247 - RNA, 22 nt, Human
ggcccagaagccagaagccucc

SEQ ID NO: 238248 - RNA, 22 nt, Human
ucucuuccauguuucagcccca

SEQ ID NO: 238249 - RNA, 22 nt, Human
ugggcaaaugcuuuuuagucaa

SEQ ID NO: 238250 - RNA, 22 nt, Human
ccaggcucagggcagacuuuca

SEQ ID NO: 238251 - RNA, 19 nt, Human
ccaugcagccugggggcag

SEQ ID NO: 238252 - RNA, 22 nt, Human
uggguccuugccaucuuggagu

SEQ ID NO: 238253 - RNA, 22 nt, Human
ugggcugcacccucagccucug

SEQ ID NO: 238254 - RNA, 18 nt, Human
agagcagcggcaucacac

SEQ ID NO: 238255 - RNA, 20 nt, Human
gcucagguuugggcuuugug

SEQ ID NO: 238256 - RNA, 22 nt, Human
ggcagcaucacuugucuccagc

SEQ ID NO: 238257 - RNA, 22 nt, Human
auuacagauuauaaauuugagc

SEQ ID NO: 238258 - RNA, 22 nt, Human
gccacagcagggcccucucagg

SEQ ID NO: 238259 - RNA, 22 nt, Human
gaugucuuugccaugcaugugu

SEQ ID NO: 238260 - RNA, 20 nt, Human
ugcuuuuauaccuauaauga

SEQ ID NO: 238261 - RNA, 22 nt, Human
uggcuucaggguugucuucagc

SEQ ID NO: 238262 - RNA, 22 nt, Human
gcauggcuucugccaggcaccu

SEQ ID NO: 238263 - RNA, 22 nt, Human
acaauauaguccaugagcaugc

SEQ ID NO: 238264 - RNA, 22 nt, Human
uaguuacaggaguuucugaaau

SEQ ID NO: 238265 - RNA, 23 nt, Human
augaaaugcuggcucagggaggu

SEQ ID NO: 238266 - RNA, 22 nt, Human
gagcccagcuaaauuuauauaa

SEQ ID NO: 238267 - RNA, 22 nt, Human
gcacagguugcaaaaguucaca

SEQ ID NO: 238268 - RNA, 22 nt, Human
uaggugguagagccuggcuugc

SEQ ID NO: 238269 - RNA, 22 nt, Human
acauuucuuucuauucaguagc

SEQ ID NO: 238270 - RNA, 23 nt, Human
uggccaggcauaaaggugggugg

SEQ ID NO: 238271 - RNA, 22 nt, Human
auccuuuaguccuacaacucga

SEQ ID NO: 238272 - RNA, 22 nt, Human
acucugggaugagaaaaggguu

SEQ ID NO: 238273 - RNA, 22 nt, Human
cugggugaauuugaaggaaagg

SEQ ID NO: 238274 - RNA, 22 nt, Human
ggcagguggcacugcugcuccc

SEQ ID NO: 238275 - RNA, 22 nt, Human
gcucagaguuaauuggaugggu

SEQ ID NO: 238276 - RNA, 22 nt, Human
ucauucuuuaccaaguugucac

SEQ ID NO: 238277 - RNA, 22 nt, Human
gcuggccuugugucugaggaag

SEQ ID NO: 238278 - RNA, 22 nt, Human
gaagaaagauuggcaugcuuca

SEQ ID NO: 238279 - RNA, 22 nt, Human
gcaugcaacucccaguucugcc

SEQ ID NO: 238280 - RNA, 20 nt, Human
uggacacagcccuguugagu

SEQ ID NO: 238281 - RNA, 22 nt, Human
gccaggcugguuauuuaaugag

SEQ ID NO: 238282 - RNA, 22 nt, Human
cucucuguuaugcuuucaugaa

SEQ ID NO: 238283 - RNA, 21 nt, Human
cuuugcaucuauauguucuca

SEQ ID NO: 238284 - RNA, 22 nt, Human
aacauucugguucuaaaaaccu

SEQ ID NO: 238285 - RNA, 22 nt, Human
uacugaaauacuaagaaguuaa

SEQ ID NO: 238286 - RNA, 22 nt, Human
aucuuuuuaucuguuuggaaca

SEQ ID NO: 238287 - RNA, 22 nt, Human
aguggaugguauugggaccagg

SEQ ID NO: 238288 - RNA, 22 nt, Human
acuugguugcuucugaaaugac

SEQ ID NO: 238289 - RNA, 22 nt, Human
gggcugagugggccucuuacuu

SEQ ID NO: 238290 - RNA, 22 nt, Human
caauuuucaauuccuucagaua

SEQ ID NO: 238291 - RNA, 22 nt, Human
caucuucagguucauggucaua

SEQ ID NO: 238292 - RNA, 22 nt, Human
ucuagaucugcacuguuggaca

SEQ ID NO: 238293 - RNA, 22 nt, Human
ccagggcucuaugaggguggag

SEQ ID NO: 238294 - RNA, 22 nt, Human
aauagugaacaggaacaugcuu

SEQ ID NO: 238295 - RNA, 22 nt, Human
cccuagaacacgcagacacuga

SEQ ID NO: 238296 - RNA, 22 nt, Human
gagugcuggaggugugaguggg

SEQ ID NO: 238297 - RNA, 22 nt, Human
ugcucugcaagcaggagcaaga

SEQ ID NO: 238298 - RNA, 22 nt, Human
gagguccucuguguccgcgggc

SEQ ID NO: 238299 - RNA, 22 nt, Human
gggcagucacagugcuggagca

SEQ ID NO: 238300 - RNA, 22 nt, Human
ccuggcugagggaccucgggua

SEQ ID NO: 238301 - RNA, 22 nt, Human
aaaccauugcaucuuucuuaau

SEQ ID NO: 238302 - RNA, 22 nt, Human
agcuguguggugucugacagcu

SEQ ID NO: 238303 - RNA, 22 nt, Human
cuccuccacagaccuacugaau

SEQ ID NO: 238304 - RNA, 22 nt, Human
acuguguggaccacucugaggc

SEQ ID NO: 238305 - RNA, 22 nt, Human
uccaggaguuugaccugugggc

SEQ ID NO: 238306 - RNA, 22 nt, Human
acuugcaucuuagagacucacc

SEQ ID NO: 238307 - RNA, 22 nt, Human
gggcuucucugaucaauauuuc

SEQ ID NO: 238308 - RNA, 22 nt, Human
cauucuaaaguguuuuauaccu

SEQ ID NO: 238309 - RNA, 22 nt, Human
gcccucuggcacagagaugcag

SEQ ID NO: 238310 - RNA, 22 nt, Human
agcugcugggagaagugagcca

SEQ ID NO: 238311 - RNA, 22 nt, Human
uuuuauacuuaagacagaguuu

SEQ ID NO: 238312 - RNA, 20 nt, Human
uacauuguagaaauauucaa

SEQ ID NO: 238313 - RNA, 22 nt, Human
caggcugaucagggcugggaug

SEQ ID NO: 238314 - RNA, 22 nt, Human
uccagccaaucagagcugaggc

SEQ ID NO: 238315 - RNA, 22 nt, Human
uaggacaggaucaugaugcugg

SEQ ID NO: 238316 - RNA, 22 nt, Human
caccagcuacuccagggccgug

SEQ ID NO: 238317 - RNA, 22 nt, Human
ucaguguccugugcggugcagc

SEQ ID NO: 238318 - RNA, 22 nt, Human
uugaagaguuugauagaguuga

SEQ ID NO: 238319 - RNA, 22 nt, Human
ccuccugguccagcaucucuuu

SEQ ID NO: 238320 - RNA, 22 nt, Human
auguaaaagauuauuuuccugu

SEQ ID NO: 238321 - RNA, 23 nt, Human
cggggccagggucaggaccgguc

SEQ ID NO: 238322 - RNA, 21 nt, Human
uaagugcaaagagacagauac

SEQ ID NO: 238323 - RNA, 22 nt, Human
cuuaacagauacaucugugguu

SEQ ID NO: 238324 - RNA, 22 nt, Human
guaacacagaaaugaaauucca

SEQ ID NO: 238325 - RNA, 22 nt, Human
cuggcuggggaagucauuugau

SEQ ID NO: 238326 - RNA, 17 nt, Human
cuacuucuucuauucuu

SEQ ID NO: 238327 - RNA, 22 nt, Human
aguacacaagacacauuuaaaa

SEQ ID NO: 238328 - RNA, 22 nt, Human
ucagcauuccugaagacaagca

SEQ ID NO: 238329 - RNA, 22 nt, Human
cagcaacauauaugaaacugug

SEQ ID NO: 238330 - RNA, 22 nt, Human
gugcaaaaguaauugugguuuu

SEQ ID NO: 238331 - RNA, 22 nt, Human
uuuauuguuguuagucauaagu

SEQ ID NO: 238332 - RNA, 22 nt, Human
ugguccuggugcaagugcauuu

SEQ ID NO: 238333 - RNA, 22 nt, Human
gaaaguuuauagguuauauaau

SEQ ID NO: 238334 - RNA, 22 nt, Human
guuaacauucaauuaaacaguc

SEQ ID NO: 238335 - RNA, 22 nt, Human
guucuacuuucugugucuuuga

SEQ ID NO: 238336 - RNA, 22 nt, Human
uagggcucagagaaguggggcc

SEQ ID NO: 238337 - RNA, 22 nt, Human
uggcuucaaaaucuaguggucu

SEQ ID NO: 238338 - RNA, 22 nt, Human
uuuauucuugagagugagaaga

SEQ ID NO: 238339 - RNA, 22 nt, Human
gcuuucugccugggcuccauuu

SEQ ID NO: 238340 - RNA, 22 nt, Human
gggccuggugcuucugacuccu

SEQ ID NO: 238341 - RNA, 22 nt, Human
ggaggccaggguggguggaucg

SEQ ID NO: 238342 - RNA, 22 nt, Human
acaggacauguaccaggugguc

SEQ ID NO: 238343 - RNA, 20 nt, Human
cuggcccaucuaccgcucug

SEQ ID NO: 238344 - RNA, 22 nt, Human
guguccugccacccugggcuuu

SEQ ID NO: 238345 - RNA, 22 nt, Human
aaagacauugaagaaggacuua

SEQ ID NO: 238346 - RNA, 22 nt, Human
acagagcaguaagaacacagcu

SEQ ID NO: 238347 - RNA, 22 nt, Human
uuccugguaguaagacaucugg

SEQ ID NO: 238348 - RNA, 22 nt, Human
uagggcacagcuuagauaaaug

SEQ ID NO: 238349 - RNA, 22 nt, Human
acauaauaggugccugaauauu

SEQ ID NO: 238350 - RNA, 22 nt, Human
aguuuuuccguggcuacgauaa

SEQ ID NO: 238351 - RNA, 19 nt, Human
uggcagccuccacuuuugc

SEQ ID NO: 238352 - RNA, 22 nt, Human
aauuuggagagaaacaaguagg

SEQ ID NO: 238353 - RNA, 22 nt, Human
caguccagccaguagggugugg

SEQ ID NO: 238354 - RNA, 22 nt, Human
agauaauuauuuacuucaaagu

SEQ ID NO: 238355 - RNA, 22 nt, Human
cugcagggcuguggucuggagu

SEQ ID NO: 238356 - RNA, 22 nt, Human
aggccaggauagcauggaucag

SEQ ID NO: 238357 - RNA, 22 nt, Human
cagaaggcaaggccugccacgc

SEQ ID NO: 238358 - RNA, 22 nt, Human
ugaggcaaguacuuucccuuuu

SEQ ID NO: 238359 - RNA, 22 nt, Human
gcugcagagacagcugccgaug

SEQ ID NO: 238360 - RNA, 23 nt, Human
ugccguguuagaaauguuuuaca

SEQ ID NO: 238361 - RNA, 22 nt, Human
aagagacagagccauguuucua

SEQ ID NO: 238362 - RNA, 22 nt, Human
uaggaaacaaaccugccucuuc

SEQ ID NO: 238363 - RNA, 21 nt, Human
aagaugauauuuuaucuguag

SEQ ID NO: 238364 - RNA, 22 nt, Human
acagugugugggaaaugugacu

SEQ ID NO: 238365 - RNA, 22 nt, Human
ugauuuacuucccagcuggguu

SEQ ID NO: 238366 - RNA, 22 nt, Human
auggcuggcacuggccuggguu

SEQ ID NO: 238367 - RNA, 22 nt, Human
agcaggcugccuuccaaagccu

SEQ ID NO: 238368 - RNA, 22 nt, Human
gcugccucccagagcccugcag

SEQ ID NO: 238369 - RNA, 22 nt, Human
ggcucugggugugaccuugggu

SEQ ID NO: 238370 - RNA, 22 nt, Human
uguguccucauguggcagagag

SEQ ID NO: 238371 - RNA, 22 nt, Human
acauuacauaagauuguaaccu

SEQ ID NO: 238372 - RNA, 22 nt, Human
agucucuuuguauaaauaggca

SEQ ID NO: 238373 - RNA, 22 nt, Human
ggugaggcagagggaguaaccu

SEQ ID NO: 238374 - RNA, 22 nt, Human
uuuccuuugcccaauacauguc

SEQ ID NO: 238375 - RNA, 22 nt, Human
cucagcuccaggugugcaucuu

SEQ ID NO: 238376 - RNA, 22 nt, Human
cugcagggagaggggacagccu

SEQ ID NO: 238377 - RNA, 22 nt, Human
aaguccugugugcuuacacuug

SEQ ID NO: 238378 - RNA, 18 nt, Human
uggacacauggccugggu

SEQ ID NO: 238379 - RNA, 22 nt, Human
ugucuuuuuaccugugaugagu

SEQ ID NO: 238380 - RNA, 22 nt, Human
ucccagggacuggaugaugcag

SEQ ID NO: 238381 - RNA, 22 nt, Human
uaguuacagaagauaaggguau

SEQ ID NO: 238382 - RNA, 20 nt, Human
ucucccugcccaucucagau

SEQ ID NO: 238383 - RNA, 22 nt, Human
gguagggcaaaguagggcaccu

SEQ ID NO: 238384 - RNA, 22 nt, Human
ucaucuaagagucuuacauuua

SEQ ID NO: 238385 - RNA, 22 nt, Human
gccuguuuuagaugcauugaug

SEQ ID NO: 238386 - RNA, 22 nt, Human
agaccccauaccucagcaggua

SEQ ID NO: 238387 - RNA, 22 nt, Human
ugagucacacauuucuucauac

SEQ ID NO: 238388 - RNA, 22 nt, Human
ugaauagagcuuggcacuagaa

SEQ ID NO: 238389 - RNA, 22 nt, Human
cuuucuuuguccaccaacaaug

SEQ ID NO: 238390 - RNA, 17 nt, Human
acugucuuuuacacccu

SEQ ID NO: 238391 - RNA, 22 nt, Human
ugguacacauguccaaggucag

SEQ ID NO: 238392 - RNA, 22 nt, Human
gaauuuaaggaccaagcauuuu

SEQ ID NO: 238393 - RNA, 22 nt, Human
ccucucagcgauuccucuugga

SEQ ID NO: 238394 - RNA, 18 nt, Human
uaggagagaauuuauuua

SEQ ID NO: 238395 - RNA, 22 nt, Human
uuggaggaagcucaugggggau

SEQ ID NO: 238396 - RNA, 22 nt, Human
ugcaugaacggaggguaagcug

SEQ ID NO: 238397 - RNA, 22 nt, Human
gcucaggacuggaggagcgggg

SEQ ID NO: 238398 - RNA, 22 nt, Human
aaagagcuuuagaaaucucaga

SEQ ID NO: 238399 - RNA, 22 nt, Human
aggcaacugacaguuucugcuu

SEQ ID NO: 238400 - RNA, 22 nt, Human
ggagugacucacagcugggaca

SEQ ID NO: 238401 - RNA, 22 nt, Human
agcaacagguuuauuaucuuau

SEQ ID NO: 238402 - RNA, 22 nt, Human
aggcucuggcuacuacagagcu

SEQ ID NO: 238403 - RNA, 22 nt, Human
aaauagaauuaacuagcuacug

SEQ ID NO: 238404 - RNA, 22 nt, Human
cugggagacaagagagggcuga

SEQ ID NO: 238405 - RNA, 22 nt, Human
cagagacagggcagggagugug

SEQ ID NO: 238406 - RNA, 22 nt, Human
uuaauacaagcauaugcacaca

SEQ ID NO: 238407 - RNA, 22 nt, Human
ccuggccucuccgaguaaccug

SEQ ID NO: 238408 - RNA, 20 nt, Human
gcugaagauucccaugcaag

SEQ ID NO: 238409 - RNA, 22 nt, Human
aggauaacuuugaaaguaaauu

SEQ ID NO: 238410 - RNA, 22 nt, Human
ucucugaguuuuaaggaugaug

SEQ ID NO: 238411 - RNA, 22 nt, Human
acaauucuggguauuuauauag

SEQ ID NO: 238412 - RNA, 22 nt, Human
agauaucuccagugaugcucgu

SEQ ID NO: 238413 - RNA, 22 nt, Human
caggcuccuucccagggauggu

SEQ ID NO: 238414 - RNA, 22 nt, Human
cacccuggaaagaaggucuggg

SEQ ID NO: 238415 - RNA, 22 nt, Human
uuguacaaaugcauauuccugg

SEQ ID NO: 238416 - RNA, 22 nt, Human
gcagagauuaugccauggaaag

SEQ ID NO: 238417 - RNA, 22 nt, Human
ggaggcaaagcacuuugcuugg

SEQ ID NO: 238418 - RNA, 22 nt, Human
ucagaguccucacccugaggau

SEQ ID NO: 238419 - RNA, 22 nt, Human
ccaggucuggcacuggccaguc

SEQ ID NO: 238420 - RNA, 22 nt, Human
gcccaggaggucaaguagcuau

SEQ ID NO: 238421 - RNA, 22 nt, Human
ucuggcagcucaguucaggucu

SEQ ID NO: 238422 - RNA, 22 nt, Human
aguguuuuucaggagcagaaca

SEQ ID NO: 238423 - RNA, 22 nt, Human
auuacaaaagaagggagaaggu

SEQ ID NO: 238424 - RNA, 22 nt, Human
uaaaugaguaauauagcuguuu

SEQ ID NO: 238425 - RNA, 22 nt, Human
ggcucacacaugacugggcucu

SEQ ID NO: 238426 - RNA, 22 nt, Human
ccucuggcagccagccaguugu

SEQ ID NO: 238427 - RNA, 22 nt, Human
cacagaggauuuuuagggcagu

SEQ ID NO: 238428 - RNA, 22 nt, Human
caccugcaaggagcuuucauuu

SEQ ID NO: 238429 - RNA, 22 nt, Human
gucuuuaucuuugaaauuaguc

SEQ ID NO: 238430 - RNA, 22 nt, Human
ucuagagauacauuggucauuu

SEQ ID NO: 238431 - RNA, 22 nt, Human
ucagggaagaaaugggacuuua

SEQ ID NO: 238432 - RNA, 21 nt, Human
acaggcucacgauccauuucu

SEQ ID NO: 238433 - RNA, 22 nt, Human
uguauauucacugagcaagggg

SEQ ID NO: 238434 - RNA, 22 nt, Human
uguuacuauuaguuugagcaua

SEQ ID NO: 238435 - RNA, 22 nt, Human
cucugggcuuguugaccugcac

SEQ ID NO: 238436 - RNA, 22 nt, Human
uguuaacaucuuggacucguga

SEQ ID NO: 238437 - RNA, 23 nt, Human
cugugucuaugcagccauaucca

SEQ ID NO: 238438 - RNA, 22 nt, Human
uuggaaaccaggcuuugagacg

SEQ ID NO: 238439 - RNA, 22 nt, Human
gaacaaauuggagaaaucagga

SEQ ID NO: 238440 - RNA, 22 nt, Human
aagucuggaagucucaguuuuc

SEQ ID NO: 238441 - RNA, 22 nt, Human
aaaaaccauugucuucagucuc

SEQ ID NO: 238442 - RNA, 22 nt, Human
gaacuuuguggggcugagagga

SEQ ID NO: 238443 - RNA, 22 nt, Human
ugcagggcagauaugacuguag

SEQ ID NO: 238444 - RNA, 19 nt, Human
ugcuggagguugacagggu

SEQ ID NO: 238445 - RNA, 21 nt, Human
gacaggacuagaccagagcuc

SEQ ID NO: 238446 - RNA, 23 nt, Human
ccuggcagcaaacgaggagguua

SEQ ID NO: 238447 - RNA, 22 nt, Human
aggacugaaaaugaguucuucu

SEQ ID NO: 238448 - RNA, 22 nt, Human
gagcagcaaagggaggguaaau

SEQ ID NO: 238449 - RNA, 22 nt, Human
aaagacacacagugcuucaguu

SEQ ID NO: 238450 - RNA, 22 nt, Human
acagaaauaacuuuuuauguuu

SEQ ID NO: 238451 - RNA, 22 nt, Human
guuguauuugccugaaugcagu

SEQ ID NO: 238452 - RNA, 22 nt, Human
cacugagaguagggcacaagug

SEQ ID NO: 238453 - RNA, 22 nt, Human
gcagggcuccacuguggccaag

SEQ ID NO: 238454 - RNA, 22 nt, Human
agcagccaauuggaggaugaag

SEQ ID NO: 238455 - RNA, 21 nt, Human
cuuaacauuuuaaaugaaagg

SEQ ID NO: 238456 - RNA, 22 nt, Human
aagagucauagagacauugauu

SEQ ID NO: 238457 - RNA, 22 nt, Human
guuauuagaagugaaggauugu

SEQ ID NO: 238458 - RNA, 19 nt, Human
aucauacauguuacacucu

SEQ ID NO: 238459 - RNA, 18 nt, Human
aggcaggauccuggccuc

SEQ ID NO: 238460 - RNA, 22 nt, Human
acacugugcaugcauauacaca

SEQ ID NO: 238461 - RNA, 20 nt, Human
ggccacagggugcuggugga

SEQ ID NO: 238462 - RNA, 22 nt, Human
gcuaauaauuccuuugugaacu

SEQ ID NO: 238463 - RNA, 22 nt, Human
uuugaaaggugucgagaugugu

SEQ ID NO: 238464 - RNA, 22 nt, Human
uuagagaagaugaaccaucguu

SEQ ID NO: 238465 - RNA, 22 nt, Human
cauugauuauggaaagcagugg

SEQ ID NO: 238466 - RNA, 21 nt, Human
aucccagcacccaggagugca

SEQ ID NO: 238467 - RNA, 22 nt, Human
gggcugacucugcacugagcca

SEQ ID NO: 238468 - RNA, 22 nt, Human
aauuagggaaaauuuacuugua

SEQ ID NO: 238469 - RNA, 20 nt, Human
uuuauuggccuuucaggaac

SEQ ID NO: 238470 - RNA, 22 nt, Human
augugucucuaccaaugcaauu

SEQ ID NO: 238471 - RNA, 22 nt, Human
auguccuuuguaucccuaggca

SEQ ID NO: 238472 - RNA, 22 nt, Human
uagcaagaccaauauguagaua

SEQ ID NO: 238473 - RNA, 22 nt, Human
aaaguucuggagaaaauaauga

SEQ ID NO: 238474 - RNA, 22 nt, Human
ugcugcagauugcagauuaacu

SEQ ID NO: 238475 - RNA, 22 nt, Human
gcugaaaugggcacugaaggcc

SEQ ID NO: 238476 - RNA, 22 nt, Human
guuaaugugguagugcauaucu

SEQ ID NO: 238477 - RNA, 22 nt, Human
aacugagauuacaagagacauu

SEQ ID NO: 238478 - RNA, 23 nt, Human
ucuggcuccauccuuggggaucc

SEQ ID NO: 238479 - RNA, 22 nt, Human
accccccagauaaucccuugag

SEQ ID NO: 238480 - RNA, 22 nt, Human
cuggcagauaguaagugaucaa

SEQ ID NO: 238481 - RNA, 22 nt, Human
aaugcacauguuguaauaaaua

SEQ ID NO: 238482 - RNA, 22 nt, Human
guuauguaaucuaacacucagu

SEQ ID NO: 238483 - RNA, 22 nt, Human
aggguagggccguagggccaug

SEQ ID NO: 238484 - RNA, 22 nt, Human
acaaaugugucuaauugugccu

SEQ ID NO: 238485 - RNA, 22 nt, Human
cuggguguagauggaaguuugg

SEQ ID NO: 238486 - RNA, 22 nt, Human
ucucccauucagcuugcaguca

SEQ ID NO: 238487 - RNA, 22 nt, Human
uuaguguguuaaugaguauauc

SEQ ID NO: 238488 - RNA, 22 nt, Human
accucagagauacaaaccaugg

SEQ ID NO: 238489 - RNA, 22 nt, Human
auccugggccucagaggugugu

SEQ ID NO: 238490 - RNA, 22 nt, Human
ucuguccuguuuccuccugaca

SEQ ID NO: 238491 - RNA, 22 nt, Human
gaagcugaugaggaccagauug

SEQ ID NO: 238492 - RNA, 22 nt, Human
uaauuuacucagauguucaauc

SEQ ID NO: 238493 - RNA, 22 nt, Human
uuuccacacaggcucuacuacu

SEQ ID NO: 238494 - RNA, 20 nt, Human
uggcccuguuuucuccaggc

SEQ ID NO: 238495 - RNA, 22 nt, Human
gagggcucugaaaggaggucac

SEQ ID NO: 238496 - RNA, 22 nt, Human
agucacugucuugcaaagguca

SEQ ID NO: 238497 - RNA, 22 nt, Human
acaguuuuuucaacauuggaau

SEQ ID NO: 238498 - RNA, 22 nt, Human
cccugguguggaugugauuggc

SEQ ID NO: 238499 - RNA, 22 nt, Human
gcccucuggugggugagccccg

SEQ ID NO: 238500 - RNA, 22 nt, Human
auuaguagcuguaauaacuggg

SEQ ID NO: 238501 - RNA, 22 nt, Human
ccucagcugcuucccuggagcc

SEQ ID NO: 238502 - RNA, 22 nt, Human
aggcagagcuggguuuugaaau

SEQ ID NO: 238503 - RNA, 22 nt, Human
agucucagaaaauaugcuuuuu

SEQ ID NO: 238504 - RNA, 22 nt, Human
agugucugcaaaaugaaagagc

SEQ ID NO: 238505 - RNA, 22 nt, Human
aguccuagcccuggauccauca

SEQ ID NO: 238506 - RNA, 22 nt, Human
ggccagaggaccucucauagcc

SEQ ID NO: 238507 - RNA, 22 nt, Human
cagagccucccuccucugccau

SEQ ID NO: 238508 - RNA, 22 nt, Human
uuuagagcaggguguggcacau

SEQ ID NO: 238509 - RNA, 20 nt, Human
uuaagaaaagcacauccugc

SEQ ID NO: 238510 - RNA, 22 nt, Human
caugugugucuccaccagcugc

SEQ ID NO: 238511 - RNA, 22 nt, Human
agaggccagaaaguaugccacc

SEQ ID NO: 238512 - RNA, 20 nt, Human
aaaugaugggaauaaucuau

SEQ ID NO: 238513 - RNA, 22 nt, Human
uacacagacucuucaauucaga

SEQ ID NO: 238514 - RNA, 22 nt, Human
auuuccaacuaccccuccauuu

SEQ ID NO: 238515 - RNA, 22 nt, Human
uuaguucuugggugaacuuuug

SEQ ID NO: 238516 - RNA, 22 nt, Human
ucagcaggcacggacaggcugc

SEQ ID NO: 238517 - RNA, 22 nt, Human
aucaagaacuuauuuuggaaau

SEQ ID NO: 238518 - RNA, 21 nt, Human
uggaaaaauguggccuaguga

SEQ ID NO: 238519 - RNA, 22 nt, Human
uuuuggcacugcgucuacaugg

SEQ ID NO: 238520 - RNA, 22 nt, Human
agccucugauggcucccaagga

SEQ ID NO: 238521 - RNA, 22 nt, Human
cacugagcugauuucaggugcc

SEQ ID NO: 238522 - RNA, 22 nt, Human
caauuauucagugacuuaagag

SEQ ID NO: 238523 - RNA, 22 nt, Human
auugauaucaguuugcugauug

SEQ ID NO: 238524 - RNA, 22 nt, Human
aguucacagccauguucaugug

SEQ ID NO: 238525 - RNA, 19 nt, Human
guggccagggcaggggcug

SEQ ID NO: 238526 - RNA, 22 nt, Human
uguaucugacaguggagcggag

SEQ ID NO: 238527 - RNA, 22 nt, Human
ucuguagucucugauauaucug

SEQ ID NO: 238528 - RNA, 22 nt, Human
gauucuuuacucagauuuuguu

SEQ ID NO: 238529 - RNA, 22 nt, Human
uaugaaauuuaaacacagauca

SEQ ID NO: 238530 - RNA, 22 nt, Human
agucacuugauucuccugagcu

SEQ ID NO: 238531 - RNA, 22 nt, Human
aaugaucuacucucauuaucuc

SEQ ID NO: 238532 - RNA, 20 nt, Human
ugggguccuggaggggaucc

SEQ ID NO: 238533 - RNA, 22 nt, Human
ucagugcaucacagaacuuugu

SEQ ID NO: 238534 - RNA, 22 nt, Human
auugaguauuguaaauaaaaca

SEQ ID NO: 238535 - RNA, 22 nt, Human
caaagcuggaaaaggaggcugg

SEQ ID NO: 238536 - RNA, 22 nt, Human
cuuuccuagaaauauauacuua

SEQ ID NO: 238537 - RNA, 22 nt, Human
uuacaugcuuagagaugcaugc

SEQ ID NO: 238538 - RNA, 22 nt, Human
auacaucucuuugaagugcuuu

SEQ ID NO: 238539 - RNA, 22 nt, Human
uaaggccaauuacauauguuca

SEQ ID NO: 238540 - RNA, 22 nt, Human
aggcaauccccugaggauacuu

SEQ ID NO: 238541 - RNA, 22 nt, Human
gacacugugcuagcugggcuua

SEQ ID NO: 238542 - RNA, 22 nt, Human
ugcuguauuacuuuuacaaacu

SEQ ID NO: 238543 - RNA, 22 nt, Human
aacugguauggugagaagagag

SEQ ID NO: 238544 - RNA, 22 nt, Human
gacauaaaauucaauaauuugu

SEQ ID NO: 238545 - RNA, 22 nt, Human
acacaguugguggcucagucug

SEQ ID NO: 238546 - RNA, 22 nt, Human
guucccaugccuccaagcuuca

SEQ ID NO: 238547 - RNA, 22 nt, Human
uaagcaaauagcuagaucagag

SEQ ID NO: 238548 - RNA, 22 nt, Human
ugcaggaggauuuuguggagcu

SEQ ID NO: 238549 - RNA, 22 nt, Human
uuagcuaaacuguaacuagaau

SEQ ID NO: 238550 - RNA, 22 nt, Human
uggcaaggcugugggggcagag

SEQ ID NO: 238551 - RNA, 22 nt, Human
cuggagcagcagguggccaggg

SEQ ID NO: 238552 - RNA, 23 nt, Human
agcaggcaucuguggcacaaggc

SEQ ID NO: 238553 - RNA, 22 nt, Human
uggagcagaggaagaaggcuuu

SEQ ID NO: 238554 - RNA, 22 nt, Human
aacacuuuccugccuuucugau

SEQ ID NO: 238555 - RNA, 22 nt, Human
ucaguguccaaaaagaggcaag

SEQ ID NO: 238556 - RNA, 22 nt, Human
uaaggccaaacuauuauaguuc

SEQ ID NO: 238557 - RNA, 22 nt, Human
caucaucuggcuuuuagaaaaa

SEQ ID NO: 238558 - RNA, 22 nt, Human
uaaugacauuguauccacagag

SEQ ID NO: 238559 - RNA, 22 nt, Human
uauguagaagcugcucaaagaa

SEQ ID NO: 238560 - RNA, 22 nt, Human
gcucaggagcucuugguggcgc

SEQ ID NO: 238561 - RNA, 22 nt, Human
accaggagccacaggaggagcc

SEQ ID NO: 238562 - RNA, 22 nt, Human
aagucauagucgggaaagacau

SEQ ID NO: 238563 - RNA, 22 nt, Human
caugagugaguaucucaagaua

SEQ ID NO: 238564 - RNA, 22 nt, Human
aaaguucugggggagaagaacg

SEQ ID NO: 238565 - RNA, 22 nt, Human
ugagcacagcuuucacuagaaa

SEQ ID NO: 238566 - RNA, 22 nt, Human
ugcugaggaaaaaugugacucu

SEQ ID NO: 238567 - RNA, 22 nt, Human
uuucugcauuguccucuugguu

SEQ ID NO: 238568 - RNA, 22 nt, Human
acauucuggaugucugaugaga

SEQ ID NO: 238569 - RNA, 22 nt, Human
uguuccucugaacuucuuccaa

SEQ ID NO: 238570 - RNA, 22 nt, Human
aaacuuucauguaucucuuuca

SEQ ID NO: 238571 - RNA, 18 nt, Human
ucagggaaucuuggccuu

SEQ ID NO: 238572 - RNA, 22 nt, Human
uuaguagaauguuauagcaauu

SEQ ID NO: 238573 - RNA, 22 nt, Human
cugaggagcugaaggcccucca

SEQ ID NO: 238574 - RNA, 20 nt, Human
ggaaucaggguaauguacug

SEQ ID NO: 238575 - RNA, 22 nt, Human
gaugcauugcaucgaguagcuu

SEQ ID NO: 238576 - RNA, 22 nt, Human
aagcaauuguccugucucuaca

SEQ ID NO: 238577 - RNA, 22 nt, Human
uaaugucuccaggguugaccua

SEQ ID NO: 238578 - RNA, 22 nt, Human
guuugcauguauuaagucaaua

SEQ ID NO: 238579 - RNA, 22 nt, Human
acaggcugcugggcuccgugcu

SEQ ID NO: 238580 - RNA, 22 nt, Human
uacagagugguuguccaacucu

SEQ ID NO: 238581 - RNA, 22 nt, Human
gcaugcagucaaccaguaaggg

SEQ ID NO: 238582 - RNA, 22 nt, Human
ccagggcaauuauuuggagggu

SEQ ID NO: 238583 - RNA, 22 nt, Human
ucucagggaguugaggcugccu

SEQ ID NO: 238584 - RNA, 22 nt, Human
cuggcugcuggccugaggaugc

SEQ ID NO: 238585 - RNA, 22 nt, Human
gcacagcucgagcucaggaggg

SEQ ID NO: 238586 - RNA, 22 nt, Human
agucuuggcuaugcauagagcu

SEQ ID NO: 238587 - RNA, 22 nt, Human
uaucuacaguuaauaugucauc

SEQ ID NO: 238588 - RNA, 22 nt, Human
uagaaucugauuacccuaugaa

SEQ ID NO: 238589 - RNA, 23 nt, Human
aaugacagugugugauugaagaa

SEQ ID NO: 238590 - RNA, 22 nt, Human
guguggcuagaagugucuuguu

SEQ ID NO: 238591 - RNA, 22 nt, Human
gcagucuaucuugugauuuaac

SEQ ID NO: 238592 - RNA, 22 nt, Human
guccagccccugacucccaggc

SEQ ID NO: 238593 - RNA, 22 nt, Human
aaagacaguggauucaaaaucc

SEQ ID NO: 238594 - RNA, 22 nt, Human
caagggaagaggacagggaccu

SEQ ID NO: 238595 - RNA, 17 nt, Human
uguauuuaucaugucag

SEQ ID NO: 238596 - RNA, 22 nt, Human
auuguauaagucuauuuacaau

SEQ ID NO: 238597 - RNA, 22 nt, Human
gggagacacgcugcaggcauaa

SEQ ID NO: 238598 - RNA, 22 nt, Human
ucacaucuccauguguuguuca

SEQ ID NO: 238599 - RNA, 22 nt, Human
acaguuuagagcaugaugacca

SEQ ID NO: 238600 - RNA, 22 nt, Human
uuuaguucucccagucuugauu

SEQ ID NO: 238601 - RNA, 22 nt, Human
gcucagcacuuucuccaaccac

SEQ ID NO: 238602 - RNA, 22 nt, Human
auugacagaaaauuggauggca

SEQ ID NO: 238603 - RNA, 22 nt, Human
aggcagcuuuaacugguaguag

SEQ ID NO: 238604 - RNA, 22 nt, Human
aauuccaacagacaaaguuaga

SEQ ID NO: 238605 - RNA, 23 nt, Human
ccagcccuccaccagcucuaggc

SEQ ID NO: 238606 - RNA, 22 nt, Human
gcauuacagcaguucaacuugg

SEQ ID NO: 238607 - RNA, 22 nt, Human
uggucagaaggaagggcuccua

SEQ ID NO: 238608 - RNA, 22 nt, Human
ggaggccagccugaggcugagg

SEQ ID NO: 238609 - RNA, 18 nt, Human
aaugugaauauuuacuuc

SEQ ID NO: 238610 - RNA, 22 nt, Human
uggcuggagcauuccuugucuu

SEQ ID NO: 238611 - RNA, 22 nt, Human
caggugggcugccucuccagcu

SEQ ID NO: 238612 - RNA, 20 nt, Human
auuugcaucugaauaacuua

SEQ ID NO: 238613 - RNA, 22 nt, Human
ggaggccuugccugcaggcaca

SEQ ID NO: 238614 - RNA, 22 nt, Human
aggcacagagagguuaaaugca

SEQ ID NO: 238615 - RNA, 22 nt, Human
gaggugaguggaucacgagguc

SEQ ID NO: 238616 - RNA, 22 nt, Human
aggcacuugcauugaugagguc

SEQ ID NO: 238617 - RNA, 22 nt, Human
cagugaggcucugcugagcggu

SEQ ID NO: 238618 - RNA, 22 nt, Human
ccucuguaaugauucacugaau

SEQ ID NO: 238619 - RNA, 22 nt, Human
gaggcugaacagguucucauga

SEQ ID NO: 238620 - RNA, 22 nt, Human
ccucuggccauucuuugaugga

SEQ ID NO: 238621 - RNA, 20 nt, Human
aggaggaaaaaaugacgagc

SEQ ID NO: 238622 - RNA, 22 nt, Human
gaaaugauuuuaguuuaucaug

SEQ ID NO: 238623 - RNA, 22 nt, Human
agccaaaguccaaaugcagugu

SEQ ID NO: 238624 - RNA, 22 nt, Human
agucuucuguuuuucagcagcu

SEQ ID NO: 238625 - RNA, 20 nt, Human
uuacagugggaccuuccuga

SEQ ID NO: 238626 - RNA, 22 nt, Human
aggcuagggccauggcugguga

SEQ ID NO: 238627 - RNA, 18 nt, Human
ucaugucucacaggugau

SEQ ID NO: 238628 - RNA, 22 nt, Human
cuuuaauucucaggugcacaua

SEQ ID NO: 238629 - RNA, 22 nt, Human
cagaacugaccucugauucuag

SEQ ID NO: 238630 - RNA, 22 nt, Human
aaacaugagcaucucuucaagc

SEQ ID NO: 238631 - RNA, 22 nt, Human
ccucuuggagucuaucauucug

SEQ ID NO: 238632 - RNA, 22 nt, Human
gcacaauaauucuuguuuugcu

SEQ ID NO: 238633 - RNA, 22 nt, Human
cuauucagccucuaagacaagu

SEQ ID NO: 238634 - RNA, 22 nt, Human
aggagcuucagagagaaccugg

SEQ ID NO: 238635 - RNA, 22 nt, Human
aguguucaggaucugaggccag

SEQ ID NO: 238636 - RNA, 22 nt, Human
auacaaucaucauuauauuccc

SEQ ID NO: 238637 - RNA, 22 nt, Human
gugcaaccaucaccacugacuc

SEQ ID NO: 238638 - RNA, 22 nt, Human
acucaccacacccuugcacuug

SEQ ID NO: 238639 - RNA, 22 nt, Human
cuucucccgaagccgguucugc

SEQ ID NO: 238640 - RNA, 22 nt, Human
cauuuguagcuauuuacuguau

SEQ ID NO: 238641 - RNA, 21 nt, Human
cugcuuccucucuucauggca

SEQ ID NO: 238642 - RNA, 22 nt, Human
ugcaauauguugcauuguaugg

SEQ ID NO: 238643 - RNA, 22 nt, Human
gacaacaauaauguggagcuga

SEQ ID NO: 238644 - RNA, 22 nt, Human
gaguagcauucuagaguaugcu

SEQ ID NO: 238645 - RNA, 23 nt, Human
ggcuccugcuucaugucccaccu

SEQ ID NO: 238646 - RNA, 22 nt, Human
aagcuguuggcagauagcucug

SEQ ID NO: 238647 - RNA, 22 nt, Human
uuuguucaugccuauauucuca

SEQ ID NO: 238648 - RNA, 22 nt, Human
ugaggauggaaugcugugcaag

SEQ ID NO: 238649 - RNA, 22 nt, Human
guggcauuaggccaggugcaua

SEQ ID NO: 238650 - RNA, 22 nt, Human
augcaggggcuguguuuugggu

SEQ ID NO: 238651 - RNA, 22 nt, Human
guuagaaagugucugcuugggu

SEQ ID NO: 238652 - RNA, 22 nt, Human
uccuggggaggucgaggcugag

SEQ ID NO: 238653 - RNA, 22 nt, Human
uucucagauauuuguauggaac

SEQ ID NO: 238654 - RNA, 22 nt, Human
uauacacauuuuuaccuauagu

SEQ ID NO: 238655 - RNA, 22 nt, Human
gcagccagccccucugaccucu

SEQ ID NO: 238656 - RNA, 22 nt, Human
uccugggcgagguacuggggcu

SEQ ID NO: 238657 - RNA, 21 nt, Human
ucugagacuggguuagaaugu

SEQ ID NO: 238658 - RNA, 22 nt, Human
uccauuuucuaaguaucacuua

SEQ ID NO: 238659 - RNA, 20 nt, Human
aauuuacucacagaaugaau

SEQ ID NO: 238660 - RNA, 22 nt, Human
gaaagcacccaagauuuccuuc

SEQ ID NO: 238661 - RNA, 23 nt, Human
aggaagagagagugccucuuucu

SEQ ID NO: 238662 - RNA, 22 nt, Human
uaaaugugggggccacgggcuu

SEQ ID NO: 238663 - RNA, 23 nt, Human
uccaggcacgcauuucuucuagc

SEQ ID NO: 238664 - RNA, 22 nt, Human
aaucuagaguucccagcauaaa

SEQ ID NO: 238665 - RNA, 22 nt, Human
uggcucugucaaacugcacaca

SEQ ID NO: 238666 - RNA, 22 nt, Human
uucagugucacaagagcaagcc

SEQ ID NO: 238667 - RNA, 17 nt, Human
ccagagcuacugagacu

SEQ ID NO: 238668 - RNA, 22 nt, Human
uccugccuguuuaccuguacuu

SEQ ID NO: 238669 - RNA, 22 nt, Human
acagcagcugccuucaggcucu

SEQ ID NO: 238670 - RNA, 18 nt, Human
agcccagcggagugaauc

SEQ ID NO: 238671 - RNA, 22 nt, Human
uccuggccgcuggccccugaga

SEQ ID NO: 238672 - RNA, 22 nt, Human
aaagugguugcugucagccucu

SEQ ID NO: 238673 - RNA, 22 nt, Human
aucucugugccaucauugcccc

SEQ ID NO: 238674 - RNA, 22 nt, Human
cuucacugaugggacagcucaa

SEQ ID NO: 238675 - RNA, 22 nt, Human
cccugaggggcuuacuuugccc

SEQ ID NO: 238676 - RNA, 22 nt, Human
uaguauuuuagaaaaccaugaa

SEQ ID NO: 238677 - RNA, 22 nt, Human
aaaaggcuuggaaccuuucccu

SEQ ID NO: 238678 - RNA, 22 nt, Human
cuccagugucucagagcagaug

SEQ ID NO: 238679 - RNA, 22 nt, Human
uucuagaauguuuugaaaggga

SEQ ID NO: 238680 - RNA, 22 nt, Human
uuagaaguucaggucuguaauc

SEQ ID NO: 238681 - RNA, 22 nt, Human
augaaucaaaguucauuugauc

SEQ ID NO: 238682 - RNA, 22 nt, Human
uuagcugcauuaucaaaguuau

SEQ ID NO: 238683 - RNA, 19 nt, Human
ugcuauuugaagaagugua

SEQ ID NO: 238684 - RNA, 19 nt, Human
auacacguguauacauaca

SEQ ID NO: 238685 - RNA, 22 nt, Human
aguguccuggcaaggguuucag

SEQ ID NO: 238686 - RNA, 22 nt, Human
caaaacauucagagagcucacu

SEQ ID NO: 238687 - RNA, 22 nt, Human
ucuccugggaggacaaggaagg

SEQ ID NO: 238688 - RNA, 22 nt, Human
uuuguucugaaaacucaagucc

SEQ ID NO: 238689 - RNA, 22 nt, Human
ugggccagcaauugcugcucag

SEQ ID NO: 238690 - RNA, 22 nt, Human
uuuucauuguaaaucaggaaac

SEQ ID NO: 238691 - RNA, 18 nt, Human
uugagggaggggcagagu

SEQ ID NO: 238692 - RNA, 17 nt, Human
gagacagcaggagcccc

SEQ ID NO: 238693 - RNA, 22 nt, Human
uaucaauaucucagugugcuuc

SEQ ID NO: 238694 - RNA, 22 nt, Human
guuaacauuucuaggugcaggg

SEQ ID NO: 238695 - RNA, 22 nt, Human
cccagcagaaucugaugagggc

SEQ ID NO: 238696 - RNA, 22 nt, Human
ggcaggcuuugagaaagagcau

SEQ ID NO: 238697 - RNA, 22 nt, Human
uguaacaguaguuacuauucuu

SEQ ID NO: 238698 - RNA, 22 nt, Human
ugaagcuuuaggauggguucau

SEQ ID NO: 238699 - RNA, 22 nt, Human
ggaggggagucucccaaagccg

SEQ ID NO: 238700 - RNA, 22 nt, Human
cuggagcuggcccaggcuggcc

SEQ ID NO: 238701 - RNA, 22 nt, Human
gaggugucguagauuauucuca

SEQ ID NO: 238702 - RNA, 22 nt, Human
auaaauugugcuuuugacaucu

SEQ ID NO: 238703 - RNA, 22 nt, Human
ugaguucuuugcaaauaacaag

SEQ ID NO: 238704 - RNA, 22 nt, Human
aagucagacagcugagcugccu

SEQ ID NO: 238705 - RNA, 22 nt, Human
ucagccuacacuccaacagcau

SEQ ID NO: 238706 - RNA, 22 nt, Human
auccuucuaagagggacguaug

SEQ ID NO: 238707 - RNA, 23 nt, Human
uaugaacugcauugcuggugugu

SEQ ID NO: 238708 - RNA, 23 nt, Human
cucuccaccuucccacccaggga

SEQ ID NO: 238709 - RNA, 22 nt, Human
acuuaacagacauuauuuaccu

SEQ ID NO: 238710 - RNA, 16 nt, Human
uucucuguuccuugug

SEQ ID NO: 238711 - RNA, 22 nt, Human
ucugcaucucuuauaaaugaug

SEQ ID NO: 238712 - RNA, 22 nt, Human
gagcagugggaaggaacagggu

SEQ ID NO: 238713 - RNA, 22 nt, Human
cagcccaggacugcagguguuu

SEQ ID NO: 238714 - RNA, 18 nt, Human
uggcagugagguaggcau

SEQ ID NO: 238715 - RNA, 22 nt, Human
aaaccaucagauaauucauacu

SEQ ID NO: 238716 - RNA, 22 nt, Human
agauaucuggaaaaaauguaug

SEQ ID NO: 238717 - RNA, 22 nt, Human
cagugccaaggagaaggacagc

SEQ ID NO: 238718 - RNA, 22 nt, Human
cuacauuucccagcugccuucc

SEQ ID NO: 238719 - RNA, 19 nt, Human
gccacaucuguaccccuuu

SEQ ID NO: 238720 - RNA, 22 nt, Human
auacacagcuacauugaacaau

SEQ ID NO: 238721 - RNA, 22 nt, Human
ucucuuuaaaaauagugaaaua

SEQ ID NO: 238722 - RNA, 22 nt, Human
uuucauguacuuuuuugauaga

SEQ ID NO: 238723 - RNA, 22 nt, Human
ugugaaaggagccauagacagu

SEQ ID NO: 238724 - RNA, 22 nt, Human
uagucuuucauuuggagcauuu

SEQ ID NO: 238725 - RNA, 22 nt, Human
ugcacagcugccuccucucugc

SEQ ID NO: 238726 - RNA, 22 nt, Human
gcagugcugaucccauggcaga

SEQ ID NO: 238727 - RNA, 22 nt, Human
guucuucaguucaggcuguuca

SEQ ID NO: 238728 - RNA, 19 nt, Human
auagaaccugcaguuucaa

SEQ ID NO: 238729 - RNA, 22 nt, Human
uguuaggguccugugcaggggc

SEQ ID NO: 238730 - RNA, 22 nt, Human
uagauccugcauagguugugcu

SEQ ID NO: 238731 - RNA, 20 nt, Human
gcucugggugguaaaugacu

SEQ ID NO: 238732 - RNA, 22 nt, Human
aacagcuaguaccaauccacua

SEQ ID NO: 238733 - RNA, 22 nt, Human
uauguacaccggggaagguggg

SEQ ID NO: 238734 - RNA, 22 nt, Human
gaggaggcuaucagcaaucagg

SEQ ID NO: 238735 - RNA, 22 nt, Human
uggagagucucugagccagggc

SEQ ID NO: 238736 - RNA, 22 nt, Human
uuguaaaguucuuaggaagcuc

SEQ ID NO: 238737 - RNA, 22 nt, Human
gaaucaaugguagauuaaguaa

SEQ ID NO: 238738 - RNA, 22 nt, Human
uuccugguaaauuauguccagg

SEQ ID NO: 238739 - RNA, 21 nt, Human
auggaaauuggcaaaugcuac

SEQ ID NO: 238740 - RNA, 22 nt, Human
uggcagagagacucuccuugau

SEQ ID NO: 238741 - RNA, 22 nt, Human
caagcaggccuggcuggaccgu

SEQ ID NO: 238742 - RNA, 22 nt, Human
cuucuggcguuggaggucugag

SEQ ID NO: 238743 - RNA, 22 nt, Human
aggagggagaugcccauccugg

SEQ ID NO: 238744 - RNA, 18 nt, Human
ggcuccaggaccuaccca

SEQ ID NO: 238745 - RNA, 22 nt, Human
aaaugaguuugccucuagauag

SEQ ID NO: 238746 - RNA, 22 nt, Human
ucugcaggccucgacaaggcca

SEQ ID NO: 238747 - RNA, 22 nt, Human
uuauuccaguaaucucuguaau

SEQ ID NO: 238748 - RNA, 22 nt, Human
uucaacaaugaaagcuaaggaa

SEQ ID NO: 238749 - RNA, 21 nt, Human
ucuggcaggaagacggauggg

SEQ ID NO: 238750 - RNA, 15 nt, Human
gcaggcaggucaccu

SEQ ID NO: 238751 - RNA, 22 nt, Human
ccagagguuccaggcuagggag

SEQ ID NO: 238752 - RNA, 22 nt, Human
gagggcucugucuggaagggaa

SEQ ID NO: 238753 - RNA, 22 nt, Human
caaggcuuggagagaaugccau

SEQ ID NO: 238754 - RNA, 22 nt, Human
ccccagagagcaccaugaagcc

SEQ ID NO: 238755 - RNA, 22 nt, Human
uugagcuguauaccuaugacug

SEQ ID NO: 238756 - RNA, 22 nt, Human
acaggccuggugcugcugacag

SEQ ID NO: 238757 - RNA, 22 nt, Human
cacaggagguuaggaagugguc

SEQ ID NO: 238758 - RNA, 22 nt, Human
uuuagaauuggcuagugggaau

SEQ ID NO: 238759 - RNA, 22 nt, Human
auggaugaguccuugagacaca

SEQ ID NO: 238760 - RNA, 18 nt, Human
agcuccugaacucugugg

SEQ ID NO: 238761 - RNA, 22 nt, Human
cccagagcaugugcugccuuug

SEQ ID NO: 238762 - RNA, 22 nt, Human
uuucagaaacgauuaugaacac

SEQ ID NO: 238763 - RNA, 22 nt, Human
uccuggccucugagucaagaac

SEQ ID NO: 238764 - RNA, 22 nt, Human
gcaaaugaagguggugcuacag

SEQ ID NO: 238765 - RNA, 22 nt, Human
uccagccaaucaacuauuguuu

SEQ ID NO: 238766 - RNA, 22 nt, Human
auaugccauuagcuagaaauaa

SEQ ID NO: 238767 - RNA, 22 nt, Human
ugagggaguuggguguauagga

SEQ ID NO: 238768 - RNA, 22 nt, Human
gcagcuuucugcaaugucaucc

SEQ ID NO: 238769 - RNA, 22 nt, Human
ugcaggaauuuuuugcagaaag

SEQ ID NO: 238770 - RNA, 22 nt, Human
cgucuuccucuuacgaugcgcu

SEQ ID NO: 238771 - RNA, 22 nt, Human
gcccacagaggcaccaccaggc

SEQ ID NO: 238772 - RNA, 22 nt, Human
ugaugaggacccaucaccuggu

SEQ ID NO: 238773 - RNA, 22 nt, Human
uggaaggaagccaaggaagguu

SEQ ID NO: 238774 - RNA, 22 nt, Human
cauuuuaagaugaccugguuuc

SEQ ID NO: 238775 - RNA, 22 nt, Human
ugcaugcaugcuacugggaggu

SEQ ID NO: 238776 - RNA, 22 nt, Human
cgugagggcauggcagugagga

SEQ ID NO: 238777 - RNA, 20 nt, Human
aguggcugauggaaagaagc

SEQ ID NO: 238778 - RNA, 22 nt, Human
gcugccuugaacuuggccuggg

SEQ ID NO: 238779 - RNA, 22 nt, Human
agaaguuauccaccuuagaugc

SEQ ID NO: 238780 - RNA, 23 nt, Human
agaagcagcuucuggaguaucgg

SEQ ID NO: 238781 - RNA, 22 nt, Human
ggcucuggugaggguaggagau

SEQ ID NO: 238782 - RNA, 22 nt, Human
gcuccaggcagagccucuuucg

SEQ ID NO: 238783 - RNA, 22 nt, Human
gucucugagcucugagcuggcu

SEQ ID NO: 238784 - RNA, 22 nt, Human
uguuuacugcauucuauuugcu

SEQ ID NO: 238785 - RNA, 22 nt, Human
agaaucuaaauaugcaauuuga

SEQ ID NO: 238786 - RNA, 22 nt, Human
caggcccugcacuaggcccugg

SEQ ID NO: 238787 - RNA, 22 nt, Human
auuguaauuuuagagaaagugg

SEQ ID NO: 238788 - RNA, 22 nt, Human
cauccauucauuaauucuaaag

SEQ ID NO: 238789 - RNA, 22 nt, Human
ggcccagcgaggccaccuacag

SEQ ID NO: 238790 - RNA, 22 nt, Human
caugugucacagccuuuuauug

SEQ ID NO: 238791 - RNA, 22 nt, Human
ugccaggcacgugagaguggcc

SEQ ID NO: 238792 - RNA, 22 nt, Human
uacaguuauaugugauaaguaa

SEQ ID NO: 238793 - RNA, 22 nt, Human
uggccucaaccguccuaagcac

SEQ ID NO: 238794 - RNA, 22 nt, Human
agcccugcucaucuggaucccg

SEQ ID NO: 238795 - RNA, 22 nt, Human
guggcuuccaugugcaucugac

SEQ ID NO: 238796 - RNA, 20 nt, Human
agugucugggccucaggccc

SEQ ID NO: 238797 - RNA, 22 nt, Human
uagcagcccaguuucuggccaa

SEQ ID NO: 238798 - RNA, 22 nt, Human
acaagucuuuuucaugucuucu

SEQ ID NO: 238799 - RNA, 22 nt, Human
cagggcauccgugcuccaugcu

SEQ ID NO: 238800 - RNA, 19 nt, Human
aauacaguguuauagaauu

SEQ ID NO: 238801 - RNA, 22 nt, Human
ggugcaaacguaauugugguuu

SEQ ID NO: 238802 - RNA, 22 nt, Human
aagugaagaaauacaugagaau

SEQ ID NO: 238803 - RNA, 20 nt, Human
aagcaauauagugcaaaugu

SEQ ID NO: 238804 - RNA, 20 nt, Human
gugggcagcaggcauacugg

SEQ ID NO: 238805 - RNA, 22 nt, Human
ucaguucuuuauuucacaguga

SEQ ID NO: 238806 - RNA, 22 nt, Human
gacagaugagggaguauucuca

SEQ ID NO: 238807 - RNA, 22 nt, Human
uauuaucauuaacuguugaauu

SEQ ID NO: 238808 - RNA, 22 nt, Human
uaagaacaagcuggggguucca

SEQ ID NO: 238809 - RNA, 22 nt, Human
aucaucuugaaagucuauguuu

SEQ ID NO: 238810 - RNA, 22 nt, Human
agcugcugagccauguccugcu

SEQ ID NO: 238811 - RNA, 22 nt, Human
cuacauuucauccagggagagc

SEQ ID NO: 238812 - RNA, 17 nt, Human
ggcuucagggagcuggg

SEQ ID NO: 238813 - RNA, 22 nt, Human
gauuuuacugucuguguaucuc

SEQ ID NO: 238814 - RNA, 23 nt, Human
ugagaucuuuguaguaucaauga

SEQ ID NO: 238815 - RNA, 22 nt, Human
agggggugucucugauuggguu

SEQ ID NO: 238816 - RNA, 22 nt, Human
ggcccugggcccucuagcuugu

SEQ ID NO: 238817 - RNA, 22 nt, Human
cagcccugaaacaaccuccucu

SEQ ID NO: 238818 - RNA, 22 nt, Human
agagccacugggagacagagca

SEQ ID NO: 238819 - RNA, 22 nt, Human
agagcugaggauccagcugagc

SEQ ID NO: 238820 - RNA, 22 nt, Human
aauacuggcugucaaagaugga

SEQ ID NO: 238821 - RNA, 22 nt, Human
gcaggcuuugacuuggggcagc

SEQ ID NO: 238822 - RNA, 23 nt, Human
agucuuacugucccagaacaggg

SEQ ID NO: 238823 - RNA, 22 nt, Human
uaggcugaaaggagaggugaag

SEQ ID NO: 238824 - RNA, 17 nt, Human
gggcugacaguggccuc

SEQ ID NO: 238825 - RNA, 22 nt, Human
uaaauguuaugcccaucaucca

SEQ ID NO: 238826 - RNA, 23 nt, Human
gaggagggucugacaaguguagc

SEQ ID NO: 238827 - RNA, 22 nt, Human
ucagucuucaaaucugagucgu

SEQ ID NO: 238828 - RNA, 22 nt, Human
uuaggaacuucugucucagugu

SEQ ID NO: 238829 - RNA, 22 nt, Human
agcccugggaggccagcuugua

SEQ ID NO: 238830 - RNA, 22 nt, Human
ugugccuggagucccugaggag

SEQ ID NO: 238831 - RNA, 22 nt, Human
gaaauacuguaaaguuauuauu

SEQ ID NO: 238832 - RNA, 22 nt, Human
cugugggagcacaugacagaua

SEQ ID NO: 238833 - RNA, 20 nt, Human
gggaugagaguccuagcucu

SEQ ID NO: 238834 - RNA, 22 nt, Human
uccaugaguuugaggaaaagag

SEQ ID NO: 238835 - RNA, 22 nt, Human
ugaaaaacacuaauuggaaagc

SEQ ID NO: 238836 - RNA, 20 nt, Human
cucugcugcgcaucccacuu

SEQ ID NO: 238837 - RNA, 22 nt, Human
auguuacaauucaaaaugcugc

SEQ ID NO: 238838 - RNA, 22 nt, Human
cucuuuggagaagcacguauua

SEQ ID NO: 238839 - RNA, 22 nt, Human
aggaacugauuuauaacuuuag

SEQ ID NO: 238840 - RNA, 22 nt, Human
uaggcugggcauucuggccagg

SEQ ID NO: 238841 - RNA, 22 nt, Human
augggacagguacuagaaaggg

SEQ ID NO: 238842 - RNA, 22 nt, Human
acugggagggucuugaagaggg

SEQ ID NO: 238843 - RNA, 22 nt, Human
caugaccccccaaggccugcag

SEQ ID NO: 238844 - RNA, 22 nt, Human
caggagcaaauccaaaagaauu

SEQ ID NO: 238845 - RNA, 21 nt, Human
ucacagacuggucagugaggc

SEQ ID NO: 238846 - RNA, 22 nt, Human
aguggcagagucaggguuugga

SEQ ID NO: 238847 - RNA, 22 nt, Human
ccucaaaucuuuagaguuauuu

SEQ ID NO: 238848 - RNA, 23 nt, Human
accaugaugggagugcaaauaag

SEQ ID NO: 238849 - RNA, 22 nt, Human
ggccucuggcaggcaggcccuc

SEQ ID NO: 238850 - RNA, 22 nt, Human
uauuauugacauuuacuuggug

SEQ ID NO: 238851 - RNA, 22 nt, Human
augcaaaugcagccauugcaga

SEQ ID NO: 238852 - RNA, 22 nt, Human
acauaugucuauuucauguaaa

SEQ ID NO: 238853 - RNA, 22 nt, Human
guuccucacguggacagaugau

SEQ ID NO: 238854 - RNA, 22 nt, Human
uggagggauacaaagaugaaaa

SEQ ID NO: 238855 - RNA, 22 nt, Human
uuucuauaacuggacuggauug

SEQ ID NO: 238856 - RNA, 22 nt, Human
aaguacaugcuuuauucagagu

SEQ ID NO: 238857 - RNA, 22 nt, Human
aguacuuuacuucuuacaguuu

SEQ ID NO: 238858 - RNA, 22 nt, Human
cuggaagagugacuuugcauuu

SEQ ID NO: 238859 - RNA, 22 nt, Human
agagcuggcugguagcccugau

SEQ ID NO: 238860 - RNA, 21 nt, Human
ucuguuggaggccucucuucc

SEQ ID NO: 238861 - RNA, 22 nt, Human
cagcaucuccauggcuuuggag

SEQ ID NO: 238862 - RNA, 21 nt, Human
ucagagagucacagugaacug

SEQ ID NO: 238863 - RNA, 22 nt, Human
uccuuuaaacuccuuucaaguc

SEQ ID NO: 238864 - RNA, 22 nt, Human
cccugcagacgucuugaugccu

SEQ ID NO: 238865 - RNA, 22 nt, Human
ugcaauaaguauugcuuacaug

SEQ ID NO: 238866 - RNA, 22 nt, Human
uugaagacacagacauauagag

SEQ ID NO: 238867 - RNA, 22 nt, Human
caguguuugcuuaaguuauaug

SEQ ID NO: 238868 - RNA, 22 nt, Human
uuuuagaaggaaugcuauggug

SEQ ID NO: 238869 - RNA, 20 nt, Human
cacaggcuauaugagagcca

SEQ ID NO: 238870 - RNA, 22 nt, Human
gcaagacaauggagcauaaacg

SEQ ID NO: 238871 - RNA, 22 nt, Human
guauuucaguuccucuugugac

SEQ ID NO: 238872 - RNA, 22 nt, Human
cuccacagccccuccaguggca

SEQ ID NO: 238873 - RNA, 22 nt, Human
aggcugaggcaagaggaucacu

SEQ ID NO: 238874 - RNA, 22 nt, Human
acuuugcagagccagaagagaa

SEQ ID NO: 238875 - RNA, 23 nt, Human
gaggcagcuccugcagugcccug

SEQ ID NO: 238876 - RNA, 22 nt, Human
ucacuggggccaugugagggac

SEQ ID NO: 238877 - RNA, 22 nt, Human
uggcaggucaugaguggccacc

SEQ ID NO: 238878 - RNA, 19 nt, Human
uccugggcugcgucuugcc

SEQ ID NO: 238879 - RNA, 22 nt, Human
agccucuguagaaagcagugug

SEQ ID NO: 238880 - RNA, 22 nt, Human
uugacccagcuuuccccacaau

SEQ ID NO: 238881 - RNA, 20 nt, Human
acgggcugggacccaugcac

SEQ ID NO: 238882 - RNA, 22 nt, Human
augguacagugcacugaaugga

SEQ ID NO: 238883 - RNA, 21 nt, Human
aggcccagcuuuccucuugcu

SEQ ID NO: 238884 - RNA, 22 nt, Human
uuagcaauuccagguaaguuau

SEQ ID NO: 238885 - RNA, 22 nt, Human
gccaggcagcagcgaggauggu

SEQ ID NO: 238886 - RNA, 22 nt, Human
uacaaugcugugcauguaaugg

SEQ ID NO: 238887 - RNA, 22 nt, Human
ggcuccacccugcuuccagaag

SEQ ID NO: 238888 - RNA, 22 nt, Human
uaccacaguuuaucuauucagc

SEQ ID NO: 238889 - RNA, 22 nt, Human
acagcauucccuuuggcugcuu

SEQ ID NO: 238890 - RNA, 19 nt, Human
caguaucauugcacauagu

SEQ ID NO: 238891 - RNA, 22 nt, Human
uggggcagcuccaucuauucca

SEQ ID NO: 238892 - RNA, 22 nt, Human
uggcucagccauucguguugcc

SEQ ID NO: 238893 - RNA, 22 nt, Human
caagcagauauuuuagucaaga

SEQ ID NO: 238894 - RNA, 16 nt, Human
caugagucaguaagca

SEQ ID NO: 238895 - RNA, 20 nt, Human
agcaggugacggggccugcu

SEQ ID NO: 238896 - RNA, 22 nt, Human
cagccaggcccagaucaugcug

SEQ ID NO: 238897 - RNA, 22 nt, Human
uuaugcaaggacuuauuacagu

SEQ ID NO: 238898 - RNA, 22 nt, Human
ugcagggcacacgcacgggugu

SEQ ID NO: 238899 - RNA, 22 nt, Human
agcugcaggccucuccugggga

SEQ ID NO: 238900 - RNA, 22 nt, Human
agaggccagaucaucauagaug

SEQ ID NO: 238901 - RNA, 22 nt, Human
cagagcaguaaaucuggggcac

SEQ ID NO: 238902 - RNA, 22 nt, Human
uagaaaugcaguguacuguguc

SEQ ID NO: 238903 - RNA, 22 nt, Human
uuggcugcuaauggcugacagc

SEQ ID NO: 238904 - RNA, 22 nt, Human
ccagcuuuccaggguugacugg

SEQ ID NO: 238905 - RNA, 22 nt, Human
aguguauucagaauguagcaaa

SEQ ID NO: 238906 - RNA, 22 nt, Human
cugagcagcguggggagcuggc

SEQ ID NO: 238907 - RNA, 22 nt, Human
gucugucuguuguugagaagca

SEQ ID NO: 238908 - RNA, 22 nt, Human
uucaguguggcccaugaagagg

SEQ ID NO: 238909 - RNA, 22 nt, Human
aauuugauuuucuuaaaccaua

SEQ ID NO: 238910 - RNA, 22 nt, Human
guuuccugcccugucuuaucca

SEQ ID NO: 238911 - RNA, 22 nt, Human
aaggccacagagccucagagag

SEQ ID NO: 238912 - RNA, 22 nt, Human
uccucagacuucccuuugugua

SEQ ID NO: 238913 - RNA, 22 nt, Human
caauuuuuaaacuaugaaguug

SEQ ID NO: 238914 - RNA, 22 nt, Human
ccuggcacauaguaaguacuag

SEQ ID NO: 238915 - RNA, 23 nt, Human
aaauccugccucuuguauuuauc

SEQ ID NO: 238916 - RNA, 22 nt, Human
gagcugccuacauugccaagag

SEQ ID NO: 238917 - RNA, 22 nt, Human
gcagacucugagagugagugcc

SEQ ID NO: 238918 - RNA, 22 nt, Human
ugccuagccuucuucaugccau

SEQ ID NO: 238919 - RNA, 22 nt, Human
caaggcugaucauuuucccaua

SEQ ID NO: 238920 - RNA, 22 nt, Human
uaucagcaggccaaagcugcaa

SEQ ID NO: 238921 - RNA, 22 nt, Human
aggugcugugcuaugcacuugu

SEQ ID NO: 238922 - RNA, 22 nt, Human
gugcacagaaacauacaaugug

SEQ ID NO: 238923 - RNA, 22 nt, Human
cacaggugccaucucuucaugg

SEQ ID NO: 238924 - RNA, 22 nt, Human
uuugacucuugcuuugguggcu

SEQ ID NO: 238925 - RNA, 22 nt, Human
gaaaggcucagauucccccagg

SEQ ID NO: 238926 - RNA, 22 nt, Human
gcugggcucguucccacacgcg

SEQ ID NO: 238927 - RNA, 22 nt, Human
uucuggaguauuccuggcagcc

SEQ ID NO: 238928 - RNA, 22 nt, Human
ccagugcauaaucaauacagcc

SEQ ID NO: 238929 - RNA, 23 nt, Human
acauaaacagaaggugugcuucc

SEQ ID NO: 238930 - RNA, 22 nt, Human
ucacagcauucgcaauggacag

SEQ ID NO: 238931 - RNA, 22 nt, Human
accuucaagauugugggucaau

SEQ ID NO: 238932 - RNA, 22 nt, Human
uuucaaaauuuugcagugguaa

SEQ ID NO: 238933 - RNA, 22 nt, Human
cagagcagucuggagauccagc

SEQ ID NO: 238934 - RNA, 22 nt, Human
ggcaugcaaaugugggugaccu

SEQ ID NO: 238935 - RNA, 22 nt, Human
uaaacauuuguuauucuuguuu

SEQ ID NO: 238936 - RNA, 22 nt, Human
aagcaaggcccagagcaucagc

SEQ ID NO: 238937 - RNA, 22 nt, Human
guccugugccgaggugggaagc

SEQ ID NO: 238938 - RNA, 22 nt, Human
cuguggaagguuuagauaggua

SEQ ID NO: 238939 - RNA, 22 nt, Human
ucuuguuucuucuaagcagcag

SEQ ID NO: 238940 - RNA, 22 nt, Human
guccuguguaagccaggacaau

SEQ ID NO: 238941 - RNA, 22 nt, Human
aguguuuuauuagaacacagcc

SEQ ID NO: 238942 - RNA, 22 nt, Human
ggaaagaacccuggauggcugg

SEQ ID NO: 238943 - RNA, 22 nt, Human
gacagcagauaagaccucauca

SEQ ID NO: 238944 - RNA, 22 nt, Human
aaagccaugaauguuauagagg

SEQ ID NO: 238945 - RNA, 22 nt, Human
uaugauaaccuguuguaguuug

SEQ ID NO: 238946 - RNA, 22 nt, Human
aaggaacuugccacagaaaaga

SEQ ID NO: 238947 - RNA, 17 nt, Human
aaacuggggucaggagc

SEQ ID NO: 238948 - RNA, 23 nt, Human
auaucacacccaguacagucucc

SEQ ID NO: 238949 - RNA, 22 nt, Human
gcuucucuuguccaagggcagg

SEQ ID NO: 238950 - RNA, 22 nt, Human
gcuuaggaguuucaggcucuca

SEQ ID NO: 238951 - RNA, 22 nt, Human
gccuucucugugagcuccuagg

SEQ ID NO: 238952 - RNA, 22 nt, Human
ggccucaguuucuucaacugua

SEQ ID NO: 238953 - RNA, 21 nt, Human
uccaggcugaugaugucaacu

SEQ ID NO: 238954 - RNA, 22 nt, Human
gcucccagaaccaaggcugggg

SEQ ID NO: 238955 - RNA, 22 nt, Human
uauugcugccucguccaggcug

SEQ ID NO: 238956 - RNA, 22 nt, Human
cugcuccuguccagcagggcca

SEQ ID NO: 238957 - RNA, 18 nt, Human
aggaagcaggaggaaggc

SEQ ID NO: 238958 - RNA, 18 nt, Human
ucagguguuuucuguaua

SEQ ID NO: 238959 - RNA, 22 nt, Human
cugggccuggacgggcagaucu

SEQ ID NO: 238960 - RNA, 22 nt, Human
guuucuuaaaagaggaguuaga

SEQ ID NO: 238961 - RNA, 22 nt, Human
ccuggcucuggggcggacagcu

SEQ ID NO: 238962 - RNA, 22 nt, Human
aaaggauaagguuaucaauuuu

SEQ ID NO: 238963 - RNA, 18 nt, Human
ucuguccuuccauucuuc

SEQ ID NO: 238964 - RNA, 22 nt, Human
uaggaagcuuccagaacuuaag

SEQ ID NO: 238965 - RNA, 20 nt, Human
ucugggagggacaagucucc

SEQ ID NO: 238966 - RNA, 22 nt, Human
caauuuuauugguccaaauaca

SEQ ID NO: 238967 - RNA, 20 nt, Human
cuccaguguucaggggagug

SEQ ID NO: 238968 - RNA, 22 nt, Human
acccagccacagcauugaggga

SEQ ID NO: 238969 - RNA, 22 nt, Human
cuuccaguaguaucauucucau

SEQ ID NO: 238970 - RNA, 22 nt, Human
aggccccaaagcagugcaagua

SEQ ID NO: 238971 - RNA, 22 nt, Human
ccaugcccuugucaucuccagg

SEQ ID NO: 238972 - RNA, 22 nt, Human
ucuuaaaaguaugccaauugga

SEQ ID NO: 238973 - RNA, 18 nt, Human
uuuauauggauagagacc

SEQ ID NO: 238974 - RNA, 22 nt, Human
uuaaauagcucuuguagaagaa

SEQ ID NO: 238975 - RNA, 22 nt, Human
uguauucucucaauauuucaua

SEQ ID NO: 238976 - RNA, 22 nt, Human
agggccagaaucccucagucua

SEQ ID NO: 238977 - RNA, 22 nt, Human
aucagguagauuuaauauucug

SEQ ID NO: 238978 - RNA, 22 nt, Human
uuucuuuaucauagcaucuuug

SEQ ID NO: 238979 - RNA, 22 nt, Human
agcgcuggcuggcgcuccuucc

SEQ ID NO: 238980 - RNA, 22 nt, Human
uuagugcuuggcacacaauaca

SEQ ID NO: 238981 - RNA, 22 nt, Human
ucaucugucuguucaacagccu

SEQ ID NO: 238982 - RNA, 22 nt, Human
cuggcuucagcugccaucaaug

SEQ ID NO: 238983 - RNA, 22 nt, Human
ugcagagaucugggcgucggcu

SEQ ID NO: 238984 - RNA, 22 nt, Human
ccagaauagaaugaaagaaggg

SEQ ID NO: 238985 - RNA, 22 nt, Human
acaugugcucuugcuguacagc

SEQ ID NO: 238986 - RNA, 20 nt, Human
agaaucugacccagagagac

SEQ ID NO: 238987 - RNA, 22 nt, Human
ccacccuggacaggccucugag

SEQ ID NO: 238988 - RNA, 22 nt, Human
aacaugaaguuuucuauaguga

SEQ ID NO: 238989 - RNA, 22 nt, Human
gccaguguuuauagcagugagg

SEQ ID NO: 238990 - RNA, 22 nt, Human
augcuucagugcuaccuucaaa

SEQ ID NO: 238991 - RNA, 22 nt, Human
gagggcucaacuacuacuaggc

SEQ ID NO: 238992 - RNA, 22 nt, Human
uaggugguuauaaauucaaggc

SEQ ID NO: 238993 - RNA, 22 nt, Human
uccuaggcccagccugagcugu

SEQ ID NO: 238994 - RNA, 22 nt, Human
cucauuuacacuaugggaacua

SEQ ID NO: 238995 - RNA, 22 nt, Human
uuuuuauaugaaggauagugcg

SEQ ID NO: 238996 - RNA, 22 nt, Human
gugacuguaauuaccuuagcaa

SEQ ID NO: 238997 - RNA, 22 nt, Human
caacagagcaguugaucaggaa

SEQ ID NO: 238998 - RNA, 22 nt, Human
gcacugcuuuuaccuaggugag

SEQ ID NO: 238999 - RNA, 22 nt, Human
ugauuacaaaagauuguuugaa

SEQ ID NO: 239000 - RNA, 22 nt, Human
auguacagccacuucacaguua

SEQ ID NO: 239001 - RNA, 23 nt, Human
ugacacaggucaaaaauaagaug

SEQ ID NO: 239002 - RNA, 22 nt, Human
uucuuucuuuguaguccugaac

SEQ ID NO: 239003 - RNA, 22 nt, Human
ugcagagagauccucaggguuu

SEQ ID NO: 239004 - RNA, 22 nt, Human
uguccucacaugguggggagag

SEQ ID NO: 239005 - RNA, 22 nt, Human
uauuagguaugaacuggcaacc

SEQ ID NO: 239006 - RNA, 22 nt, Human
uuggguuuucccuugaaacuga

SEQ ID NO: 239007 - RNA, 22 nt, Human
aagacacacacauaugcugagu

SEQ ID NO: 239008 - RNA, 22 nt, Human
agucugggagaaggugagauua

SEQ ID NO: 239009 - RNA, 22 nt, Human
uacaagaauuucuuucugguug

SEQ ID NO: 239010 - RNA, 22 nt, Human
ugcccagcgcccacauucuguc

SEQ ID NO: 239011 - RNA, 22 nt, Human
agcagccaggaaucugcagagc

SEQ ID NO: 239012 - RNA, 22 nt, Human
aaggaaagacaggacggaauuc

SEQ ID NO: 239013 - RNA, 22 nt, Human
gccaggcuggccagcaccuucu

SEQ ID NO: 239014 - RNA, 22 nt, Human
ucugcucaauacugcucaugaa

SEQ ID NO: 239015 - RNA, 19 nt, Human
acccagggguuuaugugug

SEQ ID NO: 239016 - RNA, 22 nt, Human
acuuugcaauacuuaauacaaa

SEQ ID NO: 239017 - RNA, 21 nt, Human
cuguccaaauuucauaacuuu

SEQ ID NO: 239018 - RNA, 23 nt, Human
auccagccuggggguuuaaccac

SEQ ID NO: 239019 - RNA, 22 nt, Human
ugccuuagaggauagugaagcc

SEQ ID NO: 239020 - RNA, 22 nt, Human
gccagggaaacugcagaccagc

SEQ ID NO: 239021 - RNA, 21 nt, Human
ugcuggcugaaaggcacagag

SEQ ID NO: 239022 - RNA, 22 nt, Human
guccauacaguggcacacaucu

SEQ ID NO: 239023 - RNA, 22 nt, Human
uuuaaacauaucuguugaggga

SEQ ID NO: 239024 - RNA, 22 nt, Human
acauaacauaguugacauuuuu

SEQ ID NO: 239025 - RNA, 22 nt, Human
uccuccaggcaccucacuggcu

SEQ ID NO: 239026 - RNA, 22 nt, Human
aaaauucugucauuaaauugug

SEQ ID NO: 239027 - RNA, 22 nt, Human
ugccugugcccuucuuggcauu

SEQ ID NO: 239028 - RNA, 22 nt, Human
guccuguggaaagcuagccgcu

SEQ ID NO: 239029 - RNA, 22 nt, Human
uaaauguguguagccaucugug

SEQ ID NO: 239030 - RNA, 22 nt, Human
uggcagccuucucugagaaggu

SEQ ID NO: 239031 - RNA, 23 nt, Human
auugauucccucuuggaagggau

SEQ ID NO: 239032 - RNA, 22 nt, Human
ucuguucuugcuuuucuccaac

SEQ ID NO: 239033 - RNA, 22 nt, Human
caggcagcucugcuuuuccuaa

SEQ ID NO: 239034 - RNA, 22 nt, Human
ugagcaggucaagacuccagcu

SEQ ID NO: 239035 - RNA, 22 nt, Human
aaugcaaacuccacuggagcag

SEQ ID NO: 239036 - RNA, 20 nt, Human
gggaggcgagggcugagcag

SEQ ID NO: 239037 - RNA, 22 nt, Human
uccaaauauacagaaucuccuc

SEQ ID NO: 239038 - RNA, 22 nt, Human
uauuuccauguuagaacuaagu

SEQ ID NO: 239039 - RNA, 22 nt, Human
aagguacaccaaaguucaaguu

SEQ ID NO: 239040 - RNA, 22 nt, Human
aagugguugcuugugagucccc

SEQ ID NO: 239041 - RNA, 22 nt, Human
agcuuuaucagaggagucucua

SEQ ID NO: 239042 - RNA, 22 nt, Human
cugggagcccgcguccuggugg

SEQ ID NO: 239043 - RNA, 22 nt, Human
aguaccugauuucacagaccag

SEQ ID NO: 239044 - RNA, 22 nt, Human
aaguggcauguauaagaaagaa

SEQ ID NO: 239045 - RNA, 22 nt, Human
gcauaauauacaugcuugaucc

SEQ ID NO: 239046 - RNA, 22 nt, Human
uggugagaauugguuggauuua

SEQ ID NO: 239047 - RNA, 22 nt, Human
aggcucugucaggcggagcagc

SEQ ID NO: 239048 - RNA, 22 nt, Human
auacagauguuaaagcaauuuc

SEQ ID NO: 239049 - RNA, 22 nt, Human
ccucagucugucugaucugcca

SEQ ID NO: 239050 - RNA, 22 nt, Human
cuccucagacuuuccuuguccg

SEQ ID NO: 239051 - RNA, 22 nt, Human
aaguacaaucuuucuguaaagg

SEQ ID NO: 239052 - RNA, 22 nt, Human
auccacaggucauguaaugugg

SEQ ID NO: 239053 - RNA, 22 nt, Human
ugcucuggaguggcuugugcac

SEQ ID NO: 239054 - RNA, 21 nt, Human
uucaaaaugguguguuugucu

SEQ ID NO: 239055 - RNA, 22 nt, Human
uccaggcacgaggcccugugca

SEQ ID NO: 239056 - RNA, 22 nt, Human
guccagccaggcugcagcaccc

SEQ ID NO: 239057 - RNA, 22 nt, Human
auguguauacuugugcuuacuc

SEQ ID NO: 239058 - RNA, 22 nt, Human
uugaaugaaugguccauauaga

SEQ ID NO: 239059 - RNA, 22 nt, Human
aggcucugacgucacacguggc

SEQ ID NO: 239060 - RNA, 19 nt, Human
gcauuucucuuuacagcca

SEQ ID NO: 239061 - RNA, 22 nt, Human
uccaggauggugacgguggcca

SEQ ID NO: 239062 - RNA, 22 nt, Human
guggcccaggcacccugaugac

SEQ ID NO: 239063 - RNA, 22 nt, Human
ucccuuaaaacucauguguugu

SEQ ID NO: 239064 - RNA, 22 nt, Human
cagggcucaggcucugggauuc

SEQ ID NO: 239065 - RNA, 22 nt, Human
uuuuguuuguguccacugcagu

SEQ ID NO: 239066 - RNA, 22 nt, Human
acuuuuaaaugaguuucaguug

SEQ ID NO: 239067 - RNA, 22 nt, Human
ucuucuguccuaagucaaagca

SEQ ID NO: 239068 - RNA, 22 nt, Human
aaguucuugaagacuuuaaaua

SEQ ID NO: 239069 - RNA, 22 nt, Human
cugguuuaguaggggacugaag

SEQ ID NO: 239070 - RNA, 22 nt, Human
cuacacuuugguugacuuugug

SEQ ID NO: 239071 - RNA, 22 nt, Human
gcagguguucucagaggaggcu

SEQ ID NO: 239072 - RNA, 22 nt, Human
ucccacugagccccugcuggug

SEQ ID NO: 239073 - RNA, 22 nt, Human
uugggcagggaaaggacaggca

SEQ ID NO: 239074 - RNA, 19 nt, Human
caggccagugucagggggc

SEQ ID NO: 239075 - RNA, 22 nt, Human
ugaguuuuuucaacauaugaag

SEQ ID NO: 239076 - RNA, 22 nt, Human
uugcagcuucuaccacuguuuc

SEQ ID NO: 239077 - RNA, 22 nt, Human
auggaagacagauaaggcagaa

SEQ ID NO: 239078 - RNA, 22 nt, Human
uuuguaaaaggaggaagcaugg

SEQ ID NO: 239079 - RNA, 22 nt, Human
aggagcucuugaugcuugaggg

SEQ ID NO: 239080 - RNA, 22 nt, Human
gaggccaggagugcuguaaguu

SEQ ID NO: 239081 - RNA, 22 nt, Human
cagcucagucuugaagcacugg

SEQ ID NO: 239082 - RNA, 22 nt, Human
uccaucugguaaaauucauuga

SEQ ID NO: 239083 - RNA, 22 nt, Human
acuggaaaguauucuuucacug

SEQ ID NO: 239084 - RNA, 22 nt, Human
uucugggcagagcuggagcugc

SEQ ID NO: 239085 - RNA, 16 nt, Human
ucugccagggacaggc

SEQ ID NO: 239086 - RNA, 22 nt, Human
ccaggucugcgggcggcaggca

SEQ ID NO: 239087 - RNA, 22 nt, Human
cacagaggagugcacacucucu

SEQ ID NO: 239088 - RNA, 22 nt, Human
agcaggcaggcccagcggcugg

SEQ ID NO: 239089 - RNA, 22 nt, Human
guuucauuuacaucuguaggua

SEQ ID NO: 239090 - RNA, 22 nt, Human
cccagagagguaaaacagccuu

SEQ ID NO: 239091 - RNA, 22 nt, Human
uucuggcaugagagaugggggu

SEQ ID NO: 239092 - RNA, 22 nt, Human
uagcaagaggaaacaaggggcc

SEQ ID NO: 239093 - RNA, 22 nt, Human
acuccuggguugcaguccucaa

SEQ ID NO: 239094 - RNA, 22 nt, Human
caauaauauccugugcuguuug

SEQ ID NO: 239095 - RNA, 22 nt, Human
gucccauaaguagugcaacuug

SEQ ID NO: 239096 - RNA, 22 nt, Human
agacagaacagaauaauuguug

SEQ ID NO: 239097 - RNA, 22 nt, Human
cacaggcaggagguucuccagu

SEQ ID NO: 239098 - RNA, 22 nt, Human
cugccccuggcuggugaagcag

SEQ ID NO: 239099 - RNA, 22 nt, Human
guucuuuaaacugcugcucugu

SEQ ID NO: 239100 - RNA, 19 nt, Human
gccugggaugggcagaacu

SEQ ID NO: 239101 - RNA, 22 nt, Human
ucuggagaggaggauguggaca

SEQ ID NO: 239102 - RNA, 22 nt, Human
agcacagaaugagguggaagug

SEQ ID NO: 239103 - RNA, 22 nt, Human
aguguguuuaggcugcggguug

SEQ ID NO: 239104 - RNA, 22 nt, Human
aacauggcucaugagagauuug

SEQ ID NO: 239105 - RNA, 22 nt, Human
gagcaacacauugaaugaggau

SEQ ID NO: 239106 - RNA, 22 nt, Human
ucuuccagcuucuagaggaugc

SEQ ID NO: 239107 - RNA, 22 nt, Human
gguggcugcuuccucaagagga

SEQ ID NO: 239108 - RNA, 22 nt, Human
agcauguguggagaaauauuuu

SEQ ID NO: 239109 - RNA, 22 nt, Human
cugcagggcccaaggucaacgg

SEQ ID NO: 239110 - RNA, 22 nt, Human
ugaggcagugcugggaagccug

SEQ ID NO: 239111 - RNA, 20 nt, Human
cucucacagcucccucagcc

SEQ ID NO: 239112 - RNA, 22 nt, Human
ugggaagacuccucaggaggcg

SEQ ID NO: 239113 - RNA, 22 nt, Human
uuaaggcauugauauggugcua

SEQ ID NO: 239114 - RNA, 22 nt, Human
aaguucaaguguaaucuuuauu

SEQ ID NO: 239115 - RNA, 22 nt, Human
gucaccugaggggaggugacag

SEQ ID NO: 239116 - RNA, 22 nt, Human
cuuuacagaauaagaauacugg

SEQ ID NO: 239117 - RNA, 22 nt, Human
uagggcugaggcaacaagggag

SEQ ID NO: 239118 - RNA, 22 nt, Human
uugguacaaaaguaacuguggu

SEQ ID NO: 239119 - RNA, 22 nt, Human
ugguuagaugaggcugguuuca

SEQ ID NO: 239120 - RNA, 22 nt, Human
gcccucagaugggaaaggaggg

SEQ ID NO: 239121 - RNA, 22 nt, Human
accaggcccuccagcugcgugg

SEQ ID NO: 239122 - RNA, 22 nt, Human
cuggcuccaaauucugauguuc

SEQ ID NO: 239123 - RNA, 22 nt, Human
gcagugaaaaagugcacccugu

SEQ ID NO: 239124 - RNA, 22 nt, Human
augguuuacugaucuuuuuggu

SEQ ID NO: 239125 - RNA, 19 nt, Human
gcuaggguugguggcgugc

SEQ ID NO: 239126 - RNA, 22 nt, Human
aauugaugauucuuaugugaaa

SEQ ID NO: 239127 - RNA, 22 nt, Human
ccaggaaccgaugaucagaggg

SEQ ID NO: 239128 - RNA, 22 nt, Human
aagggaggggauguaagccugg

SEQ ID NO: 239129 - RNA, 21 nt, Human
uucucuggucaagcacacaua

SEQ ID NO: 239130 - RNA, 20 nt, Human
uccacaucuuuugagaugug

SEQ ID NO: 239131 - RNA, 22 nt, Human
gcaggccugcccagcaggaugg

SEQ ID NO: 239132 - RNA, 17 nt, Human
ggcuggaggggacccgg

SEQ ID NO: 239133 - RNA, 22 nt, Human
uguuauacuauuuagagguaca

SEQ ID NO: 239134 - RNA, 19 nt, Human
cugggacaaugaaagcauc

SEQ ID NO: 239135 - RNA, 22 nt, Human
ugugugcaugcuuggggcagca

SEQ ID NO: 239136 - RNA, 22 nt, Human
gucugcccucacgccagcuggg

SEQ ID NO: 239137 - RNA, 19 nt, Human
ugcuucagaaauagaaagc

SEQ ID NO: 239138 - RNA, 22 nt, Human
agugcugacucugggcacagug

SEQ ID NO: 239139 - RNA, 21 nt, Human
ugaggcaggggugcuuuuguc

SEQ ID NO: 239140 - RNA, 22 nt, Human
gauaaacauucuugcacaugug

SEQ ID NO: 239141 - RNA, 22 nt, Human
ucugcagacaggaagcugaggc

SEQ ID NO: 239142 - RNA, 22 nt, Human
caggaauguuugugcuccuuua

SEQ ID NO: 239143 - RNA, 22 nt, Human
uuuaagagcuaguaugucauuu

SEQ ID NO: 239144 - RNA, 22 nt, Human
uuccccaggcuggagugcagug

SEQ ID NO: 239145 - RNA, 19 nt, Human
uucacauuuugcucugagg

SEQ ID NO: 239146 - RNA, 22 nt, Human
ccugucugcaugaucccugcca

SEQ ID NO: 239147 - RNA, 22 nt, Human
acaauuugaggcuacucaauug

SEQ ID NO: 239148 - RNA, 22 nt, Human
gcugcaaaccugccaccuggug

SEQ ID NO: 239149 - RNA, 22 nt, Human
uguggggcugucaggcaacugg

SEQ ID NO: 239150 - RNA, 22 nt, Human
aguguccuugauuccuguuguu

SEQ ID NO: 239151 - RNA, 22 nt, Human
ucuggcagagugauaggauaag

SEQ ID NO: 239152 - RNA, 22 nt, Human
aaagacacaaauguagaccaaa

SEQ ID NO: 239153 - RNA, 22 nt, Human
uguguucaaugacuucaucuuu

SEQ ID NO: 239154 - RNA, 22 nt, Human
ggugagaaagggauuccuguuc

SEQ ID NO: 239155 - RNA, 22 nt, Human
ggugcaggcgguggggcaagua

SEQ ID NO: 239156 - RNA, 22 nt, Human
cucagcacauuccuaagggaug

SEQ ID NO: 239157 - RNA, 22 nt, Human
caagauuuguauugggccucug

SEQ ID NO: 239158 - RNA, 22 nt, Human
uuuguucuaacuucugcagaca

SEQ ID NO: 239159 - RNA, 22 nt, Human
aagcuugaaucaauggauaucc

SEQ ID NO: 239160 - RNA, 22 nt, Human
cuccucccaauugccaagugcu

SEQ ID NO: 239161 - RNA, 18 nt, Human
gccuucagacugcaugcu

SEQ ID NO: 239162 - RNA, 23 nt, Human
cagaaaguuugagaagauacauc

SEQ ID NO: 239163 - RNA, 22 nt, Human
ucagagaacacagaggugaugu

SEQ ID NO: 239164 - RNA, 22 nt, Human
ucacaucuauacccaauaauuu

SEQ ID NO: 239165 - RNA, 22 nt, Human
aggcuucugauaccaugagaga

SEQ ID NO: 239166 - RNA, 22 nt, Human
ugacuuuagaauuuuauccaga

SEQ ID NO: 239167 - RNA, 22 nt, Human
cugacuccuaugccccaugggc

SEQ ID NO: 239168 - RNA, 22 nt, Human
agggcugagaaugacagggccg

SEQ ID NO: 239169 - RNA, 22 nt, Human
aaccagcucugcaaaaugucau

SEQ ID NO: 239170 - RNA, 22 nt, Human
ccaggccagagugcaguggcac

SEQ ID NO: 239171 - RNA, 22 nt, Human
cucuuucucauugucagcagaa

SEQ ID NO: 239172 - RNA, 22 nt, Human
uucugagggaaccuuguucuug

SEQ ID NO: 239173 - RNA, 22 nt, Human
ucuggcagguucccauguuaug

SEQ ID NO: 239174 - RNA, 22 nt, Human
cagcaagaguugggguuguugg

SEQ ID NO: 239175 - RNA, 17 nt, Human
ccaggugggaggugggg

SEQ ID NO: 239176 - RNA, 21 nt, Human
uuaaugcuaugcagaaaaucu

SEQ ID NO: 239177 - RNA, 22 nt, Human
gauuuacagaucuaagggucac

SEQ ID NO: 239178 - RNA, 20 nt, Human
uuucuguaaggcauuaaucu

SEQ ID NO: 239179 - RNA, 22 nt, Human
uguacaauagcuauuaucucca

SEQ ID NO: 239180 - RNA, 22 nt, Human
guggcagucgcugacagauaca

SEQ ID NO: 239181 - RNA, 22 nt, Human
augauggaggccgugauggacg

SEQ ID NO: 239182 - RNA, 22 nt, Human
cauauuuauagaucuggcauuu

SEQ ID NO: 239183 - RNA, 22 nt, Human
guccuggcugucuuauguugaa

SEQ ID NO: 239184 - RNA, 22 nt, Human
auacagguggacuucaguuagu

SEQ ID NO: 239185 - RNA, 22 nt, Human
auggcugccuagaggugagaug

SEQ ID NO: 239186 - RNA, 22 nt, Human
uggagggcaucuguggucaggc

SEQ ID NO: 239187 - RNA, 22 nt, Human
cuggcagcuucaggacacucgg

SEQ ID NO: 239188 - RNA, 22 nt, Human
gcuggcuggaguaaggagggag

SEQ ID NO: 239189 - RNA, 22 nt, Human
ucugccuguugcuagaauguca

SEQ ID NO: 239190 - RNA, 22 nt, Human
aaacaaguuuguagacuagcca

SEQ ID NO: 239191 - RNA, 22 nt, Human
acagguggcuuccauuuucuaa

SEQ ID NO: 239192 - RNA, 22 nt, Human
aggggugugcauccuggaggau

SEQ ID NO: 239193 - RNA, 20 nt, Human
cugcccagccacugagggau

SEQ ID NO: 239194 - RNA, 22 nt, Human
gagcugcagcggcugacgcaac

SEQ ID NO: 239195 - RNA, 22 nt, Human
cuuguugcugaauucaggauuc

SEQ ID NO: 239196 - RNA, 22 nt, Human
aaugaacacagcccucuacuuu

SEQ ID NO: 239197 - RNA, 22 nt, Human
agccugcugggaagggaggcuu

SEQ ID NO: 239198 - RNA, 22 nt, Human
uuugcuuaaaguucuuucuggu

SEQ ID NO: 239199 - RNA, 22 nt, Human
aguuggagugaacaugagauug

SEQ ID NO: 239200 - RNA, 22 nt, Human
aagggcaggcacccacccucac

SEQ ID NO: 239201 - RNA, 22 nt, Human
ugucccugauccacuggacccc

SEQ ID NO: 239202 - RNA, 22 nt, Human
cuuguuaaaaugcagauuccaa

SEQ ID NO: 239203 - RNA, 22 nt, Human
cagaacagucgccugcauggau

SEQ ID NO: 239204 - RNA, 22 nt, Human
cugaaagaauaagauguuuaca

SEQ ID NO: 239205 - RNA, 19 nt, Human
uuuauuugagacaugccuu

SEQ ID NO: 239206 - RNA, 22 nt, Human
cagcagccagacaagauacauc

SEQ ID NO: 239207 - RNA, 22 nt, Human
ucuuuuaaaagcccugcugucu

SEQ ID NO: 239208 - RNA, 22 nt, Human
acaauuucuaauauagaucuua

SEQ ID NO: 239209 - RNA, 22 nt, Human
augaaaacggaccagagcuauu

SEQ ID NO: 239210 - RNA, 22 nt, Human
ccugugacaaacccgccuauuc

SEQ ID NO: 239211 - RNA, 20 nt, Human
agaggaggauuauuuuauuc

SEQ ID NO: 239212 - RNA, 22 nt, Human
ccuggccugcucggcucuuaag

SEQ ID NO: 239213 - RNA, 22 nt, Human
ucugggcuugguuagggcuguu

SEQ ID NO: 239214 - RNA, 22 nt, Human
ucuuuggggcaucugggagauu

SEQ ID NO: 239215 - RNA, 22 nt, Human
agcaugaaaacaugaaacagca

SEQ ID NO: 239216 - RNA, 22 nt, Human
agcccuaaauuaucuuuauuuu

SEQ ID NO: 239217 - RNA, 22 nt, Human
ucugaaauuguuaguaaaaaug

SEQ ID NO: 239218 - RNA, 22 nt, Human
augcuuuagugucaaguuuggg

SEQ ID NO: 239219 - RNA, 22 nt, Human
ggcacagcacuguaggccuggg

SEQ ID NO: 239220 - RNA, 23 nt, Human
aaugggugcaacuauccaugaca

SEQ ID NO: 239221 - RNA, 22 nt, Human
uggcaaagaugguucucaccau

SEQ ID NO: 239222 - RNA, 22 nt, Human
aagggcagaaagggacgcuuug

SEQ ID NO: 239223 - RNA, 22 nt, Human
ugccagggccauagggagucua

SEQ ID NO: 239224 - RNA, 22 nt, Human
gcuggcaguaaaggguuuggca

SEQ ID NO: 239225 - RNA, 22 nt, Human
acauucuauagcaagcugaucu

SEQ ID NO: 239226 - RNA, 22 nt, Human
agguggccggugccagccgggc

SEQ ID NO: 239227 - RNA, 22 nt, Human
auucucuuuguauaacaucuug

SEQ ID NO: 239228 - RNA, 22 nt, Human
cuguggcucuuuaguugagcac

SEQ ID NO: 239229 - RNA, 22 nt, Human
uggcucugugaacagacgacug

SEQ ID NO: 239230 - RNA, 22 nt, Human
ucuggacuugaaucagaguaga

SEQ ID NO: 239231 - RNA, 22 nt, Human
ugagcagagaugacugggcauu

SEQ ID NO: 239232 - RNA, 20 nt, Human
caucugagcccacagaaguc

SEQ ID NO: 239233 - RNA, 22 nt, Human
aaacuacacuuugggaccagca

SEQ ID NO: 239234 - RNA, 22 nt, Human
ggucagguagcucugacaggcc

SEQ ID NO: 239235 - RNA, 22 nt, Human
auucaagcugaauggugacaga

SEQ ID NO: 239236 - RNA, 22 nt, Human
uacaaguauguuuuaaaauguu

SEQ ID NO: 239237 - RNA, 22 nt, Human
cugcucucuguuccccuggauc

SEQ ID NO: 239238 - RNA, 17 nt, Human
ucaaagaaugcaugcag

SEQ ID NO: 239239 - RNA, 20 nt, Human
cuuuggcaaugagaacaggg

SEQ ID NO: 239240 - RNA, 22 nt, Human
gaaggcuuauuuucuuuguaaa

SEQ ID NO: 239241 - RNA, 22 nt, Human
aagugauucuagucaugauucu

SEQ ID NO: 239242 - RNA, 22 nt, Human
ucccgcaugccgccggugaaca

SEQ ID NO: 239243 - RNA, 22 nt, Human
ccagcuggcacuguggcugccc

SEQ ID NO: 239244 - RNA, 22 nt, Human
cugccuccucacguccacagug

SEQ ID NO: 239245 - RNA, 22 nt, Human
uagaaaugugauaauagcuuaa

SEQ ID NO: 239246 - RNA, 22 nt, Human
aauguugaggauaucagaaaau

SEQ ID NO: 239247 - RNA, 22 nt, Human
cuuccugcccacuuccugcugg

SEQ ID NO: 239248 - RNA, 22 nt, Human
gccaggcgggucucaaacuccu

SEQ ID NO: 239249 - RNA, 22 nt, Human
ccauggccucgcucuacguggg

SEQ ID NO: 239250 - RNA, 22 nt, Human
ggaacauuuuuuaaggcagaaa

SEQ ID NO: 239251 - RNA, 22 nt, Human
cccaggagaauauaauguucuu

SEQ ID NO: 239252 - RNA, 22 nt, Human
auaacagagagcuacugaacug

SEQ ID NO: 239253 - RNA, 22 nt, Human
uggggaaagacauucauacagu

SEQ ID NO: 239254 - RNA, 22 nt, Human
ggagaagggccaauuccaugua

SEQ ID NO: 239255 - RNA, 22 nt, Human
agccaugcaccuuacucuugcu

SEQ ID NO: 239256 - RNA, 22 nt, Human
gaacuugguauuccuuuuaaca

SEQ ID NO: 239257 - RNA, 22 nt, Human
guacaaaaguuauugcgguuuu

SEQ ID NO: 239258 - RNA, 22 nt, Human
uccaggcauaagccuugagugu

SEQ ID NO: 239259 - RNA, 22 nt, Human
caucagugcccuuggggaugcc

SEQ ID NO: 239260 - RNA, 22 nt, Human
aacaaacaguuaaguguggaug

SEQ ID NO: 239261 - RNA, 22 nt, Human
ccaucuccacugucccugucaa

SEQ ID NO: 239262 - RNA, 22 nt, Human
cuggacagugggcagaggagac

SEQ ID NO: 239263 - RNA, 22 nt, Human
gccuguuuacuuugccgcagga

SEQ ID NO: 239264 - RNA, 21 nt, Human
gcucaggcucagguucagguu

SEQ ID NO: 239265 - RNA, 22 nt, Human
ucucucuauaugucaacagggg

SEQ ID NO: 239266 - RNA, 22 nt, Human
uauucaugacauugcauaugca

SEQ ID NO: 239267 - RNA, 22 nt, Human
augcacaggugcugaugcacgc

SEQ ID NO: 239268 - RNA, 20 nt, Human
aggagcucugugcugggaag

SEQ ID NO: 239269 - RNA, 22 nt, Human
aaacacaagauggccucuucug

SEQ ID NO: 239270 - RNA, 23 nt, Human
uuccagaguccacaucugccacc

SEQ ID NO: 239271 - RNA, 22 nt, Human
ucucaggaaaaaucccuagcuu

SEQ ID NO: 239272 - RNA, 22 nt, Human
ucagcugaaguggagaagcaga

SEQ ID NO: 239273 - RNA, 22 nt, Human
guauuucaucuugaaaaccagu

SEQ ID NO: 239274 - RNA, 22 nt, Human
agaaucagugcuggcuauuagc

SEQ ID NO: 239275 - RNA, 22 nt, Human
ggaagcugaauccagagacagg

SEQ ID NO: 239276 - RNA, 22 nt, Human
uggcugaggcacagcugccgcc

SEQ ID NO: 239277 - RNA, 23 nt, Human
agagccugaaagacuucuggcac

SEQ ID NO: 239278 - RNA, 22 nt, Human
gagcucagacucgggccugggg

SEQ ID NO: 239279 - RNA, 22 nt, Human
auuuccaugaaguuuaguuaua

SEQ ID NO: 239280 - RNA, 22 nt, Human
aggcaaauagauaguccauaca

SEQ ID NO: 239281 - RNA, 22 nt, Human
gccaggcugcuggcugcugucc

SEQ ID NO: 239282 - RNA, 22 nt, Human
gccaggcagagccccgugcagc

SEQ ID NO: 239283 - RNA, 22 nt, Human
gugagagaauuugaguuaaauu

SEQ ID NO: 239284 - RNA, 22 nt, Human
cagcuauucucugaaaugaaua

SEQ ID NO: 239285 - RNA, 22 nt, Human
acaggcagggaccucuugaguu

SEQ ID NO: 239286 - RNA, 22 nt, Human
ugccugccaggcaaccugggag

SEQ ID NO: 239287 - RNA, 22 nt, Human
cugugucugccugggauccauu

SEQ ID NO: 239288 - RNA, 22 nt, Human
gugugcucaagggcaggaaccu

SEQ ID NO: 239289 - RNA, 22 nt, Human
ucucugggaaugggccugggua

SEQ ID NO: 239290 - RNA, 22 nt, Human
cucagcccggugcucgugccac

SEQ ID NO: 239291 - RNA, 22 nt, Human
ggcuguggggggagccugcccg

SEQ ID NO: 239292 - RNA, 22 nt, Human
acacugcucacuucuucccuug

SEQ ID NO: 239293 - RNA, 19 nt, Human
ucagggcaguccggucccc

SEQ ID NO: 239294 - RNA, 22 nt, Human
auggcagggcacagcucuaguu

SEQ ID NO: 239295 - RNA, 22 nt, Human
aaaagcacuacaauuucgcuuc

SEQ ID NO: 239296 - RNA, 22 nt, Human
agaaagcccacccagaagaugu

SEQ ID NO: 239297 - RNA, 22 nt, Human
accaggcuugaugauuugcuua

SEQ ID NO: 239298 - RNA, 22 nt, Human
uaagaaacaugauacuuuuccu

SEQ ID NO: 239299 - RNA, 22 nt, Human
aagggccauaacuugcaguguu

SEQ ID NO: 239300 - RNA, 22 nt, Human
agaucagaaauguaauggcagu

SEQ ID NO: 239301 - RNA, 22 nt, Human
gaugaaaaucuugagaugucga

SEQ ID NO: 239302 - RNA, 22 nt, Human
ugggcucugguuuccuggcugg

SEQ ID NO: 239303 - RNA, 22 nt, Human
uuaccuguuuuacaugcacaac

SEQ ID NO: 239304 - RNA, 22 nt, Human
uugguuuacuaggauucaaauu

SEQ ID NO: 239305 - RNA, 22 nt, Human
gacugucuuguuucuaagauga

SEQ ID NO: 239306 - RNA, 22 nt, Human
guccuucaagguccuuggugug

SEQ ID NO: 239307 - RNA, 22 nt, Human
acugccuugauugccaguuucc

SEQ ID NO: 239308 - RNA, 18 nt, Human
acuggagcauuagcagcu

SEQ ID NO: 239309 - RNA, 22 nt, Human
agcccaggaaguugaggcuugc

SEQ ID NO: 239310 - RNA, 22 nt, Human
ggcugagggccagggcuagucu

SEQ ID NO: 239311 - RNA, 22 nt, Human
uucagagagaaaccagugggaa

SEQ ID NO: 239312 - RNA, 22 nt, Human
ucuccaggcuuaaucucagcuu

SEQ ID NO: 239313 - RNA, 22 nt, Human
auagaauccugcagcaagccuu

SEQ ID NO: 239314 - RNA, 22 nt, Human
aaauugugcucacacugauauu

SEQ ID NO: 239315 - RNA, 22 nt, Human
agugaguugaacauugauaaug

SEQ ID NO: 239316 - RNA, 22 nt, Human
gcugcagggagcuggaaggcuc

SEQ ID NO: 239317 - RNA, 22 nt, Human
ugagcugcccccuggccugcuc

SEQ ID NO: 239318 - RNA, 22 nt, Human
accuuuauagcugauuaugaca

SEQ ID NO: 239319 - RNA, 22 nt, Human
aacucucauuuuagguguaagg

SEQ ID NO: 239320 - RNA, 20 nt, Human
cugccaugauugauagagug

SEQ ID NO: 239321 - RNA, 22 nt, Human
ggcacugacacuagcauggcac

SEQ ID NO: 239322 - RNA, 22 nt, Human
cagguccugcagggagaguaaa

SEQ ID NO: 239323 - RNA, 22 nt, Human
gcaggcuucccccacaccuacg

SEQ ID NO: 239324 - RNA, 22 nt, Human
uacauauguaaacauguauaaa

SEQ ID NO: 239325 - RNA, 22 nt, Human
cucucugguuucagcgaagggg

SEQ ID NO: 239326 - RNA, 22 nt, Human
ggacacaggcagcugggugggu

SEQ ID NO: 239327 - RNA, 22 nt, Human
uggcucaggagggaucuuugcu

SEQ ID NO: 239328 - RNA, 21 nt, Human
gaggggcagcucuuagcauua

SEQ ID NO: 239329 - RNA, 22 nt, Human
ugcuaucaccaacucugcuaag

SEQ ID NO: 239330 - RNA, 22 nt, Human
uuucacauacaguguauaguag

SEQ ID NO: 239331 - RNA, 22 nt, Human
ccagcuggcaggagagucaggg

SEQ ID NO: 239332 - RNA, 22 nt, Human
uggacaggauagugcaguacgc

SEQ ID NO: 239333 - RNA, 22 nt, Human
acagagagggagugauaaaucc

SEQ ID NO: 239334 - RNA, 22 nt, Human
gacuccagguguccaggccucc

SEQ ID NO: 239335 - RNA, 22 nt, Human
aaagacagacggaaaccugagg

SEQ ID NO: 239336 - RNA, 22 nt, Human
ccugagugaccugaggucuagu

SEQ ID NO: 239337 - RNA, 21 nt, Human
uccuccuguagaggguccugg

SEQ ID NO: 239338 - RNA, 23 nt, Human
ugaaagcaaugggucuauaguau

SEQ ID NO: 239339 - RNA, 22 nt, Human
cugugucccagccaggauaaug

SEQ ID NO: 239340 - RNA, 22 nt, Human
gccuggcaguggggcccuggga

SEQ ID NO: 239341 - RNA, 22 nt, Human
cacugugcuccuaacuagcugu

SEQ ID NO: 239342 - RNA, 22 nt, Human
gucucugugucugagagagccc

SEQ ID NO: 239343 - RNA, 22 nt, Human
cucagaggcaagcaaggagcug

SEQ ID NO: 239344 - RNA, 22 nt, Human
uaaggcauaaggccagaggcua

SEQ ID NO: 239345 - RNA, 22 nt, Human
aucugucuuuuauucaugagcu

SEQ ID NO: 239346 - RNA, 22 nt, Human
ugcccugcccaucuacccuguc

SEQ ID NO: 239347 - RNA, 22 nt, Human
ucgucugugaaauugggauaag

SEQ ID NO: 239348 - RNA, 22 nt, Human
ucacaaauauuuuaacaguagg

SEQ ID NO: 239349 - RNA, 22 nt, Human
cagcaagacaaggaacaaacug

SEQ ID NO: 239350 - RNA, 22 nt, Human
aaccugcauguuucuaaaagca

SEQ ID NO: 239351 - RNA, 22 nt, Human
ucugcucacauggcuccaugca

SEQ ID NO: 239352 - RNA, 22 nt, Human
gggagggaaggaggcgccgugu

SEQ ID NO: 239353 - RNA, 22 nt, Human
uacaauguuaaggaaagagaga

SEQ ID NO: 239354 - RNA, 21 nt, Human
uuacagcaauguuagcaggaa

SEQ ID NO: 239355 - RNA, 22 nt, Human
cacaaaugguuguagacauuaa

SEQ ID NO: 239356 - RNA, 22 nt, Human
aucuucugggcagugaaaauug

SEQ ID NO: 239357 - RNA, 22 nt, Human
ucauggaaacagcaaugcuaau

SEQ ID NO: 239358 - RNA, 23 nt, Human
uccuucaaguuaggaagugaaca

SEQ ID NO: 239359 - RNA, 22 nt, Human
aaaguguuuuugagcuguaguu

SEQ ID NO: 239360 - RNA, 22 nt, Human
ggcagggcagcgcugauuaggg

SEQ ID NO: 239361 - RNA, 22 nt, Human
acccugcccucuccagcucagg

SEQ ID NO: 239362 - RNA, 22 nt, Human
cguuuuucaguggucuuagguc

SEQ ID NO: 239363 - RNA, 18 nt, Human
augcuucugauagaagca

SEQ ID NO: 239364 - RNA, 22 nt, Human
uuacugaggagcauaucugagu

SEQ ID NO: 239365 - RNA, 22 nt, Human
agaagggaacucagagaugauu

SEQ ID NO: 239366 - RNA, 22 nt, Human
gcacauauguaaauagcugccu

SEQ ID NO: 239367 - RNA, 22 nt, Human
ugugugcagccucugucuuugg

SEQ ID NO: 239368 - RNA, 22 nt, Human
uccauaaaugaaauagaacgcu

SEQ ID NO: 239369 - RNA, 22 nt, Human
gccucuagggcuguugggaauu

SEQ ID NO: 239370 - RNA, 22 nt, Human
aguccuggguccagcagguccu

SEQ ID NO: 239371 - RNA, 21 nt, Human
aauacagugaagaauuucuuu

SEQ ID NO: 239372 - RNA, 22 nt, Human
acugcugauuuuaggacuguua

SEQ ID NO: 239373 - RNA, 22 nt, Human
gcucagagauggggaaugaaaa

SEQ ID NO: 239374 - RNA, 22 nt, Human
uuaaaugcucacauaaagguag

SEQ ID NO: 239375 - RNA, 22 nt, Human
ucuauauuuugaaagguauuua

SEQ ID NO: 239376 - RNA, 22 nt, Human
gcucugggcugcccucuggaca

SEQ ID NO: 239377 - RNA, 22 nt, Human
agggcucuuuaggccgaggcca

SEQ ID NO: 239378 - RNA, 22 nt, Human
ucugccuuguugcaggcgcuau

SEQ ID NO: 239379 - RNA, 22 nt, Human
gccaggcucaguagcgauuccu

SEQ ID NO: 239380 - RNA, 22 nt, Human
gggcagagagcuggaacuccuu

SEQ ID NO: 239381 - RNA, 21 nt, Human
ucuccuggguccaacccaugc

SEQ ID NO: 239382 - RNA, 22 nt, Human
aagacaugcaguuuguuccauu

SEQ ID NO: 239383 - RNA, 22 nt, Human
uggugcaguucccagggccggg

SEQ ID NO: 239384 - RNA, 22 nt, Human
cccugcagaucuaggguccuuc

SEQ ID NO: 239385 - RNA, 22 nt, Human
uagaucauggaguaaaauggaa

SEQ ID NO: 239386 - RNA, 22 nt, Human
uucacaagucuggaauaugcua

SEQ ID NO: 239387 - RNA, 22 nt, Human
cagguccuuguuuguaaagcag

SEQ ID NO: 239388 - RNA, 22 nt, Human
agggagccagaguugggagcuc

SEQ ID NO: 239389 - RNA, 22 nt, Human
ggcuccaggagaugcugggcag

SEQ ID NO: 239390 - RNA, 22 nt, Human
aaaagggaaagcagaaugacuu

SEQ ID NO: 239391 - RNA, 22 nt, Human
ggugagcaaagcuucaucugua

SEQ ID NO: 239392 - RNA, 22 nt, Human
gccagccagaguggcugugugu

SEQ ID NO: 239393 - RNA, 22 nt, Human
aggcagcuuucuggugcaccau

SEQ ID NO: 239394 - RNA, 22 nt, Human
ggaaaagacagguuaacuguga

SEQ ID NO: 239395 - RNA, 22 nt, Human
cuccaggaaaauagggaaugag

SEQ ID NO: 239396 - RNA, 21 nt, Human
accuuagagagaaagccauca

SEQ ID NO: 239397 - RNA, 22 nt, Human
gaugagguaagaauguaacacc

SEQ ID NO: 239398 - RNA, 22 nt, Human
gacuuuauuauaguggcaauag

SEQ ID NO: 239399 - RNA, 22 nt, Human
cagaggccuuucuacagugaua

SEQ ID NO: 239400 - RNA, 22 nt, Human
acuccugggugcauuucugauu

SEQ ID NO: 239401 - RNA, 22 nt, Human
aaauuauuacaagcuaguuggc

SEQ ID NO: 239402 - RNA, 22 nt, Human
aaacucuagcuacuaggauaac

SEQ ID NO: 239403 - RNA, 22 nt, Human
acacaagauuguguauugaauu

SEQ ID NO: 239404 - RNA, 17 nt, Human
cugccuggagucccauc

SEQ ID NO: 239405 - RNA, 18 nt, Human
aaaaugcaggcgacaugg

SEQ ID NO: 239406 - RNA, 22 nt, Human
cauuucacuauucacuaaaagg

SEQ ID NO: 239407 - RNA, 22 nt, Human
aggauguggguuuucacauugu

SEQ ID NO: 239408 - RNA, 22 nt, Human
agugcagggggaaagggugucu

SEQ ID NO: 239409 - RNA, 21 nt, Human
aaaaguuugacaggaaaggga

SEQ ID NO: 239410 - RNA, 22 nt, Human
cccugugcugucaugcugggcg

SEQ ID NO: 239411 - RNA, 22 nt, Human
auaugcuuugggauuagaucau

SEQ ID NO: 239412 - RNA, 22 nt, Human
aguaaaacagagaaaucacuca

SEQ ID NO: 239413 - RNA, 22 nt, Human
uuuuggaacacagacauuagaa

SEQ ID NO: 239414 - RNA, 22 nt, Human
ccagcccucgguagucccauag

SEQ ID NO: 239415 - RNA, 22 nt, Human
uguauguauguauguauuuggg

SEQ ID NO: 239416 - RNA, 22 nt, Human
cacaggcuuuucugacauaggc

SEQ ID NO: 239417 - RNA, 22 nt, Human
uuggcugcucagugauaugaga

SEQ ID NO: 239418 - RNA, 21 nt, Human
cagaggccucaugcucugugc

SEQ ID NO: 239419 - RNA, 22 nt, Human
uaggaaagcaguagagccagga

SEQ ID NO: 239420 - RNA, 22 nt, Human
ggcaccagcacuugggauggcu

SEQ ID NO: 239421 - RNA, 23 nt, Human
agacaguggccgagagguacuag

SEQ ID NO: 239422 - RNA, 22 nt, Human
agcccugcugccugaauuagcu

SEQ ID NO: 239423 - RNA, 22 nt, Human
ucuuuggaguguuaucaguaau

SEQ ID NO: 239424 - RNA, 22 nt, Human
ucagaaguuaauacgaggagaa

SEQ ID NO: 239425 - RNA, 22 nt, Human
cuuauucauaagucagacacac

SEQ ID NO: 239426 - RNA, 22 nt, Human
cugggccuuuaccuacggaguu

SEQ ID NO: 239427 - RNA, 22 nt, Human
ugcaccaguuucucagagaauc

SEQ ID NO: 239428 - RNA, 22 nt, Human
uaaaaguauacuuucaaaggag

SEQ ID NO: 239429 - RNA, 22 nt, Human
uccaugcagagaacugaaguac

SEQ ID NO: 239430 - RNA, 22 nt, Human
caggcaugaugggaagugccug

SEQ ID NO: 239431 - RNA, 22 nt, Human
ccauuaaaauggaauguaguga

SEQ ID NO: 239432 - RNA, 22 nt, Human
uuguacagaaaaaauucuuggu

SEQ ID NO: 239433 - RNA, 22 nt, Human
aguauuucugaauauuaucaua

SEQ ID NO: 239434 - RNA, 22 nt, Human
agcccugguagccugcugccau

SEQ ID NO: 239435 - RNA, 22 nt, Human
aggaaacugaagcccagagagg

SEQ ID NO: 239436 - RNA, 22 nt, Human
cucuagaacagugcugagccuu

SEQ ID NO: 239437 - RNA, 22 nt, Human
gcugguagaccucacugcacuc

SEQ ID NO: 239438 - RNA, 22 nt, Human
gccaggcugaggcucuggaaga

SEQ ID NO: 239439 - RNA, 22 nt, Human
agccaggccagcugucuugagu

SEQ ID NO: 239440 - RNA, 22 nt, Human
aggguccugggugcaguugcuu

SEQ ID NO: 239441 - RNA, 22 nt, Human
accagaaggaccagaggcaagg

SEQ ID NO: 239442 - RNA, 22 nt, Human
guacaggaaggagggaguuuca

SEQ ID NO: 239443 - RNA, 22 nt, Human
aggugcuguuugucagcaguuu

SEQ ID NO: 239444 - RNA, 22 nt, Human
uuauucaucagugcauuaauuu

SEQ ID NO: 239445 - RNA, 22 nt, Human
cuuucccacgcaguggaugaga

SEQ ID NO: 239446 - RNA, 22 nt, Human
uugcaaguuccuuaugagaauc

SEQ ID NO: 239447 - RNA, 22 nt, Human
ccuggccuccuggccuucucau

SEQ ID NO: 239448 - RNA, 20 nt, Human
aggauggcaagcaagugcau

SEQ ID NO: 239449 - RNA, 22 nt, Human
auugucagggguuguggaguuu

SEQ ID NO: 239450 - RNA, 22 nt, Human
uguuucuuuguagauauucuuu

SEQ ID NO: 239451 - RNA, 22 nt, Human
gaauucuaggguaaauauccua

SEQ ID NO: 239452 - RNA, 22 nt, Human
ucaggaagccacuccacagaga

SEQ ID NO: 239453 - RNA, 22 nt, Human
agacaaauuuccugcaaugaag

SEQ ID NO: 239454 - RNA, 22 nt, Human
gacagcagggacauguaggaag

SEQ ID NO: 239455 - RNA, 22 nt, Human
uauuaaauguuauuuggguugu

SEQ ID NO: 239456 - RNA, 22 nt, Human
ucauuucuccgaccugcugucc

SEQ ID NO: 239457 - RNA, 22 nt, Human
uguacaaauucaguucuagggu

SEQ ID NO: 239458 - RNA, 22 nt, Human
caggaguggugugagggacucc

SEQ ID NO: 239459 - RNA, 22 nt, Human
cuggaagacguuugaagccaug

SEQ ID NO: 239460 - RNA, 22 nt, Human
cugcuguguuccuccugcaucu

SEQ ID NO: 239461 - RNA, 22 nt, Human
acagcuacucugcagauaaauc

SEQ ID NO: 239462 - RNA, 19 nt, Human
gcuacugaggcccaggacc

SEQ ID NO: 239463 - RNA, 22 nt, Human
aagaaucauuguaaaguucugu

SEQ ID NO: 239464 - RNA, 22 nt, Human
uggcuucucaguuucauaauga

SEQ ID NO: 239465 - RNA, 22 nt, Human
ucaggagcaacaucuuugaauc

SEQ ID NO: 239466 - RNA, 22 nt, Human
ugagacagggucuugcucuguu

SEQ ID NO: 239467 - RNA, 22 nt, Human
uggcuuccaaauuaucccuaga

SEQ ID NO: 239468 - RNA, 22 nt, Human
auuguacauaugauguauguaa

SEQ ID NO: 239469 - RNA, 22 nt, Human
agugaaggaaacaauugguuga

SEQ ID NO: 239470 - RNA, 21 nt, Human
cugagcuggggugaagguugc

SEQ ID NO: 239471 - RNA, 22 nt, Human
aaugucugaggcucaucugagg

SEQ ID NO: 239472 - RNA, 22 nt, Human
ccuguucaagggaugauugacc

SEQ ID NO: 239473 - RNA, 22 nt, Human
auucuuugcaucucuggguggc

SEQ ID NO: 239474 - RNA, 22 nt, Human
gcccagaguucaaggcugcagu

SEQ ID NO: 239475 - RNA, 22 nt, Human
caaggcuaagcuuuggcuuucu

SEQ ID NO: 239476 - RNA, 22 nt, Human
gggucucucagaaggcugcaau

SEQ ID NO: 239477 - RNA, 22 nt, Human
uuucuaaguaagauuaacuucu

SEQ ID NO: 239478 - RNA, 22 nt, Human
ugguccaguagcagggauacca

SEQ ID NO: 239479 - RNA, 22 nt, Human
ccagcuccucuucccaguguca

SEQ ID NO: 239480 - RNA, 22 nt, Human
aggguggcaccuggaagggaug

SEQ ID NO: 239481 - RNA, 22 nt, Human
uacagggaaugggacauaaauc

SEQ ID NO: 239482 - RNA, 19 nt, Human
acccagagcccuuugcagg

SEQ ID NO: 239483 - RNA, 22 nt, Human
ggcuucccaaggagccaggaug

SEQ ID NO: 239484 - RNA, 22 nt, Human
guauuuuucauuccaagugaga

SEQ ID NO: 239485 - RNA, 22 nt, Human
ucuccagguucagucgauggaa

SEQ ID NO: 239486 - RNA, 22 nt, Human
uggacagcuugcagagccaccc

SEQ ID NO: 239487 - RNA, 22 nt, Human
uuuagcuauggauaacaaccac

SEQ ID NO: 239488 - RNA, 18 nt, Human
cucucuggucuggauccc

SEQ ID NO: 239489 - RNA, 22 nt, Human
gcuugccuaucugguggucguu

SEQ ID NO: 239490 - RNA, 22 nt, Human
gaguggcauaugugccugugaa

SEQ ID NO: 239491 - RNA, 22 nt, Human
ugguggggucaucgucagaugc

SEQ ID NO: 239492 - RNA, 22 nt, Human
gaggggcuggcacgauggcugc

SEQ ID NO: 239493 - RNA, 22 nt, Human
uccagcccuccugggaucacag

SEQ ID NO: 239494 - RNA, 22 nt, Human
cucagugguugagagccugggc

SEQ ID NO: 239495 - RNA, 22 nt, Human
ggcauccaguucugaucaacaa

SEQ ID NO: 239496 - RNA, 22 nt, Human
ucaccuaauugaagucaggagu

SEQ ID NO: 239497 - RNA, 19 nt, Human
cuguccugguuuggucccu

SEQ ID NO: 239498 - RNA, 20 nt, Human
ccuggcaggcggguuacuua

SEQ ID NO: 239499 - RNA, 22 nt, Human
cuggcagcccaaccuagagucu

SEQ ID NO: 239500 - RNA, 22 nt, Human
ucuccccuagugcauuaaagug

SEQ ID NO: 239501 - RNA, 22 nt, Human
gagguucacuuccugaaauagc

SEQ ID NO: 239502 - RNA, 22 nt, Human
aaagcuaugaggcaugcauuuc

SEQ ID NO: 239503 - RNA, 22 nt, Human
ugaauucuuaaugaaaucuacu

SEQ ID NO: 239504 - RNA, 22 nt, Human
ggaaggcugugcaguguuugca

SEQ ID NO: 239505 - RNA, 22 nt, Human
auggaaaucgaugucuaaguua

SEQ ID NO: 239506 - RNA, 22 nt, Human
gaugugucuggcuccccugcaa

SEQ ID NO: 239507 - RNA, 22 nt, Human
aggucaaaccacagcucuaggc

SEQ ID NO: 239508 - RNA, 22 nt, Human
ccuggcucucugcagauccugg

SEQ ID NO: 239509 - RNA, 22 nt, Human
aggaggcacucacucucagggu

SEQ ID NO: 239510 - RNA, 22 nt, Human
uggucucugcaggccaggcuca

SEQ ID NO: 239511 - RNA, 22 nt, Human
cugcacagcugggcaagauaua

SEQ ID NO: 239512 - RNA, 22 nt, Human
ugacagacagcuucucauuuua

SEQ ID NO: 239513 - RNA, 22 nt, Human
aagagaaagcagacuuugucau

SEQ ID NO: 239514 - RNA, 22 nt, Human
guagcuauuuaugauacucaug

SEQ ID NO: 239515 - RNA, 22 nt, Human
auuacacauagacauucguuca

SEQ ID NO: 239516 - RNA, 22 nt, Human
ccacugucugugacaucagaaa

SEQ ID NO: 239517 - RNA, 22 nt, Human
uuacugaacccuacuuuuacag

SEQ ID NO: 239518 - RNA, 22 nt, Human
ucugagggacaauuuugauggu

SEQ ID NO: 239519 - RNA, 22 nt, Human
uuuuauugucuguauugccuau

SEQ ID NO: 239520 - RNA, 22 nt, Human
caugauaauuguuaacaaagua

SEQ ID NO: 239521 - RNA, 19 nt, Human
ccucugugggagucaguga

SEQ ID NO: 239522 - RNA, 22 nt, Human
guggcauugacauguaaacagu

SEQ ID NO: 239523 - RNA, 22 nt, Human
ccucuggccacaugggacauag

SEQ ID NO: 239524 - RNA, 22 nt, Human
ggaggugaucagaguuuugagg

SEQ ID NO: 239525 - RNA, 22 nt, Human
gaaaggcucagaaguuuguauu

SEQ ID NO: 239526 - RNA, 22 nt, Human
agacacuguguacagaaaaaga

SEQ ID NO: 239527 - RNA, 22 nt, Human
auuccuucuauucucugugggu

SEQ ID NO: 239528 - RNA, 22 nt, Human
caucuguaggugacacaugagu

SEQ ID NO: 239529 - RNA, 22 nt, Human
uucuucuucaagugcugcauuc

SEQ ID NO: 239530 - RNA, 22 nt, Human
augaaauggugguuuuccauuu

SEQ ID NO: 239531 - RNA, 22 nt, Human
auaaacaguaaaugugagcagu

SEQ ID NO: 239532 - RNA, 22 nt, Human
aaguaugugugggaugcuggga

SEQ ID NO: 239533 - RNA, 22 nt, Human
auguagggaacuaaauucacug

SEQ ID NO: 239534 - RNA, 22 nt, Human
ggacuuggggaaggcacaguua

SEQ ID NO: 239535 - RNA, 22 nt, Human
uuccauauuuguguggcaaaag

SEQ ID NO: 239536 - RNA, 22 nt, Human
ugggaauguagaauguaaacca

SEQ ID NO: 239537 - RNA, 22 nt, Human
cuuuaagagaucaccaaucaca

SEQ ID NO: 239538 - RNA, 22 nt, Human
ucagagcuucaccuguuacauu

SEQ ID NO: 239539 - RNA, 22 nt, Human
aguuacaguguucuauuacucu

SEQ ID NO: 239540 - RNA, 22 nt, Human
cagucccacaagaucuccacaa

SEQ ID NO: 239541 - RNA, 22 nt, Human
gaaggccauuagagccugugcc

SEQ ID NO: 239542 - RNA, 22 nt, Human
ucuguaccucacaugcaccauc

SEQ ID NO: 239543 - RNA, 22 nt, Human
cuguuacugaaaugcaccgugc

SEQ ID NO: 239544 - RNA, 22 nt, Human
uacaguaucuucuggcaagcau

SEQ ID NO: 239545 - RNA, 22 nt, Human
cucauguagcucucaggccaca

SEQ ID NO: 239546 - RNA, 22 nt, Human
uaucuaaauggaauauuccaga

SEQ ID NO: 239547 - RNA, 22 nt, Human
guggcagagauagaacuggaau

SEQ ID NO: 239548 - RNA, 22 nt, Human
uccuggaggcacucgcuggggc

SEQ ID NO: 239549 - RNA, 22 nt, Human
ugcuggcucaguuugcagacuc

SEQ ID NO: 239550 - RNA, 20 nt, Human
uauugccuaaauaccagaau

SEQ ID NO: 239551 - RNA, 21 nt, Human
aggcagaaagagcccaggcug

SEQ ID NO: 239552 - RNA, 22 nt, Human
ccauuugugguuuauuugcucu

SEQ ID NO: 239553 - RNA, 22 nt, Human
ccaguucugacacaagcacagu

SEQ ID NO: 239554 - RNA, 22 nt, Human
uccugcagcugcagaccugggg

SEQ ID NO: 239555 - RNA, 22 nt, Human
acuuucaauuugcacuaaccua

SEQ ID NO: 239556 - RNA, 22 nt, Human
aaggcauguguccucagagaga

SEQ ID NO: 239557 - RNA, 21 nt, Human
ccaggucuugguccuuggacu

SEQ ID NO: 239558 - RNA, 22 nt, Human
uuauugaaauggaagcuauaac

SEQ ID NO: 239559 - RNA, 22 nt, Human
agcuggcuuuaugguuggcuaa

SEQ ID NO: 239560 - RNA, 22 nt, Human
ugcauuaaggccauugaaauuu

SEQ ID NO: 239561 - RNA, 22 nt, Human
aagacagugaucucugagagau

SEQ ID NO: 239562 - RNA, 20 nt, Human
cccaguguccagccuugcca

SEQ ID NO: 239563 - RNA, 22 nt, Human
ucuggggaauguucauuucuga

SEQ ID NO: 239564 - RNA, 22 nt, Human
uuugguuuuuaccugcugagag

SEQ ID NO: 239565 - RNA, 22 nt, Human
ugcugccaagcccgugcuccug

SEQ ID NO: 239566 - RNA, 22 nt, Human
aaugaacaaaauaugcuuugca

SEQ ID NO: 239567 - RNA, 22 nt, Human
aggcugaggcgggaggaucacu

SEQ ID NO: 239568 - RNA, 22 nt, Human
ccaggcuguaagagugauguug

SEQ ID NO: 239569 - RNA, 22 nt, Human
gguuucaacucagcuaguaagg

SEQ ID NO: 239570 - RNA, 22 nt, Human
uacaaggaaaaucuugaaguac

SEQ ID NO: 239571 - RNA, 22 nt, Human
ucaaaggguccuuaacaugaga

SEQ ID NO: 239572 - RNA, 22 nt, Human
uggguggauuaggauaggguau

SEQ ID NO: 239573 - RNA, 22 nt, Human
acugguuuuccagguuacuucu

SEQ ID NO: 239574 - RNA, 22 nt, Human
cgugcccugcgcaagugcugcu

SEQ ID NO: 239575 - RNA, 22 nt, Human
uguggggcucccuggcagccug

SEQ ID NO: 239576 - RNA, 22 nt, Human
aggccagcagcaugacggcauc

SEQ ID NO: 239577 - RNA, 22 nt, Human
cuggcagcaggucacacgcaga

SEQ ID NO: 239578 - RNA, 22 nt, Human
acaauguguuuuuauacauuug

SEQ ID NO: 239579 - RNA, 22 nt, Human
aagacacuaagcuuucaggaua

SEQ ID NO: 239580 - RNA, 22 nt, Human
aagcucagagguagauaauguu

SEQ ID NO: 239581 - RNA, 22 nt, Human
uccucuggcccagcugccucug

SEQ ID NO: 239582 - RNA, 22 nt, Human
uucaacauuugaaaugaaugaa

SEQ ID NO: 239583 - RNA, 22 nt, Human
ggcuuggaaaugguaaugagcu

SEQ ID NO: 239584 - RNA, 22 nt, Human
cugggccucacccuagaccaau

SEQ ID NO: 239585 - RNA, 22 nt, Human
gcagagaggaaugaagccaucc

SEQ ID NO: 239586 - RNA, 23 nt, Human
ucuaaugcaauuagaaauuaggg

SEQ ID NO: 239587 - RNA, 19 nt, Human
gcagagucaagagcugcug

SEQ ID NO: 239588 - RNA, 23 nt, Human
uggaaugagcugggaagcugagc

SEQ ID NO: 239589 - RNA, 22 nt, Human
aguuggcaaggucuggccagcg

SEQ ID NO: 239590 - RNA, 22 nt, Human
guguucucucuacaggaauuua

SEQ ID NO: 239591 - RNA, 22 nt, Human
cagcccugagagaaccaucuau

SEQ ID NO: 239592 - RNA, 22 nt, Human
aucuaaaaugugguuaguuggu

SEQ ID NO: 239593 - RNA, 22 nt, Human
cauaaaagccaccuauuuaaag

SEQ ID NO: 239594 - RNA, 22 nt, Human
uucuguuugugaacuggcugag

SEQ ID NO: 239595 - RNA, 22 nt, Human
ugcugggcucaaccuccagagc

SEQ ID NO: 239596 - RNA, 22 nt, Human
gcuggcagagagcuggugagga

SEQ ID NO: 239597 - RNA, 22 nt, Human
uaauaauuuuaaagaaggcuag

SEQ ID NO: 239598 - RNA, 22 nt, Human
caggaugccaucugcugcugcu

SEQ ID NO: 239599 - RNA, 22 nt, Human
ccaggcugcucacaagcugccc

SEQ ID NO: 239600 - RNA, 22 nt, Human
aagugaggccuaggcacugggu

SEQ ID NO: 239601 - RNA, 22 nt, Human
agucagacauaauucuaacauu

SEQ ID NO: 239602 - RNA, 22 nt, Human
aaguucaaggaagccuccaguu

SEQ ID NO: 239603 - RNA, 22 nt, Human
ggcaauuacguauuagucaugu

SEQ ID NO: 239604 - RNA, 22 nt, Human
auggcagcggagcuggaaauga

SEQ ID NO: 239605 - RNA, 22 nt, Human
augcucauuuuauugagaauga

SEQ ID NO: 239606 - RNA, 22 nt, Human
ucaggagcagggucuguuacca

SEQ ID NO: 239607 - RNA, 19 nt, Human
acagggcagcaauaggaua

SEQ ID NO: 239608 - RNA, 22 nt, Human
uauaaucugguuuuauuaagag

SEQ ID NO: 239609 - RNA, 22 nt, Human
acaggagcaacagacuaagaca

SEQ ID NO: 239610 - RNA, 22 nt, Human
acagaggacaacuaggcgcuca

SEQ ID NO: 239611 - RNA, 22 nt, Human
uagaguguuguaauugaaaagg

SEQ ID NO: 239612 - RNA, 22 nt, Human
gaccagcucucugaagaaagag

SEQ ID NO: 239613 - RNA, 22 nt, Human
ucaaggagcccacagucuaaug

SEQ ID NO: 239614 - RNA, 22 nt, Human
ugagggcuaaauuguggcaggu

SEQ ID NO: 239615 - RNA, 22 nt, Human
aaaaccacaauuacuuuugcac

SEQ ID NO: 239616 - RNA, 22 nt, Human
augaaaugaaguuggccuggcu

SEQ ID NO: 239617 - RNA, 22 nt, Human
augucuuuuauggagaugucau

SEQ ID NO: 239618 - RNA, 17 nt, Human
ggccagaggcggggcug

SEQ ID NO: 239619 - RNA, 22 nt, Human
augcauauugucauuuaguccu

SEQ ID NO: 239620 - RNA, 20 nt, Human
aagcacugugguggcaugga

SEQ ID NO: 239621 - RNA, 22 nt, Human
ggaaagaaucaagugauccugu

SEQ ID NO: 239622 - RNA, 22 nt, Human
ggucccagaauugguuagcaca

SEQ ID NO: 239623 - RNA, 22 nt, Human
caugacaaauaaaccuuugcca

SEQ ID NO: 239624 - RNA, 22 nt, Human
caggcugaggcaguaggguuug

SEQ ID NO: 239625 - RNA, 22 nt, Human
ucugggucaugacucagcguga

SEQ ID NO: 239626 - RNA, 22 nt, Human
aggcugugcgaggucucagagu

SEQ ID NO: 239627 - RNA, 22 nt, Human
uugcugggcaugucuuaauucu

SEQ ID NO: 239628 - RNA, 22 nt, Human
aucagagccuuaugcuucucau

SEQ ID NO: 239629 - RNA, 20 nt, Human
uauuugaaauggccaagugu

SEQ ID NO: 239630 - RNA, 22 nt, Human
acugaaagaaccuuccuguugc

SEQ ID NO: 239631 - RNA, 22 nt, Human
ugggccugggcuggacagccug

SEQ ID NO: 239632 - RNA, 22 nt, Human
ccucaggcuugugagccuucag

SEQ ID NO: 239633 - RNA, 22 nt, Human
cccuggccuacaggcccagaga

SEQ ID NO: 239634 - RNA, 22 nt, Human
uaacagaaacagauaaguguaa

SEQ ID NO: 239635 - RNA, 22 nt, Human
acagcagagacacucaggaggc

SEQ ID NO: 239636 - RNA, 22 nt, Human
ggaggaagggcccaggcuuuau

SEQ ID NO: 239637 - RNA, 22 nt, Human
uuuaacauguucaagaaacaua

SEQ ID NO: 239638 - RNA, 22 nt, Human
cagguagguauggugcagucuu

SEQ ID NO: 239639 - RNA, 22 nt, Human
accugggaacgcuuuguggagg

SEQ ID NO: 239640 - RNA, 22 nt, Human
uccuggccuuagcgaggcgguc

SEQ ID NO: 239641 - RNA, 22 nt, Human
ggccagccuggggcucccagac

SEQ ID NO: 239642 - RNA, 22 nt, Human
agccucagugucaccaucuacc

SEQ ID NO: 239643 - RNA, 20 nt, Human
ugguccucacaugccaucuu

SEQ ID NO: 239644 - RNA, 22 nt, Human
uuucuaguauauaacuagaucu

SEQ ID NO: 239645 - RNA, 22 nt, Human
uguacauugucacucaucaagu

SEQ ID NO: 239646 - RNA, 22 nt, Human
guacaaaugcagguuuguuaca

SEQ ID NO: 239647 - RNA, 22 nt, Human
gcugggagggaggcuauacccu

SEQ ID NO: 239648 - RNA, 22 nt, Human
cagggaugaccagagggaugug

SEQ ID NO: 239649 - RNA, 22 nt, Human
uagugucaugaaaaguacacua

SEQ ID NO: 239650 - RNA, 22 nt, Human
uugagucuucaguaaaagggua

SEQ ID NO: 239651 - RNA, 22 nt, Human
uguuuucagucauauagcaggu

SEQ ID NO: 239652 - RNA, 20 nt, Human
ccugucucacguuccgcccc

SEQ ID NO: 239653 - RNA, 22 nt, Human
ccagaaaguucagcugugaaug

SEQ ID NO: 239654 - RNA, 22 nt, Human
uccaggccuugacaggucaguu

SEQ ID NO: 239655 - RNA, 22 nt, Human
gaccucaguauuguucaggaug

SEQ ID NO: 239656 - RNA, 22 nt, Human
gcucaaugcucaaugcugcaaa

SEQ ID NO: 239657 - RNA, 22 nt, Human
cucugcccagugcccacaggag

SEQ ID NO: 239658 - RNA, 22 nt, Human
ccacagcugaaagcagaggcuc

SEQ ID NO: 239659 - RNA, 22 nt, Human
uccuugcauaucugaaaauguu

SEQ ID NO: 239660 - RNA, 19 nt, Human
uuagggacaugaauucuag

SEQ ID NO: 239661 - RNA, 22 nt, Human
gggagcugagcucugagccacg

SEQ ID NO: 239662 - RNA, 22 nt, Human
ggagccaguauuuaguggucuu

SEQ ID NO: 239663 - RNA, 22 nt, Human
aaacuucagacuccccacuucu

SEQ ID NO: 239664 - RNA, 22 nt, Human
agaaaaguuuucugagacugac

SEQ ID NO: 239665 - RNA, 22 nt, Human
uacaacaauuuccacauuagaa

SEQ ID NO: 239666 - RNA, 22 nt, Human
acuuuagaaaaggaacagagga

SEQ ID NO: 239667 - RNA, 22 nt, Human
ccugggucaccaggcccaggca

SEQ ID NO: 239668 - RNA, 22 nt, Human
ugaguucucaugaaaucuaguu

SEQ ID NO: 239669 - RNA, 19 nt, Human
gcagacagguccagagagg

SEQ ID NO: 239670 - RNA, 22 nt, Human
cucuagaaugaauuagcgcagg

SEQ ID NO: 239671 - RNA, 22 nt, Human
cucugcagaauuugagcugcuc

SEQ ID NO: 239672 - RNA, 22 nt, Human
uugcaaaucuuugccagaaggc

SEQ ID NO: 239673 - RNA, 22 nt, Human
cugagcuguuuaaucccagaua

SEQ ID NO: 239674 - RNA, 22 nt, Human
auaagaaacauuauucuuucca

SEQ ID NO: 239675 - RNA, 22 nt, Human
uuuggagauagggccuagcaau

SEQ ID NO: 239676 - RNA, 22 nt, Human
cagaacauucacucauaugugg

SEQ ID NO: 239677 - RNA, 21 nt, Human
cugcuuuacuucagaggaucu

SEQ ID NO: 239678 - RNA, 22 nt, Human
uacacaaucuguuuuuccauuu

SEQ ID NO: 239679 - RNA, 22 nt, Human
cuauuacauuucuggacauuca

SEQ ID NO: 239680 - RNA, 22 nt, Human
cagcucuuagagggagacagac

SEQ ID NO: 239681 - RNA, 20 nt, Human
ggcucaucuugucugcugac

SEQ ID NO: 239682 - RNA, 22 nt, Human
auggaguucuuuaaauucacag

SEQ ID NO: 239683 - RNA, 22 nt, Human
gcaggcuccaggccggccccuu

SEQ ID NO: 239684 - RNA, 22 nt, Human
acugcaccucagccugggcgac

SEQ ID NO: 239685 - RNA, 22 nt, Human
gcucucagaagagccaggcuac

SEQ ID NO: 239686 - RNA, 20 nt, Human
ugaagaggaagaggacggcc

SEQ ID NO: 239687 - RNA, 16 nt, Human
augcugcuauuagagg

SEQ ID NO: 239688 - RNA, 22 nt, Human
ucccucagaugagcuccuagca

SEQ ID NO: 239689 - RNA, 22 nt, Human
aguggcugcuaugaucaggaca

SEQ ID NO: 239690 - RNA, 22 nt, Human
uuauucuuggaucugagucucu

SEQ ID NO: 239691 - RNA, 22 nt, Human
aagaacauaacagaagcugugu

SEQ ID NO: 239692 - RNA, 22 nt, Human
uucagagacagcaaccaggaca

SEQ ID NO: 239693 - RNA, 22 nt, Human
cuuggaaucaaguuuuuggaga

SEQ ID NO: 239694 - RNA, 22 nt, Human
cuggguaccucaccgcugcugc

SEQ ID NO: 239695 - RNA, 22 nt, Human
augauugcagcccuacagcugu

SEQ ID NO: 239696 - RNA, 22 nt, Human
uuucuuuccauacauauugcua

SEQ ID NO: 239697 - RNA, 22 nt, Human
aggcucugggaagcagugaguu

SEQ ID NO: 239698 - RNA, 22 nt, Human
gauuauuuugugcaauaaucgg

SEQ ID NO: 239699 - RNA, 22 nt, Human
gcacagcuggacucugccuggc

SEQ ID NO: 239700 - RNA, 17 nt, Human
gcaaaggugaggagaga

SEQ ID NO: 239701 - RNA, 22 nt, Human
ucagugcagcggcagcagcucu

SEQ ID NO: 239702 - RNA, 22 nt, Human
ccagugcucauucaaguccuua

SEQ ID NO: 239703 - RNA, 22 nt, Human
aaaucaugaggacauuaugcca

SEQ ID NO: 239704 - RNA, 22 nt, Human
ucaggcagcuccaggaauggua

SEQ ID NO: 239705 - RNA, 21 nt, Human
ggagaaggacaauguugagua

SEQ ID NO: 239706 - RNA, 22 nt, Human
agggcuccuccccggccuccac

SEQ ID NO: 239707 - RNA, 22 nt, Human
acugugcaaaugacaggcacac

SEQ ID NO: 239708 - RNA, 22 nt, Human
ccucagagacaguaacuggaau

SEQ ID NO: 239709 - RNA, 22 nt, Human
cagcccugcugguuuugggcaa

SEQ ID NO: 239710 - RNA, 22 nt, Human
caggcacagcuaagacuggcca

SEQ ID NO: 239711 - RNA, 22 nt, Human
ucccugggguaucgcugaggca

SEQ ID NO: 239712 - RNA, 22 nt, Human
acacauuuuguuaaacccugug

SEQ ID NO: 239713 - RNA, 22 nt, Human
gagggaggugauacugaacgua

SEQ ID NO: 239714 - RNA, 22 nt, Human
cucuggguggucucacugagug

SEQ ID NO: 239715 - RNA, 22 nt, Human
agcagacauggcuuggaugugg

SEQ ID NO: 239716 - RNA, 23 nt, Human
uguuccagauacgccuuuuccuc

SEQ ID NO: 239717 - RNA, 22 nt, Human
ccagccagccuugaucugagua

SEQ ID NO: 239718 - RNA, 22 nt, Human
auauuuugaaguuaauaaugug

SEQ ID NO: 239719 - RNA, 22 nt, Human
agggagagaaguuauacaagau

SEQ ID NO: 239720 - RNA, 22 nt, Human
guggaaggugcuagaacaagga

SEQ ID NO: 239721 - RNA, 22 nt, Human
cugugcauugucuugucuguag

SEQ ID NO: 239722 - RNA, 22 nt, Human
ugccuggguugacucuuagcug

SEQ ID NO: 239723 - RNA, 22 nt, Human
aguuuauucugcuuggcccucc

SEQ ID NO: 239724 - RNA, 22 nt, Human
aagugguagacaaagauaauug

SEQ ID NO: 239725 - RNA, 22 nt, Human
ugcuuucugcucuggaaacagg

SEQ ID NO: 239726 - RNA, 22 nt, Human
gagacacaagaagacaugcaca

SEQ ID NO: 239727 - RNA, 22 nt, Human
aacucuauuuacccuacuaaac

SEQ ID NO: 239728 - RNA, 22 nt, Human
cugggcaguucgcuuucguuuu

SEQ ID NO: 239729 - RNA, 22 nt, Human
cuggcagguggagguugcagug

SEQ ID NO: 239730 - RNA, 21 nt, Human
aucugaaguuugagaggaaag

SEQ ID NO: 239731 - RNA, 22 nt, Human
auugacaaucuacuauguucug

SEQ ID NO: 239732 - RNA, 22 nt, Human
gcucagaggcacgaccucuugg

SEQ ID NO: 239733 - RNA, 22 nt, Human
ggcugaggguuaagaucagaca

SEQ ID NO: 239734 - RNA, 22 nt, Human
cagcacguugaaguagaguaag

SEQ ID NO: 239735 - RNA, 22 nt, Human
augacucuaagaauucuagaug

SEQ ID NO: 239736 - RNA, 22 nt, Human
cagggcagggagcuuagaauga

SEQ ID NO: 239737 - RNA, 22 nt, Human
agguccuggucuugagucuuaa

SEQ ID NO: 239738 - RNA, 22 nt, Human
gaguuacagagaggauuauggu

SEQ ID NO: 239739 - RNA, 22 nt, Human
cucagauguguuggauggaaaa

SEQ ID NO: 239740 - RNA, 22 nt, Human
aucuuuuacuacaaaucaggug

SEQ ID NO: 239741 - RNA, 22 nt, Human
gagcaagacuacaggcagauga

SEQ ID NO: 239742 - RNA, 19 nt, Human
cuggaauguggcuggugca

SEQ ID NO: 239743 - RNA, 22 nt, Human
guccagccacccuggaggcacg

SEQ ID NO: 239744 - RNA, 22 nt, Human
ccaggcaaagcccaugcaagag

SEQ ID NO: 239745 - RNA, 22 nt, Human
uacaguaaccagucuacuuaga

SEQ ID NO: 239746 - RNA, 22 nt, Human
uuuuauucaaauaguucacacu

SEQ ID NO: 239747 - RNA, 22 nt, Human
ugucagagagcaggcaguagaa

SEQ ID NO: 239748 - RNA, 22 nt, Human
ugaggauggucccgaggacacu

SEQ ID NO: 239749 - RNA, 22 nt, Human
aaaauagauucuaggaugucuu

SEQ ID NO: 239750 - RNA, 22 nt, Human
gagggagcuugauggauguuug

SEQ ID NO: 239751 - RNA, 22 nt, Human
aaguccaguuucauuugagguc

SEQ ID NO: 239752 - RNA, 22 nt, Human
cugugcaagcccaagauaaaac

SEQ ID NO: 239753 - RNA, 22 nt, Human
uccugagcaacacagcuaagug

SEQ ID NO: 239754 - RNA, 22 nt, Human
auauucacuggguacuaaaaag

SEQ ID NO: 239755 - RNA, 22 nt, Human
ugcaggccuaugguggggcccc

SEQ ID NO: 239756 - RNA, 22 nt, Human
uacuuucuuguuccuuucauaa

SEQ ID NO: 239757 - RNA, 19 nt, Human
uccagaacugcccuggccu

SEQ ID NO: 239758 - RNA, 22 nt, Human
cacauuccugagcuucgaccug

SEQ ID NO: 239759 - RNA, 17 nt, Human
aagaacacucaauagca

SEQ ID NO: 239760 - RNA, 22 nt, Human
uguggcuggauugauuuuaccu

SEQ ID NO: 239761 - RNA, 22 nt, Human
acuucagaguuaguuauagacc

SEQ ID NO: 239762 - RNA, 22 nt, Human
agaguuuguauuuuucagugaa

SEQ ID NO: 239763 - RNA, 22 nt, Human
acacaagaauaaugaugaaggu

SEQ ID NO: 239764 - RNA, 22 nt, Human
aauaguuaagcaacuuuuucca

SEQ ID NO: 239765 - RNA, 22 nt, Human
uccugaggagaagagugcuagg

SEQ ID NO: 239766 - RNA, 22 nt, Human
uuaacauccuguuuaaauuugg

SEQ ID NO: 239767 - RNA, 22 nt, Human
gcaggagaaaugaagauugggu

SEQ ID NO: 239768 - RNA, 22 nt, Human
ggcugccugaacuuuggggaaa

SEQ ID NO: 239769 - RNA, 23 nt, Human
acaaaugcccauacaucuaguuc

SEQ ID NO: 239770 - RNA, 22 nt, Human
gguguccugucagcuagaguga

SEQ ID NO: 239771 - RNA, 22 nt, Human
uuagccuuagaagcuuagcaaa

SEQ ID NO: 239772 - RNA, 22 nt, Human
ggcacagaguuggcagagcugc

SEQ ID NO: 239773 - RNA, 22 nt, Human
cuaauagagcuucggaacucug

SEQ ID NO: 239774 - RNA, 22 nt, Human
uuugcauuuguucaaguauuga

SEQ ID NO: 239775 - RNA, 22 nt, Human
ccugcaccugccaugugagaua

SEQ ID NO: 239776 - RNA, 22 nt, Human
gagucuaaguagaaugugaaaa

SEQ ID NO: 239777 - RNA, 22 nt, Human
aaaagcucuuucugcuguagau

SEQ ID NO: 239778 - RNA, 22 nt, Human
ugaggcuuagagaauuaaguga

SEQ ID NO: 239779 - RNA, 22 nt, Human
gcucugggaaggaucguaguga

SEQ ID NO: 239780 - RNA, 22 nt, Human
uuuaaaaggcagcuucuuuugu

SEQ ID NO: 239781 - RNA, 22 nt, Human
ggcaggcuguucaccugcuuuu

SEQ ID NO: 239782 - RNA, 22 nt, Human
cuguggcugcgcccugggggag

SEQ ID NO: 239783 - RNA, 22 nt, Human
ugacuuccugcacucaggugau

SEQ ID NO: 239784 - RNA, 23 nt, Human
acagagaucuugacuuguaugga

SEQ ID NO: 239785 - RNA, 22 nt, Human
uuuacagagaauguacauaaag

SEQ ID NO: 239786 - RNA, 22 nt, Human
gucccucaguagugcacagugg

SEQ ID NO: 239787 - RNA, 22 nt, Human
accaggcuugauaccaagaaau

SEQ ID NO: 239788 - RNA, 22 nt, Human
ccagguguuacacgaguguuaa

SEQ ID NO: 239789 - RNA, 22 nt, Human
uguugcugacaagagaggagca

SEQ ID NO: 239790 - RNA, 22 nt, Human
uguaaaaccaaaucaaucuagu

SEQ ID NO: 239791 - RNA, 22 nt, Human
agauacaaaggccuacagagca

SEQ ID NO: 239792 - RNA, 22 nt, Human
auucuguuacuuggugaucuuc

SEQ ID NO: 239793 - RNA, 21 nt, Human
gcaggcuggucaaaccucagu

SEQ ID NO: 239794 - RNA, 22 nt, Human
agacccagaaagcagcugcauu

SEQ ID NO: 239795 - RNA, 23 nt, Human
aggaaugugcccacccaucuccu

SEQ ID NO: 239796 - RNA, 23 nt, Human
acagcuugccaauuagccuuccg

SEQ ID NO: 239797 - RNA, 22 nt, Human
uuccagcuaacucacaucccuu

SEQ ID NO: 239798 - RNA, 22 nt, Human
gucuccagggacacacuagccg

SEQ ID NO: 239799 - RNA, 22 nt, Human
uccaggucccagacugggcagc

SEQ ID NO: 239800 - RNA, 22 nt, Human
uauguacauaacaugaaaugca

SEQ ID NO: 239801 - RNA, 22 nt, Human
gauccugugcauggggugaugg

SEQ ID NO: 239802 - RNA, 22 nt, Human
aaagaacagauguguggugcau

SEQ ID NO: 239803 - RNA, 22 nt, Human
uucuuuccucccagccuuugga

SEQ ID NO: 239804 - RNA, 22 nt, Human
gcucagggaaugagaagauguu

SEQ ID NO: 239805 - RNA, 22 nt, Human
cauuucuagagucccaagaggu

SEQ ID NO: 239806 - RNA, 22 nt, Human
ccaggccuuccaguacgcagaa

SEQ ID NO: 239807 - RNA, 22 nt, Human
uaauuacaaagcaagcacaggg

SEQ ID NO: 239808 - RNA, 22 nt, Human
aguuucacacaacauuugcaug

SEQ ID NO: 239809 - RNA, 22 nt, Human
ugaugagguggauucaaagcag

SEQ ID NO: 239810 - RNA, 22 nt, Human
uucugggcucacagagcagcag

SEQ ID NO: 239811 - RNA, 22 nt, Human
gcagcaguacucaauauccugg

SEQ ID NO: 239812 - RNA, 22 nt, Human
cuuauugaaagccccugugccu

SEQ ID NO: 239813 - RNA, 17 nt, Human
cagcuuuaugcuacugu

SEQ ID NO: 239814 - RNA, 22 nt, Human
gaaguuuagaguguuguaauuu

SEQ ID NO: 239815 - RNA, 19 nt, Human
ugaggagcagcugguugau

SEQ ID NO: 239816 - RNA, 22 nt, Human
ucugaagaauaggauguugugu

SEQ ID NO: 239817 - RNA, 22 nt, Human
ucccaaguacuaccaaucuaau

SEQ ID NO: 239818 - RNA, 22 nt, Human
ugcagggucccgaagggaagac

SEQ ID NO: 239819 - RNA, 19 nt, Human
ugggaugaugcagaaggua

SEQ ID NO: 239820 - RNA, 22 nt, Human
aaguaacaaugcuguugaauug

SEQ ID NO: 239821 - RNA, 22 nt, Human
uaacuguaccuagauaacgaac

SEQ ID NO: 239822 - RNA, 22 nt, Human
ggccuccaggccuacucagggc

SEQ ID NO: 239823 - RNA, 21 nt, Human
gugaauuaauuauaugccuua

SEQ ID NO: 239824 - RNA, 22 nt, Human
gggcuucuagaauuucugauau

SEQ ID NO: 239825 - RNA, 22 nt, Human
aacugaggaauaacugaguugc

SEQ ID NO: 239826 - RNA, 22 nt, Human
uucaccccaaauucccagugga

SEQ ID NO: 239827 - RNA, 22 nt, Human
ucagagcugcccaugcaagggg

SEQ ID NO: 239828 - RNA, 22 nt, Human
acuguccuuuuaaugcagccgu

SEQ ID NO: 239829 - RNA, 22 nt, Human
gccagcucaguuucaaaguagg

SEQ ID NO: 239830 - RNA, 22 nt, Human
acacauaugguugcugcaguga

SEQ ID NO: 239831 - RNA, 22 nt, Human
ugggucuccugugccugggagg

SEQ ID NO: 239832 - RNA, 22 nt, Human
uuuacagcagcaugauuuauaa

SEQ ID NO: 239833 - RNA, 22 nt, Human
ucacagccuggacaguugccug

SEQ ID NO: 239834 - RNA, 22 nt, Human
aaagugcauagaguagugccua

SEQ ID NO: 239835 - RNA, 22 nt, Human
ugcacuguaugguaucuggaca

SEQ ID NO: 239836 - RNA, 22 nt, Human
ugggccucaccuucuuggcagc

SEQ ID NO: 239837 - RNA, 21 nt, Human
agagagggagaugaaacaucc

SEQ ID NO: 239838 - RNA, 22 nt, Human
ccugcagguccccggaugcgca

SEQ ID NO: 239839 - RNA, 19 nt, Human
ggcuccuggggcucagccc

SEQ ID NO: 239840 - RNA, 22 nt, Human
augcaugugcauggcucuaucu

SEQ ID NO: 239841 - RNA, 22 nt, Human
ggaacacagugccuuacaaacu

SEQ ID NO: 239842 - RNA, 17 nt, Human
agcagcuggguugaucu

SEQ ID NO: 239843 - RNA, 22 nt, Human
uguguacaggccuugcuagacu

SEQ ID NO: 239844 - RNA, 22 nt, Human
agggcauuggcacagaucugcu

SEQ ID NO: 239845 - RNA, 22 nt, Human
acauauauuacuaguaaagaca

SEQ ID NO: 239846 - RNA, 22 nt, Human
auuucauauguaucaccuagcc

SEQ ID NO: 239847 - RNA, 17 nt, Human
uacaggagagcaggaac

SEQ ID NO: 239848 - RNA, 22 nt, Human
gccaggcugcuccagggaggcc

SEQ ID NO: 239849 - RNA, 22 nt, Human
agccaugggcucccaguccuuu

SEQ ID NO: 239850 - RNA, 22 nt, Human
cagcugccuguauuguccucau

SEQ ID NO: 239851 - RNA, 22 nt, Human
acuuccagccccugucagcaaa

SEQ ID NO: 239852 - RNA, 22 nt, Human
ugguacaacuguauuaggcaaa

SEQ ID NO: 239853 - RNA, 22 nt, Human
ucagggcugacugcuacucucc

SEQ ID NO: 239854 - RNA, 22 nt, Human
ggagggagcauccccuugcuga

SEQ ID NO: 239855 - RNA, 22 nt, Human
ggcaagauccaaggggcuagga

SEQ ID NO: 239856 - RNA, 22 nt, Human
uguaucagaucaaauacuggcu

SEQ ID NO: 239857 - RNA, 22 nt, Human
aaaggcuugagcauuuguugaa

SEQ ID NO: 239858 - RNA, 22 nt, Human
auguuacauaguccuuauuugu

SEQ ID NO: 239859 - RNA, 22 nt, Human
uaagccugcaugaaccaugaga

SEQ ID NO: 239860 - RNA, 19 nt, Human
auuucaagagguuuauugg

SEQ ID NO: 239861 - RNA, 22 nt, Human
gaagugaagagauuagaaauca

SEQ ID NO: 239862 - RNA, 22 nt, Human
cagacaaccaggucuuucaguu

SEQ ID NO: 239863 - RNA, 22 nt, Human
agagauggccuuaggugggaau

SEQ ID NO: 239864 - RNA, 22 nt, Human
uacacaucccagacucccagga

SEQ ID NO: 239865 - RNA, 22 nt, Human
uggaaacuauagucacaauaga

SEQ ID NO: 239866 - RNA, 22 nt, Human
gugagcuguuuuggacccaucu

SEQ ID NO: 239867 - RNA, 22 nt, Human
acauuuugcccuuauuugcuga

SEQ ID NO: 239868 - RNA, 22 nt, Human
ucuugaagucuuaugguuuaaa

SEQ ID NO: 239869 - RNA, 22 nt, Human
guauaucucuuacauacacaca

SEQ ID NO: 239870 - RNA, 22 nt, Human
ggaauguucuggucugguucau

SEQ ID NO: 239871 - RNA, 17 nt, Human
uuucuccuuccaucuca

SEQ ID NO: 239872 - RNA, 22 nt, Human
agcuguguagggaaucagagaa

SEQ ID NO: 239873 - RNA, 22 nt, Human
ucaauguucaaguaugacaaug

SEQ ID NO: 239874 - RNA, 22 nt, Human
aucuggcuuacgaagcacuggu

SEQ ID NO: 239875 - RNA, 22 nt, Human
uggcaaagaugaagcauuucgu

SEQ ID NO: 239876 - RNA, 22 nt, Human
uuuuacaaaugaggagcuggag

SEQ ID NO: 239877 - RNA, 22 nt, Human
aaagagcauggaaaguucagga

SEQ ID NO: 239878 - RNA, 22 nt, Human
aucagcaaucaaauugcagagu

SEQ ID NO: 239879 - RNA, 22 nt, Human
acagcucugguccuuuagagag

SEQ ID NO: 239880 - RNA, 23 nt, Human
ugagggacaugguggcuucugag

SEQ ID NO: 239881 - RNA, 22 nt, Human
cuggccuuguuccuccccaagu

SEQ ID NO: 239882 - RNA, 22 nt, Human
uagaguaacacaaacgaauugg

SEQ ID NO: 239883 - RNA, 22 nt, Human
uacauucccccaauuaccaaug

SEQ ID NO: 239884 - RNA, 22 nt, Human
ucuggcaggauaucgaagugaa

SEQ ID NO: 239885 - RNA, 22 nt, Human
uugcagggucccagaggccugg

SEQ ID NO: 239886 - RNA, 22 nt, Human
cuggggcccaucgagggcugag

SEQ ID NO: 239887 - RNA, 22 nt, Human
cagugucuccagaugcuccaau

SEQ ID NO: 239888 - RNA, 20 nt, Human
acaguuuauccaguuagcag

SEQ ID NO: 239889 - RNA, 22 nt, Human
aggcuggcuggcaggggacaca

SEQ ID NO: 239890 - RNA, 22 nt, Human
cccaggcucagacuggcuuguu

SEQ ID NO: 239891 - RNA, 22 nt, Human
ucuucagaggaagucagucuuu

SEQ ID NO: 239892 - RNA, 22 nt, Human
ccugccugaaggucagccaccc

SEQ ID NO: 239893 - RNA, 22 nt, Human
ugugugcauguuaaugagaaaa

SEQ ID NO: 239894 - RNA, 16 nt, Human
acccucagaaacugcu

SEQ ID NO: 239895 - RNA, 22 nt, Human
uggcagugugggaggaagguac

SEQ ID NO: 239896 - RNA, 22 nt, Human
aagaagaaguguuauuuuuaga

SEQ ID NO: 239897 - RNA, 22 nt, Human
ucugcaacauuccucuccccac

SEQ ID NO: 239898 - RNA, 22 nt, Human
cauaaacucuugagauucuugu

SEQ ID NO: 239899 - RNA, 22 nt, Human
uuccuacauuuguacaauaaga

SEQ ID NO: 239900 - RNA, 22 nt, Human
caguuaaagugcuuaucacaga

SEQ ID NO: 239901 - RNA, 22 nt, Human
aggcugugggaauggcugcuug

SEQ ID NO: 239902 - RNA, 22 nt, Human
agcccugccauucucuggagcu

SEQ ID NO: 239903 - RNA, 22 nt, Human
cuuccaggguccaggaagagcc

SEQ ID NO: 239904 - RNA, 22 nt, Human
ugagcugguucuugaggcauga

SEQ ID NO: 239905 - RNA, 21 nt, Human
ucccucagacagggugccuau

SEQ ID NO: 239906 - RNA, 22 nt, Human
uaggauuuggcuuuagucaggu

SEQ ID NO: 239907 - RNA, 22 nt, Human
aauacagcagauggagacaaau

SEQ ID NO: 239908 - RNA, 22 nt, Human
ucuggcaccacugagucugcag

SEQ ID NO: 239909 - RNA, 21 nt, Human
gggaucuuguacuggcgugga

SEQ ID NO: 239910 - RNA, 22 nt, Human
ucacacauuucucaaguguagg

SEQ ID NO: 239911 - RNA, 22 nt, Human
ugcagcucauugguguccuggu

SEQ ID NO: 239912 - RNA, 22 nt, Human
aaagcacaugaguaguguagua

SEQ ID NO: 239913 - RNA, 22 nt, Human
aaaaaucacuuuuauaggcagc

SEQ ID NO: 239914 - RNA, 22 nt, Human
gucagggcacagugacagcucc

SEQ ID NO: 239915 - RNA, 22 nt, Human
ggugccagugggucucaggaua

SEQ ID NO: 239916 - RNA, 22 nt, Human
gaaagauauuuauuggcaacag

SEQ ID NO: 239917 - RNA, 22 nt, Human
ucugggcucuuaguguacccuc

SEQ ID NO: 239918 - RNA, 22 nt, Human
ucagggcauguauguuucuuua

SEQ ID NO: 239919 - RNA, 22 nt, Human
agcuggccuccgggugccuggg

SEQ ID NO: 239920 - RNA, 20 nt, Human
gucuacacgggcaguguaga

SEQ ID NO: 239921 - RNA, 23 nt, Human
augcaggacuuauaagguaaggu

SEQ ID NO: 239922 - RNA, 22 nt, Human
ugauuacacuauuugggaauag

SEQ ID NO: 239923 - RNA, 22 nt, Human
cuuguagcugcuucuucugaag

SEQ ID NO: 239924 - RNA, 22 nt, Human
ggucagaauuaggucuagagua

SEQ ID NO: 239925 - RNA, 22 nt, Human
auuagcagcuuucuggucucua

SEQ ID NO: 239926 - RNA, 22 nt, Human
ugagugggaugaguuagaggug

SEQ ID NO: 239927 - RNA, 22 nt, Human
cucagcucaaaauucaccuuug

SEQ ID NO: 239928 - RNA, 23 nt, Human
agcuggaaauggccgagcucugc

SEQ ID NO: 239929 - RNA, 22 nt, Human
caaauaauuacuauccucacuu

SEQ ID NO: 239930 - RNA, 22 nt, Human
uggcucagagccuugagagcug

SEQ ID NO: 239931 - RNA, 21 nt, Human
uguguaauauguauaagaaua

SEQ ID NO: 239932 - RNA, 22 nt, Human
gcuggcagucccaucagcuggg

SEQ ID NO: 239933 - RNA, 22 nt, Human
auauacagggagaaacagcuua

SEQ ID NO: 239934 - RNA, 19 nt, Human
ucccugaguuccagcccag

SEQ ID NO: 239935 - RNA, 22 nt, Human
auacaaguugugauaauguaaa

SEQ ID NO: 239936 - RNA, 22 nt, Human
ugguggcaauucaaagacagca

SEQ ID NO: 239937 - RNA, 22 nt, Human
cagucucuaaaucaaucugaau

SEQ ID NO: 239938 - RNA, 22 nt, Human
acaaaauuguguuaaacuuuau

SEQ ID NO: 239939 - RNA, 22 nt, Human
cccaggaggaggaaaaagcucg

SEQ ID NO: 239940 - RNA, 22 nt, Human
ucaggcuugggaggcccagggc

SEQ ID NO: 239941 - RNA, 22 nt, Human
caggcccagugaucagggcucu

SEQ ID NO: 239942 - RNA, 22 nt, Human
auggcccacucuggucccggca

SEQ ID NO: 239943 - RNA, 22 nt, Human
cauauccagguuucuuugguuu

SEQ ID NO: 239944 - RNA, 22 nt, Human
cagagacaccccagaaaauaag

SEQ ID NO: 239945 - RNA, 22 nt, Human
ucuguuuuugaggcuaucuucu

SEQ ID NO: 239946 - RNA, 22 nt, Human
gauuguaaaacagaucauuauc

SEQ ID NO: 239947 - RNA, 22 nt, Human
gaucuagaaggcaaauauagug

SEQ ID NO: 239948 - RNA, 22 nt, Human
aaaaguauuuauggcuauguaa

SEQ ID NO: 239949 - RNA, 22 nt, Human
uucaguauuucaugacuuucuu

SEQ ID NO: 239950 - RNA, 22 nt, Human
aggcugaggagggauguugcuu

SEQ ID NO: 239951 - RNA, 22 nt, Human
uccucagaagaaccccuagauu

SEQ ID NO: 239952 - RNA, 22 nt, Human
uucuccaggccgcgcagggggc

SEQ ID NO: 239953 - RNA, 23 nt, Human
agaggcaggaguggcuugcccgg

SEQ ID NO: 239954 - RNA, 23 nt, Human
ugcagcucaaagauggguaaaug

SEQ ID NO: 239955 - RNA, 22 nt, Human
gaggggcucuuuaauaguaaca

SEQ ID NO: 239956 - RNA, 22 nt, Human
auuguggugucaguuauaggca

SEQ ID NO: 239957 - RNA, 22 nt, Human
agaggccggccgagcccauggg

SEQ ID NO: 239958 - RNA, 22 nt, Human
caggucuguauuaacagagggu

SEQ ID NO: 239959 - RNA, 22 nt, Human
cugggugucaggagacaugaug

SEQ ID NO: 239960 - RNA, 22 nt, Human
gagcucuugcuucuaguccagg

SEQ ID NO: 239961 - RNA, 22 nt, Human
gcugggaguuugauuugacugg

SEQ ID NO: 239962 - RNA, 22 nt, Human
ucuuagaaguuuauggcacgga

SEQ ID NO: 239963 - RNA, 22 nt, Human
aaauuagaccaguucaggucca

SEQ ID NO: 239964 - RNA, 18 nt, Human
cuaucccuggagcuuggg

SEQ ID NO: 239965 - RNA, 22 nt, Human
ccaggcuagagagcaguggcac

SEQ ID NO: 239966 - RNA, 22 nt, Human
gcaccagcugccuucugugccc

SEQ ID NO: 239967 - RNA, 22 nt, Human
aggcaggaaaaucgcuugaacc

SEQ ID NO: 239968 - RNA, 22 nt, Human
aaggaacuagcaugauguguag

SEQ ID NO: 239969 - RNA, 22 nt, Human
ucaagcaaauguccuuuuguuc

SEQ ID NO: 239970 - RNA, 22 nt, Human
uugaaaguccuucuugaguuac

SEQ ID NO: 239971 - RNA, 22 nt, Human
aaauuccauuaggaaacuucca

SEQ ID NO: 239972 - RNA, 23 nt, Human
gcagugcuuggcacagcuggguc

SEQ ID NO: 239973 - RNA, 22 nt, Human
aggccacggcggguggauuacu

SEQ ID NO: 239974 - RNA, 22 nt, Human
gcagagcucaugccugcaccuc

SEQ ID NO: 239975 - RNA, 22 nt, Human
aacaagucauuccauuugacag

SEQ ID NO: 239976 - RNA, 18 nt, Human
aguaguggguuuagcuuc

SEQ ID NO: 239977 - RNA, 22 nt, Human
uagggaugaaguugcuauuuac

SEQ ID NO: 239978 - RNA, 22 nt, Human
aguuugaaauguuggcaauauu

SEQ ID NO: 239979 - RNA, 22 nt, Human
ucagguguggucaccacagggu

SEQ ID NO: 239980 - RNA, 22 nt, Human
uuacaauaguuccuucuuuugu

SEQ ID NO: 239981 - RNA, 23 nt, Human
uuggcaaagccuaugaaguccuc

SEQ ID NO: 239982 - RNA, 22 nt, Human
ucauuauccuaguaucuugaau

SEQ ID NO: 239983 - RNA, 22 nt, Human
ucucuggguaaaguucucucau

SEQ ID NO: 239984 - RNA, 22 nt, Human
uuauuacaaugcagaaaauaga

SEQ ID NO: 239985 - RNA, 22 nt, Human
aagaugaagaacaugagcacac

SEQ ID NO: 239986 - RNA, 22 nt, Human
aggagccaugagcaggaggcaa

SEQ ID NO: 239987 - RNA, 22 nt, Human
aaggcagucaguuguuuugaaa

SEQ ID NO: 239988 - RNA, 22 nt, Human
cauuuguuaaccaguguggauu

SEQ ID NO: 239989 - RNA, 22 nt, Human
uauggcaguuacccuugaugau

SEQ ID NO: 239990 - RNA, 22 nt, Human
uggcccgaccucugcucaugca

SEQ ID NO: 239991 - RNA, 21 nt, Human
ggcagccugacccccagagag

SEQ ID NO: 239992 - RNA, 22 nt, Human
gaaagugcaugugcccaccauu

SEQ ID NO: 239993 - RNA, 22 nt, Human
cugugggagggaaggcgcggcc

SEQ ID NO: 239994 - RNA, 22 nt, Human
ugagacaguaauuguauaguuu

SEQ ID NO: 239995 - RNA, 22 nt, Human
ugagucuguauguccagauuua

SEQ ID NO: 239996 - RNA, 20 nt, Human
uucuaauuugauggaguagc

SEQ ID NO: 239997 - RNA, 20 nt, Human
ucucccaggcucagggaaga

SEQ ID NO: 239998 - RNA, 19 nt, Human
ccuggcugugaagccugca

SEQ ID NO: 239999 - RNA, 22 nt, Human
auggcccuggaaagagcuugag

SEQ ID NO: 240000 - RNA, 22 nt, Human
cagaagaaaguggggagacaag

SEQ ID NO: 240001 - RNA, 22 nt, Human
ugcuauuuuagacauacuuugu

SEQ ID NO: 240002 - RNA, 22 nt, Human
caaagcagaccuuuacccuuua

SEQ ID NO: 240003 - RNA, 22 nt, Human
ucaagucacuggcagggaugcu

SEQ ID NO: 240004 - RNA, 22 nt, Human
uucacaauuucccuucaucagg

SEQ ID NO: 240005 - RNA, 22 nt, Human
aguaaacacuaaaaugacugcg

SEQ ID NO: 240006 - RNA, 18 nt, Human
uccaaaaucauguauuuu

SEQ ID NO: 240007 - RNA, 22 nt, Human
ugagugcuaagaauaaucugca

SEQ ID NO: 240008 - RNA, 22 nt, Human
acuacauuaugaggaaagagug

SEQ ID NO: 240009 - RNA, 22 nt, Human
cagcuggggagagacauggcag

SEQ ID NO: 240010 - RNA, 22 nt, Human
ucuuggauuuuaauggaucaaa

SEQ ID NO: 240011 - RNA, 22 nt, Human
uucugcuuucaguucuucuggg

SEQ ID NO: 240012 - RNA, 22 nt, Human
cacugucuugauuacuaugggu

SEQ ID NO: 240013 - RNA, 22 nt, Human
gccuggcugcugguucugagga

SEQ ID NO: 240014 - RNA, 22 nt, Human
cugcacaguuugauuucuugcu

SEQ ID NO: 240015 - RNA, 22 nt, Human
ggauuuacuaucuugaaauaua

SEQ ID NO: 240016 - RNA, 22 nt, Human
cugcccugcuucugagggaagc

SEQ ID NO: 240017 - RNA, 22 nt, Human
gauggaagaaaaaugcaugucu

SEQ ID NO: 240018 - RNA, 22 nt, Human
gcagcuuuaaucugaauaagua

SEQ ID NO: 240019 - RNA, 22 nt, Human
aaguucaagucugcaucuuuuu

SEQ ID NO: 240020 - RNA, 22 nt, Human
ggagcagagcucuucaucugca

SEQ ID NO: 240021 - RNA, 20 nt, Human
uugggccugucagcacuccc

SEQ ID NO: 240022 - RNA, 22 nt, Human
aaaguguagagacuuuggaacc

SEQ ID NO: 240023 - RNA, 22 nt, Human
ccugcuggcggggacccaguga

SEQ ID NO: 240024 - RNA, 22 nt, Human
acuucccaacacuuuugagaug

SEQ ID NO: 240025 - RNA, 22 nt, Human
cuucccugauaagagccucaga

SEQ ID NO: 240026 - RNA, 22 nt, Human
aggcacagagaaugcccuccau

SEQ ID NO: 240027 - RNA, 22 nt, Human
uauaucuaaguguauguaagag

SEQ ID NO: 240028 - RNA, 19 nt, Human
gggcuuggggcugaagccu

SEQ ID NO: 240029 - RNA, 22 nt, Human
caaauaguuuuucauguauuau

SEQ ID NO: 240030 - RNA, 22 nt, Human
ucuuggagauagggucuuaaug

SEQ ID NO: 240031 - RNA, 22 nt, Human
cuuauucagauacagacucuug

SEQ ID NO: 240032 - RNA, 22 nt, Human
guacaaauuuugacaucuagga

SEQ ID NO: 240033 - RNA, 22 nt, Human
cagagguguacagagggaggcc

SEQ ID NO: 240034 - RNA, 22 nt, Human
uucaguguuuguagagauaacu

SEQ ID NO: 240035 - RNA, 22 nt, Human
gaauuacauaauaaaaugagag

SEQ ID NO: 240036 - RNA, 22 nt, Human
caggaguguugauugcucagga

SEQ ID NO: 240037 - RNA, 22 nt, Human
uagacauuucugguuauugaca

SEQ ID NO: 240038 - RNA, 22 nt, Human
agaaggcuagagacuugcccaa

SEQ ID NO: 240039 - RNA, 22 nt, Human
uagugucaaacagggauuagaa

SEQ ID NO: 240040 - RNA, 19 nt, Human
uaccauguugacuuuccug

SEQ ID NO: 240041 - RNA, 22 nt, Human
cucccucccuacgugagcucac

SEQ ID NO: 240042 - RNA, 22 nt, Human
aggcagguuacaaaaacuuuau

SEQ ID NO: 240043 - RNA, 22 nt, Human
ucucuacauaaccucaauacuc

SEQ ID NO: 240044 - RNA, 22 nt, Human
uuauuuaggaggaaacugaggu

SEQ ID NO: 240045 - RNA, 23 nt, Human
aaacuugcuauggcugaaaucau

SEQ ID NO: 240046 - RNA, 22 nt, Human
gcgcaagccacacagccugggg

SEQ ID NO: 240047 - RNA, 22 nt, Human
uugugaauggugccgcaauaaa

SEQ ID NO: 240048 - RNA, 22 nt, Human
acacccaggcuggcgugcagug

SEQ ID NO: 240049 - RNA, 22 nt, Human
auggccagcaaguucagaauuu

SEQ ID NO: 240050 - RNA, 22 nt, Human
aaucacaauuacuuuugcacca

SEQ ID NO: 240051 - RNA, 22 nt, Human
gcuggcuggaggugaggaagaa

SEQ ID NO: 240052 - RNA, 22 nt, Human
aagcaugucccuugugauucaa

SEQ ID NO: 240053 - RNA, 22 nt, Human
uaugcaauucucuuaauauucu

SEQ ID NO: 240054 - RNA, 22 nt, Human
uggggcuguccuuagucugaga

SEQ ID NO: 240055 - RNA, 22 nt, Human
gaggucuggaccaagucgcccc

SEQ ID NO: 240056 - RNA, 22 nt, Human
gauuacaaaacucaucuaugac

SEQ ID NO: 240057 - RNA, 22 nt, Human
ggcaguggguuccccaaggcac

SEQ ID NO: 240058 - RNA, 22 nt, Human
uagcuguuugaaguauuuuucu

SEQ ID NO: 240059 - RNA, 21 nt, Human
uguggcugacacccuuuggga

SEQ ID NO: 240060 - RNA, 22 nt, Human
ugugguuuugguucagaaacaa

SEQ ID NO: 240061 - RNA, 22 nt, Human
uagagaugaauucugcagucuu

SEQ ID NO: 240062 - RNA, 22 nt, Human
ccacugagguuuugugguuaug

SEQ ID NO: 240063 - RNA, 22 nt, Human
gcagcagggugccagcuuugca

SEQ ID NO: 240064 - RNA, 22 nt, Human
aagggacccuggaucaaaugga

SEQ ID NO: 240065 - RNA, 22 nt, Human
gcauacaaagguuuacaacuga

SEQ ID NO: 240066 - RNA, 22 nt, Human
aggccuccuggcuccaggccuu

SEQ ID NO: 240067 - RNA, 22 nt, Human
uagaggcauaagagggaagcag

SEQ ID NO: 240068 - RNA, 22 nt, Human
cuguccuccagacgacaguccc

SEQ ID NO: 240069 - RNA, 22 nt, Human
uccugcagagccgcccucaggu

SEQ ID NO: 240070 - RNA, 22 nt, Human
ugaaaugaaacagaacauauca

SEQ ID NO: 240071 - RNA, 22 nt, Human
agcaucagagagaaguuaacua

SEQ ID NO: 240072 - RNA, 22 nt, Human
auggcuucugucuuggaaauuu

SEQ ID NO: 240073 - RNA, 23 nt, Human
cgcccagccucagugaccugggc

SEQ ID NO: 240074 - RNA, 22 nt, Human
uucugaauggcaagcauuaggc

SEQ ID NO: 240075 - RNA, 22 nt, Human
agacaggaugcauacucuuggu

SEQ ID NO: 240076 - RNA, 22 nt, Human
acuaacauuuguguaugucuug

SEQ ID NO: 240077 - RNA, 22 nt, Human
aaauccuaccaagaaauucccu

SEQ ID NO: 240078 - RNA, 22 nt, Human
aggaaaugggaauagaugguau

SEQ ID NO: 240079 - RNA, 22 nt, Human
cagagccugcucacgucucugu

SEQ ID NO: 240080 - RNA, 22 nt, Human
ugccagccagggaagcucaccc

SEQ ID NO: 240081 - RNA, 22 nt, Human
aguugacauccauaacaggaag

SEQ ID NO: 240082 - RNA, 22 nt, Human
acauuucugcauguaggguaau

SEQ ID NO: 240083 - RNA, 22 nt, Human
caguaaguauucgagucuccau

SEQ ID NO: 240084 - RNA, 22 nt, Human
aaagccuuuucuguuuaacaca

SEQ ID NO: 240085 - RNA, 22 nt, Human
ucagaaguccaauaccauggga

SEQ ID NO: 240086 - RNA, 22 nt, Human
auccaauuacguuuuuugucau

SEQ ID NO: 240087 - RNA, 22 nt, Human
ccaccucucaggguuuccuaau

SEQ ID NO: 240088 - RNA, 22 nt, Human
cagaaacauguauaaaguugua

SEQ ID NO: 240089 - RNA, 22 nt, Human
ucuggguggcugccaaucugcc

SEQ ID NO: 240090 - RNA, 22 nt, Human
uugauucaucuucuaauaccca

SEQ ID NO: 240091 - RNA, 22 nt, Human
acaagaauguagauuaguuaag

SEQ ID NO: 240092 - RNA, 22 nt, Human
aacaggcuaaguauuugguagc

SEQ ID NO: 240093 - RNA, 22 nt, Human
gagguacagaguguuccaaugu

SEQ ID NO: 240094 - RNA, 23 nt, Human
aaguucuuagguugauacuaaug

SEQ ID NO: 240095 - RNA, 20 nt, Human
aaaggaauauaugaaguaua

SEQ ID NO: 240096 - RNA, 22 nt, Human
accugagaccuaaucugacugu

SEQ ID NO: 240097 - RNA, 22 nt, Human
gccuggagccucagcaaggagg

SEQ ID NO: 240098 - RNA, 22 nt, Human
acugucacuccaacugagucgu

SEQ ID NO: 240099 - RNA, 22 nt, Human
uuuaguguuugcguguacuccu

SEQ ID NO: 240100 - RNA, 22 nt, Human
gaaauaauuuagaagguauucc

SEQ ID NO: 240101 - RNA, 22 nt, Human
cacugucugagcuggugauuag

SEQ ID NO: 240102 - RNA, 22 nt, Human
cagcucugccacuuccuagcua

SEQ ID NO: 240103 - RNA, 17 nt, Human
aggcugcugggccaggg

SEQ ID NO: 240104 - RNA, 22 nt, Human
aauucucaggaauuucaucugu

SEQ ID NO: 240105 - RNA, 22 nt, Human
uaucauuuguuauuauuagugg

SEQ ID NO: 240106 - RNA, 22 nt, Human
acccaggcuggaaugcaguggu

SEQ ID NO: 240107 - RNA, 21 nt, Human
aggggacagaguagcuccagg

SEQ ID NO: 240108 - RNA, 22 nt, Human
ggccaggcugguuccuugaccu

SEQ ID NO: 240109 - RNA, 22 nt, Human
aggcugagggcuccugagggca

SEQ ID NO: 240110 - RNA, 22 nt, Human
agucaggguuguaggcucaccc

SEQ ID NO: 240111 - RNA, 20 nt, Human
aggcaugggaugcccagauu

SEQ ID NO: 240112 - RNA, 22 nt, Human
guguuacauauucuaaaaugcu

SEQ ID NO: 240113 - RNA, 22 nt, Human
aggcuucuucucuauguacaag

SEQ ID NO: 240114 - RNA, 22 nt, Human
acacagaguuugacacauggga

SEQ ID NO: 240115 - RNA, 22 nt, Human
aaagaggcucaaggugggccag

SEQ ID NO: 240116 - RNA, 22 nt, Human
agggaugaucaggguagaggcu

SEQ ID NO: 240117 - RNA, 22 nt, Human
gcuguguccucacacagccuuu

SEQ ID NO: 240118 - RNA, 22 nt, Human
aggagggagcuuaagccaggca

SEQ ID NO: 240119 - RNA, 22 nt, Human
gggcucugggauucagagcaag

SEQ ID NO: 240120 - RNA, 22 nt, Human
aggcagugccuggaccccagcu

SEQ ID NO: 240121 - RNA, 22 nt, Human
gaagccaagggcugcuuuuccu

SEQ ID NO: 240122 - RNA, 22 nt, Human
acagugucuccugguacccagu

SEQ ID NO: 240123 - RNA, 22 nt, Human
agcaacauuuuucaauuaacau

SEQ ID NO: 240124 - RNA, 22 nt, Human
uaaaaaguagugagaauggcgc

SEQ ID NO: 240125 - RNA, 22 nt, Human
uauucaggucgagcuaacugcu

SEQ ID NO: 240126 - RNA, 22 nt, Human
uugccaggagacaaagugggcc

SEQ ID NO: 240127 - RNA, 22 nt, Human
cagaaccugaacgugaggugga

SEQ ID NO: 240128 - RNA, 20 nt, Human
ucugcaccuccuuccaauca

SEQ ID NO: 240129 - RNA, 22 nt, Human
aaaugucaaagacguguuuuug

SEQ ID NO: 240130 - RNA, 22 nt, Human
cuucagcuaggaucccugcagc

SEQ ID NO: 240131 - RNA, 22 nt, Human
cacugucugggacauguggucu

SEQ ID NO: 240132 - RNA, 17 nt, Human
agacagaccucugcauc

SEQ ID NO: 240133 - RNA, 22 nt, Human
gauaaauuaucagggguuuaaa

SEQ ID NO: 240134 - RNA, 22 nt, Human
aagaauuuuccagcaugucagu

SEQ ID NO: 240135 - RNA, 22 nt, Human
caaaugaauuucccugcaaaug

SEQ ID NO: 240136 - RNA, 22 nt, Human
gccagguggagguugcagugag

SEQ ID NO: 240137 - RNA, 22 nt, Human
aaaggcuuaauguuguuguaau

SEQ ID NO: 240138 - RNA, 22 nt, Human
aguauacaaauaaauguguaau

SEQ ID NO: 240139 - RNA, 22 nt, Human
augacagacccucuaaagacaa

SEQ ID NO: 240140 - RNA, 22 nt, Human
uuuagaaauucaucuauggccu

SEQ ID NO: 240141 - RNA, 22 nt, Human
cuuuggaggucauagccaagag

SEQ ID NO: 240142 - RNA, 22 nt, Human
augccuuucccaacaggguggg

SEQ ID NO: 240143 - RNA, 17 nt, Human
agaacuguaguagcucc

SEQ ID NO: 240144 - RNA, 22 nt, Human
caaugcacauggacaucaggcu

SEQ ID NO: 240145 - RNA, 22 nt, Human
ggcuuugcuuuggcuguuucag

SEQ ID NO: 240146 - RNA, 22 nt, Human
ugcuuuauuuauaaaauagcaa

SEQ ID NO: 240147 - RNA, 22 nt, Human
uagaacuuauuagaaaggcuca

SEQ ID NO: 240148 - RNA, 22 nt, Human
auaguacacauccuacaauguu

SEQ ID NO: 240149 - RNA, 22 nt, Human
acuaaagcucacagaguugaac

SEQ ID NO: 240150 - RNA, 22 nt, Human
aaagugcaaggauuacaggcau

SEQ ID NO: 240151 - RNA, 22 nt, Human
guccauggcauuuccgucacau

SEQ ID NO: 240152 - RNA, 16 nt, Human
ccuggaggucacuuca

SEQ ID NO: 240153 - RNA, 22 nt, Human
uuugccugauucuaagagcuca

SEQ ID NO: 240154 - RNA, 22 nt, Human
auuaauuuccaggcacugugcu

SEQ ID NO: 240155 - RNA, 22 nt, Human
auucacaugugcuucuuaucac

SEQ ID NO: 240156 - RNA, 22 nt, Human
gacacugaccccaagcuguccu

SEQ ID NO: 240157 - RNA, 22 nt, Human
augaaguucucaauaaucaugu

SEQ ID NO: 240158 - RNA, 22 nt, Human
gcucuguguuuugcccaggaga

SEQ ID NO: 240159 - RNA, 22 nt, Human
aucuuuggaucgcucccccuuc

SEQ ID NO: 240160 - RNA, 22 nt, Human
gccagagagagucccugggccu

SEQ ID NO: 240161 - RNA, 22 nt, Human
ugugggaggaauuagaauggga

SEQ ID NO: 240162 - RNA, 22 nt, Human
agagguugggucugaggugaga

SEQ ID NO: 240163 - RNA, 22 nt, Human
aaauggaucuuuuuauaaugca

SEQ ID NO: 240164 - RNA, 18 nt, Human
uuggggugaggccaggaa

SEQ ID NO: 240165 - RNA, 22 nt, Human
agaggccaagccagacugugca

SEQ ID NO: 240166 - RNA, 22 nt, Human
uugcauuucccauugaguaaug

SEQ ID NO: 240167 - RNA, 22 nt, Human
aagcuguucucuaaguuucaug

SEQ ID NO: 240168 - RNA, 22 nt, Human
cauucccugucucuucaauccu

SEQ ID NO: 240169 - RNA, 19 nt, Human
uucucuggacuagaugcug

SEQ ID NO: 240170 - RNA, 19 nt, Human
uccaggagcaaagccaguu

SEQ ID NO: 240171 - RNA, 22 nt, Human
caagugucuauaucagugcuug

SEQ ID NO: 240172 - RNA, 22 nt, Human
ucccucagacagauguguuccu

SEQ ID NO: 240173 - RNA, 22 nt, Human
auggucuuuuuguuaugagaga

SEQ ID NO: 240174 - RNA, 22 nt, Human
uuguguccuauaugcauguucu

SEQ ID NO: 240175 - RNA, 22 nt, Human
acauagaacuucccagugagca

SEQ ID NO: 240176 - RNA, 22 nt, Human
gcucuggggaugcuucugccgu

SEQ ID NO: 240177 - RNA, 22 nt, Human
agggacacgagguccugcuggg

SEQ ID NO: 240178 - RNA, 22 nt, Human
uggcaggguggcaacuuuuggu

SEQ ID NO: 240179 - RNA, 22 nt, Human
uuuaucugcauucugaccaucu

SEQ ID NO: 240180 - RNA, 22 nt, Human
uccuuagaccuggcaaaugggg

SEQ ID NO: 240181 - RNA, 22 nt, Human
ugaaaucaauugcaauguuuau

SEQ ID NO: 240182 - RNA, 22 nt, Human
cagcugguguccagggaagugg

SEQ ID NO: 240183 - RNA, 22 nt, Human
uacuucauucaaguucgcuaua

SEQ ID NO: 240184 - RNA, 22 nt, Human
auguggaucuguuauucuagau

SEQ ID NO: 240185 - RNA, 22 nt, Human
cuccaggcccacgucgaggagg

SEQ ID NO: 240186 - RNA, 22 nt, Human
uacuguauuugauaagugaagu

SEQ ID NO: 240187 - RNA, 22 nt, Human
uagcagagcgggugcgaggcgg

SEQ ID NO: 240188 - RNA, 22 nt, Human
cugucucagcaggaagucauca

SEQ ID NO: 240189 - RNA, 22 nt, Human
aaugugucagcuugucgaucuu

SEQ ID NO: 240190 - RNA, 22 nt, Human
cuucuucaaccugaaaguuuca

SEQ ID NO: 240191 - RNA, 22 nt, Human
ucccaggguauccuguaguaaa

SEQ ID NO: 240192 - RNA, 22 nt, Human
ugacauuugagcauacauguaa

SEQ ID NO: 240193 - RNA, 22 nt, Human
ggccugcacagagguggcucua

SEQ ID NO: 240194 - RNA, 22 nt, Human
aaggcagcacagcaacugcuca

SEQ ID NO: 240195 - RNA, 22 nt, Human
gacaaacugaaguauauuuaga

SEQ ID NO: 240196 - RNA, 21 nt, Human
agcucccuguuuccucacucu

SEQ ID NO: 240197 - RNA, 22 nt, Human
acucagaaugacugaugcugug

SEQ ID NO: 240198 - RNA, 22 nt, Human
auucuucaaagagugucaaagu

SEQ ID NO: 240199 - RNA, 22 nt, Human
ugauucuguaagucauauuguu

SEQ ID NO: 240200 - RNA, 22 nt, Human
ggcaggcacuguguuuuguguu

SEQ ID NO: 240201 - RNA, 22 nt, Human
gggcuggcugauuuuccucucu

SEQ ID NO: 240202 - RNA, 22 nt, Human
gcagggagggccuuucaugaca

SEQ ID NO: 240203 - RNA, 22 nt, Human
uaugaaauuucuaguucugcuu

SEQ ID NO: 240204 - RNA, 22 nt, Human
ccucugggcggagaucugcugc

SEQ ID NO: 240205 - RNA, 22 nt, Human
gccuccuggauuuuagugccau

SEQ ID NO: 240206 - RNA, 22 nt, Human
acuggcagaacuggugauuguc

SEQ ID NO: 240207 - RNA, 22 nt, Human
uguggacuagagaauucuguug

SEQ ID NO: 240208 - RNA, 22 nt, Human
aaauuaagggugagaagaguug

SEQ ID NO: 240209 - RNA, 20 nt, Human
gaagauggguagaggcacag

SEQ ID NO: 240210 - RNA, 22 nt, Human
acauacagaccugcagggcagc

SEQ ID NO: 240211 - RNA, 22 nt, Human
uagaacuggaauuuugugguuu

SEQ ID NO: 240212 - RNA, 22 nt, Human
augcaacagcugggaauaugua

SEQ ID NO: 240213 - RNA, 22 nt, Human
uucagacaguaagaaagagguu

SEQ ID NO: 240214 - RNA, 22 nt, Human
ucacaucucuguuuucuaaauc

SEQ ID NO: 240215 - RNA, 22 nt, Human
augaacaguaugcaacaugauu

SEQ ID NO: 240216 - RNA, 22 nt, Human
cuuagcaguggguaccagggcu

SEQ ID NO: 240217 - RNA, 22 nt, Human
aaaacauucugugaacucucaa

SEQ ID NO: 240218 - RNA, 22 nt, Human
gucaguuauuuugagcaauugg

SEQ ID NO: 240219 - RNA, 23 nt, Human
cagaggugucagugcccaguguc

SEQ ID NO: 240220 - RNA, 22 nt, Human
agcuccugcagacuccugcuca

SEQ ID NO: 240221 - RNA, 20 nt, Human
gagugggccauggagugaga

SEQ ID NO: 240222 - RNA, 22 nt, Human
guagaagugaugucauguuaua

SEQ ID NO: 240223 - RNA, 22 nt, Human
gugcuucuccguucugcagcac

SEQ ID NO: 240224 - RNA, 22 nt, Human
uugaggaguuaggauguuuaua

SEQ ID NO: 240225 - RNA, 22 nt, Human
uaaaugcagcaguuucuguucu

SEQ ID NO: 240226 - RNA, 22 nt, Human
agggacaucucacaaacaacuu

SEQ ID NO: 240227 - RNA, 22 nt, Human
gagguaauuacuauguucagau

SEQ ID NO: 240228 - RNA, 22 nt, Human
agcugugugaccuagggcaagc

SEQ ID NO: 240229 - RNA, 22 nt, Human
acuggcagaauugaauaguugu

SEQ ID NO: 240230 - RNA, 22 nt, Human
gagugcuugcauauuuauuguc

SEQ ID NO: 240231 - RNA, 22 nt, Human
caucagagugguggccuggugu

SEQ ID NO: 240232 - RNA, 22 nt, Human
agcaucuguuaagugccuucaa

SEQ ID NO: 240233 - RNA, 22 nt, Human
cccaggauggggcugcaguuau

SEQ ID NO: 240234 - RNA, 22 nt, Human
cagaauuugaaguaauauucca

SEQ ID NO: 240235 - RNA, 18 nt, Human
uauauuucacacauauuc

SEQ ID NO: 240236 - RNA, 22 nt, Human
agcuucucucuuugcacucaca

SEQ ID NO: 240237 - RNA, 18 nt, Human
auacaagcucuguuacuu

SEQ ID NO: 240238 - RNA, 22 nt, Human
agcaugcaguaaagcccauguc

SEQ ID NO: 240239 - RNA, 22 nt, Human
agggccagccgacuuccagccu

SEQ ID NO: 240240 - RNA, 22 nt, Human
uccagaggcaaaaagguaugga

SEQ ID NO: 240241 - RNA, 22 nt, Human
uaccauuuugaggauggagaga

SEQ ID NO: 240242 - RNA, 22 nt, Human
cugggaggcggagguuguagug

SEQ ID NO: 240243 - RNA, 22 nt, Human
uaacuucuggaaaugcaucugc

SEQ ID NO: 240244 - RNA, 22 nt, Human
uuccuucuuguaaugaucugcc

SEQ ID NO: 240245 - RNA, 22 nt, Human
ucugggucuuuacccauggaau

SEQ ID NO: 240246 - RNA, 22 nt, Human
gagaacuugaacuuuuccucug

SEQ ID NO: 240247 - RNA, 22 nt, Human
ggcuccagggucucuccuugug

SEQ ID NO: 240248 - RNA, 22 nt, Human
uucuccagaccuugugacuaug

SEQ ID NO: 240249 - RNA, 22 nt, Human
agcuggcuuuugugaagguuuu

SEQ ID NO: 240250 - RNA, 22 nt, Human
gaauuacaugacccugaguaga

SEQ ID NO: 240251 - RNA, 22 nt, Human
gcuggugguaaggaggaaaaag

SEQ ID NO: 240252 - RNA, 22 nt, Human
cugauucuuugaagaugcaccc

SEQ ID NO: 240253 - RNA, 22 nt, Human
auugaauagaugcauuauacua

SEQ ID NO: 240254 - RNA, 22 nt, Human
uccagggaaggugugaggcugg

SEQ ID NO: 240255 - RNA, 22 nt, Human
uagcagcaagaaugggaugugu

SEQ ID NO: 240256 - RNA, 22 nt, Human
caggccaggguugagaagagaa

SEQ ID NO: 240257 - RNA, 22 nt, Human
ugacacaguugucgacucuaca

SEQ ID NO: 240258 - RNA, 22 nt, Human
cuggagcuggcuuccuuccacu

SEQ ID NO: 240259 - RNA, 22 nt, Human
uuuguguuuuagcuggugaggc

SEQ ID NO: 240260 - RNA, 22 nt, Human
uccuugggaaacaucauguaau

SEQ ID NO: 240261 - RNA, 22 nt, Human
cagucuccgccagcuccucaca

SEQ ID NO: 240262 - RNA, 22 nt, Human
gccaggaauuucaagagccacu

SEQ ID NO: 240263 - RNA, 21 nt, Human
cagcccagcccauugacagug

SEQ ID NO: 240264 - RNA, 22 nt, Human
cauggcucggggacaggaggua

SEQ ID NO: 240265 - RNA, 22 nt, Human
uauucagugacaggguauuaug

SEQ ID NO: 240266 - RNA, 22 nt, Human
uacaagcucacaaauuuuuaag

SEQ ID NO: 240267 - RNA, 22 nt, Human
ggcuccugagaaugggccauca

SEQ ID NO: 240268 - RNA, 22 nt, Human
aggaaacuaacuuaucuuuaua

SEQ ID NO: 240269 - RNA, 22 nt, Human
ucuuucaaugugaaaccaugua

SEQ ID NO: 240270 - RNA, 22 nt, Human
gauagaguguugccucucaauu

SEQ ID NO: 240271 - RNA, 22 nt, Human
gggcucugugguugugcuuugu

SEQ ID NO: 240272 - RNA, 22 nt, Human
uauaccaaaauaucagaaaggg

SEQ ID NO: 240273 - RNA, 22 nt, Human
ggagccuguggccgucacgacu

SEQ ID NO: 240274 - RNA, 22 nt, Human
ucuguagcauucaccagcccug

SEQ ID NO: 240275 - RNA, 19 nt, Human
ggcugucuacgaaccaguc

SEQ ID NO: 240276 - RNA, 22 nt, Human
ucagaaguccaauuuucgcacc

SEQ ID NO: 240277 - RNA, 22 nt, Human
ccucagaguuuaagaugucaga

SEQ ID NO: 240278 - RNA, 22 nt, Human
aaagacauauuucuaaguuuau

SEQ ID NO: 240279 - RNA, 22 nt, Human
cuggcuagcaccucagcucaga

SEQ ID NO: 240280 - RNA, 22 nt, Human
uucauacauuuuuacuaacagc

SEQ ID NO: 240281 - RNA, 22 nt, Human
guuacaaacucaggugccaaaa

SEQ ID NO: 240282 - RNA, 22 nt, Human
gugagcagcucaggguggucuc

SEQ ID NO: 240283 - RNA, 20 nt, Human
aggcaagguagaugucugcu

SEQ ID NO: 240284 - RNA, 22 nt, Human
aaaggcagagugcucagcuggc

SEQ ID NO: 240285 - RNA, 20 nt, Human
uacagacaugacaauaaugg

SEQ ID NO: 240286 - RNA, 22 nt, Human
cuugaaauccagauuucagagg

SEQ ID NO: 240287 - RNA, 22 nt, Human
ggcccagcuuucauuccuugcu

SEQ ID NO: 240288 - RNA, 22 nt, Human
uacugugguaacauuuuaaauu

SEQ ID NO: 240289 - RNA, 22 nt, Human
accuguuuguuaagaaagcuuc

SEQ ID NO: 240290 - RNA, 22 nt, Human
uggcugaggcuggagugcagug

SEQ ID NO: 240291 - RNA, 22 nt, Human
ccugagccugaguggugcaggg

SEQ ID NO: 240292 - RNA, 22 nt, Human
aagucauuaucucuucuaaucu

SEQ ID NO: 240293 - RNA, 22 nt, Human
ccaacacagauguguuaguguu

SEQ ID NO: 240294 - RNA, 22 nt, Human
accagcacggauuagaaugcuu

SEQ ID NO: 240295 - RNA, 21 nt, Human
aauaaccacuaauauaguggc

SEQ ID NO: 240296 - RNA, 22 nt, Human
aaggcugggaaacaugcaggcc

SEQ ID NO: 240297 - RNA, 22 nt, Human
caaaguauauuucauagucuca

SEQ ID NO: 240298 - RNA, 22 nt, Human
augucuuucucacagccaguuc

SEQ ID NO: 240299 - RNA, 22 nt, Human
gaagaagacauggaacaauagu

SEQ ID NO: 240300 - RNA, 22 nt, Human
gagcuuuaagggcacuggucuu

SEQ ID NO: 240301 - RNA, 21 nt, Human
uccugugaggaccugucagug

SEQ ID NO: 240302 - RNA, 19 nt, Human
aagcauuagccaaagcauu

SEQ ID NO: 240303 - RNA, 19 nt, Human
agggcacagggacagaagg

SEQ ID NO: 240304 - RNA, 22 nt, Human
caaauagugucacauugugagg

SEQ ID NO: 240305 - RNA, 22 nt, Human
gcacaugacuuugaggaaacca

SEQ ID NO: 240306 - RNA, 22 nt, Human
ucagaaaagaccacauuauucu

SEQ ID NO: 240307 - RNA, 22 nt, Human
acaugcaaagggaugcaauuau

SEQ ID NO: 240308 - RNA, 22 nt, Human
ccaccugugcuugguacuccau

SEQ ID NO: 240309 - RNA, 22 nt, Human
aguuuccuugggcauuuguuua

SEQ ID NO: 240310 - RNA, 22 nt, Human
aagggcuggcccugggaagagu

SEQ ID NO: 240311 - RNA, 22 nt, Human
ggcucugcagugacuugagggg

SEQ ID NO: 240312 - RNA, 22 nt, Human
gcugggucagaaucucccugug

SEQ ID NO: 240313 - RNA, 22 nt, Human
ugucauuuacuccauacccuca

SEQ ID NO: 240314 - RNA, 22 nt, Human
ugcauucaucauuugaaagccc

SEQ ID NO: 240315 - RNA, 22 nt, Human
aaaguguuuugauuuaguggua

SEQ ID NO: 240316 - RNA, 22 nt, Human
cugucagggggccuggccauca

SEQ ID NO: 240317 - RNA, 19 nt, Human
acuggcagggcugcggugg

SEQ ID NO: 240318 - RNA, 22 nt, Human
uggcucaguuugggggauugaa

SEQ ID NO: 240319 - RNA, 22 nt, Human
ugugucauauuaguauugagag

SEQ ID NO: 240320 - RNA, 22 nt, Human
auuguaucuugucauuaugcau

SEQ ID NO: 240321 - RNA, 22 nt, Human
uuuaaauguuuaaaacucguga

SEQ ID NO: 240322 - RNA, 22 nt, Human
cucuguacaggagacaucucua

SEQ ID NO: 240323 - RNA, 19 nt, Human
acugggcuuguccucgugg

SEQ ID NO: 240324 - RNA, 18 nt, Human
ugacucacccugucagug

SEQ ID NO: 240325 - RNA, 22 nt, Human
agcugggagcugaaggcugauu

SEQ ID NO: 240326 - RNA, 22 nt, Human
agagaucaguuaaaaucuuuuu

SEQ ID NO: 240327 - RNA, 22 nt, Human
acuagaaagcaaaagccauuuc

SEQ ID NO: 240328 - RNA, 22 nt, Human
uccugccuucauacugcuguau

SEQ ID NO: 240329 - RNA, 22 nt, Human
uuccuuguaagaccuauuuuug

SEQ ID NO: 240330 - RNA, 22 nt, Human
gccaggaaaaacguggugggag

SEQ ID NO: 240331 - RNA, 22 nt, Human
uggguaaacaauguuugccuaa

SEQ ID NO: 240332 - RNA, 22 nt, Human
gaaugcugagucuuaucucuua

SEQ ID NO: 240333 - RNA, 22 nt, Human
agcucaggcaacucugggcccc

SEQ ID NO: 240334 - RNA, 21 nt, Human
cuggagcuuggugagaagugu

SEQ ID NO: 240335 - RNA, 22 nt, Human
uaaggcaguuuugccugagaua

SEQ ID NO: 240336 - RNA, 21 nt, Human
agacuguggauuuugacaugu

SEQ ID NO: 240337 - RNA, 22 nt, Human
cucuuucucgccgcccgcaguc

SEQ ID NO: 240338 - RNA, 22 nt, Human
gggauccauccgugcagcagag

SEQ ID NO: 240339 - RNA, 22 nt, Human
uaguucuucaugaauucagcuu

SEQ ID NO: 240340 - RNA, 22 nt, Human
uacagacagacuucccacccuc

SEQ ID NO: 240341 - RNA, 22 nt, Human
ucuguggaccaggguauaagga

SEQ ID NO: 240342 - RNA, 22 nt, Human
gguccagguccugugacagcag

SEQ ID NO: 240343 - RNA, 23 nt, Human
ggggacaguucccacuggggucu

SEQ ID NO: 240344 - RNA, 22 nt, Human
caagauuaucuucuucuuguua

SEQ ID NO: 240345 - RNA, 23 nt, Human
uccagccaaaucuggcugacagu

SEQ ID NO: 240346 - RNA, 22 nt, Human
uugggaaagccacaaauuggag

SEQ ID NO: 240347 - RNA, 22 nt, Human
uuguuucuucauuuagaagcuu

SEQ ID NO: 240348 - RNA, 22 nt, Human
caauauauaaugaguacuuucc

SEQ ID NO: 240349 - RNA, 22 nt, Human
cagaggaguucaguacacagcc

SEQ ID NO: 240350 - RNA, 22 nt, Human
uuucuacaguacugauuucaua

SEQ ID NO: 240351 - RNA, 22 nt, Human
gacaggcuucaugauggcagga

SEQ ID NO: 240352 - RNA, 22 nt, Human
acaugcuuucuagguccuucug

SEQ ID NO: 240353 - RNA, 22 nt, Human
acuguacaugcaucuugucuau

SEQ ID NO: 240354 - RNA, 22 nt, Human
augaagaaacuguucugggugg

SEQ ID NO: 240355 - RNA, 19 nt, Human
ucuuuguacaagucucugc

SEQ ID NO: 240356 - RNA, 22 nt, Human
ugucacauuauaugugaggaua

SEQ ID NO: 240357 - RNA, 22 nt, Human
ucccagaguauuagcaauugcu

SEQ ID NO: 240358 - RNA, 22 nt, Human
uaucacuugcguuuuggcagag

SEQ ID NO: 240359 - RNA, 22 nt, Human
gagcccuccauggagccaggca

SEQ ID NO: 240360 - RNA, 22 nt, Human
ccagggcuggaccagugcuugg

SEQ ID NO: 240361 - RNA, 22 nt, Human
ggcagcuguuggcucucuagga

SEQ ID NO: 240362 - RNA, 20 nt, Human
ugcugggcaugcaguggaaa

SEQ ID NO: 240363 - RNA, 22 nt, Human
cuugagaacaggguuagguaac

SEQ ID NO: 240364 - RNA, 19 nt, Human
uggugcuggccucccaugg

SEQ ID NO: 240365 - RNA, 22 nt, Human
cugguucugauguucuuggcuu

SEQ ID NO: 240366 - RNA, 22 nt, Human
ugacugccgauuguccuucucu

SEQ ID NO: 240367 - RNA, 19 nt, Human
cuuauuagagugagagcuu

SEQ ID NO: 240368 - RNA, 22 nt, Human
ggaucuuuaaguucuuuuccau

SEQ ID NO: 240369 - RNA, 22 nt, Human
acagccuguuugaucuggugcu

SEQ ID NO: 240370 - RNA, 22 nt, Human
ugccugggacaugcuguggacu

SEQ ID NO: 240371 - RNA, 22 nt, Human
ucagggagauuuggggacucaa

SEQ ID NO: 240372 - RNA, 22 nt, Human
aauauaguucugguauuguuaa

SEQ ID NO: 240373 - RNA, 22 nt, Human
gacacaaaguuugucagaaauu

SEQ ID NO: 240374 - RNA, 22 nt, Human
gggcuucucugggaguccuggu

SEQ ID NO: 240375 - RNA, 22 nt, Human
aucuuagagagucguguuuugu

SEQ ID NO: 240376 - RNA, 22 nt, Human
gcaaagguagccaaggagcuca

SEQ ID NO: 240377 - RNA, 22 nt, Human
ccugggccucacccagcucuug

SEQ ID NO: 240378 - RNA, 22 nt, Human
cgggguccgggcaguaggcugc

SEQ ID NO: 240379 - RNA, 22 nt, Human
uuccuauagaaagcuguguaga

SEQ ID NO: 240380 - RNA, 21 nt, Human
caggcucugcuagaggagccu

SEQ ID NO: 240381 - RNA, 22 nt, Human
uuuucuucuaccugcuguccaa

SEQ ID NO: 240382 - RNA, 22 nt, Human
gggagccuugggagugccagcc

SEQ ID NO: 240383 - RNA, 22 nt, Human
agaggaaguaaucaggaccugc

SEQ ID NO: 240384 - RNA, 22 nt, Human
augugugguuuguaaaugauuu

SEQ ID NO: 240385 - RNA, 22 nt, Human
cagggccuccuaaggcaucuaa

SEQ ID NO: 240386 - RNA, 22 nt, Human
uggcagguagucagaggcgaca

SEQ ID NO: 240387 - RNA, 22 nt, Human
agguuccagguucgaaucccau

SEQ ID NO: 240388 - RNA, 22 nt, Human
gcauccagagguagccacugug

SEQ ID NO: 240389 - RNA, 22 nt, Human
ugauggaagagcuaacaauauc

SEQ ID NO: 240390 - RNA, 22 nt, Human
ggggagaauaaaucagauuuua

SEQ ID NO: 240391 - RNA, 22 nt, Human
agggugggcuagacucuucccc

SEQ ID NO: 240392 - RNA, 22 nt, Human
gguguccucggauucagggcag

SEQ ID NO: 240393 - RNA, 22 nt, Human
uccugggcacaagugagucucc

SEQ ID NO: 240394 - RNA, 22 nt, Human
uacuuuauucaggaaggcuggu

SEQ ID NO: 240395 - RNA, 22 nt, Human
gaggcaggcagauugcuugagg

SEQ ID NO: 240396 - RNA, 22 nt, Human
uagaaacauauguuugagacau

SEQ ID NO: 240397 - RNA, 22 nt, Human
ccugaguuaguugcugugucuc

SEQ ID NO: 240398 - RNA, 22 nt, Human
agcugagagccccugcccugug

SEQ ID NO: 240399 - RNA, 22 nt, Human
aguggacuuuuaguauccuuau

SEQ ID NO: 240400 - RNA, 22 nt, Human
gaggugagaagggggucagaug

SEQ ID NO: 240401 - RNA, 22 nt, Human
gggcagguguugucaaucuaau

SEQ ID NO: 240402 - RNA, 22 nt, Human
ccucagaguuggccacgagagc

SEQ ID NO: 240403 - RNA, 22 nt, Human
uccuggggaggguucuggcucc

SEQ ID NO: 240404 - RNA, 22 nt, Human
acugcccuuguccuggcacacc

SEQ ID NO: 240405 - RNA, 22 nt, Human
ucucugaagagcucagacuagu

SEQ ID NO: 240406 - RNA, 22 nt, Human
ugccaggcauguaguagacuug

SEQ ID NO: 240407 - RNA, 22 nt, Human
uuuagaagacagaugcacagcc

SEQ ID NO: 240408 - RNA, 22 nt, Human
guggcuucaugaacacugauga

SEQ ID NO: 240409 - RNA, 22 nt, Human
gaacagggaguacggcacauuu

SEQ ID NO: 240410 - RNA, 22 nt, Human
auauucaaauuacauuuacuaa

SEQ ID NO: 240411 - RNA, 22 nt, Human
caguuuugguccuuucuaggua

SEQ ID NO: 240412 - RNA, 22 nt, Human
cuggcccugguaaggacaccca

SEQ ID NO: 240413 - RNA, 22 nt, Human
gccauuuagggaggcaagguga

SEQ ID NO: 240414 - RNA, 22 nt, Human
gugcaaaagcaauugcaguuuu

SEQ ID NO: 240415 - RNA, 22 nt, Human
uuccaggaagauucaacaaaag

SEQ ID NO: 240416 - RNA, 22 nt, Human
ggcagccuggagacuuugugaa

SEQ ID NO: 240417 - RNA, 19 nt, Human
cugggucuuauucugugaa

SEQ ID NO: 240418 - RNA, 22 nt, Human
augguaaccagaagacuaugac

SEQ ID NO: 240419 - RNA, 22 nt, Human
gggggaagaggcaugaaguccu

SEQ ID NO: 240420 - RNA, 22 nt, Human
cagauauguggauucuauuagc

SEQ ID NO: 240421 - RNA, 22 nt, Human
gcauucuuuccacgaggaggua

SEQ ID NO: 240422 - RNA, 22 nt, Human
gccacagacagagagucuagug

SEQ ID NO: 240423 - RNA, 21 nt, Human
aguucuguuaugcuggacuca

SEQ ID NO: 240424 - RNA, 22 nt, Human
aagaaguuaaauaaauggacca

SEQ ID NO: 240425 - RNA, 22 nt, Human
gaggaagagagcucugccuugu

SEQ ID NO: 240426 - RNA, 20 nt, Human
caccaggcgcucugagaaca

SEQ ID NO: 240427 - RNA, 22 nt, Human
uguauacauuuaacuagauaga

SEQ ID NO: 240428 - RNA, 22 nt, Human
gagggcaguagccucguacccu

SEQ ID NO: 240429 - RNA, 22 nt, Human
agaucauagcacaaaagugaca

SEQ ID NO: 240430 - RNA, 22 nt, Human
cagggcucgcucgcucgcucgc

SEQ ID NO: 240431 - RNA, 22 nt, Human
aaacaggcaucacucagcaaag

SEQ ID NO: 240432 - RNA, 22 nt, Human
uccuggcuuccacaccugucau

SEQ ID NO: 240433 - RNA, 22 nt, Human
ucucaugugauucccgugcaug

SEQ ID NO: 240434 - RNA, 22 nt, Human
augcaaacaugaagagaaagag

SEQ ID NO: 240435 - RNA, 22 nt, Human
ucuucagaggagcugaauauau

SEQ ID NO: 240436 - RNA, 22 nt, Human
aucuuuaguagaggaauauauu

SEQ ID NO: 240437 - RNA, 22 nt, Human
aaugaugguuaaacacuggagg

SEQ ID NO: 240438 - RNA, 22 nt, Human
cagcagagcuuauuaacuaaaa

SEQ ID NO: 240439 - RNA, 22 nt, Human
cagcugaaagaaggaaguguca

SEQ ID NO: 240440 - RNA, 22 nt, Human
ccaggaucugauauugggcucc

SEQ ID NO: 240441 - RNA, 19 nt, Human
aaagcagugcauccucuuu

SEQ ID NO: 240442 - RNA, 22 nt, Human
uucuucagucccacuagccaca

SEQ ID NO: 240443 - RNA, 22 nt, Human
cuuccucacggugcaacaggaa

SEQ ID NO: 240444 - RNA, 22 nt, Human
gauagaaagaauauagauucca

SEQ ID NO: 240445 - RNA, 21 nt, Human
gcauguguggugugcuccaca

SEQ ID NO: 240446 - RNA, 22 nt, Human
uuuaauuuuccugguaggccug

SEQ ID NO: 240447 - RNA, 22 nt, Human
aacuuaaacccacucauguaga

SEQ ID NO: 240448 - RNA, 22 nt, Human
acagcugggaacucacacagca

SEQ ID NO: 240449 - RNA, 22 nt, Human
ugaaaacuugacaagugaggua

SEQ ID NO: 240450 - RNA, 22 nt, Human
caguccuuggcaaguucucagu

SEQ ID NO: 240451 - RNA, 22 nt, Human
uauacacaaggugugcauuugu

SEQ ID NO: 240452 - RNA, 22 nt, Human
cuauuuucccauaugguugaca

SEQ ID NO: 240453 - RNA, 22 nt, Human
ucccuccuggugagcaggggcu

SEQ ID NO: 240454 - RNA, 22 nt, Human
gaguggguccacagaggugaca

SEQ ID NO: 240455 - RNA, 22 nt, Human
agggugugcuguugggucuuuc

SEQ ID NO: 240456 - RNA, 22 nt, Human
uucugcauucaaauuaugugag

SEQ ID NO: 240457 - RNA, 22 nt, Human
guccaugcuuaaauaccuuaaa

SEQ ID NO: 240458 - RNA, 22 nt, Human
gcuuccuguccaggccccacau

SEQ ID NO: 240459 - RNA, 22 nt, Human
gauggucuguauuaaacagaug

SEQ ID NO: 240460 - RNA, 22 nt, Human
aagugugggaaguagguggcga

SEQ ID NO: 240461 - RNA, 22 nt, Human
uguggcuguggaugcuuuccag

SEQ ID NO: 240462 - RNA, 22 nt, Human
gaggagguggagucaugcagag

SEQ ID NO: 240463 - RNA, 21 nt, Human
guucaaauccugacacuacac

SEQ ID NO: 240464 - RNA, 22 nt, Human
gaguuagagccauagagcacgg

SEQ ID NO: 240465 - RNA, 22 nt, Human
aaagucauacauggugcuuacu

SEQ ID NO: 240466 - RNA, 22 nt, Human
aaggagagguuguccguguugu

SEQ ID NO: 240467 - RNA, 22 nt, Human
gaggccagaagugccucgggcu

SEQ ID NO: 240468 - RNA, 22 nt, Human
acccugggagggagaaaucaga

SEQ ID NO: 240469 - RNA, 22 nt, Human
aaaggcuauuuuuagauguuug

SEQ ID NO: 240470 - RNA, 20 nt, Human
uacaggaccuucuuuguauc

SEQ ID NO: 240471 - RNA, 22 nt, Human
ccugcucagccccagcucaccc

SEQ ID NO: 240472 - RNA, 22 nt, Human
cccugggaguccacugauguca

SEQ ID NO: 240473 - RNA, 22 nt, Human
agaaaccaucuuuauauaucug

SEQ ID NO: 240474 - RNA, 22 nt, Human
aauuaguucacguccugugcuu

SEQ ID NO: 240475 - RNA, 22 nt, Human
cuggguccugcucucccuaaga

SEQ ID NO: 240476 - RNA, 22 nt, Human
caauauauaggaacaacuuagg

SEQ ID NO: 240477 - RNA, 22 nt, Human
cagagccuggcgaugucaugga

SEQ ID NO: 240478 - RNA, 19 nt, Human
uccuucuccggccaccccg

SEQ ID NO: 240479 - RNA, 22 nt, Human
auacuucuggugacaaagucuu

SEQ ID NO: 240480 - RNA, 22 nt, Human
ggcuccagaggccuuaccugca

SEQ ID NO: 240481 - RNA, 22 nt, Human
uggcaaggccacaggugcaguu

SEQ ID NO: 240482 - RNA, 22 nt, Human
gucuuuaguugaaacauguggu

SEQ ID NO: 240483 - RNA, 22 nt, Human
ccagagcccagcacacggugcu

SEQ ID NO: 240484 - RNA, 22 nt, Human
agccccaguaagggagggccug

SEQ ID NO: 240485 - RNA, 22 nt, Human
uuaaagcaugcugcuuuuccau

SEQ ID NO: 240486 - RNA, 22 nt, Human
gaaucagccugaguuugcagcu

SEQ ID NO: 240487 - RNA, 22 nt, Human
acacuucauuuacauuauaggc

SEQ ID NO: 240488 - RNA, 22 nt, Human
ucugcaggaaaaaagugccugg

SEQ ID NO: 240489 - RNA, 22 nt, Human
aguauacauagugcuuccucuu

SEQ ID NO: 240490 - RNA, 22 nt, Human
uaaaucuccuguuuuucaucua

SEQ ID NO: 240491 - RNA, 22 nt, Human
acauucuacaguuaaccauuag

SEQ ID NO: 240492 - RNA, 22 nt, Human
ucugugcuggacugauuucaua

SEQ ID NO: 240493 - RNA, 23 nt, Human
gagaaaccucgguaagcaggagg

SEQ ID NO: 240494 - RNA, 22 nt, Human
uauuucuguuuauuuguacauc

SEQ ID NO: 240495 - RNA, 22 nt, Human
gccagcccugggagacuuaugg

SEQ ID NO: 240496 - RNA, 22 nt, Human
uggaagggguuacgcagcagga

SEQ ID NO: 240497 - RNA, 22 nt, Human
cuccuggcacugucuugaccca

SEQ ID NO: 240498 - RNA, 22 nt, Human
uuagaaaaauguucaguaguuu

SEQ ID NO: 240499 - RNA, 22 nt, Human
guggccugccgugugguauggg

SEQ ID NO: 240500 - RNA, 22 nt, Human
agcagguggauuuagacgggag

SEQ ID NO: 240501 - RNA, 22 nt, Human
ucuggcuccuggcuccacugcc

SEQ ID NO: 240502 - RNA, 22 nt, Human
agaaucaaggugaagcccacag

SEQ ID NO: 240503 - RNA, 22 nt, Human
ugcuccagcuggagaugggggc

SEQ ID NO: 240504 - RNA, 21 nt, Human
aggccucuucauggccaugau

SEQ ID NO: 240505 - RNA, 22 nt, Human
auggagcuguagggagcagugg

SEQ ID NO: 240506 - RNA, 22 nt, Human
gcccaagcuccgccuccugucg

SEQ ID NO: 240507 - RNA, 20 nt, Human
acaguguuuuugaguagagc

SEQ ID NO: 240508 - RNA, 16 nt, Human
uaggaaacugcaugug

SEQ ID NO: 240509 - RNA, 22 nt, Human
uucugagaaugcuucuggaauc

SEQ ID NO: 240510 - RNA, 22 nt, Human
gaggcacagucccgaggcaagg

SEQ ID NO: 240511 - RNA, 21 nt, Human
ucauuucucuauguauuucac

SEQ ID NO: 240512 - RNA, 22 nt, Human
ugauucuauggaaggcauaagg

SEQ ID NO: 240513 - RNA, 22 nt, Human
gaggaagaaagcauaggugggg

SEQ ID NO: 240514 - RNA, 22 nt, Human
uagaaucugaauauucuuauuu

SEQ ID NO: 240515 - RNA, 22 nt, Human
cugggcucaaauccuggcccug

SEQ ID NO: 240516 - RNA, 22 nt, Human
uuggaaagaccgaauuccuguu

SEQ ID NO: 240517 - RNA, 22 nt, Human
agcuucuugggcuuuacacaaa

SEQ ID NO: 240518 - RNA, 22 nt, Human
uugauuccuugaaauauccuug

SEQ ID NO: 240519 - RNA, 22 nt, Human
uaaagacauaggaucagggaga

SEQ ID NO: 240520 - RNA, 22 nt, Human
augcacccauguacauacacau

SEQ ID NO: 240521 - RNA, 22 nt, Human
gccuccuggccuuugcuccuca

SEQ ID NO: 240522 - RNA, 22 nt, Human
ucaggugucaagcagggagcug

SEQ ID NO: 240523 - RNA, 18 nt, Human
ggaagaaaaggaacucag

SEQ ID NO: 240524 - RNA, 22 nt, Human
uuucaggauuuuaugagauagu

SEQ ID NO: 240525 - RNA, 22 nt, Human
cgcaacagagcagguuugauga

SEQ ID NO: 240526 - RNA, 22 nt, Human
cacaaugugguuugucaucuuu

SEQ ID NO: 240527 - RNA, 23 nt, Human
cuucaucaaaaguuaacacuagu

SEQ ID NO: 240528 - RNA, 22 nt, Human
ugagucuucuuccgggauugcu

SEQ ID NO: 240529 - RNA, 22 nt, Human
uuuauauugggagucguuuuga

SEQ ID NO: 240530 - RNA, 22 nt, Human
ucucccacagucucccauggcu

SEQ ID NO: 240531 - RNA, 17 nt, Human
agacacugagccaagua

SEQ ID NO: 240532 - RNA, 22 nt, Human
cagucuuauccugaaaacaaca

SEQ ID NO: 240533 - RNA, 17 nt, Human
gcucccugaggacagcu

SEQ ID NO: 240534 - RNA, 22 nt, Human
uaagccacugagauuugggguu

SEQ ID NO: 240535 - RNA, 22 nt, Human
gaggcccaguccugcaagcacg

SEQ ID NO: 240536 - RNA, 20 nt, Human
acuuuacagagaagacugac

SEQ ID NO: 240537 - RNA, 22 nt, Human
aguguuagugaaagguguuuau

SEQ ID NO: 240538 - RNA, 20 nt, Human
uacaggagugaguggguggg

SEQ ID NO: 240539 - RNA, 22 nt, Human
gccugcagggugaugggcugcc

SEQ ID NO: 240540 - RNA, 22 nt, Human
ccucgugugcuaggauccaggu

SEQ ID NO: 240541 - RNA, 22 nt, Human
uuccuuucucuggacugcagcc

SEQ ID NO: 240542 - RNA, 22 nt, Human
aagggcugggucugguuaaccc

SEQ ID NO: 240543 - RNA, 22 nt, Human
aaugagucaaaacagcauauag

SEQ ID NO: 240544 - RNA, 22 nt, Human
uuggucagcuaauaaggacagg

SEQ ID NO: 240545 - RNA, 22 nt, Human
agggucagagucaggugcagua

SEQ ID NO: 240546 - RNA, 22 nt, Human
cagcuacacuucuggguguguc

SEQ ID NO: 240547 - RNA, 22 nt, Human
aaccuggaggcuguguagucuu

SEQ ID NO: 240548 - RNA, 22 nt, Human
cucuguugucaguggaagcagc

SEQ ID NO: 240549 - RNA, 22 nt, Human
ccaguguuuccgucaguacacg

SEQ ID NO: 240550 - RNA, 17 nt, Human
ugucuucugaagagagc

SEQ ID NO: 240551 - RNA, 23 nt, Human
gccaggcacaugguggacacgca

SEQ ID NO: 240552 - RNA, 22 nt, Human
cauccagggcagccauggccug

SEQ ID NO: 240553 - RNA, 22 nt, Human
ucuguacauuuguguugugaau

SEQ ID NO: 240554 - RNA, 22 nt, Human
aggcugaaaacgagauggcaau

SEQ ID NO: 240555 - RNA, 21 nt, Human
aauucccagaaacagcacaag

SEQ ID NO: 240556 - RNA, 22 nt, Human
uaauuucuaauucauuuucagu

SEQ ID NO: 240557 - RNA, 22 nt, Human
aggcuggcgucaggggcuguac

SEQ ID NO: 240558 - RNA, 22 nt, Human
augugucuaauuccaggagcac

SEQ ID NO: 240559 - RNA, 21 nt, Human
uugcaacaaccuauauauuuu

SEQ ID NO: 240560 - RNA, 22 nt, Human
uaaguguugguaauuacaauga

SEQ ID NO: 240561 - RNA, 22 nt, Human
uuucacuggaauuuuaacauuu

SEQ ID NO: 240562 - RNA, 22 nt, Human
ccaggccauucccagaguugcu

SEQ ID NO: 240563 - RNA, 22 nt, Human
agccuguccagaggacagggcu

SEQ ID NO: 240564 - RNA, 21 nt, Human
ugagcccuugccucagagccc

SEQ ID NO: 240565 - RNA, 22 nt, Human
ucugcagagccucaggagaaca

SEQ ID NO: 240566 - RNA, 22 nt, Human
uguuuucaucacagaauguaac

SEQ ID NO: 240567 - RNA, 22 nt, Human
uguuaaucaaucaacaguauua

SEQ ID NO: 240568 - RNA, 22 nt, Human
gagccuucaucgcagccuuguu

SEQ ID NO: 240569 - RNA, 22 nt, Human
ucuuuagacauccaguuucucu

SEQ ID NO: 240570 - RNA, 22 nt, Human
caggccaccagauacaugcccc

SEQ ID NO: 240571 - RNA, 22 nt, Human
uuauaacuuuggauaugacaag

SEQ ID NO: 240572 - RNA, 22 nt, Human
aggccaggacacuuaaguaaga

SEQ ID NO: 240573 - RNA, 22 nt, Human
gggagcugaugauguaaguccc

SEQ ID NO: 240574 - RNA, 22 nt, Human
ucagagcugugcuucaggaaag

SEQ ID NO: 240575 - RNA, 22 nt, Human
uccagggagauacuggcugcca

SEQ ID NO: 240576 - RNA, 22 nt, Human
gcagauuucuaauaagcaaugu

SEQ ID NO: 240577 - RNA, 22 nt, Human
uaagaaauuuaguuauagaaug

SEQ ID NO: 240578 - RNA, 22 nt, Human
gacaagaugagcagcucagugu

SEQ ID NO: 240579 - RNA, 22 nt, Human
ucaugaggauuuacuagacuag

SEQ ID NO: 240580 - RNA, 22 nt, Human
ucauuguauucagaacugaaga

SEQ ID NO: 240581 - RNA, 22 nt, Human
uaaaaguggauaagcuguagga

SEQ ID NO: 240582 - RNA, 22 nt, Human
ugcagaagcagagaguugccaa

SEQ ID NO: 240583 - RNA, 22 nt, Human
auauaguaagcagucuguaaau

SEQ ID NO: 240584 - RNA, 22 nt, Human
ucauuucucugagucugauaau

SEQ ID NO: 240585 - RNA, 22 nt, Human
uacaugugcuauuuguuuugua

SEQ ID NO: 240586 - RNA, 21 nt, Human
ucugggcugcugcugcccauc

SEQ ID NO: 240587 - RNA, 22 nt, Human
aggucuggagugggaucugaga

SEQ ID NO: 240588 - RNA, 18 nt, Human
agucuuuaaagauguuac

SEQ ID NO: 240589 - RNA, 22 nt, Human
guccugggaaggaagccaggga

SEQ ID NO: 240590 - RNA, 22 nt, Human
caucucauuuauuccaacucag

SEQ ID NO: 240591 - RNA, 22 nt, Human
agaauaauacugaaaugcugaa

SEQ ID NO: 240592 - RNA, 20 nt, Human
cugaacacagaauaagcaca

SEQ ID NO: 240593 - RNA, 22 nt, Human
uaacaucuaagggagagaaagu

SEQ ID NO: 240594 - RNA, 22 nt, Human
agcccagaaaugaaaggaugau

SEQ ID NO: 240595 - RNA, 22 nt, Human
aagaacaugguaggauaacaaa

SEQ ID NO: 240596 - RNA, 22 nt, Human
auggcuucugucuuggaaacuu

SEQ ID NO: 240597 - RNA, 19 nt, Human
aauaauguucaugagauug

SEQ ID NO: 240598 - RNA, 23 nt, Human
aaguuaguuucaauaaagcaauu

SEQ ID NO: 240599 - RNA, 21 nt, Human
agacagacugccugacccacg

SEQ ID NO: 240600 - RNA, 22 nt, Human
cagccagguuagugcuaauugu

SEQ ID NO: 240601 - RNA, 22 nt, Human
agcuggcugggugccagucucc

SEQ ID NO: 240602 - RNA, 22 nt, Human
ggagaagccaggugauaagcaa

SEQ ID NO: 240603 - RNA, 22 nt, Human
auucuaaaucagagagcucugu

SEQ ID NO: 240604 - RNA, 22 nt, Human
agcuggaagugcauuucucacu

SEQ ID NO: 240605 - RNA, 22 nt, Human
acuguauucuagucauguuugu

SEQ ID NO: 240606 - RNA, 22 nt, Human
ugcuuuaucugacuuggcgcug

SEQ ID NO: 240607 - RNA, 22 nt, Human
uggcccaggcgaggugggcaga

SEQ ID NO: 240608 - RNA, 22 nt, Human
uacauauucaacguucaguauu

SEQ ID NO: 240609 - RNA, 22 nt, Human
gagggcugauaacaggaauaca

SEQ ID NO: 240610 - RNA, 22 nt, Human
ccuuccuugagaagcaauuccu

SEQ ID NO: 240611 - RNA, 22 nt, Human
cuuacaaauacacuuaggagag

SEQ ID NO: 240612 - RNA, 22 nt, Human
aguggcugguaguuacugagca

SEQ ID NO: 240613 - RNA, 21 nt, Human
acaguucaugauaacuccauc

SEQ ID NO: 240614 - RNA, 22 nt, Human
uuucaauguaacauuuccaggc

SEQ ID NO: 240615 - RNA, 22 nt, Human
agagguggccaugggcgcugga

SEQ ID NO: 240616 - RNA, 22 nt, Human
uaaaauguguuucuguaugguu

SEQ ID NO: 240617 - RNA, 22 nt, Human
auuuacagguagaauuuuaagu

SEQ ID NO: 240618 - RNA, 22 nt, Human
ugucugggauguuggcagccac

SEQ ID NO: 240619 - RNA, 22 nt, Human
cugugggagaagcuagcacagg

SEQ ID NO: 240620 - RNA, 22 nt, Human
aauaaacugcucaauugcauca

SEQ ID NO: 240621 - RNA, 22 nt, Human
aggaguuuggggauuagucagg

SEQ ID NO: 240622 - RNA, 22 nt, Human
aaagcagucuguuuuaaccuga

SEQ ID NO: 240623 - RNA, 22 nt, Human
cugacuguugcuguugaugagg

SEQ ID NO: 240624 - RNA, 22 nt, Human
cucaggagguuuccugucuagg

SEQ ID NO: 240625 - RNA, 22 nt, Human
ucacaggcuaaauuuaugcagg

SEQ ID NO: 240626 - RNA, 22 nt, Human
acauuuuacaccaagacuucuu

SEQ ID NO: 240627 - RNA, 22 nt, Human
cugagacauuaugacaagugga

SEQ ID NO: 240628 - RNA, 22 nt, Human
caacauuauauagccacaugcc

SEQ ID NO: 240629 - RNA, 22 nt, Human
aguaacuaugcuugagaaucag

SEQ ID NO: 240630 - RNA, 22 nt, Human
aucucaaagcauggagcagaau

SEQ ID NO: 240631 - RNA, 22 nt, Human
uuuaucaucuuguuuuuaaagc

SEQ ID NO: 240632 - RNA, 22 nt, Human
uacuuacaugaauucaagagca

SEQ ID NO: 240633 - RNA, 22 nt, Human
cuuccucucuugcccauaagag

SEQ ID NO: 240634 - RNA, 22 nt, Human
aagcagaggaccgacggaggga

SEQ ID NO: 240635 - RNA, 22 nt, Human
gggcagcagcaggaggucucug

SEQ ID NO: 240636 - RNA, 22 nt, Human
aaccaaguuuauuccaaguuac

SEQ ID NO: 240637 - RNA, 22 nt, Human
aaauaaguaguuuaguguugug

SEQ ID NO: 240638 - RNA, 19 nt, Human
aaauacagcagcuguuucc

SEQ ID NO: 240639 - RNA, 18 nt, Human
guauuaguuuucagagag

SEQ ID NO: 240640 - RNA, 22 nt, Human
ggcaccaggggauguaaugucc

SEQ ID NO: 240641 - RNA, 22 nt, Human
gggaagcccugugcuugccugg

SEQ ID NO: 240642 - RNA, 22 nt, Human
gugcagggagcccagaaggucc

SEQ ID NO: 240643 - RNA, 22 nt, Human
uugaggaggaaaaggggguacc

SEQ ID NO: 240644 - RNA, 22 nt, Human
acacugaaugcuguuuagaaau

SEQ ID NO: 240645 - RNA, 22 nt, Human
gaccagaaaucaacacagaaug

SEQ ID NO: 240646 - RNA, 22 nt, Human
aguggcaucaaaucaagguuug

SEQ ID NO: 240647 - RNA, 22 nt, Human
gauaacuacacuuaagacaacc

SEQ ID NO: 240648 - RNA, 22 nt, Human
cugggggcagcaagaagccaug

SEQ ID NO: 240649 - RNA, 22 nt, Human
ucauuucagaugcauuuagaau

SEQ ID NO: 240650 - RNA, 22 nt, Human
aggugcaucucguagcucuucu

SEQ ID NO: 240651 - RNA, 22 nt, Human
agacauauuggcuugcuuuaau

SEQ ID NO: 240652 - RNA, 22 nt, Human
cauucaaauuaagauuuuguua

SEQ ID NO: 240653 - RNA, 22 nt, Human
ugcucuggacgcugagugguuu

SEQ ID NO: 240654 - RNA, 22 nt, Human
gggucaggccucaaggugggcu

SEQ ID NO: 240655 - RNA, 20 nt, Human
guccagaguaaugugcugac

SEQ ID NO: 240656 - RNA, 22 nt, Human
ggcugugggccagcuagacccu

SEQ ID NO: 240657 - RNA, 22 nt, Human
acgaugcucaacuauaugaauu

SEQ ID NO: 240658 - RNA, 23 nt, Human
ucuccuccuagauacagucaugg

SEQ ID NO: 240659 - RNA, 22 nt, Human
gcagagaggauauuauugucca

SEQ ID NO: 240660 - RNA, 21 nt, Human
gagaaucuguuuucuugucuu

SEQ ID NO: 240661 - RNA, 22 nt, Human
auaaaaguuuccaaucaugccu

SEQ ID NO: 240662 - RNA, 21 nt, Human
gcagugcagcuuggaggguag

SEQ ID NO: 240663 - RNA, 22 nt, Human
ucccuucaagauuuggggaaau

SEQ ID NO: 240664 - RNA, 22 nt, Human
guauucuuauacucagugagcu

SEQ ID NO: 240665 - RNA, 22 nt, Human
uguuugcucugacuaucuugcg

SEQ ID NO: 240666 - RNA, 22 nt, Human
aagggcugccagggggugccag

SEQ ID NO: 240667 - RNA, 22 nt, Human
guggcugguuuccugcaugcaa

SEQ ID NO: 240668 - RNA, 22 nt, Human
uagacucagacagaaaaugugu

SEQ ID NO: 240669 - RNA, 22 nt, Human
aggcuccaaauuaccaagcucu

SEQ ID NO: 240670 - RNA, 22 nt, Human
aaauuuucucucuaagacuuaa

SEQ ID NO: 240671 - RNA, 22 nt, Human
uaucaaaguuguccugugaagu

SEQ ID NO: 240672 - RNA, 22 nt, Human
guuauugagguggagucucacu

SEQ ID NO: 240673 - RNA, 22 nt, Human
auaaauaucacuguugucccuc

SEQ ID NO: 240674 - RNA, 22 nt, Human
uuugucuuggccucaguuuucu

SEQ ID NO: 240675 - RNA, 18 nt, Human
cuaaacugcaccuaauga

SEQ ID NO: 240676 - RNA, 22 nt, Human
gcaggcucuucuuucugcccag

SEQ ID NO: 240677 - RNA, 22 nt, Human
acuuuggaucugauguaaucag

SEQ ID NO: 240678 - RNA, 22 nt, Human
cauacaaucaaguucuuuauua

SEQ ID NO: 240679 - RNA, 22 nt, Human
acuucuauuggucaugauaaaa

SEQ ID NO: 240680 - RNA, 22 nt, Human
uccuucaacuuuuuacuugccc

SEQ ID NO: 240681 - RNA, 22 nt, Human
cucuuuggucgcaucauccauu

SEQ ID NO: 240682 - RNA, 22 nt, Human
ccagaggugguggugucuagaa

SEQ ID NO: 240683 - RNA, 22 nt, Human
guguggggccaggaucagggcu

SEQ ID NO: 240684 - RNA, 22 nt, Human
ucagaguuggccuuucuguauu

SEQ ID NO: 240685 - RNA, 22 nt, Human
aggagccccucuucaguccugg

SEQ ID NO: 240686 - RNA, 22 nt, Human
ggaggagagagguugcaaacac

SEQ ID NO: 240687 - RNA, 22 nt, Human
cugaagcaauugagagauguuu

SEQ ID NO: 240688 - RNA, 22 nt, Human
auccccagacuuuagauuucuc

SEQ ID NO: 240689 - RNA, 19 nt, Human
acagagcucucugcuucug

SEQ ID NO: 240690 - RNA, 22 nt, Human
aucucuggccuuccuuuuccaa

SEQ ID NO: 240691 - RNA, 22 nt, Human
ccugguggacagcagccagcag

SEQ ID NO: 240692 - RNA, 22 nt, Human
auauugagaugaggauauuaac

SEQ ID NO: 240693 - RNA, 22 nt, Human
aaugucaaacagagcagagcua

SEQ ID NO: 240694 - RNA, 22 nt, Human
uuuacugaacugcuaguacagg

SEQ ID NO: 240695 - RNA, 22 nt, Human
gagcugugacacgcagcccagg

SEQ ID NO: 240696 - RNA, 22 nt, Human
uacagugcuuuuugguggagaa

SEQ ID NO: 240697 - RNA, 22 nt, Human
uuaccaagcucugcauguuaag

SEQ ID NO: 240698 - RNA, 22 nt, Human
uauuuccuguggauacuuuuag

SEQ ID NO: 240699 - RNA, 22 nt, Human
ccuagaaugugcagacuuaggg

SEQ ID NO: 240700 - RNA, 22 nt, Human
uggccaggcuggucuggaacgc

SEQ ID NO: 240701 - RNA, 22 nt, Human
cacagcaggcacuauacagggc

SEQ ID NO: 240702 - RNA, 22 nt, Human
cugggaacuguacugccuugaa

SEQ ID NO: 240703 - RNA, 22 nt, Human
aggcagguguuaacccucugag

SEQ ID NO: 240704 - RNA, 22 nt, Human
aaacugaggaaugacagcauua

SEQ ID NO: 240705 - RNA, 22 nt, Human
aaggggauuuaagguaagaaga

SEQ ID NO: 240706 - RNA, 22 nt, Human
acuggcuggacucugaccucuu

SEQ ID NO: 240707 - RNA, 22 nt, Human
auggacagcaacuggaagcuuc

SEQ ID NO: 240708 - RNA, 22 nt, Human
caugugcagacggugggcugga

SEQ ID NO: 240709 - RNA, 22 nt, Human
uuggaggauggaguuagcaucu

SEQ ID NO: 240710 - RNA, 22 nt, Human
guguccagcguggaaugagggu

SEQ ID NO: 240711 - RNA, 22 nt, Human
cuccuucaugucauguguccgg

SEQ ID NO: 240712 - RNA, 22 nt, Human
uagcccucuccagcgaggucug

SEQ ID NO: 240713 - RNA, 22 nt, Human
uguggcugcagacacuggagcc

SEQ ID NO: 240714 - RNA, 22 nt, Human
auauaauuuuugguuagcucaa

SEQ ID NO: 240715 - RNA, 22 nt, Human
uaacaacuggacaauguugcuc

SEQ ID NO: 240716 - RNA, 22 nt, Human
guccaggcugaccccuagagga

SEQ ID NO: 240717 - RNA, 22 nt, Human
uauuuaauuagugauuguagag

SEQ ID NO: 240718 - RNA, 22 nt, Human
uuucaaggauguuauauaaaug

SEQ ID NO: 240719 - RNA, 22 nt, Human
guggaagggacugccuagagga

SEQ ID NO: 240720 - RNA, 22 nt, Human
cuccugaguaguagcauuguca

SEQ ID NO: 240721 - RNA, 22 nt, Human
aaaggcuuuaaagaaccagaac

SEQ ID NO: 240722 - RNA, 22 nt, Human
uacaugaauguuucaauauugu

SEQ ID NO: 240723 - RNA, 22 nt, Human
ugaauaaucuuggguauuaaua

SEQ ID NO: 240724 - RNA, 22 nt, Human
acagaaauugcuaauagcucau

SEQ ID NO: 240725 - RNA, 22 nt, Human
gcaaagcugggugugaaugcac

SEQ ID NO: 240726 - RNA, 22 nt, Human
agcuacagucggaaggacagac

SEQ ID NO: 240727 - RNA, 22 nt, Human
cagaacugagucucauggccau

SEQ ID NO: 240728 - RNA, 22 nt, Human
auccuggguaaguuccuuuuaa

SEQ ID NO: 240729 - RNA, 22 nt, Human
gaaaggcuucuuaagcuucacu

SEQ ID NO: 240730 - RNA, 22 nt, Human
cugaggagaugggcuuuuuagg

SEQ ID NO: 240731 - RNA, 22 nt, Human
uguacuuaugagauccuagucg

SEQ ID NO: 240732 - RNA, 21 nt, Human
cggcuucugcauuccagagcu

SEQ ID NO: 240733 - RNA, 22 nt, Human
gagugagggcagcaggggcugc

SEQ ID NO: 240734 - RNA, 18 nt, Human
ucagagguacagaaaagu

SEQ ID NO: 240735 - RNA, 21 nt, Human
cagcccagagcaguggggcca

SEQ ID NO: 240736 - RNA, 22 nt, Human
uggcuccugcauuugugcuaac

SEQ ID NO: 240737 - RNA, 18 nt, Human
ugcccaccagaagaggga

SEQ ID NO: 240738 - RNA, 22 nt, Human
uggcagggccuaccccaauauc

SEQ ID NO: 240739 - RNA, 21 nt, Human
ugacuuuauuugacagcccag

SEQ ID NO: 240740 - RNA, 22 nt, Human
acuuggcuuuaguaguaacuga

SEQ ID NO: 240741 - RNA, 22 nt, Human
ccaugcugacccugugcaggca

SEQ ID NO: 240742 - RNA, 19 nt, Human
ggccagcugucuccugcua

SEQ ID NO: 240743 - RNA, 22 nt, Human
ggcaugggguguauguggcacg

SEQ ID NO: 240744 - RNA, 19 nt, Human
uauugguaugugugaggca

SEQ ID NO: 240745 - RNA, 22 nt, Human
ccugcagagccacgugccagcg

SEQ ID NO: 240746 - RNA, 22 nt, Human
uuucugaagguuaaggaauuag

SEQ ID NO: 240747 - RNA, 22 nt, Human
ccagguggcuucugcccgaugu

SEQ ID NO: 240748 - RNA, 20 nt, Human
gcuggugggggcuugacaug

SEQ ID NO: 240749 - RNA, 20 nt, Human
uuuuccucguguuuguucua

SEQ ID NO: 240750 - RNA, 20 nt, Human
ggagcugcccugggcuggag

SEQ ID NO: 240751 - RNA, 22 nt, Human
acuugaauuauauuucuagaga

SEQ ID NO: 240752 - RNA, 22 nt, Human
gagaauguuaauguugaaguau

SEQ ID NO: 240753 - RNA, 22 nt, Human
uugguuuguucaccaucaagca

SEQ ID NO: 240754 - RNA, 22 nt, Human
cacacaugugggauccgcaggg

SEQ ID NO: 240755 - RNA, 22 nt, Human
ugcagagagccagcucucucgg

SEQ ID NO: 240756 - RNA, 22 nt, Human
gccagcugaagggaagcuccug

SEQ ID NO: 240757 - RNA, 22 nt, Human
guacaugucaaaaaaugcauaa

SEQ ID NO: 240758 - RNA, 22 nt, Human
uccaggagugauaaggccacug

SEQ ID NO: 240759 - RNA, 22 nt, Human
aucuuugggcaaugaugaggga

SEQ ID NO: 240760 - RNA, 22 nt, Human
ccucuguacagccucuuuauug

SEQ ID NO: 240761 - RNA, 23 nt, Human
uuuugacaggaggaagguguuga

SEQ ID NO: 240762 - RNA, 22 nt, Human
cagagacuggagugcaguggcg

SEQ ID NO: 240763 - RNA, 22 nt, Human
agugaggcaaagugagaggcag

SEQ ID NO: 240764 - RNA, 22 nt, Human
gcugugcuuuugguagauccca

SEQ ID NO: 240765 - RNA, 22 nt, Human
ucaauucuaguggagagaguuu

SEQ ID NO: 240766 - RNA, 22 nt, Human
ugacagacacaccuuaggaaag

SEQ ID NO: 240767 - RNA, 22 nt, Human
cugugacccaguuccuggcacc

SEQ ID NO: 240768 - RNA, 22 nt, Human
uguuuacuuaaauguuuucaua

SEQ ID NO: 240769 - RNA, 22 nt, Human
agguucucacacgucuacaccc

SEQ ID NO: 240770 - RNA, 22 nt, Human
uucagagcccaaauggagauua

SEQ ID NO: 240771 - RNA, 22 nt, Human
uggagccuguucugagaagccg

SEQ ID NO: 240772 - RNA, 22 nt, Human
guuuaacaucugugaagcugcu

SEQ ID NO: 240773 - RNA, 19 nt, Human
gcucagagggcccugugcu

SEQ ID NO: 240774 - RNA, 22 nt, Human
gaugaauucuggcuuggacaga

SEQ ID NO: 240775 - RNA, 22 nt, Human
ugauuugcgucucauuugaaau

SEQ ID NO: 240776 - RNA, 22 nt, Human
cugagcagucugacucaagcua

SEQ ID NO: 240777 - RNA, 22 nt, Human
aucuacaacaucacauggcauu

SEQ ID NO: 240778 - RNA, 23 nt, Human
uccuuccuuugagaggcuccauc

SEQ ID NO: 240779 - RNA, 22 nt, Human
gggcacugacagggucccaacu

SEQ ID NO: 240780 - RNA, 22 nt, Human
caguaacagugaucaccugugg

SEQ ID NO: 240781 - RNA, 22 nt, Human
ccccaggccuguuggauggcgc

SEQ ID NO: 240782 - RNA, 22 nt, Human
gugcaaacaucauagaguguac

SEQ ID NO: 240783 - RNA, 22 nt, Human
uagggcugcugcagaugacagg

SEQ ID NO: 240784 - RNA, 22 nt, Human
ggucugagugggcaggggccgg

SEQ ID NO: 240785 - RNA, 22 nt, Human
gcccuguguguuugcacugauu

SEQ ID NO: 240786 - RNA, 18 nt, Human
ccugaagccugugucuuu

SEQ ID NO: 240787 - RNA, 22 nt, Human
uaaauguguaaaccuccauuac

SEQ ID NO: 240788 - RNA, 22 nt, Human
agcugccugccaugccgcuggu

SEQ ID NO: 240789 - RNA, 22 nt, Human
ucuccaggugcuaagugugccu

SEQ ID NO: 240790 - RNA, 22 nt, Human
cugcaaggcugaauucagcuga

SEQ ID NO: 240791 - RNA, 22 nt, Human
aaggaagacacagaugaaguga

SEQ ID NO: 240792 - RNA, 22 nt, Human
acagauguacacucauauauaa

SEQ ID NO: 240793 - RNA, 22 nt, Human
uccaggccucuagcccucucuu

SEQ ID NO: 240794 - RNA, 22 nt, Human
ggcucuggcguccaauggagcg

SEQ ID NO: 240795 - RNA, 22 nt, Human
ggcuuccuggagaaggucugag

SEQ ID NO: 240796 - RNA, 22 nt, Human
acaauucugaugguuucccagu

SEQ ID NO: 240797 - RNA, 22 nt, Human
ucuccagaguaaccuuggagca

SEQ ID NO: 240798 - RNA, 22 nt, Human
gaacuuuaaaacaaaguacagu

SEQ ID NO: 240799 - RNA, 22 nt, Human
uuucacaaugcaauccuacuuc

SEQ ID NO: 240800 - RNA, 22 nt, Human
cuggcagguuuggugucuggug

SEQ ID NO: 240801 - RNA, 22 nt, Human
aagaaacuguugcgugacagcg

SEQ ID NO: 240802 - RNA, 22 nt, Human
gcucugaggcugggagcacucu

SEQ ID NO: 240803 - RNA, 22 nt, Human
acaaacuucccagacaagcucc

SEQ ID NO: 240804 - RNA, 22 nt, Human
agucuucagcagccuucucagg

SEQ ID NO: 240805 - RNA, 22 nt, Human
ucuguugacuccuagcagccau

SEQ ID NO: 240806 - RNA, 22 nt, Human
aaagcuauuuauuacagagaau

SEQ ID NO: 240807 - RNA, 22 nt, Human
gaagcaguagauuccuacucau

SEQ ID NO: 240808 - RNA, 16 nt, Human
cucuuuggcuuccaag

SEQ ID NO: 240809 - RNA, 22 nt, Human
uucugguuacauuguuacagcu

SEQ ID NO: 240810 - RNA, 22 nt, Human
accaggccuggcugggcagcca

SEQ ID NO: 240811 - RNA, 22 nt, Human
ugggagcacucuuugggaagca

SEQ ID NO: 240812 - RNA, 22 nt, Human
caggcucgguccaguggcaccc

SEQ ID NO: 240813 - RNA, 21 nt, Human
aaacugaggcuucaagcagug

SEQ ID NO: 240814 - RNA, 22 nt, Human
uuggcucugaaacccaagcucu

SEQ ID NO: 240815 - RNA, 22 nt, Human
uguaucauauggggaagcuuca

SEQ ID NO: 240816 - RNA, 22 nt, Human
aagucacagaacccauuguaac

SEQ ID NO: 240817 - RNA, 22 nt, Human
aagucuggggagaaaaggcuaa

SEQ ID NO: 240818 - RNA, 22 nt, Human
uacaaugagcuguacaucucca

SEQ ID NO: 240819 - RNA, 22 nt, Human
aguugcuggcaccugugaguau

SEQ ID NO: 240820 - RNA, 22 nt, Human
uuugacauuggcuuauucuguu

SEQ ID NO: 240821 - RNA, 21 nt, Human
ugacauuuaguagcauuguca

SEQ ID NO: 240822 - RNA, 22 nt, Human
uuacauuuugggguaaggauaa

SEQ ID NO: 240823 - RNA, 22 nt, Human
ccucagaggcagaugguaagaa

SEQ ID NO: 240824 - RNA, 22 nt, Human
agggaccagggguagcugagau

SEQ ID NO: 240825 - RNA, 22 nt, Human
gcuggaguuagaacuagccugg

SEQ ID NO: 240826 - RNA, 22 nt, Human
aagggcugagcacagugagcca

SEQ ID NO: 240827 - RNA, 22 nt, Human
cuggaggagcaauaugguuagg

SEQ ID NO: 240828 - RNA, 22 nt, Human
gagucaggcuagaggugagucu

SEQ ID NO: 240829 - RNA, 22 nt, Human
caaaucuaggaugcauguagug

SEQ ID NO: 240830 - RNA, 22 nt, Human
ccaggcuucccccauccuagga

SEQ ID NO: 240831 - RNA, 22 nt, Human
uuauuugaaugauggcacaauu

SEQ ID NO: 240832 - RNA, 22 nt, Human
ucuuuggaaugcuagcauucua

SEQ ID NO: 240833 - RNA, 22 nt, Human
ucugucugaggaguuuuugacc

SEQ ID NO: 240834 - RNA, 22 nt, Human
ugaccauuugaucuacauucca

SEQ ID NO: 240835 - RNA, 22 nt, Human
uacuuucaguuucagcugaagu

SEQ ID NO: 240836 - RNA, 22 nt, Human
ucauguuuggaguuugcucacu

SEQ ID NO: 240837 - RNA, 22 nt, Human
ucuggcccagccccugagguca

SEQ ID NO: 240838 - RNA, 22 nt, Human
agggccucuggaacacugaggg

SEQ ID NO: 240839 - RNA, 22 nt, Human
gucagagcuggaggcaaguucu

SEQ ID NO: 240840 - RNA, 22 nt, Human
gcugggucccaagccuggggag

SEQ ID NO: 240841 - RNA, 23 nt, Human
acagcaagaggaccagaugugag

SEQ ID NO: 240842 - RNA, 22 nt, Human
ugcuuuauaggggauugcaggc

SEQ ID NO: 240843 - RNA, 22 nt, Human
uggcaaagauuaccacaucuac

SEQ ID NO: 240844 - RNA, 22 nt, Human
uggcaaagaccgcaauuacuuu

SEQ ID NO: 240845 - RNA, 22 nt, Human
gcagcuuuguggagaggcccau

SEQ ID NO: 240846 - RNA, 22 nt, Human
cagaggaagggugcugcgaaag

SEQ ID NO: 240847 - RNA, 22 nt, Human
gaggcugaggguuagagaguca

SEQ ID NO: 240848 - RNA, 22 nt, Human
accuagaaacugacagaauauu

SEQ ID NO: 240849 - RNA, 22 nt, Human
aaaaguuagcuauuaguaggug

SEQ ID NO: 240850 - RNA, 22 nt, Human
ccagguggacggcgaguacagg

SEQ ID NO: 240851 - RNA, 22 nt, Human
ccagaauaggaguaauaaaacc

SEQ ID NO: 240852 - RNA, 22 nt, Human
cagggcucgcucuugcccuucg

SEQ ID NO: 240853 - RNA, 22 nt, Human
ggcucagaguuaggacccaugu

SEQ ID NO: 240854 - RNA, 22 nt, Human
ggaacagggauuuggccugguu

SEQ ID NO: 240855 - RNA, 21 nt, Human
aaguuuuauguugccauuugu

SEQ ID NO: 240856 - RNA, 22 nt, Human
acaguuauuuucccagcauuua

SEQ ID NO: 240857 - RNA, 22 nt, Human
gcuucacagaaucaauaguugg

SEQ ID NO: 240858 - RNA, 22 nt, Human
aaguacagaaauagcaggugca

SEQ ID NO: 240859 - RNA, 22 nt, Human
ucuuuauaaaagucauuauguc

SEQ ID NO: 240860 - RNA, 22 nt, Human
auaugcaagcacauagaauacu

SEQ ID NO: 240861 - RNA, 19 nt, Human
gcuuccagcacugcaggag

SEQ ID NO: 240862 - RNA, 22 nt, Human
ucagggaguguuggcaggauca

SEQ ID NO: 240863 - RNA, 22 nt, Human
ucugugcucaaguucugccucu

SEQ ID NO: 240864 - RNA, 22 nt, Human
aagacaauuuugaguaugcaca

SEQ ID NO: 240865 - RNA, 22 nt, Human
uagauggaggcuagaugcaggg

SEQ ID NO: 240866 - RNA, 22 nt, Human
ucacacauuguugcuuaaguug

SEQ ID NO: 240867 - RNA, 23 nt, Human
ugagcugggccugcaggggucuc

SEQ ID NO: 240868 - RNA, 22 nt, Human
ucugggcagcagcagcuaguag

SEQ ID NO: 240869 - RNA, 22 nt, Human
uaccauuauucacaugaucuuu

SEQ ID NO: 240870 - RNA, 22 nt, Human
aaauuacagccuuggguagcuu

SEQ ID NO: 240871 - RNA, 22 nt, Human
uggccagugccugccagugcag

SEQ ID NO: 240872 - RNA, 22 nt, Human
cagaugaacuaggcugcacuug

SEQ ID NO: 240873 - RNA, 22 nt, Human
agaggcaccaucuggaacagcc

SEQ ID NO: 240874 - RNA, 22 nt, Human
uccaggauugcaggugcacaac

SEQ ID NO: 240875 - RNA, 22 nt, Human
aggccacagccugggaggugac

SEQ ID NO: 240876 - RNA, 22 nt, Human
auauaacucuuguucuuauagu

SEQ ID NO: 240877 - RNA, 22 nt, Human
uuaaauauuuucagcaggguca

SEQ ID NO: 240878 - RNA, 22 nt, Human
uggaacuaagguagaaacuauu

SEQ ID NO: 240879 - RNA, 22 nt, Human
ucuuugaucagccuuucacuga

SEQ ID NO: 240880 - RNA, 22 nt, Human
acaguguggugauggcacuugc

SEQ ID NO: 240881 - RNA, 22 nt, Human
augggaggaagagaagaugucu

SEQ ID NO: 240882 - RNA, 22 nt, Human
agugcauuauauguuucaaugg

SEQ ID NO: 240883 - RNA, 22 nt, Human
aagagggcagcacagguggguc

SEQ ID NO: 240884 - RNA, 22 nt, Human
uacaggacagauguuuacagga

SEQ ID NO: 240885 - RNA, 22 nt, Human
aggucagaaaaggagagcauug

SEQ ID NO: 240886 - RNA, 22 nt, Human
caggcugcagaggccuuucaug

SEQ ID NO: 240887 - RNA, 22 nt, Human
uuuucuuccuggauuuuggcau

SEQ ID NO: 240888 - RNA, 22 nt, Human
cucuccaggggaacauuguucc

SEQ ID NO: 240889 - RNA, 22 nt, Human
acacugcagaugaaagcauaag

SEQ ID NO: 240890 - RNA, 22 nt, Human
ucugaaauaggcuucuuuuggu

SEQ ID NO: 240891 - RNA, 22 nt, Human
ugacaaaacugcaauuacuuuu

SEQ ID NO: 240892 - RNA, 22 nt, Human
acagacaucaucaacaucuucc

SEQ ID NO: 240893 - RNA, 22 nt, Human
uuaagacacauuucucagacgg

SEQ ID NO: 240894 - RNA, 22 nt, Human
uggcaguuauauugccuuaggg

SEQ ID NO: 240895 - RNA, 22 nt, Human
cugcagggugacguugcccacc

SEQ ID NO: 240896 - RNA, 22 nt, Human
caccagcuacagacuacugugu

SEQ ID NO: 240897 - RNA, 22 nt, Human
cuggagaguuggaagauggacu

SEQ ID NO: 240898 - RNA, 22 nt, Human
ugucuucaggaguaaauaucau

SEQ ID NO: 240899 - RNA, 22 nt, Human
cacccccaggagcuccagggac

SEQ ID NO: 240900 - RNA, 22 nt, Human
ugucgggcaugcauucugagaa

SEQ ID NO: 240901 - RNA, 22 nt, Human
ucuguuuuagauaagaaaggcu

SEQ ID NO: 240902 - RNA, 19 nt, Human
ucagcucuggggucagugg

SEQ ID NO: 240903 - RNA, 22 nt, Human
ggacagcucugccaggagcuca

SEQ ID NO: 240904 - RNA, 22 nt, Human
auuugcauaauagugauuugua

SEQ ID NO: 240905 - RNA, 22 nt, Human
aaugcuaaaacacagauuuuug

SEQ ID NO: 240906 - RNA, 22 nt, Human
ugucaucuuguccagccaggca

SEQ ID NO: 240907 - RNA, 22 nt, Human
gagggggcgaacagaagcaagg

SEQ ID NO: 240908 - RNA, 22 nt, Human
agaggccucccucccagcuggu

SEQ ID NO: 240909 - RNA, 22 nt, Human
aaguucaaggcucuagaguucc

SEQ ID NO: 240910 - RNA, 22 nt, Human
caugccauuuuucuagauugag

SEQ ID NO: 240911 - RNA, 20 nt, Human
aaacauucauguacaaguga

SEQ ID NO: 240912 - RNA, 22 nt, Human
uagggaugggagauucucaaac

SEQ ID NO: 240913 - RNA, 20 nt, Human
gaagacacagaguucaucuc

SEQ ID NO: 240914 - RNA, 22 nt, Human
caagggcagauagcugguccaa

SEQ ID NO: 240915 - RNA, 22 nt, Human
uggcacagacugggccaaggaa

SEQ ID NO: 240916 - RNA, 22 nt, Human
gagcuugguguuauuucugugg

SEQ ID NO: 240917 - RNA, 22 nt, Human
auauuucuggggguguguuucu

SEQ ID NO: 240918 - RNA, 22 nt, Human
uccuggcuccagcagcucuucc

SEQ ID NO: 240919 - RNA, 22 nt, Human
uggaaacuauaaaagcaccuuc

SEQ ID NO: 240920 - RNA, 22 nt, Human
ggaacaguagacgaucuccuuu

SEQ ID NO: 240921 - RNA, 22 nt, Human
gaaaugaacugauuaucauugc

SEQ ID NO: 240922 - RNA, 22 nt, Human
ucuguccucuuugaagcugcuc

SEQ ID NO: 240923 - RNA, 22 nt, Human
gaggaggcuaagugggcucugg

SEQ ID NO: 240924 - RNA, 22 nt, Human
uacauuccauguguguguauuc

SEQ ID NO: 240925 - RNA, 22 nt, Human
caggcaccccaggugagcacug

SEQ ID NO: 240926 - RNA, 20 nt, Human
cugcugcccugucagccucu

SEQ ID NO: 240927 - RNA, 22 nt, Human
uacagagaauaauaggacaggu

SEQ ID NO: 240928 - RNA, 22 nt, Human
gaacugaagacuuuuacuguac

SEQ ID NO: 240929 - RNA, 22 nt, Human
guucucugccggcaccuacccg

SEQ ID NO: 240930 - RNA, 22 nt, Human
auggcuggugauacuggaguga

SEQ ID NO: 240931 - RNA, 22 nt, Human
auggguuucccucugaaauuau

SEQ ID NO: 240932 - RNA, 22 nt, Human
gcaggcaguuugcuuuucccuc

SEQ ID NO: 240933 - RNA, 20 nt, Human
uguauuacuuggucuuacaa

SEQ ID NO: 240934 - RNA, 22 nt, Human
guaucuuuccacaucuucagua

SEQ ID NO: 240935 - RNA, 22 nt, Human
agcuggcauugcagggagcugc

SEQ ID NO: 240936 - RNA, 22 nt, Human
ccucaggauacaggagccacag

SEQ ID NO: 240937 - RNA, 22 nt, Human
cccagguccccaccugucugcu

SEQ ID NO: 240938 - RNA, 22 nt, Human
gcaggaguggagaccaugggga

SEQ ID NO: 240939 - RNA, 22 nt, Human
gcugaagauaggcauuucagca

SEQ ID NO: 240940 - RNA, 22 nt, Human
uagggcucagcucuagcuccug

SEQ ID NO: 240941 - RNA, 22 nt, Human
ggcuuuaugcagggauagaaau

SEQ ID NO: 240942 - RNA, 22 nt, Human
cagacucucuuccaugcaucac

SEQ ID NO: 240943 - RNA, 22 nt, Human
ucagaguauuucauucuuaggu

SEQ ID NO: 240944 - RNA, 20 nt, Human
agcuccucaucacuggaggu

SEQ ID NO: 240945 - RNA, 22 nt, Human
agcugaggaggaaugaugggua

SEQ ID NO: 240946 - RNA, 22 nt, Human
auucuucaccauggauaauuug

SEQ ID NO: 240947 - RNA, 22 nt, Human
gaggggaguguccuccgggccc

SEQ ID NO: 240948 - RNA, 20 nt, Human
ugagcuucagauaucgugca

SEQ ID NO: 240949 - RNA, 21 nt, Human
uucuccagggggagcucucuc

SEQ ID NO: 240950 - RNA, 22 nt, Human
guuggcaaguguuccuuccucu

SEQ ID NO: 240951 - RNA, 20 nt, Human
ggguccugacuuggucuccu

SEQ ID NO: 240952 - RNA, 21 nt, Human
gcagagcuggaaccaggaccc

SEQ ID NO: 240953 - RNA, 22 nt, Human
uugaaauuuuaggccuugcaau

SEQ ID NO: 240954 - RNA, 22 nt, Human
ucuaauccuugcuaccugggug

SEQ ID NO: 240955 - RNA, 22 nt, Human
uggcugugggaugagagccuca

SEQ ID NO: 240956 - RNA, 22 nt, Human
gagccagaaaagcugccugacu

SEQ ID NO: 240957 - RNA, 22 nt, Human
cuccccuuuggaagaagggucu

SEQ ID NO: 240958 - RNA, 22 nt, Human
uuccccuugggcuguggaggag

SEQ ID NO: 240959 - RNA, 22 nt, Human
aggcucugugauccacaaugag

SEQ ID NO: 240960 - RNA, 22 nt, Human
ugucuggcauaguugcucccug

SEQ ID NO: 240961 - RNA, 22 nt, Human
agcagcagagcucuggucugca

SEQ ID NO: 240962 - RNA, 21 nt, Human
gcucagcaaaggugaggugca

SEQ ID NO: 240963 - RNA, 22 nt, Human
ccugcaccuucaagaaaauaau

SEQ ID NO: 240964 - RNA, 22 nt, Human
caaauauuccagguacaucccu

SEQ ID NO: 240965 - RNA, 22 nt, Human
gcccgugugcagagugggagcu

SEQ ID NO: 240966 - RNA, 22 nt, Human
caggcugacaacugagcauuuu

SEQ ID NO: 240967 - RNA, 23 nt, Human
ucaaacagguuucagagcaucuu

SEQ ID NO: 240968 - RNA, 22 nt, Human
ugggccaguucuuuacucgucc

SEQ ID NO: 240969 - RNA, 22 nt, Human
gucucagggcugagggcagugg

SEQ ID NO: 240970 - RNA, 20 nt, Human
accagagacuggggacaagu

SEQ ID NO: 240971 - RNA, 22 nt, Human
gacauaauaaucugaccuagau

SEQ ID NO: 240972 - RNA, 22 nt, Human
caaaauuagggagugagcugga

SEQ ID NO: 240973 - RNA, 22 nt, Human
aauucuucaagugcuuuggaga

SEQ ID NO: 240974 - RNA, 22 nt, Human
acuaugauguauuuugcaucua

SEQ ID NO: 240975 - RNA, 22 nt, Human
augauguugauaaauuacuuua

SEQ ID NO: 240976 - RNA, 21 nt, Human
agcugcuuucagcuccuagag

SEQ ID NO: 240977 - RNA, 22 nt, Human
aucauuccacauguaccacuag

SEQ ID NO: 240978 - RNA, 22 nt, Human
acaacaaaaucacuagucuucc

SEQ ID NO: 240979 - RNA, 22 nt, Human
uggcugcugagaaggcagcugu

SEQ ID NO: 240980 - RNA, 22 nt, Human
auuuaauaccacuuggugcuuu

SEQ ID NO: 240981 - RNA, 22 nt, Human
uuacagugaagauucagguucc

SEQ ID NO: 240982 - RNA, 22 nt, Human
uucaaagcaagacacaauuccu

SEQ ID NO: 240983 - RNA, 22 nt, Human
acauguggguuuuauuuugcau

SEQ ID NO: 240984 - RNA, 22 nt, Human
ugcuccugcuggcccucgugcc

SEQ ID NO: 240985 - RNA, 22 nt, Human
uugcuagcugguguaugcauug

SEQ ID NO: 240986 - RNA, 22 nt, Human
gagucuggucauuuucucuccc

SEQ ID NO: 240987 - RNA, 22 nt, Human
gacaccauuaccuuucuauauu

SEQ ID NO: 240988 - RNA, 22 nt, Human
agaaggccaugucuugguacuu

SEQ ID NO: 240989 - RNA, 23 nt, Human
agcaccauuacaguuugauuggg

SEQ ID NO: 240990 - RNA, 22 nt, Human
ggugggugcagggggcuucuua

SEQ ID NO: 240991 - RNA, 22 nt, Human
agucuuuuauucaaggcuaagu

SEQ ID NO: 240992 - RNA, 17 nt, Human
guguucacaaugacugu

SEQ ID NO: 240993 - RNA, 19 nt, Human
accagcccacucccaguuu

SEQ ID NO: 240994 - RNA, 22 nt, Human
cugcugucaaaaaucacuccau

SEQ ID NO: 240995 - RNA, 22 nt, Human
uggcaguagauccagucucucu

SEQ ID NO: 240996 - RNA, 22 nt, Human
ucaggcugaaggaggccuaucu

SEQ ID NO: 240997 - RNA, 22 nt, Human
ggaccugcccuggcucagaugc

SEQ ID NO: 240998 - RNA, 22 nt, Human
agagucuuccaggcagccugag

SEQ ID NO: 240999 - RNA, 22 nt, Human
cucaggaggugguagaggcccu

SEQ ID NO: 241000 - RNA, 22 nt, Human
gcugagguuucaggaguggcag

SEQ ID NO: 241001 - RNA, 23 nt, Human
ccuggcugaccugaagguguagu

SEQ ID NO: 241002 - RNA, 22 nt, Human
ugaaggcacguggguggauacu

SEQ ID NO: 241003 - RNA, 22 nt, Human
gacagcagacagccuggccccu

SEQ ID NO: 241004 - RNA, 22 nt, Human
gugcucagggccuggcugggga

SEQ ID NO: 241005 - RNA, 22 nt, Human
ucuagagaaguuuccuuuugaa

SEQ ID NO: 241006 - RNA, 22 nt, Human
uuucucauggaacauagcuccu

SEQ ID NO: 241007 - RNA, 22 nt, Human
ucagaugcuagggcugagcuau

SEQ ID NO: 241008 - RNA, 22 nt, Human
gcugccagucuaaugggaaaca

SEQ ID NO: 241009 - RNA, 22 nt, Human
aggugcaccugagggugucauc

SEQ ID NO: 241010 - RNA, 22 nt, Human
uaguuugagaauugaaauagaa

SEQ ID NO: 241011 - RNA, 22 nt, Human
ccagaccuaaccagcuuuugua

SEQ ID NO: 241012 - RNA, 22 nt, Human
ggcugcugcuguguaggccugu

SEQ ID NO: 241013 - RNA, 22 nt, Human
auguagagcuccuugauccucc

SEQ ID NO: 241014 - RNA, 22 nt, Human
ucuguucagaauuguaacacuc

SEQ ID NO: 241015 - RNA, 22 nt, Human
gaacaccuggguccccuggggc

SEQ ID NO: 241016 - RNA, 22 nt, Human
caggugguuguuuggauucuaa

SEQ ID NO: 241017 - RNA, 19 nt, Human
ccuccugcuagauaugcaa

SEQ ID NO: 241018 - RNA, 22 nt, Human
uccaggagggauugggcugugg

SEQ ID NO: 241019 - RNA, 22 nt, Human
ggcacugagcugccuuggggca

SEQ ID NO: 241020 - RNA, 22 nt, Human
uacccagaagauugucagcaaa

SEQ ID NO: 241021 - RNA, 22 nt, Human
uagcagggagggccagugucaa

SEQ ID NO: 241022 - RNA, 22 nt, Human
cuccaguggugauggggaagaa

SEQ ID NO: 241023 - RNA, 22 nt, Human
gccacaggucggcuagaggguc

SEQ ID NO: 241024 - RNA, 22 nt, Human
uugaaaucaccacuagcauuug

SEQ ID NO: 241025 - RNA, 22 nt, Human
gcacccagggacuuggcuggcc

SEQ ID NO: 241026 - RNA, 22 nt, Human
acaagugugugcaguuuguaaa

SEQ ID NO: 241027 - RNA, 22 nt, Human
gcuacugauugaccuuggagag

SEQ ID NO: 241028 - RNA, 22 nt, Human
gccucagggauaggaugagcau

SEQ ID NO: 241029 - RNA, 22 nt, Human
uuucugaagauacagcuuugcu

SEQ ID NO: 241030 - RNA, 22 nt, Human
gggaugaggaucaaucagggag

SEQ ID NO: 241031 - RNA, 22 nt, Human
agaaagcacgggccccaggcuc

SEQ ID NO: 241032 - RNA, 22 nt, Human
cagugggaaagugaagagcauu

SEQ ID NO: 241033 - RNA, 22 nt, Human
gugggagcccucagggaggugc

SEQ ID NO: 241034 - RNA, 22 nt, Human
caagaagugucagcuuuuuaaa

SEQ ID NO: 241035 - RNA, 22 nt, Human
uaaaaucagccgaccauggugg

SEQ ID NO: 241036 - RNA, 22 nt, Human
uuugugcagauguauauuugug

SEQ ID NO: 241037 - RNA, 22 nt, Human
acucuuuagagguacaucucuu

SEQ ID NO: 241038 - RNA, 21 nt, Human
ccaggguccagcugccauggu

SEQ ID NO: 241039 - RNA, 22 nt, Human
acaguaauauugaugcucguca

SEQ ID NO: 241040 - RNA, 22 nt, Human
gcugccuuagagggagugguuc

SEQ ID NO: 241041 - RNA, 15 nt, Human
uacauucauuuccac

SEQ ID NO: 241042 - RNA, 22 nt, Human
cuucucuggcauagcaagcagg

SEQ ID NO: 241043 - RNA, 22 nt, Human
gucccaggugggcuccaccucu

SEQ ID NO: 241044 - RNA, 22 nt, Human
agaguggcagcaagucagguag

SEQ ID NO: 241045 - RNA, 22 nt, Human
acagugcaaacuuuugucuccu

SEQ ID NO: 241046 - RNA, 22 nt, Human
aucccccucuuggauggcggca

SEQ ID NO: 241047 - RNA, 22 nt, Human
uuuuggaugagcccagauuucu

SEQ ID NO: 241048 - RNA, 22 nt, Human
cugcuggggucagagcacuggg

SEQ ID NO: 241049 - RNA, 19 nt, Human
ggaagcccugggucagagc

SEQ ID NO: 241050 - RNA, 20 nt, Human
ucauggcagccacccacagg

SEQ ID NO: 241051 - RNA, 22 nt, Human
aguuuuauguucacagaaggau

SEQ ID NO: 241052 - RNA, 22 nt, Human
agcuuagaauguguuaggaaag

SEQ ID NO: 241053 - RNA, 22 nt, Human
aguguacauaguuaggaacauc

SEQ ID NO: 241054 - RNA, 22 nt, Human
ugguccagacuuugaccucuca

SEQ ID NO: 241055 - RNA, 22 nt, Human
aguagaaauguaagaaggauua

SEQ ID NO: 241056 - RNA, 22 nt, Human
uucucucuuacugccaugcugu

SEQ ID NO: 241057 - RNA, 22 nt, Human
cuggccacaacuagcccaggac

SEQ ID NO: 241058 - RNA, 22 nt, Human
aacaucacaauuucauuuaugc

SEQ ID NO: 241059 - RNA, 23 nt, Human
uggaccugaaccagugccucugu

SEQ ID NO: 241060 - RNA, 22 nt, Human
agacagacuguguuugaauccu

SEQ ID NO: 241061 - RNA, 22 nt, Human
gugcccaggugucccugagaag

SEQ ID NO: 241062 - RNA, 22 nt, Human
agaggccagguccagaguuugu

SEQ ID NO: 241063 - RNA, 22 nt, Human
ucuaaagaagaggguucugcgg

SEQ ID NO: 241064 - RNA, 22 nt, Human
caggaagugcucgcugugggga

SEQ ID NO: 241065 - RNA, 22 nt, Human
ugcuauuuggaaaagcauuugg

SEQ ID NO: 241066 - RNA, 22 nt, Human
uuacagaaggaacacuacucag

SEQ ID NO: 241067 - RNA, 22 nt, Human
ugggcaggcaagugaauaccuu

SEQ ID NO: 241068 - RNA, 22 nt, Human
uauauuaccugccugaucuaua

SEQ ID NO: 241069 - RNA, 22 nt, Human
agaaggcuggccauggugcccu

SEQ ID NO: 241070 - RNA, 22 nt, Human
cugagggcuggagcugaggccu

SEQ ID NO: 241071 - RNA, 22 nt, Human
uucuucuuaauguccugggaac

SEQ ID NO: 241072 - RNA, 22 nt, Human
cucacccauaucuccaugacuc

SEQ ID NO: 241073 - RNA, 22 nt, Human
acaacagagcuggacugagagg

SEQ ID NO: 241074 - RNA, 21 nt, Human
acucugaaaauuaauaguuau

SEQ ID NO: 241075 - RNA, 23 nt, Human
aagaguuuagagucuugcagagu

SEQ ID NO: 241076 - RNA, 22 nt, Human
acagggcagagaggcaggcuug

SEQ ID NO: 241077 - RNA, 22 nt, Human
ccagguguggggaggacucaca

SEQ ID NO: 241078 - RNA, 22 nt, Human
aggggcaggugcugcacuuaga

SEQ ID NO: 241079 - RNA, 22 nt, Human
cccuggcaaaaucccugguaca

SEQ ID NO: 241080 - RNA, 22 nt, Human
cugggagcaagucaggaaaggu

SEQ ID NO: 241081 - RNA, 22 nt, Human
cugucuggaaugcaguacauag

SEQ ID NO: 241082 - RNA, 22 nt, Human
aagcuugggaaccacgguaauc

SEQ ID NO: 241083 - RNA, 22 nt, Human
gaaggccacuuuguguugagaa

SEQ ID NO: 241084 - RNA, 22 nt, Human
aguguagaaggagaaauggauc

SEQ ID NO: 241085 - RNA, 22 nt, Human
gaauguaaaauugccuacaaga

SEQ ID NO: 241086 - RNA, 19 nt, Human
ccagcuggccugggaccuc

SEQ ID NO: 241087 - RNA, 22 nt, Human
cagagucuuguguguucagccc

SEQ ID NO: 241088 - RNA, 20 nt, Human
gccauccagccucccaggag

SEQ ID NO: 241089 - RNA, 20 nt, Human
cucuggcaaaggaugccuau

SEQ ID NO: 241090 - RNA, 17 nt, Human
guaaggcuugcagaugc

SEQ ID NO: 241091 - RNA, 22 nt, Human
cagcaucucugcacccuccccc

SEQ ID NO: 241092 - RNA, 22 nt, Human
cuguuggccuuucaucaguaau

SEQ ID NO: 241093 - RNA, 22 nt, Human
uugacacaguuuucucauuaag

SEQ ID NO: 241094 - RNA, 22 nt, Human
agucucuuggcauucugaaaca

SEQ ID NO: 241095 - RNA, 22 nt, Human
ugucccaacccugagaagauuc

SEQ ID NO: 241096 - RNA, 22 nt, Human
auaaaggcuggcugcugugagc

SEQ ID NO: 241097 - RNA, 22 nt, Human
cugaggcucaagggcagguggg

SEQ ID NO: 241098 - RNA, 22 nt, Human
aggaaacuguccccucauccua

SEQ ID NO: 241099 - RNA, 22 nt, Human
uuugacucccaaacugugauuu

SEQ ID NO: 241100 - RNA, 22 nt, Human
gcugcugugccuggcguccugu

SEQ ID NO: 241101 - RNA, 22 nt, Human
ucacauucuucccugacuucuu

SEQ ID NO: 241102 - RNA, 22 nt, Human
gugucuuuugaggcugaccagu

SEQ ID NO: 241103 - RNA, 22 nt, Human
aggaagagcauucacaugguag

SEQ ID NO: 241104 - RNA, 22 nt, Human
aaaggcuaauuaaccaccuggu

SEQ ID NO: 241105 - RNA, 22 nt, Human
uagacauuuucucaacaucucu

SEQ ID NO: 241106 - RNA, 22 nt, Human
gggaucugcuccagagggaaaa

SEQ ID NO: 241107 - RNA, 17 nt, Human
agguggcugcugcgccu

SEQ ID NO: 241108 - RNA, 22 nt, Human
agaggccagcagugccuaucug

SEQ ID NO: 241109 - RNA, 22 nt, Human
ugcaggugcagcgauacuguga

SEQ ID NO: 241110 - RNA, 22 nt, Human
uuggcuuuuaugcagcuuaggu

SEQ ID NO: 241111 - RNA, 22 nt, Human
aaucuuuugauucuagggcugu

SEQ ID NO: 241112 - RNA, 18 nt, Human
uuucucugucgucuucug

SEQ ID NO: 241113 - RNA, 21 nt, Human
ugcuuugcagguggauuuagu

SEQ ID NO: 241114 - RNA, 22 nt, Human
uccucagaauccaaacugcagu

SEQ ID NO: 241115 - RNA, 22 nt, Human
gaggcagcuuggggcugugggu

SEQ ID NO: 241116 - RNA, 22 nt, Human
cagcuccucacgagucuugaaa

SEQ ID NO: 241117 - RNA, 22 nt, Human
uuucacauauaggggaagcuac

SEQ ID NO: 241118 - RNA, 22 nt, Human
guagacaucuagauuuaugugu

SEQ ID NO: 241119 - RNA, 22 nt, Human
cuucccagaacaauguaggcuu

SEQ ID NO: 241120 - RNA, 19 nt, Human
uccaggaggcugccauuga

SEQ ID NO: 241121 - RNA, 22 nt, Human
aaugucugccugaacuuuauau

SEQ ID NO: 241122 - RNA, 22 nt, Human
cucagagcucagcuuuguuagu

SEQ ID NO: 241123 - RNA, 22 nt, Human
ucuuccagccaauagcguccuu

SEQ ID NO: 241124 - RNA, 22 nt, Human
gauggccuuguuuucucccuuc

SEQ ID NO: 241125 - RNA, 22 nt, Human
aaggucugaguuuugccaggcc

SEQ ID NO: 241126 - RNA, 22 nt, Human
augggaaguguuagaagauuuu

SEQ ID NO: 241127 - RNA, 22 nt, Human
ucagugucauaucaagaagaug

SEQ ID NO: 241128 - RNA, 22 nt, Human
uugcuuuagggcaaauauuuca

SEQ ID NO: 241129 - RNA, 22 nt, Human
ugcuuugugacagauuaguuuu

SEQ ID NO: 241130 - RNA, 22 nt, Human
gcuuccuguaggcagguccaag

SEQ ID NO: 241131 - RNA, 22 nt, Human
aagggggccacaccugguguga

SEQ ID NO: 241132 - RNA, 22 nt, Human
gagagccugccagugaguguau

SEQ ID NO: 241133 - RNA, 22 nt, Human
agcaucucugggagucauccgu

SEQ ID NO: 241134 - RNA, 22 nt, Human
ucacagaaggaccuuguuucau

SEQ ID NO: 241135 - RNA, 22 nt, Human
ccugagggcgccgagcucccag

SEQ ID NO: 241136 - RNA, 22 nt, Human
aacccuggggcagcugcuaggg

SEQ ID NO: 241137 - RNA, 22 nt, Human
cccuagaaaugaaagcauacgu

SEQ ID NO: 241138 - RNA, 23 nt, Human
uuuuagugacuccuuuaucugcc

SEQ ID NO: 241139 - RNA, 22 nt, Human
uggucaggauucucagcccuuc

SEQ ID NO: 241140 - RNA, 22 nt, Human
cccaggagagaggccaguuggc

SEQ ID NO: 241141 - RNA, 22 nt, Human
ucacaauuuggauacagcuaug

SEQ ID NO: 241142 - RNA, 22 nt, Human
uuucuggcagcgggacaggggu

SEQ ID NO: 241143 - RNA, 22 nt, Human
aagcagguuaugaaauauagaa

SEQ ID NO: 241144 - RNA, 22 nt, Human
augaggcaaggcuggccguguu

SEQ ID NO: 241145 - RNA, 22 nt, Human
cuggagaccucuccugagagug

SEQ ID NO: 241146 - RNA, 22 nt, Human
auccugggaagcugacauugaa

SEQ ID NO: 241147 - RNA, 23 nt, Human
uguaacaauuucauauacaugca

SEQ ID NO: 241148 - RNA, 22 nt, Human
ucaggcucuacacuugacacac

SEQ ID NO: 241149 - RNA, 22 nt, Human
guaacugguuuucuucccucuc

SEQ ID NO: 241150 - RNA, 22 nt, Human
ugcucagaaacgaggugcagcc

SEQ ID NO: 241151 - RNA, 22 nt, Human
uagcaccacuucaugcuuucag

SEQ ID NO: 241152 - RNA, 22 nt, Human
aaagcacugcacauauauuugc

SEQ ID NO: 241153 - RNA, 18 nt, Human
acacaguggaugccuggu

SEQ ID NO: 241154 - RNA, 22 nt, Human
agucugucuuuggcuucaccac

SEQ ID NO: 241155 - RNA, 22 nt, Human
gaauacaccaaggaaucagaau

SEQ ID NO: 241156 - RNA, 22 nt, Human
ucacagcaggguaacaggaaga

SEQ ID NO: 241157 - RNA, 22 nt, Human
uuucucagcuguggagccuauc

SEQ ID NO: 241158 - RNA, 22 nt, Human
ggcaggcagccuccauccacag

SEQ ID NO: 241159 - RNA, 22 nt, Human
ccugucuguccucucaugagcc

SEQ ID NO: 241160 - RNA, 22 nt, Human
aguccaggccucccucuccugc

SEQ ID NO: 241161 - RNA, 22 nt, Human
aaaguggggucuagagggccug

SEQ ID NO: 241162 - RNA, 22 nt, Human
gaucuugagcaaguuguguaac

SEQ ID NO: 241163 - RNA, 22 nt, Human
cugggugugggucaagcaacca

SEQ ID NO: 241164 - RNA, 22 nt, Human
gggcugacgaaggccaugugug

SEQ ID NO: 241165 - RNA, 22 nt, Human
ggggccagcuucgcgugcucuu

SEQ ID NO: 241166 - RNA, 22 nt, Human
uaguuuaccaaauugaucuucc

SEQ ID NO: 241167 - RNA, 22 nt, Human
uaauuauacaaaaaggcaugca

SEQ ID NO: 241168 - RNA, 22 nt, Human
ucccccacucuaaaggagccuu

SEQ ID NO: 241169 - RNA, 22 nt, Human
ucucuguaaaauguggaugaua

SEQ ID NO: 241170 - RNA, 22 nt, Human
uagguucagugucuuguucugc

SEQ ID NO: 241171 - RNA, 22 nt, Human
ggaguggcagagaggguauacu

SEQ ID NO: 241172 - RNA, 22 nt, Human
ugcaucuggccuuugcuggcua

SEQ ID NO: 241173 - RNA, 22 nt, Human
aagggggcacagucacuguaau

SEQ ID NO: 241174 - RNA, 22 nt, Human
aagacaauuugauacuaguugc

SEQ ID NO: 241175 - RNA, 22 nt, Human
gacaagauuuagagucugcuaa

SEQ ID NO: 241176 - RNA, 22 nt, Human
ccagaagcagagccugaggcag

SEQ ID NO: 241177 - RNA, 22 nt, Human
ucuauuuguucucaggaucauc

SEQ ID NO: 241178 - RNA, 22 nt, Human
aauaagcuggagcuauauugag

SEQ ID NO: 241179 - RNA, 22 nt, Human
uggcagagacuccuccugggag

SEQ ID NO: 241180 - RNA, 22 nt, Human
gagaaaccgauucugcauguca

SEQ ID NO: 241181 - RNA, 22 nt, Human
uguacagagguguacauaugau

SEQ ID NO: 241182 - RNA, 23 nt, Human
agggcccaagccuggacagcagg

SEQ ID NO: 241183 - RNA, 22 nt, Human
uggaggcauugugacugcugaa

SEQ ID NO: 241184 - RNA, 22 nt, Human
agauuauuuaagacaggaacca

SEQ ID NO: 241185 - RNA, 22 nt, Human
cccacccucaagggugucuaua

SEQ ID NO: 241186 - RNA, 22 nt, Human
gacccuggugggcacuggcacc

SEQ ID NO: 241187 - RNA, 22 nt, Human
ggucacauucugagguauuagg

SEQ ID NO: 241188 - RNA, 23 nt, Human
ugcugcccacucuuccagcccuc

SEQ ID NO: 241189 - RNA, 22 nt, Human
gccaccagccccaugcgcugug

SEQ ID NO: 241190 - RNA, 22 nt, Human
uaggauuuuuuggauucuggau

SEQ ID NO: 241191 - RNA, 22 nt, Human
ucugggcugguugugcuugcuu

SEQ ID NO: 241192 - RNA, 20 nt, Human
acuguucaagggccuggugg

SEQ ID NO: 241193 - RNA, 22 nt, Human
ggaaguuguaugaucggggaau

SEQ ID NO: 241194 - RNA, 22 nt, Human
cagccuguggcagaggucuaau

SEQ ID NO: 241195 - RNA, 22 nt, Human
acaucuggaaaguuacuugaga

SEQ ID NO: 241196 - RNA, 22 nt, Human
gggcccagcacuggcugggauc

SEQ ID NO: 241197 - RNA, 22 nt, Human
uuagaaagguuuugcucugaaa

SEQ ID NO: 241198 - RNA, 22 nt, Human
gccuguggccgacugagagccu

SEQ ID NO: 241199 - RNA, 22 nt, Human
uggcuucccaggaaaggagaag

SEQ ID NO: 241200 - RNA, 22 nt, Human
ugcucaggagcuuagagcacag

SEQ ID NO: 241201 - RNA, 22 nt, Human
ggcucugcagagggcccagcuu

SEQ ID NO: 241202 - RNA, 22 nt, Human
gcagccaggcuacagcgggcuu

SEQ ID NO: 241203 - RNA, 22 nt, Human
aggcuucuugggcuucauucug

SEQ ID NO: 241204 - RNA, 22 nt, Human
ucuuagaaauuccccaguggcu

SEQ ID NO: 241205 - RNA, 22 nt, Human
uucuagaaacacaugcaaacag

SEQ ID NO: 241206 - RNA, 22 nt, Human
gaacauacaagaauuaaguaca

SEQ ID NO: 241207 - RNA, 22 nt, Human
cucuguaccuuaaaagggcuuu

SEQ ID NO: 241208 - RNA, 22 nt, Human
cugugcccucuuugcuggccuu

SEQ ID NO: 241209 - RNA, 22 nt, Human
acagcugugaagcaagcacucu

SEQ ID NO: 241210 - RNA, 22 nt, Human
ggguaggaugguagaagggacc

SEQ ID NO: 241211 - RNA, 22 nt, Human
ccuguucacuuugacuucucca

SEQ ID NO: 241212 - RNA, 22 nt, Human
gugccaaaagcuauaauuuggu

SEQ ID NO: 241213 - RNA, 21 nt, Human
aaaguucaugcuuuaauauuc

SEQ ID NO: 241214 - RNA, 22 nt, Human
gaggcaguguuuacugcccugu

SEQ ID NO: 241215 - RNA, 21 nt, Human
uggagcugccacuugagcugc

SEQ ID NO: 241216 - RNA, 22 nt, Human
ugagauccccaggaaggacaac

SEQ ID NO: 241217 - RNA, 22 nt, Human
uagcaccaugauggaagagcug

SEQ ID NO: 241218 - RNA, 22 nt, Human
auugcuggcugccaucuugccc

SEQ ID NO: 241219 - RNA, 22 nt, Human
uuagggcaaaguuucaacaguu

SEQ ID NO: 241220 - RNA, 22 nt, Human
gggauugaauugggggaucaca

SEQ ID NO: 241221 - RNA, 22 nt, Human
agcuuuaugggagcuuagauaa

SEQ ID NO: 241222 - RNA, 22 nt, Human
auagucuuagaucagauaaagu

SEQ ID NO: 241223 - RNA, 22 nt, Human
gcaggagcccuggcauguucuu

SEQ ID NO: 241224 - RNA, 22 nt, Human
ucugccugagcagagggaggcc

SEQ ID NO: 241225 - RNA, 22 nt, Human
uucuggaaagcauuugaggccc

SEQ ID NO: 241226 - RNA, 22 nt, Human
cugggcagaauuuuaggauggc

SEQ ID NO: 241227 - RNA, 22 nt, Human
ucuggcagugaagucaugaggu

SEQ ID NO: 241228 - RNA, 22 nt, Human
agugcauuccuggggaagaagc

SEQ ID NO: 241229 - RNA, 22 nt, Human
uagcauaacagguaagagugag

SEQ ID NO: 241230 - RNA, 17 nt, Human
gacaagacagaauucau

SEQ ID NO: 241231 - RNA, 22 nt, Human
ucaagagaaggggaaauagacu

SEQ ID NO: 241232 - RNA, 22 nt, Human
uacauccaaaugaauuagaauu

SEQ ID NO: 241233 - RNA, 22 nt, Human
gaucugaaauagcuacugcaga

SEQ ID NO: 241234 - RNA, 22 nt, Human
uugaaucuggguacuuguaaua

SEQ ID NO: 241235 - RNA, 22 nt, Human
cacaggggcaaacuguagggga

SEQ ID NO: 241236 - RNA, 22 nt, Human
ucuucagagcauuucugaggua

SEQ ID NO: 241237 - RNA, 22 nt, Human
uccagccaggauggcccaggga

SEQ ID NO: 241238 - RNA, 22 nt, Human
guuuauaaggcccaauauuucu

SEQ ID NO: 241239 - RNA, 22 nt, Human
cauucauccacuguuggaaauu

SEQ ID NO: 241240 - RNA, 22 nt, Human
agcaguaagugaagacuaguuu

SEQ ID NO: 241241 - RNA, 22 nt, Human
aaagaaggaccuggaggaggau

SEQ ID NO: 241242 - RNA, 19 nt, Human
ggcugccuccugggagauu

SEQ ID NO: 241243 - RNA, 22 nt, Human
caguguggugagauuccaggug

SEQ ID NO: 241244 - RNA, 23 nt, Human
uuggaauauauuguuugacauag

SEQ ID NO: 241245 - RNA, 22 nt, Human
ucugaaauucacaguugaguca

SEQ ID NO: 241246 - RNA, 22 nt, Human
gaagaguauauuuagugaaauc

SEQ ID NO: 241247 - RNA, 22 nt, Human
cuuccuuccuuccccgaaaugc

SEQ ID NO: 241248 - RNA, 18 nt, Human
cuggauuaagacagugcu

SEQ ID NO: 241249 - RNA, 22 nt, Human
ugcuucugacugggucaguuga

SEQ ID NO: 241250 - RNA, 22 nt, Human
aagaacaugauggccaugugca

SEQ ID NO: 241251 - RNA, 22 nt, Human
ccuggggagaagagcuuccccc

SEQ ID NO: 241252 - RNA, 22 nt, Human
uguuuaaugaagaugguuuuuc

SEQ ID NO: 241253 - RNA, 22 nt, Human
gaaucucaaauuaagaauuuua

SEQ ID NO: 241254 - RNA, 22 nt, Human
agguauagaauugaaaggguuu

SEQ ID NO: 241255 - RNA, 22 nt, Human
cucucagaagcuuccaguaugg

SEQ ID NO: 241256 - RNA, 22 nt, Human
cucaggcugugaugugauggca

SEQ ID NO: 241257 - RNA, 20 nt, Human
aaaugcuguaauguuuggga

SEQ ID NO: 241258 - RNA, 22 nt, Human
gggcugagaaguugaucccaag

SEQ ID NO: 241259 - RNA, 22 nt, Human
guaucuuuaucccucguuggag

SEQ ID NO: 241260 - RNA, 22 nt, Human
aggacagcauuuucagcaucuc

SEQ ID NO: 241261 - RNA, 22 nt, Human
acccugggcuuggccugcucag

SEQ ID NO: 241262 - RNA, 22 nt, Human
cauccaaacucucauuaucugu

SEQ ID NO: 241263 - RNA, 22 nt, Human
uacuuccagcaaucugcauauu

SEQ ID NO: 241264 - RNA, 22 nt, Human
ucuuuggucaucaugggaagca

SEQ ID NO: 241265 - RNA, 19 nt, Human
gcgaggaagucacuguggc

SEQ ID NO: 241266 - RNA, 22 nt, Human
uuugauaauuaaaaauuguagu

SEQ ID NO: 241267 - RNA, 22 nt, Human
ccacaguaaagaaacaacuucg

SEQ ID NO: 241268 - RNA, 22 nt, Human
aagucagagaugccaaagauua

SEQ ID NO: 241269 - RNA, 22 nt, Human
aagcugaagaugccagugggag

SEQ ID NO: 241270 - RNA, 22 nt, Human
gugucaacagccgaagauaaau

SEQ ID NO: 241271 - RNA, 22 nt, Human
uuggcugcuagaugguguuaga

SEQ ID NO: 241272 - RNA, 22 nt, Human
agggccaggaucacagccaaga

SEQ ID NO: 241273 - RNA, 22 nt, Human
uccagccacuugcacaguuaaa

SEQ ID NO: 241274 - RNA, 22 nt, Human
caggagcuggaucuccuugcgg

SEQ ID NO: 241275 - RNA, 22 nt, Human
agcuacaguugcccucagcagg

SEQ ID NO: 241276 - RNA, 22 nt, Human
ucauaaaugcagugucauaaau

SEQ ID NO: 241277 - RNA, 22 nt, Human
agcauuuaauuacaguuuaauu

SEQ ID NO: 241278 - RNA, 22 nt, Human
acucagagaacuggauuagagg

SEQ ID NO: 241279 - RNA, 22 nt, Human
cugagggugcuauucuugccuu

SEQ ID NO: 241280 - RNA, 22 nt, Human
gagauggccagugccaggacaa

SEQ ID NO: 241281 - RNA, 22 nt, Human
ccaggagggaccgcggcauccc

SEQ ID NO: 241282 - RNA, 22 nt, Human
gcuuccggagccaaaaggcccc

SEQ ID NO: 241283 - RNA, 22 nt, Human
guggguggggagcucucuggag

SEQ ID NO: 241284 - RNA, 22 nt, Human
aggacagcagugcuggcacuug

SEQ ID NO: 241285 - RNA, 22 nt, Human
ucuguuaaaaguggaauaauag

SEQ ID NO: 241286 - RNA, 22 nt, Human
aaagugcaccugcuucuucuug

SEQ ID NO: 241287 - RNA, 22 nt, Human
aaacugcaaugacagguaggag

SEQ ID NO: 241288 - RNA, 22 nt, Human
uacuuuuuaugauaagaacuga

SEQ ID NO: 241289 - RNA, 22 nt, Human
uggcagguggcucuggcauucu

SEQ ID NO: 241290 - RNA, 22 nt, Human
ccucugcacuucaccuuagcuc

SEQ ID NO: 241291 - RNA, 22 nt, Human
auguccagccaaccacuggauu

SEQ ID NO: 241292 - RNA, 22 nt, Human
cugucuuuaguacaaaaaaugu

SEQ ID NO: 241293 - RNA, 22 nt, Human
gcuggcagguaaagccccgggg

SEQ ID NO: 241294 - RNA, 22 nt, Human
uccuggcaaagcaaguuaugaa

SEQ ID NO: 241295 - RNA, 22 nt, Human
agguggcugccuccccgcgcgg

SEQ ID NO: 241296 - RNA, 22 nt, Human
cuuccuggccauugccauggca

SEQ ID NO: 241297 - RNA, 22 nt, Human
gacagcagggaaaguccagacc

SEQ ID NO: 241298 - RNA, 22 nt, Human
gggugacauuaggaagauagac

SEQ ID NO: 241299 - RNA, 22 nt, Human
uuggccuuugucaucaagauca

SEQ ID NO: 241300 - RNA, 22 nt, Human
guggcaguucugugucucuugu

SEQ ID NO: 241301 - RNA, 19 nt, Human
uuagaaacuguugacacug

SEQ ID NO: 241302 - RNA, 22 nt, Human
ccauucauacaauuuuguucua

SEQ ID NO: 241303 - RNA, 22 nt, Human
uugcugggugcuauuaugaaca

SEQ ID NO: 241304 - RNA, 22 nt, Human
uuacaaagcaggucagcugaaa

SEQ ID NO: 241305 - RNA, 22 nt, Human
uguuugcuuacuuguaugcugc

SEQ ID NO: 241306 - RNA, 22 nt, Human
guucugggaagguggaccuguu

SEQ ID NO: 241307 - RNA, 22 nt, Human
aguuguacauugugaacauuca

SEQ ID NO: 241308 - RNA, 22 nt, Human
ggcuucucccauucuucagggg

SEQ ID NO: 241309 - RNA, 23 nt, Human
agcacuuguaucuuacuaaaaug

SEQ ID NO: 241310 - RNA, 22 nt, Human
augaggcuaugaauggggagau

SEQ ID NO: 241311 - RNA, 22 nt, Human
ggccucucugagagcagacguu

SEQ ID NO: 241312 - RNA, 22 nt, Human
gcugcaccagcuccaccagggc

SEQ ID NO: 241313 - RNA, 22 nt, Human
uggugcagauagugguguagua

SEQ ID NO: 241314 - RNA, 22 nt, Human
uucucauggugucuuuauacau

SEQ ID NO: 241315 - RNA, 22 nt, Human
ugcuucucuuuauuuguagguu

SEQ ID NO: 241316 - RNA, 22 nt, Human
cucucugggguuccagacgugg

SEQ ID NO: 241317 - RNA, 22 nt, Human
aaaggcuuuccagcgcgcggac

SEQ ID NO: 241318 - RNA, 22 nt, Human
gagcaagauuaaaaggcugggu

SEQ ID NO: 241319 - RNA, 22 nt, Human
caggcugccgugggguccaggc

SEQ ID NO: 241320 - RNA, 22 nt, Human
aaacugguauucaaauguuugg

SEQ ID NO: 241321 - RNA, 22 nt, Human
cugaggagauccccccagaagu

SEQ ID NO: 241322 - RNA, 22 nt, Human
augaacaugugacucagaccug

SEQ ID NO: 241323 - RNA, 22 nt, Human
ugcugccauggucgcugguguc

SEQ ID NO: 241324 - RNA, 22 nt, Human
guaaaguucuacuagaaucaac

SEQ ID NO: 241325 - RNA, 22 nt, Human
ccugacaguuaauuguccugua

SEQ ID NO: 241326 - RNA, 22 nt, Human
cacagguccuuccugcccuggg

SEQ ID NO: 241327 - RNA, 22 nt, Human
uggguccagugcagcugcgcgu

SEQ ID NO: 241328 - RNA, 22 nt, Human
cgucacuucuuagucuauuuuc

SEQ ID NO: 241329 - RNA, 22 nt, Human
gggcuucuguuccuuucacuug

SEQ ID NO: 241330 - RNA, 22 nt, Human
aaauccaggagaauuuccacuu

SEQ ID NO: 241331 - RNA, 22 nt, Human
aggcaguguggagggcuguugc

SEQ ID NO: 241332 - RNA, 22 nt, Human
uaucauuuuacugugacauuuu

SEQ ID NO: 241333 - RNA, 21 nt, Human
agcugcagcccaaaggccugu

SEQ ID NO: 241334 - RNA, 22 nt, Human
uccugccugcaaucccagcacu

SEQ ID NO: 241335 - RNA, 22 nt, Human
guggcagugaaggucauagcau

SEQ ID NO: 241336 - RNA, 22 nt, Human
gcuagggaucugauuugcuguu

SEQ ID NO: 241337 - RNA, 22 nt, Human
aagaguuucuuuauuaaccuuu

SEQ ID NO: 241338 - RNA, 22 nt, Human
cucuccagagcccuuccggccc

SEQ ID NO: 241339 - RNA, 22 nt, Human
cuuagaauuuugccuacuacaa

SEQ ID NO: 241340 - RNA, 22 nt, Human
uucacaaacuucaugauggcac

SEQ ID NO: 241341 - RNA, 22 nt, Human
cuuagaauaaaagggggcuaua

SEQ ID NO: 241342 - RNA, 23 nt, Human
uaugugcauauguguaagaauac

SEQ ID NO: 241343 - RNA, 22 nt, Human
uuccuggcauuaugggaggcug

SEQ ID NO: 241344 - RNA, 22 nt, Human
ugaaaugcaacaguuauuuuug

SEQ ID NO: 241345 - RNA, 17 nt, Human
gaaaggaggcaacacug

SEQ ID NO: 241346 - RNA, 22 nt, Human
cuccagucuaguagagccugcu

SEQ ID NO: 241347 - RNA, 19 nt, Human
uucuagaacuguucucuca

SEQ ID NO: 241348 - RNA, 22 nt, Human
agugucugcuagguucaucaac

SEQ ID NO: 241349 - RNA, 22 nt, Human
acaaagcuagagaagagaauug

SEQ ID NO: 241350 - RNA, 22 nt, Human
ugcuggaguucgacauugcaaa

SEQ ID NO: 241351 - RNA, 22 nt, Human
ugucacauccauuuugcaagua

SEQ ID NO: 241352 - RNA, 22 nt, Human
aguuuaugucuuuacuucagcu

SEQ ID NO: 241353 - RNA, 22 nt, Human
uccuggccacccgacagaaguc

SEQ ID NO: 241354 - RNA, 22 nt, Human
ugcccucagaauugcucccugc

SEQ ID NO: 241355 - RNA, 22 nt, Human
ucacugggagaugugggaaggg

SEQ ID NO: 241356 - RNA, 22 nt, Human
aggcccuauucaauggggccca

SEQ ID NO: 241357 - RNA, 22 nt, Human
cugccugcaugcugccauagcu

SEQ ID NO: 241358 - RNA, 22 nt, Human
uuuauaaccaaguucugcuugu

SEQ ID NO: 241359 - RNA, 22 nt, Human
ucuucacaugaccuucaugucu

SEQ ID NO: 241360 - RNA, 22 nt, Human
gcugucugccgcaggcugccac

SEQ ID NO: 241361 - RNA, 22 nt, Human
ccagagcuucggggcggcugua

SEQ ID NO: 241362 - RNA, 22 nt, Human
uacuaaauaguuuaauuccuca

SEQ ID NO: 241363 - RNA, 22 nt, Human
gcaaagcaagcugucagccuca

SEQ ID NO: 241364 - RNA, 22 nt, Human
gccuggcucacagagcagccuu

SEQ ID NO: 241365 - RNA, 22 nt, Human
aucaauaucagaucagacagga

SEQ ID NO: 241366 - RNA, 22 nt, Human
aucauucagucucugggacagu

SEQ ID NO: 241367 - RNA, 22 nt, Human
aggaaccagacagaacugaaug

SEQ ID NO: 241368 - RNA, 22 nt, Human
ucauuuacacuucacaaaugga

SEQ ID NO: 241369 - RNA, 22 nt, Human
auggccuggccagagcucugcu

SEQ ID NO: 241370 - RNA, 22 nt, Human
aagagaauacaagcaggcagga

SEQ ID NO: 241371 - RNA, 22 nt, Human
aauauucaaguuauucuuucuu

SEQ ID NO: 241372 - RNA, 22 nt, Human
caugaguuuuuuaguucaugca

SEQ ID NO: 241373 - RNA, 21 nt, Human
uuggccuuugucucagacacu

SEQ ID NO: 241374 - RNA, 22 nt, Human
auaauucagguuuucuggcaca

SEQ ID NO: 241375 - RNA, 22 nt, Human
ccugccaggcgagucuaggcca

SEQ ID NO: 241376 - RNA, 22 nt, Human
ucccacaggagccugaguccca

SEQ ID NO: 241377 - RNA, 22 nt, Human
caucacagggggcuagaagucu

SEQ ID NO: 241378 - RNA, 19 nt, Human
gcaugcagaguaagaaggu

SEQ ID NO: 241379 - RNA, 22 nt, Human
cugaccaggguagaggugagag

SEQ ID NO: 241380 - RNA, 22 nt, Human
caguggccgcggggcugugggu

SEQ ID NO: 241381 - RNA, 22 nt, Human
gucuggcucccacucuuacaaa

SEQ ID NO: 241382 - RNA, 22 nt, Human
cagggacugagauccagacugu

SEQ ID NO: 241383 - RNA, 22 nt, Human
ggugccacugcacucuggccug

SEQ ID NO: 241384 - RNA, 22 nt, Human
cuucaaauucgaggaguagaug

SEQ ID NO: 241385 - RNA, 19 nt, Human
cuggguccuguucuuuuac

SEQ ID NO: 241386 - RNA, 22 nt, Human
acccugggucucaaucauccua

SEQ ID NO: 241387 - RNA, 19 nt, Human
aagucacuugagggcagga

SEQ ID NO: 241388 - RNA, 22 nt, Human
ucagugucuauagauaagguuu

SEQ ID NO: 241389 - RNA, 22 nt, Human
gaggcuuugguuauaaaagauc

SEQ ID NO: 241390 - RNA, 22 nt, Human
uucccucccuggcugccauuuc

SEQ ID NO: 241391 - RNA, 22 nt, Human
gccuuggcuguuggagcuugau

SEQ ID NO: 241392 - RNA, 22 nt, Human
guuauucuaccacuauguacag

SEQ ID NO: 241393 - RNA, 17 nt, Human
gcucuggcacaggauug

SEQ ID NO: 241394 - RNA, 22 nt, Human
auucagaagcaaucacagugag

SEQ ID NO: 241395 - RNA, 22 nt, Human
ggagucugcucccagacaugau

SEQ ID NO: 241396 - RNA, 22 nt, Human
agcaggcuccaggcuggccauc

SEQ ID NO: 241397 - RNA, 20 nt, Human
uugauaggcagcuugucagg

SEQ ID NO: 241398 - RNA, 22 nt, Human
cagugaggugcccagccugccc

SEQ ID NO: 241399 - RNA, 23 nt, Human
gcccagagaggcucaccaggaau

SEQ ID NO: 241400 - RNA, 22 nt, Human
ggcuucucgugccgaagcaaga

SEQ ID NO: 241401 - RNA, 22 nt, Human
ggcugcuccuuuacccuggcag

SEQ ID NO: 241402 - RNA, 22 nt, Human
acugagaacucaagagaaaagg

SEQ ID NO: 241403 - RNA, 22 nt, Human
aggagaggucucccuuccccag

SEQ ID NO: 241404 - RNA, 22 nt, Human
ucuggguggcuucagaggccac

SEQ ID NO: 241405 - RNA, 22 nt, Human
ggauuuacaaguuuaacucuca

SEQ ID NO: 241406 - RNA, 22 nt, Human
uucuuguucugguucuguuagc

SEQ ID NO: 241407 - RNA, 22 nt, Human
aggagggcaggcuggcugccua

SEQ ID NO: 241408 - RNA, 22 nt, Human
cuguacagcaaguucaccuugg

SEQ ID NO: 241409 - RNA, 22 nt, Human
uaggguaguaccaugcugccag

SEQ ID NO: 241410 - RNA, 21 nt, Human
ucuuccuccacagcgugccac

SEQ ID NO: 241411 - RNA, 22 nt, Human
caccagcuucucauugcggguc

SEQ ID NO: 241412 - RNA, 22 nt, Human
auacacauguguaugugcaugc

SEQ ID NO: 241413 - RNA, 22 nt, Human
ucacagacaccuuggccacagu

SEQ ID NO: 241414 - RNA, 23 nt, Human
agagcuuuccaguuucuugguga

SEQ ID NO: 241415 - RNA, 21 nt, Human
agggcagauuagcuguaagag

SEQ ID NO: 241416 - RNA, 22 nt, Human
auuugaagucuucaugauuucu

SEQ ID NO: 241417 - RNA, 22 nt, Human
ggcagcuggccuccucgcccac

SEQ ID NO: 241418 - RNA, 22 nt, Human
gauuucucugcacccacucagg

SEQ ID NO: 241419 - RNA, 22 nt, Human
uggcucagaacuacuucuaguu

SEQ ID NO: 241420 - RNA, 22 nt, Human
uucucuuuugugaugugagaug

SEQ ID NO: 241421 - RNA, 22 nt, Human
caggaacagcaccaggagcuag

SEQ ID NO: 241422 - RNA, 22 nt, Human
agaacacugcuaguauaaucac

SEQ ID NO: 241423 - RNA, 22 nt, Human
uagggaugacgaaaggacagag

SEQ ID NO: 241424 - RNA, 21 nt, Human
caguuacagccaggacaaggc

SEQ ID NO: 241425 - RNA, 22 nt, Human
aggccccaucaggaaggaggcc

SEQ ID NO: 241426 - RNA, 23 nt, Human
uggccucuccccaccuggcagaa

SEQ ID NO: 241427 - RNA, 22 nt, Human
ggcaauuaaaguacugugaaug

SEQ ID NO: 241428 - RNA, 22 nt, Human
caggaaaugggguuuaguuauu

SEQ ID NO: 241429 - RNA, 22 nt, Human
ugccuuccuggagcugaaggcu

SEQ ID NO: 241430 - RNA, 22 nt, Human
cagggcuguggaaaacuggugc

SEQ ID NO: 241431 - RNA, 22 nt, Human
cacauggccuguguggccagac

SEQ ID NO: 241432 - RNA, 22 nt, Human
ccagcugguguuccuuaggacc

SEQ ID NO: 241433 - RNA, 22 nt, Human
auauacacuccacugauacagg

SEQ ID NO: 241434 - RNA, 22 nt, Human
ugcaaaauaaugaacgauuuuu

SEQ ID NO: 241435 - RNA, 22 nt, Human
aagcaaacaggagaagagcugu

SEQ ID NO: 241436 - RNA, 22 nt, Human
aguccugaugcucuggcaggag

SEQ ID NO: 241437 - RNA, 22 nt, Human
uaaagcaaggaauagaguaguc

SEQ ID NO: 241438 - RNA, 23 nt, Human
uccaguagggagucugcuuacuu

SEQ ID NO: 241439 - RNA, 22 nt, Human
ugaccaguuaagucauccuguc

SEQ ID NO: 241440 - RNA, 22 nt, Human
gcagcaguaggaaauaacacag

SEQ ID NO: 241441 - RNA, 22 nt, Human
uucaaaguugcaugacagcuua

SEQ ID NO: 241442 - RNA, 22 nt, Human
caaauucucacccuguuugauu

SEQ ID NO: 241443 - RNA, 22 nt, Human
aguggcagggcuggcugcugca

SEQ ID NO: 241444 - RNA, 22 nt, Human
uguauuuuuagaccuuuagacc

SEQ ID NO: 241445 - RNA, 22 nt, Human
agcagggcuccugaaagccgcg

SEQ ID NO: 241446 - RNA, 22 nt, Human
gacaggugaaacagcaagguaa

SEQ ID NO: 241447 - RNA, 22 nt, Human
cugggagauaugaggaucugga

SEQ ID NO: 241448 - RNA, 22 nt, Human
cugcccaggggagugcugucgg

SEQ ID NO: 241449 - RNA, 22 nt, Human
acagucuuugcaaaguccuggu

SEQ ID NO: 241450 - RNA, 19 nt, Human
ugggccucacaaugcuccc

SEQ ID NO: 241451 - RNA, 22 nt, Human
ugcaauuaauuuacaugcuuaa

SEQ ID NO: 241452 - RNA, 22 nt, Human
cacaggugugugccuuaucaaa

SEQ ID NO: 241453 - RNA, 22 nt, Human
agucuggugcucgcucugcuuc

SEQ ID NO: 241454 - RNA, 22 nt, Human
gagccuggccuccugccucagc

SEQ ID NO: 241455 - RNA, 17 nt, Human
uggcuuuccugacacag

SEQ ID NO: 241456 - RNA, 22 nt, Human
caagcuuuccauuacacacauu

SEQ ID NO: 241457 - RNA, 22 nt, Human
ugcuauuuaacuuuuaugugua

SEQ ID NO: 241458 - RNA, 22 nt, Human
uaauaugggcagucugaauaua

SEQ ID NO: 241459 - RNA, 22 nt, Human
acugggcucccaggcuugucau

SEQ ID NO: 241460 - RNA, 22 nt, Human
ccuuuucuggccaccaagcgcu

SEQ ID NO: 241461 - RNA, 22 nt, Human
augguuuuucaaguauucagaa

SEQ ID NO: 241462 - RNA, 22 nt, Human
cucggaauggaacaacagcggu

SEQ ID NO: 241463 - RNA, 22 nt, Human
auuagugucauguugaggacuu

SEQ ID NO: 241464 - RNA, 22 nt, Human
ucagaggugguaaaggacagca

SEQ ID NO: 241465 - RNA, 22 nt, Human
agcugaaauucacaaggaucca

SEQ ID NO: 241466 - RNA, 22 nt, Human
aguuaucagguguuuucaugga

SEQ ID NO: 241467 - RNA, 22 nt, Human
auuuuaauaagauucccaagua

SEQ ID NO: 241468 - RNA, 22 nt, Human
ccugcugucaguggggcaggca

SEQ ID NO: 241469 - RNA, 22 nt, Human
agauucaaagugaagaacuuaa

SEQ ID NO: 241470 - RNA, 22 nt, Human
aacauuguuuucccuauaucca

SEQ ID NO: 241471 - RNA, 22 nt, Human
uauguacagggauagaacuuga

SEQ ID NO: 241472 - RNA, 21 nt, Human
uuggaauuugggagcuaugug

SEQ ID NO: 241473 - RNA, 22 nt, Human
auauaucaugaguaaaacuuga

SEQ ID NO: 241474 - RNA, 22 nt, Human
acaaauuauagaaaauugagcu

SEQ ID NO: 241475 - RNA, 22 nt, Human
ugcagcagggcccaggcacaga

SEQ ID NO: 241476 - RNA, 23 nt, Human
uuaaguggucaguuuuagacaac

SEQ ID NO: 241477 - RNA, 21 nt, Human
aggcauggaaauggcacacug

SEQ ID NO: 241478 - RNA, 22 nt, Human
uuucaguuaaguggcuaguccc

SEQ ID NO: 241479 - RNA, 22 nt, Human
ucagguggccaaaugggagcgc

SEQ ID NO: 241480 - RNA, 23 nt, Human
aaauaccugaauuagauauuauc

SEQ ID NO: 241481 - RNA, 22 nt, Human
agggggugcccagaugaaggau

SEQ ID NO: 241482 - RNA, 22 nt, Human
ggagugaaagguaaguugagcu

SEQ ID NO: 241483 - RNA, 22 nt, Human
auguaucacagcaauguaguca

SEQ ID NO: 241484 - RNA, 19 nt, Human
ucaggcaguuauucacaaa

SEQ ID NO: 241485 - RNA, 22 nt, Human
caaggcauuguguaagcacuug

SEQ ID NO: 241486 - RNA, 22 nt, Human
aaucaggacccacucuacaguu

SEQ ID NO: 241487 - RNA, 22 nt, Human
acucaaauuugucaacugaagc

SEQ ID NO: 241488 - RNA, 23 nt, Human
cagcuuucagggcuuuagggaag

SEQ ID NO: 241489 - RNA, 22 nt, Human
agugucaacugucuacagggag

SEQ ID NO: 241490 - RNA, 20 nt, Human
aggcagagcgcacuuuuaga

SEQ ID NO: 241491 - RNA, 22 nt, Human
acaaacaucuugaccucagauu

SEQ ID NO: 241492 - RNA, 22 nt, Human
gggcuggaggagauccagaggc

SEQ ID NO: 241493 - RNA, 22 nt, Human
gaaaaugugccuuuggguauug

SEQ ID NO: 241494 - RNA, 22 nt, Human
cagugcugguguaggcugacca

SEQ ID NO: 241495 - RNA, 22 nt, Human
uccuggagggcucacaggcggc

SEQ ID NO: 241496 - RNA, 22 nt, Human
uagaugaacagaaagccacugu

SEQ ID NO: 241497 - RNA, 22 nt, Human
cugguuuaaaauuacugguuaa

SEQ ID NO: 241498 - RNA, 22 nt, Human
cagcucaggcacuggcgcggga

SEQ ID NO: 241499 - RNA, 22 nt, Human
aaaccuagaaggaagggucucu

SEQ ID NO: 241500 - RNA, 22 nt, Human
aucccauuuccuguuuugucaa

SEQ ID NO: 241501 - RNA, 20 nt, Human
uuucugugcccaggucuguu

SEQ ID NO: 241502 - RNA, 22 nt, Human
ugcuggaagaauuccaugcugg

SEQ ID NO: 241503 - RNA, 22 nt, Human
gaauacauguuguuucccugga

SEQ ID NO: 241504 - RNA, 22 nt, Human
aggucgaguuucggggcuacuu

SEQ ID NO: 241505 - RNA, 22 nt, Human
ucugccugaggacugacaccag

SEQ ID NO: 241506 - RNA, 22 nt, Human
gcaucuuuagccucuccguggc

SEQ ID NO: 241507 - RNA, 22 nt, Human
uuuccucuaaacgcauuugcuu

SEQ ID NO: 241508 - RNA, 22 nt, Human
uuuacagaagagaaggaugcuu

SEQ ID NO: 241509 - RNA, 22 nt, Human
cagugagcacggccagagggga

SEQ ID NO: 241510 - RNA, 22 nt, Human
aggcuucccagcugagcucagc

SEQ ID NO: 241511 - RNA, 20 nt, Human
agauggugaaggccagggag

SEQ ID NO: 241512 - RNA, 22 nt, Human
gcaggugaugugaugugagcau

SEQ ID NO: 241513 - RNA, 22 nt, Human
cugccuguuccugaucauucua

SEQ ID NO: 241514 - RNA, 22 nt, Human
aaggagaauuuggcuugugaug

SEQ ID NO: 241515 - RNA, 22 nt, Human
acuggggcagugggcagugguu

SEQ ID NO: 241516 - RNA, 23 nt, Human
gccagccagaauuucuccacugu

SEQ ID NO: 241517 - RNA, 22 nt, Human
uuuuguguugccauguuaagca

SEQ ID NO: 241518 - RNA, 22 nt, Human
cagcagguuaacagaggcuggu

SEQ ID NO: 241519 - RNA, 23 nt, Human
agacagcuuagaguuugccucuc

SEQ ID NO: 241520 - RNA, 22 nt, Human
gcccugugagucaugcggcaga

SEQ ID NO: 241521 - RNA, 22 nt, Human
agugucacagacccaaucagga

SEQ ID NO: 241522 - RNA, 22 nt, Human
uucuuuugcaagacuauugauu

SEQ ID NO: 241523 - RNA, 22 nt, Human
cccagcuccagagccagaaaca

SEQ ID NO: 241524 - RNA, 22 nt, Human
agcugggcaccccgcugcgucu

SEQ ID NO: 241525 - RNA, 22 nt, Human
uggcucucugggagguccuggc

SEQ ID NO: 241526 - RNA, 22 nt, Human
auguuuguagguaagugacacu

SEQ ID NO: 241527 - RNA, 22 nt, Human
ccaugccuggacuccacucuca

SEQ ID NO: 241528 - RNA, 22 nt, Human
ucauaaagugaaggaugauggg

SEQ ID NO: 241529 - RNA, 22 nt, Human
uuagaaaaaacgucuucuagug

SEQ ID NO: 241530 - RNA, 22 nt, Human
ucagcaggcucugguugaccau

SEQ ID NO: 241531 - RNA, 22 nt, Human
aagggcaggcagagaucauaua

SEQ ID NO: 241532 - RNA, 22 nt, Human
acugucaagagauucaaauuca

SEQ ID NO: 241533 - RNA, 22 nt, Human
ucugacaugagggcuguggaga

SEQ ID NO: 241534 - RNA, 22 nt, Human
agugcugggauuacaggcauaa

SEQ ID NO: 241535 - RNA, 22 nt, Human
agugcugggauugcaggcauga

SEQ ID NO: 241536 - RNA, 22 nt, Human
gcagguggaucaccacgucagg

SEQ ID NO: 241537 - RNA, 17 nt, Human
uuucaagguuacguucc

SEQ ID NO: 241538 - RNA, 22 nt, Human
aaggaggaauucugaguucaug

SEQ ID NO: 241539 - RNA, 22 nt, Human
agccauguuaaauggacuugau

SEQ ID NO: 241540 - RNA, 22 nt, Human
aaggggccucacagaugggcuu

SEQ ID NO: 241541 - RNA, 22 nt, Human
acacuguaaacaucucaagcac

SEQ ID NO: 241542 - RNA, 20 nt, Human
uuagaaagagcgugauaaga

SEQ ID NO: 241543 - RNA, 22 nt, Human
ccugagcugaacuaagcaguuu

SEQ ID NO: 241544 - RNA, 22 nt, Human
accagccagccacaguggcucc

SEQ ID NO: 241545 - RNA, 18 nt, Human
auggcagaugauaagugc

SEQ ID NO: 241546 - RNA, 22 nt, Human
uucaaagcagagggucaauaca

SEQ ID NO: 241547 - RNA, 22 nt, Human
auguucuucuaucuuuauuaaa

SEQ ID NO: 241548 - RNA, 22 nt, Human
cugggccucacacccaccaaau

SEQ ID NO: 241549 - RNA, 22 nt, Human
cagaacuguuauaacagcuguu

SEQ ID NO: 241550 - RNA, 22 nt, Human
aacagcuuuuuuggucagcauu

SEQ ID NO: 241551 - RNA, 22 nt, Human
gagcaacagggcgaggagaacu

SEQ ID NO: 241552 - RNA, 22 nt, Human
ucaucccucugccaggcccagg

SEQ ID NO: 241553 - RNA, 22 nt, Human
ccaguggaaauguggucaggau

SEQ ID NO: 241554 - RNA, 22 nt, Human
uacaagcucgggcagcucauua

SEQ ID NO: 241555 - RNA, 22 nt, Human
aacuaguuuuagcucuagcaac

SEQ ID NO: 241556 - RNA, 22 nt, Human
acauucuuaacaguuaaaaacu

SEQ ID NO: 241557 - RNA, 17 nt, Human
acacagggagagggagc

SEQ ID NO: 241558 - RNA, 22 nt, Human
uucucaggguuugugcaggcuu

SEQ ID NO: 241559 - RNA, 22 nt, Human
gcagggcacagacagugccaag

SEQ ID NO: 241560 - RNA, 22 nt, Human
uuggaacaggauucaauuaaag

SEQ ID NO: 241561 - RNA, 22 nt, Human
uggagcaggugcucaggguaau

SEQ ID NO: 241562 - RNA, 22 nt, Human
gcccaggaaagauagggccuca

SEQ ID NO: 241563 - RNA, 22 nt, Human
uggcagggaauacagauguuua

SEQ ID NO: 241564 - RNA, 22 nt, Human
accaggcccauguggauuacua

SEQ ID NO: 241565 - RNA, 22 nt, Human
uccuugggucagugagugaggu

SEQ ID NO: 241566 - RNA, 21 nt, Human
uccaaaucccauucuguaguc

SEQ ID NO: 241567 - RNA, 22 nt, Human
agccuggcggucgucggucagg

SEQ ID NO: 241568 - RNA, 22 nt, Human
uugcuuuauucacaucuauauu

SEQ ID NO: 241569 - RNA, 17 nt, Human
uuccuccucaccauguu

SEQ ID NO: 241570 - RNA, 22 nt, Human
ugccucugugggccuuccuggc

SEQ ID NO: 241571 - RNA, 22 nt, Human
aagaggagacuucagcaacuug

SEQ ID NO: 241572 - RNA, 22 nt, Human
gaagugaagguuacucuagauu

SEQ ID NO: 241573 - RNA, 22 nt, Human
uggccugcccagagcagcucug

SEQ ID NO: 241574 - RNA, 22 nt, Human
cugaggcuuggaggggucuggu

SEQ ID NO: 241575 - RNA, 22 nt, Human
gaauuugaaaagugaugggaau

SEQ ID NO: 241576 - RNA, 22 nt, Human
ugcccaggcuggagugcagagg

SEQ ID NO: 241577 - RNA, 22 nt, Human
cccagggagguagcaggagaaa

SEQ ID NO: 241578 - RNA, 22 nt, Human
caggcacaugggagcucaucau

SEQ ID NO: 241579 - RNA, 22 nt, Human
augagaaaguuaaucaucauga

SEQ ID NO: 241580 - RNA, 22 nt, Human
acccucugagaggcacacuuug

SEQ ID NO: 241581 - RNA, 22 nt, Human
cuuggcaggguggaggaugcag

SEQ ID NO: 241582 - RNA, 22 nt, Human
ccuguccuccaagagcacaucu

SEQ ID NO: 241583 - RNA, 21 nt, Human
uccuuccuugagguccuuucc

SEQ ID NO: 241584 - RNA, 22 nt, Human
ccaggcucacagcaucccagga

SEQ ID NO: 241585 - RNA, 22 nt, Human
auccuucuccagucguauuuuu

SEQ ID NO: 241586 - RNA, 22 nt, Human
gcugaggccaguuuaaugagga

SEQ ID NO: 241587 - RNA, 22 nt, Human
aucaaaguaucucaauauggua

SEQ ID NO: 241588 - RNA, 22 nt, Human
guccugguuuucacagaccuuu

SEQ ID NO: 241589 - RNA, 22 nt, Human
ggacaggugcaaagggcacaug

SEQ ID NO: 241590 - RNA, 22 nt, Human
ucaggaaggcaaauugcaugau

SEQ ID NO: 241591 - RNA, 22 nt, Human
uccugggccuguacuccauccg

SEQ ID NO: 241592 - RNA, 22 nt, Human
cauaaucccaggcuugcauuca

SEQ ID NO: 241593 - RNA, 22 nt, Human
ucagggaaucagacucugcagc

SEQ ID NO: 241594 - RNA, 22 nt, Human
gauagaaagguguugaaaucca

SEQ ID NO: 241595 - RNA, 22 nt, Human
uuuauguaguuacggacuauca

SEQ ID NO: 241596 - RNA, 22 nt, Human
ggcaggcauggggucugccauu

SEQ ID NO: 241597 - RNA, 22 nt, Human
ugaguggacaccugcuucuuua

SEQ ID NO: 241598 - RNA, 22 nt, Human
uuuaaauguucaugauacugaa

SEQ ID NO: 241599 - RNA, 22 nt, Human
cugaggcacuaacaaggacaag

SEQ ID NO: 241600 - RNA, 22 nt, Human
cccagcccugaccuauuggaaa

SEQ ID NO: 241601 - RNA, 22 nt, Human
ugaacuuuuauuugaugacagg

SEQ ID NO: 241602 - RNA, 22 nt, Human
uuccugguuggauucugauuaa

SEQ ID NO: 241603 - RNA, 22 nt, Human
gcaggcugaguugggaaaccaa

SEQ ID NO: 241604 - RNA, 22 nt, Human
gcugggcagcugaggccucuca

SEQ ID NO: 241605 - RNA, 22 nt, Human
ugcaaggguagaagugauggca

SEQ ID NO: 241606 - RNA, 22 nt, Human
uguggcagcugcugcaggagcu

SEQ ID NO: 241607 - RNA, 22 nt, Human
agccuccacagaugcaaagggc

SEQ ID NO: 241608 - RNA, 22 nt, Human
uucuuuuaaugucuggcuuuca

SEQ ID NO: 241609 - RNA, 22 nt, Human
agaaugcaucuaaaagcagaga

SEQ ID NO: 241610 - RNA, 22 nt, Human
gucccaggcaggccacuggcag

SEQ ID NO: 241611 - RNA, 22 nt, Human
cccuccaugagugugcugcugg

SEQ ID NO: 241612 - RNA, 22 nt, Human
uuuacaacuuucuguucuguau

SEQ ID NO: 241613 - RNA, 22 nt, Human
uuccuucugaagccuuuguguu

SEQ ID NO: 241614 - RNA, 22 nt, Human
cagaaaccucccugaauauuuu

SEQ ID NO: 241615 - RNA, 22 nt, Human
ccaggcacuucaucauuagggu

SEQ ID NO: 241616 - RNA, 22 nt, Human
auuucuguuugcuacuauaagu

SEQ ID NO: 241617 - RNA, 22 nt, Human
ucacugcucugaaaguacaggg

SEQ ID NO: 241618 - RNA, 22 nt, Human
ucauaaagcucuuccaaaugua

SEQ ID NO: 241619 - RNA, 22 nt, Human
uggcugaggucuggggcuucug

SEQ ID NO: 241620 - RNA, 22 nt, Human
ucaggugugggcagagaaacca

SEQ ID NO: 241621 - RNA, 22 nt, Human
auuuccauuaucaugacaaauu

SEQ ID NO: 241622 - RNA, 22 nt, Human
cugggaaauugacacugauaaa

SEQ ID NO: 241623 - RNA, 22 nt, Human
gcuucucuucgccuagguccuu

SEQ ID NO: 241624 - RNA, 22 nt, Human
agccaugugucuuuauucuguu

SEQ ID NO: 241625 - RNA, 22 nt, Human
caggaaauugcaacagucugag

SEQ ID NO: 241626 - RNA, 22 nt, Human
ucccugccaaugauuggagcaa

SEQ ID NO: 241627 - RNA, 22 nt, Human
agaaaguucacugguauauuuu

SEQ ID NO: 241628 - RNA, 22 nt, Human
acuaaaguccuguuguagcaua

SEQ ID NO: 241629 - RNA, 22 nt, Human
caaguuuuagcaaguggaaagg

SEQ ID NO: 241630 - RNA, 22 nt, Human
gagggaaagguuaauacaugau

SEQ ID NO: 241631 - RNA, 22 nt, Human
aaacuggauuaccaggcuggug

SEQ ID NO: 241632 - RNA, 20 nt, Human
uauuuguauuugggaaaguu

SEQ ID NO: 241633 - RNA, 22 nt, Human
ucagaaggaagaagucauggga

SEQ ID NO: 241634 - RNA, 22 nt, Human
aaguuacauauucuugggcuau

SEQ ID NO: 241635 - RNA, 22 nt, Human
uccugugucucagcgugaagca

SEQ ID NO: 241636 - RNA, 22 nt, Human
uucuucugccucccaccugaua

SEQ ID NO: 241637 - RNA, 17 nt, Human
cugaggggagugcugug

SEQ ID NO: 241638 - RNA, 22 nt, Human
agaggaagccauugcuuacuga

SEQ ID NO: 241639 - RNA, 22 nt, Human
gggggaagacugggcuagugau

SEQ ID NO: 241640 - RNA, 22 nt, Human
uugcaaggagccacucugccug

SEQ ID NO: 241641 - RNA, 22 nt, Human
ugcucccaaaccugacaggcuc

SEQ ID NO: 241642 - RNA, 22 nt, Human
ugcucagggacaauggagaggg

SEQ ID NO: 241643 - RNA, 21 nt, Human
aucuggaagaacugguaagug

SEQ ID NO: 241644 - RNA, 22 nt, Human
gaaaucaauuucuugguugaua

SEQ ID NO: 241645 - RNA, 22 nt, Human
gcaguggggcgcugggaguugg

SEQ ID NO: 241646 - RNA, 19 nt, Human
cucugggcaagucacuuaa

SEQ ID NO: 241647 - RNA, 22 nt, Human
acccagaggcggagguugcagu

SEQ ID NO: 241648 - RNA, 22 nt, Human
accuacauguuccacauaguug

SEQ ID NO: 241649 - RNA, 20 nt, Human
ugcagcugguuucacaggga

SEQ ID NO: 241650 - RNA, 22 nt, Human
ucugaaauaggaaagcaaaugg

SEQ ID NO: 241651 - RNA, 22 nt, Human
gaagacacucugcagaguuauc

SEQ ID NO: 241652 - RNA, 22 nt, Human
ucccuggguccugcuugcucuc

SEQ ID NO: 241653 - RNA, 22 nt, Human
aaguccagcucuaaauaucuga

SEQ ID NO: 241654 - RNA, 22 nt, Human
gaguuuuaaccucagcucucug

SEQ ID NO: 241655 - RNA, 22 nt, Human
uccugugauggcuugcgaugug

SEQ ID NO: 241656 - RNA, 22 nt, Human
guccagccugaagagugggggc

SEQ ID NO: 241657 - RNA, 22 nt, Human
uuucaacaucaccuagcaguuc

SEQ ID NO: 241658 - RNA, 22 nt, Human
ugcagggcaguuuguuucggca

SEQ ID NO: 241659 - RNA, 22 nt, Human
ucuucucucauguaggagggaa

SEQ ID NO: 241660 - RNA, 22 nt, Human
agacauuuauguuucucuagga

SEQ ID NO: 241661 - RNA, 22 nt, Human
ugauuuacacaccuaugauuua

SEQ ID NO: 241662 - RNA, 22 nt, Human
aacuucugggcuguccaaaacu

SEQ ID NO: 241663 - RNA, 22 nt, Human
ucugaagauuaccagcuaaaug

SEQ ID NO: 241664 - RNA, 22 nt, Human
gggcucuguggaugugagagcu

SEQ ID NO: 241665 - RNA, 22 nt, Human
gugcaguguguaauccaggaac

SEQ ID NO: 241666 - RNA, 22 nt, Human
acacaugcgauagagagguagg

SEQ ID NO: 241667 - RNA, 22 nt, Human
ugucuccaaaacaaucucagau

SEQ ID NO: 241668 - RNA, 22 nt, Human
uuaucuguuguuuuaguacaau

SEQ ID NO: 241669 - RNA, 22 nt, Human
aguggcugauuacaaacugagu

SEQ ID NO: 241670 - RNA, 22 nt, Human
ccacagcaccgcugccaguccc

SEQ ID NO: 241671 - RNA, 22 nt, Human
ucuccccagacccuggacauaa

SEQ ID NO: 241672 - RNA, 22 nt, Human
aaagugguuuaugauauuccaa

SEQ ID NO: 241673 - RNA, 19 nt, Human
ucugggcagggccagcacc

SEQ ID NO: 241674 - RNA, 22 nt, Human
ugggaccugcccuggccccauc

SEQ ID NO: 241675 - RNA, 22 nt, Human
uuuagcaaaaaagcucugcgua

SEQ ID NO: 241676 - RNA, 22 nt, Human
uguucaguuugcuaucauaauc

SEQ ID NO: 241677 - RNA, 22 nt, Human
ugagcagucagacaagcaucac

SEQ ID NO: 241678 - RNA, 17 nt, Human
uuccaaggagcauuuga

SEQ ID NO: 241679 - RNA, 22 nt, Human
gcacugaaugcuuuuacuguaa

SEQ ID NO: 241680 - RNA, 22 nt, Human
auuacaugagagaauguaaaua

SEQ ID NO: 241681 - RNA, 22 nt, Human
cagcugagaaauggggaaaggg

SEQ ID NO: 241682 - RNA, 22 nt, Human
uuaauuacuaagcacaaugcaa

SEQ ID NO: 241683 - RNA, 22 nt, Human
uagggcagcugcaucaggcacu

SEQ ID NO: 241684 - RNA, 22 nt, Human
uuagaagugaaauagcuguaca

SEQ ID NO: 241685 - RNA, 22 nt, Human
ugacccauuugcuuuuccugua

SEQ ID NO: 241686 - RNA, 22 nt, Human
cacugcaguuccccagugcgca

SEQ ID NO: 241687 - RNA, 22 nt, Human
aagagagggguugcauggaaau

SEQ ID NO: 241688 - RNA, 22 nt, Human
uccagcccgagggcgcugauga

SEQ ID NO: 241689 - RNA, 22 nt, Human
uaguuaaagcccuaaauugaua

SEQ ID NO: 241690 - RNA, 22 nt, Human
caggagaugacagggaagaacc

SEQ ID NO: 241691 - RNA, 20 nt, Human
ucguuuauuugaaauugcuc

SEQ ID NO: 241692 - RNA, 22 nt, Human
gccacuguccugugccugugcu

SEQ ID NO: 241693 - RNA, 22 nt, Human
agucuauugccuaacagagagg

SEQ ID NO: 241694 - RNA, 22 nt, Human
auaaagcaauagauuguguaau

SEQ ID NO: 241695 - RNA, 22 nt, Human
cuuagaagugggcuauaauuag

SEQ ID NO: 241696 - RNA, 22 nt, Human
ggucagugcgauuucccacucc

SEQ ID NO: 241697 - RNA, 22 nt, Human
uaguccacagacucuacagcau

SEQ ID NO: 241698 - RNA, 22 nt, Human
ugagaugaauaacuccugcuaa

SEQ ID NO: 241699 - RNA, 22 nt, Human
ggccugagcagacagcaugaug

SEQ ID NO: 241700 - RNA, 22 nt, Human
agcuuuauuugucauucacggc

SEQ ID NO: 241701 - RNA, 22 nt, Human
ugagcccuaagggucaagcagg

SEQ ID NO: 241702 - RNA, 22 nt, Human
ugccuugggagccagcaugcca

SEQ ID NO: 241703 - RNA, 22 nt, Human
ccagcuuuagguugccugccag

SEQ ID NO: 241704 - RNA, 22 nt, Human
aaggcagcuucaccacagcauu

SEQ ID NO: 241705 - RNA, 22 nt, Human
ugcauggaggaagaugaaugca

SEQ ID NO: 241706 - RNA, 20 nt, Human
acaugcaguggucauuucag

SEQ ID NO: 241707 - RNA, 22 nt, Human
gugcagcugcaggagucagguc

SEQ ID NO: 241708 - RNA, 22 nt, Human
augcuuuuaacuccuuuauccc

SEQ ID NO: 241709 - RNA, 22 nt, Human
uagccauuuuuauuaaugcugg

SEQ ID NO: 241710 - RNA, 22 nt, Human
ggcacagggaggcccuggugug

SEQ ID NO: 241711 - RNA, 22 nt, Human
cugggggucgcgccucugggca

SEQ ID NO: 241712 - RNA, 22 nt, Human
agugugagcuaauagcagagcc

SEQ ID NO: 241713 - RNA, 22 nt, Human
ugcuacauaccacgaugcagua

SEQ ID NO: 241714 - RNA, 22 nt, Human
gcaaucaaugauuuauauuugu

SEQ ID NO: 241715 - RNA, 22 nt, Human
auguuacaaauccuacagguag

SEQ ID NO: 241716 - RNA, 22 nt, Human
uuacacaaaaauaagauauggc

SEQ ID NO: 241717 - RNA, 22 nt, Human
uuaucagaguccccaaaagaaa

SEQ ID NO: 241718 - RNA, 22 nt, Human
cacaugagagcccccaagagca

SEQ ID NO: 241719 - RNA, 22 nt, Human
gcuggcucuuuuugccgggcuc

SEQ ID NO: 241720 - RNA, 22 nt, Human
caugcuuuaccaaagcagugau

SEQ ID NO: 241721 - RNA, 23 nt, Human
uuuguacauugaggaggcagaau

SEQ ID NO: 241722 - RNA, 22 nt, Human
gggcccuggcuuuccuguucuu

SEQ ID NO: 241723 - RNA, 19 nt, Human
acaguuugggaaaugagca

SEQ ID NO: 241724 - RNA, 22 nt, Human
ugcuggguuaccuaagccuaaa

SEQ ID NO: 241725 - RNA, 22 nt, Human
uagaaaucagcaggcauaugua

SEQ ID NO: 241726 - RNA, 22 nt, Human
gcaggaagaugagcucagguaa

SEQ ID NO: 241727 - RNA, 22 nt, Human
gcauagucaguaggauucucaa

SEQ ID NO: 241728 - RNA, 22 nt, Human
agacagacagagaauuuaaaua

SEQ ID NO: 241729 - RNA, 22 nt, Human
ccaggagcagauauggacauaa

SEQ ID NO: 241730 - RNA, 22 nt, Human
cucugugccucaguuuucuucu

SEQ ID NO: 241731 - RNA, 22 nt, Human
cacaggaaguggucagugccag

SEQ ID NO: 241732 - RNA, 22 nt, Human
ugucuuuagagucacaaaacca

SEQ ID NO: 241733 - RNA, 22 nt, Human
uuuucauuguuccucgagcauu

SEQ ID NO: 241734 - RNA, 20 nt, Human
ucaaccuacugugcucaagu

SEQ ID NO: 241735 - RNA, 22 nt, Human
cauaauuagucauguuaugcau

SEQ ID NO: 241736 - RNA, 22 nt, Human
ccuguucauuuuuugacucugc

SEQ ID NO: 241737 - RNA, 22 nt, Human
cccagcuugcccaggacugagg

SEQ ID NO: 241738 - RNA, 22 nt, Human
uccugggaggcaggaccccuuu

SEQ ID NO: 241739 - RNA, 22 nt, Human
ucuucccagaccuuacauguga

SEQ ID NO: 241740 - RNA, 22 nt, Human
ggcuugcuucaccuacccccag

SEQ ID NO: 241741 - RNA, 22 nt, Human
gucauuuaggucugucagaaau

SEQ ID NO: 241742 - RNA, 22 nt, Human
acuaacuucugagaaccaauug

SEQ ID NO: 241743 - RNA, 22 nt, Human
aaagccuugagauccuauaguu

SEQ ID NO: 241744 - RNA, 22 nt, Human
ucugcaggaggcuggcugcagg

SEQ ID NO: 241745 - RNA, 22 nt, Human
agguccagccugcccucucucc

SEQ ID NO: 241746 - RNA, 22 nt, Human
cucaggagcuuccucagcccau

SEQ ID NO: 241747 - RNA, 22 nt, Human
uugcacagaugagggugaugcu

SEQ ID NO: 241748 - RNA, 22 nt, Human
gguguccugggcaggcagcuga

SEQ ID NO: 241749 - RNA, 23 nt, Human
cuuuuaacuugaucugagaccag

SEQ ID NO: 241750 - RNA, 22 nt, Human
uucaucuugauggcuuccuaau

SEQ ID NO: 241751 - RNA, 22 nt, Human
cagaagggcagcacugggaagg

SEQ ID NO: 241752 - RNA, 22 nt, Human
ugggcucugugccagguuggug

SEQ ID NO: 241753 - RNA, 22 nt, Human
aaagagcaagcugagauuugaa

SEQ ID NO: 241754 - RNA, 22 nt, Human
guagccuagaggucacgucuuc

SEQ ID NO: 241755 - RNA, 19 nt, Human
acacauuugcacaauccac

SEQ ID NO: 241756 - RNA, 18 nt, Human
aguggucuguuauaucau

SEQ ID NO: 241757 - RNA, 19 nt, Human
uaacuggugccuucaguca

SEQ ID NO: 241758 - RNA, 22 nt, Human
cagagccuuccuagcagacucu

SEQ ID NO: 241759 - RNA, 22 nt, Human
auuagcugugacgaggcauugu

SEQ ID NO: 241760 - RNA, 22 nt, Human
uucaugcuuuuaccgcuguuaa

SEQ ID NO: 241761 - RNA, 22 nt, Human
uccucaggaucuaggagugcuu

SEQ ID NO: 241762 - RNA, 22 nt, Human
caggauggccccggggcugugc

SEQ ID NO: 241763 - RNA, 22 nt, Human
augcaaaucuuaaguaugugug

SEQ ID NO: 241764 - RNA, 22 nt, Human
uacaggcugaacucaaugauga

SEQ ID NO: 241765 - RNA, 22 nt, Human
aguggaauguagaaaaaagaug

SEQ ID NO: 241766 - RNA, 22 nt, Human
aaggccaggccagaugacaguc

SEQ ID NO: 241767 - RNA, 22 nt, Human
gaagcagcuagcccacuaguca

SEQ ID NO: 241768 - RNA, 22 nt, Human
uccugucugcucacagagcugg

SEQ ID NO: 241769 - RNA, 22 nt, Human
gcugggacugagacagugaccu

SEQ ID NO: 241770 - RNA, 22 nt, Human
gaaggcuuuuuggguaauugua

SEQ ID NO: 241771 - RNA, 19 nt, Human
ggcaccuuggcuaugccug

SEQ ID NO: 241772 - RNA, 22 nt, Human
uacagugcuugguaucuaguaa

SEQ ID NO: 241773 - RNA, 22 nt, Human
caugcuuuucaaucuaucuuaa

SEQ ID NO: 241774 - RNA, 22 nt, Human
cagcccugggucccugcccugg

SEQ ID NO: 241775 - RNA, 22 nt, Human
ucaagacagugugauacuggcc

SEQ ID NO: 241776 - RNA, 22 nt, Human
cuggcugccuggagugagggag

SEQ ID NO: 241777 - RNA, 22 nt, Human
agucacucugcuacaugacagc

SEQ ID NO: 241778 - RNA, 20 nt, Human
uagauuucauacuucucuuu

SEQ ID NO: 241779 - RNA, 22 nt, Human
acaucuucccacacuugcaaaa

SEQ ID NO: 241780 - RNA, 22 nt, Human
gaggcccagcauucagggcagg

SEQ ID NO: 241781 - RNA, 22 nt, Human
cagggcagagggaaacuccuuu

SEQ ID NO: 241782 - RNA, 22 nt, Human
ucagaaucucuggaggcuuggc

SEQ ID NO: 241783 - RNA, 22 nt, Human
ucucccaggucauacacagaga

SEQ ID NO: 241784 - RNA, 22 nt, Human
agggcugccauuucuggcccaa

SEQ ID NO: 241785 - RNA, 22 nt, Human
gcuagccugcaguggcuauggu

SEQ ID NO: 241786 - RNA, 22 nt, Human
aguguauuaaguuaugaaguua

SEQ ID NO: 241787 - RNA, 22 nt, Human
cugggccaguuaugucucaucu

SEQ ID NO: 241788 - RNA, 22 nt, Human
gccucugcaucaucacuccagc

SEQ ID NO: 241789 - RNA, 20 nt, Human
gucugcccaggccaccacgg

SEQ ID NO: 241790 - RNA, 22 nt, Human
aagcauuuuaguaaugaacuug

SEQ ID NO: 241791 - RNA, 22 nt, Human
aagucacagcuaaauagcuaag

SEQ ID NO: 241792 - RNA, 22 nt, Human
uguccccaagguucagcccaca

SEQ ID NO: 241793 - RNA, 22 nt, Human
gggcugaggaacauauuuuguu

SEQ ID NO: 241794 - RNA, 22 nt, Human
cuauugaggacauaaggacucu

SEQ ID NO: 241795 - RNA, 23 nt, Human
agcagucagggugguaagccauc

SEQ ID NO: 241796 - RNA, 22 nt, Human
cuggagcucuguguguuccuga

SEQ ID NO: 241797 - RNA, 22 nt, Human
ccaggcuagagugcaauggcau

SEQ ID NO: 241798 - RNA, 21 nt, Human
agccugggaggcggagguugc

SEQ ID NO: 241799 - RNA, 19 nt, Human
ggacagucucagccucaug

SEQ ID NO: 241800 - RNA, 22 nt, Human
cuggcagcaguuaugaaacaau

SEQ ID NO: 241801 - RNA, 22 nt, Human
auuuuccuuguggguuagcgaa

SEQ ID NO: 241802 - RNA, 22 nt, Human
gaauuucagaucagagaccauu

SEQ ID NO: 241803 - RNA, 22 nt, Human
ucucuggggauggaccugggag

SEQ ID NO: 241804 - RNA, 22 nt, Human
ccagcccuccuccaucagagga

SEQ ID NO: 241805 - RNA, 22 nt, Human
uccuggggcucugagcgagaca

SEQ ID NO: 241806 - RNA, 22 nt, Human
ccaggaagacacaugcucaucc

SEQ ID NO: 241807 - RNA, 22 nt, Human
gaggaagaaucaggguggugag

SEQ ID NO: 241808 - RNA, 22 nt, Human
ugagguaggugucgagagaggu

SEQ ID NO: 241809 - RNA, 18 nt, Human
agcugguggggagacagc

SEQ ID NO: 241810 - RNA, 22 nt, Human
acuuugcacuaaguuacucauu

SEQ ID NO: 241811 - RNA, 22 nt, Human
aaugccuuauaggcugaaaauu

SEQ ID NO: 241812 - RNA, 22 nt, Human
accaggcuggagugcaguggcg

SEQ ID NO: 241813 - RNA, 23 nt, Human
agaauuguaaauagaauauaccu

SEQ ID NO: 241814 - RNA, 22 nt, Human
cauuucaaugccuucaacauag

SEQ ID NO: 241815 - RNA, 22 nt, Human
accugcaggcacaggugugcgc

SEQ ID NO: 241816 - RNA, 19 nt, Human
ccuuucagaacagaagcca

SEQ ID NO: 241817 - RNA, 23 nt, Human
ccaucaggccuccguguccagcc

SEQ ID NO: 241818 - RNA, 17 nt, Human
uuccugugguuugaucu

SEQ ID NO: 241819 - RNA, 19 nt, Human
acuuccugcccgcuccuuu

SEQ ID NO: 241820 - RNA, 22 nt, Human
gcagguguccugggcuggcagu

SEQ ID NO: 241821 - RNA, 22 nt, Human
aggcuucugucuuuaggaguug

SEQ ID NO: 241822 - RNA, 22 nt, Human
auaagguaaggguauugucaga

SEQ ID NO: 241823 - RNA, 22 nt, Human
cagcccugugcuaagcacccuc

SEQ ID NO: 241824 - RNA, 22 nt, Human
ggagguggagcuggaaguucca

SEQ ID NO: 241825 - RNA, 22 nt, Human
uucuccaguuucucccuucagu

SEQ ID NO: 241826 - RNA, 22 nt, Human
ccugggcucaccaugccuugga

SEQ ID NO: 241827 - RNA, 22 nt, Human
gggcucuggaaaugggagcucc

SEQ ID NO: 241828 - RNA, 22 nt, Human
uggcucagugacauuccuccca

SEQ ID NO: 241829 - RNA, 22 nt, Human
uauuucagucacuucuucucug

SEQ ID NO: 241830 - RNA, 22 nt, Human
uggguuaacaguuuauaccaga

SEQ ID NO: 241831 - RNA, 22 nt, Human
caaaaggcaggggaaagagugc

SEQ ID NO: 241832 - RNA, 22 nt, Human
uauuugaagggagaaagugcca

SEQ ID NO: 241833 - RNA, 22 nt, Human
uucuaagaaauggaaaacgauu

SEQ ID NO: 241834 - RNA, 22 nt, Human
ggaaggaaguaaaugaugcuau

SEQ ID NO: 241835 - RNA, 22 nt, Human
gccuccggagucacagugucuu

SEQ ID NO: 241836 - RNA, 20 nt, Human
uguugauuggugucaucuca

SEQ ID NO: 241837 - RNA, 22 nt, Human
caaggcuugaauucugaugggu

SEQ ID NO: 241838 - RNA, 22 nt, Human
cagugggauugggauuggaacc

SEQ ID NO: 241839 - RNA, 22 nt, Human
ggaggcauuauggggaagacuu

SEQ ID NO: 241840 - RNA, 22 nt, Human
auccuucuucugcuagugucua

SEQ ID NO: 241841 - RNA, 22 nt, Human
aaagcauggcaugaagaacaug

SEQ ID NO: 241842 - RNA, 22 nt, Human
cuccagugagugagcaggcgac

SEQ ID NO: 241843 - RNA, 22 nt, Human
aagaguuuccaugcucugugcu

SEQ ID NO: 241844 - RNA, 22 nt, Human
agaaaaagaaaguggauuuguc

SEQ ID NO: 241845 - RNA, 22 nt, Human
cagagccacagccuccagauuu

SEQ ID NO: 241846 - RNA, 18 nt, Human
ucaggagacacagacgca

SEQ ID NO: 241847 - RNA, 20 nt, Human
ccugucaucccagcauuuug

SEQ ID NO: 241848 - RNA, 22 nt, Human
ugggcugaaaugcuguggacua

SEQ ID NO: 241849 - RNA, 22 nt, Human
cggcacagccgggcaaggcugg

SEQ ID NO: 241850 - RNA, 19 nt, Human
ccagugucuagcgcacagc

SEQ ID NO: 241851 - RNA, 22 nt, Human
uuucuuauacuauauugucauc

SEQ ID NO: 241852 - RNA, 18 nt, Human
agaauuauucuuguccuc

SEQ ID NO: 241853 - RNA, 22 nt, Human
guccaucuguaggagggacaca

SEQ ID NO: 241854 - RNA, 22 nt, Human
cagaaaaccugacucuagaacu

SEQ ID NO: 241855 - RNA, 22 nt, Human
cagaaaucuccaugucagacau

SEQ ID NO: 241856 - RNA, 22 nt, Human
cuacauuuguucuauagcuuuu

SEQ ID NO: 241857 - RNA, 22 nt, Human
aaaaucuugacuguuuuuagaa

SEQ ID NO: 241858 - RNA, 22 nt, Human
ggauuucuuccuuccucagaag

SEQ ID NO: 241859 - RNA, 22 nt, Human
ucaagaaacugugcuacagagu

SEQ ID NO: 241860 - RNA, 22 nt, Human
accaggcagcacuuuccuugca

SEQ ID NO: 241861 - RNA, 23 nt, Human
acucaaaauuuggcauuugagga

SEQ ID NO: 241862 - RNA, 23 nt, Human
ugucuccaucucauuacuugggg

SEQ ID NO: 241863 - RNA, 22 nt, Human
acaaguuuauuugauuagaaca

SEQ ID NO: 241864 - RNA, 22 nt, Human
cuucucaguugcaagugucaga

SEQ ID NO: 241865 - RNA, 21 nt, Human
uuuacugagcacuuacuaugu

SEQ ID NO: 241866 - RNA, 22 nt, Human
uauuuuacuauuuggcaaaguc

SEQ ID NO: 241867 - RNA, 21 nt, Human
ggcugggucaugcagcuggcc

SEQ ID NO: 241868 - RNA, 22 nt, Human
gcccuaccucaguccagaucug

SEQ ID NO: 241869 - RNA, 22 nt, Human
cccaggcuggccuccgcagugc

SEQ ID NO: 241870 - RNA, 22 nt, Human
uuacagagcuggguggagagag

SEQ ID NO: 241871 - RNA, 22 nt, Human
agugugggugagggaggcccuc

SEQ ID NO: 241872 - RNA, 22 nt, Human
uugguuuauuucuuccuaugag

SEQ ID NO: 241873 - RNA, 22 nt, Human
uauuucugagaaccaacuuacc

SEQ ID NO: 241874 - RNA, 22 nt, Human
gccacagggcgagcggaggcca

SEQ ID NO: 241875 - RNA, 22 nt, Human
agcugguucagaaauuagaugg

SEQ ID NO: 241876 - RNA, 22 nt, Human
ugucacagucucgugagcaucu

SEQ ID NO: 241877 - RNA, 22 nt, Human
uccaggcuccugacuuuuuggg

SEQ ID NO: 241878 - RNA, 22 nt, Human
uaacagaaauaguaggugaggg

SEQ ID NO: 241879 - RNA, 20 nt, Human
agcauuugaaauaugacuau

SEQ ID NO: 241880 - RNA, 19 nt, Human
ucagaacucagaaugugua

SEQ ID NO: 241881 - RNA, 22 nt, Human
ucaagaugcauggguggcauaa

SEQ ID NO: 241882 - RNA, 22 nt, Human
aaugucugagucucuguauccc

SEQ ID NO: 241883 - RNA, 22 nt, Human
uagacaggaaacauuaggaugg

SEQ ID NO: 241884 - RNA, 22 nt, Human
gcacagccugucccuguccugg

SEQ ID NO: 241885 - RNA, 22 nt, Human
uuuaauguuaaauuuguagaug

SEQ ID NO: 241886 - RNA, 22 nt, Human
ugcccuggcucuccacuaguuu

SEQ ID NO: 241887 - RNA, 22 nt, Human
agauguggauccuaggguagaa

SEQ ID NO: 241888 - RNA, 22 nt, Human
aaagacacauaugcuuaaccca

SEQ ID NO: 241889 - RNA, 22 nt, Human
agaugauuaugauagcacuguu

SEQ ID NO: 241890 - RNA, 22 nt, Human
ugccagacuuucuuaccagugu

SEQ ID NO: 241891 - RNA, 22 nt, Human
uggauuaguuucaaggcagcaa

SEQ ID NO: 241892 - RNA, 22 nt, Human
caguuacauuaauaaugcacau

SEQ ID NO: 241893 - RNA, 22 nt, Human
uauuguuucuggcuguggcagc

SEQ ID NO: 241894 - RNA, 22 nt, Human
ggaggaaaggcucccucccucu

SEQ ID NO: 241895 - RNA, 22 nt, Human
cuccagugcuucuagaaaauac

SEQ ID NO: 241896 - RNA, 22 nt, Human
uugcucuccagaggcucacagc

SEQ ID NO: 241897 - RNA, 22 nt, Human
cugagcagaagggugcacgugc

SEQ ID NO: 241898 - RNA, 22 nt, Human
ucccagggggaugaacacugcc

SEQ ID NO: 241899 - RNA, 22 nt, Human
acagcaucuaguacagucuagu

SEQ ID NO: 241900 - RNA, 22 nt, Human
gcaggccuuuaucccugccuca

SEQ ID NO: 241901 - RNA, 22 nt, Human
caggacauugauccauuggcac

SEQ ID NO: 241902 - RNA, 22 nt, Human
acacaacagaagagcaauugca

SEQ ID NO: 241903 - RNA, 22 nt, Human
cagggaugguugagaauuggua

SEQ ID NO: 241904 - RNA, 22 nt, Human
cugagcauggccgguccauggu

SEQ ID NO: 241905 - RNA, 22 nt, Human
guucauguuugagaacaaggag

SEQ ID NO: 241906 - RNA, 18 nt, Human
auaaagugcuaauaaugg

SEQ ID NO: 241907 - RNA, 22 nt, Human
ggaggccaaagugugggcggcu

SEQ ID NO: 241908 - RNA, 22 nt, Human
cuuuucugagagggccaagauu

SEQ ID NO: 241909 - RNA, 18 nt, Human
ugaggcagucagugaugg

SEQ ID NO: 241910 - RNA, 20 nt, Human
cuaauuacagauuuuggaca

SEQ ID NO: 241911 - RNA, 20 nt, Human
uuucagagugucuuuccauu

SEQ ID NO: 241912 - RNA, 22 nt, Human
ugauaaacuggagagguggagg

SEQ ID NO: 241913 - RNA, 22 nt, Human
ucaggaaaguguucucagagga

SEQ ID NO: 241914 - RNA, 22 nt, Human
ucauaaauucuggugcugugag

SEQ ID NO: 241915 - RNA, 22 nt, Human
uaacacugccaugcuggaguca

SEQ ID NO: 241916 - RNA, 22 nt, Human
acaggccugagauuuugcauuu

SEQ ID NO: 241917 - RNA, 22 nt, Human
aggaucuuauguaauaauuaug

SEQ ID NO: 241918 - RNA, 22 nt, Human
uguuacaauauuaucaacugag

SEQ ID NO: 241919 - RNA, 22 nt, Human
ugcuuaaaauaguucauuuuug

SEQ ID NO: 241920 - RNA, 22 nt, Human
gcuggaggaggaagugugaggg

SEQ ID NO: 241921 - RNA, 22 nt, Human
uaggaaauuugaaauauguggg

SEQ ID NO: 241922 - RNA, 22 nt, Human
aguuucuuuagauagaaaguuc

SEQ ID NO: 241923 - RNA, 22 nt, Human
ucccaggacaggccacauggaa

SEQ ID NO: 241924 - RNA, 22 nt, Human
augguuuagcaacuuagggaaa

SEQ ID NO: 241925 - RNA, 22 nt, Human
gcccuguggacccaggaacucu

SEQ ID NO: 241926 - RNA, 22 nt, Human
ucagaaaggccacauggugcag

SEQ ID NO: 241927 - RNA, 22 nt, Human
uccugaggucugaaaaaggagc

SEQ ID NO: 241928 - RNA, 22 nt, Human
uucuuacauauuuucauauggu

SEQ ID NO: 241929 - RNA, 22 nt, Human
ucaagaugaaccaggacauuca

SEQ ID NO: 241930 - RNA, 22 nt, Human
ugcaggugccucuugagcuugu

SEQ ID NO: 241931 - RNA, 22 nt, Human
aggcagggugaugauaaugauu

SEQ ID NO: 241932 - RNA, 22 nt, Human
uagcaggcaucucagagauaau

SEQ ID NO: 241933 - RNA, 22 nt, Human
agcagacauaucucaugucaca

SEQ ID NO: 241934 - RNA, 22 nt, Human
ucuuuuggaaaugaugugcagg

SEQ ID NO: 241935 - RNA, 22 nt, Human
uuucaguugccaagcuaauucu

SEQ ID NO: 241936 - RNA, 22 nt, Human
ccaaggggccuuuagacacuau

SEQ ID NO: 241937 - RNA, 19 nt, Human
ccaggagagcuuggagaag

SEQ ID NO: 241938 - RNA, 22 nt, Human
auaauggcaugacaguuauaua

SEQ ID NO: 241939 - RNA, 22 nt, Human
gccagggugugcagggacagga

SEQ ID NO: 241940 - RNA, 17 nt, Human
ucuucucuuccagucuu

SEQ ID NO: 241941 - RNA, 22 nt, Human
uugggucuuauggcuggaguag

SEQ ID NO: 241942 - RNA, 17 nt, Human
auaaaggcaaguauuau

SEQ ID NO: 241943 - RNA, 22 nt, Human
agguuccaggucuggguuaugu

SEQ ID NO: 241944 - RNA, 22 nt, Human
agcacuuuaagcaacagaucaa

SEQ ID NO: 241945 - RNA, 22 nt, Human
acuugaauaggugucaaggcca

SEQ ID NO: 241946 - RNA, 22 nt, Human
guuagguagaaguuuacuuuga

SEQ ID NO: 241947 - RNA, 22 nt, Human
ccugcagacacuuguccagcaa

SEQ ID NO: 241948 - RNA, 22 nt, Human
uauauuguagcugaugacaaau

SEQ ID NO: 241949 - RNA, 22 nt, Human
aggucugagcucagggccuggc

SEQ ID NO: 241950 - RNA, 22 nt, Human
ugguccuguguucuuccugccu

SEQ ID NO: 241951 - RNA, 22 nt, Human
cugcccucuagggaugcacugg

SEQ ID NO: 241952 - RNA, 22 nt, Human
acccucagacauauuccaucau

SEQ ID NO: 241953 - RNA, 19 nt, Human
acuuugcaugugugucuaa

SEQ ID NO: 241954 - RNA, 22 nt, Human
cucugggcacuguauggguucu

SEQ ID NO: 241955 - RNA, 22 nt, Human
agcucagcccuccugugcagcu

SEQ ID NO: 241956 - RNA, 22 nt, Human
ucagaaauacuaucagcuuuug

SEQ ID NO: 241957 - RNA, 22 nt, Human
caccaggagcaucuaggaggcg

SEQ ID NO: 241958 - RNA, 22 nt, Human
ccuggccacccagccuuggcca

SEQ ID NO: 241959 - RNA, 22 nt, Human
uuuuucuaauggcuuaggaugu

SEQ ID NO: 241960 - RNA, 22 nt, Human
gagcaggccuggggugaggccu

SEQ ID NO: 241961 - RNA, 22 nt, Human
cuaaaugccuuuccuaccuaac

SEQ ID NO: 241962 - RNA, 21 nt, Human
ggguguggaaauuacauccug

SEQ ID NO: 241963 - RNA, 22 nt, Human
aacaguguguacacaucauagg

SEQ ID NO: 241964 - RNA, 22 nt, Human
uuucaugaggcugcauaaggag

SEQ ID NO: 241965 - RNA, 22 nt, Human
ucagagagcuggugggcagagg

SEQ ID NO: 241966 - RNA, 22 nt, Human
agaagcuaauucaugucuuaug

SEQ ID NO: 241967 - RNA, 22 nt, Human
caugugugggacccuuagguug

SEQ ID NO: 241968 - RNA, 22 nt, Human
uuguaauuugcaaauguauugu

SEQ ID NO: 241969 - RNA, 22 nt, Human
ggcaauuucaugugguuuaaac

SEQ ID NO: 241970 - RNA, 22 nt, Human
agcaaacagaugucuccuuuag

SEQ ID NO: 241971 - RNA, 22 nt, Human
cugcuguuuggugagugagaaa

SEQ ID NO: 241972 - RNA, 22 nt, Human
cccagagccgguggugcucaca

SEQ ID NO: 241973 - RNA, 22 nt, Human
aaguuucauguggagguagacu

SEQ ID NO: 241974 - RNA, 20 nt, Human
ugcugcaguuucaugggacu

SEQ ID NO: 241975 - RNA, 22 nt, Human
ccaggcuuucuccugacucaca

SEQ ID NO: 241976 - RNA, 22 nt, Human
agaaauagucacauuggaggaa

SEQ ID NO: 241977 - RNA, 19 nt, Human
ggccuugaugaguggggag

SEQ ID NO: 241978 - RNA, 22 nt, Human
cuuuacuaucaggaauaaacaa

SEQ ID NO: 241979 - RNA, 22 nt, Human
cugcacagccugucugggggcc

SEQ ID NO: 241980 - RNA, 22 nt, Human
uugaggcaaaaucaacgggaag

SEQ ID NO: 241981 - RNA, 22 nt, Human
gcuuggcucuaagacaccuauu

SEQ ID NO: 241982 - RNA, 22 nt, Human
aggcugagcggggucccagagc

SEQ ID NO: 241983 - RNA, 18 nt, Human
ucagcuggggcugcagcc

SEQ ID NO: 241984 - RNA, 17 nt, Human
agcuggguucucaggaa

SEQ ID NO: 241985 - RNA, 22 nt, Human
augaagcagcguuguagaguga

SEQ ID NO: 241986 - RNA, 22 nt, Human
ggaggcaggaaagacagguuca

SEQ ID NO: 241987 - RNA, 22 nt, Human
aaggggaaguagcaccagaggu

SEQ ID NO: 241988 - RNA, 22 nt, Human
ugcuugaacccaggaaguggag

SEQ ID NO: 241989 - RNA, 22 nt, Human
ggcagagcuuguuccuucuguu

SEQ ID NO: 241990 - RNA, 17 nt, Human
ugcugucugcuucccua

SEQ ID NO: 241991 - RNA, 22 nt, Human
ucagacccaggugccaagcugu

SEQ ID NO: 241992 - RNA, 22 nt, Human
cuguccagugcagagaacagag

SEQ ID NO: 241993 - RNA, 22 nt, Human
caucaaaguugauauccaauua

SEQ ID NO: 241994 - RNA, 22 nt, Human
cuuuaguucuaaugcauugaaa

SEQ ID NO: 241995 - RNA, 22 nt, Human
cuauuucauguuccuauggccg

SEQ ID NO: 241996 - RNA, 22 nt, Human
guccagugucuucuacauaaca

SEQ ID NO: 241997 - RNA, 22 nt, Human
agcauccugcuugcugucugug

SEQ ID NO: 241998 - RNA, 22 nt, Human
caagcugcuuauucucugcucu

SEQ ID NO: 241999 - RNA, 22 nt, Human
gcaggcugaaacucggggucua

SEQ ID NO: 242000 - RNA, 22 nt, Human
ggcuccagaaacuucaguccau

SEQ ID NO: 242001 - RNA, 21 nt, Human
uagaucaugguauucuuuggc

SEQ ID NO: 242002 - RNA, 22 nt, Human
uuccuguggccuuacaucugug

SEQ ID NO: 242003 - RNA, 20 nt, Human
ucuguagucuaugaggcuua

SEQ ID NO: 242004 - RNA, 22 nt, Human
ucuaacuuguauguauaguuuu

SEQ ID NO: 242005 - RNA, 22 nt, Human
aauauaacacagauggccuguu

SEQ ID NO: 242006 - RNA, 22 nt, Human
cacuagagaaacgcccaggcuc

SEQ ID NO: 242007 - RNA, 22 nt, Human
uaagauuauacuuaaagagaaa

SEQ ID NO: 242008 - RNA, 22 nt, Human
auugagaagaaaaucuaauaua

SEQ ID NO: 242009 - RNA, 22 nt, Human
ucauuucugagccuuccaugau

SEQ ID NO: 242010 - RNA, 22 nt, Human
uuuauaccucauucuuagcaaa

SEQ ID NO: 242011 - RNA, 22 nt, Human
agggaaauaaucuauucugagg

SEQ ID NO: 242012 - RNA, 22 nt, Human
aagcuguguauuacagaauauu

SEQ ID NO: 242013 - RNA, 22 nt, Human
gcuccugcagagauguuccaug

SEQ ID NO: 242014 - RNA, 22 nt, Human
uccaugauuggucaucauagaa

SEQ ID NO: 242015 - RNA, 22 nt, Human
ucccagccuuccuuguggugaa

SEQ ID NO: 242016 - RNA, 22 nt, Human
agcuccugugugaagccucccu

SEQ ID NO: 242017 - RNA, 22 nt, Human
uuggaaagaagggcugagcaag

SEQ ID NO: 242018 - RNA, 22 nt, Human
guggcaggagugggccuugaag

SEQ ID NO: 242019 - RNA, 19 nt, Human
aggguccaggcccugugga

SEQ ID NO: 242020 - RNA, 22 nt, Human
auaagcaugauuaccgggagca

SEQ ID NO: 242021 - RNA, 22 nt, Human
aagcaacauucucuguggcauu

SEQ ID NO: 242022 - RNA, 22 nt, Human
gcccucucggcauagcaggggc

SEQ ID NO: 242023 - RNA, 22 nt, Human
uagggguguuucgagagagguu

SEQ ID NO: 242024 - RNA, 22 nt, Human
uccuggcagggucuaggucuag

SEQ ID NO: 242025 - RNA, 22 nt, Human
cucagugucacguuuugccuua

SEQ ID NO: 242026 - RNA, 22 nt, Human
aaggcuuuuguuccuauuuagu

SEQ ID NO: 242027 - RNA, 22 nt, Human
uuaaguccuugguaauuuucuu

SEQ ID NO: 242028 - RNA, 21 nt, Human
aucuuuagccauccaaucaga

SEQ ID NO: 242029 - RNA, 22 nt, Human
ggcugcugaaguguggcaaucu

SEQ ID NO: 242030 - RNA, 22 nt, Human
caggacaaagcccuuugagaaa

SEQ ID NO: 242031 - RNA, 22 nt, Human
gggaaacucaggcauuuccacu

SEQ ID NO: 242032 - RNA, 22 nt, Human
uuauuuucuccucagaaagugg

SEQ ID NO: 242033 - RNA, 22 nt, Human
uuuauuuggcaucucugccaag

SEQ ID NO: 242034 - RNA, 22 nt, Human
gaaugaauucagcacauggaau

SEQ ID NO: 242035 - RNA, 21 nt, Human
ugcuccaggagggggcagucc

SEQ ID NO: 242036 - RNA, 22 nt, Human
aaauguguauaugaaacaugau

SEQ ID NO: 242037 - RNA, 22 nt, Human
aaugaaugaaccacauauaaca

SEQ ID NO: 242038 - RNA, 22 nt, Human
ugggaaggacgugucaguggca

SEQ ID NO: 242039 - RNA, 22 nt, Human
acugaugaaaacuaauaaauua

SEQ ID NO: 242040 - RNA, 22 nt, Human
aagucuuucauaagucucuuau

SEQ ID NO: 242041 - RNA, 22 nt, Human
auguaguauuuggaaauguaaa

SEQ ID NO: 242042 - RNA, 22 nt, Human
uggugcugccaccuccucugcu

SEQ ID NO: 242043 - RNA, 22 nt, Human
ucaacuuugaaaccauagugaa

SEQ ID NO: 242044 - RNA, 22 nt, Human
gggcacagcccagugggguccc

SEQ ID NO: 242045 - RNA, 22 nt, Human
gcccaagcagcuucccgagcuu

SEQ ID NO: 242046 - RNA, 22 nt, Human
cuccaggaaagucaggcuuaga

SEQ ID NO: 242047 - RNA, 22 nt, Human
ccccuguguuguucaaggguca

SEQ ID NO: 242048 - RNA, 22 nt, Human
aagacauugucauuuuauaauu

SEQ ID NO: 242049 - RNA, 22 nt, Human
cugggagaggcugcuccgcucu

SEQ ID NO: 242050 - RNA, 22 nt, Human
uagcaagaugucacuccaaguu

SEQ ID NO: 242051 - RNA, 21 nt, Human
ucaccuggcuucugaccuggc

SEQ ID NO: 242052 - RNA, 22 nt, Human
ggcagcucgaugacuucugcau

SEQ ID NO: 242053 - RNA, 22 nt, Human
aucagagcacugagcaggacac

SEQ ID NO: 242054 - RNA, 22 nt, Human
uggugggagugagggcaugcca

SEQ ID NO: 242055 - RNA, 22 nt, Human
auuccaguuaguggcagcuuau

SEQ ID NO: 242056 - RNA, 22 nt, Human
cagauaugcugagacuccugug

SEQ ID NO: 242057 - RNA, 22 nt, Human
cuacccuugccugccaggugac

SEQ ID NO: 242058 - RNA, 22 nt, Human
cagacugaguggauuaaacaau

SEQ ID NO: 242059 - RNA, 22 nt, Human
gcccugagggguggugucugua

SEQ ID NO: 242060 - RNA, 22 nt, Human
gcauuaauguaagacccacucc

SEQ ID NO: 242061 - RNA, 19 nt, Human
ucucuugaauaggucaaac

SEQ ID NO: 242062 - RNA, 22 nt, Human
gcagggugauagugaggcucag

SEQ ID NO: 242063 - RNA, 22 nt, Human
caguguccucagccagcagcua

SEQ ID NO: 242064 - RNA, 22 nt, Human
caggucugaagagucacaugcc

SEQ ID NO: 242065 - RNA, 22 nt, Human
uagaaauucaaugcucugagua

SEQ ID NO: 242066 - RNA, 22 nt, Human
uccugaccucuugcucugaccu

SEQ ID NO: 242067 - RNA, 22 nt, Human
guccuguugugagcugccuucc

SEQ ID NO: 242068 - RNA, 22 nt, Human
acagagagguaaaauauauagu

SEQ ID NO: 242069 - RNA, 22 nt, Human
ggcaccagggaaggaaggcugg

SEQ ID NO: 242070 - RNA, 22 nt, Human
gcacugggcuccaggaaggagg

SEQ ID NO: 242071 - RNA, 22 nt, Human
ugacgucaacugcaaaggccuu

SEQ ID NO: 242072 - RNA, 22 nt, Human
cagcagcuccucugcggcuaug

SEQ ID NO: 242073 - RNA, 22 nt, Human
uucuuguuuugcccaaguugua

SEQ ID NO: 242074 - RNA, 22 nt, Human
ugugugucacugaaagaaaucu

SEQ ID NO: 242075 - RNA, 22 nt, Human
auggaguggggacugcagugga

SEQ ID NO: 242076 - RNA, 22 nt, Human
ggagaaggugcuggucacugug

SEQ ID NO: 242077 - RNA, 22 nt, Human
ugucauuuuauguauguggucu

SEQ ID NO: 242078 - RNA, 22 nt, Human
aggaccuggaucacagagaucu

SEQ ID NO: 242079 - RNA, 22 nt, Human
ucagacagcuugggauaacuga

SEQ ID NO: 242080 - RNA, 22 nt, Human
aaguuuuaacaaguacuuacua

SEQ ID NO: 242081 - RNA, 22 nt, Human
agcuaaugaugagauacagaua

SEQ ID NO: 242082 - RNA, 22 nt, Human
uguggcagagagagcuuccuug

SEQ ID NO: 242083 - RNA, 22 nt, Human
aucuuucuuauuugaagaaaga

SEQ ID NO: 242084 - RNA, 22 nt, Human
uucaacaaacuguucacgaaug

SEQ ID NO: 242085 - RNA, 22 nt, Human
ucauuuguggaagugauugugg

SEQ ID NO: 242086 - RNA, 22 nt, Human
aggucugguguugggccugaaa

SEQ ID NO: 242087 - RNA, 22 nt, Human
ugggccacaagccaugggacca

SEQ ID NO: 242088 - RNA, 22 nt, Human
gaugggggccagggccugcuuu

SEQ ID NO: 242089 - RNA, 18 nt, Human
caggugggucuccugccc

SEQ ID NO: 242090 - RNA, 20 nt, Human
auuguuucauuuaauguaca

SEQ ID NO: 242091 - RNA, 22 nt, Human
cugugggcucccagcuucucuc

SEQ ID NO: 242092 - RNA, 15 nt, Human
augaggcauuugggg

SEQ ID NO: 242093 - RNA, 22 nt, Human
cuuugcaauagaggcacacaug

SEQ ID NO: 242094 - RNA, 21 nt, Human
acaggcucuggggaugcuggg

SEQ ID NO: 242095 - RNA, 20 nt, Human
gggcuggcgcauggggaaag

SEQ ID NO: 242096 - RNA, 22 nt, Human
aagauuuacuuucuuuguaaua

SEQ ID NO: 242097 - RNA, 21 nt, Human
cucaggcuggcagcaggcuag

SEQ ID NO: 242098 - RNA, 22 nt, Human
acacauuaucucauuaaauacu

SEQ ID NO: 242099 - RNA, 22 nt, Human
acaggccugggguacaaguucu

SEQ ID NO: 242100 - RNA, 22 nt, Human
aguuucuagcaaggauuguuga

SEQ ID NO: 242101 - RNA, 22 nt, Human
guuuuauuggaacacagccaug

SEQ ID NO: 242102 - RNA, 18 nt, Human
ugagaaccauguucauuc

SEQ ID NO: 242103 - RNA, 22 nt, Human
auacaguagacaaucucaugaa

SEQ ID NO: 242104 - RNA, 22 nt, Human
uuugaaaggaauuaggaugaca

SEQ ID NO: 242105 - RNA, 22 nt, Human
cagcaacuccuguagcuuaugc

SEQ ID NO: 242106 - RNA, 22 nt, Human
uaaacucuucuguagaaucaga

SEQ ID NO: 242107 - RNA, 22 nt, Human
uauggcaagaugacauguucuc

SEQ ID NO: 242108 - RNA, 20 nt, Human
uucuagaaguuugcuaccca

SEQ ID NO: 242109 - RNA, 22 nt, Human
uguuucuugggugcucacauca

SEQ ID NO: 242110 - RNA, 22 nt, Human
aaacugcaauuacuuuugcacc

SEQ ID NO: 242111 - RNA, 19 nt, Human
uuucuaguuucagcuuguc

SEQ ID NO: 242112 - RNA, 18 nt, Human
ugaacagaugaguugaag

SEQ ID NO: 242113 - RNA, 20 nt, Human
agcuggucuuaaguaacuga

SEQ ID NO: 242114 - RNA, 22 nt, Human
auuacaacuacauaaucucaga

SEQ ID NO: 242115 - RNA, 22 nt, Human
cagugguuuccaaacuuguucc

SEQ ID NO: 242116 - RNA, 23 nt, Human
uucauucaaaaggaaaagucaug

SEQ ID NO: 242117 - RNA, 22 nt, Human
augcauauagaacauuugacau

SEQ ID NO: 242118 - RNA, 22 nt, Human
cccauggagugccugagggcca

SEQ ID NO: 242119 - RNA, 22 nt, Human
aaauucaguuuuaauaaucacu

SEQ ID NO: 242120 - RNA, 23 nt, Human
uccucagcauguuuugucaugua

SEQ ID NO: 242121 - RNA, 22 nt, Human
cugaaggaagcagguggccugu

SEQ ID NO: 242122 - RNA, 22 nt, Human
caggcuggagugcaauggcaca

SEQ ID NO: 242123 - RNA, 22 nt, Human
augagugcaacagaucagcaug

SEQ ID NO: 242124 - RNA, 19 nt, Human
acccucugccacaagccuc

SEQ ID NO: 242125 - RNA, 22 nt, Human
cuucauguacaguuauuggaga

SEQ ID NO: 242126 - RNA, 23 nt, Human
auguagaguacagcacaacagca

SEQ ID NO: 242127 - RNA, 22 nt, Human
aggcccaguguggcuuccugga

SEQ ID NO: 242128 - RNA, 22 nt, Human
agcuuuagaauuguucagcaag

SEQ ID NO: 242129 - RNA, 22 nt, Human
uacauguggguuaaaaacacuc

SEQ ID NO: 242130 - RNA, 22 nt, Human
cuggggggcuacugacagagga

SEQ ID NO: 242131 - RNA, 22 nt, Human
aauuaucagauauaaaacugca

SEQ ID NO: 242132 - RNA, 19 nt, Human
gccucugagggcaggacac

SEQ ID NO: 242133 - RNA, 19 nt, Human
uagucuuuauucuuaauuu

SEQ ID NO: 242134 - RNA, 22 nt, Human
agcaaagaaauggaggcucaga

SEQ ID NO: 242135 - RNA, 22 nt, Human
agugucuggucucugaacuaaa

SEQ ID NO: 242136 - RNA, 22 nt, Human
ugcuccaggagcaaccuuugag

SEQ ID NO: 242137 - RNA, 22 nt, Human
aggagacauggaauagugaggc

SEQ ID NO: 242138 - RNA, 23 nt, Human
uucugaaaauagauaguggcucc

SEQ ID NO: 242139 - RNA, 16 nt, Human
gccugggagggaacag

SEQ ID NO: 242140 - RNA, 22 nt, Human
aguaaguuccaguuucauuaug

SEQ ID NO: 242141 - RNA, 22 nt, Human
guggcaguuuugacaucacaaa

SEQ ID NO: 242142 - RNA, 22 nt, Human
ggggaccuaggcucugucucuu

SEQ ID NO: 242143 - RNA, 22 nt, Human
uucucuaauggugaugauuaga

SEQ ID NO: 242144 - RNA, 22 nt, Human
cagcacauaagccgaagacugu

SEQ ID NO: 242145 - RNA, 23 nt, Human
uauacacauguggcaguauagug

SEQ ID NO: 242146 - RNA, 22 nt, Human
aggcaauuguuuguguaauagg

SEQ ID NO: 242147 - RNA, 22 nt, Human
ucucaaacuaacaaugauuaua

SEQ ID NO: 242148 - RNA, 22 nt, Human
uacaagugugcaccaccauguc

SEQ ID NO: 242149 - RNA, 22 nt, Human
agucucagcaagcauggcuagu

SEQ ID NO: 242150 - RNA, 22 nt, Human
ugagcuucaaaauaugugaauc

SEQ ID NO: 242151 - RNA, 22 nt, Human
cuggagcuccagggucuccucu

SEQ ID NO: 242152 - RNA, 22 nt, Human
ugcagcugcugguggcugaaag

SEQ ID NO: 242153 - RNA, 22 nt, Human
auuucucagugugaucaggccu

SEQ ID NO: 242154 - RNA, 16 nt, Human
cuacccagugagaagg

SEQ ID NO: 242155 - RNA, 22 nt, Human
cgucccaguuccagccgcgcug

SEQ ID NO: 242156 - RNA, 22 nt, Human
gggaucugaguugucaggaagg

SEQ ID NO: 242157 - RNA, 22 nt, Human
augacaaggguugacacauguc

SEQ ID NO: 242158 - RNA, 22 nt, Human
uacagauauagagauuuauaga

SEQ ID NO: 242159 - RNA, 22 nt, Human
cagaggaaguuccuugaugaga

SEQ ID NO: 242160 - RNA, 21 nt, Human
gggaaacucugcuuaacagag

SEQ ID NO: 242161 - RNA, 22 nt, Human
acuugaauuuaguuuuuccuaa

SEQ ID NO: 242162 - RNA, 22 nt, Human
uggcauuuuccaaugauauguu

SEQ ID NO: 242163 - RNA, 22 nt, Human
uuugaacugauaaucuucuguu

SEQ ID NO: 242164 - RNA, 22 nt, Human
ugggaagcauuaaugauagggg

SEQ ID NO: 242165 - RNA, 22 nt, Human
ucccauauauguuuauauugga

SEQ ID NO: 242166 - RNA, 22 nt, Human
uggggacauagccagucuggcu

SEQ ID NO: 242167 - RNA, 22 nt, Human
aaauauguaagauuagcacuag

SEQ ID NO: 242168 - RNA, 22 nt, Human
aaguuacaguuacagaauggag

SEQ ID NO: 242169 - RNA, 22 nt, Human
gaugucuuuagggcaaaauauu

SEQ ID NO: 242170 - RNA, 22 nt, Human
caaaguuaucaacugcaacauu

SEQ ID NO: 242171 - RNA, 22 nt, Human
aucagcaaguccuguuaauucu

SEQ ID NO: 242172 - RNA, 22 nt, Human
uccuccagugguacuggccaau

SEQ ID NO: 242173 - RNA, 22 nt, Human
caggaaacaaagccuugcucau

SEQ ID NO: 242174 - RNA, 22 nt, Human
aacauuuacaaauccuucugca

SEQ ID NO: 242175 - RNA, 22 nt, Human
gucacagaucucuugagucaag

SEQ ID NO: 242176 - RNA, 22 nt, Human
agauuuaaauuugcuacaauuc

SEQ ID NO: 242177 - RNA, 22 nt, Human
gacuuucugaaggucucgcagu

SEQ ID NO: 242178 - RNA, 22 nt, Human
caaggacacugagcuuuguaaa

SEQ ID NO: 242179 - RNA, 22 nt, Human
ccucugcugcuguugagcaccg

SEQ ID NO: 242180 - RNA, 22 nt, Human
auuugccuuuuaaacucacaau

SEQ ID NO: 242181 - RNA, 22 nt, Human
aacucugauuagcucaaguuaa

SEQ ID NO: 242182 - RNA, 22 nt, Human
uuauuaagugcguacuguaugc

SEQ ID NO: 242183 - RNA, 22 nt, Human
ucaugauuuuucuuuacaguug

SEQ ID NO: 242184 - RNA, 20 nt, Human
ucagaaguuuccuggagcau

SEQ ID NO: 242185 - RNA, 22 nt, Human
uaggcagcuuagguuagaagug

SEQ ID NO: 242186 - RNA, 22 nt, Human
uuacagugaaguaccauuaaaa

SEQ ID NO: 242187 - RNA, 22 nt, Human
auauuuauaagcaagcaggacu

SEQ ID NO: 242188 - RNA, 22 nt, Human
uuuaacacuaguuucuuuaacu

SEQ ID NO: 242189 - RNA, 21 nt, Human
uggugccuucagcugucuuuu

SEQ ID NO: 242190 - RNA, 22 nt, Human
uguauuuaauuguaucaucaca

SEQ ID NO: 242191 - RNA, 22 nt, Human
agccuggcuaaauucucccaug

SEQ ID NO: 242192 - RNA, 20 nt, Human
ugcagggcugccucccagcu

SEQ ID NO: 242193 - RNA, 22 nt, Human
aguggcuaugcaugacuggaau

SEQ ID NO: 242194 - RNA, 22 nt, Human
gagagggcaagguagaugcuac

SEQ ID NO: 242195 - RNA, 22 nt, Human
cacagguguaugaauaugucca

SEQ ID NO: 242196 - RNA, 22 nt, Human
acaggcagauuaaggguaggca

SEQ ID NO: 242197 - RNA, 22 nt, Human
aaccuugaauacuuaaauacau

SEQ ID NO: 242198 - RNA, 22 nt, Human
cugggucccggcuucuauccac

SEQ ID NO: 242199 - RNA, 22 nt, Human
aaaggcauggaacagauucucc

SEQ ID NO: 242200 - RNA, 22 nt, Human
cuuccagaggaacucugcagug

SEQ ID NO: 242201 - RNA, 22 nt, Human
cugggcuccacuacuugcuaac

SEQ ID NO: 242202 - RNA, 23 nt, Human
uggaaucuucgauauugauucag

SEQ ID NO: 242203 - RNA, 22 nt, Human
caggugucuaauucucaccccc

SEQ ID NO: 242204 - RNA, 18 nt, Human
aaaauaacaaaguuggcu

SEQ ID NO: 242205 - RNA, 22 nt, Human
agaguuguuguacaaacuaaau

SEQ ID NO: 242206 - RNA, 22 nt, Human
ugagcaccaggcaccacagcuc

SEQ ID NO: 242207 - RNA, 22 nt, Human
uagauuuuacuucugucauuac

SEQ ID NO: 242208 - RNA, 22 nt, Human
uaccuguuuuaaagcuaaaagg

SEQ ID NO: 242209 - RNA, 22 nt, Human
gauauuuacaaauuugccaaua

SEQ ID NO: 242210 - RNA, 19 nt, Human
gccaggucuuggguccagg

SEQ ID NO: 242211 - RNA, 22 nt, Human
agcagagguuuguuggaaaccu

SEQ ID NO: 242212 - RNA, 22 nt, Human
gccugggauuguguaagugaau

SEQ ID NO: 242213 - RNA, 19 nt, Human
ucaggagcagcuucugaac

SEQ ID NO: 242214 - RNA, 22 nt, Human
gggcuccuggcagucaugcuca

SEQ ID NO: 242215 - RNA, 22 nt, Human
cuggccaggcucucacgugguc

SEQ ID NO: 242216 - RNA, 20 nt, Human
ugaguggccacugggucgca

SEQ ID NO: 242217 - RNA, 21 nt, Human
acagagcauaaugguguggca

SEQ ID NO: 242218 - RNA, 22 nt, Human
uggcaauaugcuuucaguggcc

SEQ ID NO: 242219 - RNA, 22 nt, Human
gaggaaaauaacaacuaagggc

SEQ ID NO: 242220 - RNA, 20 nt, Human
cugggucuccuucugcuuaa

SEQ ID NO: 242221 - RNA, 22 nt, Human
uauaucagaguuaaaagaaugu

SEQ ID NO: 242222 - RNA, 21 nt, Human
ucagcuuugcaacugcacauc

SEQ ID NO: 242223 - RNA, 22 nt, Human
guucuucaguaaaauuaaaugu

SEQ ID NO: 242224 - RNA, 22 nt, Human
aagaaguuggaaaugauugaga

SEQ ID NO: 242225 - RNA, 21 nt, Human
agccagauccauuuugcaugg

SEQ ID NO: 242226 - RNA, 22 nt, Human
cagguccuggcagcugacucag

SEQ ID NO: 242227 - RNA, 22 nt, Human
uucaaauacauucuuugccacu

SEQ ID NO: 242228 - RNA, 22 nt, Human
ccugggagcuguggaaaggcug

SEQ ID NO: 242229 - RNA, 22 nt, Human
uuuguggcaggagcggagaccg

SEQ ID NO: 242230 - RNA, 22 nt, Human
ugcauuggucauuuagaaaaua

SEQ ID NO: 242231 - RNA, 18 nt, Human
gggagcugggaagcuggu

SEQ ID NO: 242232 - RNA, 20 nt, Human
uuccuggcucuaggaccuug

SEQ ID NO: 242233 - RNA, 22 nt, Human
uauaucaccaaaaacaguucug

SEQ ID NO: 242234 - RNA, 18 nt, Human
agcagcugucagaaugcc

SEQ ID NO: 242235 - RNA, 22 nt, Human
guaauuacaugaguacuguaag

SEQ ID NO: 242236 - RNA, 22 nt, Human
gugugucagagcucagagaagu

SEQ ID NO: 242237 - RNA, 22 nt, Human
ggggcagaaagcccacagagug

SEQ ID NO: 242238 - RNA, 18 nt, Human
guccacagcccucacagc

SEQ ID NO: 242239 - RNA, 22 nt, Human
gaaacagcacguuuggagagau

SEQ ID NO: 242240 - RNA, 22 nt, Human
gcagggacgcagcacucuccgu

SEQ ID NO: 242241 - RNA, 22 nt, Human
aguuaacacagucaggaguaac

SEQ ID NO: 242242 - RNA, 21 nt, Human
cacuggaauuuucugugacau

SEQ ID NO: 242243 - RNA, 22 nt, Human
gccacaggcuuaggagggaggu

SEQ ID NO: 242244 - RNA, 22 nt, Human
gugcuucugccaacuaauuaac

SEQ ID NO: 242245 - RNA, 22 nt, Human
uuccugugguccagagucaucc

SEQ ID NO: 242246 - RNA, 22 nt, Human
uuggcugcuggucuuuggauau

SEQ ID NO: 242247 - RNA, 22 nt, Human
uuugggauuuuacauuguaugg

SEQ ID NO: 242248 - RNA, 22 nt, Human
guuucauuaccugacccaugag

SEQ ID NO: 242249 - RNA, 22 nt, Human
guccugggcggagggcugcugu

SEQ ID NO: 242250 - RNA, 22 nt, Human
cugguuuauucgucacaccgga

SEQ ID NO: 242251 - RNA, 22 nt, Human
uggcccgccggaagaagauguc

SEQ ID NO: 242252 - RNA, 22 nt, Human
gcucagggcuaaggcugagggg

SEQ ID NO: 242253 - RNA, 22 nt, Human
agcugcaauacccuucuuccuu

SEQ ID NO: 242254 - RNA, 22 nt, Human
agagagacgggggcugcugcuu

SEQ ID NO: 242255 - RNA, 22 nt, Human
gagcugagcuuaacuccuugaa

SEQ ID NO: 242256 - RNA, 22 nt, Human
uauuccaaaaucccaaacugcc

SEQ ID NO: 242257 - RNA, 22 nt, Human
ucugccuugauggcauugagaa

SEQ ID NO: 242258 - RNA, 22 nt, Human
uauuuucaccuucucuggauau

SEQ ID NO: 242259 - RNA, 22 nt, Human
aggugggguucagucucagccg

SEQ ID NO: 242260 - RNA, 23 nt, Human
acaugggagggacauggaggcug

SEQ ID NO: 242261 - RNA, 22 nt, Human
aguccugucucucccagggcca

SEQ ID NO: 242262 - RNA, 22 nt, Human
agcaccuccuuagcuaugacca

SEQ ID NO: 242263 - RNA, 22 nt, Human
ugaggcaguauuuuagugacuu

SEQ ID NO: 242264 - RNA, 22 nt, Human
auggcagacacaggcaggcaga

SEQ ID NO: 242265 - RNA, 22 nt, Human
uguguccuacugaggagcuccu

SEQ ID NO: 242266 - RNA, 22 nt, Human
gcauccagucuuggcuccugga

SEQ ID NO: 242267 - RNA, 22 nt, Human
guaagccucugcucuaucuggu

SEQ ID NO: 242268 - RNA, 22 nt, Human
auucucaguucacuaguuucuu

SEQ ID NO: 242269 - RNA, 22 nt, Human
uuguagaaucauuauuucuagu

SEQ ID NO: 242270 - RNA, 22 nt, Human
gcuguucaagacuaggaaauuu

SEQ ID NO: 242271 - RNA, 22 nt, Human
agaugaguaaauggagucuucc

SEQ ID NO: 242272 - RNA, 22 nt, Human
ucuuucuguaagcuccauggaa

SEQ ID NO: 242273 - RNA, 22 nt, Human
accaguuucugggggagguugg

SEQ ID NO: 242274 - RNA, 22 nt, Human
auaguacagauccauuaauuau

SEQ ID NO: 242275 - RNA, 22 nt, Human
aggaccagugagucuggcaagu

SEQ ID NO: 242276 - RNA, 22 nt, Human
aauucacauguugaaguccuaa

SEQ ID NO: 242277 - RNA, 22 nt, Human
gugccugcuaccugacuuguuu

SEQ ID NO: 242278 - RNA, 22 nt, Human
aaauagcugaaaguuccuagau

SEQ ID NO: 242279 - RNA, 22 nt, Human
acaccauacucauguugguucc

SEQ ID NO: 242280 - RNA, 22 nt, Human
ggccacagcagaugcuucagau

SEQ ID NO: 242281 - RNA, 22 nt, Human
guuuggaauagcaguaaacauu

SEQ ID NO: 242282 - RNA, 23 nt, Human
ugauuacaagggccaaagaaagg

SEQ ID NO: 242283 - RNA, 22 nt, Human
accucagaggccagggaucuag

SEQ ID NO: 242284 - RNA, 23 nt, Human
agccucagccgguggcagaagug

SEQ ID NO: 242285 - RNA, 22 nt, Human
gucugggcagcagcauuucuua

SEQ ID NO: 242286 - RNA, 22 nt, Human
guacacuugucuugaacagccu

SEQ ID NO: 242287 - RNA, 22 nt, Human
gcucccaggaugaggagccagg

SEQ ID NO: 242288 - RNA, 22 nt, Human
aagaggcagaaauaucgcugaa

SEQ ID NO: 242289 - RNA, 22 nt, Human
auugcuuuuagugaaauuauau

SEQ ID NO: 242290 - RNA, 22 nt, Human
gcuggcuguaucaccuggccag

SEQ ID NO: 242291 - RNA, 22 nt, Human
ggaggggcagccauggaacucc

SEQ ID NO: 242292 - RNA, 22 nt, Human
cccaggagguggaguucacagu

SEQ ID NO: 242293 - RNA, 22 nt, Human
ucagucuuugcuuaugacaaua

SEQ ID NO: 242294 - RNA, 22 nt, Human
ccugggcugaagucaagugugg

SEQ ID NO: 242295 - RNA, 22 nt, Human
gcuguucauuagaaauagaaug

SEQ ID NO: 242296 - RNA, 22 nt, Human
cagugcagguggcagaggacag

SEQ ID NO: 242297 - RNA, 22 nt, Human
ucgccucaucauccuaauuaca

SEQ ID NO: 242298 - RNA, 17 nt, Human
gguggccugcaguggcu

SEQ ID NO: 242299 - RNA, 22 nt, Human
gaucugguacaggccugcagcc

SEQ ID NO: 242300 - RNA, 22 nt, Human
ugucuuuuauaacugacauaua

SEQ ID NO: 242301 - RNA, 22 nt, Human
gcucucuggaggccauggacag

SEQ ID NO: 242302 - RNA, 22 nt, Human
gaggcuaaggugccagacgaau

SEQ ID NO: 242303 - RNA, 22 nt, Human
auguuauaguuauaaaaugagg

SEQ ID NO: 242304 - RNA, 22 nt, Human
uaggagaggugaauggcacacu

SEQ ID NO: 242305 - RNA, 22 nt, Human
ggagacagugacuuagagacug

SEQ ID NO: 242306 - RNA, 22 nt, Human
ucugggugcuacaaacaguauu

SEQ ID NO: 242307 - RNA, 22 nt, Human
gcuguaggucauuuaaucaccu

SEQ ID NO: 242308 - RNA, 23 nt, Human
gcccacccucagcguccucacgg

SEQ ID NO: 242309 - RNA, 22 nt, Human
cugggucccaauagcuuuuguu

SEQ ID NO: 242310 - RNA, 22 nt, Human
aggcccugcccagugccacaag

SEQ ID NO: 242311 - RNA, 21 nt, Human
acuuggcagaacgcagaaggc

SEQ ID NO: 242312 - RNA, 22 nt, Human
cucagcagcagggaagagguca

SEQ ID NO: 242313 - RNA, 22 nt, Human
agggccagccaggcccuacaaa

SEQ ID NO: 242314 - RNA, 22 nt, Human
cccaggcacacugaagugacau

SEQ ID NO: 242315 - RNA, 22 nt, Human
gagugcugcuugggauagugag

SEQ ID NO: 242316 - RNA, 22 nt, Human
auagcaacaccccaauuuucua

SEQ ID NO: 242317 - RNA, 22 nt, Human
ugaaagaaggguggaaaaugua

SEQ ID NO: 242318 - RNA, 22 nt, Human
aggcugagagcaacgugucaga

SEQ ID NO: 242319 - RNA, 22 nt, Human
cuugcugagauaaaugcugucu

SEQ ID NO: 242320 - RNA, 22 nt, Human
agacacugauguucagcucaau

SEQ ID NO: 242321 - RNA, 23 nt, Human
ucagaagugggauacaaagcuga

SEQ ID NO: 242322 - RNA, 22 nt, Human
uuuggaauguaguuuaaucauc

SEQ ID NO: 242323 - RNA, 22 nt, Human
cuacugaguccuucagcugcca

SEQ ID NO: 242324 - RNA, 22 nt, Human
uucagcacuggacagcgagucu

SEQ ID NO: 242325 - RNA, 22 nt, Human
uggacagguuugggugccuguu

SEQ ID NO: 242326 - RNA, 22 nt, Human
acacaguaggccaccaugucau

SEQ ID NO: 242327 - RNA, 17 nt, Human
aggugcuggagcaucag

SEQ ID NO: 242328 - RNA, 22 nt, Human
uucaugcuaguaugugcuguuc

SEQ ID NO: 242329 - RNA, 22 nt, Human
uagcacccauggaaucugcugg

SEQ ID NO: 242330 - RNA, 22 nt, Human
ugcagaagaaaacagcugugug

SEQ ID NO: 242331 - RNA, 22 nt, Human
acuguuuucuuagcucccugcu

SEQ ID NO: 242332 - RNA, 22 nt, Human
agcugcagucaagcugggccac

SEQ ID NO: 242333 - RNA, 18 nt, Human
agugaguuguugaaagaa

SEQ ID NO: 242334 - RNA, 22 nt, Human
cagacaggguccuguccgucac

SEQ ID NO: 242335 - RNA, 22 nt, Human
uggcccagaucucugaccuuga

SEQ ID NO: 242336 - RNA, 22 nt, Human
guuuagaacacggaaauacuga

SEQ ID NO: 242337 - RNA, 22 nt, Human
ccugggaagcccauagcagcuu

SEQ ID NO: 242338 - RNA, 22 nt, Human
uuguacuuuugucagguggaca

SEQ ID NO: 242339 - RNA, 22 nt, Human
cacgguggcccacaggugcaag

SEQ ID NO: 242340 - RNA, 22 nt, Human
ccugcuggcauucuugcucccu

SEQ ID NO: 242341 - RNA, 22 nt, Human
gucaaaacaaaguuaagaauuc

SEQ ID NO: 242342 - RNA, 22 nt, Human
uccagggagauggcagaggcug

SEQ ID NO: 242343 - RNA, 22 nt, Human
ccuggcuggauggagccccugg

SEQ ID NO: 242344 - RNA, 22 nt, Human
aagucugagugucagugcaagu

SEQ ID NO: 242345 - RNA, 22 nt, Human
auacuacacauugacuauauuu

SEQ ID NO: 242346 - RNA, 22 nt, Human
caggaggcauauuuaaauccaa

SEQ ID NO: 242347 - RNA, 22 nt, Human
acagugucaugucguguucccc

SEQ ID NO: 242348 - RNA, 22 nt, Human
gucaaaugcacagaaccauuaa

SEQ ID NO: 242349 - RNA, 22 nt, Human
ucaaugagaaagacacagucuu

SEQ ID NO: 242350 - RNA, 22 nt, Human
agacaaguguggugagagcagu

SEQ ID NO: 242351 - RNA, 22 nt, Human
ggagcccugcugacaugggugu

SEQ ID NO: 242352 - RNA, 22 nt, Human
agaaucucuacucaaguacuug

SEQ ID NO: 242353 - RNA, 22 nt, Human
gaggcuccuccuuacauuuacc

SEQ ID NO: 242354 - RNA, 22 nt, Human
uuugcaaauucuugucuagccu

SEQ ID NO: 242355 - RNA, 22 nt, Human
augcacaguauguagggucuau

SEQ ID NO: 242356 - RNA, 22 nt, Human
gauuuauugucccuguccugcu

SEQ ID NO: 242357 - RNA, 22 nt, Human
uucucugagucuugguuucuua

SEQ ID NO: 242358 - RNA, 22 nt, Human
aagggcucccaacucaucuuuu

SEQ ID NO: 242359 - RNA, 22 nt, Human
aaacacaccuuuggaacuguga

SEQ ID NO: 242360 - RNA, 22 nt, Human
aucugguaugagguuuugcuuu

SEQ ID NO: 242361 - RNA, 22 nt, Human
uccagcuccacagccucccugu

SEQ ID NO: 242362 - RNA, 22 nt, Human
uggcauuuuguucaguauaugg

SEQ ID NO: 242363 - RNA, 20 nt, Human
aaggcagaguggguuggagc

SEQ ID NO: 242364 - RNA, 22 nt, Human
ucucagagauguuagggaagag

SEQ ID NO: 242365 - RNA, 22 nt, Human
gcauucuuagggccuggggugu

SEQ ID NO: 242366 - RNA, 23 nt, Human
aguuuccacccaggguagaaggg

SEQ ID NO: 242367 - RNA, 22 nt, Human
uggaugcugcugucagggaugg

SEQ ID NO: 242368 - RNA, 22 nt, Human
ccugagauuggcuaguaugagu

SEQ ID NO: 242369 - RNA, 22 nt, Human
uacacaguaaaugguaaauaca

SEQ ID NO: 242370 - RNA, 22 nt, Human
uuuauauguauugacuuugaug

SEQ ID NO: 242371 - RNA, 22 nt, Human
ucagcuccacagcuccucugcc

SEQ ID NO: 242372 - RNA, 23 nt, Human
agucagagagugugagacaacug

SEQ ID NO: 242373 - RNA, 22 nt, Human
cuuauaaaguccaucugaacaa

SEQ ID NO: 242374 - RNA, 22 nt, Human
ugugucuuuggcgaugucugga

SEQ ID NO: 242375 - RNA, 22 nt, Human
uaguuaaagagauccacauucc

SEQ ID NO: 242376 - RNA, 23 nt, Human
ugcuggguaucagaaucacugag

SEQ ID NO: 242377 - RNA, 22 nt, Human
agcaguuaucgaagaaucaggu

SEQ ID NO: 242378 - RNA, 22 nt, Human
gcccagcuggcuuccagcacau

SEQ ID NO: 242379 - RNA, 22 nt, Human
aaugcuguauaucuuagcuaau

SEQ ID NO: 242380 - RNA, 20 nt, Human
agaaacauuucuugagaacu

SEQ ID NO: 242381 - RNA, 22 nt, Human
auucacauuuacaaagcacuca

SEQ ID NO: 242382 - RNA, 22 nt, Human
cagcagcagauucagcgucugg

SEQ ID NO: 242383 - RNA, 22 nt, Human
uaucuguagucagaauaauuuu

SEQ ID NO: 242384 - RNA, 22 nt, Human
agcugccagaugacagugcuau

SEQ ID NO: 242385 - RNA, 22 nt, Human
acaccuuugccccaagucauag

SEQ ID NO: 242386 - RNA, 22 nt, Human
augccacauaauuacaaauaga

SEQ ID NO: 242387 - RNA, 22 nt, Human
aggcuucugcuguauuaacacu

SEQ ID NO: 242388 - RNA, 22 nt, Human
gaaaggcuaugaguuugguaua

SEQ ID NO: 242389 - RNA, 22 nt, Human
ccugggugacagagugagaccu

SEQ ID NO: 242390 - RNA, 22 nt, Human
gcugggcucauuugugugucug

SEQ ID NO: 242391 - RNA, 22 nt, Human
ggcacagagcuuugucccaguu

SEQ ID NO: 242392 - RNA, 19 nt, Human
uuuggcucuggucagagag

SEQ ID NO: 242393 - RNA, 22 nt, Human
gcucugagaggaugcugagcag

SEQ ID NO: 242394 - RNA, 22 nt, Human
cagcuuugugcaaugcagucuc

SEQ ID NO: 242395 - RNA, 22 nt, Human
uagaaagucaaaacacuguguu

SEQ ID NO: 242396 - RNA, 22 nt, Human
ucccagggccgcaaacgaguuu

SEQ ID NO: 242397 - RNA, 22 nt, Human
agcagccuuagguauugugauu

SEQ ID NO: 242398 - RNA, 22 nt, Human
uagggcuguggucaguccucua

SEQ ID NO: 242399 - RNA, 20 nt, Human
aggagggaccuggauuggcg

SEQ ID NO: 242400 - RNA, 22 nt, Human
acaguaacagucuauuucucag

SEQ ID NO: 242401 - RNA, 22 nt, Human
cccaggcuccugcuguguugac

SEQ ID NO: 242402 - RNA, 23 nt, Human
ugaaugauuguacugagcuuuua

SEQ ID NO: 242403 - RNA, 22 nt, Human
gcccaggcuagcguagagugca

SEQ ID NO: 242404 - RNA, 22 nt, Human
uagguggugggauaugagcauc

SEQ ID NO: 242405 - RNA, 20 nt, Human
gauaaauugucucuuaagug

SEQ ID NO: 242406 - RNA, 22 nt, Human
aacagguagggacucuaacuug

SEQ ID NO: 242407 - RNA, 23 nt, Human
cacaaagguuccauucucucacc

SEQ ID NO: 242408 - RNA, 19 nt, Human
ccaggucuggggccagauu

SEQ ID NO: 242409 - RNA, 22 nt, Human
acagcagcaauagcagugacau

SEQ ID NO: 242410 - RNA, 22 nt, Human
cacuggugccagagaacagaau

SEQ ID NO: 242411 - RNA, 22 nt, Human
gcggcuccgaagccaggccgcg

SEQ ID NO: 242412 - RNA, 22 nt, Human
caugugggacuccugcuguuuu

SEQ ID NO: 242413 - RNA, 22 nt, Human
ucaggcugugggcacuggccau

SEQ ID NO: 242414 - RNA, 23 nt, Human
caugugugacaguaucacuguuu

SEQ ID NO: 242415 - RNA, 22 nt, Human
acugugcaguguuguaacccga

SEQ ID NO: 242416 - RNA, 22 nt, Human
acacagagccagggaauacagu

SEQ ID NO: 242417 - RNA, 22 nt, Human
cagucccaggguugguucagcu

SEQ ID NO: 242418 - RNA, 22 nt, Human
gaguugaucauuauuugguuuc

SEQ ID NO: 242419 - RNA, 22 nt, Human
uuugcuuugggagguugucugg

SEQ ID NO: 242420 - RNA, 22 nt, Human
caggcauaaguaauguuuuaug

SEQ ID NO: 242421 - RNA, 22 nt, Human
ucucagagcucacaccuccugg

SEQ ID NO: 242422 - RNA, 22 nt, Human
cccccaccguguuccugcucgg

SEQ ID NO: 242423 - RNA, 22 nt, Human
agaccugguuuaucaccagcau

SEQ ID NO: 242424 - RNA, 22 nt, Human
aagugcugggauuacaggcguc

SEQ ID NO: 242425 - RNA, 19 nt, Human
agaagcugugaaaugaagg

SEQ ID NO: 242426 - RNA, 22 nt, Human
augcaacaggucagccaggaag

SEQ ID NO: 242427 - RNA, 22 nt, Human
gguggggccugcuccagcggcc

SEQ ID NO: 242428 - RNA, 22 nt, Human
auucagaaaguugucauauuug

SEQ ID NO: 242429 - RNA, 22 nt, Human
uuugucaaagaucagaugcuuu

SEQ ID NO: 242430 - RNA, 22 nt, Human
augucuaaaagauaaaguuuaa

SEQ ID NO: 242431 - RNA, 22 nt, Human
cagaaaauaaacauuuguggaa

SEQ ID NO: 242432 - RNA, 22 nt, Human
uaauggcagagucaugcuuucu

SEQ ID NO: 242433 - RNA, 22 nt, Human
cuuagaaggaacaguuuagugc

SEQ ID NO: 242434 - RNA, 17 nt, Human
gauggggcugacaucag

SEQ ID NO: 242435 - RNA, 21 nt, Human
cucagagacaaaugccauccc

SEQ ID NO: 242436 - RNA, 22 nt, Human
augcaggagaccaauuggaugg

SEQ ID NO: 242437 - RNA, 22 nt, Human
cugggggucuugaaagggagag

SEQ ID NO: 242438 - RNA, 22 nt, Human
gcuccuggcuccaggcagccaa

SEQ ID NO: 242439 - RNA, 22 nt, Human
ccagaggggugggccugguuua

SEQ ID NO: 242440 - RNA, 22 nt, Human
cagagccugccucuggcugugg

SEQ ID NO: 242441 - RNA, 22 nt, Human
guacaaguucuacucuauaaau

SEQ ID NO: 242442 - RNA, 22 nt, Human
aacacuuuuuaguaaagauuga

SEQ ID NO: 242443 - RNA, 22 nt, Human
ucccugggccacagcugugagc

SEQ ID NO: 242444 - RNA, 21 nt, Human
cggagcugggcagggcauccc

SEQ ID NO: 242445 - RNA, 22 nt, Human
uagcuuuuaguacuuaauggcu

SEQ ID NO: 242446 - RNA, 22 nt, Human
uuccagauauuuuuauguggaa

SEQ ID NO: 242447 - RNA, 22 nt, Human
uggccuggcccugaggcccugu

SEQ ID NO: 242448 - RNA, 22 nt, Human
ucugggcugcugugcagugacc

SEQ ID NO: 242449 - RNA, 22 nt, Human
cugagccaaaaagcagagcuug

SEQ ID NO: 242450 - RNA, 22 nt, Human
acaggcagcgucauugcugcuc

SEQ ID NO: 242451 - RNA, 22 nt, Human
gucuucugaucugguuagccau

SEQ ID NO: 242452 - RNA, 22 nt, Human
auuauuaggugcucucugacaa

SEQ ID NO: 242453 - RNA, 22 nt, Human
uguuugcuaggguugguauuua

SEQ ID NO: 242454 - RNA, 22 nt, Human
auacagauugcuauacuuacaa

SEQ ID NO: 242455 - RNA, 22 nt, Human
caaauacuuuauauacuucaaa

SEQ ID NO: 242456 - RNA, 22 nt, Human
aaccuuuugcaagugccuugac

SEQ ID NO: 242457 - RNA, 18 nt, Human
ggcuucucacugaccuca

SEQ ID NO: 242458 - RNA, 22 nt, Human
acacaggaagcaauuucagagc

SEQ ID NO: 242459 - RNA, 22 nt, Human
aaaagauuguuagggagaaugu

SEQ ID NO: 242460 - RNA, 22 nt, Human
uggcugccuagucccucagccu

SEQ ID NO: 242461 - RNA, 20 nt, Human
ggcuucacucugcaccacca

SEQ ID NO: 242462 - RNA, 22 nt, Human
uuuagcauauuuaaggaaugau

SEQ ID NO: 242463 - RNA, 22 nt, Human
aauagacauuauuucucuauga

SEQ ID NO: 242464 - RNA, 22 nt, Human
ggcuuuauuuugcaugaaugcu

SEQ ID NO: 242465 - RNA, 22 nt, Human
ugcaccagagcagggugcccaa

SEQ ID NO: 242466 - RNA, 22 nt, Human
gccaccugccaacuugcuggaa

SEQ ID NO: 242467 - RNA, 22 nt, Human
agaagccaaucagcucucugcu

SEQ ID NO: 242468 - RNA, 22 nt, Human
auucaaguacaguuuucuucuu

SEQ ID NO: 242469 - RNA, 22 nt, Human
acuucuucuucagcugggggau

SEQ ID NO: 242470 - RNA, 22 nt, Human
cucuggcuucuaccuugcaguu

SEQ ID NO: 242471 - RNA, 22 nt, Human
ucucauucauacccuacaugcu

SEQ ID NO: 242472 - RNA, 22 nt, Human
uugaggaguguuuagggugagg

SEQ ID NO: 242473 - RNA, 22 nt, Human
gcugcaggcgccugcggucucu

SEQ ID NO: 242474 - RNA, 22 nt, Human
augcaauaaauacuuuccagcu

SEQ ID NO: 242475 - RNA, 22 nt, Human
ccaggcucugagccucacucuu

SEQ ID NO: 242476 - RNA, 22 nt, Human
auuagcauugcuacucucaaga

SEQ ID NO: 242477 - RNA, 22 nt, Human
ggcaguagccagggacuggcag

SEQ ID NO: 242478 - RNA, 22 nt, Human
uacuucuguaagugcgccaagg

SEQ ID NO: 242479 - RNA, 22 nt, Human
cuguaggugauugcuauguuau

SEQ ID NO: 242480 - RNA, 22 nt, Human
uggcaggagccugcggggaggu

SEQ ID NO: 242481 - RNA, 22 nt, Human
cagcugcuuucagcaggaggga

SEQ ID NO: 242482 - RNA, 22 nt, Human
aauuuucacagugcugugagau

SEQ ID NO: 242483 - RNA, 22 nt, Human
uuauucuuuucuccagaauccc

SEQ ID NO: 242484 - RNA, 22 nt, Human
uaauaauuaacagugauggguc

SEQ ID NO: 242485 - RNA, 22 nt, Human
ucucuaaagcacuuuaaccaca

SEQ ID NO: 242486 - RNA, 22 nt, Human
aggcagguguuaccucugguuu

SEQ ID NO: 242487 - RNA, 22 nt, Human
aaugcuuugucugcuccagacu

SEQ ID NO: 242488 - RNA, 22 nt, Human
aaugcaaacagcccagaaucca

SEQ ID NO: 242489 - RNA, 22 nt, Human
aauucagauggaagauucuggc

SEQ ID NO: 242490 - RNA, 22 nt, Human
uagguacagcuaaaaauuaucu

SEQ ID NO: 242491 - RNA, 22 nt, Human
ugaggauuuaaugggacucauu

SEQ ID NO: 242492 - RNA, 22 nt, Human
cauuucaccuuagagaauuauu

SEQ ID NO: 242493 - RNA, 22 nt, Human
aagauaaugugucugucuuugc

SEQ ID NO: 242494 - RNA, 22 nt, Human
uccuugggguaacuccagccug

SEQ ID NO: 242495 - RNA, 22 nt, Human
aaucucagaaacugguggauuu

SEQ ID NO: 242496 - RNA, 22 nt, Human
cccaggagaccugugaaaggac

SEQ ID NO: 242497 - RNA, 22 nt, Human
uggagcucuggaaguucuaagc

SEQ ID NO: 242498 - RNA, 22 nt, Human
cagcaggggaacugugggccag

SEQ ID NO: 242499 - RNA, 22 nt, Human
uuagugguaaggaugaaauuuc

SEQ ID NO: 242500 - RNA, 22 nt, Human
uggagcaggaaacaucuagagg

SEQ ID NO: 242501 - RNA, 22 nt, Human
gggcacaggagaaggaucuggc

SEQ ID NO: 242502 - RNA, 22 nt, Human
aucauuagaccaaacuagagcu

SEQ ID NO: 242503 - RNA, 22 nt, Human
ucaggaaguuuugaaucaacug

SEQ ID NO: 242504 - RNA, 22 nt, Human
aacaaacauuaccuggugcugg

SEQ ID NO: 242505 - RNA, 22 nt, Human
ccugggccuggcgggucggcuc

SEQ ID NO: 242506 - RNA, 22 nt, Human
aguacaacauuagaguaucuua

SEQ ID NO: 242507 - RNA, 22 nt, Human
ucugggaaugaauaagaccugu

SEQ ID NO: 242508 - RNA, 22 nt, Human
uccucccuguaccauuccucug

SEQ ID NO: 242509 - RNA, 22 nt, Human
uagggaugagcaacugguagug

SEQ ID NO: 242510 - RNA, 21 nt, Human
ugcuccuuuaccccacaagac

SEQ ID NO: 242511 - RNA, 22 nt, Human
ugacaagaauuugggacuguua

SEQ ID NO: 242512 - RNA, 22 nt, Human
cauucugugauucuaaaucccu

SEQ ID NO: 242513 - RNA, 19 nt, Human
agagaugcuaagagucuuu

SEQ ID NO: 242514 - RNA, 22 nt, Human
uuagaaccaggguuacgauucu

SEQ ID NO: 242515 - RNA, 22 nt, Human
acagagaccagcaucuucugcc

SEQ ID NO: 242516 - RNA, 22 nt, Human
cugauauggaugccucauuguc

SEQ ID NO: 242517 - RNA, 22 nt, Human
cagaguuuugugaacaacuugg

SEQ ID NO: 242518 - RNA, 22 nt, Human
aguggcagagccaaguagagcc

SEQ ID NO: 242519 - RNA, 22 nt, Human
uaaagacaugguguaggugaac

SEQ ID NO: 242520 - RNA, 22 nt, Human
gaaugcacucacccaucacuca

SEQ ID NO: 242521 - RNA, 22 nt, Human
augaaaugugaaugcuuuucau

SEQ ID NO: 242522 - RNA, 22 nt, Human
ggcugcagaggcgaucugaggu

SEQ ID NO: 242523 - RNA, 23 nt, Human
uacauucauuugcacagccagua

SEQ ID NO: 242524 - RNA, 22 nt, Human
agcccagcaaagggguuugaga

SEQ ID NO: 242525 - RNA, 22 nt, Human
cagcugguuuuagcacaguuag

SEQ ID NO: 242526 - RNA, 22 nt, Human
aaaauccugcugacucgagaug

SEQ ID NO: 242527 - RNA, 22 nt, Human
cauuuguaucugggcugcugug

SEQ ID NO: 242528 - RNA, 22 nt, Human
ugccaggcaggacccuagaacc

SEQ ID NO: 242529 - RNA, 22 nt, Human
auuagauuguaaauguuuucac

SEQ ID NO: 242530 - RNA, 22 nt, Human
aauaguaaaagauacagcuaau

SEQ ID NO: 242531 - RNA, 22 nt, Human
gacccugacucuaaugcuuggc

SEQ ID NO: 242532 - RNA, 22 nt, Human
aauggcuuugacauuuucaaau

SEQ ID NO: 242533 - RNA, 22 nt, Human
uaaggccagccagcaaaucugu

SEQ ID NO: 242534 - RNA, 22 nt, Human
acccagggcagccagcggggag

SEQ ID NO: 242535 - RNA, 22 nt, Human
gcugcagguugggcaacagagu

SEQ ID NO: 242536 - RNA, 22 nt, Human
uuccaagaguaaauucaaauug

SEQ ID NO: 242537 - RNA, 22 nt, Human
gaucaaaagcuggguucuaaaa

SEQ ID NO: 242538 - RNA, 22 nt, Human
aaucaguuguccaaaguucaca

SEQ ID NO: 242539 - RNA, 22 nt, Human
auaugauuccacuauuguaugg

SEQ ID NO: 242540 - RNA, 22 nt, Human
acaaaauuaccuaguuauuuuc

SEQ ID NO: 242541 - RNA, 22 nt, Human
gugagcaggauuucauggugua

SEQ ID NO: 242542 - RNA, 22 nt, Human
cugcuuugacuguuaagaacca

SEQ ID NO: 242543 - RNA, 22 nt, Human
gagcauggauagaaggugggau

SEQ ID NO: 242544 - RNA, 19 nt, Human
ggcuucgaggcuggggaag

SEQ ID NO: 242545 - RNA, 22 nt, Human
aaagauuuaagaauaauuugug

SEQ ID NO: 242546 - RNA, 22 nt, Human
uggcacugccaaccugcuaggu

SEQ ID NO: 242547 - RNA, 22 nt, Human
ccagagaaagcucacaggcagu

SEQ ID NO: 242548 - RNA, 22 nt, Human
uuuggccuuaguccagaagaag

SEQ ID NO: 242549 - RNA, 22 nt, Human
uuauuucaaaagagcuuggggu

SEQ ID NO: 242550 - RNA, 22 nt, Human
uucauaguguuuccuuccagug

SEQ ID NO: 242551 - RNA, 22 nt, Human
agaaauguugaauacacaaaau

SEQ ID NO: 242552 - RNA, 22 nt, Human
uuccaugaagggcagccucuca

SEQ ID NO: 242553 - RNA, 22 nt, Human
gagcugaacaucauggaaaggc

SEQ ID NO: 242554 - RNA, 22 nt, Human
caaauuuuguguguucucuagu

SEQ ID NO: 242555 - RNA, 22 nt, Human
auguacaggucuuggcaaaggg

SEQ ID NO: 242556 - RNA, 22 nt, Human
uuuagcuuuaccucauagauuu

SEQ ID NO: 242557 - RNA, 22 nt, Human
cugaguggaacauaggaugaua

SEQ ID NO: 242558 - RNA, 22 nt, Human
ugcauuuccagauuucuggagu

SEQ ID NO: 242559 - RNA, 22 nt, Human
ucacacauaaaaagaagacuag

SEQ ID NO: 242560 - RNA, 22 nt, Human
guugggguaccuugaggcuggg

SEQ ID NO: 242561 - RNA, 22 nt, Human
gcucagagaugucugcugccuu

SEQ ID NO: 242562 - RNA, 22 nt, Human
ucaggaaggcgccccaucagga

SEQ ID NO: 242563 - RNA, 22 nt, Human
caggcccagcccuuagccaggu

SEQ ID NO: 242564 - RNA, 22 nt, Human
uauugcugaggauugaggcuug

SEQ ID NO: 242565 - RNA, 22 nt, Human
caggagugaaaugaggcccagg

SEQ ID NO: 242566 - RNA, 22 nt, Human
ggcagcucugcuccacaugagu

SEQ ID NO: 242567 - RNA, 22 nt, Human
auugucuucuggucuuaucuuu

SEQ ID NO: 242568 - RNA, 22 nt, Human
uucaaaugauggcaguccuggc

SEQ ID NO: 242569 - RNA, 22 nt, Human
uuggaaaugauuucuauuauua

SEQ ID NO: 242570 - RNA, 22 nt, Human
uagaaaugucgucuccacauuu

SEQ ID NO: 242571 - RNA, 22 nt, Human
auagaagcugauaaacuacuuc

SEQ ID NO: 242572 - RNA, 22 nt, Human
cugcugguaccaguggccguca

SEQ ID NO: 242573 - RNA, 22 nt, Human
gccucaggccgcccugcugcuc

SEQ ID NO: 242574 - RNA, 22 nt, Human
uucugggucacccuucugcuca

SEQ ID NO: 242575 - RNA, 22 nt, Human
cugggccuugccuugcccacag

SEQ ID NO: 242576 - RNA, 22 nt, Human
cugagaggugcugguggcugca

SEQ ID NO: 242577 - RNA, 22 nt, Human
uauaucuggauggacugcagaa

SEQ ID NO: 242578 - RNA, 22 nt, Human
cccucacuucacgcucugcaga

SEQ ID NO: 242579 - RNA, 22 nt, Human
uacauaaugagcuaguuaaguu

SEQ ID NO: 242580 - RNA, 22 nt, Human
caguucucuugaucgucucuug

SEQ ID NO: 242581 - RNA, 22 nt, Human
uuagaaacaaaauaguuauuug

SEQ ID NO: 242582 - RNA, 22 nt, Human
acacauauguggcaacuguaga

SEQ ID NO: 242583 - RNA, 22 nt, Human
acagaauucuaguauguggcuu

SEQ ID NO: 242584 - RNA, 22 nt, Human
agcccuggcccggcugugcuuu

SEQ ID NO: 242585 - RNA, 22 nt, Human
ugcacaaagcauucuagacgca

SEQ ID NO: 242586 - RNA, 22 nt, Human
cugggugauuccuguccaggca

SEQ ID NO: 242587 - RNA, 22 nt, Human
cucuggcagagcuguagacuuc

SEQ ID NO: 242588 - RNA, 22 nt, Human
uaccuggcuggggaauagccag

SEQ ID NO: 242589 - RNA, 22 nt, Human
gccccaggauaaauuuguaaga

SEQ ID NO: 242590 - RNA, 22 nt, Human
aggagguguagauuuccuguca

SEQ ID NO: 242591 - RNA, 17 nt, Human
uuccagcauguuacuaa

SEQ ID NO: 242592 - RNA, 15 nt, Human
aaagugcacccaaua

SEQ ID NO: 242593 - RNA, 22 nt, Human
aagcccugccacccauucacug

SEQ ID NO: 242594 - RNA, 22 nt, Human
cacugggaaucugggaaagaga

SEQ ID NO: 242595 - RNA, 23 nt, Human
cagaaagcccuuuccccacagua

SEQ ID NO: 242596 - RNA, 22 nt, Human
gauuagaauaugucagucauaa

SEQ ID NO: 242597 - RNA, 22 nt, Human
uaacugguagauuuuaaaucgg

SEQ ID NO: 242598 - RNA, 22 nt, Human
uuccuggguucccucucauucu

SEQ ID NO: 242599 - RNA, 22 nt, Human
caggaagcugccggugagcgag

SEQ ID NO: 242600 - RNA, 22 nt, Human
aauaauuagugggacagagaac

SEQ ID NO: 242601 - RNA, 22 nt, Human
uaugcacacaucgcagcaggaa

SEQ ID NO: 242602 - RNA, 22 nt, Human
uccccaggagcaaugauucagu

SEQ ID NO: 242603 - RNA, 22 nt, Human
aaaugucugagacuucugaacu

SEQ ID NO: 242604 - RNA, 22 nt, Human
gccaggaaggcugaagccagaa

SEQ ID NO: 242605 - RNA, 22 nt, Human
ucugaaauacugcagguucucu

SEQ ID NO: 242606 - RNA, 21 nt, Human
cagagcagcguucugcugugg

SEQ ID NO: 242607 - RNA, 22 nt, Human
uacaaaaguaauuacgguuuuu

SEQ ID NO: 242608 - RNA, 22 nt, Human
ugaaugaugaggggagaauaau

SEQ ID NO: 242609 - RNA, 22 nt, Human
gaucuuuucagucuugguaguu

SEQ ID NO: 242610 - RNA, 22 nt, Human
uaugaauucuguucauugauga

SEQ ID NO: 242611 - RNA, 21 nt, Human
uagaauccuggacugggacuc

SEQ ID NO: 242612 - RNA, 22 nt, Human
uguggaaugcuccuaagugaau

SEQ ID NO: 242613 - RNA, 22 nt, Human
agaaccaguuuaagauuugggu

SEQ ID NO: 242614 - RNA, 22 nt, Human
ggccccagauucugggcugggu

SEQ ID NO: 242615 - RNA, 22 nt, Human
cccaguauugagcuacaggccu

SEQ ID NO: 242616 - RNA, 22 nt, Human
gccuggccgcuccgagcuccgc

SEQ ID NO: 242617 - RNA, 20 nt, Human
cugagccaacucucuucuug

SEQ ID NO: 242618 - RNA, 22 nt, Human
ggccccaaaugucaauaguacu

SEQ ID NO: 242619 - RNA, 22 nt, Human
cuaaauguuuuaucuuccuggc

SEQ ID NO: 242620 - RNA, 22 nt, Human
agcuucuggaaggcaaggcuug

SEQ ID NO: 242621 - RNA, 22 nt, Human
uugcauguguaauuuuucuaaa

SEQ ID NO: 242622 - RNA, 22 nt, Human
uagguagauacauguguuggcu

SEQ ID NO: 242623 - RNA, 21 nt, Human
augauucugcaaaugaguagu

SEQ ID NO: 242624 - RNA, 17 nt, Human
ugggguccccgauggug

SEQ ID NO: 242625 - RNA, 21 nt, Human
uggcuuugcccugcuugcccc

SEQ ID NO: 242626 - RNA, 22 nt, Human
ggacagacagugugagugaggc

SEQ ID NO: 242627 - RNA, 22 nt, Human
guaaaucccauccuuucucugg

SEQ ID NO: 242628 - RNA, 22 nt, Human
agagccuguacuuuucugugaa

SEQ ID NO: 242629 - RNA, 22 nt, Human
ucuuuugagggccagaggaaga

SEQ ID NO: 242630 - RNA, 22 nt, Human
acugcagccuugaacucugggc

SEQ ID NO: 242631 - RNA, 18 nt, Human
ggagccagucugucucug

SEQ ID NO: 242632 - RNA, 23 nt, Human
uucaggaaaugaauacagacaca

SEQ ID NO: 242633 - RNA, 22 nt, Human
aggcagcccugugcuggaugcu

SEQ ID NO: 242634 - RNA, 22 nt, Human
ugucaguuuaguugaagaaaga

SEQ ID NO: 242635 - RNA, 22 nt, Human
ucagccaguauuugagugcuca

SEQ ID NO: 242636 - RNA, 22 nt, Human
uggagcuggcuuguggaaguug

SEQ ID NO: 242637 - RNA, 22 nt, Human
gcagcauggagaaguagcuaga

SEQ ID NO: 242638 - RNA, 22 nt, Human
accugagaaugggggcaugugu

SEQ ID NO: 242639 - RNA, 22 nt, Human
ggcaggugcuugucgaaggccu

SEQ ID NO: 242640 - RNA, 22 nt, Human
cugguuuauguaucaucuagaa

SEQ ID NO: 242641 - RNA, 22 nt, Human
uuaucuuguagagauauuuucg

SEQ ID NO: 242642 - RNA, 22 nt, Human
uuucagauuaucucaacuuugg

SEQ ID NO: 242643 - RNA, 22 nt, Human
auaggcuuuguguuuuguuauc

SEQ ID NO: 242644 - RNA, 22 nt, Human
agaaaguuugagaacuguagau

SEQ ID NO: 242645 - RNA, 22 nt, Human
ggcaggcugcuugggucauguc

SEQ ID NO: 242646 - RNA, 22 nt, Human
auggcugggaugggguagagaa

SEQ ID NO: 242647 - RNA, 22 nt, Human
aacauuugugaaguacuuagau

SEQ ID NO: 242648 - RNA, 22 nt, Human
auagaaauggcagcuggugcua

SEQ ID NO: 242649 - RNA, 22 nt, Human
aauaugcaaagcguguuaucug

SEQ ID NO: 242650 - RNA, 22 nt, Human
agaaaauuagauuuuacugugu

SEQ ID NO: 242651 - RNA, 22 nt, Human
uguguccucuuaccucugaccc

SEQ ID NO: 242652 - RNA, 22 nt, Human
aacagucuacugaauaucugcg

SEQ ID NO: 242653 - RNA, 22 nt, Human
uucucaagaacauauguagggu

SEQ ID NO: 242654 - RNA, 20 nt, Human
cugagcugagcuccaugggu

SEQ ID NO: 242655 - RNA, 22 nt, Human
cagcccugucuaugacugauga

SEQ ID NO: 242656 - RNA, 22 nt, Human
accuggaaugggguugagagcu

SEQ ID NO: 242657 - RNA, 22 nt, Human
ccagcucccgcaggcugcacag

SEQ ID NO: 242658 - RNA, 22 nt, Human
acuugaauuaggccuugagaga

SEQ ID NO: 242659 - RNA, 22 nt, Human
uacaacauuuacguuaggcugu

SEQ ID NO: 242660 - RNA, 22 nt, Human
uauccaaaggaacaaucacagc

SEQ ID NO: 242661 - RNA, 22 nt, Human
ccaagcugagcaccaucugauc

SEQ ID NO: 242662 - RNA, 22 nt, Human
caggcagauuugcugcccucca

SEQ ID NO: 242663 - RNA, 22 nt, Human
auuauuagacuuauaugguagu

SEQ ID NO: 242664 - RNA, 22 nt, Human
aucacacuguuauuuuaguuaa

SEQ ID NO: 242665 - RNA, 22 nt, Human
aagggcucuucuauuuauggcc

SEQ ID NO: 242666 - RNA, 22 nt, Human
gaacucuugcagugaaagcuua

SEQ ID NO: 242667 - RNA, 22 nt, Human
gaauuccuuaggcucuugacug

SEQ ID NO: 242668 - RNA, 22 nt, Human
uccccaggaaggcccuuccugg

SEQ ID NO: 242669 - RNA, 22 nt, Human
augauuuuuucuaacacagucg

SEQ ID NO: 242670 - RNA, 22 nt, Human
uuguguccuaagcaccagaugg

SEQ ID NO: 242671 - RNA, 22 nt, Human
ccuggccauagggcccaggaaa

SEQ ID NO: 242672 - RNA, 21 nt, Human
agcugagguaaggcaagagag

SEQ ID NO: 242673 - RNA, 22 nt, Human
aaaucuaggcucauccuggucc

SEQ ID NO: 242674 - RNA, 21 nt, Human
uguuacaguccaaauguuugu

SEQ ID NO: 242675 - RNA, 22 nt, Human
cauuuacagugagaguuuuuac

SEQ ID NO: 242676 - RNA, 22 nt, Human
aagagccagcuagugaagaggc

SEQ ID NO: 242677 - RNA, 22 nt, Human
uuagugcucacguguuagaaag

SEQ ID NO: 242678 - RNA, 22 nt, Human
caaguauauuugaacauguaaa

SEQ ID NO: 242679 - RNA, 22 nt, Human
ucugggaggggcugccauugcu

SEQ ID NO: 242680 - RNA, 22 nt, Human
gcagcaggaauuuaaauuuaua

SEQ ID NO: 242681 - RNA, 22 nt, Human
ggacccugggcucugggccuau

SEQ ID NO: 242682 - RNA, 22 nt, Human
gcucugcucuaacauuccugac

SEQ ID NO: 242683 - RNA, 22 nt, Human
uagcagaggcaaggaugugaau

SEQ ID NO: 242684 - RNA, 22 nt, Human
gcugcccugccucagacuccuc

SEQ ID NO: 242685 - RNA, 22 nt, Human
uuagcuuuagagccauuacugg

SEQ ID NO: 242686 - RNA, 22 nt, Human
agcaaggaaaguaggcacggaa

SEQ ID NO: 242687 - RNA, 22 nt, Human
ugugauuucacuggugacaugu

SEQ ID NO: 242688 - RNA, 22 nt, Human
cagcuucuagcaucggcuuuga

SEQ ID NO: 242689 - RNA, 22 nt, Human
gguucucuaacuuugacuggag

SEQ ID NO: 242690 - RNA, 22 nt, Human
agaaucauuauauuuauuaagc

SEQ ID NO: 242691 - RNA, 22 nt, Human
ucugccaguuuauagacaagcc

SEQ ID NO: 242692 - RNA, 22 nt, Human
cucuccagucaggaacucugac

SEQ ID NO: 242693 - RNA, 22 nt, Human
uguccugggaaugggaugcagu

SEQ ID NO: 242694 - RNA, 22 nt, Human
aggaggcugaacuagggucugg

SEQ ID NO: 242695 - RNA, 22 nt, Human
gacacagggacgugcucugccu

SEQ ID NO: 242696 - RNA, 22 nt, Human
uggcuucuugucuaauuuguua

SEQ ID NO: 242697 - RNA, 21 nt, Human
gcugcccuggcucagcauuca

SEQ ID NO: 242698 - RNA, 22 nt, Human
aaugaucuggcucaggauauca

SEQ ID NO: 242699 - RNA, 22 nt, Human
cugccugugucuauuccuuuuu

SEQ ID NO: 242700 - RNA, 22 nt, Human
gaucucugaaucugaagccuuc

SEQ ID NO: 242701 - RNA, 22 nt, Human
cuguuuauggagguaaggcauc

SEQ ID NO: 242702 - RNA, 22 nt, Human
gcuaaauaaucuucuucugaca

SEQ ID NO: 242703 - RNA, 22 nt, Human
aguuauaugugaaaacacguau

SEQ ID NO: 242704 - RNA, 22 nt, Human
ucacucuguggcccaggcagug

SEQ ID NO: 242705 - RNA, 22 nt, Human
aauaucucaccaugacaaagca

SEQ ID NO: 242706 - RNA, 22 nt, Human
ggagggcaucaaucaggccugg

SEQ ID NO: 242707 - RNA, 22 nt, Human
ggcagggcaggaaagucaggaa

SEQ ID NO: 242708 - RNA, 22 nt, Human
augaggcaguacacacaaagcc

SEQ ID NO: 242709 - RNA, 22 nt, Human
uagaaguugcucaauaaauguu

SEQ ID NO: 242710 - RNA, 22 nt, Human
agauauguuacugcaucauggg

SEQ ID NO: 242711 - RNA, 22 nt, Human
gguggaugcugacuguucugcu

SEQ ID NO: 242712 - RNA, 22 nt, Human
uuuagcaaguauuuacugacua

SEQ ID NO: 242713 - RNA, 22 nt, Human
ucaucaguguccuuaucacuua

SEQ ID NO: 242714 - RNA, 19 nt, Human
uaaggccaaaaguaagugu

SEQ ID NO: 242715 - RNA, 22 nt, Human
gacaugugagagcucgguuuuc

SEQ ID NO: 242716 - RNA, 22 nt, Human
cugggcucugcaguugauguuu

SEQ ID NO: 242717 - RNA, 22 nt, Human
ccugccuucuaaagcgcccgcc

SEQ ID NO: 242718 - RNA, 22 nt, Human
uuuucucaggugcuuaucuaag

SEQ ID NO: 242719 - RNA, 22 nt, Human
cuaaacuucauauguugcuuua

SEQ ID NO: 242720 - RNA, 20 nt, Human
aacaguaccauuuaucucag

SEQ ID NO: 242721 - RNA, 22 nt, Human
ccagugccuuuuguggguuugu

SEQ ID NO: 242722 - RNA, 23 nt, Human
ggccacuuugugucaguaugugc

SEQ ID NO: 242723 - RNA, 22 nt, Human
cugggccuaggauggaagggcc

SEQ ID NO: 242724 - RNA, 22 nt, Human
cuggccacugguggucauaggc

SEQ ID NO: 242725 - RNA, 22 nt, Human
cugauuuacauauacaaaagau

SEQ ID NO: 242726 - RNA, 22 nt, Human
agggaacagugaaaggcaucag

SEQ ID NO: 242727 - RNA, 22 nt, Human
uuaauuacaaaacacauagguu

SEQ ID NO: 242728 - RNA, 22 nt, Human
uuugcuuuguuuaaaaguggua

SEQ ID NO: 242729 - RNA, 22 nt, Human
ugggaucuuuugagauacugug

SEQ ID NO: 242730 - RNA, 22 nt, Human
ugcagggcuuccucuuggaguu

SEQ ID NO: 242731 - RNA, 22 nt, Human
cauggcaggaggcugcuggcag

SEQ ID NO: 242732 - RNA, 22 nt, Human
caagauggacauaaggagagaa

SEQ ID NO: 242733 - RNA, 22 nt, Human
auucagcaaacauuuauugugu

SEQ ID NO: 242734 - RNA, 22 nt, Human
aacuuauugaacauucucgaau

SEQ ID NO: 242735 - RNA, 22 nt, Human
acuguaaagcuuuucucaugcg

SEQ ID NO: 242736 - RNA, 22 nt, Human
cugccacuuuggagugcucaga

SEQ ID NO: 242737 - RNA, 22 nt, Human
aggaccugagaguuggaaaucc

SEQ ID NO: 242738 - RNA, 22 nt, Human
agguuaggaaauagggcuguaa

SEQ ID NO: 242739 - RNA, 22 nt, Human
ucuagaaacaugacauugaucu

SEQ ID NO: 242740 - RNA, 22 nt, Human
uggcccagugcuuaugcucuga

SEQ ID NO: 242741 - RNA, 22 nt, Human
aaguuucaugauguaauuauug

SEQ ID NO: 242742 - RNA, 22 nt, Human
acccagggucaccccguagggu

SEQ ID NO: 242743 - RNA, 15 nt, Human
agacagacaguggga

SEQ ID NO: 242744 - RNA, 17 nt, Human
cauuuguugaucaguug

SEQ ID NO: 242745 - RNA, 22 nt, Human
ucagacaggccucuccagccuc

SEQ ID NO: 242746 - RNA, 22 nt, Human
uggcugcagugcuugagauguc

SEQ ID NO: 242747 - RNA, 19 nt, Human
uccagcugguaugcccaga

SEQ ID NO: 242748 - RNA, 22 nt, Human
gagaggcccugaagcccacaga

SEQ ID NO: 242749 - RNA, 22 nt, Human
gcagcaucuagggcacuggccu

SEQ ID NO: 242750 - RNA, 22 nt, Human
gacaggauauuaugauagauuc

SEQ ID NO: 242751 - RNA, 22 nt, Human
cucacugcccugaaguuggguu

SEQ ID NO: 242752 - RNA, 22 nt, Human
ccuggagggcgccgcacagucc

SEQ ID NO: 242753 - RNA, 22 nt, Human
aggcucagcaucugauucauau

SEQ ID NO: 242754 - RNA, 22 nt, Human
uugcagcagggugaauucacuc

SEQ ID NO: 242755 - RNA, 22 nt, Human
uggcucuggggacaguaagucc

SEQ ID NO: 242756 - RNA, 22 nt, Human
gccuggcuaguuagugucaggu

SEQ ID NO: 242757 - RNA, 22 nt, Human
ggaggcagaauagagugugggu

SEQ ID NO: 242758 - RNA, 22 nt, Human
ggccuugcugcuuccagaaggu

SEQ ID NO: 242759 - RNA, 22 nt, Human
cccaggagccaucugucuuggc

SEQ ID NO: 242760 - RNA, 22 nt, Human
uccugguggucugugcuucuuc

SEQ ID NO: 242761 - RNA, 22 nt, Human
uugcuuuauuccuagcccuugu

SEQ ID NO: 242762 - RNA, 22 nt, Human
ggcaagugcuuccccaaccaca

SEQ ID NO: 242763 - RNA, 22 nt, Human
ucuucaaguuccaaagugcagg

SEQ ID NO: 242764 - RNA, 22 nt, Human
ccaggaagcucugcuccacggg

SEQ ID NO: 242765 - RNA, 22 nt, Human
ccaggccucaccugcccaccua

SEQ ID NO: 242766 - RNA, 22 nt, Human
uccuguuuaggcuguggucugg

SEQ ID NO: 242767 - RNA, 22 nt, Human
cugguaguuugcaaaauggugu

SEQ ID NO: 242768 - RNA, 22 nt, Human
cauuuagagucuugcaauuuua

SEQ ID NO: 242769 - RNA, 22 nt, Human
uuacacaaacacauuccagaua

SEQ ID NO: 242770 - RNA, 22 nt, Human
uggcuuuacuuaaacugaauca

SEQ ID NO: 242771 - RNA, 22 nt, Human
ccagagcccagggucaugcagg

SEQ ID NO: 242772 - RNA, 22 nt, Human
ggagcuggucagccuugagcau

SEQ ID NO: 242773 - RNA, 22 nt, Human
ucucucaaccucggcacuauug

SEQ ID NO: 242774 - RNA, 22 nt, Human
ucuaggguggagcugggaaucc

SEQ ID NO: 242775 - RNA, 22 nt, Human
aagacauuguggagauguugcu

SEQ ID NO: 242776 - RNA, 22 nt, Human
gcacagaaaugucuacacaugu

SEQ ID NO: 242777 - RNA, 22 nt, Human
cuguccuccggccaccuacagu

SEQ ID NO: 242778 - RNA, 22 nt, Human
cagugcaguggcugagcuggag

SEQ ID NO: 242779 - RNA, 22 nt, Human
gcucuggcuuggggcacucguc

SEQ ID NO: 242780 - RNA, 22 nt, Human
uaaaguuuguagcaauugauau

SEQ ID NO: 242781 - RNA, 22 nt, Human
acacuaaucuuuuauuugguuu

SEQ ID NO: 242782 - RNA, 22 nt, Human
acuaaagaugucuaaauauauu

SEQ ID NO: 242783 - RNA, 22 nt, Human
ucaggauguccaaaauccagcc

SEQ ID NO: 242784 - RNA, 22 nt, Human
ugugccuacugauagagccaag

SEQ ID NO: 242785 - RNA, 22 nt, Human
guggcuucugcggugugcgcag

SEQ ID NO: 242786 - RNA, 22 nt, Human
ccaggucuuguuugacaucaau

SEQ ID NO: 242787 - RNA, 22 nt, Human
agcuccagcccuaguacagcug

SEQ ID NO: 242788 - RNA, 22 nt, Human
gaggcagcggcucacagagaaa

SEQ ID NO: 242789 - RNA, 22 nt, Human
caagggccaucugagggcacug

SEQ ID NO: 242790 - RNA, 22 nt, Human
ccuggcuuuagcugccuucccu

SEQ ID NO: 242791 - RNA, 22 nt, Human
ucaaugagccagaauguaguac

SEQ ID NO: 242792 - RNA, 22 nt, Human
uuucuuuccagagugauuggca

SEQ ID NO: 242793 - RNA, 22 nt, Human
gcagacagaagcuaaguagaca

SEQ ID NO: 242794 - RNA, 22 nt, Human
uggcccuguggcuucagaacag

SEQ ID NO: 242795 - RNA, 23 nt, Human
gcuuuuaaaccugugacugccgc

SEQ ID NO: 242796 - RNA, 22 nt, Human
cacaugaauaaggcuuuauugu

SEQ ID NO: 242797 - RNA, 22 nt, Human
uaaaggcuuuuagugaugguaa

SEQ ID NO: 242798 - RNA, 22 nt, Human
uucauuuauucagcagguauuu

SEQ ID NO: 242799 - RNA, 22 nt, Human
uuuucagaggccuaagagguuu

SEQ ID NO: 242800 - RNA, 22 nt, Human
uccugugcuuuggaggauguuc

SEQ ID NO: 242801 - RNA, 22 nt, Human
ugacaauugcagacacagaagu

SEQ ID NO: 242802 - RNA, 22 nt, Human
aaauauguuuuccaguugucau

SEQ ID NO: 242803 - RNA, 19 nt, Human
agacacuggauggaaaaug

SEQ ID NO: 242804 - RNA, 22 nt, Human
cauucugggucuggcucaggga

SEQ ID NO: 242805 - RNA, 22 nt, Human
agcuugaaccuaaaacaauaau

SEQ ID NO: 242806 - RNA, 22 nt, Human
ucuuggcucccuuguaggcccu

SEQ ID NO: 242807 - RNA, 22 nt, Human
uugcuguagcucauuucacucu

SEQ ID NO: 242808 - RNA, 22 nt, Human
uuguuuuaucuuucuacagacu

SEQ ID NO: 242809 - RNA, 22 nt, Human
guuuccucugcugguuuucauu

SEQ ID NO: 242810 - RNA, 22 nt, Human
agccacugucugaacuucugug

SEQ ID NO: 242811 - RNA, 22 nt, Human
cagggcucccaaauaucucuuc

SEQ ID NO: 242812 - RNA, 23 nt, Human
uuauugaggguguagauuggugu

SEQ ID NO: 242813 - RNA, 22 nt, Human
uauauaugggggaagcuggaug

SEQ ID NO: 242814 - RNA, 20 nt, Human
agggaggugcugggccugag

SEQ ID NO: 242815 - RNA, 22 nt, Human
gagcacaggcugcugugaacug

SEQ ID NO: 242816 - RNA, 22 nt, Human
ucuagagauuggacuuccuaga

SEQ ID NO: 242817 - RNA, 20 nt, Human
uugauucaagggcugaugga

SEQ ID NO: 242818 - RNA, 22 nt, Human
ggcccagccucagacaugcccu

SEQ ID NO: 242819 - RNA, 22 nt, Human
cacuguucaucaaaacugcucu

SEQ ID NO: 242820 - RNA, 21 nt, Human
ucagaacaauuccaugccucc

SEQ ID NO: 242821 - RNA, 22 nt, Human
agaaaacuugucacagcucuca

SEQ ID NO: 242822 - RNA, 22 nt, Human
gccaggcauguccucugcagaa

SEQ ID NO: 242823 - RNA, 19 nt, Human
uucucugugcuagacucug

SEQ ID NO: 242824 - RNA, 22 nt, Human
agucugguguucucacacuagu

SEQ ID NO: 242825 - RNA, 22 nt, Human
aaacagauugaaauucguagua

SEQ ID NO: 242826 - RNA, 22 nt, Human
gcugccuccugagauuugggca

SEQ ID NO: 242827 - RNA, 22 nt, Human
caguuugucuugauucagaaca

SEQ ID NO: 242828 - RNA, 22 nt, Human
aguccagguggaccuuggccag

SEQ ID NO: 242829 - RNA, 22 nt, Human
cugggaacaggcacugcuguca

SEQ ID NO: 242830 - RNA, 22 nt, Human
cauaauuauaaacgcaaguuca

SEQ ID NO: 242831 - RNA, 22 nt, Human
guccagagccggaagagugaca

SEQ ID NO: 242832 - RNA, 22 nt, Human
cuuuccagaccuccuuguagcu

SEQ ID NO: 242833 - RNA, 22 nt, Human
cugcagcugucucuacugggca

SEQ ID NO: 242834 - RNA, 22 nt, Human
agacaugcaauaaugugcacuc

SEQ ID NO: 242835 - RNA, 22 nt, Human
gcauucauguccuuccugaacg

SEQ ID NO: 242836 - RNA, 22 nt, Human
auuauuuauccucuuggucuau

SEQ ID NO: 242837 - RNA, 22 nt, Human
gagcuuggacaccuuggcaggu

SEQ ID NO: 242838 - RNA, 22 nt, Human
caaagguauucucauuuuggaa

SEQ ID NO: 242839 - RNA, 22 nt, Human
cacagggccuggggcagcugcu

SEQ ID NO: 242840 - RNA, 22 nt, Human
cggcagugggcgccaggucucc

SEQ ID NO: 242841 - RNA, 21 nt, Human
uuagaacacuugcucuuggaa

SEQ ID NO: 242842 - RNA, 22 nt, Human
cugaauuaagcauuacauacau

SEQ ID NO: 242843 - RNA, 22 nt, Human
acugucuguccugcucuccgug

SEQ ID NO: 242844 - RNA, 22 nt, Human
ccaggccagggcugcagcgagc

SEQ ID NO: 242845 - RNA, 22 nt, Human
cagacacuauuguguauaaauc

SEQ ID NO: 242846 - RNA, 20 nt, Human
cccuccagcaaccaggacuu

SEQ ID NO: 242847 - RNA, 18 nt, Human
ggugagggagcuggaagc

SEQ ID NO: 242848 - RNA, 22 nt, Human
ucaacaauaggauauagcaggu

SEQ ID NO: 242849 - RNA, 17 nt, Human
ggaaaaggaugauacag

SEQ ID NO: 242850 - RNA, 22 nt, Human
ggagaugacacaauuuauuuau

SEQ ID NO: 242851 - RNA, 22 nt, Human
cuacauuuugugauuaugaaau

SEQ ID NO: 242852 - RNA, 22 nt, Human
ggguccagcgacagcaggcuca

SEQ ID NO: 242853 - RNA, 22 nt, Human
ccagcuuuccugcgaguugauu

SEQ ID NO: 242854 - RNA, 22 nt, Human
gaggccugggagccuguccucc

SEQ ID NO: 242855 - RNA, 22 nt, Human
aggagccagcguuccucaggau

SEQ ID NO: 242856 - RNA, 22 nt, Human
ccuucuccugccuuggguucau

SEQ ID NO: 242857 - RNA, 22 nt, Human
guuuucugauuagcaaaucuga

SEQ ID NO: 242858 - RNA, 22 nt, Human
gggccuggggacaccaccauga

SEQ ID NO: 242859 - RNA, 22 nt, Human
ugcauuaaaaugauggagaaau

SEQ ID NO: 242860 - RNA, 22 nt, Human
ggaaucuuaauggcauggaguu

SEQ ID NO: 242861 - RNA, 22 nt, Human
uugagguaguacuuauuauugg

SEQ ID NO: 242862 - RNA, 22 nt, Human
uaugauauucuaaauugacacc

SEQ ID NO: 242863 - RNA, 22 nt, Human
cccaggcugaugggaugggcca

SEQ ID NO: 242864 - RNA, 22 nt, Human
gcuccaaaguacagugacuuac

SEQ ID NO: 242865 - RNA, 22 nt, Human
uuaacagagaacauagaaguag

SEQ ID NO: 242866 - RNA, 22 nt, Human
aucaaagugauuuguaaacagg

SEQ ID NO: 242867 - RNA, 22 nt, Human
ugagcaguucgacuucuucccc

SEQ ID NO: 242868 - RNA, 22 nt, Human
uuucuuuaggcuguguugccaa

SEQ ID NO: 242869 - RNA, 22 nt, Human
cacacaggagagugcuggaggu

SEQ ID NO: 242870 - RNA, 19 nt, Human
cuccggccagcaacugcau

SEQ ID NO: 242871 - RNA, 22 nt, Human
aucugcaucagacuuugcauga

SEQ ID NO: 242872 - RNA, 22 nt, Human
ccaggcugcuguugguguccgc

SEQ ID NO: 242873 - RNA, 22 nt, Human
aaggaacacuacaaggcuggga

SEQ ID NO: 242874 - RNA, 22 nt, Human
ucagaaaugaucguuauucauu

SEQ ID NO: 242875 - RNA, 22 nt, Human
uuauucuuuaaacauauauguu

SEQ ID NO: 242876 - RNA, 22 nt, Human
aacaccuaaaaaucauuguuga

SEQ ID NO: 242877 - RNA, 22 nt, Human
cacccuggcuggaggugcagug

SEQ ID NO: 242878 - RNA, 22 nt, Human
cccagaggugacaucccauucu

SEQ ID NO: 242879 - RNA, 22 nt, Human
acacaaacagucuauagcacca

SEQ ID NO: 242880 - RNA, 21 nt, Human
aaaaaugaaguuguucaggaa

SEQ ID NO: 242881 - RNA, 22 nt, Human
aacacacgccuccuccaugggg

SEQ ID NO: 242882 - RNA, 22 nt, Human
agcucccaauugacuugaacua

SEQ ID NO: 242883 - RNA, 22 nt, Human
agcugugguucugggcagcgac

SEQ ID NO: 242884 - RNA, 22 nt, Human
guuguacaggcagggaaacuga

SEQ ID NO: 242885 - RNA, 22 nt, Human
uggaggcauaggccugggcccu

SEQ ID NO: 242886 - RNA, 22 nt, Human
auauugaacccuacagacugua

SEQ ID NO: 242887 - RNA, 22 nt, Human
ugcuggguggacuuggcucuca

SEQ ID NO: 242888 - RNA, 22 nt, Human
agcuccugauacaugcaggaau

SEQ ID NO: 242889 - RNA, 20 nt, Human
acuccagguggcaugaggac

SEQ ID NO: 242890 - RNA, 22 nt, Human
cugugucccaguaccuugggua

SEQ ID NO: 242891 - RNA, 22 nt, Human
ccagggagcccacaggacaaug

SEQ ID NO: 242892 - RNA, 22 nt, Human
uauuuguuccagagauaaaaau

SEQ ID NO: 242893 - RNA, 22 nt, Human
gagcccagguucugcuuccagc

SEQ ID NO: 242894 - RNA, 22 nt, Human
aagccagguuccauggaggagc

SEQ ID NO: 242895 - RNA, 22 nt, Human
caggagugucuccacacagcaa

SEQ ID NO: 242896 - RNA, 22 nt, Human
agcuaugugauuuaaacaaggu

SEQ ID NO: 242897 - RNA, 22 nt, Human
uguuacaggaaauagaauuacc

SEQ ID NO: 242898 - RNA, 22 nt, Human
gaaauaacagcucuggaagagu

SEQ ID NO: 242899 - RNA, 23 nt, Human
acuuggaagcagugaacaacuuu

SEQ ID NO: 242900 - RNA, 22 nt, Human
uggagguggcacaagggagguc

SEQ ID NO: 242901 - RNA, 22 nt, Human
aaacauuguacauucuguagcu

SEQ ID NO: 242902 - RNA, 22 nt, Human
gcauugaguccacucugucuuu

SEQ ID NO: 242903 - RNA, 22 nt, Human
acugaugaagaguaccacuguu

SEQ ID NO: 242904 - RNA, 22 nt, Human
auuuauucuccagauggcgaga

SEQ ID NO: 242905 - RNA, 22 nt, Human
cagaaauacccagcauuuggag

SEQ ID NO: 242906 - RNA, 22 nt, Human
auuuccauacacccauuucuga

SEQ ID NO: 242907 - RNA, 22 nt, Human
gcuacccugggaaucucccuca

SEQ ID NO: 242908 - RNA, 22 nt, Human
aaauccuaaaaguuugacuuaa

SEQ ID NO: 242909 - RNA, 22 nt, Human
gagaugaauguaaacaaaggca

SEQ ID NO: 242910 - RNA, 22 nt, Human
uccaggcaaaaggaacugcuug

SEQ ID NO: 242911 - RNA, 22 nt, Human
caggccagcagggccuccgugg

SEQ ID NO: 242912 - RNA, 22 nt, Human
cacuuauuaugggcuaggaacu

SEQ ID NO: 242913 - RNA, 22 nt, Human
gagccuggguccuucccuggga

SEQ ID NO: 242914 - RNA, 20 nt, Human
cacaggcuuacaguuuagau

SEQ ID NO: 242915 - RNA, 22 nt, Human
uuaaugcagaaaucaaacugac

SEQ ID NO: 242916 - RNA, 22 nt, Human
ggcccuguuagagcucccacaa

SEQ ID NO: 242917 - RNA, 22 nt, Human
ccacaggaggauguucagacaa

SEQ ID NO: 242918 - RNA, 22 nt, Human
aggcacugacucaagggagcca

SEQ ID NO: 242919 - RNA, 22 nt, Human
cacaagucuguggucuccaaca

SEQ ID NO: 242920 - RNA, 22 nt, Human
auuuacagaaacuuaaucauag

SEQ ID NO: 242921 - RNA, 20 nt, Human
cagcaggaaaagugccucag

SEQ ID NO: 242922 - RNA, 22 nt, Human
uuacacuucugaaagccuaggu

SEQ ID NO: 242923 - RNA, 22 nt, Human
uuuuagaaagaucccuggcagg

SEQ ID NO: 242924 - RNA, 22 nt, Human
agugaguggagagcucuagguu

SEQ ID NO: 242925 - RNA, 23 nt, Human
aaaggcuaucaaaguuuugcuga

SEQ ID NO: 242926 - RNA, 22 nt, Human
aaggccagcuggagggaugagg

SEQ ID NO: 242927 - RNA, 22 nt, Human
ugaguacucggagugcuuugga

SEQ ID NO: 242928 - RNA, 22 nt, Human
aaugacaauaaucauuaacuuu

SEQ ID NO: 242929 - RNA, 22 nt, Human
ugguacaaucacagcucacugu

SEQ ID NO: 242930 - RNA, 22 nt, Human
uagaaagaacuucauguaaaac

SEQ ID NO: 242931 - RNA, 19 nt, Human
aauauuuuagccucuuccu

SEQ ID NO: 242932 - RNA, 22 nt, Human
gccagcaguauguccuggcagu

SEQ ID NO: 242933 - RNA, 22 nt, Human
caaagcagaagguucuguggua

SEQ ID NO: 242934 - RNA, 22 nt, Human
augaggcacagagauguuaaug

SEQ ID NO: 242935 - RNA, 22 nt, Human
ugcccuugggauuuagguaagg

SEQ ID NO: 242936 - RNA, 22 nt, Human
ggcucccuggaaaucccgaggc

SEQ ID NO: 242937 - RNA, 22 nt, Human
gcaaacauguugugagauacca

SEQ ID NO: 242938 - RNA, 22 nt, Human
agacuacauaugccacaugaag

SEQ ID NO: 242939 - RNA, 22 nt, Human
aaacugguaaucggcaagugag

SEQ ID NO: 242940 - RNA, 22 nt, Human
cgcaggcuccggggugcccugg

SEQ ID NO: 242941 - RNA, 22 nt, Human
ggcuguccuuggccaaggcacu

SEQ ID NO: 242942 - RNA, 22 nt, Human
agggccuggcgcguggccgccg

SEQ ID NO: 242943 - RNA, 22 nt, Human
cagggcacggagaagucacccc

SEQ ID NO: 242944 - RNA, 23 nt, Human
ccugugacacuguuugugguaag

SEQ ID NO: 242945 - RNA, 22 nt, Human
accucuuaauauugcaccuucu

SEQ ID NO: 242946 - RNA, 22 nt, Human
cugcugccggcgagccucccuu

SEQ ID NO: 242947 - RNA, 17 nt, Human
uucaaagcuuaucaagg

SEQ ID NO: 242948 - RNA, 20 nt, Human
agguccuguuccuugucucc

SEQ ID NO: 242949 - RNA, 22 nt, Human
gccagcugcuggaacagcgcga

SEQ ID NO: 242950 - RNA, 20 nt, Human
agacccucuggacugggccc

SEQ ID NO: 242951 - RNA, 22 nt, Human
aauaaugauaaugguuauagcu

SEQ ID NO: 242952 - RNA, 22 nt, Human
uacaaagucagaauaacaggug

SEQ ID NO: 242953 - RNA, 22 nt, Human
uugcuuuauauucaagagagga

SEQ ID NO: 242954 - RNA, 22 nt, Human
ggccagcuucucugcugccugu

SEQ ID NO: 242955 - RNA, 22 nt, Human
gcucaggccuggcuauccauug

SEQ ID NO: 242956 - RNA, 22 nt, Human
uucacuguaugagagggcuuga

SEQ ID NO: 242957 - RNA, 22 nt, Human
cagacuuucugacucccuugcc

SEQ ID NO: 242958 - RNA, 22 nt, Human
uaauaacaauuguaggacauga

SEQ ID NO: 242959 - RNA, 22 nt, Human
aagggcaggaaaagauggaugu

SEQ ID NO: 242960 - RNA, 22 nt, Human
gacagcaggugcuugggaaagg

SEQ ID NO: 242961 - RNA, 22 nt, Human
uagggaugcuuaguaggaccca

SEQ ID NO: 242962 - RNA, 18 nt, Human
cuuguucuucucuuggcg

SEQ ID NO: 242963 - RNA, 22 nt, Human
ccugggcucaggcuugggcagc

SEQ ID NO: 242964 - RNA, 22 nt, Human
agcagcuuaucuuggagaggca

SEQ ID NO: 242965 - RNA, 22 nt, Human
caaauagaacucacagacaaga

SEQ ID NO: 242966 - RNA, 22 nt, Human
acauuguuugagaauacagaug

SEQ ID NO: 242967 - RNA, 22 nt, Human
uucauguuuccucuugugcugc

SEQ ID NO: 242968 - RNA, 18 nt, Human
cucaguguuugcugaaaa

SEQ ID NO: 242969 - RNA, 22 nt, Human
augggacaggcaugggacuuag

SEQ ID NO: 242970 - RNA, 22 nt, Human
uuuccucugucaugacagcuga

SEQ ID NO: 242971 - RNA, 23 nt, Human
agugccauugacccuaugucuau

SEQ ID NO: 242972 - RNA, 22 nt, Human
agcaaaguagcugcuguucuua

SEQ ID NO: 242973 - RNA, 22 nt, Human
gcaggcucagagcagauuagca

SEQ ID NO: 242974 - RNA, 22 nt, Human
aggagcucaaagaugccaggag

SEQ ID NO: 242975 - RNA, 22 nt, Human
aucucuucugagcaauuccugu

SEQ ID NO: 242976 - RNA, 23 nt, Human
ccacuggagaaaguggcaggugg

SEQ ID NO: 242977 - RNA, 22 nt, Human
gcugucucucccaggauccaug

SEQ ID NO: 242978 - RNA, 22 nt, Human
aguggggccgcgguccugcccu

SEQ ID NO: 242979 - RNA, 22 nt, Human
cccaggaggcagagguuggagc

SEQ ID NO: 242980 - RNA, 22 nt, Human
agaaauuaugcaguaguuuuau

SEQ ID NO: 242981 - RNA, 22 nt, Human
uaugcauauagaugcacacaca

SEQ ID NO: 242982 - RNA, 22 nt, Human
augacacucgaaaaauugaugc

SEQ ID NO: 242983 - RNA, 22 nt, Human
gugggucccuaaacacauccca

SEQ ID NO: 242984 - RNA, 22 nt, Human
ucagaagccaccuuuuguuggg

SEQ ID NO: 242985 - RNA, 22 nt, Human
aggcucccaagcacugacccca

SEQ ID NO: 242986 - RNA, 22 nt, Human
aggccagcaccagagucaagaa

SEQ ID NO: 242987 - RNA, 22 nt, Human
ugcagcugaccagcaaguccug

SEQ ID NO: 242988 - RNA, 21 nt, Human
uucugggccaugcugcuucuc

SEQ ID NO: 242989 - RNA, 22 nt, Human
guacauuggcaacucucuuaga

SEQ ID NO: 242990 - RNA, 22 nt, Human
uaggcagagaggccauaagaau

SEQ ID NO: 242991 - RNA, 22 nt, Human
cauuugaacuaauaacugugcu

SEQ ID NO: 242992 - RNA, 22 nt, Human
gagaggcagaggccugaaaccg

SEQ ID NO: 242993 - RNA, 22 nt, Human
acuugauuuuuauaauaaaugg

SEQ ID NO: 242994 - RNA, 22 nt, Human
gaaaguuauugaaccuuauuua

SEQ ID NO: 242995 - RNA, 22 nt, Human
agcuccugggagcaggugguac

SEQ ID NO: 242996 - RNA, 22 nt, Human
acuuagauuuccuuacugggug

SEQ ID NO: 242997 - RNA, 22 nt, Human
ugcuggggauccguaccaaccc

SEQ ID NO: 242998 - RNA, 22 nt, Human
augagugucauguaugagauau

SEQ ID NO: 242999 - RNA, 22 nt, Human
ucuuccaggaccuggggcucca

SEQ ID NO: 243000 - RNA, 22 nt, Human
agcuacaguggacaagugaacu

SEQ ID NO: 243001 - RNA, 22 nt, Human
ucucagagaggggccgggccuu

SEQ ID NO: 243002 - RNA, 22 nt, Human
auguuucugaguguauauacau

SEQ ID NO: 243003 - RNA, 22 nt, Human
auuugggaguugcuagugaguu

SEQ ID NO: 243004 - RNA, 22 nt, Human
ggagggaguuucauuccugccc

SEQ ID NO: 243005 - RNA, 22 nt, Human
agauccugccaauggaagcagg

SEQ ID NO: 243006 - RNA, 20 nt, Human
aagucacuuaagaugggcag

SEQ ID NO: 243007 - RNA, 23 nt, Human
uuacuacacaaguaacgauuccc

SEQ ID NO: 243008 - RNA, 22 nt, Human
cugcaucauuuucagacaaugg

SEQ ID NO: 243009 - RNA, 22 nt, Human
auacugaugaugugaagaaaca

SEQ ID NO: 243010 - RNA, 22 nt, Human
cugaggccguuggugggccuua

SEQ ID NO: 243011 - RNA, 22 nt, Human
uuuuaguuuggauuucuaaagc

SEQ ID NO: 243012 - RNA, 22 nt, Human
ucucagugauggcccauuugga

SEQ ID NO: 243013 - RNA, 22 nt, Human
cucaggcaguucuguagccucc

SEQ ID NO: 243014 - RNA, 22 nt, Human
cugcagggcauuguaacucuuu

SEQ ID NO: 243015 - RNA, 23 nt, Human
agcaaaguuguugcuaaccucau

SEQ ID NO: 243016 - RNA, 22 nt, Human
aacauagagacaggaagugcuu

SEQ ID NO: 243017 - RNA, 22 nt, Human
acagaauaguagcuuaaaguca

SEQ ID NO: 243018 - RNA, 22 nt, Human
cagcuuuaccuuuaggaguaac

SEQ ID NO: 243019 - RNA, 22 nt, Human
ucucugagcgcauuccuccggc

SEQ ID NO: 243020 - RNA, 22 nt, Human
gccaaauuugugagcccccaag

SEQ ID NO: 243021 - RNA, 22 nt, Human
gaacucagagccugagcuagga

SEQ ID NO: 243022 - RNA, 22 nt, Human
aagugcaucacuacucauuaca

SEQ ID NO: 243023 - RNA, 22 nt, Human
ugcugcacgauaaauaauuucu

SEQ ID NO: 243024 - RNA, 22 nt, Human
cuugugcauuucauuccucagg

SEQ ID NO: 243025 - RNA, 22 nt, Human
acagaauauuguaagugccacu

SEQ ID NO: 243026 - RNA, 19 nt, Human
gcucagagccaugggggcu

SEQ ID NO: 243027 - RNA, 22 nt, Human
cuccagagucacacugccuggg

SEQ ID NO: 243028 - RNA, 22 nt, Human
ugcaggaccuugauccuggacu

SEQ ID NO: 243029 - RNA, 22 nt, Human
aaaaauacuucacuucugggug

SEQ ID NO: 243030 - RNA, 22 nt, Human
cagugucaggaucaguauauuu

SEQ ID NO: 243031 - RNA, 22 nt, Human
uuucauguuggauacuguuuca

SEQ ID NO: 243032 - RNA, 22 nt, Human
gaggcaguuccugagugacaag

SEQ ID NO: 243033 - RNA, 20 nt, Human
caaggcagaccagagugagu

SEQ ID NO: 243034 - RNA, 22 nt, Human
ccaagcugccugaggcaaauuu

SEQ ID NO: 243035 - RNA, 22 nt, Human
cccaggcagugugugcaugcgu

SEQ ID NO: 243036 - RNA, 22 nt, Human
acacaugaaagacauuaaggug

SEQ ID NO: 243037 - RNA, 22 nt, Human
ucacagaauuuuugcuuccagu

SEQ ID NO: 243038 - RNA, 22 nt, Human
cagcugagcaucacuagucugg

SEQ ID NO: 243039 - RNA, 22 nt, Human
aaguucuacuguggguaaaaug

SEQ ID NO: 243040 - RNA, 22 nt, Human
guggggcuggaagauggguacu

SEQ ID NO: 243041 - RNA, 20 nt, Human
gcagagccucacugcaaggg

SEQ ID NO: 243042 - RNA, 22 nt, Human
aaguauucuacaaagaaauuga

SEQ ID NO: 243043 - RNA, 22 nt, Human
uucucuggaacugaaacaagau

SEQ ID NO: 243044 - RNA, 22 nt, Human
cagugcaaugcagaugacacca

SEQ ID NO: 243045 - RNA, 22 nt, Human
acugaauuuuaauuagaucugc

SEQ ID NO: 243046 - RNA, 22 nt, Human
aaacacaauguuucuuuguucu

SEQ ID NO: 243047 - RNA, 20 nt, Human
uuugcgaggccaaggcgggc

SEQ ID NO: 243048 - RNA, 21 nt, Human
gaaaaccauuugcaucaugag

SEQ ID NO: 243049 - RNA, 22 nt, Human
ugaaacagcuaucaguagacug

SEQ ID NO: 243050 - RNA, 22 nt, Human
uuccuggcuugucacaucuacg

SEQ ID NO: 243051 - RNA, 22 nt, Human
aggcaucuaacagagaucuuua

SEQ ID NO: 243052 - RNA, 22 nt, Human
uuacaugaugauuucauaaaca

SEQ ID NO: 243053 - RNA, 23 nt, Human
uagauguauuaagugcauuuuca

SEQ ID NO: 243054 - RNA, 22 nt, Human
ggcugagcuuuucaugaugguu

SEQ ID NO: 243055 - RNA, 22 nt, Human
guagggacuguucucaccugag

SEQ ID NO: 243056 - RNA, 20 nt, Human
aagcuggguaggagaggagc

SEQ ID NO: 243057 - RNA, 21 nt, Human
ucaggaagagcuucucccacu

SEQ ID NO: 243058 - RNA, 22 nt, Human
ugcccugcccuugcuauuucua

SEQ ID NO: 243059 - RNA, 22 nt, Human
cugccuggaaggagcaagggga

SEQ ID NO: 243060 - RNA, 22 nt, Human
aacuucauguaauuuaaaacag

SEQ ID NO: 243061 - RNA, 22 nt, Human
accuacauaguuaaguaacaaa

SEQ ID NO: 243062 - RNA, 17 nt, Human
cacuugcuggucuaccu

SEQ ID NO: 243063 - RNA, 19 nt, Human
acuucuuuucaacacagga

SEQ ID NO: 243064 - RNA, 22 nt, Human
gggagacccccaaugccagguc

SEQ ID NO: 243065 - RNA, 19 nt, Human
ccaccagugugaucuaaga

SEQ ID NO: 243066 - RNA, 22 nt, Human
uguggcuguugaggaccccaag

SEQ ID NO: 243067 - RNA, 22 nt, Human
agucagcagugaaagcacagcc

SEQ ID NO: 243068 - RNA, 22 nt, Human
gggacaugaagcaucggaggca

SEQ ID NO: 243069 - RNA, 22 nt, Human
cuggaggaccacagaagcuggu

SEQ ID NO: 243070 - RNA, 22 nt, Human
cacagggcagagaccugggugc

SEQ ID NO: 243071 - RNA, 22 nt, Human
ugggugcucugcgaccguaggg

SEQ ID NO: 243072 - RNA, 22 nt, Human
uauacagauggaaagauacaca

SEQ ID NO: 243073 - RNA, 22 nt, Human
ugaaaucauugggguugaauaa

SEQ ID NO: 243074 - RNA, 22 nt, Human
uuuuuuguagcaagcgcagaua

SEQ ID NO: 243075 - RNA, 22 nt, Human
gaugcaaagaggaccuucagua

SEQ ID NO: 243076 - RNA, 22 nt, Human
uccucaguggggcauucauuau

SEQ ID NO: 243077 - RNA, 22 nt, Human
gcggggggaggaacaucuugca

SEQ ID NO: 243078 - RNA, 22 nt, Human
ggagaaggcgaagucauucuuu

SEQ ID NO: 243079 - RNA, 22 nt, Human
ucugagcuucccucugaggcag

SEQ ID NO: 243080 - RNA, 22 nt, Human
uuccucagcuguguccuggcga

SEQ ID NO: 243081 - RNA, 20 nt, Human
gugcagaggcagccuguggg

SEQ ID NO: 243082 - RNA, 22 nt, Human
aaucagaaauucuacaucacaa

SEQ ID NO: 243083 - RNA, 22 nt, Human
gaacauaauuaaauguccuggg

SEQ ID NO: 243084 - RNA, 22 nt, Human
uucaacaagucuuuuuucacug

SEQ ID NO: 243085 - RNA, 22 nt, Human
cagaggcuggauggacuugccu

SEQ ID NO: 243086 - RNA, 22 nt, Human
ccagcugacgaugccuggucuc

SEQ ID NO: 243087 - RNA, 22 nt, Human
cugcaaaucaaguucuuauaau

SEQ ID NO: 243088 - RNA, 22 nt, Human
agcugcaagauuucuuuuguau

SEQ ID NO: 243089 - RNA, 22 nt, Human
ggcccugcugaguggaguggag

SEQ ID NO: 243090 - RNA, 22 nt, Human
uaacugguccugaacagcccag

SEQ ID NO: 243091 - RNA, 22 nt, Human
ugcucuggcugggaugagugca

SEQ ID NO: 243092 - RNA, 20 nt, Human
gcuaccagaacaaggccauu

SEQ ID NO: 243093 - RNA, 22 nt, Human
uagcagcaauuucagaaguuug

SEQ ID NO: 243094 - RNA, 22 nt, Human
acagcuggugaauguucucugu

SEQ ID NO: 243095 - RNA, 22 nt, Human
guuugccugugauguacauuuc

SEQ ID NO: 243096 - RNA, 22 nt, Human
aagccaaggccugucuggggcu

SEQ ID NO: 243097 - RNA, 19 nt, Human
aagcuacagcccaggucug

SEQ ID NO: 243098 - RNA, 22 nt, Human
gggaagagauuuccacaucauu

SEQ ID NO: 243099 - RNA, 22 nt, Human
cauuaaaucuuccagaccucac

SEQ ID NO: 243100 - RNA, 22 nt, Human
aagagucuauuggaacuagaca

SEQ ID NO: 243101 - RNA, 22 nt, Human
cacuuuacccuuguuacucaug

SEQ ID NO: 243102 - RNA, 22 nt, Human
acagguggcagaagcauuuacu

SEQ ID NO: 243103 - RNA, 22 nt, Human
ccagggcagaaaaagagggaau

SEQ ID NO: 243104 - RNA, 22 nt, Human
agcaaauacauuuuuagcauaa

SEQ ID NO: 243105 - RNA, 20 nt, Human
gggugugugcagggccuggu

SEQ ID NO: 243106 - RNA, 22 nt, Human
uaguaaaaguuuaguugaaagu

SEQ ID NO: 243107 - RNA, 22 nt, Human
gauccacagcugcgguaggaga

SEQ ID NO: 243108 - RNA, 22 nt, Human
aagaugauguuguguuuucacu

SEQ ID NO: 243109 - RNA, 22 nt, Human
ggaaucagaauuacugaaugga

SEQ ID NO: 243110 - RNA, 22 nt, Human
aggcugagguaggaggaucgcu

SEQ ID NO: 243111 - RNA, 22 nt, Human
gcccggccaggaacagaguaua

SEQ ID NO: 243112 - RNA, 22 nt, Human
acuuagaauuaaauauuuuugg

SEQ ID NO: 243113 - RNA, 22 nt, Human
augucaaacacaacaccagugg

SEQ ID NO: 243114 - RNA, 22 nt, Human
gccuguccccaggagaguccgg

SEQ ID NO: 243115 - RNA, 22 nt, Human
uuuugaaagccagguuuguaug

SEQ ID NO: 243116 - RNA, 22 nt, Human
gauguacuugccuuaucuaucc

SEQ ID NO: 243117 - RNA, 22 nt, Human
cccugggcaccaggccugguaa

SEQ ID NO: 243118 - RNA, 22 nt, Human
gacaggccagacaggagacuga

SEQ ID NO: 243119 - RNA, 18 nt, Human
aacuguugaaauagcuug

SEQ ID NO: 243120 - RNA, 22 nt, Human
ugucuuuuaccuaaugagcugg

SEQ ID NO: 243121 - RNA, 22 nt, Human
ggaacaggaaaggagggaugcu

SEQ ID NO: 243122 - RNA, 22 nt, Human
acccagcuggaugcauggaggc

SEQ ID NO: 243123 - RNA, 22 nt, Human
gcagaugcagagauggcugggg

SEQ ID NO: 243124 - RNA, 22 nt, Human
caguggcaaguccgguauugaa

SEQ ID NO: 243125 - RNA, 22 nt, Human
acauguaaaaggaacaugcaug

SEQ ID NO: 243126 - RNA, 22 nt, Human
ucauggcacuuagcacaguccu

SEQ ID NO: 243127 - RNA, 22 nt, Human
cugagguguggucugggaguau

SEQ ID NO: 243128 - RNA, 22 nt, Human
ccccuccugcagcaccuuucuu

SEQ ID NO: 243129 - RNA, 22 nt, Human
acauuucuccuacuuguuauuu

SEQ ID NO: 243130 - RNA, 22 nt, Human
ucccaaaguauuagcauuucaa

SEQ ID NO: 243131 - RNA, 22 nt, Human
uguuagaaaggcuauuggacca

SEQ ID NO: 243132 - RNA, 22 nt, Human
aggcagaaaauagucauccaaa

SEQ ID NO: 243133 - RNA, 17 nt, Human
ucuccaggacgagcuca

SEQ ID NO: 243134 - RNA, 22 nt, Human
acaggcucuggggcaggauggc

SEQ ID NO: 243135 - RNA, 22 nt, Human
uaaaaccauaaggcuggaagga

SEQ ID NO: 243136 - RNA, 22 nt, Human
ucucagaaaagagcuucagaaa

SEQ ID NO: 243137 - RNA, 22 nt, Human
gaugcagcagccagcuucugaa

SEQ ID NO: 243138 - RNA, 23 nt, Human
ucagagaggcccccugcagagau

SEQ ID NO: 243139 - RNA, 22 nt, Human
gccccagauggaggaagcuggg

SEQ ID NO: 243140 - RNA, 22 nt, Human
uguaugcacauauauagguaca

SEQ ID NO: 243141 - RNA, 22 nt, Human
uucugcagugugcagggccugu

SEQ ID NO: 243142 - RNA, 22 nt, Human
cagucucucuccuugcaggcgu

SEQ ID NO: 243143 - RNA, 22 nt, Human
cagcaggucccacugagggccc

SEQ ID NO: 243144 - RNA, 22 nt, Human
aaacuuuuuuagguucauaggc

SEQ ID NO: 243145 - RNA, 22 nt, Human
gguccugucugacaucacugcu

SEQ ID NO: 243146 - RNA, 22 nt, Human
augcuuugauuugguuucucua

SEQ ID NO: 243147 - RNA, 22 nt, Human
ggccacagcaaugcugugaugu

SEQ ID NO: 243148 - RNA, 22 nt, Human
ccaagcuucuuuccuacuacag

SEQ ID NO: 243149 - RNA, 22 nt, Human
cuggaagaacuccaguucugug

SEQ ID NO: 243150 - RNA, 22 nt, Human
agacaauggagagcagaguacu

SEQ ID NO: 243151 - RNA, 22 nt, Human
auucaagguuggcucaggaauu

SEQ ID NO: 243152 - RNA, 22 nt, Human
ucauguuugcccuaagaaaaag

SEQ ID NO: 243153 - RNA, 21 nt, Human
uggaggaauaaagcacagaag

SEQ ID NO: 243154 - RNA, 22 nt, Human
guuuaauaauguugaauuacua

SEQ ID NO: 243155 - RNA, 22 nt, Human
ucaggucugggcacaugguaca

SEQ ID NO: 243156 - RNA, 22 nt, Human
cuggcuuuaaugucaucuuucu

SEQ ID NO: 243157 - RNA, 22 nt, Human
uggccugggugcugcugacauc

SEQ ID NO: 243158 - RNA, 22 nt, Human
uggcugugucccuguccagagu

SEQ ID NO: 243159 - RNA, 22 nt, Human
ccagcagacacacaggcguggg

SEQ ID NO: 243160 - RNA, 22 nt, Human
caggcauagaagggcaagaaua

SEQ ID NO: 243161 - RNA, 22 nt, Human
auucuuuucccaacugcuuuaa

SEQ ID NO: 243162 - RNA, 22 nt, Human
ucccagugggugacuggaggcu

SEQ ID NO: 243163 - RNA, 22 nt, Human
gagcugaauugcugccauuugc

SEQ ID NO: 243164 - RNA, 22 nt, Human
ccugugacuuggcaaaccucca

SEQ ID NO: 243165 - RNA, 22 nt, Human
ucauugccauggcauuugcaga

SEQ ID NO: 243166 - RNA, 22 nt, Human
ggagccagaggcugcugcugug

SEQ ID NO: 243167 - RNA, 21 nt, Human
agucuggggaagggaucccag

SEQ ID NO: 243168 - RNA, 22 nt, Human
uagcuuuacaaagugcugcacc

SEQ ID NO: 243169 - RNA, 22 nt, Human
gggcacaccuugucugagcaca

SEQ ID NO: 243170 - RNA, 22 nt, Human
auagauguucaaucagauauuu

SEQ ID NO: 243171 - RNA, 22 nt, Human
uaaauucugaucaaguuccuuc

SEQ ID NO: 243172 - RNA, 22 nt, Human
aguguguaagggaucaaagagu

SEQ ID NO: 243173 - RNA, 22 nt, Human
aaagcuaccuuuguguucauag

SEQ ID NO: 243174 - RNA, 22 nt, Human
augucauugccaagaugcuaau

SEQ ID NO: 243175 - RNA, 22 nt, Human
uuauuugcccauguuuagcaga

SEQ ID NO: 243176 - RNA, 19 nt, Human
caggccucuggucugcugu

SEQ ID NO: 243177 - RNA, 22 nt, Human
uccugggacaccccaauaugag

SEQ ID NO: 243178 - RNA, 22 nt, Human
cucuucccagcuccacgagagg

SEQ ID NO: 243179 - RNA, 22 nt, Human
cuucauaggguuguaaggauua

SEQ ID NO: 243180 - RNA, 22 nt, Human
aauagcuuuuguaugaugaaau

SEQ ID NO: 243181 - RNA, 22 nt, Human
acuuuauuuccuauugcaucca

SEQ ID NO: 243182 - RNA, 22 nt, Human
cuuaagauugucagcuucagcc

SEQ ID NO: 243183 - RNA, 22 nt, Human
cacugucugcuucgacucuuca

SEQ ID NO: 243184 - RNA, 22 nt, Human
ucuggcaguggaugagggcagc

SEQ ID NO: 243185 - RNA, 22 nt, Human
uacuguuuucuuuauaguacag

SEQ ID NO: 243186 - RNA, 22 nt, Human
gcugaccauuaggaggacgaua

SEQ ID NO: 243187 - RNA, 22 nt, Human
uuggggaagaguugacuuugga

SEQ ID NO: 243188 - RNA, 17 nt, Human
ugguccagguggagcca

SEQ ID NO: 243189 - RNA, 22 nt, Human
ugggaaccauguagcugagaug

SEQ ID NO: 243190 - RNA, 22 nt, Human
ccaggcuagagugcaguggcau

SEQ ID NO: 243191 - RNA, 22 nt, Human
agcagcugggcucagagcuggg

SEQ ID NO: 243192 - RNA, 22 nt, Human
acaggaggggcaugaaagacgg

SEQ ID NO: 243193 - RNA, 22 nt, Human
ucacagaauaaauguacuggcc

SEQ ID NO: 243194 - RNA, 22 nt, Human
acauuagaacauuaauauuggg

SEQ ID NO: 243195 - RNA, 22 nt, Human
guuuuauuuccaugagagaccg

SEQ ID NO: 243196 - RNA, 22 nt, Human
cuggcuguaugcuggccucaga

SEQ ID NO: 243197 - RNA, 22 nt, Human
ucuuccuucuuugaugacaagg

SEQ ID NO: 243198 - RNA, 22 nt, Human
agcauaaaggucaacguuuuag

SEQ ID NO: 243199 - RNA, 22 nt, Human
uucucaggcucugagacccuau

SEQ ID NO: 243200 - RNA, 22 nt, Human
ucaguuuaagaugacuaacaau

SEQ ID NO: 243201 - RNA, 22 nt, Human
gcuauuuuugagccauuuauaa

SEQ ID NO: 243202 - RNA, 22 nt, Human
agcacugcuuuagagccucugc

SEQ ID NO: 243203 - RNA, 19 nt, Human
cucugggcugcaucuuggu

SEQ ID NO: 243204 - RNA, 22 nt, Human
agaaauguuacaguuguuauuu

SEQ ID NO: 243205 - RNA, 22 nt, Human
ucaggaagucucaauuagcuac

SEQ ID NO: 243206 - RNA, 22 nt, Human
uggcacaugguuaaucauaauu

SEQ ID NO: 243207 - RNA, 22 nt, Human
cuggagucuuagguuaugguga

SEQ ID NO: 243208 - RNA, 23 nt, Human
gcaggugguucgaacagaaguuu

SEQ ID NO: 243209 - RNA, 22 nt, Human
ugggcaugaguggacagagaag

SEQ ID NO: 243210 - RNA, 22 nt, Human
cuggcucuaucuccaaggcugg

SEQ ID NO: 243211 - RNA, 22 nt, Human
uguccuggggacaagaggcccu

SEQ ID NO: 243212 - RNA, 22 nt, Human
aagggcucgguagcaguccuga

SEQ ID NO: 243213 - RNA, 22 nt, Human
cuggcugguugucucaauccag

SEQ ID NO: 243214 - RNA, 22 nt, Human
ccaggugccuccagucacagug

SEQ ID NO: 243215 - RNA, 22 nt, Human
aaaaaguauuggccaugguuga

SEQ ID NO: 243216 - RNA, 22 nt, Human
cuggcccuggcuggagcccagg

SEQ ID NO: 243217 - RNA, 22 nt, Human
uacaaucaggauaauaauagug

SEQ ID NO: 243218 - RNA, 22 nt, Human
ggagcugggaacuauguaguau

SEQ ID NO: 243219 - RNA, 22 nt, Human
uuucagaaagcugaacauauga

SEQ ID NO: 243220 - RNA, 22 nt, Human
uugaaaugagcaaacugucagc

SEQ ID NO: 243221 - RNA, 22 nt, Human
uggugcugccaggcuccugcca

SEQ ID NO: 243222 - RNA, 22 nt, Human
cagaaguugauccugcguuucc

SEQ ID NO: 243223 - RNA, 22 nt, Human
ugcaaauacaaaaugguacagc

SEQ ID NO: 243224 - RNA, 23 nt, Human
uugcagggauggaguucaaaaug

SEQ ID NO: 243225 - RNA, 22 nt, Human
ucuguugcaaugugcaugguga

SEQ ID NO: 243226 - RNA, 22 nt, Human
ccuugguccaacccugcacagc

SEQ ID NO: 243227 - RNA, 18 nt, Human
cugaauuaucucaucauu

SEQ ID NO: 243228 - RNA, 22 nt, Human
aggaccuguagggccugcaucc

SEQ ID NO: 243229 - RNA, 22 nt, Human
uugcaaaagccgaggcacucca

SEQ ID NO: 243230 - RNA, 22 nt, Human
uagggcugccauuugcuuuucu

SEQ ID NO: 243231 - RNA, 22 nt, Human
acagauuuuugguaaauaauuu

SEQ ID NO: 243232 - RNA, 14 nt, Human
gcagguggaucacc

SEQ ID NO: 243233 - RNA, 14 nt, Human
gcaggcggaucacu

SEQ ID NO: 243234 - RNA, 22 nt, Human
ccaucacaguccccaucgugau

SEQ ID NO: 243235 - RNA, 22 nt, Human
cugugcccagcucccugacugc

SEQ ID NO: 243236 - RNA, 22 nt, Human
agagccugucugccuuucuacc

SEQ ID NO: 243237 - RNA, 22 nt, Human
uaauauauaccuuuguuaggaa

SEQ ID NO: 243238 - RNA, 22 nt, Human
agccagcugugggcucaggcgg

SEQ ID NO: 243239 - RNA, 22 nt, Human
gcaggcugggguagccccacuu

SEQ ID NO: 243240 - RNA, 22 nt, Human
cagccacuacaauugguuccau

SEQ ID NO: 243241 - RNA, 23 nt, Human
agcaaugcugggagacucuguaa

SEQ ID NO: 243242 - RNA, 22 nt, Human
uccaggcccgagaugggcugga

SEQ ID NO: 243243 - RNA, 22 nt, Human
acaguggccucaaagaaagaga

SEQ ID NO: 243244 - RNA, 22 nt, Human
cggcaggguugguuuucucuga

SEQ ID NO: 243245 - RNA, 22 nt, Human
gagcaggucuuucauggugcau

SEQ ID NO: 243246 - RNA, 21 nt, Human
uuagaacaauauuugguauag

SEQ ID NO: 243247 - RNA, 22 nt, Human
uguccuggugcuccagguggcu

SEQ ID NO: 243248 - RNA, 22 nt, Human
uuagauaauguagagauaugag

SEQ ID NO: 243249 - RNA, 22 nt, Human
gaguuaaaguaccuuuguaugu

SEQ ID NO: 243250 - RNA, 23 nt, Human
agugccagggagaucaggacgga

SEQ ID NO: 243251 - RNA, 22 nt, Human
auuaacuguacuuucuaauuuu

SEQ ID NO: 243252 - RNA, 22 nt, Human
cagagccuuaguucuccuagaa

SEQ ID NO: 243253 - RNA, 22 nt, Human
uucaaaugguuagacuguuagc

SEQ ID NO: 243254 - RNA, 22 nt, Human
cacuguucuuuuuguaguccaa

SEQ ID NO: 243255 - RNA, 22 nt, Human
aucagcaaaaaugccuucagaa

SEQ ID NO: 243256 - RNA, 23 nt, Human
aucucucugguggucacagucag

SEQ ID NO: 243257 - RNA, 22 nt, Human
ugauucaagagaguugggguau

SEQ ID NO: 243258 - RNA, 22 nt, Human
aacaaaggccguuaauaaccac

SEQ ID NO: 243259 - RNA, 22 nt, Human
agaagccacugcucccagugag

SEQ ID NO: 243260 - RNA, 22 nt, Human
uuucagaaauggcacugaaauc

SEQ ID NO: 243261 - RNA, 22 nt, Human
cacaggccaguaagacuguguu

SEQ ID NO: 243262 - RNA, 22 nt, Human
aaauuagucgguuuaggaauuu

SEQ ID NO: 243263 - RNA, 22 nt, Human
uuccagcccgcgacuuguucag

SEQ ID NO: 243264 - RNA, 22 nt, Human
ccuggacaaugagaugucaggg

SEQ ID NO: 243265 - RNA, 22 nt, Human
ugccuugcuggaugucaguuuu

SEQ ID NO: 243266 - RNA, 22 nt, Human
ucuggggagggagccacagguc

SEQ ID NO: 243267 - RNA, 22 nt, Human
gccugugcuuaacugacgugag

SEQ ID NO: 243268 - RNA, 22 nt, Human
ugcugucugauucagggugauu

SEQ ID NO: 243269 - RNA, 22 nt, Human
aauuugauucccugcaccuguu

SEQ ID NO: 243270 - RNA, 23 nt, Human
acaagcagcccagugcucugccu

SEQ ID NO: 243271 - RNA, 22 nt, Human
caguucuuaauaccaugugguu

SEQ ID NO: 243272 - RNA, 22 nt, Human
acacaugcuccagucuccagga

SEQ ID NO: 243273 - RNA, 22 nt, Human
agucacauuugggggugucaaa

SEQ ID NO: 243274 - RNA, 22 nt, Human
ucuucacauggaacaugaagcu

SEQ ID NO: 243275 - RNA, 22 nt, Human
aaggcugagagucacaguccua

SEQ ID NO: 243276 - RNA, 22 nt, Human
ucaggagcugugaauacaaagg

SEQ ID NO: 243277 - RNA, 22 nt, Human
ucuugggcauguguuugauuuc

SEQ ID NO: 243278 - RNA, 22 nt, Human
ucuacagacuccuauguaacac

SEQ ID NO: 243279 - RNA, 22 nt, Human
cugcugguugcacagagcuagg

SEQ ID NO: 243280 - RNA, 22 nt, Human
auuggucuggggaaaugaagag

SEQ ID NO: 243281 - RNA, 22 nt, Human
uguuuuuuccuuaugcaaucug

SEQ ID NO: 243282 - RNA, 22 nt, Human
acaggaaaugaaaugguaucua

SEQ ID NO: 243283 - RNA, 22 nt, Human
agcuccuggucuuuguccagag

SEQ ID NO: 243284 - RNA, 22 nt, Human
gaaaaguauguuuauuuugacu

SEQ ID NO: 243285 - RNA, 22 nt, Human
uggccugccccgagauccuggc

SEQ ID NO: 243286 - RNA, 22 nt, Human
uggccagugggguugagcagga

SEQ ID NO: 243287 - RNA, 22 nt, Human
aagaagucuggagcaaugcaau

SEQ ID NO: 243288 - RNA, 22 nt, Human
uuuaugauuauuuuaaagcagc

SEQ ID NO: 243289 - RNA, 22 nt, Human
uuugaacaggaguaucuauagu

SEQ ID NO: 243290 - RNA, 20 nt, Human
ugcagggccuaaaaagggaa

SEQ ID NO: 243291 - RNA, 22 nt, Human
aacauauaaacucuuaaguuca

SEQ ID NO: 243292 - RNA, 22 nt, Human
gggugugucuuuugcuccugga

SEQ ID NO: 243293 - RNA, 22 nt, Human
augccacauaaccaguucacuu

SEQ ID NO: 243294 - RNA, 19 nt, Human
agcauccagucaugggauc

SEQ ID NO: 243295 - RNA, 22 nt, Human
uccagcacucgcccagggcuug

SEQ ID NO: 243296 - RNA, 22 nt, Human
ggguccaccugagcagcagccu

SEQ ID NO: 243297 - RNA, 21 nt, Human
augcagagaacuccagggaag

SEQ ID NO: 243298 - RNA, 22 nt, Human
cagagcugagucuucaagguug

SEQ ID NO: 243299 - RNA, 22 nt, Human
agggggugcuacuuccagaguu

SEQ ID NO: 243300 - RNA, 19 nt, Human
cucugccucuggcuguggc

SEQ ID NO: 243301 - RNA, 22 nt, Human
ccuggagcaggagcugcagagg

SEQ ID NO: 243302 - RNA, 22 nt, Human
aaacuugacaguagacagauua

SEQ ID NO: 243303 - RNA, 22 nt, Human
ucagcagagcgagaccaaguca

SEQ ID NO: 243304 - RNA, 22 nt, Human
agcccagcuccuccacagaaua

SEQ ID NO: 243305 - RNA, 22 nt, Human
gagcagggagacaacucuggug

SEQ ID NO: 243306 - RNA, 22 nt, Human
ggaggccaucagggagggcauu

SEQ ID NO: 243307 - RNA, 22 nt, Human
acaccugggucagugugacagu

SEQ ID NO: 243308 - RNA, 22 nt, Human
ucugaggaaaaguucuugucac

SEQ ID NO: 243309 - RNA, 22 nt, Human
cuuauucagaccuuggauucuu

SEQ ID NO: 243310 - RNA, 22 nt, Human
guugugcagucagacugccugg

SEQ ID NO: 243311 - RNA, 22 nt, Human
uggcccugcuggacacgccugc

SEQ ID NO: 243312 - RNA, 21 nt, Human
cauuucuauugaugagaaaag

SEQ ID NO: 243313 - RNA, 22 nt, Human
ugggcaggagagaagcuaaaga

SEQ ID NO: 243314 - RNA, 22 nt, Human
aggaccaccgguccauccaccc

SEQ ID NO: 243315 - RNA, 22 nt, Human
gaggaaaugguuguucaggugg

SEQ ID NO: 243316 - RNA, 20 nt, Human
gagggcaggcacccauuuca

SEQ ID NO: 243317 - RNA, 22 nt, Human
ggcacagcgacuaccaucgaaa

SEQ ID NO: 243318 - RNA, 21 nt, Human
cugcagagcaugcaaaauguu

SEQ ID NO: 243319 - RNA, 22 nt, Human
agaguuugaauuuugaaaagau

SEQ ID NO: 243320 - RNA, 22 nt, Human
cagccugcaggaggccgucagc

SEQ ID NO: 243321 - RNA, 22 nt, Human
ccaggagagcauugcacagagg

SEQ ID NO: 243322 - RNA, 22 nt, Human
gcaaagugcuucagugggagcu

SEQ ID NO: 243323 - RNA, 22 nt, Human
auccauuguggucuuguacauu

SEQ ID NO: 243324 - RNA, 22 nt, Human
cauuagaagguuuuaaaggaau

SEQ ID NO: 243325 - RNA, 20 nt, Human
auggaggaagggcaagagaa

SEQ ID NO: 243326 - RNA, 22 nt, Human
ucagcaaaggaccagcacaggc

SEQ ID NO: 243327 - RNA, 22 nt, Human
gcagcgcuacucacagcucuga

SEQ ID NO: 243328 - RNA, 22 nt, Human
cccuuccuggaguacccucugu

SEQ ID NO: 243329 - RNA, 18 nt, Human
gugugcucagagagugag

SEQ ID NO: 243330 - RNA, 22 nt, Human
uucauugaaauguuucuagcug

SEQ ID NO: 243331 - RNA, 22 nt, Human
cucuggucauuuggaagagcau

SEQ ID NO: 243332 - RNA, 22 nt, Human
ccaggcugugguuuagauagag

SEQ ID NO: 243333 - RNA, 22 nt, Human
aucaguuuuuauuaauguagcu

SEQ ID NO: 243334 - RNA, 22 nt, Human
aguccagggcucucugugggau

SEQ ID NO: 243335 - RNA, 22 nt, Human
gaauuuaagaggaugaaucugu

SEQ ID NO: 243336 - RNA, 22 nt, Human
gaagcaagugcaaggaagaggc

SEQ ID NO: 243337 - RNA, 22 nt, Human
aaaaaauuaucauaguuccuga

SEQ ID NO: 243338 - RNA, 22 nt, Human
cuggguggaaagugcugagaau

SEQ ID NO: 243339 - RNA, 22 nt, Human
ggcccugagucuagcugcucuu

SEQ ID NO: 243340 - RNA, 22 nt, Human
cagagcauaauugacaugaggu

SEQ ID NO: 243341 - RNA, 22 nt, Human
gacuacaacucccagaagacuu

SEQ ID NO: 243342 - RNA, 22 nt, Human
aaacucaaagucagaucagaga

SEQ ID NO: 243343 - RNA, 19 nt, Human
aggguggcaaaggagggug

SEQ ID NO: 243344 - RNA, 22 nt, Human
uuccaauggaaucaugucuuga

SEQ ID NO: 243345 - RNA, 22 nt, Human
agcaagaugcaaacauccgucc

SEQ ID NO: 243346 - RNA, 22 nt, Human
acaaauauuuacugaauccacu

SEQ ID NO: 243347 - RNA, 20 nt, Human
gggugugggcccggccaggc

SEQ ID NO: 243348 - RNA, 22 nt, Human
gccugggagcacaucggggucc

SEQ ID NO: 243349 - RNA, 22 nt, Human
gacagcaggaugugaggggaug

SEQ ID NO: 243350 - RNA, 19 nt, Human
cuucagcaucuccggagcu

SEQ ID NO: 243351 - RNA, 22 nt, Human
ccugccucccagagguccucua

SEQ ID NO: 243352 - RNA, 22 nt, Human
aggcaaggugcuacagacagug

SEQ ID NO: 243353 - RNA, 22 nt, Human
agugacuaaagguuuuaauggc

SEQ ID NO: 243354 - RNA, 22 nt, Human
caaaaguaauugcgguuuuugc

SEQ ID NO: 243355 - RNA, 22 nt, Human
ucccaggcgccugguggggagc

SEQ ID NO: 243356 - RNA, 22 nt, Human
uacacgugcaaauucaauguau

SEQ ID NO: 243357 - RNA, 22 nt, Human
agcucaagugcaagcauucuau

SEQ ID NO: 243358 - RNA, 20 nt, Human
ggcugcccacuccagaguac

SEQ ID NO: 243359 - RNA, 22 nt, Human
uagggugguuagaaggaguaug

SEQ ID NO: 243360 - RNA, 22 nt, Human
uaggcugacuuguuucauaaag

SEQ ID NO: 243361 - RNA, 22 nt, Human
uuucauuggcucccugaugaau

SEQ ID NO: 243362 - RNA, 22 nt, Human
cagcugaagcucuugucaaagg

SEQ ID NO: 243363 - RNA, 22 nt, Human
augaacaauaaucaugucuaug

SEQ ID NO: 243364 - RNA, 20 nt, Human
auugaaauuuuucugagauu

SEQ ID NO: 243365 - RNA, 22 nt, Human
gaaggcuucccaccugauauuu

SEQ ID NO: 243366 - RNA, 22 nt, Human
auguccucaaaacugauugcag

SEQ ID NO: 243367 - RNA, 22 nt, Human
ucacaugagucacuaucuuaau

SEQ ID NO: 243368 - RNA, 22 nt, Human
uccagagagccacggacagggg

SEQ ID NO: 243369 - RNA, 22 nt, Human
gcaguguuguuaaaagauuaga

SEQ ID NO: 243370 - RNA, 22 nt, Human
gaaggcuuuucuaccagaucuu

SEQ ID NO: 243371 - RNA, 22 nt, Human
uccaggcaaaaaccaacuacag

SEQ ID NO: 243372 - RNA, 22 nt, Human
gguccagcacaacacuggcaug

SEQ ID NO: 243373 - RNA, 22 nt, Human
auucugagacaauugccgucag

SEQ ID NO: 243374 - RNA, 22 nt, Human
auuaggaaauguguugcaagca

SEQ ID NO: 243375 - RNA, 21 nt, Human
uguggcugccucuggcccugg

SEQ ID NO: 243376 - RNA, 22 nt, Human
gcacauaugcuguaagcacaug

SEQ ID NO: 243377 - RNA, 21 nt, Human
gccugggaaaucugggaagcc

SEQ ID NO: 243378 - RNA, 22 nt, Human
cccacagguggaagccucggaa

SEQ ID NO: 243379 - RNA, 22 nt, Human
augauucuggggcaaaagcugg

SEQ ID NO: 243380 - RNA, 22 nt, Human
auggucuugauuuuccauaggu

SEQ ID NO: 243381 - RNA, 22 nt, Human
agaaagcacccugcacuuucug

SEQ ID NO: 243382 - RNA, 22 nt, Human
gcauuauuaauagcugcaugag

SEQ ID NO: 243383 - RNA, 23 nt, Human
uggccagguagaggagguaguga

SEQ ID NO: 243384 - RNA, 22 nt, Human
aaaugucagaggaacauauuga

SEQ ID NO: 243385 - RNA, 22 nt, Human
uuguauuaaaauguguuucugu

SEQ ID NO: 243386 - RNA, 22 nt, Human
cggagcugccugccaagccugc

SEQ ID NO: 243387 - RNA, 22 nt, Human
agugucugagcuaucauuaggg

SEQ ID NO: 243388 - RNA, 22 nt, Human
cagugagggcccccuuccaggu

SEQ ID NO: 243389 - RNA, 22 nt, Human
cgcugggggaacagcgagggug

SEQ ID NO: 243390 - RNA, 22 nt, Human
agcugcagguucagcauuccac

SEQ ID NO: 243391 - RNA, 22 nt, Human
cuugccaguguugcagaagcuc

SEQ ID NO: 243392 - RNA, 22 nt, Human
gccuggagcucuccacuugggg

SEQ ID NO: 243393 - RNA, 22 nt, Human
gcucccagguucuugggccuug

SEQ ID NO: 243394 - RNA, 22 nt, Human
uaguaaacccaugaggcuuaaa

SEQ ID NO: 243395 - RNA, 22 nt, Human
gugagcaggauaggggcucccu

SEQ ID NO: 243396 - RNA, 22 nt, Human
ucugagauuuguauggugagac

SEQ ID NO: 243397 - RNA, 22 nt, Human
ccuguggcugccacuuggguga

SEQ ID NO: 243398 - RNA, 22 nt, Human
agcaggcuaaucuugcugaaca

SEQ ID NO: 243399 - RNA, 22 nt, Human
ucaaaguuuguggcaauuuauu

SEQ ID NO: 243400 - RNA, 22 nt, Human
uguaaagagaaugguauaugga

SEQ ID NO: 243401 - RNA, 22 nt, Human
auggcucugcugggcaaagcaa

SEQ ID NO: 243402 - RNA, 22 nt, Human
ucuucagagugaaagucuguga

SEQ ID NO: 243403 - RNA, 21 nt, Human
aggaaaggccagcacguaggg

SEQ ID NO: 243404 - RNA, 22 nt, Human
ggcagcuggguuggccagaaac

SEQ ID NO: 243405 - RNA, 22 nt, Human
ucaaacagcaggucuuucauag

SEQ ID NO: 243406 - RNA, 22 nt, Human
gguggcugggauuaguagccca

SEQ ID NO: 243407 - RNA, 22 nt, Human
guauacagauacuuagacgugc

SEQ ID NO: 243408 - RNA, 22 nt, Human
uucucagggucuggauggccug

SEQ ID NO: 243409 - RNA, 22 nt, Human
cugugugucauuugucaauccu

SEQ ID NO: 243410 - RNA, 22 nt, Human
accucccagaaaguuuugcagg

SEQ ID NO: 243411 - RNA, 22 nt, Human
aggaggcagucugucccuuagc

SEQ ID NO: 243412 - RNA, 22 nt, Human
uagaaagagcuuugcuuccuuu

SEQ ID NO: 243413 - RNA, 22 nt, Human
ugaauuagcaguagacagacug

SEQ ID NO: 243414 - RNA, 22 nt, Human
aaugucugaaaaucagacugca

SEQ ID NO: 243415 - RNA, 18 nt, Human
uccuggcagucagagagg

SEQ ID NO: 243416 - RNA, 22 nt, Human
agcaguuuggaaaauacuagaa

SEQ ID NO: 243417 - RNA, 22 nt, Human
uggagcugguaaacagugacau

SEQ ID NO: 243418 - RNA, 22 nt, Human
uucugucacagugcugguauca

SEQ ID NO: 243419 - RNA, 22 nt, Human
cuauaaaucuacccagcauugg

SEQ ID NO: 243420 - RNA, 22 nt, Human
cuccagggaaaggggcguccgc

SEQ ID NO: 243421 - RNA, 22 nt, Human
uuuaguguagcauucagaguca

SEQ ID NO: 243422 - RNA, 22 nt, Human
gcagguguggagaguggucggg

SEQ ID NO: 243423 - RNA, 22 nt, Human
ccaggcugggcuacaaguugag

SEQ ID NO: 243424 - RNA, 22 nt, Human
aucugaaauagucuuaucugag

SEQ ID NO: 243425 - RNA, 22 nt, Human
uuuguuuacucauucauugaug

SEQ ID NO: 243426 - RNA, 22 nt, Human
ccuuagaggcaggaagaauugc

SEQ ID NO: 243427 - RNA, 23 nt, Human
uuuaccagaauagcaggggagag

SEQ ID NO: 243428 - RNA, 21 nt, Human
acaugucuggucauuuuuagc

SEQ ID NO: 243429 - RNA, 22 nt, Human
gugcaaaaguaaaugugguuuu

SEQ ID NO: 243430 - RNA, 22 nt, Human
agacagcuccaagugucucugu

SEQ ID NO: 243431 - RNA, 22 nt, Human
caaagauaaucacagaauaccc

SEQ ID NO: 243432 - RNA, 22 nt, Human
gagcucagcccaaagagcagug

SEQ ID NO: 243433 - RNA, 22 nt, Human
acauuucagauguaaugugaug

SEQ ID NO: 243434 - RNA, 22 nt, Human
acacauuuucaacacugucaag

SEQ ID NO: 243435 - RNA, 22 nt, Human
cccagcuugcgggcggcaggag

SEQ ID NO: 243436 - RNA, 22 nt, Human
agccuccuguagcccucaccca

SEQ ID NO: 243437 - RNA, 22 nt, Human
aagcccuggcucagcucaccag

SEQ ID NO: 243438 - RNA, 22 nt, Human
caagauuugacuucgugguuug

SEQ ID NO: 243439 - RNA, 20 nt, Human
uagaaucuguucugauucau

SEQ ID NO: 243440 - RNA, 22 nt, Human
acaguggcuuuugugucugcag

SEQ ID NO: 243441 - RNA, 22 nt, Human
auuuccuauagauauggugagu

SEQ ID NO: 243442 - RNA, 22 nt, Human
uuagagccaguuacaaggucaa

SEQ ID NO: 243443 - RNA, 22 nt, Human
aauccaauccuacucagaaagu

SEQ ID NO: 243444 - RNA, 22 nt, Human
cagaugaaggccugaaugucua

SEQ ID NO: 243445 - RNA, 18 nt, Human
agacagcugaaaggaaaa

SEQ ID NO: 243446 - RNA, 21 nt, Human
cucuugucuuugcucaguagc

SEQ ID NO: 243447 - RNA, 22 nt, Human
gcugcagagugaugaagugggg

SEQ ID NO: 243448 - RNA, 22 nt, Human
ucucuaaauacagaugucaugg

SEQ ID NO: 243449 - RNA, 22 nt, Human
uggaauggaaacaaacugagga

SEQ ID NO: 243450 - RNA, 22 nt, Human
ucacugugaauguuaucaucuu

SEQ ID NO: 243451 - RNA, 22 nt, Human
cucuggagggaggcugagcugg

SEQ ID NO: 243452 - RNA, 22 nt, Human
cuggggacuuugguucuccaug

SEQ ID NO: 243453 - RNA, 21 nt, Human
ugggauagaaauauggcugcu

SEQ ID NO: 243454 - RNA, 22 nt, Human
ucuggccccggucuucacagcu

SEQ ID NO: 243455 - RNA, 22 nt, Human
cagguggugccuccaggcuggu

SEQ ID NO: 243456 - RNA, 22 nt, Human
aaaugacacuaggcuuuuugca

SEQ ID NO: 243457 - RNA, 22 nt, Human
uuaaguacaggguuagugacgg

SEQ ID NO: 243458 - RNA, 22 nt, Human
uuccaugaaauguguuaugcuu

SEQ ID NO: 243459 - RNA, 22 nt, Human
ggcuuucuagaucuagcucugu

SEQ ID NO: 243460 - RNA, 22 nt, Human
aacaagaauaagugguuucugg

SEQ ID NO: 243461 - RNA, 22 nt, Human
uaaggcuuuuaaagguucacca

SEQ ID NO: 243462 - RNA, 22 nt, Human
aggucucugaguacugcuggac

SEQ ID NO: 243463 - RNA, 22 nt, Human
ucccaguggugggugcacauuu

SEQ ID NO: 243464 - RNA, 22 nt, Human
acucaggcuagggaaaaagugg

SEQ ID NO: 243465 - RNA, 21 nt, Human
acagcuggugcagggcgggga

SEQ ID NO: 243466 - RNA, 22 nt, Human
ggcacugggugagggucacugg

SEQ ID NO: 243467 - RNA, 23 nt, Human
agcagcaaaaauuuaucuuucug

SEQ ID NO: 243468 - RNA, 22 nt, Human
aggaguccucaugucugugcga

SEQ ID NO: 243469 - RNA, 22 nt, Human
cuuccugcaacaccuguguugc

SEQ ID NO: 243470 - RNA, 22 nt, Human
guacaaauguacacuuguauaa

SEQ ID NO: 243471 - RNA, 21 nt, Human
aacaggucccccacgggcuuu

SEQ ID NO: 243472 - RNA, 22 nt, Human
cuaguguuuggaagucauagcc

SEQ ID NO: 243473 - RNA, 21 nt, Human
cccaggaguccuauuuaaaug

SEQ ID NO: 243474 - RNA, 22 nt, Human
acugggcuucacuuggcacauc

SEQ ID NO: 243475 - RNA, 22 nt, Human
augucugcuuuccuuuuaauca

SEQ ID NO: 243476 - RNA, 22 nt, Human
acuuguuugaaucucucuagag

SEQ ID NO: 243477 - RNA, 22 nt, Human
cuggcaugguguauuuguucaa

SEQ ID NO: 243478 - RNA, 22 nt, Human
cuuuucugucagugcccaaauu

SEQ ID NO: 243479 - RNA, 22 nt, Human
acaugcauaagccuagccauca

SEQ ID NO: 243480 - RNA, 22 nt, Human
ugagccagcuccuugccuguca

SEQ ID NO: 243481 - RNA, 22 nt, Human
aagaggagggcagauucaaggc

SEQ ID NO: 243482 - RNA, 16 nt, Human
ccucugggccugcaag

SEQ ID NO: 243483 - RNA, 22 nt, Human
auucuucacauggauaggaucu

SEQ ID NO: 243484 - RNA, 22 nt, Human
gggcagcucucacagcagccaa

SEQ ID NO: 243485 - RNA, 21 nt, Human
auggcuucucaggugcacuga

SEQ ID NO: 243486 - RNA, 17 nt, Human
ucagggaaugagguugu

SEQ ID NO: 243487 - RNA, 18 nt, Human
gcugggguugagcucucc

SEQ ID NO: 243488 - RNA, 22 nt, Human
aagcacagauaaaacaggauuc

SEQ ID NO: 243489 - RNA, 22 nt, Human
ccacagaaucgcuaguggagca

SEQ ID NO: 243490 - RNA, 22 nt, Human
caucugcuguuccuuggacuca

SEQ ID NO: 243491 - RNA, 21 nt, Human
gggugcuguggucaugcagga

SEQ ID NO: 243492 - RNA, 22 nt, Human
auguuucagauacagaucaaau

SEQ ID NO: 243493 - RNA, 22 nt, Human
guuaauuugcagcuuucgagcu

SEQ ID NO: 243494 - RNA, 22 nt, Human
uuagcauuucaguacacauguu

SEQ ID NO: 243495 - RNA, 22 nt, Human
uagucagacccaagagagccau

SEQ ID NO: 243496 - RNA, 22 nt, Human
gcugcucuccauggccgugagu

SEQ ID NO: 243497 - RNA, 22 nt, Human
acuuaaaaagaaucuuuucacg

SEQ ID NO: 243498 - RNA, 22 nt, Human
aaccaccaccguaauuuaccca

SEQ ID NO: 243499 - RNA, 22 nt, Human
uggcugagccacuuguucagau

SEQ ID NO: 243500 - RNA, 19 nt, Human
guacaacaaugcugagcau

SEQ ID NO: 243501 - RNA, 22 nt, Human
gccagaggaacgcugcgcgccc

SEQ ID NO: 243502 - RNA, 22 nt, Human
gccacauccagguggaucaaau

SEQ ID NO: 243503 - RNA, 22 nt, Human
aggagauggagcucagugggca

SEQ ID NO: 243504 - RNA, 22 nt, Human
aggaccuguguuuuccuugaau

SEQ ID NO: 243505 - RNA, 22 nt, Human
auggagggaaaaguggagagcc

SEQ ID NO: 243506 - RNA, 22 nt, Human
acugagcacucacuuuuguuau

SEQ ID NO: 243507 - RNA, 22 nt, Human
aaaggccauuacuugcuuuuag

SEQ ID NO: 243508 - RNA, 22 nt, Human
auugucugaauccaaagcucug

SEQ ID NO: 243509 - RNA, 22 nt, Human
gcuggagugcuggagugcagug

SEQ ID NO: 243510 - RNA, 22 nt, Human
ugcagaaacagucauuaaugua

SEQ ID NO: 243511 - RNA, 22 nt, Human
gcacacaggcaguuuccagcca

SEQ ID NO: 243512 - RNA, 22 nt, Human
gagcugggcuggcuuccucccu

SEQ ID NO: 243513 - RNA, 22 nt, Human
uucugcauuucuaauaaguucc

SEQ ID NO: 243514 - RNA, 22 nt, Human
uguacauagaucuugaaaauua

SEQ ID NO: 243515 - RNA, 22 nt, Human
agguggggcccaccaauuugca

SEQ ID NO: 243516 - RNA, 22 nt, Human
uuucuaaggaaaguaccuggga

SEQ ID NO: 243517 - RNA, 22 nt, Human
caggcacaguguugcuguucaa

SEQ ID NO: 243518 - RNA, 22 nt, Human
aggucugguauuuuucuauacu

SEQ ID NO: 243519 - RNA, 22 nt, Human
ugcugccaggucuugcugucca

SEQ ID NO: 243520 - RNA, 22 nt, Human
cagggccugcaagagaccuggg

SEQ ID NO: 243521 - RNA, 22 nt, Human
aaauagcagcuuugacagcaca

SEQ ID NO: 243522 - RNA, 22 nt, Human
agcaguccuucuuuagagagcc

SEQ ID NO: 243523 - RNA, 22 nt, Human
aggcagcucuguggccucccag

SEQ ID NO: 243524 - RNA, 22 nt, Human
aggcugagacugugcauuagug

SEQ ID NO: 243525 - RNA, 22 nt, Human
uccugcagccacugcaggcaga

SEQ ID NO: 243526 - RNA, 22 nt, Human
gguccaggaucaaggcaucacc

SEQ ID NO: 243527 - RNA, 22 nt, Human
aagggcagcuauuaucgucauc

SEQ ID NO: 243528 - RNA, 21 nt, Human
uuauugagacauuuguggaaa

SEQ ID NO: 243529 - RNA, 22 nt, Human
ucaggcuguggcuucaguucuu

SEQ ID NO: 243530 - RNA, 22 nt, Human
aaguuuuauuggaacauagcca

SEQ ID NO: 243531 - RNA, 22 nt, Human
auguuguuuuuucauaaaguau

SEQ ID NO: 243532 - RNA, 22 nt, Human
uucagagaacuucauggaagag

SEQ ID NO: 243533 - RNA, 22 nt, Human
cacagcuagauggauagauaga

SEQ ID NO: 243534 - RNA, 22 nt, Human
acuuucugcaguguuggaaaug

SEQ ID NO: 243535 - RNA, 19 nt, Human
ggacacagaaagcugcauu

SEQ ID NO: 243536 - RNA, 20 nt, Human
ccuucuccagcuuguucuug

SEQ ID NO: 243537 - RNA, 22 nt, Human
ugguccugaggcuuguuuccac

SEQ ID NO: 243538 - RNA, 22 nt, Human
cagcauggcuugaguguuuccu

SEQ ID NO: 243539 - RNA, 22 nt, Human
aggccuugggccauagucuccu

SEQ ID NO: 243540 - RNA, 22 nt, Human
cagagagaggccacugcuauua

SEQ ID NO: 243541 - RNA, 22 nt, Human
aagggcugcaauccaaaacacu

SEQ ID NO: 243542 - RNA, 22 nt, Human
caguccuggggaccaggcugag

SEQ ID NO: 243543 - RNA, 22 nt, Human
cauaaauuguacccauuccaac

SEQ ID NO: 243544 - RNA, 22 nt, Human
cuacaugaacucuuaagucaca

SEQ ID NO: 243545 - RNA, 22 nt, Human
gagacacaggcacagaagaggc

SEQ ID NO: 243546 - RNA, 19 nt, Human
uuggaaggagccagagugg

SEQ ID NO: 243547 - RNA, 22 nt, Human
cgcaacucagcaacuuaacugc

SEQ ID NO: 243548 - RNA, 22 nt, Human
ccagguggauaagguuucugga

SEQ ID NO: 243549 - RNA, 22 nt, Human
gaaacuuucaugaauauaagau

SEQ ID NO: 243550 - RNA, 22 nt, Human
cagcaagacaggauucccgugg

SEQ ID NO: 243551 - RNA, 22 nt, Human
uucuuugcccuuaaugaaauaa

SEQ ID NO: 243552 - RNA, 22 nt, Human
gagggaugcagaaacagaggcc

SEQ ID NO: 243553 - RNA, 18 nt, Human
gccaguggguccaggugc

SEQ ID NO: 243554 - RNA, 22 nt, Human
uagagcagaacuuguuaacacc

SEQ ID NO: 243555 - RNA, 22 nt, Human
cagagcagggugcaccuugggc

SEQ ID NO: 243556 - RNA, 22 nt, Human
auucuagaaggcaaagcaaggg

SEQ ID NO: 243557 - RNA, 22 nt, Human
gcuguagggcugagcuggaccg

SEQ ID NO: 243558 - RNA, 22 nt, Human
aucuggcuuaccuagggugccu

SEQ ID NO: 243559 - RNA, 22 nt, Human
uucuaacucuguuauguguuuc

SEQ ID NO: 243560 - RNA, 22 nt, Human
cagcccuggcccaggugccuua

SEQ ID NO: 243561 - RNA, 22 nt, Human
agggagcucugggggcacacgg

SEQ ID NO: 243562 - RNA, 22 nt, Human
ugaaacugaaagguauuuauag

SEQ ID NO: 243563 - RNA, 22 nt, Human
gcagaggaucaggcucuggaaa

SEQ ID NO: 243564 - RNA, 21 nt, Human
ucuugaaaaguuagauucucu

SEQ ID NO: 243565 - RNA, 22 nt, Human
cagcuguugugauuuccaggag

SEQ ID NO: 243566 - RNA, 22 nt, Human
caaaaguaauuaugguuuuugc

SEQ ID NO: 243567 - RNA, 22 nt, Human
uaaguguuguuuucaagagaua

SEQ ID NO: 243568 - RNA, 22 nt, Human
agcagggggcauccuugcccuu

SEQ ID NO: 243569 - RNA, 22 nt, Human
acagccuggccugaguuaaggc

SEQ ID NO: 243570 - RNA, 22 nt, Human
gcagugcuugcucaggcuucau

SEQ ID NO: 243571 - RNA, 22 nt, Human
ccagcucugcuugcccagucag

SEQ ID NO: 243572 - RNA, 22 nt, Human
agggcccuccccgcucagggca

SEQ ID NO: 243573 - RNA, 22 nt, Human
ccucugggugacagacucuugg

SEQ ID NO: 243574 - RNA, 22 nt, Human
acaauuucuuauaguucaauuc

SEQ ID NO: 243575 - RNA, 17 nt, Human
ggcaggugcggggccgc

SEQ ID NO: 243576 - RNA, 22 nt, Human
acagaauauuuggcaugcgucu

SEQ ID NO: 243577 - RNA, 21 nt, Human
cugccaggauagcaugcaggc

SEQ ID NO: 243578 - RNA, 22 nt, Human
ugcuuuauaaccauuucugugg

SEQ ID NO: 243579 - RNA, 22 nt, Human
aacaguuugccugaaauguauu

SEQ ID NO: 243580 - RNA, 22 nt, Human
ggcaggaagcauuaaaacgauu

SEQ ID NO: 243581 - RNA, 22 nt, Human
aaagcagcagaaucucucaggg

SEQ ID NO: 243582 - RNA, 22 nt, Human
ugcauauuauguguaucugucu

SEQ ID NO: 243583 - RNA, 22 nt, Human
agaacagaagggaggaaggccu

SEQ ID NO: 243584 - RNA, 22 nt, Human
gcuggagggguaauaggauggg

SEQ ID NO: 243585 - RNA, 22 nt, Human
acaaguuagguuuuaauccaaa

SEQ ID NO: 243586 - RNA, 22 nt, Human
cccagaggguggagguugcagu

SEQ ID NO: 243587 - RNA, 22 nt, Human
auaugcuugggacugauacagu

SEQ ID NO: 243588 - RNA, 22 nt, Human
aggguagggcccggagacagac

SEQ ID NO: 243589 - RNA, 22 nt, Human
uggaccucacugucugcuggua

SEQ ID NO: 243590 - RNA, 18 nt, Human
ggaaggaagaaugcauuu

SEQ ID NO: 243591 - RNA, 22 nt, Human
ucuaaauuacuuugggcaguau

SEQ ID NO: 243592 - RNA, 22 nt, Human
acccugggaacuggaaacugga

SEQ ID NO: 243593 - RNA, 22 nt, Human
acacaucucaggggacacucuc

SEQ ID NO: 243594 - RNA, 22 nt, Human
acucugggcccacccucagagu

SEQ ID NO: 243595 - RNA, 22 nt, Human
ggagagggggcucccugcuugg

SEQ ID NO: 243596 - RNA, 22 nt, Human
cucaggcuugggaggaggccca

SEQ ID NO: 243597 - RNA, 22 nt, Human
ucuuugaugugguuaauuauga

SEQ ID NO: 243598 - RNA, 22 nt, Human
uaaaugagggcugacaugauug

SEQ ID NO: 243599 - RNA, 22 nt, Human
gacagauggucaguguugaagu

SEQ ID NO: 243600 - RNA, 19 nt, Human
ugaauuagaauuauccucu

SEQ ID NO: 243601 - RNA, 22 nt, Human
cagggcugguuugucgaagaaa

SEQ ID NO: 243602 - RNA, 22 nt, Human
agcuggaagcugaugagcacag

SEQ ID NO: 243603 - RNA, 22 nt, Human
cagcaagaaaauucacaugcuc

SEQ ID NO: 243604 - RNA, 22 nt, Human
gaccacagcuacaagggcaagg

SEQ ID NO: 243605 - RNA, 22 nt, Human
ggcugagacuagagugaggcau

SEQ ID NO: 243606 - RNA, 22 nt, Human
agccaggcagggcucucgcucu

SEQ ID NO: 243607 - RNA, 22 nt, Human
ucuugauuacaaauaacaucau

SEQ ID NO: 243608 - RNA, 22 nt, Human
ucuagaauguuccaccuuguuu

SEQ ID NO: 243609 - RNA, 22 nt, Human
auagggcccccgugggugcuca

SEQ ID NO: 243610 - RNA, 22 nt, Human
cccugcagggaggauucugaag

SEQ ID NO: 243611 - RNA, 23 nt, Human
acugcugucuuugaagugcuuga

SEQ ID NO: 243612 - RNA, 22 nt, Human
aagcccuuuucaagauacaaca

SEQ ID NO: 243613 - RNA, 22 nt, Human
uguauuuaagcuuuaccuaaaa

SEQ ID NO: 243614 - RNA, 22 nt, Human
acugcccucccaucuauugcaa

SEQ ID NO: 243615 - RNA, 22 nt, Human
cacugguagcaguuaaguuagg

SEQ ID NO: 243616 - RNA, 22 nt, Human
caggcacacaggcucccugggc

SEQ ID NO: 243617 - RNA, 22 nt, Human
uccacagggccuuucuggugug

SEQ ID NO: 243618 - RNA, 22 nt, Human
ggguaggcucugcaggcugggu

SEQ ID NO: 243619 - RNA, 22 nt, Human
ucugggcugugggaauucaaca

SEQ ID NO: 243620 - RNA, 19 nt, Human
cucaccuggaggugcugau

SEQ ID NO: 243621 - RNA, 22 nt, Human
caaugcaugauggaauugccuu

SEQ ID NO: 243622 - RNA, 22 nt, Human
ugcuggcuggagugccucugga

SEQ ID NO: 243623 - RNA, 22 nt, Human
ugucuauuaauuccacauaaaa

SEQ ID NO: 243624 - RNA, 22 nt, Human
aauaacuucauguaacauuuaa

SEQ ID NO: 243625 - RNA, 20 nt, Human
ucacauccucucccaacaug

SEQ ID NO: 243626 - RNA, 22 nt, Human
accaaccagggacuuggcuccc

SEQ ID NO: 243627 - RNA, 22 nt, Human
caauuauauuuagaaugauaca

SEQ ID NO: 243628 - RNA, 19 nt, Human
gcauaaaaugucaaugugu

SEQ ID NO: 243629 - RNA, 22 nt, Human
agcaagcauugcugguuagguc

SEQ ID NO: 243630 - RNA, 21 nt, Human
acagcauguuuguguguuugc

SEQ ID NO: 243631 - RNA, 22 nt, Human
caauuucaucuugugcuucaau

SEQ ID NO: 243632 - RNA, 22 nt, Human
ucugagaaaauaggaaacuuga

SEQ ID NO: 243633 - RNA, 22 nt, Human
ucaggcucaaagggccggauga

SEQ ID NO: 243634 - RNA, 22 nt, Human
caaggccacugcucagguuucc

SEQ ID NO: 243635 - RNA, 22 nt, Human
uuacaguuaaugugacuaacca

SEQ ID NO: 243636 - RNA, 19 nt, Human
uucuuacaacacccuggga

SEQ ID NO: 243637 - RNA, 22 nt, Human
accagccuccuagcugcuccug

SEQ ID NO: 243638 - RNA, 22 nt, Human
ucagugcaaucaagguauguuu

SEQ ID NO: 243639 - RNA, 22 nt, Human
auaaucaaaguccuaugacauc

SEQ ID NO: 243640 - RNA, 22 nt, Human
cuuggacuggacccgaggaaug

SEQ ID NO: 243641 - RNA, 22 nt, Human
uagagugguuaacaguuuagaa

SEQ ID NO: 243642 - RNA, 22 nt, Human
gcagggcuaggucuucuagggc

SEQ ID NO: 243643 - RNA, 22 nt, Human
uucugacagcaaaacucagccu

SEQ ID NO: 243644 - RNA, 22 nt, Human
agcuuuauauguuguuucucca

SEQ ID NO: 243645 - RNA, 22 nt, Human
uugcugauuuguuucuauucca

SEQ ID NO: 243646 - RNA, 22 nt, Human
caucuguagcuccaugacaauu

SEQ ID NO: 243647 - RNA, 22 nt, Human
ucauguuaucuuggcucuggga

SEQ ID NO: 243648 - RNA, 22 nt, Human
cuccauggaaccggggcugcuu

SEQ ID NO: 243649 - RNA, 22 nt, Human
agugcucauaaaaaugugaaac

SEQ ID NO: 243650 - RNA, 22 nt, Human
auauauaucgaguucaugucuc

SEQ ID NO: 243651 - RNA, 19 nt, Human
accugcaguaauaauuccu

SEQ ID NO: 243652 - RNA, 22 nt, Human
gcacaggucaggagaugagauu

SEQ ID NO: 243653 - RNA, 22 nt, Human
aaaggccuugagcugggugcca

SEQ ID NO: 243654 - RNA, 22 nt, Human
cagggcuguaaauuagugcuga

SEQ ID NO: 243655 - RNA, 22 nt, Human
ugccucagucuaaagucucuca

SEQ ID NO: 243656 - RNA, 22 nt, Human
cuucagagaguccagggacugc

SEQ ID NO: 243657 - RNA, 22 nt, Human
cugaggaaugagugaggagcca

SEQ ID NO: 243658 - RNA, 22 nt, Human
cacauuccuggugcucagcagc

SEQ ID NO: 243659 - RNA, 22 nt, Human
accuguuuagaaagcuuaugag

SEQ ID NO: 243660 - RNA, 22 nt, Human
uaacugaauguauuacaacaga

SEQ ID NO: 243661 - RNA, 22 nt, Human
cuuguauagggaaagauaaauc

SEQ ID NO: 243662 - RNA, 22 nt, Human
ggcugcugggucaugaugcaga

SEQ ID NO: 243663 - RNA, 22 nt, Human
cagugcaguuucccagaugcug

SEQ ID NO: 243664 - RNA, 22 nt, Human
aggguagcuacccaacuccaga

SEQ ID NO: 243665 - RNA, 22 nt, Human
cugugccuaagaugcaugucuc

SEQ ID NO: 243666 - RNA, 22 nt, Human
acagguggggaggcugagguuc

SEQ ID NO: 243667 - RNA, 22 nt, Human
guccugugagauucaugcucaa

SEQ ID NO: 243668 - RNA, 22 nt, Human
agcagggcagcuuuuuucagaa

SEQ ID NO: 243669 - RNA, 22 nt, Human
auccaauucuaauauuguguuu

SEQ ID NO: 243670 - RNA, 22 nt, Human
uguuuacaaggaguuuauauug

SEQ ID NO: 243671 - RNA, 22 nt, Human
cagaagaguagcugaacaaguu

SEQ ID NO: 243672 - RNA, 22 nt, Human
acauguaaaaauuaagguaaga

SEQ ID NO: 243673 - RNA, 22 nt, Human
ggcagccuucucucauagguga

SEQ ID NO: 243674 - RNA, 22 nt, Human
ucagggcugcauacaggagaua

SEQ ID NO: 243675 - RNA, 22 nt, Human
uaaggacauugguuuugaguaa

SEQ ID NO: 243676 - RNA, 23 nt, Human
uccaggagaauuccagggcccgg

SEQ ID NO: 243677 - RNA, 22 nt, Human
cuugauuucagccuugugauau

SEQ ID NO: 243678 - RNA, 22 nt, Human
uggcccagcugcagauggugga

SEQ ID NO: 243679 - RNA, 22 nt, Human
ggcuuucuccuugccuuagucu

SEQ ID NO: 243680 - RNA, 22 nt, Human
cucaggcacuuuugucacagac

SEQ ID NO: 243681 - RNA, 22 nt, Human
ugucuuuaauucuacauaucuc

SEQ ID NO: 243682 - RNA, 22 nt, Human
caauuuuacucuuccucuucca

SEQ ID NO: 243683 - RNA, 22 nt, Human
gagcuggcaaugacuuguguau

SEQ ID NO: 243684 - RNA, 22 nt, Human
ccagagcagauguggccuuggu

SEQ ID NO: 243685 - RNA, 22 nt, Human
caaaagauacuugcaucuaacu

SEQ ID NO: 243686 - RNA, 20 nt, Human
uguauauuuucugguguaaa

SEQ ID NO: 243687 - RNA, 22 nt, Human
gcaguggcagagacagcaccaa

SEQ ID NO: 243688 - RNA, 22 nt, Human
cugcaucugcauaaucaacuuc

SEQ ID NO: 243689 - RNA, 22 nt, Human
gcaaauauuucuaauuccugaa

SEQ ID NO: 243690 - RNA, 22 nt, Human
ggccugugcaagacagcacccc

SEQ ID NO: 243691 - RNA, 22 nt, Human
uccucaguuauaaauaggaaac

SEQ ID NO: 243692 - RNA, 22 nt, Human
ugcaggcccaguguagaggcuc

SEQ ID NO: 243693 - RNA, 22 nt, Human
ccagagaggccuuggcaagaca

SEQ ID NO: 243694 - RNA, 22 nt, Human
ccagcuuggaauaugccauugu

SEQ ID NO: 243695 - RNA, 22 nt, Human
aagccagauagaagaacucauu

SEQ ID NO: 243696 - RNA, 22 nt, Human
ugagggagcacacacugaagug

SEQ ID NO: 243697 - RNA, 22 nt, Human
auggcagggcccuuggcuccca

SEQ ID NO: 243698 - RNA, 23 nt, Human
uguguauguaucuaugcauaggu

SEQ ID NO: 243699 - RNA, 22 nt, Human
guugaaaaugacuuuauaccau

SEQ ID NO: 243700 - RNA, 22 nt, Human
ucauguuaucagacacagagua

SEQ ID NO: 243701 - RNA, 22 nt, Human
ucagcacuuuuuaaagcagcau

SEQ ID NO: 243702 - RNA, 22 nt, Human
auugcagcuggucaggguaauu

SEQ ID NO: 243703 - RNA, 22 nt, Human
ggaaugaauuuccagcuggguc

SEQ ID NO: 243704 - RNA, 22 nt, Human
ggguccaggcacuaugcuaagu

SEQ ID NO: 243705 - RNA, 22 nt, Human
ugccugccaaugaugcuugugu

SEQ ID NO: 243706 - RNA, 19 nt, Human
cugucccucccagguauga

SEQ ID NO: 243707 - RNA, 22 nt, Human
agauugaagacugguggagcug

SEQ ID NO: 243708 - RNA, 22 nt, Human
cgagagauggguuggcaggggc

SEQ ID NO: 243709 - RNA, 22 nt, Human
cacuguaauagcauuauaagug

SEQ ID NO: 243710 - RNA, 22 nt, Human
acaggccuagcuaaugcuuucc

SEQ ID NO: 243711 - RNA, 23 nt, Human
aaugauuucaugaugauagcagc

SEQ ID NO: 243712 - RNA, 22 nt, Human
uagcagaaacuguuacagaagg

SEQ ID NO: 243713 - RNA, 22 nt, Human
gacagcuguggagaggcaugug

SEQ ID NO: 243714 - RNA, 22 nt, Human
gggggcaguaaccucaaagugu

SEQ ID NO: 243715 - RNA, 22 nt, Human
uucugucaaaugccaguagaga

SEQ ID NO: 243716 - RNA, 22 nt, Human
agcuaacacauuccagcuauuu

SEQ ID NO: 243717 - RNA, 22 nt, Human
caaagcuggacugcucaguuca

SEQ ID NO: 243718 - RNA, 22 nt, Human
cccugcagagaccacugaccuu

SEQ ID NO: 243719 - RNA, 22 nt, Human
augcaauaccuucugaaaauaa

SEQ ID NO: 243720 - RNA, 22 nt, Human
ugguccgcuccuauucgccgca

SEQ ID NO: 243721 - RNA, 22 nt, Human
ucuucaaagaauuuuaguaauu

SEQ ID NO: 243722 - RNA, 22 nt, Human
agcaguuacuaguuaaaugcau

SEQ ID NO: 243723 - RNA, 22 nt, Human
gccaccagugggggccugggca

SEQ ID NO: 243724 - RNA, 22 nt, Human
gggguacuggcuggagccccac

SEQ ID NO: 243725 - RNA, 22 nt, Human
caguggcuucucaugucauuca

SEQ ID NO: 243726 - RNA, 22 nt, Human
ugcuuugugauaugcugugucu

SEQ ID NO: 243727 - RNA, 22 nt, Human
ccaggaagggcucuuuaaagac

SEQ ID NO: 243728 - RNA, 22 nt, Human
ggccccucagcaucugagucag

SEQ ID NO: 243729 - RNA, 22 nt, Human
agguggaaauggcuuuccuagg

SEQ ID NO: 243730 - RNA, 22 nt, Human
ugugaauaaugccgcaauaaac

SEQ ID NO: 243731 - RNA, 22 nt, Human
auuaagugugacaugcugcucu

SEQ ID NO: 243732 - RNA, 22 nt, Human
ggagggggaaacuuuggcugcc

SEQ ID NO: 243733 - RNA, 22 nt, Human
ccucagagacugcaucuucccu

SEQ ID NO: 243734 - RNA, 19 nt, Human
ccucugccagcccgccucu

SEQ ID NO: 243735 - RNA, 22 nt, Human
ugguggggccagacuucagcuc

SEQ ID NO: 243736 - RNA, 22 nt, Human
aucauucaaaugauuuggaggu

SEQ ID NO: 243737 - RNA, 22 nt, Human
gcuuggaaguaggauugggaga

SEQ ID NO: 243738 - RNA, 22 nt, Human
gugaagaugccucaggugaccc

SEQ ID NO: 243739 - RNA, 22 nt, Human
ugcaaauuugacuucacacauc

SEQ ID NO: 243740 - RNA, 22 nt, Human
ugaagagauuaaguugguuuug

SEQ ID NO: 243741 - RNA, 22 nt, Human
augcacaagguagauuauuauu

SEQ ID NO: 243742 - RNA, 19 nt, Human
agccagaguggcccagggg

SEQ ID NO: 243743 - RNA, 22 nt, Human
agaagccauucccuguaggcuc

SEQ ID NO: 243744 - RNA, 22 nt, Human
aaucaagaguuguguaauauuu

SEQ ID NO: 243745 - RNA, 22 nt, Human
auguauuugaaauuugagacau

SEQ ID NO: 243746 - RNA, 22 nt, Human
uacuucauaccugcuagaaugg

SEQ ID NO: 243747 - RNA, 22 nt, Human
augugcauaaacauauuguugg

SEQ ID NO: 243748 - RNA, 21 nt, Human
cagcagguggagccucuuguc

SEQ ID NO: 243749 - RNA, 22 nt, Human
auuucacagcugucaguguuac

SEQ ID NO: 243750 - RNA, 22 nt, Human
aagcugugaaaucucuagugca

SEQ ID NO: 243751 - RNA, 20 nt, Human
accuccuggaagcaggugcc

SEQ ID NO: 243752 - RNA, 22 nt, Human
cauucagagcuuucuuaucaua

SEQ ID NO: 243753 - RNA, 18 nt, Human
ccuagccuccaagcucau

SEQ ID NO: 243754 - RNA, 22 nt, Human
aagcaagaggaaauguggaccu

SEQ ID NO: 243755 - RNA, 19 nt, Human
agagaccacagagcugccu

SEQ ID NO: 243756 - RNA, 22 nt, Human
gcauuuuauaaagaguuauuug

SEQ ID NO: 243757 - RNA, 21 nt, Human
ccuggcuucagggugcacugg

SEQ ID NO: 243758 - RNA, 22 nt, Human
ucaggccugcagugccaaccca

SEQ ID NO: 243759 - RNA, 22 nt, Human
uccuggcagagggcggccucga

SEQ ID NO: 243760 - RNA, 19 nt, Human
uuuagaaguugaaacucug

SEQ ID NO: 243761 - RNA, 22 nt, Human
uuuaauguagcgugaaaugauu

SEQ ID NO: 243762 - RNA, 22 nt, Human
gugggggcagugggcuucgagc

SEQ ID NO: 243763 - RNA, 22 nt, Human
uuacuuuugcaccaaacuaaua

SEQ ID NO: 243764 - RNA, 22 nt, Human
aaagcacuuugagacugacagg

SEQ ID NO: 243765 - RNA, 22 nt, Human
augcaggagagcauguuuaaga

SEQ ID NO: 243766 - RNA, 22 nt, Human
caaagcuguaccccaaccuaug

SEQ ID NO: 243767 - RNA, 22 nt, Human
ucuuucccaguagcucucccag

SEQ ID NO: 243768 - RNA, 22 nt, Human
gaaugaauagguguccagaugg

SEQ ID NO: 243769 - RNA, 22 nt, Human
ggagccagugcccucuggugga

SEQ ID NO: 243770 - RNA, 22 nt, Human
acagaauagagacugccugcuc

SEQ ID NO: 243771 - RNA, 22 nt, Human
ugaaauacugagugaaagaauu

SEQ ID NO: 243772 - RNA, 22 nt, Human
aacucaguucuuuccacaaugc

SEQ ID NO: 243773 - RNA, 20 nt, Human
aaaaauugauaucgcuuccu

SEQ ID NO: 243774 - RNA, 22 nt, Human
gaaaguuauaucaugauuuuag

SEQ ID NO: 243775 - RNA, 22 nt, Human
ugagcagggacuuugaguguag

SEQ ID NO: 243776 - RNA, 22 nt, Human
uagugaauaguccaaucccgca

SEQ ID NO: 243777 - RNA, 22 nt, Human
gcuggguccuaugcugguagag

SEQ ID NO: 243778 - RNA, 22 nt, Human
agauggggcucaguguggaggc

SEQ ID NO: 243779 - RNA, 20 nt, Human
uggcccagcacgacgaggac

SEQ ID NO: 243780 - RNA, 22 nt, Human
aaggccaggagacuuggaguca

SEQ ID NO: 243781 - RNA, 22 nt, Human
ccugggcuguugcaucauccuu

SEQ ID NO: 243782 - RNA, 22 nt, Human
gaauagcuuagauuccuuagug

SEQ ID NO: 243783 - RNA, 22 nt, Human
aaauuguugaucuacaguaagg

SEQ ID NO: 243784 - RNA, 22 nt, Human
cugcccugacugaccuuuugaa

SEQ ID NO: 243785 - RNA, 22 nt, Human
gugacccagaggcugacuaaca

SEQ ID NO: 243786 - RNA, 22 nt, Human
augaauggauggggucaagaua

SEQ ID NO: 243787 - RNA, 22 nt, Human
acucagagucugagauaaaucu

SEQ ID NO: 243788 - RNA, 22 nt, Human
auaugaaaagaagucaccauug

SEQ ID NO: 243789 - RNA, 22 nt, Human
gaaauauuacaguggaggggau

SEQ ID NO: 243790 - RNA, 22 nt, Human
ucaagcaaacucugagaaauaa

SEQ ID NO: 243791 - RNA, 22 nt, Human
gcagcucaguaaaagaggagca

SEQ ID NO: 243792 - RNA, 22 nt, Human
gaagaauauauaaugauuuugu

SEQ ID NO: 243793 - RNA, 22 nt, Human
auacauauaugguacuuccugg

SEQ ID NO: 243794 - RNA, 22 nt, Human
gaaggcaucacagaggcugugg

SEQ ID NO: 243795 - RNA, 20 nt, Human
ccucagagcgcaggcccccu

SEQ ID NO: 243796 - RNA, 22 nt, Human
caagauuugggggcacggaauc

SEQ ID NO: 243797 - RNA, 22 nt, Human
gugggacagcggggugggacag

SEQ ID NO: 243798 - RNA, 22 nt, Human
ccuccaagcugguccucugugu

SEQ ID NO: 243799 - RNA, 22 nt, Human
cccuccagggagccaugcuggg

SEQ ID NO: 243800 - RNA, 22 nt, Human
ccugccuuucucaguaaucuuu

SEQ ID NO: 243801 - RNA, 21 nt, Human
cagaggcaggcucugugugug

SEQ ID NO: 243802 - RNA, 20 nt, Human
gaggaaaagcugccaggccu

SEQ ID NO: 243803 - RNA, 22 nt, Human
gucaucuuaaggacugcuauag

SEQ ID NO: 243804 - RNA, 18 nt, Human
agaagccugccucaaugc

SEQ ID NO: 243805 - RNA, 22 nt, Human
aaagucaucuaggagcagauuu

SEQ ID NO: 243806 - RNA, 22 nt, Human
ucacaccuugcuggcugagugc

SEQ ID NO: 243807 - RNA, 20 nt, Human
acuuuacugagcuguaauuc

SEQ ID NO: 243808 - RNA, 22 nt, Human
caccaggaagugguggccuggg

SEQ ID NO: 243809 - RNA, 22 nt, Human
guauuuuauggcaugcaguggc

SEQ ID NO: 243810 - RNA, 22 nt, Human
cugcagaaaccuuuccugauuu

SEQ ID NO: 243811 - RNA, 22 nt, Human
gucaguuacagccacggcgggu

SEQ ID NO: 243812 - RNA, 22 nt, Human
ugaggcucugcuucuguggcuc

SEQ ID NO: 243813 - RNA, 22 nt, Human
agcagggcugcagugugucuuu

SEQ ID NO: 243814 - RNA, 22 nt, Human
ggagccuuagacaucugauccu

SEQ ID NO: 243815 - RNA, 22 nt, Human
uucagagaagugcacaaaauca

SEQ ID NO: 243816 - RNA, 22 nt, Human
aauagauggguuaaacagcaaa

SEQ ID NO: 243817 - RNA, 22 nt, Human
auuuucauggcuucugcucagu

SEQ ID NO: 243818 - RNA, 22 nt, Human
ggccuuccugcugcuccgggcc

SEQ ID NO: 243819 - RNA, 22 nt, Human
ggaccaggagcucagagcccuc

SEQ ID NO: 243820 - RNA, 22 nt, Human
ucaugcagauaagaauaaguaa

SEQ ID NO: 243821 - RNA, 22 nt, Human
agugacauuugcaccagcugcu

SEQ ID NO: 243822 - RNA, 22 nt, Human
uacaaauuaaugggcauguuua

SEQ ID NO: 243823 - RNA, 22 nt, Human
uuuaugucccuucaaauguuua

SEQ ID NO: 243824 - RNA, 22 nt, Human
ccugagagcccuagccaggcgc

SEQ ID NO: 243825 - RNA, 22 nt, Human
gucaacauuuacugcccuggcc

SEQ ID NO: 243826 - RNA, 22 nt, Human
ucuguaggguaguaguggagau

SEQ ID NO: 243827 - RNA, 22 nt, Human
aaaugcuguagaucagugaguu

SEQ ID NO: 243828 - RNA, 22 nt, Human
gccuguuuaucuaucaugaacu

SEQ ID NO: 243829 - RNA, 22 nt, Human
ccaggaguuugaggcugcagug

SEQ ID NO: 243830 - RNA, 22 nt, Human
auuauauugaguauaaccagag

SEQ ID NO: 243831 - RNA, 22 nt, Human
ugcccugcuaaauauagguagc

SEQ ID NO: 243832 - RNA, 22 nt, Human
cuggggaggcagggcugccccu

SEQ ID NO: 243833 - RNA, 22 nt, Human
uccugggaagagaccugagcau

SEQ ID NO: 243834 - RNA, 22 nt, Human
cucagggcggcgggcagcccag

SEQ ID NO: 243835 - RNA, 22 nt, Human
guuguucucccuaacaauuacu

SEQ ID NO: 243836 - RNA, 22 nt, Human
ugggagagauaggcuucuggac

SEQ ID NO: 243837 - RNA, 23 nt, Human
ucccugagaugcugcucuguccc

SEQ ID NO: 243838 - RNA, 22 nt, Human
uccaguccuaucugcccuugga

SEQ ID NO: 243839 - RNA, 22 nt, Human
accuugaugccuuuccaagaug

SEQ ID NO: 243840 - RNA, 22 nt, Human
cuggagggcugcagcgaggcug

SEQ ID NO: 243841 - RNA, 22 nt, Human
aaagcagucacuccagugugau

SEQ ID NO: 243842 - RNA, 22 nt, Human
caggagucuguuccucauuugu

SEQ ID NO: 243843 - RNA, 22 nt, Human
aggcagcauccagaggagaaug

SEQ ID NO: 243844 - RNA, 22 nt, Human
uggcacugaccccaggccugug

SEQ ID NO: 243845 - RNA, 22 nt, Human
gcuguucacggaggaggauggg

SEQ ID NO: 243846 - RNA, 22 nt, Human
ucuccuggccgggcuguccccu

SEQ ID NO: 243847 - RNA, 22 nt, Human
ggacuggccggcgcugaggccc

SEQ ID NO: 243848 - RNA, 22 nt, Human
uucacagugugaucuaugggca

SEQ ID NO: 243849 - RNA, 22 nt, Human
gugcagauccugauugcaguuc

SEQ ID NO: 243850 - RNA, 22 nt, Human
ugguuccacuaaccugagagcc

SEQ ID NO: 243851 - RNA, 22 nt, Human
cucccaggccaugcucuagcca

SEQ ID NO: 243852 - RNA, 22 nt, Human
agaaaucacaggaggcagaagg

SEQ ID NO: 243853 - RNA, 22 nt, Human
uggcauugacgcugaccugcac

SEQ ID NO: 243854 - RNA, 22 nt, Human
gggaucuuguuuaauauuguuu

SEQ ID NO: 243855 - RNA, 22 nt, Human
ggccuuggugcucuguguugca

SEQ ID NO: 243856 - RNA, 22 nt, Human
ucagcugggugaguguucugca

SEQ ID NO: 243857 - RNA, 22 nt, Human
aagaacaugcuauaauuaucuu

SEQ ID NO: 243858 - RNA, 22 nt, Human
accugcuuuguaguguuugcug

SEQ ID NO: 243859 - RNA, 22 nt, Human
agcaccugcuaugugucaggga

SEQ ID NO: 243860 - RNA, 19 nt, Human
gaguccugugcuccuuguu

SEQ ID NO: 243861 - RNA, 22 nt, Human
cuugagaaaggaacaggaagcu

SEQ ID NO: 243862 - RNA, 19 nt, Human
acacugaauguagaauugg

SEQ ID NO: 243863 - RNA, 22 nt, Human
cacuggcccauaaaggccuggg

SEQ ID NO: 243864 - RNA, 22 nt, Human
auguguacacuggacuucugau

SEQ ID NO: 243865 - RNA, 22 nt, Human
ucuacacuguagaauuauaagg

SEQ ID NO: 243866 - RNA, 22 nt, Human
uuguaacagcuguuuauauagu

SEQ ID NO: 243867 - RNA, 22 nt, Human
cugggccuggcguuccaggcug

SEQ ID NO: 243868 - RNA, 21 nt, Human
cuuggcugcagugacaggcau

SEQ ID NO: 243869 - RNA, 22 nt, Human
caucacaucaaaccuacucuca

SEQ ID NO: 243870 - RNA, 22 nt, Human
ggagacucggguucuagccuug

SEQ ID NO: 243871 - RNA, 19 nt, Human
uagaacugaggacuugcau

SEQ ID NO: 243872 - RNA, 22 nt, Human
caaagugcuaggauuacaggcc

SEQ ID NO: 243873 - RNA, 22 nt, Human
cugaagggaugugauuucuaca

SEQ ID NO: 243874 - RNA, 22 nt, Human
uuuagcagcaaauaaguagugc

SEQ ID NO: 243875 - RNA, 20 nt, Human
ucugccuuagggggagccuc

SEQ ID NO: 243876 - RNA, 22 nt, Human
aaguaccuagaaauauuuuuga

SEQ ID NO: 243877 - RNA, 22 nt, Human
ccuggcagcuaagugcuuugag

SEQ ID NO: 243878 - RNA, 21 nt, Human
uagaaucacuaauaagaugua

SEQ ID NO: 243879 - RNA, 22 nt, Human
cagcucuuggagccuccaguaa

SEQ ID NO: 243880 - RNA, 22 nt, Human
cagaaucugagucgugauugua

SEQ ID NO: 243881 - RNA, 22 nt, Human
gaggccucaggaaugucgugug

SEQ ID NO: 243882 - RNA, 22 nt, Human
agggcugcccagugugagagcu

SEQ ID NO: 243883 - RNA, 21 nt, Human
gagauggcccaguagcgggcc

SEQ ID NO: 243884 - RNA, 22 nt, Human
uuccaaagcugcuuuauuuagu

SEQ ID NO: 243885 - RNA, 22 nt, Human
agcccugauuaaccuuggcuuu

SEQ ID NO: 243886 - RNA, 22 nt, Human
gaagugacaagaugcuaggauc

SEQ ID NO: 243887 - RNA, 22 nt, Human
cauaauccuguccuggauucuu

SEQ ID NO: 243888 - RNA, 22 nt, Human
caacaaguggguacuuuacagg

SEQ ID NO: 243889 - RNA, 22 nt, Human
ucaguuaacaacuauuuauuga

SEQ ID NO: 243890 - RNA, 22 nt, Human
ccagucagccaagcugcagcgg

SEQ ID NO: 243891 - RNA, 22 nt, Human
ccuagggagccugagagcagug

SEQ ID NO: 243892 - RNA, 22 nt, Human
ccuggcuccagcugccuguccu

SEQ ID NO: 243893 - RNA, 22 nt, Human
uuuguguuuucacuagcagugu

SEQ ID NO: 243894 - RNA, 22 nt, Human
ugggauaagguaugugaaguac

SEQ ID NO: 243895 - RNA, 22 nt, Human
aauugcuuguuucuuuaacuga

SEQ ID NO: 243896 - RNA, 19 nt, Human
ccuggcccugcugcgcggg

SEQ ID NO: 243897 - RNA, 22 nt, Human
ccugaggcuggcccuuccaucc

SEQ ID NO: 243898 - RNA, 22 nt, Human
uuacagaguagggaauugaagu

SEQ ID NO: 243899 - RNA, 22 nt, Human
agacuccaaaugaaagaggggg

SEQ ID NO: 243900 - RNA, 19 nt, Human
ccuggcucugagcccagcc

SEQ ID NO: 243901 - RNA, 22 nt, Human
cuuagcaaggcugccuggagaa

SEQ ID NO: 243902 - RNA, 22 nt, Human
uuauauguuucuguuuggaggc

SEQ ID NO: 243903 - RNA, 22 nt, Human
cacagguggcuccaaguuagag

SEQ ID NO: 243904 - RNA, 22 nt, Human
ggcuucucuaaagaucaugcgu

SEQ ID NO: 243905 - RNA, 22 nt, Human
agacagacaaaauuccugccug

SEQ ID NO: 243906 - RNA, 22 nt, Human
cuccugacacaguccacacuug

SEQ ID NO: 243907 - RNA, 22 nt, Human
uucaaacuguguaauuuauaaa

SEQ ID NO: 243908 - RNA, 22 nt, Human
agugauggcaucggguccagca

SEQ ID NO: 243909 - RNA, 21 nt, Human
ucuccaguugacagugucucc

SEQ ID NO: 243910 - RNA, 22 nt, Human
gccaaaucuggauuuagcaaga

SEQ ID NO: 243911 - RNA, 22 nt, Human
aaguuuuugguagagaaaagua

SEQ ID NO: 243912 - RNA, 22 nt, Human
gaggggagaggcuuauggauca

SEQ ID NO: 243913 - RNA, 22 nt, Human
uuuagaaguucacacauuuaaa

SEQ ID NO: 243914 - RNA, 22 nt, Human
ugaauacaggaaaauauacuga

SEQ ID NO: 243915 - RNA, 22 nt, Human
acuauucacagauucaguguuc

SEQ ID NO: 243916 - RNA, 22 nt, Human
uaaaagaucacuggcugcuuua

SEQ ID NO: 243917 - RNA, 22 nt, Human
aauucacaguucugcaccuuac

SEQ ID NO: 243918 - RNA, 22 nt, Human
cagcugagaccagaaugcaggu

SEQ ID NO: 243919 - RNA, 22 nt, Human
ugcacccacuuagcugaaguuc

SEQ ID NO: 243920 - RNA, 19 nt, Human
uuccaggugcuguggggag

SEQ ID NO: 243921 - RNA, 22 nt, Human
ucaaggaagauagcuauuauga

SEQ ID NO: 243922 - RNA, 22 nt, Human
ucacacuaagacaaaauaauuu

SEQ ID NO: 243923 - RNA, 21 nt, Human
aaagagacaaauggcauauac

SEQ ID NO: 243924 - RNA, 22 nt, Human
guguccugguuccuuguggcug

SEQ ID NO: 243925 - RNA, 19 nt, Human
agaggcaaggguggaagua

SEQ ID NO: 243926 - RNA, 22 nt, Human
ugacacaguaucaaacaugauu

SEQ ID NO: 243927 - RNA, 22 nt, Human
ggguaggaaauccagagguggc

SEQ ID NO: 243928 - RNA, 22 nt, Human
aacagcaauagcacuauucauu

SEQ ID NO: 243929 - RNA, 22 nt, Human
uucaguuucuucccugugaaau

SEQ ID NO: 243930 - RNA, 22 nt, Human
ucuacauuuuaacaagaugccc

SEQ ID NO: 243931 - RNA, 22 nt, Human
acggggcuagagaagguuucuu

SEQ ID NO: 243932 - RNA, 22 nt, Human
auguucuuguucaaaugucagu

SEQ ID NO: 243933 - RNA, 22 nt, Human
ccuggcaguuuugcccaggauu

SEQ ID NO: 243934 - RNA, 22 nt, Human
ccacugagaagggguugggguc

SEQ ID NO: 243935 - RNA, 22 nt, Human
agcugcuccuuuccugcaggcg

SEQ ID NO: 243936 - RNA, 22 nt, Human
gacuguacuugagagaggaacu

SEQ ID NO: 243937 - RNA, 20 nt, Human
aacacaggguuaccaucaga

SEQ ID NO: 243938 - RNA, 22 nt, Human
gccagguccccucauggcuccu

SEQ ID NO: 243939 - RNA, 23 nt, Human
cuccuggaggguccggcccugcc

SEQ ID NO: 243940 - RNA, 23 nt, Human
uaauacugcuucagaggcuuaga

SEQ ID NO: 243941 - RNA, 22 nt, Human
aacugcauguguguggcaugau

SEQ ID NO: 243942 - RNA, 22 nt, Human
gaauuuccucuaaaccccugag

SEQ ID NO: 243943 - RNA, 22 nt, Human
gccacagguacuaugggagaga

SEQ ID NO: 243944 - RNA, 19 nt, Human
uccaguuuggcaggaagac

SEQ ID NO: 243945 - RNA, 22 nt, Human
ugcagaauuauggugcuggcuu

SEQ ID NO: 243946 - RNA, 20 nt, Human
cagggccuaugauugagcuu

SEQ ID NO: 243947 - RNA, 19 nt, Human
uuagaacauccucuaggga

SEQ ID NO: 243948 - RNA, 22 nt, Human
ugguccugaucaccgcugggca

SEQ ID NO: 243949 - RNA, 23 nt, Human
agggcuccuuguugauuagcauu

SEQ ID NO: 243950 - RNA, 22 nt, Human
uuugaagacagaucaauauaag

SEQ ID NO: 243951 - RNA, 22 nt, Human
auggcagaguccuaagccuuua

SEQ ID NO: 243952 - RNA, 22 nt, Human
aaaguuuauuuucccugguuag

SEQ ID NO: 243953 - RNA, 22 nt, Human
auaauacaugguugaucuuuuc

SEQ ID NO: 243954 - RNA, 22 nt, Human
gagaacaggcucuggagucaga

SEQ ID NO: 243955 - RNA, 22 nt, Human
cucagagagugaauuccugccu

SEQ ID NO: 243956 - RNA, 22 nt, Human
auggaaauggagugugcuugcu

SEQ ID NO: 243957 - RNA, 22 nt, Human
uacacaacugacaaccauucug

SEQ ID NO: 243958 - RNA, 20 nt, Human
uccuggccuucucgggcagu

SEQ ID NO: 243959 - RNA, 21 nt, Human
uagggggcagugggaugcuua

SEQ ID NO: 243960 - RNA, 22 nt, Human
uccugggcccaggcugccaggg

SEQ ID NO: 243961 - RNA, 22 nt, Human
uuugcaaugguaguuguugcuc

SEQ ID NO: 243962 - RNA, 22 nt, Human
gcagaauauauuacugagccuc

SEQ ID NO: 243963 - RNA, 19 nt, Human
ccaguccucuuugggccug

SEQ ID NO: 243964 - RNA, 22 nt, Human
cagaggugcauacaggucauua

SEQ ID NO: 243965 - RNA, 22 nt, Human
aguguuuauugugugccacaca

SEQ ID NO: 243966 - RNA, 22 nt, Human
acagcagagccuagcuuaaucu

SEQ ID NO: 243967 - RNA, 22 nt, Human
uacuuguguucuacuagagaaa

SEQ ID NO: 243968 - RNA, 22 nt, Human
cauaauuucuguaucagcacca

SEQ ID NO: 243969 - RNA, 22 nt, Human
aaacagacugaagaguugaagc

SEQ ID NO: 243970 - RNA, 22 nt, Human
ugggcaaacugucaaccauguc

SEQ ID NO: 243971 - RNA, 22 nt, Human
ggaagagaaaugagucaagacu

SEQ ID NO: 243972 - RNA, 22 nt, Human
uggucucugugcucgggcaugg

SEQ ID NO: 243973 - RNA, 23 nt, Human
agcuaaugggacagauuccaugg

SEQ ID NO: 243974 - RNA, 22 nt, Human
aagacagugugucaggcaggug

SEQ ID NO: 243975 - RNA, 22 nt, Human
ggcccugggcagaggagugggc

SEQ ID NO: 243976 - RNA, 22 nt, Human
uccuguguuacugccuggagcg

SEQ ID NO: 243977 - RNA, 22 nt, Human
ggcucugcaaaaguagauacuu

SEQ ID NO: 243978 - RNA, 22 nt, Human
cuucugaaguguuugaugauug

SEQ ID NO: 243979 - RNA, 22 nt, Human
ccugccuugacguaacgcauga

SEQ ID NO: 243980 - RNA, 22 nt, Human
gccuguguguuuagcucugggg

SEQ ID NO: 243981 - RNA, 22 nt, Human
uggccugacuguccagccaggg

SEQ ID NO: 243982 - RNA, 22 nt, Human
ugggccacuaccuucucuggau

SEQ ID NO: 243983 - RNA, 22 nt, Human
aaacugcaauuauuuuugcaau

SEQ ID NO: 243984 - RNA, 22 nt, Human
cauuccugagggcccccuacuu

SEQ ID NO: 243985 - RNA, 22 nt, Human
ucagagagguuggugauaagaa

SEQ ID NO: 243986 - RNA, 18 nt, Human
acauuucucucugcguga

SEQ ID NO: 243987 - RNA, 22 nt, Human
agagcacacugacgucagucug

SEQ ID NO: 243988 - RNA, 22 nt, Human
uacaaagugaaauaauucugag

SEQ ID NO: 243989 - RNA, 22 nt, Human
augcaacagucaguacauccgg

SEQ ID NO: 243990 - RNA, 22 nt, Human
cccacacacauuuaugauagga

SEQ ID NO: 243991 - RNA, 22 nt, Human
cuguggcuuucucugccuccuu

SEQ ID NO: 243992 - RNA, 22 nt, Human
ggacagcauaucagcagggcag

SEQ ID NO: 243993 - RNA, 22 nt, Human
ucuucuuugaaucauagugacc

SEQ ID NO: 243994 - RNA, 22 nt, Human
agaggcaagauuaucagggcau

SEQ ID NO: 243995 - RNA, 22 nt, Human
ugguccugagaauccuguccuc

SEQ ID NO: 243996 - RNA, 22 nt, Human
gcacagagcuggcccuccaggc

SEQ ID NO: 243997 - RNA, 22 nt, Human
gggccugaggcccagacacugg

SEQ ID NO: 243998 - RNA, 22 nt, Human
ugucccugccugcccacucugu

SEQ ID NO: 243999 - RNA, 22 nt, Human
aaggugucaaacuagaagaugu

SEQ ID NO: 244000 - RNA, 22 nt, Human
gcucuggcucaaaccaccggcu

SEQ ID NO: 244001 - RNA, 22 nt, Human
gcagcagcccagggcucucaga

SEQ ID NO: 244002 - RNA, 23 nt, Human
agcuccagcugacgugggcagcc

SEQ ID NO: 244003 - RNA, 18 nt, Human
ugcagccuguagucuugu

SEQ ID NO: 244004 - RNA, 21 nt, Human
cagagcucuuucugcuugcug

SEQ ID NO: 244005 - RNA, 22 nt, Human
gcuggccugaccagccacaggc

SEQ ID NO: 244006 - RNA, 19 nt, Human
auuguacauugaguuuggc

SEQ ID NO: 244007 - RNA, 22 nt, Human
uucuuuccccauggaguucgga

SEQ ID NO: 244008 - RNA, 22 nt, Human
cucuggcuggcugggccucagu

SEQ ID NO: 244009 - RNA, 22 nt, Human
agggcuggagccacagcuggga

SEQ ID NO: 244010 - RNA, 22 nt, Human
uuuuauauggcacauugguugg

SEQ ID NO: 244011 - RNA, 22 nt, Human
gugguuuaggggaaagaacugu

SEQ ID NO: 244012 - RNA, 22 nt, Human
agguggggaaaccagcgauccc

SEQ ID NO: 244013 - RNA, 22 nt, Human
ucagggcuuuggcuuuuacucu

SEQ ID NO: 244014 - RNA, 22 nt, Human
guacaggaccgcggcccccugg

SEQ ID NO: 244015 - RNA, 22 nt, Human
gacagggaacuucauuagcugu

SEQ ID NO: 244016 - RNA, 22 nt, Human
uauuagggaacugcaagacuaa

SEQ ID NO: 244017 - RNA, 22 nt, Human
acacauauauuauuuguggcuc

SEQ ID NO: 244018 - RNA, 18 nt, Human
ggacacagauagguacag

SEQ ID NO: 244019 - RNA, 22 nt, Human
ucucugagcuggauuuguucuu

SEQ ID NO: 244020 - RNA, 22 nt, Human
ugaaaucuucacuaagucucuu

SEQ ID NO: 244021 - RNA, 22 nt, Human
uugcagcugaggaaauugaagc

SEQ ID NO: 244022 - RNA, 22 nt, Human
uaccauuucaguaaaaacuuag

SEQ ID NO: 244023 - RNA, 22 nt, Human
gaacaaacugggucccaaugau

SEQ ID NO: 244024 - RNA, 22 nt, Human
gcauucuugagguguggacuca

SEQ ID NO: 244025 - RNA, 19 nt, Human
ggucucagugcagcugcag

SEQ ID NO: 244026 - RNA, 22 nt, Human
ugggaggcccaggccuggcagg

SEQ ID NO: 244027 - RNA, 22 nt, Human
guccuggcugguucuguggggc

SEQ ID NO: 244028 - RNA, 22 nt, Human
acagaaaaugccagaagggugg

SEQ ID NO: 244029 - RNA, 22 nt, Human
ugguccauguccuccaucucuc

SEQ ID NO: 244030 - RNA, 22 nt, Human
aggaggcugggcacaguggccu

SEQ ID NO: 244031 - RNA, 22 nt, Human
cacuccuguuccacuaaaugag

SEQ ID NO: 244032 - RNA, 20 nt, Human
cuaacuaaccacuuucugau

SEQ ID NO: 244033 - RNA, 21 nt, Human
aacauuaguaauuugacuuuu

SEQ ID NO: 244034 - RNA, 22 nt, Human
gcaagcaaguaucuggcaggga

SEQ ID NO: 244035 - RNA, 22 nt, Human
uccacaucucucgccaaccaau

SEQ ID NO: 244036 - RNA, 22 nt, Human
gucagaagcauuuguggcugaa

SEQ ID NO: 244037 - RNA, 22 nt, Human
uggugcugccucagaugccuua

SEQ ID NO: 244038 - RNA, 22 nt, Human
cagacagggaccucgcuccaga

SEQ ID NO: 244039 - RNA, 22 nt, Human
cucccugguguccccuccagga

SEQ ID NO: 244040 - RNA, 22 nt, Human
gccaccucuuugucucugccgc

SEQ ID NO: 244041 - RNA, 22 nt, Human
uggcaggagagcgucagaucag

SEQ ID NO: 244042 - RNA, 22 nt, Human
aaugauguauuaguacaacaca

SEQ ID NO: 244043 - RNA, 22 nt, Human
ucuagaaagccaaauuaggaau

SEQ ID NO: 244044 - RNA, 22 nt, Human
uuucacauguauauaggcauua

SEQ ID NO: 244045 - RNA, 22 nt, Human
augcaacagagaaaauauugag

SEQ ID NO: 244046 - RNA, 22 nt, Human
gcccuggagagggauauggcau

SEQ ID NO: 244047 - RNA, 22 nt, Human
guauaacugcuaccaccugaug

SEQ ID NO: 244048 - RNA, 22 nt, Human
agagcccagguccuggagaggg

SEQ ID NO: 244049 - RNA, 22 nt, Human
ggcucugggguuggcccaucuc

SEQ ID NO: 244050 - RNA, 19 nt, Human
uacaggaggccugcaaucu

SEQ ID NO: 244051 - RNA, 22 nt, Human
cuagaaucuccaaguuuacuca

SEQ ID NO: 244052 - RNA, 22 nt, Human
uuuuccuacugauaaacaguua

SEQ ID NO: 244053 - RNA, 22 nt, Human
aacaggcuaaauuguccauuuc

SEQ ID NO: 244054 - RNA, 22 nt, Human
gaacuuggaacuggggcuacug

SEQ ID NO: 244055 - RNA, 22 nt, Human
gaaguacaguuuuaucuagcca

SEQ ID NO: 244056 - RNA, 22 nt, Human
ucucuguaagcugccuucucgu

SEQ ID NO: 244057 - RNA, 22 nt, Human
gcugcccugugguagagggugg

SEQ ID NO: 244058 - RNA, 22 nt, Human
uucuuucuuagcaaucuauggu

SEQ ID NO: 244059 - RNA, 22 nt, Human
acauucuuucucuucaggaaac

SEQ ID NO: 244060 - RNA, 22 nt, Human
agaaaauaauuucuuggcuggu

SEQ ID NO: 244061 - RNA, 22 nt, Human
aggcucugguucaucaugaugg

SEQ ID NO: 244062 - RNA, 22 nt, Human
auagaaucuuuguaaaacacuu

SEQ ID NO: 244063 - RNA, 22 nt, Human
uuauauuguguaauaagugaag

SEQ ID NO: 244064 - RNA, 22 nt, Human
aguguccucaucuguaaaauga

SEQ ID NO: 244065 - RNA, 17 nt, Human
cuuguuuuccacuggga

SEQ ID NO: 244066 - RNA, 22 nt, Human
cuacaucagaacauuuacccua

SEQ ID NO: 244067 - RNA, 22 nt, Human
ccagcuuuauagcuucaaagga

SEQ ID NO: 244068 - RNA, 22 nt, Human
cccagcagcuugcacagugcug

SEQ ID NO: 244069 - RNA, 22 nt, Human
aggccucagcucagugugacag

SEQ ID NO: 244070 - RNA, 22 nt, Human
ugagcacuuuaaaauauuccca

SEQ ID NO: 244071 - RNA, 22 nt, Human
ucgccauggaaguccuugcgga

SEQ ID NO: 244072 - RNA, 22 nt, Human
gaggcuggaggucaaagaugaa

SEQ ID NO: 244073 - RNA, 22 nt, Human
ucauucagagagaauguuccag

SEQ ID NO: 244074 - RNA, 22 nt, Human
gggacucugagagccugagggu

SEQ ID NO: 244075 - RNA, 22 nt, Human
ucgggcucgcucuccuagcgga

SEQ ID NO: 244076 - RNA, 22 nt, Human
aggcaggcacuccggaaguguc

SEQ ID NO: 244077 - RNA, 22 nt, Human
caucucuguguccccacaccca

SEQ ID NO: 244078 - RNA, 22 nt, Human
augguggauuugugauucagcu

SEQ ID NO: 244079 - RNA, 22 nt, Human
agccacagcacauuguaagaaa

SEQ ID NO: 244080 - RNA, 22 nt, Human
aggcugccucuuuugagagggu

SEQ ID NO: 244081 - RNA, 22 nt, Human
aaggcuucuuuaguguccuaau

SEQ ID NO: 244082 - RNA, 22 nt, Human
ugacaugugcucaucuuggcua

SEQ ID NO: 244083 - RNA, 22 nt, Human
aucagagaaauggagggcgcuu

SEQ ID NO: 244084 - RNA, 22 nt, Human
auucuacacaaagcaagaagac

SEQ ID NO: 244085 - RNA, 22 nt, Human
ccuggcagcuccuccccggcgg

SEQ ID NO: 244086 - RNA, 22 nt, Human
cugccuuugugaucaguucuuu

SEQ ID NO: 244087 - RNA, 22 nt, Human
uucauauauaugcacuacguac

SEQ ID NO: 244088 - RNA, 22 nt, Human
uaaagacaugcaaagucuaauu

SEQ ID NO: 244089 - RNA, 22 nt, Human
ccauucugacaccuaauucugu

SEQ ID NO: 244090 - RNA, 22 nt, Human
uuucugaagggcagcagacucu

SEQ ID NO: 244091 - RNA, 22 nt, Human
auauauuuugcggucacguggc

SEQ ID NO: 244092 - RNA, 22 nt, Human
acccaggcuagggugcaguggc

SEQ ID NO: 244093 - RNA, 22 nt, Human
ggccaggcuggucucagacuuc

SEQ ID NO: 244094 - RNA, 22 nt, Human
auugcugggaauauuuagccca

SEQ ID NO: 244095 - RNA, 22 nt, Human
aagaagcacuuuccuacauguu

SEQ ID NO: 244096 - RNA, 22 nt, Human
uuggcccacaguaccaugcugu

SEQ ID NO: 244097 - RNA, 22 nt, Human
auagcaaacuggagcuugcuuu

SEQ ID NO: 244098 - RNA, 22 nt, Human
gacuggagucaaugagcagcac

SEQ ID NO: 244099 - RNA, 22 nt, Human
cacagaaaggcucaaaucccaa

SEQ ID NO: 244100 - RNA, 22 nt, Human
cuucugggcagaaguuuugaga

SEQ ID NO: 244101 - RNA, 22 nt, Human
gacugagaaucauagaaggcaa

SEQ ID NO: 244102 - RNA, 21 nt, Human
ucagugacaggugcugaccuc

SEQ ID NO: 244103 - RNA, 22 nt, Human
ucucagaaaugacaggagguac

SEQ ID NO: 244104 - RNA, 22 nt, Human
aagcacugagcacaguggcuga

SEQ ID NO: 244105 - RNA, 22 nt, Human
uccaguuuccaaucacugcacg

SEQ ID NO: 244106 - RNA, 22 nt, Human
aaaucaugugcagagaucagga

SEQ ID NO: 244107 - RNA, 22 nt, Human
cugcugugcacccaggaaggcu

SEQ ID NO: 244108 - RNA, 22 nt, Human
ucuggcucaggagcuguguuca

SEQ ID NO: 244109 - RNA, 22 nt, Human
ggggugggcgugcagggacacc

SEQ ID NO: 244110 - RNA, 22 nt, Human
agcaggagaacacuguggcucu

SEQ ID NO: 244111 - RNA, 21 nt, Human
ucccagggucuuaugggaugu

SEQ ID NO: 244112 - RNA, 22 nt, Human
gcagcagcucugaaugggcccc

SEQ ID NO: 244113 - RNA, 22 nt, Human
aaagacauggaacuagagaugg

SEQ ID NO: 244114 - RNA, 22 nt, Human
ccuuuugcucucccauccagaa

SEQ ID NO: 244115 - RNA, 22 nt, Human
gaggccucaggcgugggaaggg

SEQ ID NO: 244116 - RNA, 22 nt, Human
ggccaggcugcccugggagcag

SEQ ID NO: 244117 - RNA, 22 nt, Human
caguuuaaccuauccauuaugu

SEQ ID NO: 244118 - RNA, 22 nt, Human
uaaacauguugacaucuuaccu

SEQ ID NO: 244119 - RNA, 22 nt, Human
accaucuuagcagacugcagug

SEQ ID NO: 244120 - RNA, 23 nt, Human
cccacaugucugagucagugcca

SEQ ID NO: 244121 - RNA, 21 nt, Human
ggugacacguggccccgcucu

SEQ ID NO: 244122 - RNA, 22 nt, Human
uagccauguguggaacacagcc

SEQ ID NO: 244123 - RNA, 22 nt, Human
auguguacaaccaagcacuaaa

SEQ ID NO: 244124 - RNA, 22 nt, Human
ugagcagagucgcuccagagug

SEQ ID NO: 244125 - RNA, 18 nt, Human
ggacccagggccucaccc

SEQ ID NO: 244126 - RNA, 23 nt, Human
ucacagagcauacugcauuuugc

SEQ ID NO: 244127 - RNA, 22 nt, Human
aacaggcuggccuugaagcagu

SEQ ID NO: 244128 - RNA, 20 nt, Human
ugcaaggaagcaggcaagug

SEQ ID NO: 244129 - RNA, 22 nt, Human
cagaugaggcaaccucauugcu

SEQ ID NO: 244130 - RNA, 22 nt, Human
caaaguaucaacucccacacug

SEQ ID NO: 244131 - RNA, 21 nt, Human
agggagcugcgucuugaaaga

SEQ ID NO: 244132 - RNA, 22 nt, Human
ucauuuggagccuuccuguuuu

SEQ ID NO: 244133 - RNA, 22 nt, Human
uggagcauucagguuucccuuu

SEQ ID NO: 244134 - RNA, 22 nt, Human
uaugaacuuuugaugugacaug

SEQ ID NO: 244135 - RNA, 22 nt, Human
cagugcugacagggaggaaccu

SEQ ID NO: 244136 - RNA, 22 nt, Human
gagcuggucgaaaugggcugac

SEQ ID NO: 244137 - RNA, 22 nt, Human
aggccagcgcugcuagcucccg

SEQ ID NO: 244138 - RNA, 22 nt, Human
uguccuuuucuuuagugcagcu

SEQ ID NO: 244139 - RNA, 22 nt, Human
ccaggaagcugugagauuccaa

SEQ ID NO: 244140 - RNA, 22 nt, Human
cucccuggcacagcgagagguu

SEQ ID NO: 244141 - RNA, 22 nt, Human
uguucacaggggagccauuuau

SEQ ID NO: 244142 - RNA, 22 nt, Human
ucucagaaaaaggagaaacugg

SEQ ID NO: 244143 - RNA, 22 nt, Human
auugucuuuccacugagaaguu

SEQ ID NO: 244144 - RNA, 22 nt, Human
caggcccagaggccucuuccca

SEQ ID NO: 244145 - RNA, 22 nt, Human
aaauuguaaugacuucacuuga

SEQ ID NO: 244146 - RNA, 22 nt, Human
ucaaaugcggucauggcuuuua

SEQ ID NO: 244147 - RNA, 22 nt, Human
gcugaagggagugcugagucug

SEQ ID NO: 244148 - RNA, 22 nt, Human
aauguuuuagauuacugcuggg

SEQ ID NO: 244149 - RNA, 22 nt, Human
agguccaguugccagaauggcc

SEQ ID NO: 244150 - RNA, 22 nt, Human
ccugaaaugacuccagcugagu

SEQ ID NO: 244151 - RNA, 22 nt, Human
auccugugcaaugacugcaucu

SEQ ID NO: 244152 - RNA, 22 nt, Human
gagcagcucugugccuggagac

SEQ ID NO: 244153 - RNA, 21 nt, Human
ggcuugucaccauagcuacug

SEQ ID NO: 244154 - RNA, 22 nt, Human
agagccaggaugucuucugggg

SEQ ID NO: 244155 - RNA, 20 nt, Human
cucagcagauucuucuagaa

SEQ ID NO: 244156 - RNA, 22 nt, Human
uaggagcuauaaugugaagucu

SEQ ID NO: 244157 - RNA, 22 nt, Human
caggcauggaaaagcccagagg

SEQ ID NO: 244158 - RNA, 18 nt, Human
agcuggggccucuggucc

SEQ ID NO: 244159 - RNA, 22 nt, Human
aucauaauugcuccagugauau

SEQ ID NO: 244160 - RNA, 22 nt, Human
ucuggcugucauuggaggcccc

SEQ ID NO: 244161 - RNA, 22 nt, Human
gccaggugggagacagacagca

SEQ ID NO: 244162 - RNA, 22 nt, Human
uccagagcugggucugugcuca

SEQ ID NO: 244163 - RNA, 22 nt, Human
uuccuccacgugacaggagcca

SEQ ID NO: 244164 - RNA, 15 nt, Human
aagaaucugaagcuu

SEQ ID NO: 244165 - RNA, 22 nt, Human
gaggagccauagauagugcugc

SEQ ID NO: 244166 - RNA, 22 nt, Human
uguguucugaaggagaagagug

SEQ ID NO: 244167 - RNA, 15 nt, Human
uuucaaaaugaggcc

SEQ ID NO: 244168 - RNA, 23 nt, Human
uuucacauuuacuguuagauggc

SEQ ID NO: 244169 - RNA, 22 nt, Human
aaucagaaucaguugacacagc

SEQ ID NO: 244170 - RNA, 22 nt, Human
uugggcuggcccuugucucugg

SEQ ID NO: 244171 - RNA, 22 nt, Human
cuacuuccagggguggggcuca

SEQ ID NO: 244172 - RNA, 21 nt, Human
cuucuuggggagcagcuagac

SEQ ID NO: 244173 - RNA, 22 nt, Human
cagcucagcuuccugggugugu

SEQ ID NO: 244174 - RNA, 22 nt, Human
gaggagcuugugagaagauguc

SEQ ID NO: 244175 - RNA, 22 nt, Human
uauugagaacccucaggaggca

SEQ ID NO: 244176 - RNA, 22 nt, Human
acaggcugccuaccaaguauca

SEQ ID NO: 244177 - RNA, 22 nt, Human
cagcaaagguagaagcacagga

SEQ ID NO: 244178 - RNA, 18 nt, Human
guggccagccuggucuug

SEQ ID NO: 244179 - RNA, 22 nt, Human
aaagugggaacaauggagagug

SEQ ID NO: 244180 - RNA, 20 nt, Human
ggaaggggcaaaguguguga

SEQ ID NO: 244181 - RNA, 22 nt, Human
auuuagaagcuaauuuuucaga

SEQ ID NO: 244182 - RNA, 22 nt, Human
ucagaggacaagcucccuggug

SEQ ID NO: 244183 - RNA, 22 nt, Human
agcacagagguggaaguguaua

SEQ ID NO: 244184 - RNA, 22 nt, Human
uccugggagcaugaagagggau

SEQ ID NO: 244185 - RNA, 22 nt, Human
caugcuaaaauaucugaagauu

SEQ ID NO: 244186 - RNA, 22 nt, Human
aggcugggaaauguagucuucc

SEQ ID NO: 244187 - RNA, 22 nt, Human
uuccuaaucacgaacauuauuu

SEQ ID NO: 244188 - RNA, 22 nt, Human
gauggcaggcaggugaguagag

SEQ ID NO: 244189 - RNA, 22 nt, Human
ugugcccagacugccucaguga

SEQ ID NO: 244190 - RNA, 22 nt, Human
uaagaacaagauguuccuguuu

SEQ ID NO: 244191 - RNA, 22 nt, Human
caguguacuuggaauguaacag

SEQ ID NO: 244192 - RNA, 22 nt, Human
acuggcuuugccucugccucuc

SEQ ID NO: 244193 - RNA, 22 nt, Human
cuccuccaguccuccaaggaca

SEQ ID NO: 244194 - RNA, 22 nt, Human
aguguuacuacagacugguuaa

SEQ ID NO: 244195 - RNA, 21 nt, Human
ggccuaggggcagauggugcu

SEQ ID NO: 244196 - RNA, 22 nt, Human
caggcuugggagcagagccacu

SEQ ID NO: 244197 - RNA, 22 nt, Human
gaauuuucagguagcaauuuca

SEQ ID NO: 244198 - RNA, 22 nt, Human
aggcaguggagcuggaauaggc

SEQ ID NO: 244199 - RNA, 22 nt, Human
cuaaagaagcuagcaaucuaua

SEQ ID NO: 244200 - RNA, 22 nt, Human
agcuggguggccucuccucggg

SEQ ID NO: 244201 - RNA, 22 nt, Human
ugggguccagugccaccccaag

SEQ ID NO: 244202 - RNA, 22 nt, Human
aggcuucuccacauaaaguuac

SEQ ID NO: 244203 - RNA, 22 nt, Human
uccuggauggagcugcccucgc

SEQ ID NO: 244204 - RNA, 23 nt, Human
auuccagagcuagagucaagugg

SEQ ID NO: 244205 - RNA, 22 nt, Human
gaaauaguacagcauaguucuu

SEQ ID NO: 244206 - RNA, 22 nt, Human
aucuaagacaaugagugagacu

SEQ ID NO: 244207 - RNA, 22 nt, Human
ugcagguggauaucucaucaga

SEQ ID NO: 244208 - RNA, 22 nt, Human
agcuggcuggccccuuccugcc

SEQ ID NO: 244209 - RNA, 22 nt, Human
ucaggcagguggcuggcuaugg

SEQ ID NO: 244210 - RNA, 22 nt, Human
accauuuaauaaguauuuccau

SEQ ID NO: 244211 - RNA, 22 nt, Human
ugcauauuuguaugauguuuag

SEQ ID NO: 244212 - RNA, 22 nt, Human
agggcugcugcuccgggcccag

SEQ ID NO: 244213 - RNA, 22 nt, Human
guccuucaagaguccccuacug

SEQ ID NO: 244214 - RNA, 22 nt, Human
ucacaagaauuuguagaugaaa

SEQ ID NO: 244215 - RNA, 22 nt, Human
acaggccugaugccuuggcugg

SEQ ID NO: 244216 - RNA, 18 nt, Human
uugagucuagccauggaa

SEQ ID NO: 244217 - RNA, 22 nt, Human
caagacauugauuuuguacaga

SEQ ID NO: 244218 - RNA, 22 nt, Human
ucagaagcaagcuucuacuucu

SEQ ID NO: 244219 - RNA, 22 nt, Human
agggacuugaugucagggagau

SEQ ID NO: 244220 - RNA, 22 nt, Human
cugccuguggacacccuggagg

SEQ ID NO: 244221 - RNA, 22 nt, Human
caaagugcugagauuacaggua

SEQ ID NO: 244222 - RNA, 22 nt, Human
aauuaaaugacaggggaagaug

SEQ ID NO: 244223 - RNA, 22 nt, Human
uccuagaacuccaggacagucc

SEQ ID NO: 244224 - RNA, 22 nt, Human
ccaggcacaggugggccucaga

SEQ ID NO: 244225 - RNA, 22 nt, Human
guguuacugggaggacggaggu

SEQ ID NO: 244226 - RNA, 22 nt, Human
ggcucugccacuucuuggcugu

SEQ ID NO: 244227 - RNA, 22 nt, Human
gagaaaaucuugggucaagaau

SEQ ID NO: 244228 - RNA, 19 nt, Human
uccagcuguuuugagucac

SEQ ID NO: 244229 - RNA, 22 nt, Human
ggaaguagaaguaaugaaauca

SEQ ID NO: 244230 - RNA, 21 nt, Human
uuuggcaguuucccaggaaau

SEQ ID NO: 244231 - RNA, 22 nt, Human
ugacaggcguuuuucucuagua

SEQ ID NO: 244232 - RNA, 22 nt, Human
ccagcccuuagauaaaccuggc

SEQ ID NO: 244233 - RNA, 22 nt, Human
uauuguauuaaggauucaagua

SEQ ID NO: 244234 - RNA, 22 nt, Human
aucuuucuauuucuaaaaacua

SEQ ID NO: 244235 - RNA, 22 nt, Human
ucgaggcagugcgcuggcuguu

SEQ ID NO: 244236 - RNA, 22 nt, Human
ugguccugcuacaggggauuag

SEQ ID NO: 244237 - RNA, 22 nt, Human
uguagcuauagaggcuguaccu

SEQ ID NO: 244238 - RNA, 22 nt, Human
aaagcagagaucauggcuugua

SEQ ID NO: 244239 - RNA, 22 nt, Human
uaggggaagucucagaaugcag

SEQ ID NO: 244240 - RNA, 22 nt, Human
auguguguguuuaauccucaaa

SEQ ID NO: 244241 - RNA, 22 nt, Human
caccuguuagcucuaauuuucu

SEQ ID NO: 244242 - RNA, 22 nt, Human
cagcuguugucaccucacaucc

SEQ ID NO: 244243 - RNA, 22 nt, Human
agagugggccuagcuguaaaag

SEQ ID NO: 244244 - RNA, 18 nt, Human
ugcuuggagcauuuacca

SEQ ID NO: 244245 - RNA, 22 nt, Human
aaaaucuaaguagcgaguaagg

SEQ ID NO: 244246 - RNA, 22 nt, Human
cugggccuuagggcacucccuu

SEQ ID NO: 244247 - RNA, 22 nt, Human
gaaggcuauaugacucagcccu

SEQ ID NO: 244248 - RNA, 20 nt, Human
uccagggcaaacucaucacc

SEQ ID NO: 244249 - RNA, 22 nt, Human
gagagcugggggacuguggaug

SEQ ID NO: 244250 - RNA, 22 nt, Human
uggaaucuugcgggcacauggc

SEQ ID NO: 244251 - RNA, 22 nt, Human
gccagggugagggcugagaggu

SEQ ID NO: 244252 - RNA, 22 nt, Human
aguucagcuucccaggucacug

SEQ ID NO: 244253 - RNA, 22 nt, Human
gcugagugagguccagagcuug

SEQ ID NO: 244254 - RNA, 22 nt, Human
uacauggugguggcacuugacu

SEQ ID NO: 244255 - RNA, 22 nt, Human
gcugcccugugguccagcaggu

SEQ ID NO: 244256 - RNA, 22 nt, Human
guucacaguguuuucuuugcau

SEQ ID NO: 244257 - RNA, 22 nt, Human
auguccagggcacacagcagug

SEQ ID NO: 244258 - RNA, 22 nt, Human
gcuuuuaauuaguugcuuccau

SEQ ID NO: 244259 - RNA, 22 nt, Human
uugaaaacuuucuagaccaaga

SEQ ID NO: 244260 - RNA, 20 nt, Human
cuguuugcuaucaugagcug

SEQ ID NO: 244261 - RNA, 22 nt, Human
agucugguaaacugaaaaauau

SEQ ID NO: 244262 - RNA, 22 nt, Human
cuucucugacagucuguuucac

SEQ ID NO: 244263 - RNA, 22 nt, Human
agucagugggcuuggcacagaa

SEQ ID NO: 244264 - RNA, 22 nt, Human
ugcauacacuucaaaugagcau

SEQ ID NO: 244265 - RNA, 22 nt, Human
ugaaggagaaauggaaaguggg

SEQ ID NO: 244266 - RNA, 22 nt, Human
uacacaaaggcacucuguuguu

SEQ ID NO: 244267 - RNA, 21 nt, Human
agagggagaguggcccuucca

SEQ ID NO: 244268 - RNA, 22 nt, Human
guacacauacuauucaaagaga

SEQ ID NO: 244269 - RNA, 22 nt, Human
ggugcugagugagcuagaggcu

SEQ ID NO: 244270 - RNA, 22 nt, Human
ugcagucucuaguuucugaaug

SEQ ID NO: 244271 - RNA, 21 nt, Human
uauugauucaauuucuugagu

SEQ ID NO: 244272 - RNA, 22 nt, Human
auuuauuggaugcuuacuuggg

SEQ ID NO: 244273 - RNA, 21 nt, Human
gcucagcugcuugguuccugu

SEQ ID NO: 244274 - RNA, 22 nt, Human
aagaguuugggcaagucauaaa

SEQ ID NO: 244275 - RNA, 22 nt, Human
uugggaagaauggaggugguua

SEQ ID NO: 244276 - RNA, 22 nt, Human
gccugggacccuuagcucuugg

SEQ ID NO: 244277 - RNA, 22 nt, Human
auggcuuccaaggcccuccgug

SEQ ID NO: 244278 - RNA, 22 nt, Human
cagggccagccgcagcauccac

SEQ ID NO: 244279 - RNA, 22 nt, Human
ugacaggugauugugaacuaag

SEQ ID NO: 244280 - RNA, 22 nt, Human
agugccaggagcaaggagcucc

SEQ ID NO: 244281 - RNA, 19 nt, Human
accaggagacagugagcuu

SEQ ID NO: 244282 - RNA, 22 nt, Human
acugugaugcaguugccaucca

SEQ ID NO: 244283 - RNA, 20 nt, Human
gaggaaccacugggaggaga

SEQ ID NO: 244284 - RNA, 22 nt, Human
gcagguggcagaggugggaucu

SEQ ID NO: 244285 - RNA, 22 nt, Human
gauguacaaguaaaauaugugu

SEQ ID NO: 244286 - RNA, 22 nt, Human
ccagccaguauauuccaaagcc

SEQ ID NO: 244287 - RNA, 22 nt, Human
gccugugcauagcagcggacuc

SEQ ID NO: 244288 - RNA, 22 nt, Human
aaagauuauggaacacacauga

SEQ ID NO: 244289 - RNA, 22 nt, Human
uauacagcuauggcaagacaaa

SEQ ID NO: 244290 - RNA, 19 nt, Human
cuguggcugaccucuggcc

SEQ ID NO: 244291 - RNA, 23 nt, Human
aggauguaggauguauggcagag

SEQ ID NO: 244292 - RNA, 22 nt, Human
aaccugcaguuuuuauucugag

SEQ ID NO: 244293 - RNA, 22 nt, Human
uuguccugcaaccucacauggc

SEQ ID NO: 244294 - RNA, 22 nt, Human
ucuagguggaugaggaacauag

SEQ ID NO: 244295 - RNA, 22 nt, Human
aggugcuguuaacauaugaggu

SEQ ID NO: 244296 - RNA, 22 nt, Human
ugaggcaggacugagcgggaug

SEQ ID NO: 244297 - RNA, 22 nt, Human
uuaguuuauaauucauuucugu

SEQ ID NO: 244298 - RNA, 22 nt, Human
gagggggcgugcaaggcuccgc

SEQ ID NO: 244299 - RNA, 17 nt, Human
agccugccccaugcugc

SEQ ID NO: 244300 - RNA, 22 nt, Human
cccaggcuggauuucgguggca

SEQ ID NO: 244301 - RNA, 19 nt, Human
ugacagagagcaggguggu

SEQ ID NO: 244302 - RNA, 22 nt, Human
augccaguaagucucagcuagg

SEQ ID NO: 244303 - RNA, 23 nt, Human
ggccacugaauuuucugcaucuu

SEQ ID NO: 244304 - RNA, 17 nt, Human
cagugcagauaagugag

SEQ ID NO: 244305 - RNA, 22 nt, Human
aucagugcugggagaugucaga

SEQ ID NO: 244306 - RNA, 22 nt, Human
agagggggcagcggaccaguga

SEQ ID NO: 244307 - RNA, 20 nt, Human
ugcagguguuggagaaggua

SEQ ID NO: 244308 - RNA, 22 nt, Human
uagcuguccagugagucccuuu

SEQ ID NO: 244309 - RNA, 22 nt, Human
uuaguucucaugaauuuuaagu

SEQ ID NO: 244310 - RNA, 22 nt, Human
uaagcucacuguaagaacugau

SEQ ID NO: 244311 - RNA, 22 nt, Human
uaauacuuaccuugcagagucu

SEQ ID NO: 244312 - RNA, 22 nt, Human
uguuuacagcugaucaggcauc

SEQ ID NO: 244313 - RNA, 23 nt, Human
uggacagcagcagcagugucacc

SEQ ID NO: 244314 - RNA, 22 nt, Human
uucugagcugcaacacuaacau

SEQ ID NO: 244315 - RNA, 22 nt, Human
aacuggaaccuuuuauucaguc

SEQ ID NO: 244316 - RNA, 22 nt, Human
uuaacagacauauauauuugua

SEQ ID NO: 244317 - RNA, 22 nt, Human
accuagaauccaucugcuuauu

SEQ ID NO: 244318 - RNA, 20 nt, Human
auuugggacgauuggccacc

SEQ ID NO: 244319 - RNA, 22 nt, Human
accaggccaacagcuaaguuaa

SEQ ID NO: 244320 - RNA, 22 nt, Human
gccaggccugcaagugcuggug

SEQ ID NO: 244321 - RNA, 22 nt, Human
uucuggaagccccagagucaga

SEQ ID NO: 244322 - RNA, 22 nt, Human
ggagcugcacgcucugaagccu

SEQ ID NO: 244323 - RNA, 22 nt, Human
caauguacuacaaagauuguca

SEQ ID NO: 244324 - RNA, 22 nt, Human
acaagcauaagugagaugaaua

SEQ ID NO: 244325 - RNA, 22 nt, Human
agacgcuauuuugaggggucua

SEQ ID NO: 244326 - RNA, 19 nt, Human
caucagagggcauaggaug

SEQ ID NO: 244327 - RNA, 22 nt, Human
gugcaaagcuuaacauucugca

SEQ ID NO: 244328 - RNA, 18 nt, Human
uaaaugcauguuaauaac

SEQ ID NO: 244329 - RNA, 22 nt, Human
ggaugcaggaacacagcgaccu

SEQ ID NO: 244330 - RNA, 22 nt, Human
cuaaaggcucagcauucuuuuc

SEQ ID NO: 244331 - RNA, 22 nt, Human
uagaagucucucaagaaacaua

SEQ ID NO: 244332 - RNA, 22 nt, Human
uccacuuuagcaaugauugaau

SEQ ID NO: 244333 - RNA, 22 nt, Human
aaaggcuucucagaaaggccuu

SEQ ID NO: 244334 - RNA, 22 nt, Human
acuucccaggugguguggaguu

SEQ ID NO: 244335 - RNA, 21 nt, Human
uucuccuccaaguugcuccug

SEQ ID NO: 244336 - RNA, 23 nt, Human
acaaguguuuccaauauggcugg

SEQ ID NO: 244337 - RNA, 22 nt, Human
aaagauuauggcauugaaauac

SEQ ID NO: 244338 - RNA, 22 nt, Human
agcagcuggguccggcggagca

SEQ ID NO: 244339 - RNA, 22 nt, Human
ugggaagcugcauuuuaacaag

SEQ ID NO: 244340 - RNA, 17 nt, Human
uggcuucccugggccac

SEQ ID NO: 244341 - RNA, 22 nt, Human
ucagugaaaugcauauucuucg

SEQ ID NO: 244342 - RNA, 22 nt, Human
acccuaauaaucacagacuagu

SEQ ID NO: 244343 - RNA, 22 nt, Human
gaggcucagggaaacagcgcag

SEQ ID NO: 244344 - RNA, 22 nt, Human
uuaugaacaauuucuaggaaug

SEQ ID NO: 244345 - RNA, 22 nt, Human
acugggcuguaaagagaggcaa

SEQ ID NO: 244346 - RNA, 20 nt, Human
aucuucuuggccagcuugcu

SEQ ID NO: 244347 - RNA, 22 nt, Human
uuuaucuguuccucuuggaggc

SEQ ID NO: 244348 - RNA, 22 nt, Human
agggcccugaguugcagcccug

SEQ ID NO: 244349 - RNA, 22 nt, Human
ccaggaggugcuggaagaaagc

SEQ ID NO: 244350 - RNA, 22 nt, Human
gcccacaguguagcagguacuc

SEQ ID NO: 244351 - RNA, 22 nt, Human
ggcccagcugugcuuccagccc

SEQ ID NO: 244352 - RNA, 22 nt, Human
uauauccagaaaaucaguucau

SEQ ID NO: 244353 - RNA, 22 nt, Human
uucugggccaaucucuuaaucu

SEQ ID NO: 244354 - RNA, 22 nt, Human
ucagagugaggcgucaacauga

SEQ ID NO: 244355 - RNA, 22 nt, Human
uccugggauucugcauuucuaa

SEQ ID NO: 244356 - RNA, 18 nt, Human
agcaacagaaacauaugg

SEQ ID NO: 244357 - RNA, 22 nt, Human
ugcuuuaagacacuaaguuuga

SEQ ID NO: 244358 - RNA, 22 nt, Human
aauaacuuuuaaaagacccugg

SEQ ID NO: 244359 - RNA, 22 nt, Human
uauugguagauggagagagaca

SEQ ID NO: 244360 - RNA, 22 nt, Human
agaggcaacauggggaacagau

SEQ ID NO: 244361 - RNA, 22 nt, Human
cacuggguaaauuugaggcuga

SEQ ID NO: 244362 - RNA, 22 nt, Human
augggcucggcgcugcugggau

SEQ ID NO: 244363 - RNA, 22 nt, Human
guuuacauguacucauuauacu

SEQ ID NO: 244364 - RNA, 22 nt, Human
aaacucuaagacacuguacaau

SEQ ID NO: 244365 - RNA, 22 nt, Human
uggacaacauagugagaccuca

SEQ ID NO: 244366 - RNA, 22 nt, Human
ccuuuggagaguuuguuagggg

SEQ ID NO: 244367 - RNA, 21 nt, Human
ccuccaggugauuccgugcuc

SEQ ID NO: 244368 - RNA, 22 nt, Human
aacacaggggguuacaaauugu

SEQ ID NO: 244369 - RNA, 22 nt, Human
cuguuuauucucaucuaaaaug

SEQ ID NO: 244370 - RNA, 22 nt, Human
acuggggccuccuccaugcucu

SEQ ID NO: 244371 - RNA, 22 nt, Human
uuccaggaggagguacuagagg

SEQ ID NO: 244372 - RNA, 22 nt, Human
uuuauuaauguagcauccaugg

SEQ ID NO: 244373 - RNA, 17 nt, Human
ccugggaggaguuauga

SEQ ID NO: 244374 - RNA, 22 nt, Human
acagaugauuuuuaugaaaaca

SEQ ID NO: 244375 - RNA, 22 nt, Human
cagaaucucgacuucuggcccc

SEQ ID NO: 244376 - RNA, 22 nt, Human
aaugaugaguucuaauagaccc

SEQ ID NO: 244377 - RNA, 22 nt, Human
cucccagggucuaggcugcugg

SEQ ID NO: 244378 - RNA, 22 nt, Human
auuuagcaagaguacaaaauaa

SEQ ID NO: 244379 - RNA, 22 nt, Human
caguauuuguucccuaucaaug

SEQ ID NO: 244380 - RNA, 22 nt, Human
cggggcugcucguccuccugug

SEQ ID NO: 244381 - RNA, 22 nt, Human
ucuuuaucaagucuguucuuug

SEQ ID NO: 244382 - RNA, 22 nt, Human
gugugcaggugucagugcagcu

SEQ ID NO: 244383 - RNA, 22 nt, Human
aacucagucauaaagcgaaugc

SEQ ID NO: 244384 - RNA, 22 nt, Human
aauuggcaagcagauuuccacu

SEQ ID NO: 244385 - RNA, 22 nt, Human
gauuucuguaacacuucagaua

SEQ ID NO: 244386 - RNA, 22 nt, Human
uaggggaaagcagaauccugga

SEQ ID NO: 244387 - RNA, 22 nt, Human
ucucugaguaagugacaguuca

SEQ ID NO: 244388 - RNA, 22 nt, Human
uggcucaggaucuaagcagaau

SEQ ID NO: 244389 - RNA, 22 nt, Human
agcauucaaguaauucacuugg

SEQ ID NO: 244390 - RNA, 22 nt, Human
uccucuggcucuuucccuagga

SEQ ID NO: 244391 - RNA, 22 nt, Human
uuaaagaauagugccccuauug

SEQ ID NO: 244392 - RNA, 20 nt, Human
uaaugucaaagucacaaggu

SEQ ID NO: 244393 - RNA, 22 nt, Human
aacacuguaacagcaucauuuu

SEQ ID NO: 244394 - RNA, 22 nt, Human
caugcuaagucauaaaagagua

SEQ ID NO: 244395 - RNA, 22 nt, Human
uaauguguccugaaagcuucug

SEQ ID NO: 244396 - RNA, 22 nt, Human
uggagcugagcaccuccagggc

SEQ ID NO: 244397 - RNA, 22 nt, Human
gcacagcaguggcauaaacaau

SEQ ID NO: 244398 - RNA, 22 nt, Human
acagguguacaaugcaugacag

SEQ ID NO: 244399 - RNA, 22 nt, Human
augcugaaaauuggauuugaau

SEQ ID NO: 244400 - RNA, 20 nt, Human
aacuuguucuaccuguuuca

SEQ ID NO: 244401 - RNA, 20 nt, Human
aggaaaaauggaaacuggag

SEQ ID NO: 244402 - RNA, 22 nt, Human
ggcucugggccuccaaggucug

SEQ ID NO: 244403 - RNA, 22 nt, Human
cugcuguuccaccucugaaugc

SEQ ID NO: 244404 - RNA, 22 nt, Human
cugugucccccucagccaggug

SEQ ID NO: 244405 - RNA, 19 nt, Human
gcuccuggaugaccugugg

SEQ ID NO: 244406 - RNA, 22 nt, Human
agcuugguggcccuccuggcug

SEQ ID NO: 244407 - RNA, 22 nt, Human
uugucaaggcuuuuaauauucu

SEQ ID NO: 244408 - RNA, 22 nt, Human
uuuaccacagaaaaaaguaacu

SEQ ID NO: 244409 - RNA, 18 nt, Human
gccucuguugcuugccug

SEQ ID NO: 244410 - RNA, 22 nt, Human
gggucuggagggcagcccuucu

SEQ ID NO: 244411 - RNA, 22 nt, Human
uuugagaagauaggggaauacu

SEQ ID NO: 244412 - RNA, 22 nt, Human
ugagguggccgaggagcaggac

SEQ ID NO: 244413 - RNA, 22 nt, Human
agcuucuuggcucagcacuugg

SEQ ID NO: 244414 - RNA, 22 nt, Human
gaggugugaugcagaguggugg

SEQ ID NO: 244415 - RNA, 21 nt, Human
cagcaagacauguuuaucaag

SEQ ID NO: 244416 - RNA, 22 nt, Human
gaguccagagauuaagcaccuc

SEQ ID NO: 244417 - RNA, 22 nt, Human
agaguuuggagagggugaggca

SEQ ID NO: 244418 - RNA, 22 nt, Human
uuggccagacugaggugcuggg

SEQ ID NO: 244419 - RNA, 22 nt, Human
cuguuuauuacguaauuaauau

SEQ ID NO: 244420 - RNA, 22 nt, Human
cccaggcucacuguccgcuucc

SEQ ID NO: 244421 - RNA, 22 nt, Human
uagaauauacacuacagcuuaa

SEQ ID NO: 244422 - RNA, 22 nt, Human
gcaugcaggauagguugagcuc

SEQ ID NO: 244423 - RNA, 22 nt, Human
gccuguucuccagcauccaggu

SEQ ID NO: 244424 - RNA, 22 nt, Human
agaaacucauccuggagaugac

SEQ ID NO: 244425 - RNA, 22 nt, Human
gcagaaguggugcugugccacu

SEQ ID NO: 244426 - RNA, 22 nt, Human
gacaggggucccucugggcugu

SEQ ID NO: 244427 - RNA, 22 nt, Human
ucauugaauuucacagcuuuau

SEQ ID NO: 244428 - RNA, 22 nt, Human
cagcugagcugccagacuacug

SEQ ID NO: 244429 - RNA, 17 nt, Human
gcuccuucuaacuucca

SEQ ID NO: 244430 - RNA, 22 nt, Human
aaggcugguuuccuugauguuu

SEQ ID NO: 244431 - RNA, 22 nt, Human
augaacaaugacuacauauuga

SEQ ID NO: 244432 - RNA, 17 nt, Human
guguaacuaugagccau

SEQ ID NO: 244433 - RNA, 22 nt, Human
uuauuuguuuucugagaaguau

SEQ ID NO: 244434 - RNA, 22 nt, Human
ugucucaggcccaagccaguaa

SEQ ID NO: 244435 - RNA, 22 nt, Human
ugcauuaagggccuggagauac

SEQ ID NO: 244436 - RNA, 22 nt, Human
uuuacuguuacaccuaccuucu

SEQ ID NO: 244437 - RNA, 22 nt, Human
ugauguccucaugucaagcucc

SEQ ID NO: 244438 - RNA, 22 nt, Human
ucuuuucuccagaccugggauc

SEQ ID NO: 244439 - RNA, 22 nt, Human
ugcucaaugucuuaugagacug

SEQ ID NO: 244440 - RNA, 22 nt, Human
ccaggccuggaccaugccaggg

SEQ ID NO: 244441 - RNA, 22 nt, Human
uaugagcaagaguuugugaagg

SEQ ID NO: 244442 - RNA, 22 nt, Human
ucaggcugaaucauccuagcuu

SEQ ID NO: 244443 - RNA, 22 nt, Human
gucagcagugucagcucugggg

SEQ ID NO: 244444 - RNA, 22 nt, Human
uggugggggaggcugucuagca

SEQ ID NO: 244445 - RNA, 22 nt, Human
ggccagcuuugagcugcaggaa

SEQ ID NO: 244446 - RNA, 22 nt, Human
cugcagggguguccuguauugg

SEQ ID NO: 244447 - RNA, 23 nt, Human
augcaacauugccaguaugggca

SEQ ID NO: 244448 - RNA, 22 nt, Human
uugggugguggggagaguucag

SEQ ID NO: 244449 - RNA, 22 nt, Human
auagggcagucaggccgccacu

SEQ ID NO: 244450 - RNA, 22 nt, Human
aaguccuucccaagcauguacc

SEQ ID NO: 244451 - RNA, 22 nt, Human
aguuauaaucugcuacugauau

SEQ ID NO: 244452 - RNA, 19 nt, Human
ccagaggacuguuaaugaa

SEQ ID NO: 244453 - RNA, 22 nt, Human
auauaaaguguuuagaaagcug

SEQ ID NO: 244454 - RNA, 22 nt, Human
gaggcugcuguuagcccugggc

SEQ ID NO: 244455 - RNA, 22 nt, Human
uacuuaaauaauugcugcuauu

SEQ ID NO: 244456 - RNA, 22 nt, Human
gggaaggacauucugggcucag

SEQ ID NO: 244457 - RNA, 22 nt, Human
ucaaagccuguggauaguuugg

SEQ ID NO: 244458 - RNA, 22 nt, Human
cuagagaaaccccaugagcuuu

SEQ ID NO: 244459 - RNA, 22 nt, Human
agcccuggggcuggucuuggaa

SEQ ID NO: 244460 - RNA, 23 nt, Human
agggaacaagcaagcugcuaguc

SEQ ID NO: 244461 - RNA, 18 nt, Human
aagcugggaaggagacag

SEQ ID NO: 244462 - RNA, 22 nt, Human
uaaagccaauauaccuagcaua

SEQ ID NO: 244463 - RNA, 22 nt, Human
agagggugcuggagagacauug

SEQ ID NO: 244464 - RNA, 22 nt, Human
gggcugagggguaucucauggg

SEQ ID NO: 244465 - RNA, 22 nt, Human
cugggagaggaaccucgagggu

SEQ ID NO: 244466 - RNA, 20 nt, Human
gucugaggagcagugggaaa

SEQ ID NO: 244467 - RNA, 22 nt, Human
ccaggucucgggucugcucgug

SEQ ID NO: 244468 - RNA, 22 nt, Human
agguccaggcauuuggguuggg

SEQ ID NO: 244469 - RNA, 22 nt, Human
uuugcauugcauuaaguauucu

SEQ ID NO: 244470 - RNA, 22 nt, Human
aguccaggcaaguuguugugua

SEQ ID NO: 244471 - RNA, 22 nt, Human
ugcagggcauaggguccaguuu

SEQ ID NO: 244472 - RNA, 22 nt, Human
aaacauuguaauuuuagcaugg

SEQ ID NO: 244473 - RNA, 22 nt, Human
ggcccagucuggggcccuguga

SEQ ID NO: 244474 - RNA, 22 nt, Human
aaggcaauguaaauuacagcuu

SEQ ID NO: 244475 - RNA, 22 nt, Human
ucagaacagaagcuggcuauaa

SEQ ID NO: 244476 - RNA, 22 nt, Human
ucugccaucuuaauucucuuuu

SEQ ID NO: 244477 - RNA, 23 nt, Human
ugucacauuuaguuggcauuguu

SEQ ID NO: 244478 - RNA, 22 nt, Human
agcccagaggguagcagaagaa

SEQ ID NO: 244479 - RNA, 22 nt, Human
uucugcugcgacccaggaguua

SEQ ID NO: 244480 - RNA, 22 nt, Human
uagucuuuuuaauaaauaaugc

SEQ ID NO: 244481 - RNA, 22 nt, Human
ugucauaaaacacaagcuguug

SEQ ID NO: 244482 - RNA, 21 nt, Human
agccagucugccagagaagcc

SEQ ID NO: 244483 - RNA, 20 nt, Human
ccaagagcaugcaugaggaa

SEQ ID NO: 244484 - RNA, 22 nt, Human
cugccugugccaaugcuccuuu

SEQ ID NO: 244485 - RNA, 18 nt, Human
gucagaggauggggaaau

SEQ ID NO: 244486 - RNA, 22 nt, Human
cugguuuagcuguaagguuccc

SEQ ID NO: 244487 - RNA, 22 nt, Human
ucucugggcuaaaaucaaggug

SEQ ID NO: 244488 - RNA, 22 nt, Human
gaaaaggcugcccacuuauuga

SEQ ID NO: 244489 - RNA, 22 nt, Human
aaguauauacuaaauguuaauc

SEQ ID NO: 244490 - RNA, 22 nt, Human
agauguggccggcuagggagag

SEQ ID NO: 244491 - RNA, 22 nt, Human
gagcuggcagugguagacaugg

SEQ ID NO: 244492 - RNA, 22 nt, Human
aguuauuuaaaaugauuguccu

SEQ ID NO: 244493 - RNA, 22 nt, Human
ucaguaacccugcuguucagag

SEQ ID NO: 244494 - RNA, 22 nt, Human
agauuacaacaugggacgcaua

SEQ ID NO: 244495 - RNA, 22 nt, Human
agcaggaacgaguucaugggga

SEQ ID NO: 244496 - RNA, 22 nt, Human
uacagaggcuggguuuucaggg

SEQ ID NO: 244497 - RNA, 22 nt, Human
augguauuggaguaggacuugc

SEQ ID NO: 244498 - RNA, 22 nt, Human
ucuggaugcucugagcccaagg

SEQ ID NO: 244499 - RNA, 22 nt, Human
ugauuuuuggaucugagcugca

SEQ ID NO: 244500 - RNA, 22 nt, Human
uucauuaauucauucagugacu

SEQ ID NO: 244501 - RNA, 22 nt, Human
uuucugaacuugguacuggagc

SEQ ID NO: 244502 - RNA, 22 nt, Human
caucuaccagaauugcuauaaa

SEQ ID NO: 244503 - RNA, 22 nt, Human
gagccuggauagccuuguucca

SEQ ID NO: 244504 - RNA, 22 nt, Human
agcaguguuuugauucugggag

SEQ ID NO: 244505 - RNA, 17 nt, Human
gcuccaggcgugaguga

SEQ ID NO: 244506 - RNA, 17 nt, Human
cuccuggcagccucagg

SEQ ID NO: 244507 - RNA, 22 nt, Human
uuugacuucuaucuaguaagaa

SEQ ID NO: 244508 - RNA, 22 nt, Human
uuauguuuuaaguguguaucuu

SEQ ID NO: 244509 - RNA, 22 nt, Human
aucugggcguauaggugcaagu

SEQ ID NO: 244510 - RNA, 22 nt, Human
uggcuucuucauaugugaucuu

SEQ ID NO: 244511 - RNA, 22 nt, Human
agaaagggcuauuuugagguag

SEQ ID NO: 244512 - RNA, 22 nt, Human
ccaggcuagagagcaguggcau

SEQ ID NO: 244513 - RNA, 22 nt, Human
aaguggcagaauaguggcagga

SEQ ID NO: 244514 - RNA, 22 nt, Human
uagugaaaugauaacagagcag

SEQ ID NO: 244515 - RNA, 21 nt, Human
aaauacugggcagugacuuga

SEQ ID NO: 244516 - RNA, 22 nt, Human
uggagcccagggugagaaggag

SEQ ID NO: 244517 - RNA, 22 nt, Human
uacauauagacaguuacucuag

SEQ ID NO: 244518 - RNA, 22 nt, Human
uuucaaagucaauaucauuacc

SEQ ID NO: 244519 - RNA, 22 nt, Human
aagcauguacucaagcaaaugu

SEQ ID NO: 244520 - RNA, 22 nt, Human
uaaaguauauuuuuucucaaua

SEQ ID NO: 244521 - RNA, 22 nt, Human
uugaaauggcagcagcugaccu

SEQ ID NO: 244522 - RNA, 22 nt, Human
ugggaccugcucuuggaaugag

SEQ ID NO: 244523 - RNA, 22 nt, Human
ggggcuccagucuucacauuuu

SEQ ID NO: 244524 - RNA, 22 nt, Human
aguccauaguuuacauuacagc

SEQ ID NO: 244525 - RNA, 22 nt, Human
gaucugaagauaugaaauauuu

SEQ ID NO: 244526 - RNA, 22 nt, Human
uugggucuguuuagcugagaag

SEQ ID NO: 244527 - RNA, 22 nt, Human
acaguaaugauaaccagcauuu

SEQ ID NO: 244528 - RNA, 22 nt, Human
acuuuagagaaauguagaagua

SEQ ID NO: 244529 - RNA, 22 nt, Human
ucauuuguugaacuuuagugcg

SEQ ID NO: 244530 - RNA, 22 nt, Human
ugguccagacauuucugaggua

SEQ ID NO: 244531 - RNA, 22 nt, Human
cugggucuccggcagccucggg

SEQ ID NO: 244532 - RNA, 22 nt, Human
agguggcugaagagugggugag

SEQ ID NO: 244533 - RNA, 20 nt, Human
cuucuucaguaguuuguucu

SEQ ID NO: 244534 - RNA, 18 nt, Human
ggcuucucuguuuauuuc

SEQ ID NO: 244535 - RNA, 22 nt, Human
aaggugguaauagugcaggauu

SEQ ID NO: 244536 - RNA, 22 nt, Human
cuucuuucaagaauggauuagg

SEQ ID NO: 244537 - RNA, 22 nt, Human
gcugagcacaccuaggguagag

SEQ ID NO: 244538 - RNA, 21 nt, Human
gccuccagccagauggccucc

SEQ ID NO: 244539 - RNA, 22 nt, Human
acaauuucugaucagugaauuu

SEQ ID NO: 244540 - RNA, 22 nt, Human
uuccaauaaaauguuauuugca

SEQ ID NO: 244541 - RNA, 22 nt, Human
cccaccucucagagagccuugc

SEQ ID NO: 244542 - RNA, 22 nt, Human
acacaccaugauuuauuuaccc

SEQ ID NO: 244543 - RNA, 22 nt, Human
ggcaggcucagcagccaaggag

SEQ ID NO: 244544 - RNA, 19 nt, Human
gcaggugugaauccguaga

SEQ ID NO: 244545 - RNA, 22 nt, Human
gcagcugagcgugaggaagagu

SEQ ID NO: 244546 - RNA, 22 nt, Human
agcucuggaacucccggcugcu

SEQ ID NO: 244547 - RNA, 22 nt, Human
cuguauaugugcauacacacac

SEQ ID NO: 244548 - RNA, 22 nt, Human
uugauuuuuccagcuucuagag

SEQ ID NO: 244549 - RNA, 22 nt, Human
ucagguggcuuggagggggacg

SEQ ID NO: 244550 - RNA, 22 nt, Human
cuucauuaacuauuggaaugca

SEQ ID NO: 244551 - RNA, 20 nt, Human
auacacaugcagacagaugc

SEQ ID NO: 244552 - RNA, 22 nt, Human
ucuggggugugaccugagcaug

SEQ ID NO: 244553 - RNA, 22 nt, Human
ugcuuuauuuuaaauaugccau

SEQ ID NO: 244554 - RNA, 18 nt, Human
aggcaggugcuggaaguc

SEQ ID NO: 244555 - RNA, 19 nt, Human
gcaugcuugguggcuucug

SEQ ID NO: 244556 - RNA, 22 nt, Human
aagaaaacaugaucuaauuuaa

SEQ ID NO: 244557 - RNA, 22 nt, Human
cuccugggagucuuccuggaug

SEQ ID NO: 244558 - RNA, 22 nt, Human
agaggcugggaaggguccccgg

SEQ ID NO: 244559 - RNA, 22 nt, Human
uccuuucuccagcuggcauugu

SEQ ID NO: 244560 - RNA, 22 nt, Human
ucagaaguugauaaaguaguug

SEQ ID NO: 244561 - RNA, 22 nt, Human
auauauuuacucuccuguugca

SEQ ID NO: 244562 - RNA, 22 nt, Human
uagaaacaugagagaaacucuu

SEQ ID NO: 244563 - RNA, 22 nt, Human
ucauacaucuguccuggagcuc

SEQ ID NO: 244564 - RNA, 22 nt, Human
aaaucuaggccgggugcggugg

SEQ ID NO: 244565 - RNA, 22 nt, Human
uucuucuugucugcccucacau

SEQ ID NO: 244566 - RNA, 22 nt, Human
aagaguuuaccagugcugcuuc

SEQ ID NO: 244567 - RNA, 22 nt, Human
guggcuggaguaugaggaaagg

SEQ ID NO: 244568 - RNA, 22 nt, Human
auucuucaccugagucagucua

SEQ ID NO: 244569 - RNA, 22 nt, Human
guguguccuguuuuaaaauagu

SEQ ID NO: 244570 - RNA, 22 nt, Human
aagugguaggaagagagcacug

SEQ ID NO: 244571 - RNA, 20 nt, Human
auuagcuuggagacaguggc

SEQ ID NO: 244572 - RNA, 22 nt, Human
gccugugacccagggcccagga

SEQ ID NO: 244573 - RNA, 22 nt, Human
cugccagccaggccagguaggc

SEQ ID NO: 244574 - RNA, 22 nt, Human
agagccagagaccuggguucac

SEQ ID NO: 244575 - RNA, 22 nt, Human
cccugcaggcucagacuggagu

SEQ ID NO: 244576 - RNA, 22 nt, Human
uuggcagagaguaugcugaaga

SEQ ID NO: 244577 - RNA, 22 nt, Human
auauuucagguuuugcaggccg

SEQ ID NO: 244578 - RNA, 22 nt, Human
ucaggccuagaacacagcagau

SEQ ID NO: 244579 - RNA, 22 nt, Human
uauguagguaaacacagacaua

SEQ ID NO: 244580 - RNA, 22 nt, Human
aauucaaauuugaguuugugau

SEQ ID NO: 244581 - RNA, 22 nt, Human
gaaucaaaucaaguucuuuuga

SEQ ID NO: 244582 - RNA, 22 nt, Human
cuggccuuuuguuucuggagaa

SEQ ID NO: 244583 - RNA, 22 nt, Human
aguaaaauuucugcugaggaga

SEQ ID NO: 244584 - RNA, 22 nt, Human
ugucauuuauucucuuauucua

SEQ ID NO: 244585 - RNA, 22 nt, Human
ccucaggcugggcugccccugg

SEQ ID NO: 244586 - RNA, 22 nt, Human
ucaaagcaucagucaauuuagg

SEQ ID NO: 244587 - RNA, 22 nt, Human
gaaaacacuuugaucugaaagu

SEQ ID NO: 244588 - RNA, 22 nt, Human
caggcugcggccgugugagcau

SEQ ID NO: 244589 - RNA, 22 nt, Human
auggaugaaggcgaggaugagg

SEQ ID NO: 244590 - RNA, 22 nt, Human
agccucugcuggcccuggcacu

SEQ ID NO: 244591 - RNA, 22 nt, Human
agaacaaaauuagaggagugca

SEQ ID NO: 244592 - RNA, 22 nt, Human
agggcuccaaggaaguguagcu

SEQ ID NO: 244593 - RNA, 22 nt, Human
gcagggcagaaggugcugagga

SEQ ID NO: 244594 - RNA, 22 nt, Human
agcugcugccucacuggucugu

SEQ ID NO: 244595 - RNA, 22 nt, Human
ccagagaccagaacauggggau

SEQ ID NO: 244596 - RNA, 22 nt, Human
auccauuuuuucagaaugcucu

SEQ ID NO: 244597 - RNA, 22 nt, Human
auuuguucacaaucagggcagg

SEQ ID NO: 244598 - RNA, 22 nt, Human
auuggccauuugcauguauuau

SEQ ID NO: 244599 - RNA, 22 nt, Human
guccaggccugccucugaggag

SEQ ID NO: 244600 - RNA, 21 nt, Human
uuuguucaggggcaaaguuaa

SEQ ID NO: 244601 - RNA, 22 nt, Human
aggccagggcacugcucuuuag

SEQ ID NO: 244602 - RNA, 22 nt, Human
auguucaaacuuuuuacacacc

SEQ ID NO: 244603 - RNA, 22 nt, Human
agaaucugcauuucuaauaagc

SEQ ID NO: 244604 - RNA, 22 nt, Human
agugucugccagcugccaggug

SEQ ID NO: 244605 - RNA, 22 nt, Human
ccucccuccauugccaucgucu

SEQ ID NO: 244606 - RNA, 22 nt, Human
gcagagccccucaagccagccu

SEQ ID NO: 244607 - RNA, 22 nt, Human
ucacacagcagccccggguguu

SEQ ID NO: 244608 - RNA, 22 nt, Human
augucacuccagggacacaggu

SEQ ID NO: 244609 - RNA, 22 nt, Human
cuuuaaauaauacaagguccag

SEQ ID NO: 244610 - RNA, 22 nt, Human
aaaagcaaguugccuagguuga

SEQ ID NO: 244611 - RNA, 22 nt, Human
uauugauucugucccaaguuga

SEQ ID NO: 244612 - RNA, 22 nt, Human
ugaggcuugauuugcccgagag

SEQ ID NO: 244613 - RNA, 22 nt, Human
cuguaucuguguuggaugaguu

SEQ ID NO: 244614 - RNA, 22 nt, Human
ccugccuggcugucagcagagc

SEQ ID NO: 244615 - RNA, 22 nt, Human
ggcaggugugagaucgaggcca

SEQ ID NO: 244616 - RNA, 22 nt, Human
caggaguguuugcuacaguuuc

SEQ ID NO: 244617 - RNA, 22 nt, Human
gugaaaagcaacauuguggacc

SEQ ID NO: 244618 - RNA, 22 nt, Human
gcagggcuguaauuugagccug

SEQ ID NO: 244619 - RNA, 22 nt, Human
uagaaagucaugaauuacacca

SEQ ID NO: 244620 - RNA, 22 nt, Human
ggccugacauuugcaucaacac

SEQ ID NO: 244621 - RNA, 22 nt, Human
agugagaguauuaaugugaacu

SEQ ID NO: 244622 - RNA, 22 nt, Human
guggcugcagcccagcggcacg

SEQ ID NO: 244623 - RNA, 22 nt, Human
agacaugccaagaaacccagug

SEQ ID NO: 244624 - RNA, 22 nt, Human
uccagccauaucuuguagcccu

SEQ ID NO: 244625 - RNA, 22 nt, Human
ggucuggcacucaugcagcagg

SEQ ID NO: 244626 - RNA, 22 nt, Human
agcagggcagugcuucagcucu

SEQ ID NO: 244627 - RNA, 22 nt, Human
uagaaaccucagggaaaucuuu

SEQ ID NO: 244628 - RNA, 22 nt, Human
cacagcugccaugcagucagug

SEQ ID NO: 244629 - RNA, 22 nt, Human
ugucaugguauuugugagcugc

SEQ ID NO: 244630 - RNA, 22 nt, Human
accuccuggcugcucauggaac

SEQ ID NO: 244631 - RNA, 22 nt, Human
gguaauaaaauugugucaaaca

SEQ ID NO: 244632 - RNA, 22 nt, Human
cucugugggccagagaggcccc

SEQ ID NO: 244633 - RNA, 22 nt, Human
acaguggcagucguguucucua

SEQ ID NO: 244634 - RNA, 22 nt, Human
aggaauguaguuugaguagaaa

SEQ ID NO: 244635 - RNA, 22 nt, Human
ugcagggauccuagcugaagag

SEQ ID NO: 244636 - RNA, 19 nt, Human
cccaguccuuguccugggc

SEQ ID NO: 244637 - RNA, 22 nt, Human
cagcacaguuugcuuggcagag

SEQ ID NO: 244638 - RNA, 22 nt, Human
agcaauuauggaguuguugacg

SEQ ID NO: 244639 - RNA, 22 nt, Human
ucagaggagaaguugggaaaau

SEQ ID NO: 244640 - RNA, 22 nt, Human
ucugggagaguagauaaaggaa

SEQ ID NO: 244641 - RNA, 22 nt, Human
cacccugggcugggccuguuaa

SEQ ID NO: 244642 - RNA, 22 nt, Human
ggcuguguuccaagugucagga

SEQ ID NO: 244643 - RNA, 20 nt, Human
gaaggcuuggacagugacag

SEQ ID NO: 244644 - RNA, 22 nt, Human
cuuauauuuuaggaacagacaa

SEQ ID NO: 244645 - RNA, 22 nt, Human
agaguuuggagguguuccugga

SEQ ID NO: 244646 - RNA, 23 nt, Human
ugggcuucugagaaagcaccuaa

SEQ ID NO: 244647 - RNA, 22 nt, Human
uuuaguauguauuuaauggacu

SEQ ID NO: 244648 - RNA, 22 nt, Human
ggagggggaauucagccccagc

SEQ ID NO: 244649 - RNA, 22 nt, Human
ggaagaggaggagccaggcuuu

SEQ ID NO: 244650 - RNA, 22 nt, Human
aaaaugagacacaugugacucc

SEQ ID NO: 244651 - RNA, 22 nt, Human
acugagcucccugagggcaggc

SEQ ID NO: 244652 - RNA, 22 nt, Human
caugccugccuggugggcgugg

SEQ ID NO: 244653 - RNA, 22 nt, Human
cauuuacauaacaguaacgcug

SEQ ID NO: 244654 - RNA, 22 nt, Human
cuuucuaguugacagcaugcca

SEQ ID NO: 244655 - RNA, 18 nt, Human
gggaagccgggaagccgg

SEQ ID NO: 244656 - RNA, 22 nt, Human
auauuuuuccaugugggacucu

SEQ ID NO: 244657 - RNA, 22 nt, Human
ucuguucaucaucuggacacau

SEQ ID NO: 244658 - RNA, 22 nt, Human
aaaguguuaugcaaaacucugu

SEQ ID NO: 244659 - RNA, 22 nt, Human
aaggugucauuguuuauggaga

SEQ ID NO: 244660 - RNA, 22 nt, Human
auaugaagucagacaaacuggg

SEQ ID NO: 244661 - RNA, 22 nt, Human
ucaggcuuuuucucaaccucuu

SEQ ID NO: 244662 - RNA, 22 nt, Human
gaggugguuuguggugacucau

SEQ ID NO: 244663 - RNA, 21 nt, Human
acuuucuguggguucaagcau

SEQ ID NO: 244664 - RNA, 22 nt, Human
ccaggcaggcagcguucucagg

SEQ ID NO: 244665 - RNA, 22 nt, Human
cagcugcagaucauguuuacag

SEQ ID NO: 244666 - RNA, 22 nt, Human
uaacuguagcuaaccgaugaga

SEQ ID NO: 244667 - RNA, 22 nt, Human
auaauagcuaacacagagugcu

SEQ ID NO: 244668 - RNA, 22 nt, Human
ucuccaggggcagggucuggag

SEQ ID NO: 244669 - RNA, 22 nt, Human
gguaacacaggugcaguuuuaa

SEQ ID NO: 244670 - RNA, 22 nt, Human
gaagcuggggugcugagggcaa

SEQ ID NO: 244671 - RNA, 17 nt, Human
cagugcagagcccuuuc

SEQ ID NO: 244672 - RNA, 22 nt, Human
ucaguauccacaaaugcucaaa

SEQ ID NO: 244673 - RNA, 22 nt, Human
uggcccugggcaucuuucguga

SEQ ID NO: 244674 - RNA, 22 nt, Human
aagucguggcaggcuugcacga

SEQ ID NO: 244675 - RNA, 22 nt, Human
agccuuagagacuuaaaacagg

SEQ ID NO: 244676 - RNA, 22 nt, Human
auggcaguugcccagccaaucc

SEQ ID NO: 244677 - RNA, 22 nt, Human
agguucuggcauugcucaguaa

SEQ ID NO: 244678 - RNA, 22 nt, Human
acuuuaaagcagaauggcuaug

SEQ ID NO: 244679 - RNA, 22 nt, Human
guggggaaaggaguggggcuca

SEQ ID NO: 244680 - RNA, 22 nt, Human
ggcuacuagacuuugauacuag

SEQ ID NO: 244681 - RNA, 22 nt, Human
agugcccugcuggggcaggaga

SEQ ID NO: 244682 - RNA, 22 nt, Human
ucucagggcgcagugaggcagu

SEQ ID NO: 244683 - RNA, 22 nt, Human
gagcacagaaucuucccaugca

SEQ ID NO: 244684 - RNA, 22 nt, Human
guauuaggugguggaauuguag

SEQ ID NO: 244685 - RNA, 22 nt, Human
aaauguauccuacuuccugagu

SEQ ID NO: 244686 - RNA, 22 nt, Human
ucugucuucuguagcuaauaau

SEQ ID NO: 244687 - RNA, 22 nt, Human
uacauucuacuuuuucacuccc

SEQ ID NO: 244688 - RNA, 22 nt, Human
uuccaaaguuaguuauuagaaa

SEQ ID NO: 244689 - RNA, 22 nt, Human
cauaauuagagaauucauguua

SEQ ID NO: 244690 - RNA, 19 nt, Human
auuaacaucaguguuggcc

SEQ ID NO: 244691 - RNA, 22 nt, Human
acaaaaagcuccauuacugucc

SEQ ID NO: 244692 - RNA, 22 nt, Human
gaauaacauuuuuuccuuuaca

SEQ ID NO: 244693 - RNA, 22 nt, Human
gaacauuugaugaugacauugg

SEQ ID NO: 244694 - RNA, 22 nt, Human
cagauggaaggcauagagguuu

SEQ ID NO: 244695 - RNA, 22 nt, Human
uuacugcaacauaauguagucu

SEQ ID NO: 244696 - RNA, 22 nt, Human
guuauauucaaaaugaggcugu

SEQ ID NO: 244697 - RNA, 22 nt, Human
acuuggcugggagaguugaaga

SEQ ID NO: 244698 - RNA, 22 nt, Human
uucugccaucugcagaagggga

SEQ ID NO: 244699 - RNA, 22 nt, Human
caguuuuugccauuaagaguaa

SEQ ID NO: 244700 - RNA, 22 nt, Human
ucuagagcuggaguagaaugug

SEQ ID NO: 244701 - RNA, 22 nt, Human
aauguacaauaagacaaagagg

SEQ ID NO: 244702 - RNA, 17 nt, Human
gaauuucuuggucaaaa

SEQ ID NO: 244703 - RNA, 22 nt, Human
cuggcagcauggagccugugcu

SEQ ID NO: 244704 - RNA, 19 nt, Human
ugagacagaagaugagccu

SEQ ID NO: 244705 - RNA, 22 nt, Human
uuacucugaauguuucuacuga

SEQ ID NO: 244706 - RNA, 22 nt, Human
ucugauuagagcauucuugagu

SEQ ID NO: 244707 - RNA, 14 nt, Human
uccacaucagcagu

SEQ ID NO: 244708 - RNA, 22 nt, Human
agguggcagcaggagaugugga

SEQ ID NO: 244709 - RNA, 22 nt, Human
auguggauguuuauaugaagaa

SEQ ID NO: 244710 - RNA, 22 nt, Human
cugccuggccacaacccagggu

SEQ ID NO: 244711 - RNA, 22 nt, Human
ucauaaacacacuaguaugauu

SEQ ID NO: 244712 - RNA, 22 nt, Human
uguguguguuccuccucagcua

SEQ ID NO: 244713 - RNA, 22 nt, Human
uacauucaaacgauuuauugau

SEQ ID NO: 244714 - RNA, 22 nt, Human
uguaaaauaccauuccuuguca

SEQ ID NO: 244715 - RNA, 22 nt, Human
ugggacagugugccuugcuccu

SEQ ID NO: 244716 - RNA, 22 nt, Human
ccagguggugccucuguucgca

SEQ ID NO: 244717 - RNA, 22 nt, Human
augcuuucucuuaguucauuga

SEQ ID NO: 244718 - RNA, 21 nt, Human
gaaagcacagaaaggacucuu

SEQ ID NO: 244719 - RNA, 21 nt, Human
acuguucaucuguucagaagc

SEQ ID NO: 244720 - RNA, 17 nt, Human
ugcuccuguggcagccu

SEQ ID NO: 244721 - RNA, 18 nt, Human
uaugagaagauuagcaau

SEQ ID NO: 244722 - RNA, 22 nt, Human
gauauuuacauuaagcacauug

SEQ ID NO: 244723 - RNA, 22 nt, Human
ucuuguuuggauuuugggcagu

SEQ ID NO: 244724 - RNA, 22 nt, Human
agagcuguucaacguagcaaug

SEQ ID NO: 244725 - RNA, 22 nt, Human
guugaauaucccguaucuuaaa

SEQ ID NO: 244726 - RNA, 22 nt, Human
aauuuuauuaacuggauguagc

SEQ ID NO: 244727 - RNA, 22 nt, Human
gucugggcuuagggacauggca

SEQ ID NO: 244728 - RNA, 22 nt, Human
ucagggcacguuucugcaaugc

SEQ ID NO: 244729 - RNA, 22 nt, Human
ugggaugagcuauauagaaagu

SEQ ID NO: 244730 - RNA, 22 nt, Human
cauuuccacucugggagucaga

SEQ ID NO: 244731 - RNA, 22 nt, Human
acuuauuucauggaucauaaug

SEQ ID NO: 244732 - RNA, 22 nt, Human
gucuuucuuaaacaacagaaca

SEQ ID NO: 244733 - RNA, 22 nt, Human
caguaccagucaccacauugau

SEQ ID NO: 244734 - RNA, 22 nt, Human
uagcuucugggaguguuuacua

SEQ ID NO: 244735 - RNA, 22 nt, Human
guauuaggagguggagccuuug

SEQ ID NO: 244736 - RNA, 22 nt, Human
ucacaauauuuaucuuccaauu

SEQ ID NO: 244737 - RNA, 22 nt, Human
ucuccugggugcuuuaucagaa

SEQ ID NO: 244738 - RNA, 22 nt, Human
aaagugguuucccaguucagua

SEQ ID NO: 244739 - RNA, 22 nt, Human
ccuguucagagcuaagcaucau

SEQ ID NO: 244740 - RNA, 22 nt, Human
cacagcaggcagaacgugggca

SEQ ID NO: 244741 - RNA, 22 nt, Human
gggcagcaggcuccacguuccu

SEQ ID NO: 244742 - RNA, 22 nt, Human
cauauauuauggacugcagaau

SEQ ID NO: 244743 - RNA, 19 nt, Human
ucucuggcuugucugccug

SEQ ID NO: 244744 - RNA, 20 nt, Human
gugcagauguccuuucacac

SEQ ID NO: 244745 - RNA, 22 nt, Human
cauuuauucaugaucuguagcu

SEQ ID NO: 244746 - RNA, 22 nt, Human
aguaacaaaugcaucugggcau

SEQ ID NO: 244747 - RNA, 18 nt, Human
guucaaggucaagagaga

SEQ ID NO: 244748 - RNA, 22 nt, Human
uagaacuagaacaaggauuuga

SEQ ID NO: 244749 - RNA, 20 nt, Human
uagauccuggggauuuauug

SEQ ID NO: 244750 - RNA, 22 nt, Human
gguggcagcgucuaucugacau

SEQ ID NO: 244751 - RNA, 22 nt, Human
agaaagggaugagguagcugcu

SEQ ID NO: 244752 - RNA, 22 nt, Human
augauuuguuaacagacuuaau

SEQ ID NO: 244753 - RNA, 22 nt, Human
uuugaacuucuccauucugaug

SEQ ID NO: 244754 - RNA, 22 nt, Human
gcugugugaaaacugggccugg

SEQ ID NO: 244755 - RNA, 22 nt, Human
ucaggcaaucugacagcuggag

SEQ ID NO: 244756 - RNA, 17 nt, Human
gcagaaaagucaaggga

SEQ ID NO: 244757 - RNA, 22 nt, Human
uugcagggcuuggggauuacag

SEQ ID NO: 244758 - RNA, 22 nt, Human
ccuggcccacauggcuucuccc

SEQ ID NO: 244759 - RNA, 22 nt, Human
gcaggcugugaggcucagaugg

SEQ ID NO: 244760 - RNA, 22 nt, Human
cugaggacauugaugaggcaau

SEQ ID NO: 244761 - RNA, 23 nt, Human
gccuggccaccccagggcugcuu

SEQ ID NO: 244762 - RNA, 22 nt, Human
ggugggucuugcggggcagcuu

SEQ ID NO: 244763 - RNA, 22 nt, Human
aacaugaaaaccuccacagcaa

SEQ ID NO: 244764 - RNA, 22 nt, Human
cuuucucuuacccaaggaucug

SEQ ID NO: 244765 - RNA, 22 nt, Human
aggucugaguagagaaaaggca

SEQ ID NO: 244766 - RNA, 22 nt, Human
uacaauguaauucugauuaugu

SEQ ID NO: 244767 - RNA, 22 nt, Human
cuauagaaaauuguaucacacg

SEQ ID NO: 244768 - RNA, 22 nt, Human
uauuucuugaguggucaguuuc

SEQ ID NO: 244769 - RNA, 22 nt, Human
gcgcaccaccuccagguggccg

SEQ ID NO: 244770 - RNA, 22 nt, Human
uccccagauucaugucugcugu

SEQ ID NO: 244771 - RNA, 22 nt, Human
uaacaauaguguuugcuaguca

SEQ ID NO: 244772 - RNA, 22 nt, Human
uauauuaaaugaccaguuuuaa

SEQ ID NO: 244773 - RNA, 22 nt, Human
gagggcuccacacgggcccagc

SEQ ID NO: 244774 - RNA, 23 nt, Human
ggcacucggccgugaacucgugc

SEQ ID NO: 244775 - RNA, 19 nt, Human
ggcaccuuggucuuggacu

SEQ ID NO: 244776 - RNA, 22 nt, Human
gugucccaggccucuggaauua

SEQ ID NO: 244777 - RNA, 22 nt, Human
acccuccacaccagucuuauuu

SEQ ID NO: 244778 - RNA, 22 nt, Human
cugcaggggcuggaguuggcuu

SEQ ID NO: 244779 - RNA, 22 nt, Human
uagaaagcagaaaccaucagag

SEQ ID NO: 244780 - RNA, 23 nt, Human
uuuggacuugugacucuucuccu

SEQ ID NO: 244781 - RNA, 22 nt, Human
gcugccuuuagggggugcucag

SEQ ID NO: 244782 - RNA, 22 nt, Human
acagaauaguuggcccugcuau

SEQ ID NO: 244783 - RNA, 22 nt, Human
accugggaggcggagguugcag

SEQ ID NO: 244784 - RNA, 22 nt, Human
ggucacagggaagggcucucaa

SEQ ID NO: 244785 - RNA, 22 nt, Human
uuugacucuugucucuuguuag

SEQ ID NO: 244786 - RNA, 22 nt, Human
aggcuucccaagcagcugcaaa

SEQ ID NO: 244787 - RNA, 22 nt, Human
aagguacagaaauuaacaagga

SEQ ID NO: 244788 - RNA, 22 nt, Human
cuuuuguuaggagaaaacauca

SEQ ID NO: 244789 - RNA, 23 nt, Human
ucucaggguggcugggcccaucc

SEQ ID NO: 244790 - RNA, 22 nt, Human
agaaggcacagugcugcuaaga

SEQ ID NO: 244791 - RNA, 22 nt, Human
ccucaggaaaugaauaaauggc

SEQ ID NO: 244792 - RNA, 22 nt, Human
ggcucagcuuggugcgcagaaa

SEQ ID NO: 244793 - RNA, 22 nt, Human
uccaggccaauguagcaggccc

SEQ ID NO: 244794 - RNA, 22 nt, Human
ggagacagcaggaagaaauauc

SEQ ID NO: 244795 - RNA, 22 nt, Human
acuggcaguggcagcagaaaga

SEQ ID NO: 244796 - RNA, 22 nt, Human
gggcugagugucccaggccgaa

SEQ ID NO: 244797 - RNA, 22 nt, Human
uuuucauuuacauuagggaaga

SEQ ID NO: 244798 - RNA, 22 nt, Human
caggagacuauggcccaaggcc

SEQ ID NO: 244799 - RNA, 22 nt, Human
uggcuugcuacugaggugucag

SEQ ID NO: 244800 - RNA, 22 nt, Human
gagggcucuaccaaguaacucu

SEQ ID NO: 244801 - RNA, 22 nt, Human
acccagcuguuucccgugucau

SEQ ID NO: 244802 - RNA, 23 nt, Human
gucuuuauaguggggcacuuugu

SEQ ID NO: 244803 - RNA, 22 nt, Human
cccaggcuccugacucauucua

SEQ ID NO: 244804 - RNA, 22 nt, Human
uaaggccaccguuauagaacca

SEQ ID NO: 244805 - RNA, 22 nt, Human
caguggugaagagcaggggcuc

SEQ ID NO: 244806 - RNA, 22 nt, Human
uccuggagagaggccuggaaga

SEQ ID NO: 244807 - RNA, 22 nt, Human
gcagguguggaguggggugagc

SEQ ID NO: 244808 - RNA, 23 nt, Human
acagagacaaugguuucaucuug

SEQ ID NO: 244809 - RNA, 22 nt, Human
aagcagccaccucaucuccacu

SEQ ID NO: 244810 - RNA, 22 nt, Human
gggagccagccuuugccuauaa

SEQ ID NO: 244811 - RNA, 22 nt, Human
aaagccaucugcugguucgcau

SEQ ID NO: 244812 - RNA, 22 nt, Human
ggcuggcuacauuggaggaagg

SEQ ID NO: 244813 - RNA, 22 nt, Human
uucuuuuagucauucagggaag

SEQ ID NO: 244814 - RNA, 22 nt, Human
agcaucugcauauugggagacc

SEQ ID NO: 244815 - RNA, 19 nt, Human
cccagaggaaugccuggaa

SEQ ID NO: 244816 - RNA, 18 nt, Human
agcaggugugcagaaugu

SEQ ID NO: 244817 - RNA, 22 nt, Human
ggucuagaucaagaacagaacu

SEQ ID NO: 244818 - RNA, 22 nt, Human
ccaggcugccgaggaaagaaag

SEQ ID NO: 244819 - RNA, 22 nt, Human
uuaauaaguaguaguuauuguu

SEQ ID NO: 244820 - RNA, 22 nt, Human
gcuccugcaggacccaggagac

SEQ ID NO: 244821 - RNA, 20 nt, Human
ucacaucuggcagcugauga

SEQ ID NO: 244822 - RNA, 22 nt, Human
ugcccuccuccugagcccaugu

SEQ ID NO: 244823 - RNA, 22 nt, Human
auuuuucucucacacuuaccag

SEQ ID NO: 244824 - RNA, 22 nt, Human
acacuuuaucucaucucagaca

SEQ ID NO: 244825 - RNA, 22 nt, Human
uagaaagcaaaauccuaccaag

SEQ ID NO: 244826 - RNA, 22 nt, Human
uggcucagcuuuccccaucugg

SEQ ID NO: 244827 - RNA, 22 nt, Human
ucaagcaaucucugugucccug

SEQ ID NO: 244828 - RNA, 22 nt, Human
auucuaacacaugcucuaagaa

SEQ ID NO: 244829 - RNA, 22 nt, Human
aaagaagauggagaccugacua

SEQ ID NO: 244830 - RNA, 22 nt, Human
aaagaauacuccuuuugccuug

SEQ ID NO: 244831 - RNA, 22 nt, Human
ccaggaggugaaacuucaccag

SEQ ID NO: 244832 - RNA, 22 nt, Human
agucucuccacauuguuauaaa

SEQ ID NO: 244833 - RNA, 22 nt, Human
cagcuuuauuaaugauugucuu

SEQ ID NO: 244834 - RNA, 22 nt, Human
auggcagggacuguggcccuug

SEQ ID NO: 244835 - RNA, 21 nt, Human
gccuggcuagaagcuccuagc

SEQ ID NO: 244836 - RNA, 19 nt, Human
ccuacaugaguaagcuugg

SEQ ID NO: 244837 - RNA, 22 nt, Human
gcagacacauccacuccuacag

SEQ ID NO: 244838 - RNA, 22 nt, Human
gggugggagaaaugaguaucua

SEQ ID NO: 244839 - RNA, 22 nt, Human
aacugcaaaaaugguagucuua

SEQ ID NO: 244840 - RNA, 22 nt, Human
ggccuugaucucucuaacugcu

SEQ ID NO: 244841 - RNA, 22 nt, Human
ugguccuggggugcaggcugac

SEQ ID NO: 244842 - RNA, 22 nt, Human
agcuuaaagccgccaucuagua

SEQ ID NO: 244843 - RNA, 22 nt, Human
uccaggagauucauuaggucau

SEQ ID NO: 244844 - RNA, 22 nt, Human
acacagggcagagagcuggcuc

SEQ ID NO: 244845 - RNA, 22 nt, Human
gguacaaggagugaagguuugg

SEQ ID NO: 244846 - RNA, 21 nt, Human
ggaaggcuaugguguauuuuu

SEQ ID NO: 244847 - RNA, 20 nt, Human
ggauuuacaggggaaaagug

SEQ ID NO: 244848 - RNA, 22 nt, Human
uccaggcucuaggcugcucucc

SEQ ID NO: 244849 - RNA, 19 nt, Human
ccuccuguggcgggugggg

SEQ ID NO: 244850 - RNA, 22 nt, Human
ugggucuguagggcuguccaau

SEQ ID NO: 244851 - RNA, 22 nt, Human
uaaguuuucuggaauaacuugg

SEQ ID NO: 244852 - RNA, 22 nt, Human
gaccacagguaugggcuuggca

SEQ ID NO: 244853 - RNA, 22 nt, Human
cucucuggcccauccuguugcc

SEQ ID NO: 244854 - RNA, 22 nt, Human
ccagugcaccauuucccucugu

SEQ ID NO: 244855 - RNA, 22 nt, Human
gucucuguuauuuccaggguca

SEQ ID NO: 244856 - RNA, 22 nt, Human
uagaaacucaggauacucuucc

SEQ ID NO: 244857 - RNA, 22 nt, Human
ggcucuggcggcucuuucaaua

SEQ ID NO: 244858 - RNA, 22 nt, Human
guuccuaaccagcagagaaaca

SEQ ID NO: 244859 - RNA, 22 nt, Human
gccugcagccucagagaauuuu

SEQ ID NO: 244860 - RNA, 22 nt, Human
augacaugaccugguagagaca

SEQ ID NO: 244861 - RNA, 22 nt, Human
uugaacauuaacuucagucuau

SEQ ID NO: 244862 - RNA, 21 nt, Human
aaugcauuaacauaaagcuga

SEQ ID NO: 244863 - RNA, 22 nt, Human
uaugcaaaguccuaagaaagaa

SEQ ID NO: 244864 - RNA, 22 nt, Human
acugaauauauuccauugcaug

SEQ ID NO: 244865 - RNA, 22 nt, Human
agcuucccggcaggcacguccu

SEQ ID NO: 244866 - RNA, 22 nt, Human
ugugggaggaacacagccagaa

SEQ ID NO: 244867 - RNA, 22 nt, Human
agucagaauucgaucccagguc

SEQ ID NO: 244868 - RNA, 22 nt, Human
agccuucagcaguucaggugcc

SEQ ID NO: 244869 - RNA, 22 nt, Human
ggaauguugucauuuacauuau

SEQ ID NO: 244870 - RNA, 22 nt, Human
aauacagaggcuuccaguaaaa

SEQ ID NO: 244871 - RNA, 22 nt, Human
gcagagcagugcuugcccagcg

SEQ ID NO: 244872 - RNA, 22 nt, Human
uuggaacacuagaaucuguacu

SEQ ID NO: 244873 - RNA, 22 nt, Human
ucugggcucugggaauuaggga

SEQ ID NO: 244874 - RNA, 21 nt, Human
agacagagugcagucuacaua

SEQ ID NO: 244875 - RNA, 22 nt, Human
ggagacccagguuaggaaguaa

SEQ ID NO: 244876 - RNA, 22 nt, Human
auaagagcuacagccaguucug

SEQ ID NO: 244877 - RNA, 22 nt, Human
auuuuaauaagauccauuuggu

SEQ ID NO: 244878 - RNA, 22 nt, Human
uugcugaugcccuuguccaggc

SEQ ID NO: 244879 - RNA, 22 nt, Human
cugugggaacacugaggacuuc

SEQ ID NO: 244880 - RNA, 22 nt, Human
cuucuucauaggcaguccuguu

SEQ ID NO: 244881 - RNA, 22 nt, Human
uagcagggauacaaggucgccu

SEQ ID NO: 244882 - RNA, 22 nt, Human
cagucuuugaugcauccuagcc

SEQ ID NO: 244883 - RNA, 22 nt, Human
ucugggcagccaugugccuggc

SEQ ID NO: 244884 - RNA, 22 nt, Human
gccauccucugagcacuaggca

SEQ ID NO: 244885 - RNA, 22 nt, Human
acagugucugacacauuguagc

SEQ ID NO: 244886 - RNA, 22 nt, Human
gagguucacaggcuaucacagu

SEQ ID NO: 244887 - RNA, 20 nt, Human
uauuuagauucaaguaugga

SEQ ID NO: 244888 - RNA, 22 nt, Human
aacacauauuuauauaugcaca

SEQ ID NO: 244889 - RNA, 22 nt, Human
acaugaaguggucagaucaaac

SEQ ID NO: 244890 - RNA, 22 nt, Human
uugguuuacucuggggauaucu

SEQ ID NO: 244891 - RNA, 22 nt, Human
acaguucuuuggauggaagaau

SEQ ID NO: 244892 - RNA, 22 nt, Human
aacaaauguaaaaugcagaugc

SEQ ID NO: 244893 - RNA, 23 nt, Human
caggaaaugaauccaggaggaug

SEQ ID NO: 244894 - RNA, 22 nt, Human
ggaggguggcagcguccugggc

SEQ ID NO: 244895 - RNA, 22 nt, Human
ucacaggagucauaauuacagu

SEQ ID NO: 244896 - RNA, 22 nt, Human
aaaaagguugauccagauuagg

SEQ ID NO: 244897 - RNA, 22 nt, Human
ccaugggcgcacaggccuggag

SEQ ID NO: 244898 - RNA, 22 nt, Human
uucaggaaauuggaguccuucu

SEQ ID NO: 244899 - RNA, 22 nt, Human
ugagcuggucacuccuucugaa

SEQ ID NO: 244900 - RNA, 22 nt, Human
ucccagcccagauuugugugac

SEQ ID NO: 244901 - RNA, 22 nt, Human
aaggcagucaaagcagacuucu

SEQ ID NO: 244902 - RNA, 22 nt, Human
cucaggagaugacagaagguau

SEQ ID NO: 244903 - RNA, 22 nt, Human
agcuguguguuuccacugagcu

SEQ ID NO: 244904 - RNA, 22 nt, Human
agcagcagaagggagacccagg

SEQ ID NO: 244905 - RNA, 22 nt, Human
aaauuuguucaaugucuauuug

SEQ ID NO: 244906 - RNA, 22 nt, Human
ggcaccuguguaagaucuggaa

SEQ ID NO: 244907 - RNA, 22 nt, Human
ucacaggguuuggaagccuccu

SEQ ID NO: 244908 - RNA, 20 nt, Human
aggcugagggugauuguguc

SEQ ID NO: 244909 - RNA, 22 nt, Human
caggacaggaguggggucaaag

SEQ ID NO: 244910 - RNA, 22 nt, Human
acaguaacaccuacucuguccc

SEQ ID NO: 244911 - RNA, 18 nt, Human
gcaacaguaucagcaggc

SEQ ID NO: 244912 - RNA, 22 nt, Human
agggcagcggugcuuguguuau

SEQ ID NO: 244913 - RNA, 22 nt, Human
aucuuagaaguuugauaaaauc

SEQ ID NO: 244914 - RNA, 22 nt, Human
gaggagcugagccacguccugg

SEQ ID NO: 244915 - RNA, 22 nt, Human
ugacugaggcagccugaguuau

SEQ ID NO: 244916 - RNA, 22 nt, Human
uuuauucacuucagugccaaag

SEQ ID NO: 244917 - RNA, 22 nt, Human
guggggugcagcaguacugugu

SEQ ID NO: 244918 - RNA, 22 nt, Human
aagucucuggugaugcaggaaa

SEQ ID NO: 244919 - RNA, 22 nt, Human
aggccugggucucgugccuacc

SEQ ID NO: 244920 - RNA, 22 nt, Human
aagcaauaggguaaucuacuca

SEQ ID NO: 244921 - RNA, 19 nt, Human
aaggaauggcuuuaaguag

SEQ ID NO: 244922 - RNA, 22 nt, Human
aagaauguucuuguagucauga

SEQ ID NO: 244923 - RNA, 22 nt, Human
aagugcugggauuacaagcgug

SEQ ID NO: 244924 - RNA, 22 nt, Human
ugaggcaagcugggcccaugga

SEQ ID NO: 244925 - RNA, 19 nt, Human
ugugauaguugaaccugcc

SEQ ID NO: 244926 - RNA, 20 nt, Human
uuuaucaggcacuuacuauu

SEQ ID NO: 244927 - RNA, 22 nt, Human
uuaggaaucaccugcagaucuu

SEQ ID NO: 244928 - RNA, 23 nt, Human
uccucaguauauaaaggcagaug

SEQ ID NO: 244929 - RNA, 22 nt, Human
uugcuuugccaccagaagucua

SEQ ID NO: 244930 - RNA, 22 nt, Human
aucuuucucugcacuauacaau

SEQ ID NO: 244931 - RNA, 19 nt, Human
agacacaucacauuucucc

SEQ ID NO: 244932 - RNA, 21 nt, Human
uggcggggacuuguggcugcc

SEQ ID NO: 244933 - RNA, 22 nt, Human
uugcagcugcaguaaauguuca

SEQ ID NO: 244934 - RNA, 22 nt, Human
cagcugaagagaggugcugagu

SEQ ID NO: 244935 - RNA, 22 nt, Human
uggauuaguuaagaaauguuag

SEQ ID NO: 244936 - RNA, 22 nt, Human
auccuggguuugugaguuuaug

SEQ ID NO: 244937 - RNA, 23 nt, Human
augggcuuagaaagcaaguggga

SEQ ID NO: 244938 - RNA, 22 nt, Human
aacaugcugccuuucuacgagu

SEQ ID NO: 244939 - RNA, 22 nt, Human
cucugcccucacuuggggccug

SEQ ID NO: 244940 - RNA, 21 nt, Human
ugcuggguuugcccaucaggc

SEQ ID NO: 244941 - RNA, 22 nt, Human
cagagacaggagugcucccagu

SEQ ID NO: 244942 - RNA, 22 nt, Human
uugugucccugcggcugaggag

SEQ ID NO: 244943 - RNA, 22 nt, Human
uuguguccuaacaucuaguuaa

SEQ ID NO: 244944 - RNA, 22 nt, Human
cagggccuuguucaggagugaa

SEQ ID NO: 244945 - RNA, 20 nt, Human
cagagcagugcccaggcggc

SEQ ID NO: 244946 - RNA, 22 nt, Human
agcagagaccauauagcccaga

SEQ ID NO: 244947 - RNA, 22 nt, Human
cauacauauguggaugucauau

SEQ ID NO: 244948 - RNA, 22 nt, Human
ggccaagauggaaggagagaug

SEQ ID NO: 244949 - RNA, 22 nt, Human
uuuaucagaaguuagagaaaga

SEQ ID NO: 244950 - RNA, 22 nt, Human
guggccagaaucuugaggccuu

SEQ ID NO: 244951 - RNA, 22 nt, Human
uucugggagagaaagggccuug

SEQ ID NO: 244952 - RNA, 22 nt, Human
uccaccccugggaaugucaaua

SEQ ID NO: 244953 - RNA, 22 nt, Human
gcucuguaugagggugagagau

SEQ ID NO: 244954 - RNA, 22 nt, Human
cugaacuuauugagugcuugcu

SEQ ID NO: 244955 - RNA, 22 nt, Human
acaaugcuugguuuuucuagaa

SEQ ID NO: 244956 - RNA, 22 nt, Human
cugucccacaagcagugugcac

SEQ ID NO: 244957 - RNA, 22 nt, Human
ucccugggacggccuuuuggag

SEQ ID NO: 244958 - RNA, 22 nt, Human
gcuggccauagaagccaaagag

SEQ ID NO: 244959 - RNA, 22 nt, Human
ugggccaguuucucauugaaau

SEQ ID NO: 244960 - RNA, 18 nt, Human
gcaaggcucaggccaggc

SEQ ID NO: 244961 - RNA, 22 nt, Human
uugcaaaugugguuagggcuuu

SEQ ID NO: 244962 - RNA, 22 nt, Human
cuuggaauggggcagaaaaugg

SEQ ID NO: 244963 - RNA, 22 nt, Human
ucuuuccccuacauuugguuaa

SEQ ID NO: 244964 - RNA, 22 nt, Human
uccaaauucuagggccuugguu

SEQ ID NO: 244965 - RNA, 22 nt, Human
aggaggaaaaaggccacagcaa

SEQ ID NO: 244966 - RNA, 22 nt, Human
caauagaaggcacagauaggua

SEQ ID NO: 244967 - RNA, 19 nt, Human
ggccagccaccucgccugg

SEQ ID NO: 244968 - RNA, 22 nt, Human
cuugcaugcauuugaagaucau

SEQ ID NO: 244969 - RNA, 22 nt, Human
acagcugcacacugaacuuggu

SEQ ID NO: 244970 - RNA, 22 nt, Human
ggugggacagguaggaguggcu

SEQ ID NO: 244971 - RNA, 22 nt, Human
cacauuuaagcagauguggacc

SEQ ID NO: 244972 - RNA, 22 nt, Human
uuagcuuuccuacuaauaaaua

SEQ ID NO: 244973 - RNA, 23 nt, Human
gcugugcacgagccacugccugu

SEQ ID NO: 244974 - RNA, 22 nt, Human
ugauacagaauugauaucugag

SEQ ID NO: 244975 - RNA, 22 nt, Human
gacuuuauuuuaacggagauuc

SEQ ID NO: 244976 - RNA, 22 nt, Human
ccuucaggucauauaugucaga

SEQ ID NO: 244977 - RNA, 22 nt, Human
gucaucuucucucagcccaggc

SEQ ID NO: 244978 - RNA, 22 nt, Human
gagcuucccucugcagucccug

SEQ ID NO: 244979 - RNA, 22 nt, Human
aaguaaaauucaaucuucacug

SEQ ID NO: 244980 - RNA, 22 nt, Human
aggcagauuuucuuuacucagu

SEQ ID NO: 244981 - RNA, 22 nt, Human
ugccugaacaugaauaguuuau

SEQ ID NO: 244982 - RNA, 22 nt, Human
aggcugcccugccgccaguggg

SEQ ID NO: 244983 - RNA, 22 nt, Human
guuauguaugagggaaugauua

SEQ ID NO: 244984 - RNA, 22 nt, Human
uuguguccaaggcuauggugau

SEQ ID NO: 244985 - RNA, 22 nt, Human
ugugcugggaaauggcaggaua

SEQ ID NO: 244986 - RNA, 21 nt, Human
acuuuacaauuuacauaguga

SEQ ID NO: 244987 - RNA, 22 nt, Human
ugggugggagcgcccugucugg

SEQ ID NO: 244988 - RNA, 22 nt, Human
gcaggugggggagaaguuguga

SEQ ID NO: 244989 - RNA, 22 nt, Human
gagcagugagugaauguugccu

SEQ ID NO: 244990 - RNA, 22 nt, Human
cagagggcuucagguucaggau

SEQ ID NO: 244991 - RNA, 22 nt, Human
caggaacagaguggcauugucu

SEQ ID NO: 244992 - RNA, 22 nt, Human
auuuuaguuuuagcauccaugc

SEQ ID NO: 244993 - RNA, 22 nt, Human
gcagccaggggcugugaccugu

SEQ ID NO: 244994 - RNA, 22 nt, Human
uggaccacucuggugcccaugu

SEQ ID NO: 244995 - RNA, 22 nt, Human
gcaggugucugacugccuucuu

SEQ ID NO: 244996 - RNA, 22 nt, Human
ugcaaauagccugaugaaagaa

SEQ ID NO: 244997 - RNA, 22 nt, Human
aaucagaaaauucaguggaauu

SEQ ID NO: 244998 - RNA, 22 nt, Human
ucugugcacuaacauuccuggu

SEQ ID NO: 244999 - RNA, 20 nt, Human
gaauuuuaugaacacuacca

SEQ ID NO: 245000 - RNA, 22 nt, Human
gugucugcuugcugagcauuua

SEQ ID NO: 245001 - RNA, 22 nt, Human
gcuuuagauagauuuagucuuu

SEQ ID NO: 245002 - RNA, 22 nt, Human
gaugagucauucacagucguga

SEQ ID NO: 245003 - RNA, 22 nt, Human
aaauuaacuaucacuuuuguga

SEQ ID NO: 245004 - RNA, 22 nt, Human
gaauguuagagauucuuagguu

SEQ ID NO: 245005 - RNA, 22 nt, Human
gccucagugauaugugggacaa

SEQ ID NO: 245006 - RNA, 22 nt, Human
gucaggaaaaauugauaauuuu

SEQ ID NO: 245007 - RNA, 22 nt, Human
uaagcccacauuuuucugaaga

SEQ ID NO: 245008 - RNA, 22 nt, Human
aggcucugaguagagcugccag

SEQ ID NO: 245009 - RNA, 22 nt, Human
ucaaauaccagcaauuucaugu

SEQ ID NO: 245010 - RNA, 22 nt, Human
cccaggccccagggcuugucag

SEQ ID NO: 245011 - RNA, 22 nt, Human
uguacagacuguauuuacaagu

SEQ ID NO: 245012 - RNA, 22 nt, Human
ucuuuaaaguuggagcuugcaa

SEQ ID NO: 245013 - RNA, 22 nt, Human
ucucuucuuguguuuuccugcc

SEQ ID NO: 245014 - RNA, 22 nt, Human
ugagagccaggaucugcucuau

SEQ ID NO: 245015 - RNA, 22 nt, Human
augaugucuaucuuuguaguau

SEQ ID NO: 245016 - RNA, 22 nt, Human
cagagacccuucucaguggcca

SEQ ID NO: 245017 - RNA, 22 nt, Human
gcuggcagaauuucuucuugcu

SEQ ID NO: 245018 - RNA, 22 nt, Human
auaauggcuucugaguauuagg

SEQ ID NO: 245019 - RNA, 19 nt, Human
acucugagcuugcucuauc

SEQ ID NO: 245020 - RNA, 22 nt, Human
ccuggcugugcauugccggccc

SEQ ID NO: 245021 - RNA, 22 nt, Human
agaugcugggaggcugagugca

SEQ ID NO: 245022 - RNA, 22 nt, Human
uauacaaugaguacauucuggg

SEQ ID NO: 245023 - RNA, 22 nt, Human
uccugacucugguguccucuac

SEQ ID NO: 245024 - RNA, 22 nt, Human
cuuuaauuaggaaguauaauga

SEQ ID NO: 245025 - RNA, 22 nt, Human
aaguucaagcucugccuaaaau

SEQ ID NO: 245026 - RNA, 22 nt, Human
uuuaucugaaaaaacucuugga

SEQ ID NO: 245027 - RNA, 22 nt, Human
agaggugacauaggagaggcuc

SEQ ID NO: 245028 - RNA, 22 nt, Human
gacagcaguuuuucucuagggu

SEQ ID NO: 245029 - RNA, 22 nt, Human
ugaucugguccuacugugggca

SEQ ID NO: 245030 - RNA, 22 nt, Human
ccugaggaugccagcaugggug

SEQ ID NO: 245031 - RNA, 22 nt, Human
aaagauacuuaauaguugucug

SEQ ID NO: 245032 - RNA, 22 nt, Human
uguaauuaacguucuuguuaga

SEQ ID NO: 245033 - RNA, 22 nt, Human
gcugcuccgucugagcucuggu

SEQ ID NO: 245034 - RNA, 22 nt, Human
uaacagagugaaaaucagcaca

SEQ ID NO: 245035 - RNA, 23 nt, Human
ggcugggagcuccgggugcacgu

SEQ ID NO: 245036 - RNA, 22 nt, Human
caucuugaagguuucuuuagcu

SEQ ID NO: 245037 - RNA, 21 nt, Human
uaucaagauguuaugguugaa

SEQ ID NO: 245038 - RNA, 22 nt, Human
uauguguacaucugguugagca

SEQ ID NO: 245039 - RNA, 22 nt, Human
uaaaguguuguacaaauguaug

SEQ ID NO: 245040 - RNA, 22 nt, Human
uagaaucugaauguagagcuga

SEQ ID NO: 245041 - RNA, 22 nt, Human
gcuggcagagcucugggcuggg

SEQ ID NO: 245042 - RNA, 22 nt, Human
acagaucucaaagccuggaccc

SEQ ID NO: 245043 - RNA, 22 nt, Human
ccagagcugagggagccugagc

SEQ ID NO: 245044 - RNA, 22 nt, Human
ucuccagugaaucuccuccugg

SEQ ID NO: 245045 - RNA, 22 nt, Human
uucagagagaccaaguggcgug

SEQ ID NO: 245046 - RNA, 22 nt, Human
gcacacacaugugaguacaugc

SEQ ID NO: 245047 - RNA, 22 nt, Human
agcagggcuugccgcuuguccu

SEQ ID NO: 245048 - RNA, 22 nt, Human
ugcagaauguggacaguggguu

SEQ ID NO: 245049 - RNA, 22 nt, Human
ucuggcucaaaauacguacucu

SEQ ID NO: 245050 - RNA, 22 nt, Human
gccuucaguagugucagcugua

SEQ ID NO: 245051 - RNA, 21 nt, Human
ugagcaggugcugcuuuuaug

SEQ ID NO: 245052 - RNA, 21 nt, Human
ugagucuuuuaauaggugcac

SEQ ID NO: 245053 - RNA, 22 nt, Human
uagacagauuucuuguuagaca

SEQ ID NO: 245054 - RNA, 22 nt, Human
cugccuguuagucuagcaguua

SEQ ID NO: 245055 - RNA, 22 nt, Human
uauguauucucagauuuacuaa

SEQ ID NO: 245056 - RNA, 22 nt, Human
cuuaaacugggcauucagagaa

SEQ ID NO: 245057 - RNA, 22 nt, Human
uacaggugguaaaaauauuguu

SEQ ID NO: 245058 - RNA, 22 nt, Human
gugcagcugagggccucuucua

SEQ ID NO: 245059 - RNA, 22 nt, Human
cagaugcuaaguuaucagcagg

SEQ ID NO: 245060 - RNA, 22 nt, Human
uccugguggcuuucccugccuu

SEQ ID NO: 245061 - RNA, 22 nt, Human
acaauuccugagaauacuuguu

SEQ ID NO: 245062 - RNA, 22 nt, Human
ggaggccaucuggcuggaggcu

SEQ ID NO: 245063 - RNA, 22 nt, Human
cagcuggcugcaugaugccaaa

SEQ ID NO: 245064 - RNA, 22 nt, Human
cagagggugugaaggggaugaa

SEQ ID NO: 245065 - RNA, 22 nt, Human
ucagggcugcagaagaggcagg

SEQ ID NO: 245066 - RNA, 22 nt, Human
cagauucuucauucauucuaca

SEQ ID NO: 245067 - RNA, 22 nt, Human
augccuuuuuaucauggaugau

SEQ ID NO: 245068 - RNA, 22 nt, Human
agguaggauggguggagaugau

SEQ ID NO: 245069 - RNA, 19 nt, Human
cguccaggugcuggaagau

SEQ ID NO: 245070 - RNA, 22 nt, Human
ucuuugcagaauuuaacuuugc

SEQ ID NO: 245071 - RNA, 21 nt, Human
guucaaauggguagauucaca

SEQ ID NO: 245072 - RNA, 22 nt, Human
uagggcuguuuaaaagugaggu

SEQ ID NO: 245073 - RNA, 22 nt, Human
gacuuuggagcagaaagaaauu

SEQ ID NO: 245074 - RNA, 22 nt, Human
ccuggcaguucaucaaauggca

SEQ ID NO: 245075 - RNA, 22 nt, Human
aaagugcaguaacuugcccaag

SEQ ID NO: 245076 - RNA, 22 nt, Human
uaagaacaucuguccccagauu

SEQ ID NO: 245077 - RNA, 23 nt, Human
uacuacagggucuugcuaugaau

SEQ ID NO: 245078 - RNA, 22 nt, Human
ggagccaggcaaucuguacuuu

SEQ ID NO: 245079 - RNA, 22 nt, Human
uacacuauuuuacugauacaaa

SEQ ID NO: 245080 - RNA, 22 nt, Human
uccaggagugugugcuaauggg

SEQ ID NO: 245081 - RNA, 22 nt, Human
uuguguacuacaguaugccaca

SEQ ID NO: 245082 - RNA, 22 nt, Human
aaaguguacuaugucaugaaca

SEQ ID NO: 245083 - RNA, 22 nt, Human
ggccugcugcuaugacuuccug

SEQ ID NO: 245084 - RNA, 21 nt, Human
uuuagcauuuacauauuucca

SEQ ID NO: 245085 - RNA, 22 nt, Human
cacauuguagagauuagaaaga

SEQ ID NO: 245086 - RNA, 22 nt, Human
agagucuguuacuuguccccua

SEQ ID NO: 245087 - RNA, 22 nt, Human
gccagccacaagggaggcuugu

SEQ ID NO: 245088 - RNA, 22 nt, Human
cuuggcugcuuuugugcacauu

SEQ ID NO: 245089 - RNA, 22 nt, Human
uuacaaagaguguucuuuucca

SEQ ID NO: 245090 - RNA, 22 nt, Human
ccagacugagggucccugagcu

SEQ ID NO: 245091 - RNA, 22 nt, Human
ugggggugcccuaugaggaagc

SEQ ID NO: 245092 - RNA, 22 nt, Human
aucuuagacccuugguagaaaa

SEQ ID NO: 245093 - RNA, 22 nt, Human
cuguccucaacccauccuucuc

SEQ ID NO: 245094 - RNA, 22 nt, Human
uuccuggcugaacugaacuccu

SEQ ID NO: 245095 - RNA, 21 nt, Human
ggaagggcucugaggacggcu

SEQ ID NO: 245096 - RNA, 22 nt, Human
cagagcugcucaugguggccag

SEQ ID NO: 245097 - RNA, 20 nt, Human
acacuugacaccagaaaugg

SEQ ID NO: 245098 - RNA, 22 nt, Human
aucuuuagauuagaaacucuaa

SEQ ID NO: 245099 - RNA, 19 nt, Human
aaucuagaaauauguguuc

SEQ ID NO: 245100 - RNA, 22 nt, Human
gaaaaggccuccccauaggaau

SEQ ID NO: 245101 - RNA, 22 nt, Human
caaagucagggaagaguggcug

SEQ ID NO: 245102 - RNA, 22 nt, Human
uuggaaaguuuuuacugaagac

SEQ ID NO: 245103 - RNA, 22 nt, Human
agcacugauuuaaacuggauuu

SEQ ID NO: 245104 - RNA, 22 nt, Human
aaaugcacagaaaggaugugga

SEQ ID NO: 245105 - RNA, 22 nt, Human
gagugucaaggcucucuuuggc

SEQ ID NO: 245106 - RNA, 22 nt, Human
caguuacucaauaauucuugcg

SEQ ID NO: 245107 - RNA, 22 nt, Human
augaggcagcccuucccuucuc

SEQ ID NO: 245108 - RNA, 21 nt, Human
ccaggcuggccaugguauuga

SEQ ID NO: 245109 - RNA, 22 nt, Human
acauguguacauauauaugugc

SEQ ID NO: 245110 - RNA, 22 nt, Human
uugagggagauguugacuucag

SEQ ID NO: 245111 - RNA, 22 nt, Human
cuucguuuuuaguagcaauguu

SEQ ID NO: 245112 - RNA, 21 nt, Human
uuucuuaucuguaaaguggga

SEQ ID NO: 245113 - RNA, 21 nt, Human
agcagcagggaagccucaucc

SEQ ID NO: 245114 - RNA, 22 nt, Human
cucagagcacaguuuaugacag

SEQ ID NO: 245115 - RNA, 22 nt, Human
uaaaugaagcucaugggccaca

SEQ ID NO: 245116 - RNA, 22 nt, Human
gcccagcaggacagagugguuu

SEQ ID NO: 245117 - RNA, 22 nt, Human
uuccuggccccauccaucuuca

SEQ ID NO: 245118 - RNA, 22 nt, Human
gagugggugacagaaggaggua

SEQ ID NO: 245119 - RNA, 22 nt, Human
ugaggcucauucugcaugccaa

SEQ ID NO: 245120 - RNA, 22 nt, Human
ggccgugcuccaaagucaucgu

SEQ ID NO: 245121 - RNA, 22 nt, Human
caacugagcaguagcgucugga

SEQ ID NO: 245122 - RNA, 22 nt, Human
cuggaggagagucugaaugaca

SEQ ID NO: 245123 - RNA, 19 nt, Human
gcaggguggcagagcucuu

SEQ ID NO: 245124 - RNA, 21 nt, Human
aggcccagagucuugggggga

SEQ ID NO: 245125 - RNA, 22 nt, Human
aauuuaagagcauagcuccaac

SEQ ID NO: 245126 - RNA, 19 nt, Human
uggaggagaggaaaaguca

SEQ ID NO: 245127 - RNA, 22 nt, Human
uuguacagaaacugcauuugga

SEQ ID NO: 245128 - RNA, 22 nt, Human
uccucagcauggaaucuggacu

SEQ ID NO: 245129 - RNA, 22 nt, Human
gaggaaaucauuccagaaaagg

SEQ ID NO: 245130 - RNA, 22 nt, Human
aagacccuucucugaggaggaa

SEQ ID NO: 245131 - RNA, 20 nt, Human
aguggccacugcagagaugc

SEQ ID NO: 245132 - RNA, 22 nt, Human
gagaagccgagucagcugagcc

SEQ ID NO: 245133 - RNA, 22 nt, Human
ucugagaggugaauucagcaaa

SEQ ID NO: 245134 - RNA, 22 nt, Human
accaucugaguagagagaagua

SEQ ID NO: 245135 - RNA, 22 nt, Human
gauggcuuccuucucacugugu

SEQ ID NO: 245136 - RNA, 22 nt, Human
acagauggagcuacuagguaaa

SEQ ID NO: 245137 - RNA, 22 nt, Human
acuacauuugcagagaagcaau

SEQ ID NO: 245138 - RNA, 23 nt, Human
aacugagauaauguauguaaagc

SEQ ID NO: 245139 - RNA, 22 nt, Human
caggcaugcuucugucugggca

SEQ ID NO: 245140 - RNA, 22 nt, Human
auaguugguccaugaaaaaagu

SEQ ID NO: 245141 - RNA, 22 nt, Human
aggcuccugcaggccuuguagg

SEQ ID NO: 245142 - RNA, 22 nt, Human
cuuuacuucagcaagcuuuccu

SEQ ID NO: 245143 - RNA, 22 nt, Human
uuuccucacuucaugagaguuu

SEQ ID NO: 245144 - RNA, 22 nt, Human
uccuucagaaccugugauggaa

SEQ ID NO: 245145 - RNA, 22 nt, Human
cugagcugguguuucaggguca

SEQ ID NO: 245146 - RNA, 22 nt, Human
ccuugcaguuguuacuguagcc

SEQ ID NO: 245147 - RNA, 22 nt, Human
uugcuaauuuaacuaccuuguu

SEQ ID NO: 245148 - RNA, 22 nt, Human
uauugguaucugagacagaguu

SEQ ID NO: 245149 - RNA, 22 nt, Human
gcaagaacugcaauuacuuuug

SEQ ID NO: 245150 - RNA, 22 nt, Human
aggcucagaggugagcaucugc

SEQ ID NO: 245151 - RNA, 22 nt, Human
caaauacaaauacgggcagcuu

SEQ ID NO: 245152 - RNA, 22 nt, Human
auucuuucauauaaaggcucag

SEQ ID NO: 245153 - RNA, 22 nt, Human
acaucuuuuuucucuaauugug

SEQ ID NO: 245154 - RNA, 22 nt, Human
cauuucacgcacacucauuacu

SEQ ID NO: 245155 - RNA, 22 nt, Human
ucugaggauagaggcaauagga

SEQ ID NO: 245156 - RNA, 22 nt, Human
caggcagagugagaagcccuug

SEQ ID NO: 245157 - RNA, 22 nt, Human
ccugucuguccuuugcauucuu

SEQ ID NO: 245158 - RNA, 22 nt, Human
aaguucaagagugacauauuag

SEQ ID NO: 245159 - RNA, 20 nt, Human
aauuagauguuuaaucaaua

SEQ ID NO: 245160 - RNA, 18 nt, Human
ugccagccgacuggccug

SEQ ID NO: 245161 - RNA, 22 nt, Human
aaaauagcaugaaaggccuuug

SEQ ID NO: 245162 - RNA, 22 nt, Human
uguguccugugcaaggggauga

SEQ ID NO: 245163 - RNA, 22 nt, Human
cuccaggccauggcugcggagg

SEQ ID NO: 245164 - RNA, 22 nt, Human
agcugcuccaacccagcgggcu

SEQ ID NO: 245165 - RNA, 22 nt, Human
acauuucaguaaguguuaauuu

SEQ ID NO: 245166 - RNA, 22 nt, Human
ugggaaggggagcuggaaagga

SEQ ID NO: 245167 - RNA, 22 nt, Human
ggccucugccccagccacaccu

SEQ ID NO: 245168 - RNA, 22 nt, Human
guguacauagaauugugcuuug

SEQ ID NO: 245169 - RNA, 22 nt, Human
acagcaacuccugcuucugagu

SEQ ID NO: 245170 - RNA, 22 nt, Human
uggcuucugcucccagaaugau

SEQ ID NO: 245171 - RNA, 22 nt, Human
ggugggcaacauuuggccugag

SEQ ID NO: 245172 - RNA, 22 nt, Human
gacaagacauugguaaagauau

SEQ ID NO: 245173 - RNA, 22 nt, Human
gaggauggaggcaguuagggcc

SEQ ID NO: 245174 - RNA, 22 nt, Human
caggcacacugucuacacugag

SEQ ID NO: 245175 - RNA, 22 nt, Human
auacacuucauguuuucaucug

SEQ ID NO: 245176 - RNA, 20 nt, Human
acagccagaggaggcagaca

SEQ ID NO: 245177 - RNA, 22 nt, Human
uagagaaaagcagggaucagga

SEQ ID NO: 245178 - RNA, 22 nt, Human
cuacaaaaguaauugugguuuu

SEQ ID NO: 245179 - RNA, 22 nt, Human
agcccaggugagggguucgaaa

SEQ ID NO: 245180 - RNA, 22 nt, Human
caggcugcaagaaaggcauuca

SEQ ID NO: 245181 - RNA, 22 nt, Human
uuacaagauaaccugaugcugu

SEQ ID NO: 245182 - RNA, 22 nt, Human
uagugaaacaguuaucaaucug

SEQ ID NO: 245183 - RNA, 18 nt, Human
uuaguauaacugccugug

SEQ ID NO: 245184 - RNA, 22 nt, Human
gaacaacuccaagggacaucau

SEQ ID NO: 245185 - RNA, 22 nt, Human
ccaggccuguguuguguggagg

SEQ ID NO: 245186 - RNA, 22 nt, Human
gaagcuuugagagcagaagccc

SEQ ID NO: 245187 - RNA, 22 nt, Human
cacagaggaugcccaagcgauc

SEQ ID NO: 245188 - RNA, 22 nt, Human
uuucuucagccuucacaaccug

SEQ ID NO: 245189 - RNA, 22 nt, Human
ccugggcuggaguacagcagug

SEQ ID NO: 245190 - RNA, 22 nt, Human
cagggcagaaggcacucuacuc

SEQ ID NO: 245191 - RNA, 22 nt, Human
agugucagccugggcaaggaac

SEQ ID NO: 245192 - RNA, 22 nt, Human
ucaucuguucauacacaugcgu

SEQ ID NO: 245193 - RNA, 22 nt, Human
uauaucugggaaccaaaggggg

SEQ ID NO: 245194 - RNA, 22 nt, Human
aagagcauuuuguaaaauccuu

SEQ ID NO: 245195 - RNA, 20 nt, Human
agcaccagugggggcagccc

SEQ ID NO: 245196 - RNA, 22 nt, Human
ggcagcugugaagugccucaca

SEQ ID NO: 245197 - RNA, 21 nt, Human
aggcaggauucaaacacagag

SEQ ID NO: 245198 - RNA, 22 nt, Human
aaagcaaugaugguagacacgu

SEQ ID NO: 245199 - RNA, 22 nt, Human
uggcuucuagcaguguugauuu

SEQ ID NO: 245200 - RNA, 22 nt, Human
cugggggccuuacggaacucca

SEQ ID NO: 245201 - RNA, 22 nt, Human
ccugggcuuuggaacaguacuu

SEQ ID NO: 245202 - RNA, 22 nt, Human
ccagcugucugguuccagagcc

SEQ ID NO: 245203 - RNA, 22 nt, Human
cucugcugcaggaaggcgugca

SEQ ID NO: 245204 - RNA, 22 nt, Human
ucuccaggcacuaccuggguaa

SEQ ID NO: 245205 - RNA, 22 nt, Human
uacugaaaguggucaacagugg

SEQ ID NO: 245206 - RNA, 22 nt, Human
ugcuuuauucagucucugccau

SEQ ID NO: 245207 - RNA, 22 nt, Human
uuggagucagaugacuguagga

SEQ ID NO: 245208 - RNA, 22 nt, Human
agaggccaggcugcagagggau

SEQ ID NO: 245209 - RNA, 17 nt, Human
uuuauaauuggccucuu

SEQ ID NO: 245210 - RNA, 22 nt, Human
ugagcuuucauguaugaaaaga

SEQ ID NO: 245211 - RNA, 22 nt, Human
ggaagaaaugcucuucuaugcg

SEQ ID NO: 245212 - RNA, 17 nt, Human
uccaggcauaucuccua

SEQ ID NO: 245213 - RNA, 22 nt, Human
gcuuucuguggugauguaaagg

SEQ ID NO: 245214 - RNA, 22 nt, Human
cucuggagugcagccugguggc

SEQ ID NO: 245215 - RNA, 23 nt, Human
uucugggcuguggaagccucggg

SEQ ID NO: 245216 - RNA, 22 nt, Human
uuucaaagcaacugaaaaggaa

SEQ ID NO: 245217 - RNA, 22 nt, Human
ccaugagccaggcugaggaagc

SEQ ID NO: 245218 - RNA, 22 nt, Human
aagaugugcaguucauggcagg

SEQ ID NO: 245219 - RNA, 22 nt, Human
cuucccacuaaagcccuuguug

SEQ ID NO: 245220 - RNA, 22 nt, Human
caguuaaaggcccaauaucugg

SEQ ID NO: 245221 - RNA, 22 nt, Human
gcccagcacaucuggccuugaa

SEQ ID NO: 245222 - RNA, 22 nt, Human
agagacagacacaucgggcugc

SEQ ID NO: 245223 - RNA, 23 nt, Human
cacaugaccugaccuaggcuagg

SEQ ID NO: 245224 - RNA, 22 nt, Human
gaucugaaucaauagaauaacu

SEQ ID NO: 245225 - RNA, 22 nt, Human
acacauaucuaagauagaugac

SEQ ID NO: 245226 - RNA, 22 nt, Human
ggagcagagcugggcuuggcug

SEQ ID NO: 245227 - RNA, 22 nt, Human
uuggcucauuaaagaugauaau

SEQ ID NO: 245228 - RNA, 22 nt, Human
aagaaacuggaauauagagagc

SEQ ID NO: 245229 - RNA, 23 nt, Human
ggaggcacuuaggcagagcagag

SEQ ID NO: 245230 - RNA, 22 nt, Human
cagcucugaggaacacuccuuu

SEQ ID NO: 245231 - RNA, 22 nt, Human
agguguccaauccugguuggau

SEQ ID NO: 245232 - RNA, 22 nt, Human
ccuggccagcgccggcugcucg

SEQ ID NO: 245233 - RNA, 22 nt, Human
cugggaggacaacuuggagcuc

SEQ ID NO: 245234 - RNA, 22 nt, Human
cugccccagugccaggcaggug

SEQ ID NO: 245235 - RNA, 22 nt, Human
gcugcccugcaucugugccuuc

SEQ ID NO: 245236 - RNA, 22 nt, Human
uacauuuacagagccuucucug

SEQ ID NO: 245237 - RNA, 22 nt, Human
ccagggcaggggcuggaguuca

SEQ ID NO: 245238 - RNA, 22 nt, Human
gagccaggguuugaaacuagac

SEQ ID NO: 245239 - RNA, 22 nt, Human
guauaucagacacucauaugua

SEQ ID NO: 245240 - RNA, 22 nt, Human
agacacagaaguugcuguuggg

SEQ ID NO: 245241 - RNA, 22 nt, Human
agguccaggauuuguggggucu

SEQ ID NO: 245242 - RNA, 22 nt, Human
ucaccugggagggcugugguag

SEQ ID NO: 245243 - RNA, 22 nt, Human
uauagacaagcguaacaagaag

SEQ ID NO: 245244 - RNA, 23 nt, Human
uaagaacagacaagcauuuacau

SEQ ID NO: 245245 - RNA, 22 nt, Human
gaaggccauugcguccugggau

SEQ ID NO: 245246 - RNA, 22 nt, Human
uuugacauggaauaacucauuu

SEQ ID NO: 245247 - RNA, 22 nt, Human
ucaagacaggguuuaagguuga

SEQ ID NO: 245248 - RNA, 22 nt, Human
cagaaaccugucuggaguggga

SEQ ID NO: 245249 - RNA, 22 nt, Human
agcuucaggaacaggcagccug

SEQ ID NO: 245250 - RNA, 22 nt, Human
uuuauucuagcucagaauaguu

SEQ ID NO: 245251 - RNA, 22 nt, Human
ucacagacauggugagguaaca

SEQ ID NO: 245252 - RNA, 21 nt, Human
acaaauuguuuauauaggaag

SEQ ID NO: 245253 - RNA, 22 nt, Human
ccacauuuuugauacucucacu

SEQ ID NO: 245254 - RNA, 22 nt, Human
uuccuagggcagagccgcuggg

SEQ ID NO: 245255 - RNA, 19 nt, Human
auucauuggccaggguggu

SEQ ID NO: 245256 - RNA, 23 nt, Human
ccauucccacugugccuucccug

SEQ ID NO: 245257 - RNA, 22 nt, Human
uuucucuggcauuagguauaaa

SEQ ID NO: 245258 - RNA, 22 nt, Human
aaaagcagaucuccaaagucua

SEQ ID NO: 245259 - RNA, 22 nt, Human
agacccuugcagucugguuguc

SEQ ID NO: 245260 - RNA, 22 nt, Human
ucuccaaacucagacuaaguau

SEQ ID NO: 245261 - RNA, 22 nt, Human
agcugcaaaccaggccggcgcg

SEQ ID NO: 245262 - RNA, 22 nt, Human
uauuugauagagauaaaugaua

SEQ ID NO: 245263 - RNA, 22 nt, Human
auauauuguaucuuucaugggg

SEQ ID NO: 245264 - RNA, 21 nt, Human
uguuuacucccugcaagcacg

SEQ ID NO: 245265 - RNA, 22 nt, Human
uaaagacaaaugacauuacggc

SEQ ID NO: 245266 - RNA, 22 nt, Human
cugaagggucuggggcugugcc

SEQ ID NO: 245267 - RNA, 22 nt, Human
agucuccuuggccucaaugccu

SEQ ID NO: 245268 - RNA, 22 nt, Human
ugccugccacgcuugcuaccac

SEQ ID NO: 245269 - RNA, 22 nt, Human
uaagauguuuugguuugauaag

SEQ ID NO: 245270 - RNA, 22 nt, Human
uagagcaguuggcagcuguauu

SEQ ID NO: 245271 - RNA, 22 nt, Human
caguggcacccacgggcugggc

SEQ ID NO: 245272 - RNA, 22 nt, Human
cuccucagaagaggguaacaca

SEQ ID NO: 245273 - RNA, 22 nt, Human
ugauuucucuccguuauuucag

SEQ ID NO: 245274 - RNA, 22 nt, Human
ugcuuaaaaugaugauuauuuu

SEQ ID NO: 245275 - RNA, 22 nt, Human
caucuuugagacagcauuaccc

SEQ ID NO: 245276 - RNA, 22 nt, Human
cuucuuaacuguauauacuaug

SEQ ID NO: 245277 - RNA, 22 nt, Human
uggcuucuggcuggugagaaau

SEQ ID NO: 245278 - RNA, 22 nt, Human
uaucuauaaguacuaacauggu

SEQ ID NO: 245279 - RNA, 22 nt, Human
caggguccaucuuucaucacug

SEQ ID NO: 245280 - RNA, 22 nt, Human
uccuggacaagcccuucacccu

SEQ ID NO: 245281 - RNA, 20 nt, Human
cuguuuauuagaaguggauu

SEQ ID NO: 245282 - RNA, 22 nt, Human
guggaggaagggauucagacca

SEQ ID NO: 245283 - RNA, 22 nt, Human
cccagcugauuuuugcagagau

SEQ ID NO: 245284 - RNA, 22 nt, Human
cuccaggaaagccugaggcccg

SEQ ID NO: 245285 - RNA, 22 nt, Human
gggaucuugaaacagcuggauu

SEQ ID NO: 245286 - RNA, 22 nt, Human
cucacauucacaggacagaagg

SEQ ID NO: 245287 - RNA, 22 nt, Human
cagcccuguccaaugucugcuc

SEQ ID NO: 245288 - RNA, 22 nt, Human
agcucagaacugcagacaugug

SEQ ID NO: 245289 - RNA, 22 nt, Human
acaggaaauuggcauaucaguu

SEQ ID NO: 245290 - RNA, 22 nt, Human
gcaggaagccuuaccaagccca

SEQ ID NO: 245291 - RNA, 22 nt, Human
aaaggcuucacuuauuuauuuu

SEQ ID NO: 245292 - RNA, 22 nt, Human
caagagacuuauguggaaaccu

SEQ ID NO: 245293 - RNA, 22 nt, Human
ugagaacugaggauuugaauuc

SEQ ID NO: 245294 - RNA, 19 nt, Human
cuggucugcugcuuccagg

SEQ ID NO: 245295 - RNA, 22 nt, Human
aggguggcacugguggcucuau

SEQ ID NO: 245296 - RNA, 22 nt, Human
uggucucuucuuccaagauggc

SEQ ID NO: 245297 - RNA, 22 nt, Human
ugccugccuaggaagcugugaa

SEQ ID NO: 245298 - RNA, 22 nt, Human
gucaggccaauacucuccagca

SEQ ID NO: 245299 - RNA, 22 nt, Human
aauugcuuuucaaggguacagc

SEQ ID NO: 245300 - RNA, 22 nt, Human
aacugcaauuacuuuugcacua

SEQ ID NO: 245301 - RNA, 19 nt, Human
uagugucaaggaggagggu

SEQ ID NO: 245302 - RNA, 22 nt, Human
uugugcagaguugccuuuauuu

SEQ ID NO: 245303 - RNA, 22 nt, Human
uugugcaugacugugaauagcu

SEQ ID NO: 245304 - RNA, 22 nt, Human
ucaggauggagggaagcacaga

SEQ ID NO: 245305 - RNA, 22 nt, Human
cuacagaaacacuggacaugug

SEQ ID NO: 245306 - RNA, 22 nt, Human
acagaauugaaaguauaaucug

SEQ ID NO: 245307 - RNA, 22 nt, Human
gacauguugaagaauauuugga

SEQ ID NO: 245308 - RNA, 22 nt, Human
agguaaagacagugaaagaggg

SEQ ID NO: 245309 - RNA, 22 nt, Human
ucuuugcauuccugugugcuuu

SEQ ID NO: 245310 - RNA, 22 nt, Human
auaaacucaugcugaaaaccca

SEQ ID NO: 245311 - RNA, 22 nt, Human
ggcaggugccuucugugcuagc

SEQ ID NO: 245312 - RNA, 22 nt, Human
gaaagucauggaugaacacuac

SEQ ID NO: 245313 - RNA, 22 nt, Human
ugcugccaccugguggcugaag

SEQ ID NO: 245314 - RNA, 22 nt, Human
guucaaauggcugcaguuacca

SEQ ID NO: 245315 - RNA, 22 nt, Human
acaaauuucauaggcaaauuuu

SEQ ID NO: 245316 - RNA, 22 nt, Human
cccaggcagcccuucugacgca

SEQ ID NO: 245317 - RNA, 22 nt, Human
auacacauuacuuucugucuga

SEQ ID NO: 245318 - RNA, 19 nt, Human
cuucuggcccugagccacc

SEQ ID NO: 245319 - RNA, 22 nt, Human
uacacagugaguccucucugcc

SEQ ID NO: 245320 - RNA, 22 nt, Human
acaugcaaagccacaggacccg

SEQ ID NO: 245321 - RNA, 20 nt, Human
cuggcccaggaugauggcgc

SEQ ID NO: 245322 - RNA, 22 nt, Human
uugaaugauuaaagucaucuga

SEQ ID NO: 245323 - RNA, 22 nt, Human
agggccaguauuaagguaauua

SEQ ID NO: 245324 - RNA, 22 nt, Human
ugaggcaggagguugagaacug

SEQ ID NO: 245325 - RNA, 22 nt, Human
ugccuucuugaauaugguucuu

SEQ ID NO: 245326 - RNA, 22 nt, Human
uaacagaguaacagguauguaa

SEQ ID NO: 245327 - RNA, 22 nt, Human
cuuucaaagaccuuggcauggg

SEQ ID NO: 245328 - RNA, 23 nt, Human
cagagcugauuaaacuuaaucuc

SEQ ID NO: 245329 - RNA, 22 nt, Human
uacauucagagaaaguuuccau

SEQ ID NO: 245330 - RNA, 22 nt, Human
agagccuugcucuaaauuucuc

SEQ ID NO: 245331 - RNA, 22 nt, Human
aggcucagccccugggaggaga

SEQ ID NO: 245332 - RNA, 22 nt, Human
aaaugcacucugcuucugugac

SEQ ID NO: 245333 - RNA, 22 nt, Human
ccucagagguguggcaucucug

SEQ ID NO: 245334 - RNA, 22 nt, Human
cucugggugucuuaggagcuca

SEQ ID NO: 245335 - RNA, 22 nt, Human
cugcccaccacaccugcuccug

SEQ ID NO: 245336 - RNA, 22 nt, Human
aguccugguucugauucugaca

SEQ ID NO: 245337 - RNA, 22 nt, Human
ggugacauaguuacuucaggcu

SEQ ID NO: 245338 - RNA, 22 nt, Human
uuugucuucccccuuuaaucag

SEQ ID NO: 245339 - RNA, 22 nt, Human
uucuuaagucaguaagaugcaa

SEQ ID NO: 245340 - RNA, 23 nt, Human
ucugggcugagacuuggaagguc

SEQ ID NO: 245341 - RNA, 22 nt, Human
uaugccagggacuguuucacca

SEQ ID NO: 245342 - RNA, 22 nt, Human
ccuggcagucaggggaguccuu

SEQ ID NO: 245343 - RNA, 22 nt, Human
aguggaaggucaggggacagug

SEQ ID NO: 245344 - RNA, 22 nt, Human
gagacaggauuuaaccaaagcu

SEQ ID NO: 245345 - RNA, 22 nt, Human
ucaucucucaggauaccagcag

SEQ ID NO: 245346 - RNA, 22 nt, Human
aggcuugguuaauucuguguga

SEQ ID NO: 245347 - RNA, 22 nt, Human
uaagaugagguagguaagacuu

SEQ ID NO: 245348 - RNA, 22 nt, Human
cagguugaaaguggaggagcua

SEQ ID NO: 245349 - RNA, 22 nt, Human
cagcucuuuacucugcaaugau

SEQ ID NO: 245350 - RNA, 23 nt, Human
agggguggucaguacccgcagug

SEQ ID NO: 245351 - RNA, 22 nt, Human
ccugugaguuuacauucuggcc

SEQ ID NO: 245352 - RNA, 22 nt, Human
aacaucucagaagugacccuga

SEQ ID NO: 245353 - RNA, 22 nt, Human
cauggcagcaauuuuccugacu

SEQ ID NO: 245354 - RNA, 22 nt, Human
uucucagagcacugcugacaaa

SEQ ID NO: 245355 - RNA, 22 nt, Human
cuacauuaaauuggcuuacuua

SEQ ID NO: 245356 - RNA, 22 nt, Human
ugucaaacugugacuucuaaug

SEQ ID NO: 245357 - RNA, 22 nt, Human
accagagcuuacaugcuagaaa

SEQ ID NO: 245358 - RNA, 22 nt, Human
gacuggggcucuagccaggccu

SEQ ID NO: 245359 - RNA, 22 nt, Human
acucagagcagagcagccugag

SEQ ID NO: 245360 - RNA, 22 nt, Human
cccaaagguugaggcugcagug

SEQ ID NO: 245361 - RNA, 22 nt, Human
aguuagagacacaugcacaugc

SEQ ID NO: 245362 - RNA, 22 nt, Human
agguuaaaaaggauucaguuaa

SEQ ID NO: 245363 - RNA, 22 nt, Human
uggcuucuuacuagggcucagu

SEQ ID NO: 245364 - RNA, 22 nt, Human
gcccagcuuuucacuuccacac

SEQ ID NO: 245365 - RNA, 19 nt, Human
ccaugccaucauuuuaaag

SEQ ID NO: 245366 - RNA, 22 nt, Human
agcaguggcauacauuuugagu

SEQ ID NO: 245367 - RNA, 22 nt, Human
uucauugagugguuuauucuaa

SEQ ID NO: 245368 - RNA, 22 nt, Human
auauuuaaacaggguaccaaua

SEQ ID NO: 245369 - RNA, 21 nt, Human
ggcaacagauauuuugcuuag

SEQ ID NO: 245370 - RNA, 22 nt, Human
agagaugcuguggguagaggca

SEQ ID NO: 245371 - RNA, 22 nt, Human
cauuucaauuauuugcucuucu

SEQ ID NO: 245372 - RNA, 22 nt, Human
uaagaggcaaaagauacucaga

SEQ ID NO: 245373 - RNA, 20 nt, Human
gggguuggcuggcacaggga

SEQ ID NO: 245374 - RNA, 22 nt, Human
gaggugucaucaggcagcucug

SEQ ID NO: 245375 - RNA, 22 nt, Human
gugugacuuuauuuggaaauag

SEQ ID NO: 245376 - RNA, 22 nt, Human
uggaugaguucaaugaggcaga

SEQ ID NO: 245377 - RNA, 22 nt, Human
cugggccuggagcccacgagcc

SEQ ID NO: 245378 - RNA, 22 nt, Human
agcauucaugaugacaacagga

SEQ ID NO: 245379 - RNA, 22 nt, Human
agcaagauuuuccuugaauguu

SEQ ID NO: 245380 - RNA, 20 nt, Human
acauggcauucccacguggu

SEQ ID NO: 245381 - RNA, 22 nt, Human
augaagucugccaaggaaaggc

SEQ ID NO: 245382 - RNA, 22 nt, Human
ucuccaggaaagacacuggacu

SEQ ID NO: 245383 - RNA, 15 nt, Human
uuggaggauguagua

SEQ ID NO: 245384 - RNA, 22 nt, Human
agcugcuguccuaggcacugua

SEQ ID NO: 245385 - RNA, 22 nt, Human
aggggacauuuagcaaugacua

SEQ ID NO: 245386 - RNA, 22 nt, Human
uuuaauuuguauuucuagaggg

SEQ ID NO: 245387 - RNA, 22 nt, Human
cuagggaaugagagacuggauc

SEQ ID NO: 245388 - RNA, 22 nt, Human
auggggagagccucugucccca

SEQ ID NO: 245389 - RNA, 22 nt, Human
augacaauacuucaauaagcug

SEQ ID NO: 245390 - RNA, 22 nt, Human
aagcucaggcuggaccuggcuu

SEQ ID NO: 245391 - RNA, 22 nt, Human
agaaaucaauaucuauauguug

SEQ ID NO: 245392 - RNA, 22 nt, Human
cugcuguggaugcaggaccuca

SEQ ID NO: 245393 - RNA, 21 nt, Human
uuacuucugcuuguuauuguc

SEQ ID NO: 245394 - RNA, 22 nt, Human
gauguuucaugcuagcaugugu

SEQ ID NO: 245395 - RNA, 22 nt, Human
agucucuugcuagaaucagcca

SEQ ID NO: 245396 - RNA, 23 nt, Human
agcaguuagggauacaaguuauc

SEQ ID NO: 245397 - RNA, 22 nt, Human
ugcauaaaacaugauuucugcu

SEQ ID NO: 245398 - RNA, 22 nt, Human
cuggccucacagaggcuaagcc

SEQ ID NO: 245399 - RNA, 22 nt, Human
uggaaacuagagugugggaagc

SEQ ID NO: 245400 - RNA, 21 nt, Human
ugcacuucaguggcuaaauuc

SEQ ID NO: 245401 - RNA, 22 nt, Human
uugcaaaugugaguuuagacug

SEQ ID NO: 245402 - RNA, 22 nt, Human
cagggagaggcaucauagggaa

SEQ ID NO: 245403 - RNA, 22 nt, Human
gauaaauugcacuuuuucuuac

SEQ ID NO: 245404 - RNA, 22 nt, Human
gcagcuuuaaacauuggaaaua

SEQ ID NO: 245405 - RNA, 22 nt, Human
gugcuggggguuucuguagguc

SEQ ID NO: 245406 - RNA, 22 nt, Human
ucuuuggcuugucuccucaguu

SEQ ID NO: 245407 - RNA, 22 nt, Human
uauauaacuacuauuuugcuca

SEQ ID NO: 245408 - RNA, 22 nt, Human
uggacaguuacugagcuugagu

SEQ ID NO: 245409 - RNA, 21 nt, Human
aaacugaccuugccugagaca

SEQ ID NO: 245410 - RNA, 22 nt, Human
agcuccucuagaucugccacuu

SEQ ID NO: 245411 - RNA, 22 nt, Human
ugcagcugggucugcccuggcu

SEQ ID NO: 245412 - RNA, 22 nt, Human
uguguccuuucuuaagagugag

SEQ ID NO: 245413 - RNA, 22 nt, Human
gucugcccuggggcaucaguuu

SEQ ID NO: 245414 - RNA, 22 nt, Human
aaaauccucuaauucuagaaua

SEQ ID NO: 245415 - RNA, 22 nt, Human
uggcauuuggcuuacuuauguu

SEQ ID NO: 245416 - RNA, 22 nt, Human
aggaagcuuguguguauugguc

SEQ ID NO: 245417 - RNA, 22 nt, Human
cagccagagaaagggcacugcc

SEQ ID NO: 245418 - RNA, 22 nt, Human
ugcaaaaaggcagacuggugau

SEQ ID NO: 245419 - RNA, 22 nt, Human
cgggaggaaaggcgaggcucug

SEQ ID NO: 245420 - RNA, 22 nt, Human
gagccagcagccggcaccacca

SEQ ID NO: 245421 - RNA, 22 nt, Human
uuucuuuguaguagcauaauca

SEQ ID NO: 245422 - RNA, 22 nt, Human
gagcuggaggaccaggacuggg

SEQ ID NO: 245423 - RNA, 22 nt, Human
gcccaggaagugacucagaugu

SEQ ID NO: 245424 - RNA, 22 nt, Human
ugacaggugaaauguccuuauu

SEQ ID NO: 245425 - RNA, 22 nt, Human
gccuggcaaggcccuguugacu

SEQ ID NO: 245426 - RNA, 22 nt, Human
uucagauaaacuacaaauaauu

SEQ ID NO: 245427 - RNA, 22 nt, Human
aagggcagaauagagaagaugg

SEQ ID NO: 245428 - RNA, 22 nt, Human
cugcagagaguaacugaaauau

SEQ ID NO: 245429 - RNA, 22 nt, Human
uagggcucugcucaucaguugu

SEQ ID NO: 245430 - RNA, 22 nt, Human
uggggacaggagacuuacagcu

SEQ ID NO: 245431 - RNA, 23 nt, Human
ucugguacuauugcuguugagca

SEQ ID NO: 245432 - RNA, 22 nt, Human
cuucucaaaguugugaaucagg

SEQ ID NO: 245433 - RNA, 22 nt, Human
gguggcauaagaacacuaaaga

SEQ ID NO: 245434 - RNA, 22 nt, Human
augacaggaggcagcugggcag

SEQ ID NO: 245435 - RNA, 22 nt, Human
agagcacagaagaauaggugcu

SEQ ID NO: 245436 - RNA, 22 nt, Human
cugccuggaccggcagcccucc

SEQ ID NO: 245437 - RNA, 21 nt, Human
uagaagcacauagguucaaag

SEQ ID NO: 245438 - RNA, 22 nt, Human
uugcacccaguaguuuaaauuc

SEQ ID NO: 245439 - RNA, 22 nt, Human
ucucugguuaugucauuaagca

SEQ ID NO: 245440 - RNA, 22 nt, Human
cuuugcaaacgauuaccacaug

SEQ ID NO: 245441 - RNA, 22 nt, Human
cugcugagagccacguggcaca

SEQ ID NO: 245442 - RNA, 22 nt, Human
uagggaugacuaugauucccac

SEQ ID NO: 245443 - RNA, 22 nt, Human
guugucuuagucagaaauaugc

SEQ ID NO: 245444 - RNA, 22 nt, Human
uacauaauuaaucuuuaaguuc

SEQ ID NO: 245445 - RNA, 17 nt, Human
uaugaggcaguuuguga

SEQ ID NO: 245446 - RNA, 22 nt, Human
uguuuauaaauuuucuugccau

SEQ ID NO: 245447 - RNA, 22 nt, Human
ccucuggcauagcaaguggccu

SEQ ID NO: 245448 - RNA, 22 nt, Human
ugcauuaagguaauuguauaau

SEQ ID NO: 245449 - RNA, 22 nt, Human
gcugcccuagaaguacagagag

SEQ ID NO: 245450 - RNA, 22 nt, Human
gcacacaugcaugugugcaucc

SEQ ID NO: 245451 - RNA, 22 nt, Human
gcuagaaaucgacuucagaauu

SEQ ID NO: 245452 - RNA, 22 nt, Human
uaaagguagugugacauauugu

SEQ ID NO: 245453 - RNA, 20 nt, Human
aaugaguccugcuggaucac

SEQ ID NO: 245454 - RNA, 22 nt, Human
ccugccacuucuugcuauggag

SEQ ID NO: 245455 - RNA, 22 nt, Human
cuccucagcugggaggaguccc

SEQ ID NO: 245456 - RNA, 22 nt, Human
uuuaauugauucacagucugua

SEQ ID NO: 245457 - RNA, 23 nt, Human
uggacccugcacaccagcucuac

SEQ ID NO: 245458 - RNA, 22 nt, Human
gagguaacacuguucagugggc

SEQ ID NO: 245459 - RNA, 22 nt, Human
agcaaugcuuauugcugacuau

SEQ ID NO: 245460 - RNA, 22 nt, Human
ucacauuuuaucuauuuuaagu

SEQ ID NO: 245461 - RNA, 21 nt, Human
acagcagggcuggcaugacag

SEQ ID NO: 245462 - RNA, 18 nt, Human
ucugcccugccauucacu

SEQ ID NO: 245463 - RNA, 22 nt, Human
augagcucauccgagucacacu

SEQ ID NO: 245464 - RNA, 22 nt, Human
gaggcagcugggauacaaggga

SEQ ID NO: 245465 - RNA, 22 nt, Human
ugugggaaucagccaggggggc

SEQ ID NO: 245466 - RNA, 22 nt, Human
aacaugugagcagguuuuuuau

SEQ ID NO: 245467 - RNA, 20 nt, Human
gaggccucagccucagcucc

SEQ ID NO: 245468 - RNA, 23 nt, Human
uucagacugccuucagcauuguc

SEQ ID NO: 245469 - RNA, 22 nt, Human
agcuguugucugcaggagaagc

SEQ ID NO: 245470 - RNA, 22 nt, Human
ucugugaaugugaccuuauuug

SEQ ID NO: 245471 - RNA, 18 nt, Human
gggcucacacaggucauc

SEQ ID NO: 245472 - RNA, 22 nt, Human
uuacaaugcacucaccuuuaga

SEQ ID NO: 245473 - RNA, 22 nt, Human
ccagcacuccugucucaagucu

SEQ ID NO: 245474 - RNA, 22 nt, Human
cauggcagagccugcagguggg

SEQ ID NO: 245475 - RNA, 22 nt, Human
acuucucuccacccaagucccu

SEQ ID NO: 245476 - RNA, 22 nt, Human
ucauuuauaaggaugcaauuaa

SEQ ID NO: 245477 - RNA, 22 nt, Human
ccaggcuuucccagccucucca

SEQ ID NO: 245478 - RNA, 19 nt, Human
uagugaguagugaauuaga

SEQ ID NO: 245479 - RNA, 17 nt, Human
uccagcccugcccgacg

SEQ ID NO: 245480 - RNA, 22 nt, Human
uugagaaaccuggcaguagaga

SEQ ID NO: 245481 - RNA, 22 nt, Human
ugcucagcuucagaggaucccc

SEQ ID NO: 245482 - RNA, 22 nt, Human
accuucugaccaguuaucuuga

SEQ ID NO: 245483 - RNA, 22 nt, Human
cagcuacaggaccugaugcacc

SEQ ID NO: 245484 - RNA, 22 nt, Human
ucaagagauugaauaauaacug

SEQ ID NO: 245485 - RNA, 22 nt, Human
gcugccugcccugggucaucug

SEQ ID NO: 245486 - RNA, 22 nt, Human
uaugcacauugguuuccucauu

SEQ ID NO: 245487 - RNA, 22 nt, Human
acacugugacggaaauaaagaa

SEQ ID NO: 245488 - RNA, 22 nt, Human
auguuuguugaacaucuacugc

SEQ ID NO: 245489 - RNA, 22 nt, Human
ggaaggcuaauaaugcaagaaa

SEQ ID NO: 245490 - RNA, 22 nt, Human
ugcuggcuauuuaaagaagaaa

SEQ ID NO: 245491 - RNA, 22 nt, Human
gguaggaagauagagcaaaguu

SEQ ID NO: 245492 - RNA, 22 nt, Human
guccccagcugugacgagagcc

SEQ ID NO: 245493 - RNA, 22 nt, Human
auaguaacuggcauguuuauga

SEQ ID NO: 245494 - RNA, 22 nt, Human
uuagaaaggggugaaucaaugg

SEQ ID NO: 245495 - RNA, 18 nt, Human
ucaugagguagaggcugg

SEQ ID NO: 245496 - RNA, 22 nt, Human
aucuucaucaaguucacagugg

SEQ ID NO: 245497 - RNA, 22 nt, Human
uuuauagaugucuguauuauaa

SEQ ID NO: 245498 - RNA, 22 nt, Human
ggcucuugagaggcacagguuu

SEQ ID NO: 245499 - RNA, 22 nt, Human
uauacacauaucuucuaggccu

SEQ ID NO: 245500 - RNA, 21 nt, Human
uauacagaggggaacaggaga

SEQ ID NO: 245501 - RNA, 22 nt, Human
aagugauacguguuuauuucca

SEQ ID NO: 245502 - RNA, 22 nt, Human
guguccauguuguucaggguga

SEQ ID NO: 245503 - RNA, 22 nt, Human
uaaugucuaugggccagauaau

SEQ ID NO: 245504 - RNA, 22 nt, Human
ccugggugaaaucucuccugca

SEQ ID NO: 245505 - RNA, 22 nt, Human
cugauacacucccuaaaauaua

SEQ ID NO: 245506 - RNA, 22 nt, Human
aagccugcuuuguuccacagca

SEQ ID NO: 245507 - RNA, 22 nt, Human
uuauguauggauggcugaaagu

SEQ ID NO: 245508 - RNA, 22 nt, Human
auucucuggguuccaguaaaug

SEQ ID NO: 245509 - RNA, 22 nt, Human
uagaaucuuuaaaauucauagu

SEQ ID NO: 245510 - RNA, 21 nt, Human
gcaggugugguaucagcuucc

SEQ ID NO: 245511 - RNA, 19 nt, Human
ugacagguuuuauguguuu

SEQ ID NO: 245512 - RNA, 22 nt, Human
ccugcagagcaggagaggcauc

SEQ ID NO: 245513 - RNA, 22 nt, Human
ucugaggguuacuuuauuaggc

SEQ ID NO: 245514 - RNA, 22 nt, Human
gccucucuccuuggcuugcagu

SEQ ID NO: 245515 - RNA, 22 nt, Human
uguguauuaauguuuguauaug

SEQ ID NO: 245516 - RNA, 22 nt, Human
gcauuuuaauaagauucauagg

SEQ ID NO: 245517 - RNA, 22 nt, Human
ugcaacuuguuuggagagaaag

SEQ ID NO: 245518 - RNA, 22 nt, Human
ccacuguuggcccgaagggguc

SEQ ID NO: 245519 - RNA, 19 nt, Human
auuccucaaggacagaaau

SEQ ID NO: 245520 - RNA, 22 nt, Human
agcugccaaguuggaguagcaa

SEQ ID NO: 245521 - RNA, 22 nt, Human
uagaaacauauaggauggcagg

SEQ ID NO: 245522 - RNA, 21 nt, Human
caaagccaggcaacucucucc

SEQ ID NO: 245523 - RNA, 22 nt, Human
caauaauuuacauuggauacca

SEQ ID NO: 245524 - RNA, 22 nt, Human
acaugacaaaaugcacaggauu

SEQ ID NO: 245525 - RNA, 22 nt, Human
gaauuguaaguaccagcaugcu

SEQ ID NO: 245526 - RNA, 22 nt, Human
uccaggaguggggcagaggucu

SEQ ID NO: 245527 - RNA, 22 nt, Human
ugggcucucacacauguucuga

SEQ ID NO: 245528 - RNA, 22 nt, Human
cccugcagagggaugggggcag

SEQ ID NO: 245529 - RNA, 22 nt, Human
gagcaacaguuuaugguuuuuc

SEQ ID NO: 245530 - RNA, 22 nt, Human
auggcuggauaguugaagcucu

SEQ ID NO: 245531 - RNA, 22 nt, Human
aaggagaaaugguagaugugca

SEQ ID NO: 245532 - RNA, 22 nt, Human
ucagugucuucucuuuccuacc

SEQ ID NO: 245533 - RNA, 22 nt, Human
uacaaagccugguagauaucug

SEQ ID NO: 245534 - RNA, 22 nt, Human
uuccugcuuccuggccucacaa

SEQ ID NO: 245535 - RNA, 22 nt, Human
ugauggaauggaggacaugugg

SEQ ID NO: 245536 - RNA, 22 nt, Human
uguuuucugaugguuaaugagu

SEQ ID NO: 245537 - RNA, 22 nt, Human
gcagccucagggcacucagaug

SEQ ID NO: 245538 - RNA, 22 nt, Human
cugagcuguuacucuguccucg

SEQ ID NO: 245539 - RNA, 22 nt, Human
guccuuggcauucugagucuug

SEQ ID NO: 245540 - RNA, 22 nt, Human
aagcagccuggcaugaugcuuu

SEQ ID NO: 245541 - RNA, 22 nt, Human
aagucucuggcaaaugaucuug

SEQ ID NO: 245542 - RNA, 22 nt, Human
uggaaugacagagagucugaau

SEQ ID NO: 245543 - RNA, 22 nt, Human
agucccuguacuuuccacugcc

SEQ ID NO: 245544 - RNA, 16 nt, Human
aaggcugauuuucccu

SEQ ID NO: 245545 - RNA, 22 nt, Human
gcagcuuugucacggagugucg

SEQ ID NO: 245546 - RNA, 22 nt, Human
uguggauaaugcacuauccaua

SEQ ID NO: 245547 - RNA, 22 nt, Human
ucaaauuauuuaggauagugcu

SEQ ID NO: 245548 - RNA, 21 nt, Human
agaagggauugugguaaagau

SEQ ID NO: 245549 - RNA, 22 nt, Human
uggggaaagggauggcucccgc

SEQ ID NO: 245550 - RNA, 22 nt, Human
aagucacuggcaaaagcugcag

SEQ ID NO: 245551 - RNA, 22 nt, Human
uacuacauacagaauuuagaga

SEQ ID NO: 245552 - RNA, 22 nt, Human
gugcacccccaaggagguggag

SEQ ID NO: 245553 - RNA, 22 nt, Human
uuauauccaaaggcaaggagga

SEQ ID NO: 245554 - RNA, 22 nt, Human
guuuuuguccauggaggcaaac

SEQ ID NO: 245555 - RNA, 23 nt, Human
ucauaaauauuagcacaguagga

SEQ ID NO: 245556 - RNA, 22 nt, Human
uucugggugcaacucuguucug

SEQ ID NO: 245557 - RNA, 22 nt, Human
caguguuucugaguuccagcuc

SEQ ID NO: 245558 - RNA, 22 nt, Human
ccaggacaggaguuggcuucgc

SEQ ID NO: 245559 - RNA, 22 nt, Human
gcaaauucaacagcacauucuc

SEQ ID NO: 245560 - RNA, 20 nt, Human
ucuggggaugaggucuagga

SEQ ID NO: 245561 - RNA, 22 nt, Human
ugagccaggaguuugaggcugu

SEQ ID NO: 245562 - RNA, 22 nt, Human
uccugcugagcgucugucauuu

SEQ ID NO: 245563 - RNA, 22 nt, Human
ccugaggcccuggcugugcuga

SEQ ID NO: 245564 - RNA, 22 nt, Human
uggccuggcugcccugucugga

SEQ ID NO: 245565 - RNA, 22 nt, Human
uauuuaagaugugucauaaaga

SEQ ID NO: 245566 - RNA, 22 nt, Human
auacaaugauugguucucaccc

SEQ ID NO: 245567 - RNA, 22 nt, Human
uaguguucuaagaacauccaug

SEQ ID NO: 245568 - RNA, 22 nt, Human
accaggcucugccaguguuuac

SEQ ID NO: 245569 - RNA, 22 nt, Human
acaagauuuagcuuaaagggcu

SEQ ID NO: 245570 - RNA, 22 nt, Human
uccaggcauagaaggcacgcac

SEQ ID NO: 245571 - RNA, 22 nt, Human
uaaggcuuuauuuuuacaaugc

SEQ ID NO: 245572 - RNA, 22 nt, Human
cagcuguggggagcuugggcca

SEQ ID NO: 245573 - RNA, 22 nt, Human
uccuggccauaggcuauuucag

SEQ ID NO: 245574 - RNA, 22 nt, Human
uguuacaguggcuuuuuaaaca

SEQ ID NO: 245575 - RNA, 22 nt, Human
ugggcacaggggaauggaugaa

SEQ ID NO: 245576 - RNA, 22 nt, Human
uacauguacaugcauagguaga

SEQ ID NO: 245577 - RNA, 22 nt, Human
ggcaaaaacagcaaugacuuuu

SEQ ID NO: 245578 - RNA, 22 nt, Human
cagucuggaggucagcuggcuu

SEQ ID NO: 245579 - RNA, 22 nt, Human
ucuuuggcauuuaggagcagga

SEQ ID NO: 245580 - RNA, 22 nt, Human
auaucuggggacugaauuuaga

SEQ ID NO: 245581 - RNA, 20 nt, Human
guuuuucucucuugccacua

SEQ ID NO: 245582 - RNA, 22 nt, Human
gaaaccuuugccgauggggucc

SEQ ID NO: 245583 - RNA, 22 nt, Human
caaaguaugaaccaguuucucu

SEQ ID NO: 245584 - RNA, 22 nt, Human
ggagagcugacaucaugauguu

SEQ ID NO: 245585 - RNA, 22 nt, Human
agcagcugguucccgagggcgu

SEQ ID NO: 245586 - RNA, 22 nt, Human
acaggacaggcugggcuagacu

SEQ ID NO: 245587 - RNA, 22 nt, Human
agcccaugcaacaggccuagcg

SEQ ID NO: 245588 - RNA, 22 nt, Human
aucagagauuguaguaugugca

SEQ ID NO: 245589 - RNA, 21 nt, Human
guuuagaaguagucuggcuca

SEQ ID NO: 245590 - RNA, 22 nt, Human
ccuaaagaauuuucauagagcu

SEQ ID NO: 245591 - RNA, 22 nt, Human
ucaugacaggugaguuuuuagg

SEQ ID NO: 245592 - RNA, 22 nt, Human
gaaauauuguacuggagauguu

SEQ ID NO: 245593 - RNA, 22 nt, Human
gcagagccaggcuggggcaggu

SEQ ID NO: 245594 - RNA, 22 nt, Human
uuauuccaauuucuccuacaaa

SEQ ID NO: 245595 - RNA, 22 nt, Human
ucaaagagcucuaucuucaaaa

SEQ ID NO: 245596 - RNA, 20 nt, Human
aagaaacuugaaaguacaag

SEQ ID NO: 245597 - RNA, 22 nt, Human
ggcagcuguuuguccuccuguu

SEQ ID NO: 245598 - RNA, 22 nt, Human
ucacagaagagauauugacaga

SEQ ID NO: 245599 - RNA, 22 nt, Human
cacaucugaaaagaugcacaag

SEQ ID NO: 245600 - RNA, 22 nt, Human
cagcgucucguugugggccucg

SEQ ID NO: 245601 - RNA, 23 nt, Human
gaauucuuaaggucacuaaaguc

SEQ ID NO: 245602 - RNA, 22 nt, Human
uaccugcaaaguuccuuuugcc

SEQ ID NO: 245603 - RNA, 22 nt, Human
gucucagggacugcuucugggg

SEQ ID NO: 245604 - RNA, 22 nt, Human
agggggugaaugucugucuaca

SEQ ID NO: 245605 - RNA, 22 nt, Human
cuucagaagaaaagcagugugu

SEQ ID NO: 245606 - RNA, 22 nt, Human
uggaagaaggcagagaggcauu

SEQ ID NO: 245607 - RNA, 22 nt, Human
cuuccaggugcuggccuggccu

SEQ ID NO: 245608 - RNA, 22 nt, Human
aagagcaucaaugacucgcagu

SEQ ID NO: 245609 - RNA, 22 nt, Human
uucugauaacaaacaccaauuu

SEQ ID NO: 245610 - RNA, 22 nt, Human
caugccaacaacaagcaaugag

SEQ ID NO: 245611 - RNA, 22 nt, Human
uuucuugucuuuaguaucuggc

SEQ ID NO: 245612 - RNA, 22 nt, Human
cuuuuuuccuaaggcaacauga

SEQ ID NO: 245613 - RNA, 22 nt, Human
caguggcagagaacagagaccu

SEQ ID NO: 245614 - RNA, 23 nt, Human
uccuuugucuuugcauagauggu

SEQ ID NO: 245615 - RNA, 22 nt, Human
uucccugcaaccuuucccuggg

SEQ ID NO: 245616 - RNA, 22 nt, Human
uguuaaaaccacaggugaggac

SEQ ID NO: 245617 - RNA, 22 nt, Human
ggcuggcuggaugaauggauua

SEQ ID NO: 245618 - RNA, 22 nt, Human
caugaggauccaggugacaggc

SEQ ID NO: 245619 - RNA, 20 nt, Human
ugcugggugggcagcuguaa

SEQ ID NO: 245620 - RNA, 20 nt, Human
cugcucagaccaacucuucu

SEQ ID NO: 245621 - RNA, 22 nt, Human
ugcuggagcccaggcggccuuu

SEQ ID NO: 245622 - RNA, 22 nt, Human
ugaaauguuaaucacacaaagg

SEQ ID NO: 245623 - RNA, 22 nt, Human
ugagcagucauccauuucuccu

SEQ ID NO: 245624 - RNA, 22 nt, Human
guuuuauaauugcuucauaaga

SEQ ID NO: 245625 - RNA, 20 nt, Human
uggcagaguugucccaccca

SEQ ID NO: 245626 - RNA, 22 nt, Human
uugccaggggacaucuggagcc

SEQ ID NO: 245627 - RNA, 22 nt, Human
agggccuggaacugugggcagg

SEQ ID NO: 245628 - RNA, 22 nt, Human
gcaaauauucaagacuuuucca

SEQ ID NO: 245629 - RNA, 22 nt, Human
ucucacugggucacagcagagg

SEQ ID NO: 245630 - RNA, 22 nt, Human
agcaaucagcuucuuuguguuu

SEQ ID NO: 245631 - RNA, 22 nt, Human
uuguuuuuaaacaugugacuga

SEQ ID NO: 245632 - RNA, 22 nt, Human
cuuuggaagccaggcaguucac

SEQ ID NO: 245633 - RNA, 22 nt, Human
gaaucucaggaagaucucugca

SEQ ID NO: 245634 - RNA, 22 nt, Human
aaacaucauaggcaugcaugau

SEQ ID NO: 245635 - RNA, 22 nt, Human
acuguauuuuguacuuucgugu

SEQ ID NO: 245636 - RNA, 22 nt, Human
aagcccuguccggggggaagaa

SEQ ID NO: 245637 - RNA, 22 nt, Human
gcagagugaggaagagcuucca

SEQ ID NO: 245638 - RNA, 22 nt, Human
aucuuugacugccauucuugac

SEQ ID NO: 245639 - RNA, 22 nt, Human
aaacucuauuucuguuggcuua

SEQ ID NO: 245640 - RNA, 22 nt, Human
acuaaaguaucuccuauuucau

SEQ ID NO: 245641 - RNA, 22 nt, Human
cagcccugcuggcaaugaugag

SEQ ID NO: 245642 - RNA, 21 nt, Human
agaaaaaccagcauguuuuca

SEQ ID NO: 245643 - RNA, 22 nt, Human
gaagucuucauucucucugaga

SEQ ID NO: 245644 - RNA, 22 nt, Human
gaccagcuggugaaaaccaauu

SEQ ID NO: 245645 - RNA, 22 nt, Human
uuacagagaggugauugugaag

SEQ ID NO: 245646 - RNA, 22 nt, Human
uggcagcugaauggcuggaugg

SEQ ID NO: 245647 - RNA, 22 nt, Human
gcucugcuaauauuguaguacc

SEQ ID NO: 245648 - RNA, 22 nt, Human
uucaaaguuucaaucuguauca

SEQ ID NO: 245649 - RNA, 22 nt, Human
gucuucuguucugugaggcuuc

SEQ ID NO: 245650 - RNA, 22 nt, Human
cugagggaggagaauugcuuga

SEQ ID NO: 245651 - RNA, 22 nt, Human
agcuucuguucaucuuccaggc

SEQ ID NO: 245652 - RNA, 22 nt, Human
gguguccuacagggccgcaggc

SEQ ID NO: 245653 - RNA, 22 nt, Human
ucccucagcucauauuuaugcc

SEQ ID NO: 245654 - RNA, 22 nt, Human
auuucaaggacuacuuuucaau

SEQ ID NO: 245655 - RNA, 22 nt, Human
cagacagguugcaaaacuucaa

SEQ ID NO: 245656 - RNA, 22 nt, Human
aagucagaauaauguuucuuuu

SEQ ID NO: 245657 - RNA, 22 nt, Human
aaggagaguacaggaguuggua

SEQ ID NO: 245658 - RNA, 22 nt, Human
aggaaugucauagaauaaucau

SEQ ID NO: 245659 - RNA, 22 nt, Human
ugggagagagaauucccagugg

SEQ ID NO: 245660 - RNA, 22 nt, Human
agccauuuugguaaugauaaca

SEQ ID NO: 245661 - RNA, 19 nt, Human
aaaauugcguauuuugagg

SEQ ID NO: 245662 - RNA, 22 nt, Human
gcugcccuucgucaucuauaaa

SEQ ID NO: 245663 - RNA, 22 nt, Human
ucacaugcuacugagccagacc

SEQ ID NO: 245664 - RNA, 22 nt, Human
ucugcauauuguuaauggaaug

SEQ ID NO: 245665 - RNA, 22 nt, Human
gauucaaaaguuugagcuccaa

SEQ ID NO: 245666 - RNA, 22 nt, Human
aagcaaaugugggugcagaauu

SEQ ID NO: 245667 - RNA, 22 nt, Human
ggcagaggaagcuggaaguggg

SEQ ID NO: 245668 - RNA, 22 nt, Human
accaugaugggaagcucagggc

SEQ ID NO: 245669 - RNA, 19 nt, Human
aggcaggugcagagguccc

SEQ ID NO: 245670 - RNA, 22 nt, Human
acacagagcuggaacugcuuca

SEQ ID NO: 245671 - RNA, 22 nt, Human
uuauucugcacuuuuaaaauau

SEQ ID NO: 245672 - RNA, 22 nt, Human
cagagccucugcccugggcacu

SEQ ID NO: 245673 - RNA, 22 nt, Human
cagguuuacaaaguaaagugug

SEQ ID NO: 245674 - RNA, 21 nt, Human
ugggacagugauggcuccucc

SEQ ID NO: 245675 - RNA, 22 nt, Human
gacaggcuuccuaagugccaga

SEQ ID NO: 245676 - RNA, 22 nt, Human
auacaauccagccauugccaca

SEQ ID NO: 245677 - RNA, 22 nt, Human
uaacaaagguugccaaacuaag

SEQ ID NO: 245678 - RNA, 22 nt, Human
aauuucagagguagagauucua

SEQ ID NO: 245679 - RNA, 22 nt, Human
ccccacaguccgugaggagcca

SEQ ID NO: 245680 - RNA, 22 nt, Human
cauggcuuuuagcccuacauga

SEQ ID NO: 245681 - RNA, 22 nt, Human
acugccuguagcucuucaucuc

SEQ ID NO: 245682 - RNA, 22 nt, Human
cuggcuaugugguuagacauaa

SEQ ID NO: 245683 - RNA, 22 nt, Human
uuucucugcuguguuggcagcu

SEQ ID NO: 245684 - RNA, 22 nt, Human
uugcaggguacauucuuagaau

SEQ ID NO: 245685 - RNA, 22 nt, Human
agcaaacagugugcuaagaaau

SEQ ID NO: 245686 - RNA, 22 nt, Human
gcaggggaguggcaggcccgga

SEQ ID NO: 245687 - RNA, 22 nt, Human
uuuugagauggagucuugcucu

SEQ ID NO: 245688 - RNA, 22 nt, Human
aaggcagcaccgccuccugaaa

SEQ ID NO: 245689 - RNA, 22 nt, Human
ugcagguucugaccagccaacu

SEQ ID NO: 245690 - RNA, 22 nt, Human
gcuuaggaaaaugguggaguug

SEQ ID NO: 245691 - RNA, 22 nt, Human
cagucagaggucuucuaaaaca

SEQ ID NO: 245692 - RNA, 22 nt, Human
uaauuuugcugugaccauugaa

SEQ ID NO: 245693 - RNA, 22 nt, Human
ugggaggaaugucacugagcca

SEQ ID NO: 245694 - RNA, 22 nt, Human
uacauugugauguuucaauaca

SEQ ID NO: 245695 - RNA, 22 nt, Human
uaugacaagaaauacagaggua

SEQ ID NO: 245696 - RNA, 17 nt, Human
cugguuuaugggcagug

SEQ ID NO: 245697 - RNA, 22 nt, Human
uggcuucucugugugagggaga

SEQ ID NO: 245698 - RNA, 22 nt, Human
aggcagugagaaauagcaagau

SEQ ID NO: 245699 - RNA, 22 nt, Human
cccaggcagugcugaucccuca

SEQ ID NO: 245700 - RNA, 22 nt, Human
uguagcacagagcuuugacacu

SEQ ID NO: 245701 - RNA, 21 nt, Human
ucagagucucaggagcaaggg

SEQ ID NO: 245702 - RNA, 22 nt, Human
uauguacaucuugagcaaugaa

SEQ ID NO: 245703 - RNA, 22 nt, Human
guuugcuaauuuaaagcuauuu

SEQ ID NO: 245704 - RNA, 22 nt, Human
cugccuggggaaugugaggauu

SEQ ID NO: 245705 - RNA, 22 nt, Human
uuacauuaagccaauggauucu

SEQ ID NO: 245706 - RNA, 22 nt, Human
cuagggacagaaagaggguaga

SEQ ID NO: 245707 - RNA, 22 nt, Human
cccaggacucuucacugcagcc

SEQ ID NO: 245708 - RNA, 22 nt, Human
auuggcuccuucuaacaugucu

SEQ ID NO: 245709 - RNA, 22 nt, Human
ccagaggugcugggagaggucu

SEQ ID NO: 245710 - RNA, 22 nt, Human
ugggcuccagcaccugugcucu

SEQ ID NO: 245711 - RNA, 17 nt, Human
uggcagcugaaagcucu

SEQ ID NO: 245712 - RNA, 22 nt, Human
gcuccagggaguacauuuauca

SEQ ID NO: 245713 - RNA, 22 nt, Human
cauuuguucaaccauucucgcu

SEQ ID NO: 245714 - RNA, 22 nt, Human
ucuggaauuuuauugaucaaaa

SEQ ID NO: 245715 - RNA, 19 nt, Human
ugcauugagggcugucuca

SEQ ID NO: 245716 - RNA, 21 nt, Human
aucaggcucaaaucaucccaa

SEQ ID NO: 245717 - RNA, 22 nt, Human
uaggugaguuuggggaagauag

SEQ ID NO: 245718 - RNA, 22 nt, Human
uugcuugcagacuuagcaaauu

SEQ ID NO: 245719 - RNA, 22 nt, Human
agggucucuugccaugccucag

SEQ ID NO: 245720 - RNA, 22 nt, Human
cuggauucaugccaggccaccc

SEQ ID NO: 245721 - RNA, 22 nt, Human
uuguguacacgccuuuaaauga

SEQ ID NO: 245722 - RNA, 22 nt, Human
uaccagcuuccuucaagaugug

SEQ ID NO: 245723 - RNA, 22 nt, Human
uacagagagauaaguguaaaag

SEQ ID NO: 245724 - RNA, 22 nt, Human
accaugaugcauccuuaaggaa

SEQ ID NO: 245725 - RNA, 20 nt, Human
ugcccacaucacucaggagu

SEQ ID NO: 245726 - RNA, 22 nt, Human
agguggcugagcugugccccug

SEQ ID NO: 245727 - RNA, 22 nt, Human
agugcucaccugucaggucaag

SEQ ID NO: 245728 - RNA, 22 nt, Human
agcuccugaaaauccagacugg

SEQ ID NO: 245729 - RNA, 22 nt, Human
aagaagagaaaugugcugcugg

SEQ ID NO: 245730 - RNA, 20 nt, Human
gcugucugacaguucccaga

SEQ ID NO: 245731 - RNA, 22 nt, Human
gcaaggaggcugguggaggaag

SEQ ID NO: 245732 - RNA, 22 nt, Human
acguuagaaaagcaggagcuca

SEQ ID NO: 245733 - RNA, 22 nt, Human
ccagcuguuggaguuucacugc

SEQ ID NO: 245734 - RNA, 22 nt, Human
gcugcccucuguguuuguccuu

SEQ ID NO: 245735 - RNA, 22 nt, Human
ugacaaauucauauuucagagg

SEQ ID NO: 245736 - RNA, 22 nt, Human
cugaggcuaaccucgagagaca

SEQ ID NO: 245737 - RNA, 22 nt, Human
gcuccuggguguggcugccccu

SEQ ID NO: 245738 - RNA, 20 nt, Human
uccagcccucaugucgcuca

SEQ ID NO: 245739 - RNA, 22 nt, Human
uaggccagaggagcagcuuugg

SEQ ID NO: 245740 - RNA, 18 nt, Human
gcucuggcucaccuccag

SEQ ID NO: 245741 - RNA, 22 nt, Human
uuuaacagauaguuucuucugu

SEQ ID NO: 245742 - RNA, 22 nt, Human
ucucugggagcaauuguuugcu

SEQ ID NO: 245743 - RNA, 22 nt, Human
aucauucagccuaagcaaguac

SEQ ID NO: 245744 - RNA, 22 nt, Human
cagcagcucacucagguggcuc

SEQ ID NO: 245745 - RNA, 22 nt, Human
aaugcuuuagcagugauuagug

SEQ ID NO: 245746 - RNA, 22 nt, Human
uucacuguacugacugucuuau

SEQ ID NO: 245747 - RNA, 19 nt, Human
acauguuuugcagaacagc

SEQ ID NO: 245748 - RNA, 22 nt, Human
caugaaggaauuaagguaagga

SEQ ID NO: 245749 - RNA, 20 nt, Human
uacaggaaucaagacugcau

SEQ ID NO: 245750 - RNA, 22 nt, Human
guucugaguccuccuuugaagg

SEQ ID NO: 245751 - RNA, 22 nt, Human
aagggggcggcagccaguggaa

SEQ ID NO: 245752 - RNA, 22 nt, Human
ggcagcugcugcauuacguugu

SEQ ID NO: 245753 - RNA, 22 nt, Human
gaguuaaaaaugccuccaugga

SEQ ID NO: 245754 - RNA, 22 nt, Human
ugucugucugcacagcucaugg

SEQ ID NO: 245755 - RNA, 22 nt, Human
gcagacagggcuacagagguac

SEQ ID NO: 245756 - RNA, 22 nt, Human
augaggucuggcaaucagaaac

SEQ ID NO: 245757 - RNA, 22 nt, Human
uuuaaaauuuagaccucuccac

SEQ ID NO: 245758 - RNA, 22 nt, Human
ccacauuucuucacuuguccca

SEQ ID NO: 245759 - RNA, 22 nt, Human
aucuaaagugucauaaguagcu

SEQ ID NO: 245760 - RNA, 22 nt, Human
agaggucagcugcaugccacau

SEQ ID NO: 245761 - RNA, 22 nt, Human
aaccagcuaaacuuugcucgaa

SEQ ID NO: 245762 - RNA, 22 nt, Human
ggcugagcaauuuugaugacau

SEQ ID NO: 245763 - RNA, 19 nt, Human
augcagagaauggcaguag

SEQ ID NO: 245764 - RNA, 22 nt, Human
ucacaucugcaaaaucccuuuu

SEQ ID NO: 245765 - RNA, 22 nt, Human
ucuuucugcagcacaggggcag

SEQ ID NO: 245766 - RNA, 23 nt, Human
ugauucagcaaguccacuucugg

SEQ ID NO: 245767 - RNA, 22 nt, Human
guucuguacuccaagcucuucc

SEQ ID NO: 245768 - RNA, 18 nt, Human
agaccagacaagaauggu

SEQ ID NO: 245769 - RNA, 22 nt, Human
cuugucagccaauuguggauuu

SEQ ID NO: 245770 - RNA, 22 nt, Human
ggcucccaggagggccuggagg

SEQ ID NO: 245771 - RNA, 22 nt, Human
uauucucugcagcugaauguuu

SEQ ID NO: 245772 - RNA, 22 nt, Human
agucuggggucugguagaacga

SEQ ID NO: 245773 - RNA, 22 nt, Human
uccuggccaaguagauguggcg

SEQ ID NO: 245774 - RNA, 22 nt, Human
cacagcuggaaugggguaccug

SEQ ID NO: 245775 - RNA, 22 nt, Human
uggcaaaggcgcucacaugccu

SEQ ID NO: 245776 - RNA, 21 nt, Human
agcaggugaaccuccaguaca

SEQ ID NO: 245777 - RNA, 18 nt, Human
ucagggaagagaauauga

SEQ ID NO: 245778 - RNA, 22 nt, Human
uaaaaguuagcuaggacaaagu

SEQ ID NO: 245779 - RNA, 22 nt, Human
ggucacaugugauuugagccaa

SEQ ID NO: 245780 - RNA, 22 nt, Human
ccugauuagggucuuucaaaug

SEQ ID NO: 245781 - RNA, 22 nt, Human
cuggucuguccgcaggucaccu

SEQ ID NO: 245782 - RNA, 21 nt, Human
gaaucuuugauuuacauggga

SEQ ID NO: 245783 - RNA, 22 nt, Human
acaggcagcccucucccugguu

SEQ ID NO: 245784 - RNA, 22 nt, Human
cugccauguuaccugcacaggu

SEQ ID NO: 245785 - RNA, 22 nt, Human
cuuggugagacucccacccacc

SEQ ID NO: 245786 - RNA, 22 nt, Human
ugcagucuguacauuuuaagaa

SEQ ID NO: 245787 - RNA, 21 nt, Human
ugcaccuguucacugcaguuc

SEQ ID NO: 245788 - RNA, 22 nt, Human
ugacauuucuuguugauauaaa

SEQ ID NO: 245789 - RNA, 22 nt, Human
uaaggaaagugccaugauuucu

SEQ ID NO: 245790 - RNA, 21 nt, Human
ucagugcaauucuauggggaa

SEQ ID NO: 245791 - RNA, 22 nt, Human
acugugagugauuuccuucugg

SEQ ID NO: 245792 - RNA, 22 nt, Human
ggcauuuuugacaaagagcaau

SEQ ID NO: 245793 - RNA, 22 nt, Human
uguauucaacuucuuaaaaauu

SEQ ID NO: 245794 - RNA, 22 nt, Human
acuucagaaaauguugaauguu

SEQ ID NO: 245795 - RNA, 22 nt, Human
uaaagguagcaugaaacugcaa

SEQ ID NO: 245796 - RNA, 22 nt, Human
aauucagagacucauucuggag

SEQ ID NO: 245797 - RNA, 22 nt, Human
gggagggaggugaugcuuggcu

SEQ ID NO: 245798 - RNA, 22 nt, Human
cagcagccuggccccuccucgg

SEQ ID NO: 245799 - RNA, 22 nt, Human
cagagccucucagaggucagac

SEQ ID NO: 245800 - RNA, 22 nt, Human
gccugcagacguguuuuccuca

SEQ ID NO: 245801 - RNA, 22 nt, Human
agguggcaguuguggaaccauc

SEQ ID NO: 245802 - RNA, 18 nt, Human
ucaggcugcccugugucu

SEQ ID NO: 245803 - RNA, 22 nt, Human
uuuauugggccuggaggaucua

SEQ ID NO: 245804 - RNA, 22 nt, Human
acauaaugagcucuuuauaaau

SEQ ID NO: 245805 - RNA, 23 nt, Human
uggagcugggcucagacccuggg

SEQ ID NO: 245806 - RNA, 22 nt, Human
gcacaucuggagcucuguggaa

SEQ ID NO: 245807 - RNA, 22 nt, Human
gcuguagggugucauaugaagc

SEQ ID NO: 245808 - RNA, 18 nt, Human
aauguccaguguucauau

SEQ ID NO: 245809 - RNA, 22 nt, Human
uuuacacaaaagauagcacacc

SEQ ID NO: 245810 - RNA, 22 nt, Human
agugacuggugugaaguuaaau

SEQ ID NO: 245811 - RNA, 22 nt, Human
gaagcaguauccugacagcacc

SEQ ID NO: 245812 - RNA, 22 nt, Human
gccacauuagcccucaccaucu

SEQ ID NO: 245813 - RNA, 22 nt, Human
accagcaagauuuugcuuugca

SEQ ID NO: 245814 - RNA, 22 nt, Human
aucucagagaaauuugaaugca

SEQ ID NO: 245815 - RNA, 22 nt, Human
aagacgcacccuuugagggcac

SEQ ID NO: 245816 - RNA, 22 nt, Human
aagagucagcuucuguaugggu

SEQ ID NO: 245817 - RNA, 22 nt, Human
ucuggcucccagccugcucuca

SEQ ID NO: 245818 - RNA, 22 nt, Human
gaggugucuagaucuaccagua

SEQ ID NO: 245819 - RNA, 22 nt, Human
gaacacaacucagaaugcuggu

SEQ ID NO: 245820 - RNA, 22 nt, Human
uugccugggcuaguaagccaga

SEQ ID NO: 245821 - RNA, 22 nt, Human
ccagggcauguaacuaauggug

SEQ ID NO: 245822 - RNA, 22 nt, Human
ucagugucuagggacaguaauc

SEQ ID NO: 245823 - RNA, 22 nt, Human
acuguucauauucuuagaaauu

SEQ ID NO: 245824 - RNA, 23 nt, Human
acccaucucuccugucaugcaga

SEQ ID NO: 245825 - RNA, 22 nt, Human
uggcagaggaaaaagucacugg

SEQ ID NO: 245826 - RNA, 22 nt, Human
uuucaaguacuguaaacaugcu

SEQ ID NO: 245827 - RNA, 22 nt, Human
gagcugaagcgcuacagcaucc

SEQ ID NO: 245828 - RNA, 22 nt, Human
gggugcagggucuccagcagcu

SEQ ID NO: 245829 - RNA, 22 nt, Human
gcagcugccccgacugugaguc

SEQ ID NO: 245830 - RNA, 22 nt, Human
gaggcuucuguucacucacgcu

SEQ ID NO: 245831 - RNA, 22 nt, Human
uacuuucaugucuauacauauu

SEQ ID NO: 245832 - RNA, 22 nt, Human
cagcuuuagagaaaacauauuu

SEQ ID NO: 245833 - RNA, 22 nt, Human
uguggcugugccgucacacgug

SEQ ID NO: 245834 - RNA, 22 nt, Human
aaguguuuaaauuauuugcagg

SEQ ID NO: 245835 - RNA, 21 nt, Human
ugucuucauaugagauggugu

SEQ ID NO: 245836 - RNA, 22 nt, Human
uuagaggacuguaggugggaau

SEQ ID NO: 245837 - RNA, 22 nt, Human
aacuggauuuugaugagcaguu

SEQ ID NO: 245838 - RNA, 22 nt, Human
uucuguuuuagaaauaaguagu

SEQ ID NO: 245839 - RNA, 22 nt, Human
agaauuguaauaauaauagcau

SEQ ID NO: 245840 - RNA, 22 nt, Human
gcccaggagguugggcugugca

SEQ ID NO: 245841 - RNA, 22 nt, Human
ucccugcacccuugcugggccc

SEQ ID NO: 245842 - RNA, 22 nt, Human
uccugggacccugggugcagag

SEQ ID NO: 245843 - RNA, 21 nt, Human
gcccagagggagccaagccca

SEQ ID NO: 245844 - RNA, 22 nt, Human
uuauagaauccaguuguuguau

SEQ ID NO: 245845 - RNA, 22 nt, Human
cucucaguccugcgcgccucug

SEQ ID NO: 245846 - RNA, 22 nt, Human
uuggaacauccaggacagauau

SEQ ID NO: 245847 - RNA, 22 nt, Human
ucccagccuuucuuuucugcug

SEQ ID NO: 245848 - RNA, 22 nt, Human
agagucagcuuaugacacaguc

SEQ ID NO: 245849 - RNA, 22 nt, Human
agcccagcugccugccugcugu

SEQ ID NO: 245850 - RNA, 22 nt, Human
ccugagucuuucccauugcgcu

SEQ ID NO: 245851 - RNA, 22 nt, Human
caccagcuacucggguuuccug

SEQ ID NO: 245852 - RNA, 22 nt, Human
ucagaaguccccagucaaggag

SEQ ID NO: 245853 - RNA, 22 nt, Human
agcagauggugucaugggaugg

SEQ ID NO: 245854 - RNA, 22 nt, Human
caaaaccaagaacauucauuuc

SEQ ID NO: 245855 - RNA, 22 nt, Human
gagauuuagcugcuuaacuccu

SEQ ID NO: 245856 - RNA, 22 nt, Human
aauguauucucuuuauaagaua

SEQ ID NO: 245857 - RNA, 22 nt, Human
cucuccagccaggggcuuccug

SEQ ID NO: 245858 - RNA, 22 nt, Human
ccucuggccagagaaaggccag

SEQ ID NO: 245859 - RNA, 22 nt, Human
gguggcaccuuacccugcgcag

SEQ ID NO: 245860 - RNA, 22 nt, Human
ggccugacugaccugauucuaa

SEQ ID NO: 245861 - RNA, 22 nt, Human
caccugaagauuuagagauuga

SEQ ID NO: 245862 - RNA, 22 nt, Human
aaauuagaaauacuuucaaagc

SEQ ID NO: 245863 - RNA, 22 nt, Human
ugcacacauuaaggauacacag

SEQ ID NO: 245864 - RNA, 22 nt, Human
uucugugcccauuuuaaaaugg

SEQ ID NO: 245865 - RNA, 22 nt, Human
gcccugcagugcggagguggca

SEQ ID NO: 245866 - RNA, 22 nt, Human
augcaacauacauucugaagcu

SEQ ID NO: 245867 - RNA, 19 nt, Human
ucuccaaaaccaaucacua

SEQ ID NO: 245868 - RNA, 22 nt, Human
cauucucuugacaggacagccc

SEQ ID NO: 245869 - RNA, 22 nt, Human
uuggcuuccaggaucucagcag

SEQ ID NO: 245870 - RNA, 22 nt, Human
uuucagacugcugugugaaacu

SEQ ID NO: 245871 - RNA, 22 nt, Human
ccauggccaauugcaccuugcu

SEQ ID NO: 245872 - RNA, 17 nt, Human
agucagaggaguaucug

SEQ ID NO: 245873 - RNA, 22 nt, Human
agcuaaugggagacccuuucac

SEQ ID NO: 245874 - RNA, 22 nt, Human
auacaugacucacacauucugc

SEQ ID NO: 245875 - RNA, 22 nt, Human
gcaggcucccuugcagagcagg

SEQ ID NO: 245876 - RNA, 21 nt, Human
uuuuuucuugcgugaggccug

SEQ ID NO: 245877 - RNA, 23 nt, Human
ucagaauaauaaccuaguaacug

SEQ ID NO: 245878 - RNA, 22 nt, Human
acucaaauagcugccccuagug

SEQ ID NO: 245879 - RNA, 22 nt, Human
ugagagcacacagaaauauuuu

SEQ ID NO: 245880 - RNA, 22 nt, Human
ggacgcagccgagggagcaggg

SEQ ID NO: 245881 - RNA, 21 nt, Human
ucuuucugaaaucucagucug

SEQ ID NO: 245882 - RNA, 22 nt, Human
ugaaggcuguuggauggggaag

SEQ ID NO: 245883 - RNA, 22 nt, Human
caaagcagagccagagcuuguc

SEQ ID NO: 245884 - RNA, 22 nt, Human
cgggagccucugggucacacug

SEQ ID NO: 245885 - RNA, 22 nt, Human
ggcaguuucucaggcaggggua

SEQ ID NO: 245886 - RNA, 22 nt, Human
auucucuggcuaaaaccugaag

SEQ ID NO: 245887 - RNA, 22 nt, Human
aauuacaaauguagacucucau

SEQ ID NO: 245888 - RNA, 20 nt, Human
cuacauguucugcuucucuc

SEQ ID NO: 245889 - RNA, 22 nt, Human
uagaggagaguugcuggaugga

SEQ ID NO: 245890 - RNA, 22 nt, Human
ucauuuaugcaggaauggcaua

SEQ ID NO: 245891 - RNA, 22 nt, Human
agacagguaaauagagaugcug

SEQ ID NO: 245892 - RNA, 22 nt, Human
agugggacaguguagagcguca

SEQ ID NO: 245893 - RNA, 22 nt, Human
uugcuuuugugugcucucugga

SEQ ID NO: 245894 - RNA, 22 nt, Human
cugcccacaguucucugccaug

SEQ ID NO: 245895 - RNA, 22 nt, Human
agauuuacucccugcuuccgcc

SEQ ID NO: 245896 - RNA, 22 nt, Human
gggcugagggccaauuccuacu

SEQ ID NO: 245897 - RNA, 22 nt, Human
uauugcuggugcuguucugaau

SEQ ID NO: 245898 - RNA, 22 nt, Human
uacaaugcaaaauacugucugc

SEQ ID NO: 245899 - RNA, 22 nt, Human
cccaggaccgcgcggcugagcg

SEQ ID NO: 245900 - RNA, 22 nt, Human
ucaggccaggagaucagauuga

SEQ ID NO: 245901 - RNA, 22 nt, Human
ggcugggcuccgggagcaugcg

SEQ ID NO: 245902 - RNA, 22 nt, Human
gcuggaagaaugagugccucgu

SEQ ID NO: 245903 - RNA, 22 nt, Human
ucuggccucuugggaugcuccc

SEQ ID NO: 245904 - RNA, 22 nt, Human
uuauuaggaaaaggucagaugu

SEQ ID NO: 245905 - RNA, 22 nt, Human
cacuuaucucauuuaaucacca

SEQ ID NO: 245906 - RNA, 18 nt, Human
uugaggaguucacugucu

SEQ ID NO: 245907 - RNA, 22 nt, Human
uuucucagagcacggggaguga

SEQ ID NO: 245908 - RNA, 22 nt, Human
cuccccuucuugccagauccuu

SEQ ID NO: 245909 - RNA, 22 nt, Human
ugauauuuaagcaaaaauaugg

SEQ ID NO: 245910 - RNA, 22 nt, Human
ugaggaauguuuugagugccga

SEQ ID NO: 245911 - RNA, 19 nt, Human
ggcucucccuugagagagc

SEQ ID NO: 245912 - RNA, 22 nt, Human
gcuuucugauugcgaaaacaaa

SEQ ID NO: 245913 - RNA, 22 nt, Human
ucucuguaguugggcagcugcu

SEQ ID NO: 245914 - RNA, 22 nt, Human
gacagucugggcacacaugaaa

SEQ ID NO: 245915 - RNA, 22 nt, Human
ggguggggccaggcaauuugca

SEQ ID NO: 245916 - RNA, 22 nt, Human
ugccugcauuuuguggcuggcu

SEQ ID NO: 245917 - RNA, 22 nt, Human
uucuuuccuugccucagugaag

SEQ ID NO: 245918 - RNA, 22 nt, Human
agcugugugugcuugggauuau

SEQ ID NO: 245919 - RNA, 22 nt, Human
uggccugaguugucugcaggcc

SEQ ID NO: 245920 - RNA, 22 nt, Human
aagucuggugcuguccucaccc

SEQ ID NO: 245921 - RNA, 22 nt, Human
gaacuuuaauuagcuuuugucu

SEQ ID NO: 245922 - RNA, 22 nt, Human
caagaaucuugcagcuuagacu

SEQ ID NO: 245923 - RNA, 22 nt, Human
aucuuggacuacagaagagagg

SEQ ID NO: 245924 - RNA, 22 nt, Human
uucucugggaacauaaaugaag

SEQ ID NO: 245925 - RNA, 22 nt, Human
uguucagagacagaaauucuaa

SEQ ID NO: 245926 - RNA, 22 nt, Human
ccuggcucagaccccaguucug

SEQ ID NO: 245927 - RNA, 22 nt, Human
ccugggccuauccuagaaccaa

SEQ ID NO: 245928 - RNA, 22 nt, Human
gaagcaaagagcuagugccgcu

SEQ ID NO: 245929 - RNA, 22 nt, Human
ggagaggguagggguccugccc

SEQ ID NO: 245930 - RNA, 22 nt, Human
cucuuuggggugccccacuggu

SEQ ID NO: 245931 - RNA, 22 nt, Human
cuguucaugcugauucuguaug

SEQ ID NO: 245932 - RNA, 22 nt, Human
ccugcaccaggcccagcauggu

SEQ ID NO: 245933 - RNA, 22 nt, Human
gcucugagcccccagaagcaga

SEQ ID NO: 245934 - RNA, 22 nt, Human
agaacuuaggaacaacagcuua

SEQ ID NO: 245935 - RNA, 22 nt, Human
gcagugcaugucggaacucauu

SEQ ID NO: 245936 - RNA, 22 nt, Human
aagcagaaggggaauaauauuu

SEQ ID NO: 245937 - RNA, 18 nt, Human
acccaggcucaugguccu

SEQ ID NO: 245938 - RNA, 21 nt, Human
aaguaaugugucucuucuacc

SEQ ID NO: 245939 - RNA, 22 nt, Human
aguccaggcauuccagccauuc

SEQ ID NO: 245940 - RNA, 22 nt, Human
ugcugcucacacacagugaaug

SEQ ID NO: 245941 - RNA, 22 nt, Human
guuagaauaaaaggucagagag

SEQ ID NO: 245942 - RNA, 22 nt, Human
auucacaugcccaagcagcacc

SEQ ID NO: 245943 - RNA, 16 nt, Human
agagguuuacagccug

SEQ ID NO: 245944 - RNA, 20 nt, Human
gcuucucagggcuucucuga

SEQ ID NO: 245945 - RNA, 22 nt, Human
acacaaaaucaaaguccuaggc

SEQ ID NO: 245946 - RNA, 22 nt, Human
auuucuucagguucuucuagga

SEQ ID NO: 245947 - RNA, 22 nt, Human
acagugcacauccugagugauu

SEQ ID NO: 245948 - RNA, 22 nt, Human
ucugagacuuuaaccuggggcc

SEQ ID NO: 245949 - RNA, 22 nt, Human
cuuugcugagcugguuguucaa

SEQ ID NO: 245950 - RNA, 22 nt, Human
gacagguggguaccuuuaugga

SEQ ID NO: 245951 - RNA, 22 nt, Human
caggcaggagacauuugguugg

SEQ ID NO: 245952 - RNA, 23 nt, Human
gaagucagcccuacagagagcag

SEQ ID NO: 245953 - RNA, 22 nt, Human
uguauuuuuaggaaugcgcuau

SEQ ID NO: 245954 - RNA, 22 nt, Human
cagggcugucuccaaaggcccc

SEQ ID NO: 245955 - RNA, 22 nt, Human
agcuggguucagaggcacaugg

SEQ ID NO: 245956 - RNA, 22 nt, Human
ugagacaguuggugaaaucuaa

SEQ ID NO: 245957 - RNA, 22 nt, Human
gcugguuuccuuaucuauaaag

SEQ ID NO: 245958 - RNA, 22 nt, Human
aagguuaaauagguauuuucca

SEQ ID NO: 245959 - RNA, 22 nt, Human
ucuaagaauacucauaucuucu

SEQ ID NO: 245960 - RNA, 22 nt, Human
uccuacaucagcucucaguagc

SEQ ID NO: 245961 - RNA, 22 nt, Human
cuggggcucacuccagcccugg

SEQ ID NO: 245962 - RNA, 22 nt, Human
gcacacaugugaguguccuuuc

SEQ ID NO: 245963 - RNA, 22 nt, Human
ugcccuggcacacacacagcug

SEQ ID NO: 245964 - RNA, 22 nt, Human
aaugggcuuucuuggacaggag

SEQ ID NO: 245965 - RNA, 22 nt, Human
acuucauguuguuuacaacuua

SEQ ID NO: 245966 - RNA, 22 nt, Human
ugauccauauguguuacuucuc

SEQ ID NO: 245967 - RNA, 22 nt, Human
aagcugauucuaaaauuuauua

SEQ ID NO: 245968 - RNA, 22 nt, Human
aagugcaggucucagcuacucu

SEQ ID NO: 245969 - RNA, 22 nt, Human
gucugggcaggaaucugcauuc

SEQ ID NO: 245970 - RNA, 20 nt, Human
uaggcaauuaguagauaaca

SEQ ID NO: 245971 - RNA, 22 nt, Human
agugucugcuuaucaguucuug

SEQ ID NO: 245972 - RNA, 22 nt, Human
gcacacaucuuguaauccugag

SEQ ID NO: 245973 - RNA, 22 nt, Human
gagggcugcugccagauaugcc

SEQ ID NO: 245974 - RNA, 22 nt, Human
cccugggagaaguugagggcug

SEQ ID NO: 245975 - RNA, 22 nt, Human
cuauuucuaaaccuauaaguga

SEQ ID NO: 245976 - RNA, 22 nt, Human
ccacaggcugcugcaggucccg

SEQ ID NO: 245977 - RNA, 22 nt, Human
gcauuucuuccuggugugagcc

SEQ ID NO: 245978 - RNA, 22 nt, Human
gcuuuugucauucaaaugcucu

SEQ ID NO: 245979 - RNA, 18 nt, Human
cugugcagcaaacugagc

SEQ ID NO: 245980 - RNA, 22 nt, Human
ucccugcauuugggagaguguc

SEQ ID NO: 245981 - RNA, 22 nt, Human
cuaaaugacuuccagugguuau

SEQ ID NO: 245982 - RNA, 22 nt, Human
cacaugcauaaggauaauuacu

SEQ ID NO: 245983 - RNA, 22 nt, Human
ccuuggcccuagccucaggcaa

SEQ ID NO: 245984 - RNA, 22 nt, Human
cauuauauuacagcacuguuaa

SEQ ID NO: 245985 - RNA, 20 nt, Human
ucccaaggaugccugggugu

SEQ ID NO: 245986 - RNA, 22 nt, Human
uauucuuguauacuacaaucuu

SEQ ID NO: 245987 - RNA, 22 nt, Human
gauuuucugagccuucaaauuu

SEQ ID NO: 245988 - RNA, 22 nt, Human
ucuccuggauagauacuaucca

SEQ ID NO: 245989 - RNA, 22 nt, Human
auacaguauuaccuguucagga

SEQ ID NO: 245990 - RNA, 22 nt, Human
ggagcagcuugcaugcucaggg

SEQ ID NO: 245991 - RNA, 22 nt, Human
uccuggggccagcacuggugga

SEQ ID NO: 245992 - RNA, 23 nt, Human
aucugggcaucuggagugguccu

SEQ ID NO: 245993 - RNA, 22 nt, Human
ugcagggcagcuagggagcuuu

SEQ ID NO: 245994 - RNA, 16 nt, Human
aauugcuucuugcugc

SEQ ID NO: 245995 - RNA, 18 nt, Human
ucccucagaauuauagaa

SEQ ID NO: 245996 - RNA, 22 nt, Human
cauuuagagaagauuacaagga

SEQ ID NO: 245997 - RNA, 22 nt, Human
ugugacagaauuggucuguucu

SEQ ID NO: 245998 - RNA, 22 nt, Human
gcacacagaacauuuggauccu

SEQ ID NO: 245999 - RNA, 22 nt, Human
ccaggguuuaaauucugacuau

SEQ ID NO: 246000 - RNA, 22 nt, Human
caaggccaagucucugugaaga

SEQ ID NO: 246001 - RNA, 21 nt, Human
agcagcagaucuggugagggc

SEQ ID NO: 246002 - RNA, 22 nt, Human
cugggcucaguggcucauggcu

SEQ ID NO: 246003 - RNA, 22 nt, Human
ugcucugggcucaauggcagcu

SEQ ID NO: 246004 - RNA, 22 nt, Human
guggcuucaucaacugugcuua

SEQ ID NO: 246005 - RNA, 22 nt, Human
ucacacgugagguucuauccug

SEQ ID NO: 246006 - RNA, 18 nt, Human
cugcccagagcauuucau

SEQ ID NO: 246007 - RNA, 22 nt, Human
ucucuggcuuagguugagugca

SEQ ID NO: 246008 - RNA, 22 nt, Human
ccuccaggaacuugagagacac

SEQ ID NO: 246009 - RNA, 22 nt, Human
ucugaagagcuuuggaaguaug

SEQ ID NO: 246010 - RNA, 17 nt, Human
cacaugucuacauggau

SEQ ID NO: 246011 - RNA, 22 nt, Human
guucuguagucauagagcaauu

SEQ ID NO: 246012 - RNA, 22 nt, Human
cacauaauacauguuccacuua

SEQ ID NO: 246013 - RNA, 19 nt, Human
gcaggcaguggcauucgga

SEQ ID NO: 246014 - RNA, 22 nt, Human
gauucuuuacaucucugcugac

SEQ ID NO: 246015 - RNA, 22 nt, Human
uugugaaauguuucaaaauagu

SEQ ID NO: 246016 - RNA, 21 nt, Human
cugaauuaugugcuuaccuuu

SEQ ID NO: 246017 - RNA, 22 nt, Human
aaaaggauguuuucaugaaaca

SEQ ID NO: 246018 - RNA, 22 nt, Human
auaucuuuguuuuugccaagau

SEQ ID NO: 246019 - RNA, 22 nt, Human
cuggcugggagcgagcugcuca

SEQ ID NO: 246020 - RNA, 22 nt, Human
aacugcuuagugauggaugacc

SEQ ID NO: 246021 - RNA, 22 nt, Human
aagaguuucugauucaguaggu

SEQ ID NO: 246022 - RNA, 18 nt, Human
gacaaaaguacagacaga

SEQ ID NO: 246023 - RNA, 22 nt, Human
aaguaaaccacagagaagccac

SEQ ID NO: 246024 - RNA, 22 nt, Human
guacuucccugggaggcaagca

SEQ ID NO: 246025 - RNA, 22 nt, Human
gggaucugaugcacugcugaaa

SEQ ID NO: 246026 - RNA, 22 nt, Human
aaacugaggaacaaggaaggau

SEQ ID NO: 246027 - RNA, 22 nt, Human
gaguggggcuuuaaaggcucag

SEQ ID NO: 246028 - RNA, 22 nt, Human
gcagaaggauccgcaggugcaa

SEQ ID NO: 246029 - RNA, 22 nt, Human
ugagggacaccagggcuggagc

SEQ ID NO: 246030 - RNA, 22 nt, Human
aaagccuuugucucaggcucug

SEQ ID NO: 246031 - RNA, 23 nt, Human
ccauaaucaggguuguggggucc

SEQ ID NO: 246032 - RNA, 22 nt, Human
uuuuaaaggauagcucugguug

SEQ ID NO: 246033 - RNA, 22 nt, Human
aauaaagacucagaggcccagg

SEQ ID NO: 246034 - RNA, 22 nt, Human
uaauuccuagaaauuauucuca

SEQ ID NO: 246035 - RNA, 22 nt, Human
ggaaagagcccagcagugcuug

SEQ ID NO: 246036 - RNA, 22 nt, Human
aaaaugaggucaauauccuuuu

SEQ ID NO: 246037 - RNA, 22 nt, Human
uucugggcuaccuucccggcag

SEQ ID NO: 246038 - RNA, 22 nt, Human
cagcauuuggaggagaggcuuu

SEQ ID NO: 246039 - RNA, 22 nt, Human
cagcuuuaguaacccacugcuc

SEQ ID NO: 246040 - RNA, 22 nt, Human
gagcuucauauguugcagagaa

SEQ ID NO: 246041 - RNA, 22 nt, Human
uguccuuugggagggcacagcu

SEQ ID NO: 246042 - RNA, 22 nt, Human
uugcaacuucucccaucacucu

SEQ ID NO: 246043 - RNA, 20 nt, Human
guaaaauauggucuuugggu

SEQ ID NO: 246044 - RNA, 22 nt, Human
ucucuggaagcgcagaucuguu

SEQ ID NO: 246045 - RNA, 22 nt, Human
uugcaauugcuauggagagcgu

SEQ ID NO: 246046 - RNA, 22 nt, Human
aaauggaauguguuuauaauuc

SEQ ID NO: 246047 - RNA, 22 nt, Human
agaggccaucugcucugugggg

SEQ ID NO: 246048 - RNA, 22 nt, Human
acccaggagguggaggcugcag

SEQ ID NO: 246049 - RNA, 22 nt, Human
uccuucccaggugucgccgccu

SEQ ID NO: 246050 - RNA, 23 nt, Human
ucagaaugcacugaauuuacccu

SEQ ID NO: 246051 - RNA, 22 nt, Human
ugggcuauuaggaccaggccau

SEQ ID NO: 246052 - RNA, 22 nt, Human
acagugcagggcgggaagaagg

SEQ ID NO: 246053 - RNA, 16 nt, Human
ucuuuguaaucagcag

SEQ ID NO: 246054 - RNA, 22 nt, Human
aguguggcaggaaugacuagaa

SEQ ID NO: 246055 - RNA, 22 nt, Human
cauaauuuuuuuaagucagaac

SEQ ID NO: 246056 - RNA, 22 nt, Human
gaggcagugcauugucuagggg

SEQ ID NO: 246057 - RNA, 22 nt, Human
ucaauuucauucuauuaguuaa

SEQ ID NO: 246058 - RNA, 22 nt, Human
aaagaauuuguacacccuacua

SEQ ID NO: 246059 - RNA, 22 nt, Human
gcugucugucuucacaucucgc

SEQ ID NO: 246060 - RNA, 22 nt, Human
gagggaggcaucaugaauccag

SEQ ID NO: 246061 - RNA, 22 nt, Human
ggcugcucggagccuccuguga

SEQ ID NO: 246062 - RNA, 22 nt, Human
gccugcagaggugcugcuagcu

SEQ ID NO: 246063 - RNA, 22 nt, Human
cucuccagaauuauuacuauua

SEQ ID NO: 246064 - RNA, 22 nt, Human
acccagccuacaaagcucaccu

SEQ ID NO: 246065 - RNA, 22 nt, Human
uucauugaaccacuuuauucuu

SEQ ID NO: 246066 - RNA, 22 nt, Human
uggcucuggagcuggcggcuga

SEQ ID NO: 246067 - RNA, 22 nt, Human
guucauauucuaaguaacuggc

SEQ ID NO: 246068 - RNA, 22 nt, Human
acuacacuccaauuuucuaggu

SEQ ID NO: 246069 - RNA, 22 nt, Human
uauuuccaaaagccuauuauga

SEQ ID NO: 246070 - RNA, 21 nt, Human
auauuguagguaaagugcagg

SEQ ID NO: 246071 - RNA, 22 nt, Human
uguuucaggaccuaucuuuuag

SEQ ID NO: 246072 - RNA, 22 nt, Human
aguuuacucuggugacaauuua

SEQ ID NO: 246073 - RNA, 22 nt, Human
cagggacaggggagaaaagaug

SEQ ID NO: 246074 - RNA, 23 nt, Human
ugaaacauuuaggguagaauuuc

SEQ ID NO: 246075 - RNA, 22 nt, Human
ucugucagccccucagcuguca

SEQ ID NO: 246076 - RNA, 21 nt, Human
cuguccuggucuagaggcaca

SEQ ID NO: 246077 - RNA, 22 nt, Human
gcacugguaucaccugagagcu

SEQ ID NO: 246078 - RNA, 18 nt, Human
ucccuccugccugcuucc

SEQ ID NO: 246079 - RNA, 22 nt, Human
cucuggaauguuuacaugcccu

SEQ ID NO: 246080 - RNA, 19 nt, Human
ucuccaguugcuuucaggg

SEQ ID NO: 246081 - RNA, 22 nt, Human
uguggccucuaagcucacgaag

SEQ ID NO: 246082 - RNA, 21 nt, Human
ucauguguaacuuuugaccac

SEQ ID NO: 246083 - RNA, 22 nt, Human
agaaagaacgcacuugugcugc

SEQ ID NO: 246084 - RNA, 22 nt, Human
agaaugcauuuuguguagcuau

SEQ ID NO: 246085 - RNA, 22 nt, Human
gaaaaggauugguaaaauaucu

SEQ ID NO: 246086 - RNA, 22 nt, Human
gaggccaggggucagcaauugg

SEQ ID NO: 246087 - RNA, 17 nt, Human
uaucaagaagucuggcc

SEQ ID NO: 246088 - RNA, 22 nt, Human
uccagagggcgauggcuggggg

SEQ ID NO: 246089 - RNA, 22 nt, Human
agauccaucaucauauuuucua

SEQ ID NO: 246090 - RNA, 22 nt, Human
agugcugaggccauacuccaua

SEQ ID NO: 246091 - RNA, 22 nt, Human
ucuaaagauguuuauugacaua

SEQ ID NO: 246092 - RNA, 23 nt, Human
gccugugccuaugcccagcucug

SEQ ID NO: 246093 - RNA, 22 nt, Human
gguguccuuugggggcuccgag

SEQ ID NO: 246094 - RNA, 22 nt, Human
gaagcugggucgcugggauccu

SEQ ID NO: 246095 - RNA, 22 nt, Human
accauuacaugauccuuaccca

SEQ ID NO: 246096 - RNA, 22 nt, Human
caacaagcgcucagagcaaagc

SEQ ID NO: 246097 - RNA, 22 nt, Human
uucagcaaauggacuguucagg

SEQ ID NO: 246098 - RNA, 22 nt, Human
aguugaauaauuagacauaucu

SEQ ID NO: 246099 - RNA, 21 nt, Human
uccaggagcacgggacuagga

SEQ ID NO: 246100 - RNA, 22 nt, Human
aggcuucugcugauauuucauu

SEQ ID NO: 246101 - RNA, 22 nt, Human
agauccacuauggugcugauga

SEQ ID NO: 246102 - RNA, 19 nt, Human
aggcagucauuggaauaua

SEQ ID NO: 246103 - RNA, 22 nt, Human
guggaggagaggcgccuugcgg

SEQ ID NO: 246104 - RNA, 22 nt, Human
gaacaggguugggugagagagg

SEQ ID NO: 246105 - RNA, 22 nt, Human
uuuaugcaucucuaggaagggc

SEQ ID NO: 246106 - RNA, 22 nt, Human
ccugaagaugcuguggccuggu

SEQ ID NO: 246107 - RNA, 22 nt, Human
aauguguagggugccuguuuuu

SEQ ID NO: 246108 - RNA, 22 nt, Human
uaggcuccucucacauucuauu

SEQ ID NO: 246109 - RNA, 22 nt, Human
cugccuuugcccuugacacugu

SEQ ID NO: 246110 - RNA, 22 nt, Human
accugggauggggccagguuua

SEQ ID NO: 246111 - RNA, 22 nt, Human
acagguggcacugcuguuacuc

SEQ ID NO: 246112 - RNA, 22 nt, Human
gagagaaaagggggaauugauu

SEQ ID NO: 246113 - RNA, 22 nt, Human
uguuaugaacuucuagaaaaca

SEQ ID NO: 246114 - RNA, 22 nt, Human
gcugagcucccagcaguaucug

SEQ ID NO: 246115 - RNA, 22 nt, Human
aagacauuuaugaaaagugcug

SEQ ID NO: 246116 - RNA, 22 nt, Human
ccugggugaugugcugcccucg

SEQ ID NO: 246117 - RNA, 22 nt, Human
augacugcucugggcucccaug

SEQ ID NO: 246118 - RNA, 22 nt, Human
uuugacaaaggaaaaaugcaca

SEQ ID NO: 246119 - RNA, 22 nt, Human
aggcacuuaauaaggauucaau

SEQ ID NO: 246120 - RNA, 22 nt, Human
uggaggagaccgcauuuuauuu

SEQ ID NO: 246121 - RNA, 22 nt, Human
uuagcucagaaaauuuaaacuu

SEQ ID NO: 246122 - RNA, 22 nt, Human
guucucccuguccccugagcuu

SEQ ID NO: 246123 - RNA, 22 nt, Human
cauccauuaacucauuuguuuc

SEQ ID NO: 246124 - RNA, 22 nt, Human
aacaugauggggaagaacaaga

SEQ ID NO: 246125 - RNA, 22 nt, Human
aggcuggcugagcugcagccug

SEQ ID NO: 246126 - RNA, 22 nt, Human
guuacagucaggagauauuuug

SEQ ID NO: 246127 - RNA, 22 nt, Human
caggcuuggcagggaggcuggu

SEQ ID NO: 246128 - RNA, 22 nt, Human
acucagaggcuggaaaucaaag

SEQ ID NO: 246129 - RNA, 22 nt, Human
cuggucccugcagugugcuggg

SEQ ID NO: 246130 - RNA, 22 nt, Human
caggcugcagugcaguggcuau

SEQ ID NO: 246131 - RNA, 22 nt, Human
cccucucugacuucugaacuug

SEQ ID NO: 246132 - RNA, 22 nt, Human
aucauaagacccagccaguauu

SEQ ID NO: 246133 - RNA, 22 nt, Human
aagaguuuuuggagugugaguu

SEQ ID NO: 246134 - RNA, 22 nt, Human
uccauauaaugggauuccuuau

SEQ ID NO: 246135 - RNA, 22 nt, Human
gugcaugguaagaugcuucaca

SEQ ID NO: 246136 - RNA, 20 nt, Human
cccucccagaugcuucccaa

SEQ ID NO: 246137 - RNA, 22 nt, Human
ugagcaggcgcagcaggagguc

SEQ ID NO: 246138 - RNA, 22 nt, Human
uccuggcauugugcagggugug

SEQ ID NO: 246139 - RNA, 22 nt, Human
caggggcagucugugugcgugg

SEQ ID NO: 246140 - RNA, 22 nt, Human
ggagucugacucugacccugga

SEQ ID NO: 246141 - RNA, 22 nt, Human
uggagcuggaauuugagcugga

SEQ ID NO: 246142 - RNA, 22 nt, Human
ucuucuuuuauuucaagggugu

SEQ ID NO: 246143 - RNA, 22 nt, Human
uucacuuaacaucauaucauga

SEQ ID NO: 246144 - RNA, 22 nt, Human
uuaaggaaagccaaaaugaauu

SEQ ID NO: 246145 - RNA, 22 nt, Human
ggagggggacugacacugauuu

SEQ ID NO: 246146 - RNA, 22 nt, Human
aagcccaguuucacacugagac

SEQ ID NO: 246147 - RNA, 22 nt, Human
uacagguaaaauuaucagaaac

SEQ ID NO: 246148 - RNA, 22 nt, Human
gcugucuuggguagaaagaggu

SEQ ID NO: 246149 - RNA, 22 nt, Human
ccucccagaugugcccaaugga

SEQ ID NO: 246150 - RNA, 19 nt, Human
gcuggcuggaggagggaca

SEQ ID NO: 246151 - RNA, 22 nt, Human
aaaugcaccuugcugugagacu

SEQ ID NO: 246152 - RNA, 22 nt, Human
uuacaaagugcugcaccauuuu

SEQ ID NO: 246153 - RNA, 22 nt, Human
ugguaacuuucagcauggugac

SEQ ID NO: 246154 - RNA, 22 nt, Human
agagagcauggcacagaggggu

SEQ ID NO: 246155 - RNA, 22 nt, Human
ucacugugcucucuagauaggc

SEQ ID NO: 246156 - RNA, 22 nt, Human
ccuacaguuauauucuugauug

SEQ ID NO: 246157 - RNA, 22 nt, Human
gacaagauaaugaagugcaauu

SEQ ID NO: 246158 - RNA, 22 nt, Human
gcuuccagaccccagucccuca

SEQ ID NO: 246159 - RNA, 22 nt, Human
uccaggccacauggauggcgau

SEQ ID NO: 246160 - RNA, 22 nt, Human
caaggccaagguuuugugaacu

SEQ ID NO: 246161 - RNA, 22 nt, Human
ggagaccuuaaggugcuuccua

SEQ ID NO: 246162 - RNA, 22 nt, Human
gagcuauaauagagcuucagug

SEQ ID NO: 246163 - RNA, 22 nt, Human
uuguacagacccugaaaagcuc

SEQ ID NO: 246164 - RNA, 22 nt, Human
ucuguucagacacuuuacaugu

SEQ ID NO: 246165 - RNA, 19 nt, Human
uccuggcacaguggaacca

SEQ ID NO: 246166 - RNA, 22 nt, Human
cccauuuaaacacaagcuuuca

SEQ ID NO: 246167 - RNA, 22 nt, Human
gcaagaugguuauaaaaaaugu

SEQ ID NO: 246168 - RNA, 22 nt, Human
gcacuggggucauagccuccag

SEQ ID NO: 246169 - RNA, 23 nt, Human
guguguccauucgcacucuuagg

SEQ ID NO: 246170 - RNA, 19 nt, Human
uagcccagagccuggcuac

SEQ ID NO: 246171 - RNA, 23 nt, Human
gggcagguuuuuauaggcuucag

SEQ ID NO: 246172 - RNA, 22 nt, Human
gcccucagcaggaaagaucaac

SEQ ID NO: 246173 - RNA, 22 nt, Human
cugcagggccauggguucuaua

SEQ ID NO: 246174 - RNA, 22 nt, Human
ucugaggcccugcaggcagugu

SEQ ID NO: 246175 - RNA, 22 nt, Human
ugcacuccaggcugggugacag

SEQ ID NO: 246176 - RNA, 22 nt, Human
aggccagccucaggcagggacc

SEQ ID NO: 246177 - RNA, 22 nt, Human
agcugcaguucguuccagcucu

SEQ ID NO: 246178 - RNA, 22 nt, Human
ccaggcacgguggcucaugccu

SEQ ID NO: 246179 - RNA, 19 nt, Human
gaacuuggccaggcacagu

SEQ ID NO: 246180 - RNA, 22 nt, Human
acuauucaagugcucauucaga

SEQ ID NO: 246181 - RNA, 22 nt, Human
aaugucaauuaccagaacagaa

SEQ ID NO: 246182 - RNA, 22 nt, Human
cugggacagcugagacaggaga

SEQ ID NO: 246183 - RNA, 22 nt, Human
uucuucaguuugguaaauguaa

SEQ ID NO: 246184 - RNA, 22 nt, Human
agagcuguguuaagaacaggcc

SEQ ID NO: 246185 - RNA, 22 nt, Human
gggguugguuuaaaugcuugag

SEQ ID NO: 246186 - RNA, 22 nt, Human
ugaguauuccuuaucugaaaug

SEQ ID NO: 246187 - RNA, 20 nt, Human
caucuuuggcaggacuccuu

SEQ ID NO: 246188 - RNA, 22 nt, Human
auccuggcccucaugaccccuu

SEQ ID NO: 246189 - RNA, 22 nt, Human
uuacuaguauaugucaagcaac

SEQ ID NO: 246190 - RNA, 22 nt, Human
gccuggcacaguagggacccaa

SEQ ID NO: 246191 - RNA, 18 nt, Human
ccugagcccugcuuacuu

SEQ ID NO: 246192 - RNA, 22 nt, Human
uaacuguauagcuuggacuaaa

SEQ ID NO: 246193 - RNA, 22 nt, Human
cucuugggagugcucuggagaa

SEQ ID NO: 246194 - RNA, 22 nt, Human
aagucuuuuugaaucuauaacu

SEQ ID NO: 246195 - RNA, 22 nt, Human
aucucagucagguugaauuugg

SEQ ID NO: 246196 - RNA, 22 nt, Human
uccugugaccagcuuccaugcu

SEQ ID NO: 246197 - RNA, 22 nt, Human
ggaagaaagcacacaaacuuga

SEQ ID NO: 246198 - RNA, 22 nt, Human
aaggccuccgccaauggcagag

SEQ ID NO: 246199 - RNA, 22 nt, Human
uccaggaggugaggggaccaaa

SEQ ID NO: 246200 - RNA, 19 nt, Human
uuuggaacuuuuugaugcc

SEQ ID NO: 246201 - RNA, 22 nt, Human
acagcagcuuccugacuguacu

SEQ ID NO: 246202 - RNA, 22 nt, Human
aggcgaagggaccagacgguag

SEQ ID NO: 246203 - RNA, 22 nt, Human
aggguccugagccuggggcgca

SEQ ID NO: 246204 - RNA, 22 nt, Human
gcuucccaaacuuguggauaga

SEQ ID NO: 246205 - RNA, 22 nt, Human
agcugaggcaugaugcuaucag

SEQ ID NO: 246206 - RNA, 17 nt, Human
ugccugccagcauugga

SEQ ID NO: 246207 - RNA, 22 nt, Human
gugggcagcaccagggaagugu

SEQ ID NO: 246208 - RNA, 22 nt, Human
agcugguauuucugaaggaaag

SEQ ID NO: 246209 - RNA, 22 nt, Human
ugacauuuuaucaauaucacag

SEQ ID NO: 246210 - RNA, 22 nt, Human
acuuucaaauaucaugauucua

SEQ ID NO: 246211 - RNA, 22 nt, Human
accucuaaaaaauuagaagccu

SEQ ID NO: 246212 - RNA, 22 nt, Human
gggguccuggaggccagcugga

SEQ ID NO: 246213 - RNA, 22 nt, Human
agcacaauauaaagugaacgca

SEQ ID NO: 246214 - RNA, 22 nt, Human
auaguuugaaggcuguucuacu

SEQ ID NO: 246215 - RNA, 22 nt, Human
uuccuggcacauaguuagugcu

SEQ ID NO: 246216 - RNA, 22 nt, Human
ucauauaagagcuuuagaguca

SEQ ID NO: 246217 - RNA, 22 nt, Human
acagucauuagauacaaugucu

SEQ ID NO: 246218 - RNA, 22 nt, Human
gggaagagugucgguugaagug

SEQ ID NO: 246219 - RNA, 22 nt, Human
uaggccaguaaaauguuucagu

SEQ ID NO: 246220 - RNA, 22 nt, Human
gcagagcauguccucaggacag

SEQ ID NO: 246221 - RNA, 22 nt, Human
uugaaugauccuaucuagcaca

SEQ ID NO: 246222 - RNA, 22 nt, Human
ucugggcugugccaaagcucuu

SEQ ID NO: 246223 - RNA, 19 nt, Human
acauggcaucccaggaggu

SEQ ID NO: 246224 - RNA, 22 nt, Human
ccaugcagugcuggagcugauu

SEQ ID NO: 246225 - RNA, 22 nt, Human
uggccugguaccacauagauuu

SEQ ID NO: 246226 - RNA, 22 nt, Human
aaaguucaugguguuauagaaa

SEQ ID NO: 246227 - RNA, 22 nt, Human
uacagagggauuaucuaagggu

SEQ ID NO: 246228 - RNA, 22 nt, Human
gggagccagcagggcauggagc

SEQ ID NO: 246229 - RNA, 22 nt, Human
ugagguggugcuaaucucugcu

SEQ ID NO: 246230 - RNA, 22 nt, Human
aauacaguagguaauaguucau

SEQ ID NO: 246231 - RNA, 22 nt, Human
aagcuguucugaaucaguaagu

SEQ ID NO: 246232 - RNA, 22 nt, Human
aaguauaagcuauucuucauga

SEQ ID NO: 246233 - RNA, 22 nt, Human
cagggaugucucuggaagggag

SEQ ID NO: 246234 - RNA, 22 nt, Human
ugcaggugucugggggcaacag

SEQ ID NO: 246235 - RNA, 22 nt, Human
agcucagggcuccaggaccgcu

SEQ ID NO: 246236 - RNA, 22 nt, Human
ucuggcccuauggcauguaccu

SEQ ID NO: 246237 - RNA, 22 nt, Human
ggacugggauucuggaucugcu

SEQ ID NO: 246238 - RNA, 22 nt, Human
uuacuuuaucuccuagauucca

SEQ ID NO: 246239 - RNA, 22 nt, Human
ugucgauucagcucuucagaga

SEQ ID NO: 246240 - RNA, 22 nt, Human
aagaagcauggcuguagauucc

SEQ ID NO: 246241 - RNA, 22 nt, Human
ccugggcccucaccgccggugg

SEQ ID NO: 246242 - RNA, 22 nt, Human
uaagcaagauuuauugaauuuu

SEQ ID NO: 246243 - RNA, 22 nt, Human
ggacaggcaggugauuuccaga

SEQ ID NO: 246244 - RNA, 22 nt, Human
gacaaaaguguuuugaacaagg

SEQ ID NO: 246245 - RNA, 22 nt, Human
aagagucuuauaguguaauuaa

SEQ ID NO: 246246 - RNA, 22 nt, Human
cagcccuggccucuucgcuuuc

SEQ ID NO: 246247 - RNA, 22 nt, Human
ccuuuggucuugaugaacuguu

SEQ ID NO: 246248 - RNA, 21 nt, Human
ucuggggaagacaucuaggau

SEQ ID NO: 246249 - RNA, 22 nt, Human
ccugggaguggcacucacagca

SEQ ID NO: 246250 - RNA, 22 nt, Human
ggcccucugcucacuuccuauu

SEQ ID NO: 246251 - RNA, 22 nt, Human
cuccagggcagcauggcagugg

SEQ ID NO: 246252 - RNA, 22 nt, Human
agaaugcucuucaaaaucuagc

SEQ ID NO: 246253 - RNA, 22 nt, Human
agagucagacuaagccauggug

SEQ ID NO: 246254 - RNA, 22 nt, Human
ggagucuuaaaaaucaaaugga

SEQ ID NO: 246255 - RNA, 22 nt, Human
gagucuucuacgcucacacaaa

SEQ ID NO: 246256 - RNA, 19 nt, Human
acaugacaacaggggaggc

SEQ ID NO: 246257 - RNA, 22 nt, Human
cuucuugugcugggccagcuuc

SEQ ID NO: 246258 - RNA, 22 nt, Human
caggguccggcugccuggcugu

SEQ ID NO: 246259 - RNA, 22 nt, Human
ucccugcuuggaaugacccuua

SEQ ID NO: 246260 - RNA, 22 nt, Human
gcacaguaccugucacagaggc

SEQ ID NO: 246261 - RNA, 22 nt, Human
auucuucacauaagugcuguac

SEQ ID NO: 246262 - RNA, 22 nt, Human
aaacugucauuuuauauaguua

SEQ ID NO: 246263 - RNA, 22 nt, Human
uuguacagguuccuagggugga

SEQ ID NO: 246264 - RNA, 22 nt, Human
gcugugcacuaccuauacaucc

SEQ ID NO: 246265 - RNA, 19 nt, Human
aguguguacugaaagcacu

SEQ ID NO: 246266 - RNA, 22 nt, Human
agggagcugacuggcugccauu

SEQ ID NO: 246267 - RNA, 22 nt, Human
gaggagcugaggcugaggccuc

SEQ ID NO: 246268 - RNA, 22 nt, Human
cccuggugcccugggucagccu

SEQ ID NO: 246269 - RNA, 20 nt, Human
ucuuggaaaaaguucagaau

SEQ ID NO: 246270 - RNA, 20 nt, Human
auacaaagagauugauguau

SEQ ID NO: 246271 - RNA, 22 nt, Human
cagugcaggcugggggcccugc

SEQ ID NO: 246272 - RNA, 22 nt, Human
uauucacuguaacucagcaaua

SEQ ID NO: 246273 - RNA, 22 nt, Human
agguccagcucuauugaaaaga

SEQ ID NO: 246274 - RNA, 18 nt, Human
auuuacccagcaacgugg

SEQ ID NO: 246275 - RNA, 23 nt, Human
acuacagauacuccugcuguuug

SEQ ID NO: 246276 - RNA, 22 nt, Human
gccucuuguuuccuuacaugga

SEQ ID NO: 246277 - RNA, 18 nt, Human
gcaggccuagaacuuggu

SEQ ID NO: 246278 - RNA, 22 nt, Human
uugugaauagugccgcuauaaa

SEQ ID NO: 246279 - RNA, 23 nt, Human
uggaggcaggaugcuaaggaguc

SEQ ID NO: 246280 - RNA, 22 nt, Human
ucacaaaugaggaaaucgagca

SEQ ID NO: 246281 - RNA, 22 nt, Human
uccaggcaagggaggagcaugg

SEQ ID NO: 246282 - RNA, 22 nt, Human
cccugaggcacaggccacguau

SEQ ID NO: 246283 - RNA, 22 nt, Human
ucaaaggguagcccagggaaga

SEQ ID NO: 246284 - RNA, 22 nt, Human
acagaauuaaaguguuugugga

SEQ ID NO: 246285 - RNA, 22 nt, Human
aaacaugcuggauuuagaauau

SEQ ID NO: 246286 - RNA, 23 nt, Human
ugcuguggauggcagguccuugc

SEQ ID NO: 246287 - RNA, 22 nt, Human
gggugggaaggcuaagggauug

SEQ ID NO: 246288 - RNA, 22 nt, Human
uuccaggcuccugcaguuucua

SEQ ID NO: 246289 - RNA, 22 nt, Human
ucuuagaaacuguaucgauuag

SEQ ID NO: 246290 - RNA, 22 nt, Human
uucuuuauccuauuuguaggug

SEQ ID NO: 246291 - RNA, 22 nt, Human
ugcuuuaacauaagauaucuuu

SEQ ID NO: 246292 - RNA, 22 nt, Human
ucacagaaggagggaagcuagu

SEQ ID NO: 246293 - RNA, 22 nt, Human
cuccuccagcucucccuggggg

SEQ ID NO: 246294 - RNA, 22 nt, Human
ggggagcaggcugggcugucug

SEQ ID NO: 246295 - RNA, 22 nt, Human
ggucuggauaauuccaguaccu

SEQ ID NO: 246296 - RNA, 22 nt, Human
gcugccugcucggcuccuggga

SEQ ID NO: 246297 - RNA, 23 nt, Human
uucuuucaagaaguucacagugc

SEQ ID NO: 246298 - RNA, 22 nt, Human
ugucaucuucacugggucacaa

SEQ ID NO: 246299 - RNA, 22 nt, Human
aacaugcauauagguaaaugga

SEQ ID NO: 246300 - RNA, 23 nt, Human
aggcaaggguguaaaggaaauga

SEQ ID NO: 246301 - RNA, 22 nt, Human
cugcaacucucuccagaggcug

SEQ ID NO: 246302 - RNA, 22 nt, Human
uccugagggcugcagucauagg

SEQ ID NO: 246303 - RNA, 22 nt, Human
ucagugcauucauggguggcug

SEQ ID NO: 246304 - RNA, 22 nt, Human
aagagcuucccuguuguagagg

SEQ ID NO: 246305 - RNA, 22 nt, Human
gagggggacguauccugguaug

SEQ ID NO: 246306 - RNA, 19 nt, Human
ucucccggcacuccugccc

SEQ ID NO: 246307 - RNA, 22 nt, Human
cagagcaccagugggagacaag

SEQ ID NO: 246308 - RNA, 22 nt, Human
cuggagagaauguggaaugauu

SEQ ID NO: 246309 - RNA, 19 nt, Human
ucuguaacacucuagccuu

SEQ ID NO: 246310 - RNA, 22 nt, Human
gaaccucuuuagugcauccuuc

SEQ ID NO: 246311 - RNA, 18 nt, Human
ccucugccauagccagca

SEQ ID NO: 246312 - RNA, 22 nt, Human
ucauuccauuuccagcucugaa

SEQ ID NO: 246313 - RNA, 20 nt, Human
acugguggacuguucauuga

SEQ ID NO: 246314 - RNA, 22 nt, Human
uccccaccuacacacugcuccu

SEQ ID NO: 246315 - RNA, 22 nt, Human
aggucuggcucuucuccacaga

SEQ ID NO: 246316 - RNA, 22 nt, Human
aaaaaaucagaucuuugguuaa

SEQ ID NO: 246317 - RNA, 22 nt, Human
cauuugugugggaacccaucag

SEQ ID NO: 246318 - RNA, 22 nt, Human
auggacuuaagagucagaagcu

SEQ ID NO: 246319 - RNA, 22 nt, Human
accucagaggaggcuccuggcu

SEQ ID NO: 246320 - RNA, 22 nt, Human
caguuaaacgaugaugggguca

SEQ ID NO: 246321 - RNA, 22 nt, Human
ugcauuuuuaacaaggcuaauu

SEQ ID NO: 246322 - RNA, 22 nt, Human
gauugcugccagcguguccgug

SEQ ID NO: 246323 - RNA, 22 nt, Human
gaugugucccuuucaacucaga

SEQ ID NO: 246324 - RNA, 22 nt, Human
cacaauuauagaagaaagcaua

SEQ ID NO: 246325 - RNA, 22 nt, Human
agaaaaacuaagaguggguggu

SEQ ID NO: 246326 - RNA, 23 nt, Human
agcucugaaauagggaaagagga

SEQ ID NO: 246327 - RNA, 22 nt, Human
agguggcagagugacaggcuga

SEQ ID NO: 246328 - RNA, 22 nt, Human
agcugagcacauucaaacaggu

SEQ ID NO: 246329 - RNA, 22 nt, Human
ggagucugauacugaguuccuc

SEQ ID NO: 246330 - RNA, 22 nt, Human
uaguccaguaaaacagcuaacg

SEQ ID NO: 246331 - RNA, 23 nt, Human
cagucugcagcccacuugggcag

SEQ ID NO: 246332 - RNA, 22 nt, Human
auaagcauguuagaauauuuga

SEQ ID NO: 246333 - RNA, 22 nt, Human
aggcagagcuaggaagaauugu

SEQ ID NO: 246334 - RNA, 22 nt, Human
cagcccuggcgcccccagaucu

SEQ ID NO: 246335 - RNA, 22 nt, Human
gaaucaauugugaagacuauga

SEQ ID NO: 246336 - RNA, 22 nt, Human
agguggggccaaaugcuacagu

SEQ ID NO: 246337 - RNA, 22 nt, Human
uucaugaauauauugaauuagc

SEQ ID NO: 246338 - RNA, 22 nt, Human
acaggcagagaguggcggacuc

SEQ ID NO: 246339 - RNA, 21 nt, Human
uggcugacucuuccuaucauu

SEQ ID NO: 246340 - RNA, 22 nt, Human
aaagauaauguuuccuuauucu

SEQ ID NO: 246341 - RNA, 21 nt, Human
aauagcauucaggaugggcuc

SEQ ID NO: 246342 - RNA, 22 nt, Human
uacagggauuccugccgcucgc

SEQ ID NO: 246343 - RNA, 22 nt, Human
ccuuuucuacaagcaaaugugc

SEQ ID NO: 246344 - RNA, 22 nt, Human
aggcagcuuuguaguaaagcua

SEQ ID NO: 246345 - RNA, 22 nt, Human
aagauggcugcagcaauuccaa

SEQ ID NO: 246346 - RNA, 22 nt, Human
gcagaggccugaagguggcggg

SEQ ID NO: 246347 - RNA, 22 nt, Human
ugagaccucuggguucugagcu

SEQ ID NO: 246348 - RNA, 22 nt, Human
uauauauucuuaaguaguguag

SEQ ID NO: 246349 - RNA, 22 nt, Human
cuagggaaggacaaccucuucc

SEQ ID NO: 246350 - RNA, 22 nt, Human
agaagccagcuucagcugcccg

SEQ ID NO: 246351 - RNA, 22 nt, Human
acuuccagguuccacccaagac

SEQ ID NO: 246352 - RNA, 18 nt, Human
ugggccugcauccuaguc

SEQ ID NO: 246353 - RNA, 22 nt, Human
acaagaaccaaagaaggauauu

SEQ ID NO: 246354 - RNA, 22 nt, Human
uuccaggaccaggaagagggga

SEQ ID NO: 246355 - RNA, 22 nt, Human
cagcaacugugccugacacaca

SEQ ID NO: 246356 - RNA, 22 nt, Human
gacauaaaugaaguuugacuau

SEQ ID NO: 246357 - RNA, 20 nt, Human
agcugguuaucuuaauucuu

SEQ ID NO: 246358 - RNA, 22 nt, Human
uaauauacuucccauaguuuga

SEQ ID NO: 246359 - RNA, 18 nt, Human
augcaagcuauggauuug

SEQ ID NO: 246360 - RNA, 22 nt, Human
uaggugucuuucuguccuuguu

SEQ ID NO: 246361 - RNA, 22 nt, Human
ucugugcaggaagucauuauga

SEQ ID NO: 246362 - RNA, 22 nt, Human
caggaaaauggaaucaccugua

SEQ ID NO: 246363 - RNA, 22 nt, Human
cagacagaaggaaggccaacau

SEQ ID NO: 246364 - RNA, 22 nt, Human
ucagaacagguuguacuauguc

SEQ ID NO: 246365 - RNA, 22 nt, Human
auggcaguguuucaguuuuugg

SEQ ID NO: 246366 - RNA, 22 nt, Human
agcccagcuuccuucugucucu

SEQ ID NO: 246367 - RNA, 22 nt, Human
ugguccuuuaagucuuucucug

SEQ ID NO: 246368 - RNA, 23 nt, Human
uuacaugugugcacacauucugg

SEQ ID NO: 246369 - RNA, 22 nt, Human
ggagccugguuacuagagccug

SEQ ID NO: 246370 - RNA, 22 nt, Human
uggcccaaagcagcccagcagg

SEQ ID NO: 246371 - RNA, 22 nt, Human
auuuauuauugugguuacuucu

SEQ ID NO: 246372 - RNA, 22 nt, Human
caauacaauuaccaguuaauca

SEQ ID NO: 246373 - RNA, 20 nt, Human
agcuguuuacauggauuucu

SEQ ID NO: 246374 - RNA, 22 nt, Human
cccaguuucaacuuuccagugg

SEQ ID NO: 246375 - RNA, 22 nt, Human
ugaggaaacugaggcacagaug

SEQ ID NO: 246376 - RNA, 22 nt, Human
gcagggcacaaggacgcacagg

SEQ ID NO: 246377 - RNA, 22 nt, Human
uuuaaucaggcaaagcauaaua

SEQ ID NO: 246378 - RNA, 22 nt, Human
gguccuuugaaagggguguguc

SEQ ID NO: 246379 - RNA, 22 nt, Human
gagucagaaacucacucuauag

SEQ ID NO: 246380 - RNA, 23 nt, Human
acagggcuuaucugucacucauc

SEQ ID NO: 246381 - RNA, 21 nt, Human
cuggcucuguugucacccggc

SEQ ID NO: 246382 - RNA, 22 nt, Human
gguccagguuugcucuacuugu

SEQ ID NO: 246383 - RNA, 22 nt, Human
gcccccacaggcgggcucgggu

SEQ ID NO: 246384 - RNA, 21 nt, Human
ucugugguauggccaucuucc

SEQ ID NO: 246385 - RNA, 22 nt, Human
cauggccuugagugacugcacu

SEQ ID NO: 246386 - RNA, 19 nt, Human
uccuuucuguuccugagau

SEQ ID NO: 246387 - RNA, 18 nt, Human
aggcuugggcccagcagc

SEQ ID NO: 246388 - RNA, 22 nt, Human
gccuggcaggccugggccagca

SEQ ID NO: 246389 - RNA, 22 nt, Human
cagcaugccugggcugccugcc

SEQ ID NO: 246390 - RNA, 22 nt, Human
acaguguggaaagucaacuuga

SEQ ID NO: 246391 - RNA, 22 nt, Human
aucaaaaugcuccagugauggu

SEQ ID NO: 246392 - RNA, 22 nt, Human
gccugugaugcccccauaagua

SEQ ID NO: 246393 - RNA, 22 nt, Human
gucuggagggaagagaugucag

SEQ ID NO: 246394 - RNA, 22 nt, Human
gggccagcaguaucggaggcau

SEQ ID NO: 246395 - RNA, 22 nt, Human
cagcugaguuuccaagucugcc

SEQ ID NO: 246396 - RNA, 22 nt, Human
cuccuggcccugagcucccagg

SEQ ID NO: 246397 - RNA, 23 nt, Human
gagguacagcaccagugaauagg

SEQ ID NO: 246398 - RNA, 22 nt, Human
cuggccacugcgggccucugcc

SEQ ID NO: 246399 - RNA, 22 nt, Human
uucagagaagcaaaggcagauu

SEQ ID NO: 246400 - RNA, 22 nt, Human
cuuaagcaaaauauucuuucac

SEQ ID NO: 246401 - RNA, 22 nt, Human
ugcccugcaugcagggagcugu

SEQ ID NO: 246402 - RNA, 22 nt, Human
uccuggguaaacacugaccuuu

SEQ ID NO: 246403 - RNA, 22 nt, Human
ugaggucaagcccagagcagca

SEQ ID NO: 246404 - RNA, 22 nt, Human
ugccuuuuccaguuccuagaag

SEQ ID NO: 246405 - RNA, 22 nt, Human
gaugauuuaaguggccaaagua

SEQ ID NO: 246406 - RNA, 22 nt, Human
ucucagugguguuuugagucca

SEQ ID NO: 246407 - RNA, 22 nt, Human
acuucauuguaauauuauagca

SEQ ID NO: 246408 - RNA, 22 nt, Human
aauauccauugggagcaaaugg

SEQ ID NO: 246409 - RNA, 22 nt, Human
caguucaaaauuuugaagaagg

SEQ ID NO: 246410 - RNA, 22 nt, Human
uccaggccacugcagaggcucu

SEQ ID NO: 246411 - RNA, 22 nt, Human
agacacaguuugggauggguug

SEQ ID NO: 246412 - RNA, 22 nt, Human
uucugagauacaaaauuuacuu

SEQ ID NO: 246413 - RNA, 22 nt, Human
ugcaaaggggacagaguccacu

SEQ ID NO: 246414 - RNA, 22 nt, Human
ucuagggugugcggcagggcua

SEQ ID NO: 246415 - RNA, 22 nt, Human
aauuaacagagggcuuauuacu

SEQ ID NO: 246416 - RNA, 20 nt, Human
ugugucuuccuuucuuuaug

SEQ ID NO: 246417 - RNA, 22 nt, Human
ucauuuaucgcugccuuuuaaa

SEQ ID NO: 246418 - RNA, 22 nt, Human
aggaagaacagauaauggacgc

SEQ ID NO: 246419 - RNA, 23 nt, Human
gggcccagcacaggaccuggcag

SEQ ID NO: 246420 - RNA, 22 nt, Human
ucugaaauuccuuccagacuuu

SEQ ID NO: 246421 - RNA, 22 nt, Human
uugagaaaauaguucgaauguu

SEQ ID NO: 246422 - RNA, 22 nt, Human
acuuagcagguggugacucgaa

SEQ ID NO: 246423 - RNA, 22 nt, Human
ccaggcuguaaacaccuucaaa

SEQ ID NO: 246424 - RNA, 22 nt, Human
gaagacauguuuuuaauaugua

SEQ ID NO: 246425 - RNA, 22 nt, Human
agaaaugcucuuccugaccaga

SEQ ID NO: 246426 - RNA, 22 nt, Human
uagauguuaagcuucuagaagg

SEQ ID NO: 246427 - RNA, 19 nt, Human
agcacaguuuccacaugca

SEQ ID NO: 246428 - RNA, 22 nt, Human
cagcuucagaagaagccgugag

SEQ ID NO: 246429 - RNA, 22 nt, Human
uuucucuuuggaggggcugaau

SEQ ID NO: 246430 - RNA, 22 nt, Human
uccauacuggaguccacaguuc

SEQ ID NO: 246431 - RNA, 22 nt, Human
aaaugcuugcucuugauuauuu

SEQ ID NO: 246432 - RNA, 22 nt, Human
ucuuucaaagcaaaaugaggcu

SEQ ID NO: 246433 - RNA, 18 nt, Human
uucggcagauacgcuugg

SEQ ID NO: 246434 - RNA, 22 nt, Human
uccucagagaugggcaucuaag

SEQ ID NO: 246435 - RNA, 17 nt, Human
uccuuucuuuaccuguu

SEQ ID NO: 246436 - RNA, 22 nt, Human
uuguauuugauugucauaucgu

SEQ ID NO: 246437 - RNA, 22 nt, Human
uacuuguggcaguuugaauuua

SEQ ID NO: 246438 - RNA, 22 nt, Human
uccugggcugugugccacucug

SEQ ID NO: 246439 - RNA, 22 nt, Human
cacccagcauuggcuaagagag

SEQ ID NO: 246440 - RNA, 21 nt, Human
aguccaggccugcccacuucc

SEQ ID NO: 246441 - RNA, 22 nt, Human
cccagcaucuccaggcauggcc

SEQ ID NO: 246442 - RNA, 23 nt, Human
uuuuauugauauguagcuguugu

SEQ ID NO: 246443 - RNA, 22 nt, Human
agggagaaugaccaagguauau

SEQ ID NO: 246444 - RNA, 22 nt, Human
augcuuuuaugucacaugguca

SEQ ID NO: 246445 - RNA, 22 nt, Human
aaagacuuucaccuagcaaaga

SEQ ID NO: 246446 - RNA, 22 nt, Human
uuucucucuggcccugauuguc

SEQ ID NO: 246447 - RNA, 22 nt, Human
uggcaauguaggcaagaacauu

SEQ ID NO: 246448 - RNA, 22 nt, Human
uggucagaacucagcgugcuug

SEQ ID NO: 246449 - RNA, 22 nt, Human
ugggccuggacaaggccacuag

SEQ ID NO: 246450 - RNA, 23 nt, Human
uuccaggcagagcagggauuaga

SEQ ID NO: 246451 - RNA, 22 nt, Human
aaaagacauaugugggcauucu

SEQ ID NO: 246452 - RNA, 22 nt, Human
aaaguggugggcgaacucauca

SEQ ID NO: 246453 - RNA, 22 nt, Human
gcagggugccgacuucagggau

SEQ ID NO: 246454 - RNA, 18 nt, Human
gcacagagcccaggcucu

SEQ ID NO: 246455 - RNA, 21 nt, Human
auacauucuauuaagcauuua

SEQ ID NO: 246456 - RNA, 22 nt, Human
acaauagaguucucauaggaca

SEQ ID NO: 246457 - RNA, 22 nt, Human
aacugcaagaguaaaugucuag

SEQ ID NO: 246458 - RNA, 22 nt, Human
uaaaugcagauuccugagccua

SEQ ID NO: 246459 - RNA, 22 nt, Human
uugugcauuagggaaaggaacu

SEQ ID NO: 246460 - RNA, 22 nt, Human
uagaaacuagauugauagcgga

SEQ ID NO: 246461 - RNA, 22 nt, Human
aggcagggcugggauuagacuc

SEQ ID NO: 246462 - RNA, 22 nt, Human
ucaagacauauuaaaugugcga

SEQ ID NO: 246463 - RNA, 22 nt, Human
aguguccuuucuguuccagcca

SEQ ID NO: 246464 - RNA, 22 nt, Human
ugucuucaaauauugaaauccu

SEQ ID NO: 246465 - RNA, 22 nt, Human
gcacccaggcuugggcagcaac

SEQ ID NO: 246466 - RNA, 22 nt, Human
ucaggcccagagucacggaucc

SEQ ID NO: 246467 - RNA, 22 nt, Human
ccugagagagugagcccugaca

SEQ ID NO: 246468 - RNA, 22 nt, Human
aaggcauaugcauagaagacag

SEQ ID NO: 246469 - RNA, 17 nt, Human
uccuuggcaaccaguuc

SEQ ID NO: 246470 - RNA, 22 nt, Human
uuacaguaaucgaguguugugg

SEQ ID NO: 246471 - RNA, 22 nt, Human
ugagucucauuaauuaugaaug

SEQ ID NO: 246472 - RNA, 22 nt, Human
gaguccaguucuuuccagcagu

SEQ ID NO: 246473 - RNA, 22 nt, Human
uaaagcacauaucuuacaauaa

SEQ ID NO: 246474 - RNA, 22 nt, Human
caggaacuggaacccuggccga

SEQ ID NO: 246475 - RNA, 22 nt, Human
aagcugaaucugaaauagaauu

SEQ ID NO: 246476 - RNA, 22 nt, Human
ugcuuauuugaauuuauucuca

SEQ ID NO: 246477 - RNA, 22 nt, Human
agcuggagccagugugaggcuu

SEQ ID NO: 246478 - RNA, 22 nt, Human
gacagcaaagcagagccaaggc

SEQ ID NO: 246479 - RNA, 22 nt, Human
gauucauguuauagagagucag

SEQ ID NO: 246480 - RNA, 22 nt, Human
uucugggcaggacuggggaccc

SEQ ID NO: 246481 - RNA, 22 nt, Human
uugaauuauaagugugucuacu

SEQ ID NO: 246482 - RNA, 22 nt, Human
uggucacacauguaucucaaug

SEQ ID NO: 246483 - RNA, 23 nt, Human
agcuccugaggccagccucuccu

SEQ ID NO: 246484 - RNA, 22 nt, Human
uccaauguuccugcuuucagcu

SEQ ID NO: 246485 - RNA, 22 nt, Human
uucccucucuagcuuuccccaa

SEQ ID NO: 246486 - RNA, 22 nt, Human
auaauaacuccuguugaagaac

SEQ ID NO: 246487 - RNA, 22 nt, Human
aagaucagaacuuuauacagga

SEQ ID NO: 246488 - RNA, 20 nt, Human
ccagagcagccacugaaguu

SEQ ID NO: 246489 - RNA, 22 nt, Human
ugccaggcuuagagcaggggcu

SEQ ID NO: 246490 - RNA, 22 nt, Human
cugagguaccuggagcaggucc

SEQ ID NO: 246491 - RNA, 21 nt, Human
agcagccauggaugguaugua

SEQ ID NO: 246492 - RNA, 22 nt, Human
guguacauauugagucugcuga

SEQ ID NO: 246493 - RNA, 22 nt, Human
cagcccuccuuucacucccagg

SEQ ID NO: 246494 - RNA, 22 nt, Human
caggagaggcuguacguuucuc

SEQ ID NO: 246495 - RNA, 22 nt, Human
uaucuagagccuggaagucuug

SEQ ID NO: 246496 - RNA, 22 nt, Human
ugggagagaauaaucaauaggu

SEQ ID NO: 246497 - RNA, 22 nt, Human
gccuggcagccuccaaccuuca

SEQ ID NO: 246498 - RNA, 22 nt, Human
ucuagggaaccuauccuaugau

SEQ ID NO: 246499 - RNA, 21 nt, Human
aacugcuggucuuuucugucu

SEQ ID NO: 246500 - RNA, 22 nt, Human
gaucuuugcaaacuuugucacu

SEQ ID NO: 246501 - RNA, 23 nt, Human
uaagugauuccaaguuucaggga

SEQ ID NO: 246502 - RNA, 22 nt, Human
acccaggcuagagugcaguggu

SEQ ID NO: 246503 - RNA, 22 nt, Human
caggacagacagaaugccuaac

SEQ ID NO: 246504 - RNA, 22 nt, Human
aaugcacauaaauauggucuua

SEQ ID NO: 246505 - RNA, 22 nt, Human
ggaggugacuggaucaugggca

SEQ ID NO: 246506 - RNA, 22 nt, Human
guuggcuaugagagcuuuagug

SEQ ID NO: 246507 - RNA, 22 nt, Human
agcuauggaacagaguggcugu

SEQ ID NO: 246508 - RNA, 22 nt, Human
guuucaaaagucaggcuauucu

SEQ ID NO: 246509 - RNA, 22 nt, Human
gaggccucaugaggugagcauu

SEQ ID NO: 246510 - RNA, 22 nt, Human
ucauaaaaugcuccugauauug

SEQ ID NO: 246511 - RNA, 17 nt, Human
gagagucuaaugggaga

SEQ ID NO: 246512 - RNA, 22 nt, Human
gaaagcagcuaagucuuaugau

SEQ ID NO: 246513 - RNA, 22 nt, Human
cucaaaauccauaaaaucaggu

SEQ ID NO: 246514 - RNA, 22 nt, Human
agaggccagcacugcagggaag

SEQ ID NO: 246515 - RNA, 22 nt, Human
aagccuuccugagugcaaggcc

SEQ ID NO: 246516 - RNA, 22 nt, Human
ucuguaggacagagaaaugggg

SEQ ID NO: 246517 - RNA, 22 nt, Human
auucaagguauuuaaaacauaa

SEQ ID NO: 246518 - RNA, 22 nt, Human
gagcuggugaucagcuggagga

SEQ ID NO: 246519 - RNA, 22 nt, Human
gccagucucccucaguccucug

SEQ ID NO: 246520 - RNA, 20 nt, Human
ggcaccaggcuaggauugga

SEQ ID NO: 246521 - RNA, 22 nt, Human
uauguuacucacauguucuugc

SEQ ID NO: 246522 - RNA, 22 nt, Human
ggcucuggagcacagacgucug

SEQ ID NO: 246523 - RNA, 22 nt, Human
ucucugggaauucacaagcccu

SEQ ID NO: 246524 - RNA, 22 nt, Human
acaaaugcaaguuuuaugucaa

SEQ ID NO: 246525 - RNA, 22 nt, Human
uuagugcucauccagauggggg

SEQ ID NO: 246526 - RNA, 22 nt, Human
uucuccaguuauauuauguuaa

SEQ ID NO: 246527 - RNA, 22 nt, Human
ucaucuguggcugcuuuugugc

SEQ ID NO: 246528 - RNA, 22 nt, Human
gaaggccacggaauggagcugg

SEQ ID NO: 246529 - RNA, 22 nt, Human
ccagagucuaugaguccucauu

SEQ ID NO: 246530 - RNA, 22 nt, Human
cugaggggauguuuuugacgga

SEQ ID NO: 246531 - RNA, 22 nt, Human
aaauagaauuggaagcagaguu

SEQ ID NO: 246532 - RNA, 22 nt, Human
agcaaacacaagagguaauuuc

SEQ ID NO: 246533 - RNA, 22 nt, Human
cucucugugguggcugucccau

SEQ ID NO: 246534 - RNA, 22 nt, Human
gugggccugaugcugccaugag

SEQ ID NO: 246535 - RNA, 22 nt, Human
gaagucuuuuagcaaaacgaac

SEQ ID NO: 246536 - RNA, 22 nt, Human
cugggccuugaucacacaggug

SEQ ID NO: 246537 - RNA, 22 nt, Human
uacaguauuaugagugauugaa

SEQ ID NO: 246538 - RNA, 23 nt, Human
ucaguaccacagcugcaugaccu

SEQ ID NO: 246539 - RNA, 22 nt, Human
uuggucagcucaauggagaggg

SEQ ID NO: 246540 - RNA, 22 nt, Human
gaccuagauuaacauucuguga

SEQ ID NO: 246541 - RNA, 22 nt, Human
ucugggaacugagcuccccuag

SEQ ID NO: 246542 - RNA, 22 nt, Human
augcuuuacaguuuuccaaaca

SEQ ID NO: 246543 - RNA, 22 nt, Human
cuuucuuucgaagacgugauua

SEQ ID NO: 246544 - RNA, 22 nt, Human
cuucuuccugcugcagccucca

SEQ ID NO: 246545 - RNA, 22 nt, Human
augauuuaaagucauugugaac

SEQ ID NO: 246546 - RNA, 22 nt, Human
ggcuaggccucaggccugccug

SEQ ID NO: 246547 - RNA, 19 nt, Human
ccaaaagcaauuccaagua

SEQ ID NO: 246548 - RNA, 22 nt, Human
ugggacucacucuuuuggccag

SEQ ID NO: 246549 - RNA, 23 nt, Human
ucagagaaugguaugcuuuuccu

SEQ ID NO: 246550 - RNA, 19 nt, Human
ccugaguguuucagagaca

SEQ ID NO: 246551 - RNA, 22 nt, Human
gacaagcucgccugccccggaa

SEQ ID NO: 246552 - RNA, 22 nt, Human
acagaagcaaagacucaggcaa

SEQ ID NO: 246553 - RNA, 22 nt, Human
uucacauuucauaccacagcuu

SEQ ID NO: 246554 - RNA, 22 nt, Human
cugagucuccuggggaggugaa

SEQ ID NO: 246555 - RNA, 22 nt, Human
ucugggaaguccucugucaugc

SEQ ID NO: 246556 - RNA, 22 nt, Human
aaaugcuguaacugauauucug

SEQ ID NO: 246557 - RNA, 22 nt, Human
aaggcuuuaugugaccaaaaga

SEQ ID NO: 246558 - RNA, 22 nt, Human
gcacaggaaaugacucauguua

SEQ ID NO: 246559 - RNA, 22 nt, Human
cagcuucuccggccuggugcgg

SEQ ID NO: 246560 - RNA, 22 nt, Human
aaagcuggcuuuuacaggggcu

SEQ ID NO: 246561 - RNA, 22 nt, Human
agaaaucagaacccugaaguuc

SEQ ID NO: 246562 - RNA, 22 nt, Human
cguguccuuuuagcuucagguc

SEQ ID NO: 246563 - RNA, 22 nt, Human
acuuggugaagucaggugauua

SEQ ID NO: 246564 - RNA, 19 nt, Human
uggcauugguccagauaaa

SEQ ID NO: 246565 - RNA, 22 nt, Human
aagcuguagaggcaguacauuu

SEQ ID NO: 246566 - RNA, 22 nt, Human
aguacaaaugcagccagaguag

SEQ ID NO: 246567 - RNA, 22 nt, Human
gagcucuucuaaagauggcaau

SEQ ID NO: 246568 - RNA, 21 nt, Human
ugaggcaaguccuuuuauagc

SEQ ID NO: 246569 - RNA, 22 nt, Human
guccuggcuguguuugguuucu

SEQ ID NO: 246570 - RNA, 22 nt, Human
uggaggcaucagagugcuuggc

SEQ ID NO: 246571 - RNA, 22 nt, Human
caccuagcauuccucuuccuca

SEQ ID NO: 246572 - RNA, 22 nt, Human
cccagcaguacccaagcccuug

SEQ ID NO: 246573 - RNA, 22 nt, Human
cacaauguauauguauaucaaa

SEQ ID NO: 246574 - RNA, 22 nt, Human
aucuggagugggacacagaaau

SEQ ID NO: 246575 - RNA, 22 nt, Human
auucacauuuagacaucaggua

SEQ ID NO: 246576 - RNA, 22 nt, Human
uugcaaauuaaagaggauagca

SEQ ID NO: 246577 - RNA, 22 nt, Human
aagacauucaugaagaagggau

SEQ ID NO: 246578 - RNA, 22 nt, Human
ucaaauaccagcuuuuccagaa

SEQ ID NO: 246579 - RNA, 22 nt, Human
guuauauugccaaguauauugu

SEQ ID NO: 246580 - RNA, 22 nt, Human
acaggagccaaacacaugccag

SEQ ID NO: 246581 - RNA, 22 nt, Human
uuggccuucccuaccugggcca

SEQ ID NO: 246582 - RNA, 22 nt, Human
aagcacagggugucugcauuca

SEQ ID NO: 246583 - RNA, 22 nt, Human
ggugggagagcucugucuccag

SEQ ID NO: 246584 - RNA, 22 nt, Human
acaggcagagaacucagccaga

SEQ ID NO: 246585 - RNA, 22 nt, Human
aagcugaaaaugagacucuaca

SEQ ID NO: 246586 - RNA, 22 nt, Human
ucuggugucaguauucuuugaa

SEQ ID NO: 246587 - RNA, 23 nt, Human
agguccuggacauaugugcauca

SEQ ID NO: 246588 - RNA, 22 nt, Human
agagccaggcucuaccuggguu

SEQ ID NO: 246589 - RNA, 22 nt, Human
ugucuccuacugccuguggauc

SEQ ID NO: 246590 - RNA, 22 nt, Human
ugaggggcggccugcagaggcc

SEQ ID NO: 246591 - RNA, 22 nt, Human
aaagggcagaguucacuagaaa

SEQ ID NO: 246592 - RNA, 22 nt, Human
augcagcugucagggagaacau

SEQ ID NO: 246593 - RNA, 22 nt, Human
guggccuuuccugaagaaauga

SEQ ID NO: 246594 - RNA, 22 nt, Human
aaucuggacuugucugugaaga

SEQ ID NO: 246595 - RNA, 22 nt, Human
aauuucagaccauuugcaauua

SEQ ID NO: 246596 - RNA, 22 nt, Human
cuuauucuacuccacaagcucu

SEQ ID NO: 246597 - RNA, 20 nt, Human
ucuaauuaaaauugucuagu

SEQ ID NO: 246598 - RNA, 22 nt, Human
auuucuaguccuuguguaguca

SEQ ID NO: 246599 - RNA, 22 nt, Human
agcccugagccagccuggucag

SEQ ID NO: 246600 - RNA, 22 nt, Human
ugcaggucuccauuggcagacu

SEQ ID NO: 246601 - RNA, 22 nt, Human
accaggcaugauguggagcaca

SEQ ID NO: 246602 - RNA, 22 nt, Human
aaaagccuggauacuaucauua

SEQ ID NO: 246603 - RNA, 22 nt, Human
ccuggcugcuuucacuauggag

SEQ ID NO: 246604 - RNA, 22 nt, Human
ucacccagaaaagacagcagau

SEQ ID NO: 246605 - RNA, 22 nt, Human
uuugaaacccgucacuuugagu

SEQ ID NO: 246606 - RNA, 22 nt, Human
uauuuguugcgggaauugcuau

SEQ ID NO: 246607 - RNA, 22 nt, Human
ugguccugccccgugcacagag

SEQ ID NO: 246608 - RNA, 22 nt, Human
aucuaagauguauugagcacuu

SEQ ID NO: 246609 - RNA, 22 nt, Human
aaaccugauagauuuucagaau

SEQ ID NO: 246610 - RNA, 22 nt, Human
ccagguggugaaagugggcccu

SEQ ID NO: 246611 - RNA, 22 nt, Human
uacaguuuagaaccauagaugg

SEQ ID NO: 246612 - RNA, 22 nt, Human
caaauguuaaauguguuaagac

SEQ ID NO: 246613 - RNA, 22 nt, Human
agcugggucuugggccaggaga

SEQ ID NO: 246614 - RNA, 22 nt, Human
agguauauauucugguccuuau

SEQ ID NO: 246615 - RNA, 22 nt, Human
gcugggagccccgagccagcgc

SEQ ID NO: 246616 - RNA, 22 nt, Human
gucauuuaaaagggaacacaug

SEQ ID NO: 246617 - RNA, 22 nt, Human
ggagggaagugaguucucagcu

SEQ ID NO: 246618 - RNA, 18 nt, Human
cccagcuccacuucccuc

SEQ ID NO: 246619 - RNA, 22 nt, Human
gaaauuaaccaccuuuggcuuu

SEQ ID NO: 246620 - RNA, 22 nt, Human
ucucugggccucaguuuucuca

SEQ ID NO: 246621 - RNA, 22 nt, Human
gcuccagcaccuagagcagguc

SEQ ID NO: 246622 - RNA, 22 nt, Human
cugggagggguagccaauccua

SEQ ID NO: 246623 - RNA, 22 nt, Human
gacucuuucccugugacagagu

SEQ ID NO: 246624 - RNA, 22 nt, Human
uguguucauuuaacuguucuuu

SEQ ID NO: 246625 - RNA, 22 nt, Human
accuagaacugcaggcuauuuu

SEQ ID NO: 246626 - RNA, 22 nt, Human
cacugagccuugccagcuuggu

SEQ ID NO: 246627 - RNA, 22 nt, Human
acuaaauaguuuugacagaaca

SEQ ID NO: 246628 - RNA, 22 nt, Human
uguuuacuggcuccugugguuc

SEQ ID NO: 246629 - RNA, 22 nt, Human
auguuaaaagugaggauggcca

SEQ ID NO: 246630 - RNA, 22 nt, Human
aaagccugucuggucauagcua

SEQ ID NO: 246631 - RNA, 22 nt, Human
uuccucagggcggaugggcagg

SEQ ID NO: 246632 - RNA, 22 nt, Human
ugagucugggcauguucacuuu

SEQ ID NO: 246633 - RNA, 22 nt, Human
ugcauauaucuuauuuuucugu

SEQ ID NO: 246634 - RNA, 22 nt, Human
ucugaggaauaagaaggaagug

SEQ ID NO: 246635 - RNA, 22 nt, Human
ggcccucuguggcugccaugga

SEQ ID NO: 246636 - RNA, 22 nt, Human
aggacagagggaccagagccca

SEQ ID NO: 246637 - RNA, 22 nt, Human
guugccuucuaugauucucagu

SEQ ID NO: 246638 - RNA, 22 nt, Human
augaggcuauuucauagauuuu

SEQ ID NO: 246639 - RNA, 22 nt, Human
acuauacaguauguacgugcac

SEQ ID NO: 246640 - RNA, 23 nt, Human
acuuugcagagccccuugaaaca

SEQ ID NO: 246641 - RNA, 20 nt, Human
cagaaagaagguagauuuuu

SEQ ID NO: 246642 - RNA, 22 nt, Human
ucuuugcaugcauuuucccuua

SEQ ID NO: 246643 - RNA, 22 nt, Human
acauguguaaggucucucaguc

SEQ ID NO: 246644 - RNA, 22 nt, Human
auauuucagcuuuacuuaggaa

SEQ ID NO: 246645 - RNA, 22 nt, Human
acaacaaucuacccuagcuucu

SEQ ID NO: 246646 - RNA, 22 nt, Human
gagccuccuccuggugugccga

SEQ ID NO: 246647 - RNA, 22 nt, Human
gaacauuccuggaagagugcuu

SEQ ID NO: 246648 - RNA, 22 nt, Human
ugagcuuauacaugugaaguca

SEQ ID NO: 246649 - RNA, 22 nt, Human
uauuuagugauagaagcaagga

SEQ ID NO: 246650 - RNA, 23 nt, Human
ugcauuauccucucugaagacca

SEQ ID NO: 246651 - RNA, 22 nt, Human
auguuauuaaaguacagauucu

SEQ ID NO: 246652 - RNA, 22 nt, Human
caugcuguugaauaugacauug

SEQ ID NO: 246653 - RNA, 22 nt, Human
ugcuagaauuugcagaagcaua

SEQ ID NO: 246654 - RNA, 22 nt, Human
agugcuuuauguuguugugcaa

SEQ ID NO: 246655 - RNA, 23 nt, Human
uaggcuucugcuguccccgacgc

SEQ ID NO: 246656 - RNA, 22 nt, Human
ccuggcucagcagcucuuucuc

SEQ ID NO: 246657 - RNA, 22 nt, Human
auucuuguuuaauuugcauccc

SEQ ID NO: 246658 - RNA, 22 nt, Human
aagcaaaagguuacacuucugg

SEQ ID NO: 246659 - RNA, 22 nt, Human
caggcugcauggagggguacag

SEQ ID NO: 246660 - RNA, 22 nt, Human
uuuguaaagucuguucugaguu

SEQ ID NO: 246661 - RNA, 22 nt, Human
ucugugugaccauaagccagcu

SEQ ID NO: 246662 - RNA, 22 nt, Human
auacaugugucccugauuuauu

SEQ ID NO: 246663 - RNA, 22 nt, Human
agucugggagggaugccagugu

SEQ ID NO: 246664 - RNA, 20 nt, Human
uuuaagaaguuucugaggaa

SEQ ID NO: 246665 - RNA, 23 nt, Human
auaguuuucccugguucuugcca

SEQ ID NO: 246666 - RNA, 22 nt, Human
uacaagucacuuccuuucuaaa

SEQ ID NO: 246667 - RNA, 22 nt, Human
aaaaucugcuuccuuuuacaga

SEQ ID NO: 246668 - RNA, 22 nt, Human
uugauucaaccacuuaauaauc

SEQ ID NO: 246669 - RNA, 22 nt, Human
caggcagcugacugucagauau

SEQ ID NO: 246670 - RNA, 20 nt, Human
gcaacuagggagacacagcu

SEQ ID NO: 246671 - RNA, 22 nt, Human
cauuagaauuagguuguuuacc

SEQ ID NO: 246672 - RNA, 22 nt, Human
gccuguucugcccugagagccu

SEQ ID NO: 246673 - RNA, 22 nt, Human
ccuugaaagccaggcagaggaa

SEQ ID NO: 246674 - RNA, 22 nt, Human
uggcaggugaaguuguuaggga

SEQ ID NO: 246675 - RNA, 22 nt, Human
uguggaagugccaaugacaaau

SEQ ID NO: 246676 - RNA, 22 nt, Human
gacacagaauuccccuccaagu

SEQ ID NO: 246677 - RNA, 22 nt, Human
cagcaugcuugggggagggagc

SEQ ID NO: 246678 - RNA, 22 nt, Human
cugccugcugcccuccagagcc

SEQ ID NO: 246679 - RNA, 18 nt, Human
acucugcggaggccccag

SEQ ID NO: 246680 - RNA, 22 nt, Human
uuggaauccugagaugagaauu

SEQ ID NO: 246681 - RNA, 22 nt, Human
cuguucuaucauuaaaagcuau

SEQ ID NO: 246682 - RNA, 22 nt, Human
cugagucuguacguuagccaua

SEQ ID NO: 246683 - RNA, 22 nt, Human
agagggcaaguguaguccagua

SEQ ID NO: 246684 - RNA, 22 nt, Human
uguaaauugaaggaaauuugug

SEQ ID NO: 246685 - RNA, 22 nt, Human
gugcaggcuagauccuuccuac

SEQ ID NO: 246686 - RNA, 22 nt, Human
aaguggacuaauacaaggacua

SEQ ID NO: 246687 - RNA, 22 nt, Human
uggguaggaaucgaguguaugg

SEQ ID NO: 246688 - RNA, 22 nt, Human
aggugcuuggcucgugcacaca

SEQ ID NO: 246689 - RNA, 22 nt, Human
ggcuagggaucuagaccaggac

SEQ ID NO: 246690 - RNA, 22 nt, Human
ucuguuuagaugcuuuaucugu

SEQ ID NO: 246691 - RNA, 22 nt, Human
gggaaacugaauucaggacucu

SEQ ID NO: 246692 - RNA, 22 nt, Human
auccaggccugagucugguccu

SEQ ID NO: 246693 - RNA, 22 nt, Human
gcuggagguggugagaaaaggu

SEQ ID NO: 246694 - RNA, 22 nt, Human
cuguuacuggacgcacgcagcu

SEQ ID NO: 246695 - RNA, 22 nt, Human
gagauguacaauguguauuaau

SEQ ID NO: 246696 - RNA, 22 nt, Human
cuguccuguagcuccaucaguc

SEQ ID NO: 246697 - RNA, 22 nt, Human
aggaucuugcuguagaggauag

SEQ ID NO: 246698 - RNA, 22 nt, Human
uccaggagguuuggaggaagca

SEQ ID NO: 246699 - RNA, 22 nt, Human
gcaggcuguagacaccaaacua

SEQ ID NO: 246700 - RNA, 22 nt, Human
uccaggucagacuucugugccc

SEQ ID NO: 246701 - RNA, 22 nt, Human
uggccaggcauucagauaagac

SEQ ID NO: 246702 - RNA, 22 nt, Human
gaagggaacugggucuccuugu

SEQ ID NO: 246703 - RNA, 22 nt, Human
ccucccacauugaggacaugcu

SEQ ID NO: 246704 - RNA, 22 nt, Human
aaggaagaggcagguuuugcug

SEQ ID NO: 246705 - RNA, 22 nt, Human
ugaaacagugcuucacucagcc

SEQ ID NO: 246706 - RNA, 19 nt, Human
auacagauguauccaugau

SEQ ID NO: 246707 - RNA, 22 nt, Human
uccaggcugugcaugaguuuag

SEQ ID NO: 246708 - RNA, 22 nt, Human
uggugaggucauagagaacugu

SEQ ID NO: 246709 - RNA, 22 nt, Human
ggcagugccacuaagcucugcu

SEQ ID NO: 246710 - RNA, 22 nt, Human
aauauaugacuccacugcauga

SEQ ID NO: 246711 - RNA, 22 nt, Human
uuguuuaauaucgugaaguacu

SEQ ID NO: 246712 - RNA, 22 nt, Human
uuaagaagguacucaaagaucu

SEQ ID NO: 246713 - RNA, 22 nt, Human
gcuggcuggcacguucgcacgu

SEQ ID NO: 246714 - RNA, 18 nt, Human
aagucuggcagcuuuccc

SEQ ID NO: 246715 - RNA, 22 nt, Human
uccaauauuucucacauaugga

SEQ ID NO: 246716 - RNA, 22 nt, Human
gaagcaaguggccugauucaga

SEQ ID NO: 246717 - RNA, 22 nt, Human
cucugggcggcccaggccaacc

SEQ ID NO: 246718 - RNA, 21 nt, Human
uucaaaguuugccuaaagauu

SEQ ID NO: 246719 - RNA, 22 nt, Human
auuuuaguaccucaaguaucca

SEQ ID NO: 246720 - RNA, 17 nt, Human
ucuguucaagugagagg

SEQ ID NO: 246721 - RNA, 21 nt, Human
agagaaagucauggcuguggc

SEQ ID NO: 246722 - RNA, 20 nt, Human
guccaggacccagcaggagg

SEQ ID NO: 246723 - RNA, 23 nt, Human
ugugaccccuaggaguggggacc

SEQ ID NO: 246724 - RNA, 22 nt, Human
uuccugggggcagcagucuuga

SEQ ID NO: 246725 - RNA, 22 nt, Human
ucugccuucgcugcucccugaa

SEQ ID NO: 246726 - RNA, 22 nt, Human
agcagcuggaacauaugaagaa

SEQ ID NO: 246727 - RNA, 21 nt, Human
uggagcucccugcaucccacu

SEQ ID NO: 246728 - RNA, 22 nt, Human
uuguaacagguacuaaauaacu

SEQ ID NO: 246729 - RNA, 22 nt, Human
aaauaucauucuggugcacaga

SEQ ID NO: 246730 - RNA, 22 nt, Human
ugcuuucaugaagucuauagag

SEQ ID NO: 246731 - RNA, 22 nt, Human
uuuauucacuggggucugcccg

SEQ ID NO: 246732 - RNA, 22 nt, Human
uggaggaguagauuuucagagg

SEQ ID NO: 246733 - RNA, 22 nt, Human
gcaguuugagguuuucugaugu

SEQ ID NO: 246734 - RNA, 22 nt, Human
gaguucuuaggcaaacaacucu

SEQ ID NO: 246735 - RNA, 22 nt, Human
caagcagguccugaaucugguc

SEQ ID NO: 246736 - RNA, 22 nt, Human
aacuuucuggcuuuggggagag

SEQ ID NO: 246737 - RNA, 22 nt, Human
uuucauuauacagcuucauaaa

SEQ ID NO: 246738 - RNA, 22 nt, Human
cuguccugguacuuugagguuc

SEQ ID NO: 246739 - RNA, 22 nt, Human
ugcaagagacagacaugacuca

SEQ ID NO: 246740 - RNA, 22 nt, Human
agucuccacuugacaucagcag

SEQ ID NO: 246741 - RNA, 22 nt, Human
aaggaacuuugcagaggugauu

SEQ ID NO: 246742 - RNA, 22 nt, Human
cuugcugggguaagucugugcu

SEQ ID NO: 246743 - RNA, 22 nt, Human
ugccaggcagugucagauugag

SEQ ID NO: 246744 - RNA, 22 nt, Human
cagggcccagucccugcuguca

SEQ ID NO: 246745 - RNA, 22 nt, Human
caguggcaaugggacagagcac

SEQ ID NO: 246746 - RNA, 22 nt, Human
accuucaagaaacauuuccuug

SEQ ID NO: 246747 - RNA, 22 nt, Human
cagaaagcaaaauggaucucug

SEQ ID NO: 246748 - RNA, 22 nt, Human
gccucugcugcaagccugguug

SEQ ID NO: 246749 - RNA, 22 nt, Human
ggaaagaggauaguggguaggu

SEQ ID NO: 246750 - RNA, 22 nt, Human
acuagauuuuggccauuauaca

SEQ ID NO: 246751 - RNA, 22 nt, Human
uuccccaggcggcuuuuucagc

SEQ ID NO: 246752 - RNA, 22 nt, Human
uacaguuuguauggucaggaau

SEQ ID NO: 246753 - RNA, 22 nt, Human
ugggggugguucuugccuccag

SEQ ID NO: 246754 - RNA, 22 nt, Human
cacuggaaccauccacauagug

SEQ ID NO: 246755 - RNA, 22 nt, Human
cauuugaaaauacucuuuucca

SEQ ID NO: 246756 - RNA, 22 nt, Human
guucacauccuugugaggauuu

SEQ ID NO: 246757 - RNA, 18 nt, Human
cugagugaugauggggug

SEQ ID NO: 246758 - RNA, 22 nt, Human
gugcagcagggggaagacagug

SEQ ID NO: 246759 - RNA, 22 nt, Human
aggccagugcagcuggaacaga

SEQ ID NO: 246760 - RNA, 22 nt, Human
aacagguacaguuucccucugg

SEQ ID NO: 246761 - RNA, 20 nt, Human
uccucccccaccuuugcagc

SEQ ID NO: 246762 - RNA, 22 nt, Human
ccaggggcuggugcugagcugg

SEQ ID NO: 246763 - RNA, 22 nt, Human
augguacaauuuucauuugugg

SEQ ID NO: 246764 - RNA, 22 nt, Human
cucugagggucuaaggagucac

SEQ ID NO: 246765 - RNA, 22 nt, Human
gaguguauggaaggaagagauu

SEQ ID NO: 246766 - RNA, 22 nt, Human
gcugcucuggcucugcaguguc

SEQ ID NO: 246767 - RNA, 22 nt, Human
gcugcgguggcuggcgauggga

SEQ ID NO: 246768 - RNA, 22 nt, Human
acaucuuugcucuuauagagcu

SEQ ID NO: 246769 - RNA, 16 nt, Human
agcaccagaucauauc

SEQ ID NO: 246770 - RNA, 23 nt, Human
uuucacagcuuuuauucugcauc

SEQ ID NO: 246771 - RNA, 22 nt, Human
uggcagcuuccugcucauagga

SEQ ID NO: 246772 - RNA, 22 nt, Human
aaauguguuuagaugguuuauu

SEQ ID NO: 246773 - RNA, 22 nt, Human
acacauucuuuaaaugucuguu

SEQ ID NO: 246774 - RNA, 22 nt, Human
uucuccagaccacugccucugu

SEQ ID NO: 246775 - RNA, 22 nt, Human
ggcaucagagguguguucugcu

SEQ ID NO: 246776 - RNA, 22 nt, Human
cagagugauggcaccugcuggg

SEQ ID NO: 246777 - RNA, 22 nt, Human
cacuggugaguccagaagucau

SEQ ID NO: 246778 - RNA, 22 nt, Human
ucuccacaagcugaugcuagga

SEQ ID NO: 246779 - RNA, 22 nt, Human
ucuggcaguuugagaaaggcua

SEQ ID NO: 246780 - RNA, 22 nt, Human
gccucagcucccagcccaggcu

SEQ ID NO: 246781 - RNA, 22 nt, Human
aagacagaccacgugacagggc

SEQ ID NO: 246782 - RNA, 22 nt, Human
auuuggaacuuauaauaaguuu

SEQ ID NO: 246783 - RNA, 22 nt, Human
aaaacaggugucagcaaacuau

SEQ ID NO: 246784 - RNA, 22 nt, Human
guguguccuugggccucugcag

SEQ ID NO: 246785 - RNA, 22 nt, Human
uugcagggaaauagaaauaaac

SEQ ID NO: 246786 - RNA, 22 nt, Human
uuucacagcuagugagcuucua

SEQ ID NO: 246787 - RNA, 22 nt, Human
uuuucuuuaaucugguggggug

SEQ ID NO: 246788 - RNA, 22 nt, Human
uuaacauacaucaugaacaaug

SEQ ID NO: 246789 - RNA, 22 nt, Human
uggggccugaaagguucucgcc

SEQ ID NO: 246790 - RNA, 22 nt, Human
acuggcagagguuggacaccau

SEQ ID NO: 246791 - RNA, 22 nt, Human
ucucuggagggcuccaggcggg

SEQ ID NO: 246792 - RNA, 22 nt, Human
gcccaggauucuuucuuccuua

SEQ ID NO: 246793 - RNA, 22 nt, Human
uccugaggccucugugauguga

SEQ ID NO: 246794 - RNA, 22 nt, Human
gaaaguauucucccugaauuuu

SEQ ID NO: 246795 - RNA, 22 nt, Human
cacaaugauuugguucaaaaau

SEQ ID NO: 246796 - RNA, 22 nt, Human
caggcuucuuuucuuuccagac

SEQ ID NO: 246797 - RNA, 20 nt, Human
cauggcugugagcccacagg

SEQ ID NO: 246798 - RNA, 23 nt, Human
ccaccuggacucugggcaggugc

SEQ ID NO: 246799 - RNA, 22 nt, Human
agcuuccuugaauucuguagaa

SEQ ID NO: 246800 - RNA, 22 nt, Human
ugucagcaguaucucuaucuca

SEQ ID NO: 246801 - RNA, 22 nt, Human
gagugucagcagggcagagcac

SEQ ID NO: 246802 - RNA, 22 nt, Human
agagggugagcagguacacaug

SEQ ID NO: 246803 - RNA, 22 nt, Human
gcagggacaucuucagaucacu

SEQ ID NO: 246804 - RNA, 22 nt, Human
aaacuugacagugagacaguuu

SEQ ID NO: 246805 - RNA, 22 nt, Human
agagggggaaaauagagguguu

SEQ ID NO: 246806 - RNA, 22 nt, Human
gccugagcccaggugugcagag

SEQ ID NO: 246807 - RNA, 22 nt, Human
cagagcaggcccacugcccucc

SEQ ID NO: 246808 - RNA, 22 nt, Human
ucugggcacacaccaugcccac

SEQ ID NO: 246809 - RNA, 22 nt, Human
ugcucagcgccaaagcugaugg

SEQ ID NO: 246810 - RNA, 22 nt, Human
ggcaggcuugguggcaccgguu

SEQ ID NO: 246811 - RNA, 22 nt, Human
uagcacaagcaacuacugaagu

SEQ ID NO: 246812 - RNA, 22 nt, Human
gagggggagaugugcacacacu

SEQ ID NO: 246813 - RNA, 19 nt, Human
ccuacuuguuugagggaag

SEQ ID NO: 246814 - RNA, 19 nt, Human
aucuaagagaugggggaaa

SEQ ID NO: 246815 - RNA, 22 nt, Human
ccaaaauuaagccucuuauguu

SEQ ID NO: 246816 - RNA, 22 nt, Human
gaggcacaguguuuggucagug

SEQ ID NO: 246817 - RNA, 22 nt, Human
gagcugaaauaugaagccaauu

SEQ ID NO: 246818 - RNA, 22 nt, Human
uaugagaacaagaacaaucucc

SEQ ID NO: 246819 - RNA, 22 nt, Human
agacaaauaacuuuuuaugucc

SEQ ID NO: 246820 - RNA, 22 nt, Human
acuguuuaggaggcuuauaugc

SEQ ID NO: 246821 - RNA, 22 nt, Human
ccuggcacagauccuucauaca

SEQ ID NO: 246822 - RNA, 22 nt, Human
agggccugggccagcacccuuu

SEQ ID NO: 246823 - RNA, 22 nt, Human
uauuuacuuuuaaauugagaac

SEQ ID NO: 246824 - RNA, 22 nt, Human
aggcuuggugccaaggagccug

SEQ ID NO: 246825 - RNA, 22 nt, Human
aaggcuggggugcagacggccu

SEQ ID NO: 246826 - RNA, 22 nt, Human
gggggacaggaugaauaucugu

SEQ ID NO: 246827 - RNA, 22 nt, Human
ggccaggccaagaggguuggaa

SEQ ID NO: 246828 - RNA, 22 nt, Human
uacauguucaaauuugucuuuc

SEQ ID NO: 246829 - RNA, 22 nt, Human
acugucuugcuaugagcuccca

SEQ ID NO: 246830 - RNA, 22 nt, Human
agcugaaucucaggcauccuuu

SEQ ID NO: 246831 - RNA, 22 nt, Human
aggcuucuacguggucccaggg

SEQ ID NO: 246832 - RNA, 22 nt, Human
gcugggcugagaaguuaagcaa

SEQ ID NO: 246833 - RNA, 22 nt, Human
ccucagcauccucaugcucagu

SEQ ID NO: 246834 - RNA, 23 nt, Human
auuuccuaaaagauaaucauuac

SEQ ID NO: 246835 - RNA, 22 nt, Human
guuccugaagggacuggugcag

SEQ ID NO: 246836 - RNA, 23 nt, Human
uuuugugugacuuaauaucucuu

SEQ ID NO: 246837 - RNA, 22 nt, Human
uacuaggaagcagcugcauugg

SEQ ID NO: 246838 - RNA, 22 nt, Human
cucucagcaggaaagcaugcaa

SEQ ID NO: 246839 - RNA, 22 nt, Human
aagcaguagaaugcauugcuuu

SEQ ID NO: 246840 - RNA, 22 nt, Human
caaaguuuuaguaaacauauau

SEQ ID NO: 246841 - RNA, 22 nt, Human
uggucugggcaaauccuucuga

SEQ ID NO: 246842 - RNA, 22 nt, Human
caggucccgccccgggcugacc

SEQ ID NO: 246843 - RNA, 22 nt, Human
gugcaaagugcauggggaaggg

SEQ ID NO: 246844 - RNA, 23 nt, Human
ugacagaccuucccagacaguca

SEQ ID NO: 246845 - RNA, 22 nt, Human
aucuuguuaaaaugcagaaacu

SEQ ID NO: 246846 - RNA, 22 nt, Human
cacagggaggcggucacuggcu

SEQ ID NO: 246847 - RNA, 22 nt, Human
ucuuugcaucccuuccauaguu

SEQ ID NO: 246848 - RNA, 22 nt, Human
aaauucaauuaacuuucaugcu

SEQ ID NO: 246849 - RNA, 22 nt, Human
gcuuccugaguacacccucauc

SEQ ID NO: 246850 - RNA, 22 nt, Human
aauguaaagcucaggucaggag

SEQ ID NO: 246851 - RNA, 22 nt, Human
gcagguguuuuaagacauugaa

SEQ ID NO: 246852 - RNA, 22 nt, Human
acacauaugucauugaaaaauc

SEQ ID NO: 246853 - RNA, 22 nt, Human
agcacaggugaaacagucaggu

SEQ ID NO: 246854 - RNA, 20 nt, Human
ggagagccacauagucuccc

SEQ ID NO: 246855 - RNA, 22 nt, Human
uuuuucauauuccccucucugg

SEQ ID NO: 246856 - RNA, 22 nt, Human
aagaaaacaaugacuugccagc

SEQ ID NO: 246857 - RNA, 22 nt, Human
uguuucugucuguuuucuacau

SEQ ID NO: 246858 - RNA, 22 nt, Human
accagcucuucugcucuaguug

SEQ ID NO: 246859 - RNA, 22 nt, Human
uucacacuguuuuucauagugg

SEQ ID NO: 246860 - RNA, 22 nt, Human
cccagacccagagggaggcagg

SEQ ID NO: 246861 - RNA, 22 nt, Human
aaugcuuugagggaagaugaaa

SEQ ID NO: 246862 - RNA, 22 nt, Human
uguguccucacuguaugcaagg

SEQ ID NO: 246863 - RNA, 22 nt, Human
agaagcuaggcuagacaaguga

SEQ ID NO: 246864 - RNA, 22 nt, Human
ccaggguuggcaagcaaggcuu

SEQ ID NO: 246865 - RNA, 22 nt, Human
cuucucuguguagagauucaga

SEQ ID NO: 246866 - RNA, 22 nt, Human
gaggcucacuaggcauccuggg

SEQ ID NO: 246867 - RNA, 22 nt, Human
cauaauuacugauaugcugauu

SEQ ID NO: 246868 - RNA, 22 nt, Human
uucugacauauccagucucagu

SEQ ID NO: 246869 - RNA, 22 nt, Human
ugucagugguagacccagaggu

SEQ ID NO: 246870 - RNA, 22 nt, Human
ccugggcagccugcucaaggac

SEQ ID NO: 246871 - RNA, 22 nt, Human
uccuucaagaugccacagcuuu

SEQ ID NO: 246872 - RNA, 22 nt, Human
uugacaaguggagauauuuaag

SEQ ID NO: 246873 - RNA, 22 nt, Human
ucaagcaaaguuuagcugguua

SEQ ID NO: 246874 - RNA, 22 nt, Human
uuucuguuuagcauaaaguggc

SEQ ID NO: 246875 - RNA, 22 nt, Human
uccuggccuccguucucugcau

SEQ ID NO: 246876 - RNA, 22 nt, Human
uuuucuaacaucuaguaauuug

SEQ ID NO: 246877 - RNA, 22 nt, Human
uggcagcacuugaacuugagcc

SEQ ID NO: 246878 - RNA, 22 nt, Human
ucugggaugagaucagagacac

SEQ ID NO: 246879 - RNA, 19 nt, Human
ugcccagaguguaugcgca

SEQ ID NO: 246880 - RNA, 21 nt, Human
uguggcagauguugggaggca

SEQ ID NO: 246881 - RNA, 22 nt, Human
agcccugcauaaaucaguuggu

SEQ ID NO: 246882 - RNA, 20 nt, Human
agaagucagcucagaaguga

SEQ ID NO: 246883 - RNA, 22 nt, Human
gagacugggggcuuggccuuuu

SEQ ID NO: 246884 - RNA, 22 nt, Human
aucuuuaccaccaaagaaugcu

SEQ ID NO: 246885 - RNA, 22 nt, Human
uagagcuggaauuugcagcaag

SEQ ID NO: 246886 - RNA, 21 nt, Human
cugugggaccaagcacuggga

SEQ ID NO: 246887 - RNA, 21 nt, Human
ggagggcagcccagacuggcu

SEQ ID NO: 246888 - RNA, 22 nt, Human
uccuggggccaggcaccucugg

SEQ ID NO: 246889 - RNA, 20 nt, Human
agcauacaucauaagaaacc

SEQ ID NO: 246890 - RNA, 21 nt, Human
aguugcugcugcugcagguga

SEQ ID NO: 246891 - RNA, 22 nt, Human
aguauuuagcugacucgcuaca

SEQ ID NO: 246892 - RNA, 17 nt, Human
uggccaggccccgccag

SEQ ID NO: 246893 - RNA, 20 nt, Human
cagcaggcuauggggcaccc

SEQ ID NO: 246894 - RNA, 20 nt, Human
ugucuucauuauggugcccu

SEQ ID NO: 246895 - RNA, 22 nt, Human
uuagaaaacauaagugguaaag

SEQ ID NO: 246896 - RNA, 22 nt, Human
cuguggcauugugaggacugca

SEQ ID NO: 246897 - RNA, 22 nt, Human
aagcuguacuuagcauugacuc

SEQ ID NO: 246898 - RNA, 22 nt, Human
agcuuccuuggcgcugaggccu

SEQ ID NO: 246899 - RNA, 22 nt, Human
ucugccccugcugggcacagag

SEQ ID NO: 246900 - RNA, 22 nt, Human
auaacagaauaagucauuaccg

SEQ ID NO: 246901 - RNA, 20 nt, Human
ugcugcugugagcgucccug

SEQ ID NO: 246902 - RNA, 22 nt, Human
uuuaccuucuuuuaacuacagu

SEQ ID NO: 246903 - RNA, 22 nt, Human
uuuguagcagcaugauuuauaa

SEQ ID NO: 246904 - RNA, 22 nt, Human
ucugagcaccuuauauucuuga

SEQ ID NO: 246905 - RNA, 22 nt, Human
agucuagaugauccuaggaaua

SEQ ID NO: 246906 - RNA, 22 nt, Human
gagcuggcugugguugagugca

SEQ ID NO: 246907 - RNA, 22 nt, Human
caucuuugguuuucuauaugcc

SEQ ID NO: 246908 - RNA, 22 nt, Human
ugccaauucgcagugaguauuu

SEQ ID NO: 246909 - RNA, 22 nt, Human
aucuuuuuugucuuggucacug

SEQ ID NO: 246910 - RNA, 22 nt, Human
uuuacacaaaauguuaguagau

SEQ ID NO: 246911 - RNA, 22 nt, Human
agccuucucugaaauucuguuu

SEQ ID NO: 246912 - RNA, 22 nt, Human
gaaagaagcuuuagauggcuau

SEQ ID NO: 246913 - RNA, 19 nt, Human
ccuguucaugacucugucc

SEQ ID NO: 246914 - RNA, 22 nt, Human
uuugugauuaauuuucaaccuc

SEQ ID NO: 246915 - RNA, 22 nt, Human
ggugggagccaacacccuucug

SEQ ID NO: 246916 - RNA, 23 nt, Human
ugccuuaguuagcacauuucuaa

SEQ ID NO: 246917 - RNA, 22 nt, Human
uggcagggucuugcuguguugc

SEQ ID NO: 246918 - RNA, 22 nt, Human
gagagccaugguggagaugggg

SEQ ID NO: 246919 - RNA, 22 nt, Human
uuagggacaaauuugcagaacc

SEQ ID NO: 246920 - RNA, 22 nt, Human
auugcaaagaaauacaugcuua

SEQ ID NO: 246921 - RNA, 22 nt, Human
ccaggcucuguuccccgaggag

SEQ ID NO: 246922 - RNA, 22 nt, Human
ccuccuggaggcucuagggaaa

SEQ ID NO: 246923 - RNA, 22 nt, Human
ccccacagcuuguggagagaau

SEQ ID NO: 246924 - RNA, 22 nt, Human
cuuugcaagggauuucaugucu

SEQ ID NO: 246925 - RNA, 22 nt, Human
ucagcuguguaucccagggccu

SEQ ID NO: 246926 - RNA, 22 nt, Human
gggacauggcuaggauuccaau

SEQ ID NO: 246927 - RNA, 22 nt, Human
uggcagggaguugcaggauuuc

SEQ ID NO: 246928 - RNA, 19 nt, Human
aggcugcaagguggugggc

SEQ ID NO: 246929 - RNA, 22 nt, Human
uucagucucaagugcugcucac

SEQ ID NO: 246930 - RNA, 22 nt, Human
ugcauguuaagaaaauauugag

SEQ ID NO: 246931 - RNA, 22 nt, Human
guuggugaugccacacauauuu

SEQ ID NO: 246932 - RNA, 22 nt, Human
ucuucaaaugcuaguaauauca

SEQ ID NO: 246933 - RNA, 17 nt, Human
auuucacuuagcaugag

SEQ ID NO: 246934 - RNA, 22 nt, Human
auuucuagguucacauguguuu

SEQ ID NO: 246935 - RNA, 22 nt, Human
uuauuccauucaguucaacaag

SEQ ID NO: 246936 - RNA, 22 nt, Human
cuagggaaaguggacauggcuu

SEQ ID NO: 246937 - RNA, 22 nt, Human
uccuuagagugguugugcuaug

SEQ ID NO: 246938 - RNA, 18 nt, Human
ggcugcucgcucuccccg

SEQ ID NO: 246939 - RNA, 22 nt, Human
ugagcaggggagagcgaaugug

SEQ ID NO: 246940 - RNA, 22 nt, Human
ucaugcaguuacuguuaugcaa

SEQ ID NO: 246941 - RNA, 22 nt, Human
ugcuucuuuaugauguaugauu

SEQ ID NO: 246942 - RNA, 22 nt, Human
uaucaaaaggaguugaaagggg

SEQ ID NO: 246943 - RNA, 19 nt, Human
ugcucaggccaaggagccc

SEQ ID NO: 246944 - RNA, 22 nt, Human
uguuuuaguucugucuugcaug

SEQ ID NO: 246945 - RNA, 19 nt, Human
cuaaacuuaugugaccaca

SEQ ID NO: 246946 - RNA, 22 nt, Human
cccugcaggggaccugcagccu

SEQ ID NO: 246947 - RNA, 22 nt, Human
aaauccuuuucuauacagcaua

SEQ ID NO: 246948 - RNA, 22 nt, Human
aaguuugcauagauuaagcauu

SEQ ID NO: 246949 - RNA, 22 nt, Human
uuuagaauguuagcguuaaagg

SEQ ID NO: 246950 - RNA, 22 nt, Human
uugcuuuaggauuuaaguggca

SEQ ID NO: 246951 - RNA, 21 nt, Human
aguguccuugaucuugccuug

SEQ ID NO: 246952 - RNA, 22 nt, Human
cuucucugcaccccacuuuugc

SEQ ID NO: 246953 - RNA, 22 nt, Human
ucuauaaaacucaagagcaauu

SEQ ID NO: 246954 - RNA, 22 nt, Human
cugucuccgcccucuugguagg

SEQ ID NO: 246955 - RNA, 22 nt, Human
uaaggcuuaugaucagaagguu

SEQ ID NO: 246956 - RNA, 22 nt, Human
aaggcugccucugccagaggag

SEQ ID NO: 246957 - RNA, 22 nt, Human
uggcgaggccaggccagggccu

SEQ ID NO: 246958 - RNA, 22 nt, Human
uaugcauaauuggauaaguaga

SEQ ID NO: 246959 - RNA, 22 nt, Human
cugccaggcgauggauuggcug

SEQ ID NO: 246960 - RNA, 22 nt, Human
gguucccggaucuccgaguccc

SEQ ID NO: 246961 - RNA, 22 nt, Human
gcucagaggccaagugcccgcc

SEQ ID NO: 246962 - RNA, 22 nt, Human
gguacaaaguuagauuuaacuu

SEQ ID NO: 246963 - RNA, 22 nt, Human
gaggccagaguuccccgaguca

SEQ ID NO: 246964 - RNA, 20 nt, Human
aacagcacacauucgcauua

SEQ ID NO: 246965 - RNA, 22 nt, Human
auuacaguucuacacauccuuu

SEQ ID NO: 246966 - RNA, 22 nt, Human
ucuauuuuuauaguugaagugc

SEQ ID NO: 246967 - RNA, 22 nt, Human
ccagagguccccugccaggagg

SEQ ID NO: 246968 - RNA, 22 nt, Human
gaggccaggguaccaucaacau

SEQ ID NO: 246969 - RNA, 22 nt, Human
uuuaugaacuacagauauaacu

SEQ ID NO: 246970 - RNA, 22 nt, Human
cagugcugagagccuggccagg

SEQ ID NO: 246971 - RNA, 22 nt, Human
uuaauuacuggcauggugguug

SEQ ID NO: 246972 - RNA, 22 nt, Human
uuacaucacuuuacuuaauaau

SEQ ID NO: 246973 - RNA, 21 nt, Human
gccaagaacaagacagacaug

SEQ ID NO: 246974 - RNA, 22 nt, Human
ucuuuugugauucuuuaguuac

SEQ ID NO: 246975 - RNA, 22 nt, Human
ccuggcucugcagccacuccag

SEQ ID NO: 246976 - RNA, 22 nt, Human
uaaguucaguuggucgaaguag

SEQ ID NO: 246977 - RNA, 22 nt, Human
uuccuguggcugucacuccugg

SEQ ID NO: 246978 - RNA, 22 nt, Human
aacacaggggcguggcucuuac

SEQ ID NO: 246979 - RNA, 22 nt, Human
cuuaaaggucauucuguugaua

SEQ ID NO: 246980 - RNA, 22 nt, Human
gucaucugugcuuuugguagga

SEQ ID NO: 246981 - RNA, 22 nt, Human
acagaaauucugggacagaaaa

SEQ ID NO: 246982 - RNA, 22 nt, Human
aaucucaagcuguaaauaccuc

SEQ ID NO: 246983 - RNA, 22 nt, Human
ccacacuaaacugcucaaacca

SEQ ID NO: 246984 - RNA, 22 nt, Human
caugggggucuggacaacaggc

SEQ ID NO: 246985 - RNA, 22 nt, Human
auacagguguacacacaugcaa

SEQ ID NO: 246986 - RNA, 22 nt, Human
agcccugcaggaugagggaggu

SEQ ID NO: 246987 - RNA, 22 nt, Human
acaaggcuggcugggaaaaacu

SEQ ID NO: 246988 - RNA, 22 nt, Human
cuguggugagcaacugacugaa

SEQ ID NO: 246989 - RNA, 22 nt, Human
aacuacauuuuacagaagauga

SEQ ID NO: 246990 - RNA, 15 nt, Human
uguggcuggcuccug

SEQ ID NO: 246991 - RNA, 22 nt, Human
aaguguauauaugacuuauaaa

SEQ ID NO: 246992 - RNA, 22 nt, Human
gcuuccagcaaacacuggcugc

SEQ ID NO: 246993 - RNA, 23 nt, Human
acaggcucuuaaucagugcuccu

SEQ ID NO: 246994 - RNA, 22 nt, Human
aacagaauuguacaccagggag

SEQ ID NO: 246995 - RNA, 22 nt, Human
auauacacagagcuuaugguga

SEQ ID NO: 246996 - RNA, 22 nt, Human
cuguggcaagucugccugucac

SEQ ID NO: 246997 - RNA, 22 nt, Human
uguagcauguaaauugguuauu

SEQ ID NO: 246998 - RNA, 22 nt, Human
ugcugaaauuagaacauugagg

SEQ ID NO: 246999 - RNA, 21 nt, Human
uggaccuguccuucucgcugu

SEQ ID NO: 247000 - RNA, 22 nt, Human
gcuccaggcgagcuggaccaga

SEQ ID NO: 247001 - RNA, 22 nt, Human
cauuucaagcauugacuucuau

SEQ ID NO: 247002 - RNA, 22 nt, Human
gcugggagaggcagcuuucgga

SEQ ID NO: 247003 - RNA, 22 nt, Human
ucagcaggggccguugggugga

SEQ ID NO: 247004 - RNA, 22 nt, Human
gcagacagcauguugggcuauu

SEQ ID NO: 247005 - RNA, 22 nt, Human
aaugagauggaggacucuuaau

SEQ ID NO: 247006 - RNA, 22 nt, Human
gacauauacuauggaugguucu

SEQ ID NO: 247007 - RNA, 22 nt, Human
uggagaaggccggccaggagug

SEQ ID NO: 247008 - RNA, 22 nt, Human
cuuguuuuggcuaguaugaugu

SEQ ID NO: 247009 - RNA, 22 nt, Human
cugacaagguugaauuguccca

SEQ ID NO: 247010 - RNA, 22 nt, Human
ugaaggcuugguggcagccucu

SEQ ID NO: 247011 - RNA, 22 nt, Human
acagaugguuauugucauuucu

SEQ ID NO: 247012 - RNA, 22 nt, Human
ucaggcagagggagaagccaag

SEQ ID NO: 247013 - RNA, 22 nt, Human
uuuacagucaccaaacuuugcu

SEQ ID NO: 247014 - RNA, 22 nt, Human
uucuaacuuucaagguccuuuc

SEQ ID NO: 247015 - RNA, 22 nt, Human
augaggcaugggaucaaaauga

SEQ ID NO: 247016 - RNA, 23 nt, Human
acagugucugcugcaagauaucu

SEQ ID NO: 247017 - RNA, 20 nt, Human
gauggauuucaacaccuuuc

SEQ ID NO: 247018 - RNA, 22 nt, Human
gccaggguugccaaugggggca

SEQ ID NO: 247019 - RNA, 22 nt, Human
uauuccagguuucuuguuguau

SEQ ID NO: 247020 - RNA, 22 nt, Human
auaaguaggaaaauuugaauau

SEQ ID NO: 247021 - RNA, 20 nt, Human
ucaggaugugcugagugaag

SEQ ID NO: 247022 - RNA, 22 nt, Human
gagcaguuuuauuucaugagac

SEQ ID NO: 247023 - RNA, 22 nt, Human
gcucagagcccgaggcuugcau

SEQ ID NO: 247024 - RNA, 22 nt, Human
uggcucccgcuugcaccuaaga

SEQ ID NO: 247025 - RNA, 22 nt, Human
auguuuugcuggauguuggcua

SEQ ID NO: 247026 - RNA, 22 nt, Human
aagcaggugugagccagugggc

SEQ ID NO: 247027 - RNA, 22 nt, Human
gugaggcagggaaagaggauaa

SEQ ID NO: 247028 - RNA, 22 nt, Human
ugaagggggagauauaugugug

SEQ ID NO: 247029 - RNA, 22 nt, Human
gagggaugguaguugacacuga

SEQ ID NO: 247030 - RNA, 22 nt, Human
acugcauuugucugucucaauu

SEQ ID NO: 247031 - RNA, 22 nt, Human
caggccuugcgucccauggccu

SEQ ID NO: 247032 - RNA, 22 nt, Human
caguggaaaucagagugagagu

SEQ ID NO: 247033 - RNA, 22 nt, Human
gauggcuuugccugcugugagg

SEQ ID NO: 247034 - RNA, 22 nt, Human
aacaucaucaugaacaacuaau

SEQ ID NO: 247035 - RNA, 22 nt, Human
cacauuuaagugcuuguucaga

SEQ ID NO: 247036 - RNA, 22 nt, Human
cccagccaagugaucugaccgc

SEQ ID NO: 247037 - RNA, 22 nt, Human
uagaaaucuuguuacuaugugu

SEQ ID NO: 247038 - RNA, 22 nt, Human
uugagguauugauauuuuauga

SEQ ID NO: 247039 - RNA, 22 nt, Human
gucugaaaauaugauuuugccu

SEQ ID NO: 247040 - RNA, 21 nt, Human
agcaugucucagucaacaagg

SEQ ID NO: 247041 - RNA, 22 nt, Human
ucauagaugugcugugcacaaa

SEQ ID NO: 247042 - RNA, 22 nt, Human
ggcuuuaugcacagcagauggu

SEQ ID NO: 247043 - RNA, 22 nt, Human
ccuuucucuuugcugaucaugu

SEQ ID NO: 247044 - RNA, 22 nt, Human
ucuuuuaagccucuggcauagg

SEQ ID NO: 247045 - RNA, 22 nt, Human
acagaagagcacauuuaguaug

SEQ ID NO: 247046 - RNA, 22 nt, Human
ugagugcuggcuaaauagaaaa

SEQ ID NO: 247047 - RNA, 22 nt, Human
ggagagucugagccugcuggag

SEQ ID NO: 247048 - RNA, 22 nt, Human
acacaucuccagaagugggcug

SEQ ID NO: 247049 - RNA, 22 nt, Human
ucugcaggcuguacaggaagca

SEQ ID NO: 247050 - RNA, 22 nt, Human
uaaaagauuuuauaggaacaag

SEQ ID NO: 247051 - RNA, 22 nt, Human
aagucucuuaguaauauccaac

SEQ ID NO: 247052 - RNA, 22 nt, Human
agcacagugcugggcacacagu

SEQ ID NO: 247053 - RNA, 22 nt, Human
acagcuguauucaaguugcaag

SEQ ID NO: 247054 - RNA, 22 nt, Human
cuggaugugguaaugacuuuga

SEQ ID NO: 247055 - RNA, 22 nt, Human
ucuugaaagcaugagauggaca

SEQ ID NO: 247056 - RNA, 22 nt, Human
uggaaauguauuugggcaugcc

SEQ ID NO: 247057 - RNA, 22 nt, Human
agagguagagguugcagugagc

SEQ ID NO: 247058 - RNA, 22 nt, Human
uagaaccaccuucuccuuuacc

SEQ ID NO: 247059 - RNA, 22 nt, Human
uaaagcaauuugagcaaguucu

SEQ ID NO: 247060 - RNA, 22 nt, Human
acagggcagugucuugaaaaau

SEQ ID NO: 247061 - RNA, 20 nt, Human
acauaugaaugauagagcca

SEQ ID NO: 247062 - RNA, 22 nt, Human
auguuaaaaaccaguacaguug

SEQ ID NO: 247063 - RNA, 20 nt, Human
agcccaucucccacagcuac

SEQ ID NO: 247064 - RNA, 22 nt, Human
uaaaauguagcuucuaggcugg

SEQ ID NO: 247065 - RNA, 22 nt, Human
ggcugaggggcccagaggaaca

SEQ ID NO: 247066 - RNA, 22 nt, Human
ggaggagacggagugauuagug

SEQ ID NO: 247067 - RNA, 22 nt, Human
gggcucuggaguucuagaaaga

SEQ ID NO: 247068 - RNA, 22 nt, Human
uuggcucagugugagggagaug

SEQ ID NO: 247069 - RNA, 22 nt, Human
aagagggguggucugugaggau

SEQ ID NO: 247070 - RNA, 22 nt, Human
uuaccugugucaguauaugaga

SEQ ID NO: 247071 - RNA, 22 nt, Human
agcugcaggcccaugcucaguc

SEQ ID NO: 247072 - RNA, 22 nt, Human
aacauucaaguucugguuuaug

SEQ ID NO: 247073 - RNA, 22 nt, Human
aauaggcagcuuagcaggggcu

SEQ ID NO: 247074 - RNA, 22 nt, Human
uugcuguaguguucugauguca

SEQ ID NO: 247075 - RNA, 22 nt, Human
aggcugcuuccuuacguggcug

SEQ ID NO: 247076 - RNA, 22 nt, Human
ugggaugucuuuaggggaagag

SEQ ID NO: 247077 - RNA, 22 nt, Human
ggugaccucaccuggucccacc

SEQ ID NO: 247078 - RNA, 22 nt, Human
agcuuuaucuucaccugggaau

SEQ ID NO: 247079 - RNA, 22 nt, Human
ggucugaggcuccaaggaggug

SEQ ID NO: 247080 - RNA, 22 nt, Human
cuuagcuagugcucagcuguca

SEQ ID NO: 247081 - RNA, 22 nt, Human
uucauucauucaugaauguuaa

SEQ ID NO: 247082 - RNA, 22 nt, Human
ccuccuggugacaaggcaaagc

SEQ ID NO: 247083 - RNA, 22 nt, Human
agcacaauauggguuuuauagu

SEQ ID NO: 247084 - RNA, 22 nt, Human
uuaauuaauuaguuaagcaugu

SEQ ID NO: 247085 - RNA, 22 nt, Human
gcuggcaguguauuguuagcug

SEQ ID NO: 247086 - RNA, 22 nt, Human
agggagcugggccacacugauc

SEQ ID NO: 247087 - RNA, 22 nt, Human
ugauaacucucaguuucucaug

SEQ ID NO: 247088 - RNA, 21 nt, Human
agcucagcaagauggaggcuc

SEQ ID NO: 247089 - RNA, 20 nt, Human
acuagaaagucacugggggg

SEQ ID NO: 247090 - RNA, 19 nt, Human
gggcccagcauggaggguu

SEQ ID NO: 247091 - RNA, 22 nt, Human
acauuaaaaaauguugcaugaa

SEQ ID NO: 247092 - RNA, 22 nt, Human
cugaaggacuuggugauaguug

SEQ ID NO: 247093 - RNA, 21 nt, Human
auugugaccaucauuuuggaa

SEQ ID NO: 247094 - RNA, 22 nt, Human
augcaguuagguaauagucuca

SEQ ID NO: 247095 - RNA, 22 nt, Human
agggaagaaucacugggauguu

SEQ ID NO: 247096 - RNA, 22 nt, Human
caggccucuauggucagcugag

SEQ ID NO: 247097 - RNA, 22 nt, Human
aaggugucacuguuucuggccu

SEQ ID NO: 247098 - RNA, 22 nt, Human
gcaguggcuaagcucgcaugca

SEQ ID NO: 247099 - RNA, 22 nt, Human
cuucccaggugcucuuagcaug

SEQ ID NO: 247100 - RNA, 22 nt, Human
agguaaacaggagaaaaugaga

SEQ ID NO: 247101 - RNA, 22 nt, Human
acacacagaguuuauacaggca

SEQ ID NO: 247102 - RNA, 22 nt, Human
ugugagacaauugcaucagggc

SEQ ID NO: 247103 - RNA, 22 nt, Human
aucucugcguccccagcaucga

SEQ ID NO: 247104 - RNA, 22 nt, Human
gauuagaagaacuuguuagccu

SEQ ID NO: 247105 - RNA, 22 nt, Human
gggagaagaaugugucaauugu

SEQ ID NO: 247106 - RNA, 22 nt, Human
agaaucuucagucuaauuccua

SEQ ID NO: 247107 - RNA, 22 nt, Human
uauuacagggcuaguuaugagu

SEQ ID NO: 247108 - RNA, 22 nt, Human
ugcacagguaugcaaagcaugu

SEQ ID NO: 247109 - RNA, 22 nt, Human
gcucucagggugauggcauacu

SEQ ID NO: 247110 - RNA, 22 nt, Human
cagaggccucacuuccagccag

SEQ ID NO: 247111 - RNA, 22 nt, Human
aaaaacacaacugucuuucucu

SEQ ID NO: 247112 - RNA, 22 nt, Human
aauguacagcugcugcugaagg

SEQ ID NO: 247113 - RNA, 21 nt, Human
uggcugccuggcucugugguu

SEQ ID NO: 247114 - RNA, 22 nt, Human
cuuauuuuaagucaguuugggu

SEQ ID NO: 247115 - RNA, 22 nt, Human
cauguaaagcauccuucuaggg

SEQ ID NO: 247116 - RNA, 22 nt, Human
ccagaagaggacacagugugga

SEQ ID NO: 247117 - RNA, 22 nt, Human
ucacaagacugagcuugcuuga

SEQ ID NO: 247118 - RNA, 22 nt, Human
acaccaaaguagaauuaaugua

SEQ ID NO: 247119 - RNA, 22 nt, Human
cuccuacauuccaccuuggacu

SEQ ID NO: 247120 - RNA, 22 nt, Human
gcccucugcucagcuccucagc

SEQ ID NO: 247121 - RNA, 22 nt, Human
ucuggagaggggccuagaauuu

SEQ ID NO: 247122 - RNA, 22 nt, Human
aaguucaaucagaugaaaaagc

SEQ ID NO: 247123 - RNA, 22 nt, Human
ucaguaucaggcuggaauuaag

SEQ ID NO: 247124 - RNA, 22 nt, Human
gcugagggaccauguuucagga

SEQ ID NO: 247125 - RNA, 22 nt, Human
ggccaggaagggaagaucagca

SEQ ID NO: 247126 - RNA, 20 nt, Human
uuccaaggucuaugcuucuu

SEQ ID NO: 247127 - RNA, 22 nt, Human
cugccaggccuggggugcuguc

SEQ ID NO: 247128 - RNA, 22 nt, Human
ugaggaugacgauggcaauggc

SEQ ID NO: 247129 - RNA, 22 nt, Human
ugcuggcuguguaccaucucaa

SEQ ID NO: 247130 - RNA, 22 nt, Human
aggacauguaaauggagaggga

SEQ ID NO: 247131 - RNA, 22 nt, Human
aauaacuuaagaaauuucccca

SEQ ID NO: 247132 - RNA, 22 nt, Human
aucuggcugacuuugugggaca

SEQ ID NO: 247133 - RNA, 22 nt, Human
acaguccuagcugcaaagaagu

SEQ ID NO: 247134 - RNA, 22 nt, Human
auaucuguguuucccuuuugcu

SEQ ID NO: 247135 - RNA, 21 nt, Human
cugcaaauaccuaguuaucug

SEQ ID NO: 247136 - RNA, 22 nt, Human
agcugccugugcugggagccca

SEQ ID NO: 247137 - RNA, 22 nt, Human
uuauugagcacauaguaugugg

SEQ ID NO: 247138 - RNA, 22 nt, Human
guuuuucugugagcgguaaagg

SEQ ID NO: 247139 - RNA, 22 nt, Human
acaguuuagaaugccacauagu

SEQ ID NO: 247140 - RNA, 22 nt, Human
caguggcuuaaauaagauuagg

SEQ ID NO: 247141 - RNA, 22 nt, Human
ggcugccugaggcagugagaga

SEQ ID NO: 247142 - RNA, 22 nt, Human
ccuggcagaaagaguuacaccu

SEQ ID NO: 247143 - RNA, 22 nt, Human
uuguguggauaauauuacuuga

SEQ ID NO: 247144 - RNA, 22 nt, Human
agcugggaggcuccucugugac

SEQ ID NO: 247145 - RNA, 17 nt, Human
ccccuaccuccguuuga

SEQ ID NO: 247146 - RNA, 22 nt, Human
acuccugugggcauggcacccc

SEQ ID NO: 247147 - RNA, 22 nt, Human
aacaguuugagcuuugaauuuc

SEQ ID NO: 247148 - RNA, 22 nt, Human
gcagcuuuaaaggaggcucuga

SEQ ID NO: 247149 - RNA, 18 nt, Human
gcucugguuccuucaacc

SEQ ID NO: 247150 - RNA, 19 nt, Human
aaaguguuuucuuuucugu

SEQ ID NO: 247151 - RNA, 22 nt, Human
ugucuucagaauuaagaguaug

SEQ ID NO: 247152 - RNA, 22 nt, Human
ugcagugccucggcagugcagc

SEQ ID NO: 247153 - RNA, 22 nt, Human
cuugucuugcacacgguugcca

SEQ ID NO: 247154 - RNA, 19 nt, Human
gucacauuugucucccagg

SEQ ID NO: 247155 - RNA, 22 nt, Human
uuuagcaucgaaguaaauuuag

SEQ ID NO: 247156 - RNA, 22 nt, Human
guuuccauggcucuguuaaugg

SEQ ID NO: 247157 - RNA, 22 nt, Human
ugcaguucaagguuguacagcu

SEQ ID NO: 247158 - RNA, 22 nt, Human
uugguacauuacaguuugauug

SEQ ID NO: 247159 - RNA, 22 nt, Human
caaaggcucaguaaaucuuugu

SEQ ID NO: 247160 - RNA, 22 nt, Human
aaaagguagauucuccuucuau

SEQ ID NO: 247161 - RNA, 22 nt, Human
aaaaacugcaauuacuuuuguc

SEQ ID NO: 247162 - RNA, 22 nt, Human
uucuggcuucaucugacaagcc

SEQ ID NO: 247163 - RNA, 22 nt, Human
aaugcaaugcagcaccuccuug

SEQ ID NO: 247164 - RNA, 19 nt, Human
ugcccugcccgcagccuug

SEQ ID NO: 247165 - RNA, 22 nt, Human
ugcugaggcagaugucugugac

SEQ ID NO: 247166 - RNA, 22 nt, Human
cuucacugugcuucaagcagcu

SEQ ID NO: 247167 - RNA, 22 nt, Human
ccuuuauacuaaggcauacaau

SEQ ID NO: 247168 - RNA, 22 nt, Human
gggauaggagauugggaguguu

SEQ ID NO: 247169 - RNA, 22 nt, Human
ucuccagaaauggggcugggga

SEQ ID NO: 247170 - RNA, 22 nt, Human
acuuuguucuaauaguaucucu

SEQ ID NO: 247171 - RNA, 22 nt, Human
guuaagaaucaagacuuaucuu

SEQ ID NO: 247172 - RNA, 21 nt, Human
ugagaugcuagaaggcaggga

SEQ ID NO: 247173 - RNA, 22 nt, Human
cuggcccuguaggaugugaguu

SEQ ID NO: 247174 - RNA, 22 nt, Human
gcugcugggauccugggucuca

SEQ ID NO: 247175 - RNA, 22 nt, Human
cagagguagccgagugcaaucg

SEQ ID NO: 247176 - RNA, 22 nt, Human
aggaagccuggggcugcccucg

SEQ ID NO: 247177 - RNA, 22 nt, Human
cuacaucacuuaauucuuagaa

SEQ ID NO: 247178 - RNA, 22 nt, Human
acaggcagguaauuuacauauu

SEQ ID NO: 247179 - RNA, 18 nt, Human
cggcuucugucaccuugc

SEQ ID NO: 247180 - RNA, 22 nt, Human
auuaauuuuaccuuuguaaaca

SEQ ID NO: 247181 - RNA, 22 nt, Human
uauacacacaugcuccggccuu

SEQ ID NO: 247182 - RNA, 22 nt, Human
ccuggaggggaccaggaccagg

SEQ ID NO: 247183 - RNA, 22 nt, Human
cugagcugucaggaauggaaag

SEQ ID NO: 247184 - RNA, 22 nt, Human
agauaaaaugauuuucuggauc

SEQ ID NO: 247185 - RNA, 22 nt, Human
uauauugaccaguacaauuggu

SEQ ID NO: 247186 - RNA, 22 nt, Human
gcuuccucccugcugcucacua

SEQ ID NO: 247187 - RNA, 22 nt, Human
aaaggcuuguacagcagccuuc

SEQ ID NO: 247188 - RNA, 21 nt, Human
agcagacacuugugaccuucc

SEQ ID NO: 247189 - RNA, 22 nt, Human
auguucuauaucauuauuguga

SEQ ID NO: 247190 - RNA, 22 nt, Human
gucaggauuauaauccccaugg

SEQ ID NO: 247191 - RNA, 23 nt, Human
gagagcccauuggcagggguacc

SEQ ID NO: 247192 - RNA, 22 nt, Human
uggcugaggagggucuucuggu

SEQ ID NO: 247193 - RNA, 22 nt, Human
uggccugaggcucggcaugggu

SEQ ID NO: 247194 - RNA, 22 nt, Human
uauuggaagugaacaccaggcu

SEQ ID NO: 247195 - RNA, 23 nt, Human
augaggcauuaaacaggcuuuuu

SEQ ID NO: 247196 - RNA, 22 nt, Human
augguuuuagaaucaggaaaaa

SEQ ID NO: 247197 - RNA, 22 nt, Human
gauauagguucauaguguuaca

SEQ ID NO: 247198 - RNA, 22 nt, Human
aggacacagcucuucaguaaga

SEQ ID NO: 247199 - RNA, 22 nt, Human
ucagacacagaugagacaagga

SEQ ID NO: 247200 - RNA, 22 nt, Human
ccaggcauccauugcuuccucu

SEQ ID NO: 247201 - RNA, 22 nt, Human
aagcuggaacaucuugaggaag

SEQ ID NO: 247202 - RNA, 22 nt, Human
acaguguggggugagauggaac

SEQ ID NO: 247203 - RNA, 22 nt, Human
gaauacauuggaaaucagaaua

SEQ ID NO: 247204 - RNA, 22 nt, Human
cuucuucacacuggucugaagc

SEQ ID NO: 247205 - RNA, 15 nt, Human
gcucuggguauuuga

SEQ ID NO: 247206 - RNA, 22 nt, Human
gucuccuguccugcaggaugga

SEQ ID NO: 247207 - RNA, 22 nt, Human
gcacagagagucccgggugccc

SEQ ID NO: 247208 - RNA, 22 nt, Human
ggucuucucuaugagcuggucu

SEQ ID NO: 247209 - RNA, 22 nt, Human
ccucucagccggacugucaggc

SEQ ID NO: 247210 - RNA, 22 nt, Human
ggccacuguccucuagcccaga

SEQ ID NO: 247211 - RNA, 22 nt, Human
ggagacaguauggcuuguagcu

SEQ ID NO: 247212 - RNA, 22 nt, Human
uccuuggcagcagggagcauga

SEQ ID NO: 247213 - RNA, 22 nt, Human
ucacagaaugucuagcauaauu

SEQ ID NO: 247214 - RNA, 22 nt, Human
ccugucagccccacuucugccu

SEQ ID NO: 247215 - RNA, 22 nt, Human
uucuuuuaauuucugucugcag

SEQ ID NO: 247216 - RNA, 22 nt, Human
agcuggguuucuggcaggcuua

SEQ ID NO: 247217 - RNA, 20 nt, Human
aagagucuuuacugagcuaa

SEQ ID NO: 247218 - RNA, 18 nt, Human
ggccagcuccugaggcag

SEQ ID NO: 247219 - RNA, 22 nt, Human
uggucuaagagccuaacugcug

SEQ ID NO: 247220 - RNA, 20 nt, Human
caauagaauguggagauaag

SEQ ID NO: 247221 - RNA, 22 nt, Human
aaaugcacaauaaaguaaaggc

SEQ ID NO: 247222 - RNA, 22 nt, Human
acaaaacaguguuccugccccu

SEQ ID NO: 247223 - RNA, 22 nt, Human
agagcuggggccagagucaagg

SEQ ID NO: 247224 - RNA, 19 nt, Human
caucuuggaguacuccuuu

SEQ ID NO: 247225 - RNA, 22 nt, Human
ggcaccagggcaagggucuuuc

SEQ ID NO: 247226 - RNA, 22 nt, Human
gccuaauaacuagcuguguaac

SEQ ID NO: 247227 - RNA, 20 nt, Human
acugugugaucuggaaagcu

SEQ ID NO: 247228 - RNA, 22 nt, Human
auugcagauucuucucagggag

SEQ ID NO: 247229 - RNA, 22 nt, Human
ucagaggucccuagcaggagug

SEQ ID NO: 247230 - RNA, 22 nt, Human
ucaccauacauaaauuacauug

SEQ ID NO: 247231 - RNA, 17 nt, Human
guggcugcacacacaug

SEQ ID NO: 247232 - RNA, 22 nt, Human
gucugcucaugcuaccgcgggc

SEQ ID NO: 247233 - RNA, 22 nt, Human
gcagagcugguacuugagccug

SEQ ID NO: 247234 - RNA, 22 nt, Human
ccaggccagcgcuggcuggagg

SEQ ID NO: 247235 - RNA, 19 nt, Human
accaggaacuucccuaggc

SEQ ID NO: 247236 - RNA, 22 nt, Human
aacauuucugagaauaucaguu

SEQ ID NO: 247237 - RNA, 22 nt, Human
ggagccagagcacuggggagcc

SEQ ID NO: 247238 - RNA, 22 nt, Human
cacuaaauguuucaauguggga

SEQ ID NO: 247239 - RNA, 22 nt, Human
caaggcuuagucagagggugcu

SEQ ID NO: 247240 - RNA, 22 nt, Human
uccaggcucagucaagcacuuc

SEQ ID NO: 247241 - RNA, 23 nt, Human
acuagaaaaugacuuucucccug

SEQ ID NO: 247242 - RNA, 22 nt, Human
uuccagaaaacucugccuggua

SEQ ID NO: 247243 - RNA, 22 nt, Human
auccugagguacugcagggccg

SEQ ID NO: 247244 - RNA, 22 nt, Human
ucacagaagggaaagaugccaa

SEQ ID NO: 247245 - RNA, 22 nt, Human
cagaaauuggaauagagaaaua

SEQ ID NO: 247246 - RNA, 22 nt, Human
aggcaggcaaguucauaugagg

SEQ ID NO: 247247 - RNA, 22 nt, Human
acuccaggauguagaaucagag

SEQ ID NO: 247248 - RNA, 22 nt, Human
caggucuguuuccaucagugcu

SEQ ID NO: 247249 - RNA, 23 nt, Human
auccaugugagaauagacuagca

SEQ ID NO: 247250 - RNA, 22 nt, Human
uccccaggggcaucucucugcu

SEQ ID NO: 247251 - RNA, 22 nt, Human
ucccugagcucacauggcagga

SEQ ID NO: 247252 - RNA, 22 nt, Human
aguccaauaaccucuuuccuuc

SEQ ID NO: 247253 - RNA, 22 nt, Human
uauugcuggggugggccauguu

SEQ ID NO: 247254 - RNA, 22 nt, Human
ugcauauacccgcauuuacaua

SEQ ID NO: 247255 - RNA, 22 nt, Human
aaagcugggcuggccaacccag

SEQ ID NO: 247256 - RNA, 22 nt, Human
ucugggagccaugccuuggagu

SEQ ID NO: 247257 - RNA, 22 nt, Human
gccuuagaaaaauaagauuuua

SEQ ID NO: 247258 - RNA, 22 nt, Human
auaucaaagcuaguggaaauuu

SEQ ID NO: 247259 - RNA, 17 nt, Human
agguggguggaucaccu

SEQ ID NO: 247260 - RNA, 22 nt, Human
ccagugucuagucacagguacu

SEQ ID NO: 247261 - RNA, 21 nt, Human
uccugccuuaguccagagcag

SEQ ID NO: 247262 - RNA, 22 nt, Human
uguugauuaguguuuagacuua

SEQ ID NO: 247263 - RNA, 22 nt, Human
cucccuggucuuucccaucauu

SEQ ID NO: 247264 - RNA, 22 nt, Human
agucacaugaggaaggggaagg

SEQ ID NO: 247265 - RNA, 22 nt, Human
ggaaggcuguucacuaacaugu

SEQ ID NO: 247266 - RNA, 22 nt, Human
uguggcagaacugggacucaaa

SEQ ID NO: 247267 - RNA, 22 nt, Human
auucucuguuuccaagaugaaa

SEQ ID NO: 247268 - RNA, 22 nt, Human
cagaggcuaagaugagugggug

SEQ ID NO: 247269 - RNA, 20 nt, Human
uagaaucuggugauguaucg

SEQ ID NO: 247270 - RNA, 22 nt, Human
ccuugaaaccacaucuuagaaa

SEQ ID NO: 247271 - RNA, 22 nt, Human
cauuugcugaggccuucagagg

SEQ ID NO: 247272 - RNA, 22 nt, Human
uggcuucaagucuagguucuac

SEQ ID NO: 247273 - RNA, 22 nt, Human
cagcccucaucucagcuucuuu

SEQ ID NO: 247274 - RNA, 22 nt, Human
auuguacagaugaaccucacuc

SEQ ID NO: 247275 - RNA, 22 nt, Human
ggagccagagggaugcaguuga

SEQ ID NO: 247276 - RNA, 22 nt, Human
ucuguguuuaaaagauaugucc

SEQ ID NO: 247277 - RNA, 21 nt, Human
cucuuuauauaguaaagauau

SEQ ID NO: 247278 - RNA, 22 nt, Human
cuuagagcuuaggcuagccauu

SEQ ID NO: 247279 - RNA, 22 nt, Human
acaguuaauaugugacagaacu

SEQ ID NO: 247280 - RNA, 17 nt, Human
agggucaggugaaguuc

SEQ ID NO: 247281 - RNA, 22 nt, Human
ugaaacaggcaaaacugcagau

SEQ ID NO: 247282 - RNA, 22 nt, Human
gccuagagaaaaagccucugca

SEQ ID NO: 247283 - RNA, 22 nt, Human
accuuagaaaaucaaaauuaga

SEQ ID NO: 247284 - RNA, 22 nt, Human
agcauuuaauccuacauagauc

SEQ ID NO: 247285 - RNA, 22 nt, Human
aauucacauauacauuauuccu

SEQ ID NO: 247286 - RNA, 22 nt, Human
uccugggagcacaugguccugc

SEQ ID NO: 247287 - RNA, 22 nt, Human
gcugccuuaugucuauuaguau

SEQ ID NO: 247288 - RNA, 22 nt, Human
agcagcugucccuuaacaucag

SEQ ID NO: 247289 - RNA, 22 nt, Human
uuucucucugacugggagcuga

SEQ ID NO: 247290 - RNA, 22 nt, Human
uccccagcauugagggucucuc

SEQ ID NO: 247291 - RNA, 22 nt, Human
cacagggaggacaucaacagug

SEQ ID NO: 247292 - RNA, 22 nt, Human
agcuggugcugaagcucuugag

SEQ ID NO: 247293 - RNA, 22 nt, Human
gggagcuccacugccucucauu

SEQ ID NO: 247294 - RNA, 21 nt, Human
uuacaugguuuaucauaugga

SEQ ID NO: 247295 - RNA, 22 nt, Human
uuccuucuauucagcuccaaga

SEQ ID NO: 247296 - RNA, 22 nt, Human
gucuagaauaucuagaaagauc

SEQ ID NO: 247297 - RNA, 22 nt, Human
gaucugagaucuaaaccagagg

SEQ ID NO: 247298 - RNA, 23 nt, Human
guguuacucugauaggugcuuuu

SEQ ID NO: 247299 - RNA, 22 nt, Human
gcaggugguuaaggucccaugu

SEQ ID NO: 247300 - RNA, 22 nt, Human
uacauacacaaauauacuguuu

SEQ ID NO: 247301 - RNA, 22 nt, Human
gcagaauauuauggaaaaagua

SEQ ID NO: 247302 - RNA, 23 nt, Human
gugacccaaggaccuuccagaau

SEQ ID NO: 247303 - RNA, 22 nt, Human
uucuuacauuacuuuacaugug

SEQ ID NO: 247304 - RNA, 22 nt, Human
uauggaaaaauguaucuuguca

SEQ ID NO: 247305 - RNA, 22 nt, Human
gcuuccaguccucagaggcugg

SEQ ID NO: 247306 - RNA, 22 nt, Human
agaguugcuaccaagaugcuag

SEQ ID NO: 247307 - RNA, 22 nt, Human
aaucuggaauauuugcauugua

SEQ ID NO: 247308 - RNA, 22 nt, Human
aaugccaucccucugucaccaa

SEQ ID NO: 247309 - RNA, 22 nt, Human
ggaaggaaauuggggcaguugu

SEQ ID NO: 247310 - RNA, 22 nt, Human
gaaacaauacuuguccucacua

SEQ ID NO: 247311 - RNA, 22 nt, Human
cacccucccgucagccccuggg

SEQ ID NO: 247312 - RNA, 22 nt, Human
auacuucuuuagcauauugaac

SEQ ID NO: 247313 - RNA, 22 nt, Human
uggcauuucuggccauuugugu

SEQ ID NO: 247314 - RNA, 22 nt, Human
aagaguuuccaguuguggcuca

SEQ ID NO: 247315 - RNA, 22 nt, Human
auccauuuuaacuguuagugca

SEQ ID NO: 247316 - RNA, 22 nt, Human
uuauguguguacaugcauaugu

SEQ ID NO: 247317 - RNA, 22 nt, Human
uccucuccagcaaacuggcuau

SEQ ID NO: 247318 - RNA, 22 nt, Human
uuuauugucuucguggugccua

SEQ ID NO: 247319 - RNA, 22 nt, Human
cauucuuauauuuacucauuca

SEQ ID NO: 247320 - RNA, 22 nt, Human
aaucuagagacaauuugaauau

SEQ ID NO: 247321 - RNA, 21 nt, Human
agccugcaauguagguaccgg

SEQ ID NO: 247322 - RNA, 21 nt, Human
cccugggaugggcuuggacuu

SEQ ID NO: 247323 - RNA, 22 nt, Human
aaugcuguaaagaugcuaucug

SEQ ID NO: 247324 - RNA, 22 nt, Human
uccuguguguggccuuucccag

SEQ ID NO: 247325 - RNA, 22 nt, Human
gagcccuguagcaagucauguc

SEQ ID NO: 247326 - RNA, 22 nt, Human
ucucucucagccauuacagaac

SEQ ID NO: 247327 - RNA, 17 nt, Human
uccagagcacagagcuc

SEQ ID NO: 247328 - RNA, 22 nt, Human
uuacaacuugcagaggauguug

SEQ ID NO: 247329 - RNA, 22 nt, Human
uuccuggcugucaugcccuagu

SEQ ID NO: 247330 - RNA, 17 nt, Human
agauggcaggaggcaga

SEQ ID NO: 247331 - RNA, 22 nt, Human
ccugccagacgcaccagggggc

SEQ ID NO: 247332 - RNA, 22 nt, Human
ccagggugagaaaaggcuggau

SEQ ID NO: 247333 - RNA, 22 nt, Human
gguggcucguuuuucuugaaag

SEQ ID NO: 247334 - RNA, 22 nt, Human
aguuuauuuuugauaagucuug

SEQ ID NO: 247335 - RNA, 22 nt, Human
ucuuuggaucucaagguggcag

SEQ ID NO: 247336 - RNA, 22 nt, Human
acagcaaucugagagacauagu

SEQ ID NO: 247337 - RNA, 22 nt, Human
uuccagaaaguucuggaacugg

SEQ ID NO: 247338 - RNA, 20 nt, Human
uccaggcccacucagcugaa

SEQ ID NO: 247339 - RNA, 22 nt, Human
ucuggcagaagugcugucagua

SEQ ID NO: 247340 - RNA, 22 nt, Human
ucacagaacacaaaugccacuu

SEQ ID NO: 247341 - RNA, 22 nt, Human
aucuguuuaauucauuuucaca

SEQ ID NO: 247342 - RNA, 22 nt, Human
agaaucaggaccuguggcuguc

SEQ ID NO: 247343 - RNA, 22 nt, Human
ugaugaaaauguucagcaauua

SEQ ID NO: 247344 - RNA, 22 nt, Human
aaggcagaggaaggucuaguuu

SEQ ID NO: 247345 - RNA, 22 nt, Human
aauuucagaugucauaaauaua

SEQ ID NO: 247346 - RNA, 22 nt, Human
acugccuucugcucaggguuca

SEQ ID NO: 247347 - RNA, 22 nt, Human
guaguucugcagugucaccuga

SEQ ID NO: 247348 - RNA, 22 nt, Human
cacugccuggaaggagagacau

SEQ ID NO: 247349 - RNA, 17 nt, Human
gcacaaaucaauuacua

SEQ ID NO: 247350 - RNA, 22 nt, Human
uuccagagguagcaaugacuug

SEQ ID NO: 247351 - RNA, 22 nt, Human
ucugagcucuaucugugggaau

SEQ ID NO: 247352 - RNA, 22 nt, Human
augucacagcucccauuccucc

SEQ ID NO: 247353 - RNA, 22 nt, Human
uuccaguugguagaauguaagg

SEQ ID NO: 247354 - RNA, 22 nt, Human
agaaauucaauucuaauuagcu

SEQ ID NO: 247355 - RNA, 22 nt, Human
cuguauuaguccauuugagcug

SEQ ID NO: 247356 - RNA, 22 nt, Human
gccgugucaucugcggguggca

SEQ ID NO: 247357 - RNA, 22 nt, Human
ccaggaguuggaagcugccaug

SEQ ID NO: 247358 - RNA, 18 nt, Human
uggcuccugccuccugca

SEQ ID NO: 247359 - RNA, 22 nt, Human
uuaagucacuuaucuaaagaca

SEQ ID NO: 247360 - RNA, 22 nt, Human
aaugcaguuucauuuguagaau

SEQ ID NO: 247361 - RNA, 22 nt, Human
aauuuccagaccccauccacag

SEQ ID NO: 247362 - RNA, 22 nt, Human
gagaggggaccugugugucuag

SEQ ID NO: 247363 - RNA, 22 nt, Human
cagggccagagagggcuggcug

SEQ ID NO: 247364 - RNA, 22 nt, Human
ugcuucucuguucuaacccuug

SEQ ID NO: 247365 - RNA, 22 nt, Human
aaagaugucaguuugaaauaac

SEQ ID NO: 247366 - RNA, 22 nt, Human
ucaggcuuugggaaugccacuu

SEQ ID NO: 247367 - RNA, 23 nt, Human
ugcugcccgcuuggcacgcuccc

SEQ ID NO: 247368 - RNA, 22 nt, Human
ugcucccaaacgaccuacugug

SEQ ID NO: 247369 - RNA, 22 nt, Human
gcagcucacagucuccgccauc

SEQ ID NO: 247370 - RNA, 22 nt, Human
gccugccucaaaaucccaguuc

SEQ ID NO: 247371 - RNA, 22 nt, Human
auuuaguguguauugcuauuau

SEQ ID NO: 247372 - RNA, 22 nt, Human
uccagcccucagccaaguggaa

SEQ ID NO: 247373 - RNA, 22 nt, Human
gcacagcccugagcgcaugucu

SEQ ID NO: 247374 - RNA, 22 nt, Human
ucucugcaucccagggcucagc

SEQ ID NO: 247375 - RNA, 22 nt, Human
gcucucugcagccuccuuggag

SEQ ID NO: 247376 - RNA, 22 nt, Human
guuucuuagguaaauucuuuga

SEQ ID NO: 247377 - RNA, 22 nt, Human
gaugccuggcacccagcaagga

SEQ ID NO: 247378 - RNA, 22 nt, Human
gauucccaugucugaggaggug

SEQ ID NO: 247379 - RNA, 18 nt, Human
ggccagccccaggccagc

SEQ ID NO: 247380 - RNA, 22 nt, Human
uucugaaggucagcagcuuggu

SEQ ID NO: 247381 - RNA, 22 nt, Human
accacaggaggauggcugcugg

SEQ ID NO: 247382 - RNA, 20 nt, Human
uggugagagcaccugauggg

SEQ ID NO: 247383 - RNA, 22 nt, Human
uagcugaagggcauuuaauaaa

SEQ ID NO: 247384 - RNA, 22 nt, Human
augguggagguguauucuggau

SEQ ID NO: 247385 - RNA, 22 nt, Human
aacuuguauauguuauucagag

SEQ ID NO: 247386 - RNA, 22 nt, Human
ucagacagucaucagagcuugu

SEQ ID NO: 247387 - RNA, 22 nt, Human
uuacacuuuugacaaaccugag

SEQ ID NO: 247388 - RNA, 21 nt, Human
aaugaugaaagaugacagagu

SEQ ID NO: 247389 - RNA, 22 nt, Human
cagcugugauuccugcugucca

SEQ ID NO: 247390 - RNA, 19 nt, Human
ccuggaggugaagguucuc

SEQ ID NO: 247391 - RNA, 22 nt, Human
uggcugcaguugggcccucaga

SEQ ID NO: 247392 - RNA, 22 nt, Human
accuguuuguguccauuaguga

SEQ ID NO: 247393 - RNA, 22 nt, Human
uguggcuggucuccgagcgucg

SEQ ID NO: 247394 - RNA, 22 nt, Human
uguagaaagaauauguuucaua

SEQ ID NO: 247395 - RNA, 22 nt, Human
uacagucucuuugagugauugu

SEQ ID NO: 247396 - RNA, 22 nt, Human
cucagccaugggguggaucagc

SEQ ID NO: 247397 - RNA, 22 nt, Human
aggugcaugaugcagagugcag

SEQ ID NO: 247398 - RNA, 22 nt, Human
aguucuaaguaaauauuuuaua

SEQ ID NO: 247399 - RNA, 22 nt, Human
acacaugaguucucaucuugug

SEQ ID NO: 247400 - RNA, 22 nt, Human
ugagaaggaaacaauggcuuuu

SEQ ID NO: 247401 - RNA, 22 nt, Human
aggcagcuggaaaacuccaggc

SEQ ID NO: 247402 - RNA, 22 nt, Human
aaacugaggaguuagacuaggg

SEQ ID NO: 247403 - RNA, 22 nt, Human
cagccagaucaaacucagaugu

SEQ ID NO: 247404 - RNA, 22 nt, Human
aagugauuuagucuuauaaagg

SEQ ID NO: 247405 - RNA, 22 nt, Human
aauagauacuacuuagauguag

SEQ ID NO: 247406 - RNA, 22 nt, Human
ccugggacucggccaggacaga

SEQ ID NO: 247407 - RNA, 17 nt, Human
ugagcuucaaucaggug

SEQ ID NO: 247408 - RNA, 22 nt, Human
gcccuguggauuaaugagcagg

SEQ ID NO: 247409 - RNA, 22 nt, Human
acaaacagcuaacauauguuaa

SEQ ID NO: 247410 - RNA, 22 nt, Human
acugguuugucuauugucauuc

SEQ ID NO: 247411 - RNA, 22 nt, Human
aucuaacuuauguuuuaccaaa

SEQ ID NO: 247412 - RNA, 22 nt, Human
gcuccaggccccagcguuccgc

SEQ ID NO: 247413 - RNA, 22 nt, Human
gagggcugaagauuguggcccc

SEQ ID NO: 247414 - RNA, 22 nt, Human
ugaaauacacaaauuuaguaag

SEQ ID NO: 247415 - RNA, 22 nt, Human
gugacagagcugggauuugaag

SEQ ID NO: 247416 - RNA, 22 nt, Human
ugcagagucacccagauaauua

SEQ ID NO: 247417 - RNA, 22 nt, Human
cuugacuucuucuagaaauaag

SEQ ID NO: 247418 - RNA, 22 nt, Human
aggcaguguauugcuagcggcu

SEQ ID NO: 247419 - RNA, 22 nt, Human
gcucagagagaggcucaccauu

SEQ ID NO: 247420 - RNA, 22 nt, Human
uuggcucccacuaacuccagca

SEQ ID NO: 247421 - RNA, 22 nt, Human
aguggcagcugucaugcccuag

SEQ ID NO: 247422 - RNA, 22 nt, Human
uuuggaauuacuuacucaagcc

SEQ ID NO: 247423 - RNA, 22 nt, Human
gaauauauuucucuuaccuuua

SEQ ID NO: 247424 - RNA, 22 nt, Human
ucugggugagcugccucggguc

SEQ ID NO: 247425 - RNA, 22 nt, Human
gccacuggcgcugugcagagug

SEQ ID NO: 247426 - RNA, 22 nt, Human
uggauaaaugugcagaugacau

SEQ ID NO: 247427 - RNA, 22 nt, Human
aaugacaagacauagucucuga

SEQ ID NO: 247428 - RNA, 22 nt, Human
ugggaccucucuugagagagca

SEQ ID NO: 247429 - RNA, 22 nt, Human
gagggagggccaggucccaacc

SEQ ID NO: 247430 - RNA, 22 nt, Human
uuccagugaaacaugaggugug

SEQ ID NO: 247431 - RNA, 22 nt, Human
cugccaccaugccccagcagag

SEQ ID NO: 247432 - RNA, 18 nt, Human
cccacacagcaguagcuc

SEQ ID NO: 247433 - RNA, 22 nt, Human
gcuuagcacagaaugagaguuc

SEQ ID NO: 247434 - RNA, 22 nt, Human
ucuguucaugaaauaucuuuuu

SEQ ID NO: 247435 - RNA, 22 nt, Human
cccaguggggaaauagcuagcu

SEQ ID NO: 247436 - RNA, 22 nt, Human
uacuguacauuccguuuguugc

SEQ ID NO: 247437 - RNA, 22 nt, Human
gggcaggugcccagggccagag

SEQ ID NO: 247438 - RNA, 22 nt, Human
agagcacggccaccauuuacaa

SEQ ID NO: 247439 - RNA, 22 nt, Human
gcugccugguuucucagcugca

SEQ ID NO: 247440 - RNA, 22 nt, Human
uucagaaaaagaccauugcaau

SEQ ID NO: 247441 - RNA, 22 nt, Human
caaauacuggguaaguuaauuu

SEQ ID NO: 247442 - RNA, 22 nt, Human
acuauacaccaaaauauuaagg

SEQ ID NO: 247443 - RNA, 22 nt, Human
ucagguguucuccacucaguuu

SEQ ID NO: 247444 - RNA, 22 nt, Human
uguguccuaugaaagaggguua

SEQ ID NO: 247445 - RNA, 22 nt, Human
cuggccuaggaaugguuuuccg

SEQ ID NO: 247446 - RNA, 22 nt, Human
agaguuaaggccacugucagua

SEQ ID NO: 247447 - RNA, 22 nt, Human
agaaggcuaaagaaacagauug

SEQ ID NO: 247448 - RNA, 22 nt, Human
guugcugggagcagggauccug

SEQ ID NO: 247449 - RNA, 20 nt, Human
uauuucugggcaaccauuua

SEQ ID NO: 247450 - RNA, 22 nt, Human
caggcuaaagcuuugagcaugu

SEQ ID NO: 247451 - RNA, 22 nt, Human
ggcuccaggguaccccuggaug

SEQ ID NO: 247452 - RNA, 22 nt, Human
auuugaauggcuuaacacaacg

SEQ ID NO: 247453 - RNA, 22 nt, Human
gugcauuaggcuggaauguuga

SEQ ID NO: 247454 - RNA, 22 nt, Human
uuuuacaagcugagucguuaaa

SEQ ID NO: 247455 - RNA, 22 nt, Human
aaagcugguuauucugaggcag

SEQ ID NO: 247456 - RNA, 21 nt, Human
uaaaugugagcagggcugggc

SEQ ID NO: 247457 - RNA, 22 nt, Human
aauaacuucaguucuuacauua

SEQ ID NO: 247458 - RNA, 22 nt, Human
uaugugucuuuaucuggcucuu

SEQ ID NO: 247459 - RNA, 22 nt, Human
uggaagaaugcuccacagggaa

SEQ ID NO: 247460 - RNA, 22 nt, Human
uuccagcacagaaguauacauu

SEQ ID NO: 247461 - RNA, 19 nt, Human
gguguccuagagauaagag

SEQ ID NO: 247462 - RNA, 22 nt, Human
gaaugaaucuguaagugacaag

SEQ ID NO: 247463 - RNA, 22 nt, Human
uuucaaaugcaugucuuuccuc

SEQ ID NO: 247464 - RNA, 22 nt, Human
agacuucacucccagagauucu

SEQ ID NO: 247465 - RNA, 22 nt, Human
cagcacuggggccacuggaguu

SEQ ID NO: 247466 - RNA, 22 nt, Human
cagcccucaucccgccugcguu

SEQ ID NO: 247467 - RNA, 21 nt, Human
aggagcuguguuagcuggucg

SEQ ID NO: 247468 - RNA, 22 nt, Human
uccuggacagauccccaucauc

SEQ ID NO: 247469 - RNA, 22 nt, Human
uggguggagaaguggaccugcu

SEQ ID NO: 247470 - RNA, 20 nt, Human
uuccaacucacaucucuaca

SEQ ID NO: 247471 - RNA, 22 nt, Human
aaguuauaucaucucauugacg

SEQ ID NO: 247472 - RNA, 23 nt, Human
gugucauuacuguaauuauugug

SEQ ID NO: 247473 - RNA, 23 nt, Human
uugcaaaaugagucuugagugaa

SEQ ID NO: 247474 - RNA, 22 nt, Human
agccuugcaugauuucauucau

SEQ ID NO: 247475 - RNA, 22 nt, Human
cucaaggccaguucuucugacu

SEQ ID NO: 247476 - RNA, 22 nt, Human
uuaaugacaucauaggugaagu

SEQ ID NO: 247477 - RNA, 22 nt, Human
cagagccagcaguggggacagg

SEQ ID NO: 247478 - RNA, 22 nt, Human
caggccagcggcccgcgcguuc

SEQ ID NO: 247479 - RNA, 22 nt, Human
cuggaucuucagagaucaccag

SEQ ID NO: 247480 - RNA, 22 nt, Human
aggacauguuuguaucuuccuu

SEQ ID NO: 247481 - RNA, 22 nt, Human
ugggagcaaaugacugggagau

SEQ ID NO: 247482 - RNA, 22 nt, Human
gaaccacaaugugaagaaggag

SEQ ID NO: 247483 - RNA, 22 nt, Human
gaggagagccugcacuuugacc

SEQ ID NO: 247484 - RNA, 22 nt, Human
augauacaagcaaaacuaauca

SEQ ID NO: 247485 - RNA, 22 nt, Human
agagucagaaccaagaugaggc

SEQ ID NO: 247486 - RNA, 22 nt, Human
augcaucuaugacuuagacauu

SEQ ID NO: 247487 - RNA, 22 nt, Human
augcauucauucauucuuucua

SEQ ID NO: 247488 - RNA, 22 nt, Human
agaaacauuuagauuauauguc

SEQ ID NO: 247489 - RNA, 22 nt, Human
aaaauaugacugugcuccuuaa

SEQ ID NO: 247490 - RNA, 22 nt, Human
agaugcugcuccacaggccagg

SEQ ID NO: 247491 - RNA, 22 nt, Human
ggcagcucacugauuagcaauu

SEQ ID NO: 247492 - RNA, 22 nt, Human
ggacccagaggggagucuggca

SEQ ID NO: 247493 - RNA, 22 nt, Human
uuaagauuuguagagaaaaagc

SEQ ID NO: 247494 - RNA, 22 nt, Human
auugaguaccuccagauucaua

SEQ ID NO: 247495 - RNA, 22 nt, Human
gguuuauuaaugugaacuguau

SEQ ID NO: 247496 - RNA, 22 nt, Human
ucuuaaguaccuccuuuaucac

SEQ ID NO: 247497 - RNA, 22 nt, Human
ucacaucuuuaggcuuacaggu

SEQ ID NO: 247498 - RNA, 22 nt, Human
aggggcaguuccaaguuuugug

SEQ ID NO: 247499 - RNA, 23 nt, Human
ugauuacaggaaguucaaguguu

SEQ ID NO: 247500 - RNA, 22 nt, Human
caggcauugccauuccuccaga

SEQ ID NO: 247501 - RNA, 22 nt, Human
caucugcucugucugccauguu

SEQ ID NO: 247502 - RNA, 22 nt, Human
ucuggcucugacacuacuguua

SEQ ID NO: 247503 - RNA, 22 nt, Human
ggucuuuucacagugguuugag

SEQ ID NO: 247504 - RNA, 22 nt, Human
gggcugacaguuuccccugaaa

SEQ ID NO: 247505 - RNA, 22 nt, Human
acagugcuuuuguuccucuccu

SEQ ID NO: 247506 - RNA, 19 nt, Human
gcccuccucacugagcucu

SEQ ID NO: 247507 - RNA, 22 nt, Human
cucugggcccacuuaaaucugg

SEQ ID NO: 247508 - RNA, 22 nt, Human
ggucccaaggaggaugaggcua

SEQ ID NO: 247509 - RNA, 22 nt, Human
gcaggaagaggcucgaagcccc

SEQ ID NO: 247510 - RNA, 23 nt, Human
ugauuuuaaaaaguaaguuauca

SEQ ID NO: 247511 - RNA, 22 nt, Human
acauguguauagccuguauaga

SEQ ID NO: 247512 - RNA, 22 nt, Human
uaaagcuguucagugcagaaag

SEQ ID NO: 247513 - RNA, 22 nt, Human
uagcaggguccaaugugaggca

SEQ ID NO: 247514 - RNA, 22 nt, Human
uaauuauaaacugcaguaggua

SEQ ID NO: 247515 - RNA, 22 nt, Human
ggcucugccauuuccuagcugc

SEQ ID NO: 247516 - RNA, 22 nt, Human
ggcauuugagccauuggccugu

SEQ ID NO: 247517 - RNA, 22 nt, Human
ggucucugcucagaugccacuu

SEQ ID NO: 247518 - RNA, 22 nt, Human
caguuucccugcuugaaaacgu

SEQ ID NO: 247519 - RNA, 22 nt, Human
ucugggaauuuauuggcacuuu

SEQ ID NO: 247520 - RNA, 22 nt, Human
agaaucaacugaaaauugguga

SEQ ID NO: 247521 - RNA, 17 nt, Human
gcuuccucaugcaguuc

SEQ ID NO: 247522 - RNA, 22 nt, Human
aagugaauucauuguguuauau

SEQ ID NO: 247523 - RNA, 22 nt, Human
ucucugggagccaggaugacac

SEQ ID NO: 247524 - RNA, 22 nt, Human
auggaaagugcauggaagucau

SEQ ID NO: 247525 - RNA, 22 nt, Human
gguggcagucuuaagagaucuu

SEQ ID NO: 247526 - RNA, 22 nt, Human
guggucagcagcagugggagug

SEQ ID NO: 247527 - RNA, 22 nt, Human
cauccauagccucaauaaauag

SEQ ID NO: 247528 - RNA, 22 nt, Human
ucaaauggguaugcuuuauaau

SEQ ID NO: 247529 - RNA, 22 nt, Human
acauguaaacauuuacaguauu

SEQ ID NO: 247530 - RNA, 22 nt, Human
cagcagguucuacgggugagau

SEQ ID NO: 247531 - RNA, 22 nt, Human
uuugucaucccuuuugaaacug

SEQ ID NO: 247532 - RNA, 22 nt, Human
auucaaauuaaguuaauucagc

SEQ ID NO: 247533 - RNA, 22 nt, Human
aggcaggccgugucccuccuca

SEQ ID NO: 247534 - RNA, 22 nt, Human
auugagaauccauuugagauga

SEQ ID NO: 247535 - RNA, 22 nt, Human
aaauuucaagcaaaguagcuau

SEQ ID NO: 247536 - RNA, 22 nt, Human
aggaagaaccuaagaaagucuc

SEQ ID NO: 247537 - RNA, 21 nt, Human
ugucuuuaggaccuguuaaau

SEQ ID NO: 247538 - RNA, 22 nt, Human
acugggcuggggcucauucucc

SEQ ID NO: 247539 - RNA, 22 nt, Human
guguacaggaugacuguacuua

SEQ ID NO: 247540 - RNA, 22 nt, Human
cuuggcugucuauaggaaagag

SEQ ID NO: 247541 - RNA, 22 nt, Human
uggccuccccuaacagccucuu

SEQ ID NO: 247542 - RNA, 22 nt, Human
cuugccugccacuacagcugaa

SEQ ID NO: 247543 - RNA, 22 nt, Human
uauuccagugugaucuuuguag

SEQ ID NO: 247544 - RNA, 22 nt, Human
ccugggcaacauagggagaccc

SEQ ID NO: 247545 - RNA, 22 nt, Human
ugaggcaggaauggggaaaagu

SEQ ID NO: 247546 - RNA, 19 nt, Human
aaacucugaaggccacugg

SEQ ID NO: 247547 - RNA, 19 nt, Human
ugcugcaggaugcugcugg

SEQ ID NO: 247548 - RNA, 22 nt, Human
agugggggcuggcucugucugu

SEQ ID NO: 247549 - RNA, 22 nt, Human
caggugagcucuaucuagggag

SEQ ID NO: 247550 - RNA, 19 nt, Human
ccucccacggauuccuucc

SEQ ID NO: 247551 - RNA, 22 nt, Human
uaaaggcaaacucuccaaggau

SEQ ID NO: 247552 - RNA, 22 nt, Human
gguuucaacuuuugugaggaau

SEQ ID NO: 247553 - RNA, 22 nt, Human
acugccuuauaauaugucaaca

SEQ ID NO: 247554 - RNA, 22 nt, Human
agguggggcugggaaagauucc

SEQ ID NO: 247555 - RNA, 22 nt, Human
uccaggcccagacggggugagg

SEQ ID NO: 247556 - RNA, 22 nt, Human
ugcucaggucguucugccccuu

SEQ ID NO: 247557 - RNA, 22 nt, Human
agcugcaagaagaggucccuga

SEQ ID NO: 247558 - RNA, 22 nt, Human
cagaaauggagcccaggaaucu

SEQ ID NO: 247559 - RNA, 22 nt, Human
gcuucauuucucucuguagacc

SEQ ID NO: 247560 - RNA, 22 nt, Human
uccaugaggaccaaauucguag

SEQ ID NO: 247561 - RNA, 22 nt, Human
gauaggaccagguaaccucuaa

SEQ ID NO: 247562 - RNA, 22 nt, Human
gccauugagauugaaguaagca

SEQ ID NO: 247563 - RNA, 22 nt, Human
cuugacucuugcuucccaugga

SEQ ID NO: 247564 - RNA, 20 nt, Human
cagaugggacguggaggagu

SEQ ID NO: 247565 - RNA, 22 nt, Human
cuuugcugccagaacccagcag

SEQ ID NO: 247566 - RNA, 22 nt, Human
gggguggauuccuacaggucca

SEQ ID NO: 247567 - RNA, 22 nt, Human
uugcacucaccacauuucaggu

SEQ ID NO: 247568 - RNA, 22 nt, Human
aaaguacuuacaguaugcuugg

SEQ ID NO: 247569 - RNA, 22 nt, Human
uuggcccuuuaugggaugggca

SEQ ID NO: 247570 - RNA, 22 nt, Human
gcccugagacugagcauggguu

SEQ ID NO: 247571 - RNA, 22 nt, Human
ucccuuggaaaguagccucaca

SEQ ID NO: 247572 - RNA, 22 nt, Human
uguuuuauuucuccaagaggga

SEQ ID NO: 247573 - RNA, 22 nt, Human
uggggagagguaucauugagau

SEQ ID NO: 247574 - RNA, 22 nt, Human
ucccugggaccggcagcucaca

SEQ ID NO: 247575 - RNA, 22 nt, Human
cuucccugguguuagcccaaug

SEQ ID NO: 247576 - RNA, 22 nt, Human
uuggcucagcugggacuguuga

SEQ ID NO: 247577 - RNA, 22 nt, Human
gaggccuggagccgccuaggcg

SEQ ID NO: 247578 - RNA, 22 nt, Human
agcugaagcaacaacaggaugg

SEQ ID NO: 247579 - RNA, 22 nt, Human
accccagggcugccagccuccu

SEQ ID NO: 247580 - RNA, 22 nt, Human
uaguacuacguuuucuacuauc

SEQ ID NO: 247581 - RNA, 22 nt, Human
ggggaccuggccacccauccuu

SEQ ID NO: 247582 - RNA, 22 nt, Human
uaguauaauuguucuggaauca

SEQ ID NO: 247583 - RNA, 22 nt, Human
ucuuuccuagaggcugaugagu

SEQ ID NO: 247584 - RNA, 22 nt, Human
uuguacaaauaggaaccucuga

SEQ ID NO: 247585 - RNA, 22 nt, Human
uccccagaggugaggcagcuuu

SEQ ID NO: 247586 - RNA, 22 nt, Human
cuccagaggaaagcacauagug

SEQ ID NO: 247587 - RNA, 22 nt, Human
agcuucucaaguguuugcgggg

SEQ ID NO: 247588 - RNA, 22 nt, Human
ucucauugaaaugugacugagu

SEQ ID NO: 247589 - RNA, 22 nt, Human
gccaaaggauucuauggagaua

SEQ ID NO: 247590 - RNA, 22 nt, Human
gcagugggccugaggaagggug

SEQ ID NO: 247591 - RNA, 22 nt, Human
aaggcauagucuuuaaguucug

SEQ ID NO: 247592 - RNA, 22 nt, Human
caaagggcggcugucggagggu

SEQ ID NO: 247593 - RNA, 22 nt, Human
ugccuucauccauguuauagug

SEQ ID NO: 247594 - RNA, 22 nt, Human
aagcaaaggcaggagcuuguga

SEQ ID NO: 247595 - RNA, 22 nt, Human
uagaacuuauuuggcauuauuu

SEQ ID NO: 247596 - RNA, 23 nt, Human
uccugugaagccauguuuguugu

SEQ ID NO: 247597 - RNA, 22 nt, Human
acuguauuuuggguguauuuuc

SEQ ID NO: 247598 - RNA, 22 nt, Human
ggcacagauagaucaagugucu

SEQ ID NO: 247599 - RNA, 21 nt, Human
ccugugugugucccuuuaaga

SEQ ID NO: 247600 - RNA, 22 nt, Human
cagcucuuuuuugcagcagcug

SEQ ID NO: 247601 - RNA, 22 nt, Human
ccagaggucuccugcacgggau

SEQ ID NO: 247602 - RNA, 22 nt, Human
cagagaaaaaauccugcucuca

SEQ ID NO: 247603 - RNA, 22 nt, Human
aguccuuugcugaacugucaca

SEQ ID NO: 247604 - RNA, 22 nt, Human
accacccccuuggguguggaag

SEQ ID NO: 247605 - RNA, 22 nt, Human
guuuauaugugugccacucuua

SEQ ID NO: 247606 - RNA, 23 nt, Human
uccuuuaaugcuggaauggcuag

SEQ ID NO: 247607 - RNA, 22 nt, Human
aagucccugugggguggaggcu

SEQ ID NO: 247608 - RNA, 22 nt, Human
agacaaauggaguaugagcaac

SEQ ID NO: 247609 - RNA, 22 nt, Human
aauagcuuaguccugauucugu

SEQ ID NO: 247610 - RNA, 22 nt, Human
uugagggauugcaccagaagag

SEQ ID NO: 247611 - RNA, 22 nt, Human
uaggaagaucaaguuuaucuca

SEQ ID NO: 247612 - RNA, 22 nt, Human
acucuguacuuucuuguugugu

SEQ ID NO: 247613 - RNA, 18 nt, Human
uucuuuaauucaguuuga

SEQ ID NO: 247614 - RNA, 22 nt, Human
acauguguuuuccuacuuauga

SEQ ID NO: 247615 - RNA, 22 nt, Human
ccugccagauccccugagcuga

SEQ ID NO: 247616 - RNA, 22 nt, Human
gggagccacaguagcagcuacu

SEQ ID NO: 247617 - RNA, 20 nt, Human
aauauaauucucugaauuua

SEQ ID NO: 247618 - RNA, 22 nt, Human
cugggcagcacaucaucguauc

SEQ ID NO: 247619 - RNA, 22 nt, Human
ucuacgaagccaccauggagac

SEQ ID NO: 247620 - RNA, 22 nt, Human
ucacagugcaccagugugaagc

SEQ ID NO: 247621 - RNA, 22 nt, Human
uagaacuaagaguuaucauuua

SEQ ID NO: 247622 - RNA, 22 nt, Human
aguuacauauaagaagacagac

SEQ ID NO: 247623 - RNA, 22 nt, Human
aggggcugccuggcuuggcacu

SEQ ID NO: 247624 - RNA, 22 nt, Human
gcuccccagcuuagcccuggcu

SEQ ID NO: 247625 - RNA, 22 nt, Human
agcccuggcagagccagguagu

SEQ ID NO: 247626 - RNA, 22 nt, Human
aauuccaagagcuuccuaagug

SEQ ID NO: 247627 - RNA, 22 nt, Human
uacagugagacuggcucaggga

SEQ ID NO: 247628 - RNA, 22 nt, Human
acagaggaagcauauagcacaa

SEQ ID NO: 247629 - RNA, 22 nt, Human
agaagcuacugggauauuaauu

SEQ ID NO: 247630 - RNA, 22 nt, Human
auguuucaucaguaagguuuug

SEQ ID NO: 247631 - RNA, 21 nt, Human
aaagagcccgcugagagguuc

SEQ ID NO: 247632 - RNA, 22 nt, Human
aggcaugaugugcaguggcaaa

SEQ ID NO: 247633 - RNA, 22 nt, Human
uggagcugccuggcaccuacag

SEQ ID NO: 247634 - RNA, 22 nt, Human
gcucugggccgggcaccagccu

SEQ ID NO: 247635 - RNA, 22 nt, Human
aauccauuaaaaacaagcgcau

SEQ ID NO: 247636 - RNA, 22 nt, Human
agacaugugguauaaucagggg

SEQ ID NO: 247637 - RNA, 22 nt, Human
ucaggcugaccagguuuugcuc

SEQ ID NO: 247638 - RNA, 22 nt, Human
ugcccuguggguaucugauggc

SEQ ID NO: 247639 - RNA, 22 nt, Human
uagaacuugaaugugaaaucag

SEQ ID NO: 247640 - RNA, 16 nt, Human
cagaguguaaacagga

SEQ ID NO: 247641 - RNA, 22 nt, Human
aagauuuauuagaugcuuaccu

SEQ ID NO: 247642 - RNA, 22 nt, Human
guuaggaauuuguuacugugua

SEQ ID NO: 247643 - RNA, 19 nt, Human
uuugacuccucauuuuuau

SEQ ID NO: 247644 - RNA, 20 nt, Human
aggaggcaauguagauaagc

SEQ ID NO: 247645 - RNA, 22 nt, Human
aaaaugaagcaaaggcauucag

SEQ ID NO: 247646 - RNA, 22 nt, Human
gcagaggccuagguggaaggcc

SEQ ID NO: 247647 - RNA, 17 nt, Human
ugaggcaaccaucacua

SEQ ID NO: 247648 - RNA, 22 nt, Human
gguggcagaggugcaucagccc

SEQ ID NO: 247649 - RNA, 22 nt, Human
gaggcagccucaguggaccucg

SEQ ID NO: 247650 - RNA, 22 nt, Human
aagugcugaaugaagacacaaa

SEQ ID NO: 247651 - RNA, 22 nt, Human
aggccucugggucuccucugac

SEQ ID NO: 247652 - RNA, 22 nt, Human
ugcacagaucugguggcaagga

SEQ ID NO: 247653 - RNA, 22 nt, Human
ucucagcaaggaaagaggcagg

SEQ ID NO: 247654 - RNA, 22 nt, Human
gagaguccuuaguuugcaggua

SEQ ID NO: 247655 - RNA, 22 nt, Human
caacagaagguguacuacugaa

SEQ ID NO: 247656 - RNA, 22 nt, Human
cuguccugaaguuuucaugaga

SEQ ID NO: 247657 - RNA, 22 nt, Human
ccacagagcauuagauuucaga

SEQ ID NO: 247658 - RNA, 22 nt, Human
ugaaauucaaaacacauuuguc

SEQ ID NO: 247659 - RNA, 22 nt, Human
aagugaccucaugguuucuccu

SEQ ID NO: 247660 - RNA, 22 nt, Human
aaagcagggaugaggcuagagg

SEQ ID NO: 247661 - RNA, 22 nt, Human
aauggcaaggaaaccguuacca

SEQ ID NO: 247662 - RNA, 22 nt, Human
guagaaaaagcaguaagucuca

SEQ ID NO: 247663 - RNA, 22 nt, Human
aaagcugcuuuaaacaucuaug

SEQ ID NO: 247664 - RNA, 22 nt, Human
cugaaauuauuguuuaaucaaa

SEQ ID NO: 247665 - RNA, 22 nt, Human
uacacuuuucaauguagucugu

SEQ ID NO: 247666 - RNA, 19 nt, Human
ugagacagagaccaguucu

SEQ ID NO: 247667 - RNA, 20 nt, Human
ucucuggcaagaagcugcag

SEQ ID NO: 247668 - RNA, 22 nt, Human
auguuucauuuagauaucaggc

SEQ ID NO: 247669 - RNA, 22 nt, Human
auuugcauuuagaaagaucacu

SEQ ID NO: 247670 - RNA, 21 nt, Human
auuucacacccuccuuuuucu

SEQ ID NO: 247671 - RNA, 22 nt, Human
ggagcugggacccugucaucug

SEQ ID NO: 247672 - RNA, 22 nt, Human
ugagccagguuuuccaucauuc

SEQ ID NO: 247673 - RNA, 22 nt, Human
uuaagacaguguauuuguuuuc

SEQ ID NO: 247674 - RNA, 19 nt, Human
ggguuguguggaagguauc

SEQ ID NO: 247675 - RNA, 22 nt, Human
ucugucugacuaccaugaggca

SEQ ID NO: 247676 - RNA, 22 nt, Human
guauuagguuggugcaaaauug

SEQ ID NO: 247677 - RNA, 22 nt, Human
gagaugguugcaauaguuuaaa

SEQ ID NO: 247678 - RNA, 22 nt, Human
ucaggugugugguggaaggcag

SEQ ID NO: 247679 - RNA, 22 nt, Human
uaacugguccucggauguugug

SEQ ID NO: 247680 - RNA, 22 nt, Human
ccagcuuucauaucaugaggua

SEQ ID NO: 247681 - RNA, 22 nt, Human
ugguccuggggaucugcaguga

SEQ ID NO: 247682 - RNA, 20 nt, Human
uaccaacagcaggaagcaua

SEQ ID NO: 247683 - RNA, 22 nt, Human
aaaccauuagguuuuaucuacu

SEQ ID NO: 247684 - RNA, 22 nt, Human
agggcagugggaaagccugcuc

SEQ ID NO: 247685 - RNA, 22 nt, Human
agcagguggaaaauucuuauca

SEQ ID NO: 247686 - RNA, 22 nt, Human
ucaaagcuuagauaauuucuuu

SEQ ID NO: 247687 - RNA, 22 nt, Human
agaugcagaguuugcuguggac

SEQ ID NO: 247688 - RNA, 22 nt, Human
uuugugaucuccucccucuaga

SEQ ID NO: 247689 - RNA, 22 nt, Human
uagggauguggugagaacugag

SEQ ID NO: 247690 - RNA, 22 nt, Human
cgguccuguacuugaugagaua

SEQ ID NO: 247691 - RNA, 22 nt, Human
ucuagaacuccaguuaggcaau

SEQ ID NO: 247692 - RNA, 22 nt, Human
ucucaagcuaguguuuauagua

SEQ ID NO: 247693 - RNA, 22 nt, Human
aucuucaaggaaaaaauacagu

SEQ ID NO: 247694 - RNA, 22 nt, Human
gggugcagcagagcuccucugu

SEQ ID NO: 247695 - RNA, 22 nt, Human
uuaaacaguguuucaugugggg

SEQ ID NO: 247696 - RNA, 22 nt, Human
agagcagauuucaaauauuggc

SEQ ID NO: 247697 - RNA, 18 nt, Human
gccuuugcacaagcagcu

SEQ ID NO: 247698 - RNA, 22 nt, Human
ucauucauaaaaauuaguuggc

SEQ ID NO: 247699 - RNA, 22 nt, Human
caugcagcggcguuugguuuaa

SEQ ID NO: 247700 - RNA, 22 nt, Human
cugggcugauuuagucacguuu

SEQ ID NO: 247701 - RNA, 22 nt, Human
aaggcuggaguacagugcagug

SEQ ID NO: 247702 - RNA, 22 nt, Human
aaaugagguuaauacagugcuu

SEQ ID NO: 247703 - RNA, 22 nt, Human
uuuaaccugucaauuugcaugc

SEQ ID NO: 247704 - RNA, 21 nt, Human
agcuggcuauaguuagugaug

SEQ ID NO: 247705 - RNA, 22 nt, Human
auuguacaaugccuggaacauu

SEQ ID NO: 247706 - RNA, 17 nt, Human
cugucugcugcuuccuc

SEQ ID NO: 247707 - RNA, 22 nt, Human
uucauuaaguauaaaauguggu

SEQ ID NO: 247708 - RNA, 22 nt, Human
acagagcuucccagccugagca

SEQ ID NO: 247709 - RNA, 22 nt, Human
gaggccagcgcgcagcacuuuu

SEQ ID NO: 247710 - RNA, 22 nt, Human
agagggugggcacgugauggau

SEQ ID NO: 247711 - RNA, 22 nt, Human
gcuuccuuccuuacauuggugg

SEQ ID NO: 247712 - RNA, 18 nt, Human
cccauguugccagucagc

SEQ ID NO: 247713 - RNA, 22 nt, Human
ccuuccagugacuaaggaggaa

SEQ ID NO: 247714 - RNA, 22 nt, Human
gaggcagagaccuucaggaccu

SEQ ID NO: 247715 - RNA, 22 nt, Human
cacccaggcuggagugcauugg

SEQ ID NO: 247716 - RNA, 22 nt, Human
gcaggagccacuucagggaugc

SEQ ID NO: 247717 - RNA, 22 nt, Human
cucuggaaauggccauagucau

SEQ ID NO: 247718 - RNA, 22 nt, Human
gaccucaucugaacauaugcaa

SEQ ID NO: 247719 - RNA, 22 nt, Human
ccaguuuagguacuaggcucua

SEQ ID NO: 247720 - RNA, 22 nt, Human
caggaaugaguucuggugcucu

SEQ ID NO: 247721 - RNA, 22 nt, Human
uguuuuucaaauauugcucugu

SEQ ID NO: 247722 - RNA, 22 nt, Human
auuguauucaguuacaggucuu

SEQ ID NO: 247723 - RNA, 22 nt, Human
ugcacacaggucuaggacaugg

SEQ ID NO: 247724 - RNA, 22 nt, Human
auugagaaugcaaucuacuaug

SEQ ID NO: 247725 - RNA, 22 nt, Human
ggcagugucaaaauaggcagaa

SEQ ID NO: 247726 - RNA, 22 nt, Human
agcaaacuaauugcaguucugg

SEQ ID NO: 247727 - RNA, 22 nt, Human
agcugcagcccuccugcauggc

SEQ ID NO: 247728 - RNA, 20 nt, Human
ugggccucuggugccucugg

SEQ ID NO: 247729 - RNA, 22 nt, Human
cucuggaauggguguuucuaac

SEQ ID NO: 247730 - RNA, 22 nt, Human
ucucugugaauggcgucaccug

SEQ ID NO: 247731 - RNA, 22 nt, Human
uugaauuuagauuguauguuga

SEQ ID NO: 247732 - RNA, 22 nt, Human
cauuuccuuccugcugcuccuc

SEQ ID NO: 247733 - RNA, 22 nt, Human
auggauaaucaugaacuuugag

SEQ ID NO: 247734 - RNA, 22 nt, Human
cucucugguacauagaguuugg

SEQ ID NO: 247735 - RNA, 22 nt, Human
gccaacagcugggugcaugucc

SEQ ID NO: 247736 - RNA, 22 nt, Human
uuauucaccucuauuagacuca

SEQ ID NO: 247737 - RNA, 22 nt, Human
uaggaaacagugcauauauagu

SEQ ID NO: 247738 - RNA, 22 nt, Human
ucuucccagaggaggugccagc

SEQ ID NO: 247739 - RNA, 22 nt, Human
aagaggcgccggguacguggcg

SEQ ID NO: 247740 - RNA, 22 nt, Human
gugcagcugguggagucugggg

SEQ ID NO: 247741 - RNA, 21 nt, Human
aguaguuuagcacaggguuug

SEQ ID NO: 247742 - RNA, 22 nt, Human
cucaggaggaugacugccuugg

SEQ ID NO: 247743 - RNA, 22 nt, Human
uuucuucauucaccuucacccc

SEQ ID NO: 247744 - RNA, 22 nt, Human
ggcugcagggcagcuggugugg

SEQ ID NO: 247745 - RNA, 20 nt, Human
gcauggcuaaucuguacuga

SEQ ID NO: 247746 - RNA, 22 nt, Human
aaacagcuaaguacauucaagg

SEQ ID NO: 247747 - RNA, 22 nt, Human
ucagcaggugccucagauucuu

SEQ ID NO: 247748 - RNA, 22 nt, Human
gggagcuggggcauuuauaccc

SEQ ID NO: 247749 - RNA, 22 nt, Human
ccagggcuccauugcucauccu

SEQ ID NO: 247750 - RNA, 20 nt, Human
ucacucugaugcuagggugg

SEQ ID NO: 247751 - RNA, 23 nt, Human
gggcugcuccaggccaaggcugg

SEQ ID NO: 247752 - RNA, 22 nt, Human
gcaaggauguacugcaauagga

SEQ ID NO: 247753 - RNA, 22 nt, Human
agucaguuucccuggaaagcag

SEQ ID NO: 247754 - RNA, 22 nt, Human
uagaggguuauuaggacagaag

SEQ ID NO: 247755 - RNA, 22 nt, Human
cugcucugagaggcucuuccua

SEQ ID NO: 247756 - RNA, 22 nt, Human
cuggccugccugccgguugucg

SEQ ID NO: 247757 - RNA, 22 nt, Human
gaugcucaucuguccuuugaug

SEQ ID NO: 247758 - RNA, 22 nt, Human
uccugaagaacgaagucaugua

SEQ ID NO: 247759 - RNA, 22 nt, Human
cccagccuuccacccuggacua

SEQ ID NO: 247760 - RNA, 22 nt, Human
ugggcccaagagagucuccaac

SEQ ID NO: 247761 - RNA, 22 nt, Human
uuccucagagggcgcuggggaa

SEQ ID NO: 247762 - RNA, 19 nt, Human
uggggccuccugucccugg

SEQ ID NO: 247763 - RNA, 22 nt, Human
aaagcuggccucucaggcuuua

SEQ ID NO: 247764 - RNA, 22 nt, Human
gacccuggcagauaccgucaca

SEQ ID NO: 247765 - RNA, 22 nt, Human
ugucaacagauacuagagagcu

SEQ ID NO: 247766 - RNA, 22 nt, Human
uccauuauacuucugauucaaa

SEQ ID NO: 247767 - RNA, 23 nt, Human
auagucauguaaaauauuugaag

SEQ ID NO: 247768 - RNA, 22 nt, Human
agacauuuuacauucuuccauu

SEQ ID NO: 247769 - RNA, 22 nt, Human
aagucccuuuaaucagugccuu

SEQ ID NO: 247770 - RNA, 22 nt, Human
aaaaguucccugguuagaaaag

SEQ ID NO: 247771 - RNA, 22 nt, Human
cagccuucaaggcuuagcucag

SEQ ID NO: 247772 - RNA, 22 nt, Human
aagcaggcuugguguggccgcu

SEQ ID NO: 247773 - RNA, 22 nt, Human
gagaggcucugaggacuggggu

SEQ ID NO: 247774 - RNA, 22 nt, Human
ugguuuaccccuguccuauauc

SEQ ID NO: 247775 - RNA, 22 nt, Human
ggaaucagaugaggggcagagc

SEQ ID NO: 247776 - RNA, 22 nt, Human
cccucagggaccacugacuuca

SEQ ID NO: 247777 - RNA, 22 nt, Human
agaggcugaaugaugucaucau

SEQ ID NO: 247778 - RNA, 22 nt, Human
ugagcaguaacagcucacaggg

SEQ ID NO: 247779 - RNA, 22 nt, Human
gggagccacucagcugagaguu

SEQ ID NO: 247780 - RNA, 22 nt, Human
ugcugcagaucagcugaguccu

SEQ ID NO: 247781 - RNA, 22 nt, Human
ugccaggcucaggaugucccug

SEQ ID NO: 247782 - RNA, 22 nt, Human
agcgacagaaaccaaggacaag

SEQ ID NO: 247783 - RNA, 18 nt, Human
ccugugacagaggcauca

SEQ ID NO: 247784 - RNA, 22 nt, Human
cacagguguuuguuauacucag

SEQ ID NO: 247785 - RNA, 22 nt, Human
acacauauaugucgaaguccuc

SEQ ID NO: 247786 - RNA, 21 nt, Human
aaaugcuuuguauauaucugu

SEQ ID NO: 247787 - RNA, 19 nt, Human
agcaguuauaugcauggga

SEQ ID NO: 247788 - RNA, 23 nt, Human
agguggucuuguggaugcugcaa

SEQ ID NO: 247789 - RNA, 22 nt, Human
agcacauuaagugaguucaugu

SEQ ID NO: 247790 - RNA, 22 nt, Human
uggcagugccccuugaccagug

SEQ ID NO: 247791 - RNA, 22 nt, Human
caauuucagguggauagguuuu

SEQ ID NO: 247792 - RNA, 22 nt, Human
uucaaugccuagaacuuagcau

SEQ ID NO: 247793 - RNA, 23 nt, Human
aagaacugcgaauggagaaagua

SEQ ID NO: 247794 - RNA, 21 nt, Human
agcagagugcuuugacuuugu

SEQ ID NO: 247795 - RNA, 22 nt, Human
cagagggacaguaugaugaaag

SEQ ID NO: 247796 - RNA, 22 nt, Human
ccuuagcagggagucuguccag

SEQ ID NO: 247797 - RNA, 22 nt, Human
ucacuuauugcucaucucaugc

SEQ ID NO: 247798 - RNA, 22 nt, Human
ggucuggccuggcauucuaugg

SEQ ID NO: 247799 - RNA, 22 nt, Human
ucuguucagcugccucagggua

SEQ ID NO: 247800 - RNA, 22 nt, Human
acugggccuacccagauuggca

SEQ ID NO: 247801 - RNA, 22 nt, Human
gugacccaggacacuguguauc

SEQ ID NO: 247802 - RNA, 22 nt, Human
gaaagaaucaacuaugucucug

SEQ ID NO: 247803 - RNA, 20 nt, Human
ccuucagaacuuacauagua

SEQ ID NO: 247804 - RNA, 17 nt, Human
uccuggcucugccacug

SEQ ID NO: 247805 - RNA, 22 nt, Human
cacaaggaccucagauggauga

SEQ ID NO: 247806 - RNA, 20 nt, Human
gaacauggcagguggagggg

SEQ ID NO: 247807 - RNA, 22 nt, Human
ucuggaugaaagggcuauauau

SEQ ID NO: 247808 - RNA, 22 nt, Human
ccaaaaaguacauuuaggugug

SEQ ID NO: 247809 - RNA, 22 nt, Human
ucagaggagccaaaguucugag

SEQ ID NO: 247810 - RNA, 22 nt, Human
uguaugcuuguguauaauauaa

SEQ ID NO: 247811 - RNA, 22 nt, Human
cuggcaggaaguuagaugguaa

SEQ ID NO: 247812 - RNA, 22 nt, Human
cuacugaugauguugguugugg

SEQ ID NO: 247813 - RNA, 22 nt, Human
gugcuuccuguauugauuccau

SEQ ID NO: 247814 - RNA, 22 nt, Human
ggagagcaggguccugagauac

SEQ ID NO: 247815 - RNA, 22 nt, Human
gucuuuggauguaagauaaagu

SEQ ID NO: 247816 - RNA, 22 nt, Human
caaagacacgggaaacaacguu

SEQ ID NO: 247817 - RNA, 22 nt, Human
accaggcuuaauccuuugcuau

SEQ ID NO: 247818 - RNA, 22 nt, Human
cacgcuuggcuuauacagagaa

SEQ ID NO: 247819 - RNA, 22 nt, Human
uggagcagaaauuugaagccau

SEQ ID NO: 247820 - RNA, 22 nt, Human
ucuggagaagcccagggagcug

SEQ ID NO: 247821 - RNA, 22 nt, Human
auuugccuuggugauuuguaaa

SEQ ID NO: 247822 - RNA, 22 nt, Human
ucugggaacucugucauuuccc

SEQ ID NO: 247823 - RNA, 22 nt, Human
cagcauggccauuucucgcugc

SEQ ID NO: 247824 - RNA, 22 nt, Human
acagccagcagagcuguuuccu

SEQ ID NO: 247825 - RNA, 22 nt, Human
gcuggccucgcaggcaggaugu

SEQ ID NO: 247826 - RNA, 23 nt, Human
ggaagcucacguaguccugcacu

SEQ ID NO: 247827 - RNA, 22 nt, Human
acuguauuggaaauauagcaaa

SEQ ID NO: 247828 - RNA, 22 nt, Human
cugacccuugcucgggcccugu

SEQ ID NO: 247829 - RNA, 22 nt, Human
ggggcagauggaacagagcaca

SEQ ID NO: 247830 - RNA, 22 nt, Human
uccaggacuauaggaaagacac

SEQ ID NO: 247831 - RNA, 22 nt, Human
acuugguuggucucacccuguu

SEQ ID NO: 247832 - RNA, 22 nt, Human
agcuucuugaccaagccuguaa

SEQ ID NO: 247833 - RNA, 22 nt, Human
ucucuggaguauaaccagggau

SEQ ID NO: 247834 - RNA, 22 nt, Human
cucugggcaaguaugauagaaa

SEQ ID NO: 247835 - RNA, 22 nt, Human
uacaaaugguugaauggaugaa

SEQ ID NO: 247836 - RNA, 18 nt, Human
aaaggcugaauauagaag

SEQ ID NO: 247837 - RNA, 22 nt, Human
uggcagcuggcucugcgcaggc

SEQ ID NO: 247838 - RNA, 22 nt, Human
gcuguucagaugcgauucagga

SEQ ID NO: 247839 - RNA, 22 nt, Human
uagguucucuauugcccccaaa

SEQ ID NO: 247840 - RNA, 22 nt, Human
auguagaggaguuucuggucug

SEQ ID NO: 247841 - RNA, 22 nt, Human
agucccagcuucccccaugcag

SEQ ID NO: 247842 - RNA, 22 nt, Human
aggaggguacaauggguggaaa

SEQ ID NO: 247843 - RNA, 22 nt, Human
ucugccuuucccaggcuacugu

SEQ ID NO: 247844 - RNA, 22 nt, Human
ugccucuguggaaauggugguc

SEQ ID NO: 247845 - RNA, 22 nt, Human
gagugugguaugcucugaggcu

SEQ ID NO: 247846 - RNA, 22 nt, Human
aaguggcuuugagcuucugcca

SEQ ID NO: 247847 - RNA, 22 nt, Human
uugucugaaucuggagcucucu

SEQ ID NO: 247848 - RNA, 22 nt, Human
gcaaaucaccaccuagcuggau

SEQ ID NO: 247849 - RNA, 22 nt, Human
auccuucuaccuaggacuauuu

SEQ ID NO: 247850 - RNA, 22 nt, Human
aacugucuuauuuauauuucug

SEQ ID NO: 247851 - RNA, 22 nt, Human
ucuccagguagauaugucagga

SEQ ID NO: 247852 - RNA, 22 nt, Human
uuuccuuccagguuccuaaggc

SEQ ID NO: 247853 - RNA, 22 nt, Human
uuucuagggcucuugucuucug

SEQ ID NO: 247854 - RNA, 22 nt, Human
cccuuccuugugacuggugggg

SEQ ID NO: 247855 - RNA, 22 nt, Human
agcacugugguggaagcaucaa

SEQ ID NO: 247856 - RNA, 22 nt, Human
ggcaggugcccagagagcacga

SEQ ID NO: 247857 - RNA, 22 nt, Human
agcagacaccaggaguaaagaa

SEQ ID NO: 247858 - RNA, 22 nt, Human
aggcccuggcccccagagauuc

SEQ ID NO: 247859 - RNA, 22 nt, Human
cacgcauguggaucagaugaag

SEQ ID NO: 247860 - RNA, 21 nt, Human
ugcuauuuaauuuuucuguuc

SEQ ID NO: 247861 - RNA, 22 nt, Human
guugcuuuucuccaucacaugg

SEQ ID NO: 247862 - RNA, 22 nt, Human
auuugucuagugguauucacgu

SEQ ID NO: 247863 - RNA, 22 nt, Human
ucugcagggaugugagggguga

SEQ ID NO: 247864 - RNA, 22 nt, Human
caagaggcuaaacugggcuauu

SEQ ID NO: 247865 - RNA, 22 nt, Human
cagggcucuuccggagcaggga

SEQ ID NO: 247866 - RNA, 22 nt, Human
ccuuaaacucugauaugauauu

SEQ ID NO: 247867 - RNA, 22 nt, Human
ggagccagagucugcaguguaa

SEQ ID NO: 247868 - RNA, 22 nt, Human
uggguccacggaagacuuaggg

SEQ ID NO: 247869 - RNA, 22 nt, Human
uggcugagggggcucugcucag

SEQ ID NO: 247870 - RNA, 22 nt, Human
cugaaggcugaggcuguguugu

SEQ ID NO: 247871 - RNA, 22 nt, Human
acagagagaauuggguuuacag

SEQ ID NO: 247872 - RNA, 22 nt, Human
cccaggagacagaaacagaggu

SEQ ID NO: 247873 - RNA, 22 nt, Human
augcaaauaagugcaggcgugg

SEQ ID NO: 247874 - RNA, 22 nt, Human
ugaugacaauguugcugcaaua

SEQ ID NO: 247875 - RNA, 22 nt, Human
agggccugguucuguguaggga

SEQ ID NO: 247876 - RNA, 22 nt, Human
aacugaaaucaaucagugauuc

SEQ ID NO: 247877 - RNA, 22 nt, Human
uuacaaagcgcuuuaccucuga

SEQ ID NO: 247878 - RNA, 22 nt, Human
cuguguccuuuuaguugcugug

SEQ ID NO: 247879 - RNA, 22 nt, Human
gagcuuccugaugccgaccagu

SEQ ID NO: 247880 - RNA, 22 nt, Human
ggacagcccauacacaugucug

SEQ ID NO: 247881 - RNA, 22 nt, Human
ccccacccucgcuccauuucgg

SEQ ID NO: 247882 - RNA, 22 nt, Human
acacuguaugaaaacaggaaau

SEQ ID NO: 247883 - RNA, 22 nt, Human
aagaaauguagagccuaguaaa

SEQ ID NO: 247884 - RNA, 22 nt, Human
uccccaguaagccugcacugug

SEQ ID NO: 247885 - RNA, 22 nt, Human
agcaguccuccaguguguuuua

SEQ ID NO: 247886 - RNA, 22 nt, Human
agucaguucauggcucuguccu

SEQ ID NO: 247887 - RNA, 22 nt, Human
ucuggcucacuucaggcuucac

SEQ ID NO: 247888 - RNA, 22 nt, Human
ucuggcagagucagugcacaca

SEQ ID NO: 247889 - RNA, 17 nt, Human
gaaaguuucucucucuu

SEQ ID NO: 247890 - RNA, 22 nt, Human
ucucuggggccuuucuacauca

SEQ ID NO: 247891 - RNA, 22 nt, Human
uuuagguucuuggaaucagucu

SEQ ID NO: 247892 - RNA, 22 nt, Human
uucuacagaauaaauguuuaca

SEQ ID NO: 247893 - RNA, 22 nt, Human
uccuggagauaauugcagugaa

SEQ ID NO: 247894 - RNA, 22 nt, Human
ccagugcccagcugcccaggca

SEQ ID NO: 247895 - RNA, 22 nt, Human
cugaggagaccaucaacuaauu

SEQ ID NO: 247896 - RNA, 22 nt, Human
gccugggagaugcguuguggcc

SEQ ID NO: 247897 - RNA, 22 nt, Human
auucucuguacagaagguaccg

SEQ ID NO: 247898 - RNA, 22 nt, Human
cccagaggcugaguugggagca

SEQ ID NO: 247899 - RNA, 22 nt, Human
gcaguguuuguguucucacaug

SEQ ID NO: 247900 - RNA, 22 nt, Human
aggcugcucaccucccugucug

SEQ ID NO: 247901 - RNA, 22 nt, Human
agaccuggaaguucaagagaaa

SEQ ID NO: 247902 - RNA, 22 nt, Human
ucaggcucaggaauguguuuau

SEQ ID NO: 247903 - RNA, 22 nt, Human
ccaggagaugggaaaguagcag

SEQ ID NO: 247904 - RNA, 22 nt, Human
uuauauauauguagaggucacg

SEQ ID NO: 247905 - RNA, 22 nt, Human
agucuagaaacaagguagagcu

SEQ ID NO: 247906 - RNA, 22 nt, Human
ccaggcuuuuagcugcauggca

SEQ ID NO: 247907 - RNA, 22 nt, Human
ucucccucauuccugcuuccau

SEQ ID NO: 247908 - RNA, 22 nt, Human
guccuucuuuucaucccugguu

SEQ ID NO: 247909 - RNA, 22 nt, Human
uucucaguauuacaugcuaaug

SEQ ID NO: 247910 - RNA, 22 nt, Human
agugcuuugagcguuugaaaag

SEQ ID NO: 247911 - RNA, 22 nt, Human
cugcugucgccacggucgccgc

SEQ ID NO: 247912 - RNA, 22 nt, Human
agcuuucguuccuuagacacau

SEQ ID NO: 247913 - RNA, 22 nt, Human
uucuguggaauaugaacuagca

SEQ ID NO: 247914 - RNA, 22 nt, Human
ccaggcucaccuggagccccug

SEQ ID NO: 247915 - RNA, 20 nt, Human
ugcucuggggguggagagac

SEQ ID NO: 247916 - RNA, 22 nt, Human
gucucugucauuucaccuuccc

SEQ ID NO: 247917 - RNA, 22 nt, Human
cauaacuugcuuuggagcccgg

SEQ ID NO: 247918 - RNA, 22 nt, Human
uaggaacaacugcagguacaag

SEQ ID NO: 247919 - RNA, 22 nt, Human
cuggugcacguggcugcagucg

SEQ ID NO: 247920 - RNA, 22 nt, Human
ugagcccugaggaucuguucgg

SEQ ID NO: 247921 - RNA, 23 nt, Human
cugagcacagcucugugggccuc

SEQ ID NO: 247922 - RNA, 22 nt, Human
uaugccuggaaccuuucucuuu

SEQ ID NO: 247923 - RNA, 22 nt, Human
uagcacaagaaguacacauaga

SEQ ID NO: 247924 - RNA, 22 nt, Human
aacuaaaacugguuuguucucu

SEQ ID NO: 247925 - RNA, 22 nt, Human
agugugcuauugcaccaucaua

SEQ ID NO: 247926 - RNA, 20 nt, Human
caggagggacauuucagcau

SEQ ID NO: 247927 - RNA, 19 nt, Human
aguccaugaauggaggaug

SEQ ID NO: 247928 - RNA, 22 nt, Human
uguuucaaagaaagaaaauaua

SEQ ID NO: 247929 - RNA, 22 nt, Human
aaggcagauauaaagacuagag

SEQ ID NO: 247930 - RNA, 22 nt, Human
caguucugagcuuucccagaag

SEQ ID NO: 247931 - RNA, 23 nt, Human
uuuauuuauuuaggcugagggau

SEQ ID NO: 247932 - RNA, 22 nt, Human
cagagucaguauugaauugaaa

SEQ ID NO: 247933 - RNA, 22 nt, Human
agacugaaauagugcacaccaa

SEQ ID NO: 247934 - RNA, 22 nt, Human
acuguucacccagcacuagcag

SEQ ID NO: 247935 - RNA, 22 nt, Human
aauauuuuaggcuuuccaggcu

SEQ ID NO: 247936 - RNA, 22 nt, Human
gaauucugguuuugaaaugaau

SEQ ID NO: 247937 - RNA, 22 nt, Human
gucauuuuuuucguaauagugg

SEQ ID NO: 247938 - RNA, 22 nt, Human
acuucuaugcacagagcuugga

SEQ ID NO: 247939 - RNA, 22 nt, Human
cucuguggcuugccuuucuguc

SEQ ID NO: 247940 - RNA, 22 nt, Human
acauggcucagucucaugacag

SEQ ID NO: 247941 - RNA, 22 nt, Human
uaggcuguaagagagggcagag

SEQ ID NO: 247942 - RNA, 22 nt, Human
aggaagccugcaggugacugcu

SEQ ID NO: 247943 - RNA, 22 nt, Human
uuucccaaguguaaacauggca

SEQ ID NO: 247944 - RNA, 23 nt, Human
aaaugacauaugguuucugaagg

SEQ ID NO: 247945 - RNA, 22 nt, Human
cuuuggaacacaugggcauggu

SEQ ID NO: 247946 - RNA, 22 nt, Human
cucugggcuucaagucagauuu

SEQ ID NO: 247947 - RNA, 22 nt, Human
aggccucauaguagaccugccc

SEQ ID NO: 247948 - RNA, 22 nt, Human
aaagcagagcagggcacuuaug

SEQ ID NO: 247949 - RNA, 22 nt, Human
aagcuauugaauuuauagcaua

SEQ ID NO: 247950 - RNA, 22 nt, Human
gcacugaaauuauaugcauuug

SEQ ID NO: 247951 - RNA, 22 nt, Human
caggcugcccuagcuuggacau

SEQ ID NO: 247952 - RNA, 20 nt, Human
agggccuggaguacagcagg

SEQ ID NO: 247953 - RNA, 22 nt, Human
acaaauagagauucaaauaaag

SEQ ID NO: 247954 - RNA, 21 nt, Human
ugcaauuuagacuugaacauu

SEQ ID NO: 247955 - RNA, 21 nt, Human
gcucuguacguuggugccuuc

SEQ ID NO: 247956 - RNA, 22 nt, Human
ugggacagagugagcuuuggcc

SEQ ID NO: 247957 - RNA, 22 nt, Human
ucugagcuguaaguagacaagg

SEQ ID NO: 247958 - RNA, 22 nt, Human
ugcauaaagugccauaguauua

SEQ ID NO: 247959 - RNA, 22 nt, Human
gggcagguggcaaagccagagg

SEQ ID NO: 247960 - RNA, 22 nt, Human
gaaaaggccacuccuaggagcu

SEQ ID NO: 247961 - RNA, 22 nt, Human
ggcuccuguccccucagcugcu

SEQ ID NO: 247962 - RNA, 22 nt, Human
gccugggagggcagcagugugg

SEQ ID NO: 247963 - RNA, 22 nt, Human
uucaugaacgaacauauguaua

SEQ ID NO: 247964 - RNA, 22 nt, Human
aagcugcaaggaagugugccag

SEQ ID NO: 247965 - RNA, 21 nt, Human
gggaggaagcugcuucucucu

SEQ ID NO: 247966 - RNA, 22 nt, Human
gagacagagagguacucaacau

SEQ ID NO: 247967 - RNA, 22 nt, Human
caaaugaauauuuccauggguu

SEQ ID NO: 247968 - RNA, 22 nt, Human
aagggagaaagaaugaguuuag

SEQ ID NO: 247969 - RNA, 22 nt, Human
uaugaauucucuuguguauagu

SEQ ID NO: 247970 - RNA, 22 nt, Human
uccaucuggguggggagaagga

SEQ ID NO: 247971 - RNA, 22 nt, Human
ucacucugaaugguacugagga

SEQ ID NO: 247972 - RNA, 22 nt, Human
uugaaagacuucuccugugaaa

SEQ ID NO: 247973 - RNA, 22 nt, Human
ucuccuccagaggcugugggga

SEQ ID NO: 247974 - RNA, 22 nt, Human
uggggcuaaacacgccuggccu

SEQ ID NO: 247975 - RNA, 22 nt, Human
gagcaagacucacugcaucuug

SEQ ID NO: 247976 - RNA, 22 nt, Human
caggcacacauccgugagagau

SEQ ID NO: 247977 - RNA, 22 nt, Human
gaaggaggucugcauucuacag

SEQ ID NO: 247978 - RNA, 22 nt, Human
gcaaggcugugcacuuugcauu

SEQ ID NO: 247979 - RNA, 22 nt, Human
ugcacacacucugcauauacuu

SEQ ID NO: 247980 - RNA, 20 nt, Human
ugugagcagaugcugaguga

SEQ ID NO: 247981 - RNA, 22 nt, Human
cccucucagucagagccagaua

SEQ ID NO: 247982 - RNA, 22 nt, Human
gcgggccaccuuggagagcgcu

SEQ ID NO: 247983 - RNA, 22 nt, Human
auacuacauuugaaaauugcag

SEQ ID NO: 247984 - RNA, 22 nt, Human
cacuuagucucaccaguucagu

SEQ ID NO: 247985 - RNA, 22 nt, Human
aucagucuguguuagaaaagag

SEQ ID NO: 247986 - RNA, 22 nt, Human
gaggcucagagagguccacaua

SEQ ID NO: 247987 - RNA, 16 nt, Human
ugcagagagcauggug

SEQ ID NO: 247988 - RNA, 23 nt, Human
aaacuacauuuauaguuuuucuc

SEQ ID NO: 247989 - RNA, 22 nt, Human
cagagcccuaguccugauggcc

SEQ ID NO: 247990 - RNA, 22 nt, Human
aucaccaggcaaaaugucagag

SEQ ID NO: 247991 - RNA, 22 nt, Human
augcauugucugguuucauuuu

SEQ ID NO: 247992 - RNA, 22 nt, Human
aaaugcaaggcacauuccuuuu

SEQ ID NO: 247993 - RNA, 22 nt, Human
gggcugagauuggugcccuguc

SEQ ID NO: 247994 - RNA, 22 nt, Human
agaagcagcuuucaaggugauu

SEQ ID NO: 247995 - RNA, 22 nt, Human
gcucaggauuucauccaugugu

SEQ ID NO: 247996 - RNA, 20 nt, Human
guuuuucuugggcgagcuau

SEQ ID NO: 247997 - RNA, 22 nt, Human
cccagcuugucugauucagccu

SEQ ID NO: 247998 - RNA, 22 nt, Human
cuuuggaagugaccacaauccu

SEQ ID NO: 247999 - RNA, 22 nt, Human
guucccaggcccugggcucucc

SEQ ID NO: 248000 - RNA, 22 nt, Human
ugauaggcuuaauuuuccuguc

SEQ ID NO: 248001 - RNA, 22 nt, Human
auucaagaggaacaaugaagau

SEQ ID NO: 248002 - RNA, 22 nt, Human
gacauaaaguucuugcuugaau

SEQ ID NO: 248003 - RNA, 22 nt, Human
uccaggaaaaggcuugcagggg

SEQ ID NO: 248004 - RNA, 22 nt, Human
caaggcugugcaggguccauau

SEQ ID NO: 248005 - RNA, 22 nt, Human
augggcucuaugucuaggagau

SEQ ID NO: 248006 - RNA, 22 nt, Human
aagugaguucagcauucacucg

SEQ ID NO: 248007 - RNA, 22 nt, Human
ugcuggcuuuagugauuggggu

SEQ ID NO: 248008 - RNA, 22 nt, Human
ggcuuggaaauugcaggacaca

SEQ ID NO: 248009 - RNA, 22 nt, Human
auacaugugugagcgaagaugu

SEQ ID NO: 248010 - RNA, 22 nt, Human
cagucacuggaauagcugagga

SEQ ID NO: 248011 - RNA, 17 nt, Human
uuucaucugggaccacc

SEQ ID NO: 248012 - RNA, 22 nt, Human
aauuuagaauucgcuagcuaau

SEQ ID NO: 248013 - RNA, 18 nt, Human
uccugggaacuugcuagc

SEQ ID NO: 248014 - RNA, 22 nt, Human
cagaggcagccgggggagaacg

SEQ ID NO: 248015 - RNA, 22 nt, Human
cagaggcagugggguugcuccu

SEQ ID NO: 248016 - RNA, 22 nt, Human
acuuccuguauuuauccauagc

SEQ ID NO: 248017 - RNA, 22 nt, Human
acugguggcuuucagacagaaa

SEQ ID NO: 248018 - RNA, 22 nt, Human
acagcaaaggacgaacacucug

SEQ ID NO: 248019 - RNA, 22 nt, Human
ucuuagauguuagcucugugug

SEQ ID NO: 248020 - RNA, 22 nt, Human
uaagaaacauuuuuaugacagu

SEQ ID NO: 248021 - RNA, 22 nt, Human
ugcuuuauucgacaucugguag

SEQ ID NO: 248022 - RNA, 22 nt, Human
gcacagagacaguccugagauc

SEQ ID NO: 248023 - RNA, 22 nt, Human
ucuggagccacaaaccucagcu

SEQ ID NO: 248024 - RNA, 22 nt, Human
acucacagucccuguaggagug

SEQ ID NO: 248025 - RNA, 22 nt, Human
uuaggaauuuaucacagacugg

SEQ ID NO: 248026 - RNA, 19 nt, Human
acccaggguugauguccag

SEQ ID NO: 248027 - RNA, 22 nt, Human
cagggagaggccucuguugccc

SEQ ID NO: 248028 - RNA, 22 nt, Human
uacagauauuguacaguuauag

SEQ ID NO: 248029 - RNA, 21 nt, Human
agagcucaaggcaaaaauaau

SEQ ID NO: 248030 - RNA, 22 nt, Human
ccugugucuuugccucaggguc

SEQ ID NO: 248031 - RNA, 22 nt, Human
cagaaauucccauuucagauuc

SEQ ID NO: 248032 - RNA, 22 nt, Human
aauuagggagagguagcuaggu

SEQ ID NO: 248033 - RNA, 22 nt, Human
aaaaguauaggguuuggaguca

SEQ ID NO: 248034 - RNA, 22 nt, Human
ucaaagcacacuuagugguaga

SEQ ID NO: 248035 - RNA, 22 nt, Human
ggcuggcuugcggagucacaga

SEQ ID NO: 248036 - RNA, 21 nt, Human
agcugcaggccucccagggau

SEQ ID NO: 248037 - RNA, 22 nt, Human
uccugagcacagagacaaggaa

SEQ ID NO: 248038 - RNA, 22 nt, Human
caggugguugagagcuguaggc

SEQ ID NO: 248039 - RNA, 22 nt, Human
uuccaugcaagaaguauggcuc

SEQ ID NO: 248040 - RNA, 20 nt, Human
uggaguuguucugcuagguc

SEQ ID NO: 248041 - RNA, 22 nt, Human
cagcuccugaggacugcuggga

SEQ ID NO: 248042 - RNA, 22 nt, Human
auuuuagauuuaagaauaaggu

SEQ ID NO: 248043 - RNA, 22 nt, Human
gcuucuauuauuuggagcugag

SEQ ID NO: 248044 - RNA, 22 nt, Human
gcagagccugugucugagcaaa

SEQ ID NO: 248045 - RNA, 22 nt, Human
agcuucugcccguguuugcucu

SEQ ID NO: 248046 - RNA, 22 nt, Human
guuuccugacccuggcccagca

SEQ ID NO: 248047 - RNA, 18 nt, Human
uguagcuggaggccaggc

SEQ ID NO: 248048 - RNA, 22 nt, Human
uuacaguaugaucaacuuuuca

SEQ ID NO: 248049 - RNA, 22 nt, Human
ccuguaaauaguuucuucugac

SEQ ID NO: 248050 - RNA, 21 nt, Human
ccaggacuccauggggucucu

SEQ ID NO: 248051 - RNA, 22 nt, Human
uucuccagacaacagaggguga

SEQ ID NO: 248052 - RNA, 22 nt, Human
acagugcugaucuagacugacc

SEQ ID NO: 248053 - RNA, 22 nt, Human
guuuuucucugaaauaguugac

SEQ ID NO: 248054 - RNA, 22 nt, Human
aagucagaaaacagagcaauua

SEQ ID NO: 248055 - RNA, 22 nt, Human
ccuggcugaggggccaaggacc

SEQ ID NO: 248056 - RNA, 22 nt, Human
cgcaggcugcagccaagaagag

SEQ ID NO: 248057 - RNA, 22 nt, Human
uuucucagucacaugaaccaau

SEQ ID NO: 248058 - RNA, 22 nt, Human
ggcuucuuccugugaacauguu

SEQ ID NO: 248059 - RNA, 22 nt, Human
ugcuuucuccugucugaaagau

SEQ ID NO: 248060 - RNA, 22 nt, Human
ccuuccuuucagggcuaugccu

SEQ ID NO: 248061 - RNA, 22 nt, Human
ugguuccaagauggcugccaca

SEQ ID NO: 248062 - RNA, 17 nt, Human
ugaacuuuagguggagc

SEQ ID NO: 248063 - RNA, 22 nt, Human
ggcugcaggcuucccuccagca

SEQ ID NO: 248064 - RNA, 22 nt, Human
uggaaacuuggaacgucuucag

SEQ ID NO: 248065 - RNA, 22 nt, Human
agaguguggaacuugaggagcu

SEQ ID NO: 248066 - RNA, 22 nt, Human
ucaugcuaguuaagaacacaau

SEQ ID NO: 248067 - RNA, 22 nt, Human
uggagaaggggcagggucucca

SEQ ID NO: 248068 - RNA, 22 nt, Human
acaucuuuuacucugguucggg

SEQ ID NO: 248069 - RNA, 22 nt, Human
agccagagggaucuuucuaaga

SEQ ID NO: 248070 - RNA, 22 nt, Human
augugucugguuauugacaugc

SEQ ID NO: 248071 - RNA, 22 nt, Human
auugcuuuugagcuagaauuuu

SEQ ID NO: 248072 - RNA, 22 nt, Human
uggggaaaggaaaguuaaccug

SEQ ID NO: 248073 - RNA, 22 nt, Human
ccucaggcagugguauggaugg

SEQ ID NO: 248074 - RNA, 22 nt, Human
agagcggggauaguuaauauuc

SEQ ID NO: 248075 - RNA, 22 nt, Human
agggccucugagccaguucugg

SEQ ID NO: 248076 - RNA, 22 nt, Human
uugccaugcagccaggaaggag

SEQ ID NO: 248077 - RNA, 22 nt, Human
augcagaagcagaacuuacaca

SEQ ID NO: 248078 - RNA, 22 nt, Human
cugaauaauuuucuguuguaug

SEQ ID NO: 248079 - RNA, 15 nt, Human
cuccaugauuuugca

SEQ ID NO: 248080 - RNA, 22 nt, Human
aggaaaggauuggcuucucugu

SEQ ID NO: 248081 - RNA, 22 nt, Human
uucuagacaaauguguucauuc

SEQ ID NO: 248082 - RNA, 22 nt, Human
ccauuuggaggucauuaggaca

SEQ ID NO: 248083 - RNA, 19 nt, Human
ucacuucuguuagcaugga

SEQ ID NO: 248084 - RNA, 19 nt, Human
ggccugaggccacagaucc

SEQ ID NO: 248085 - RNA, 22 nt, Human
aguuauuacucuuuaacauauu

SEQ ID NO: 248086 - RNA, 22 nt, Human
ggcaggcacugugauagauucu

SEQ ID NO: 248087 - RNA, 22 nt, Human
ucugaaucacagucauucagcu

SEQ ID NO: 248088 - RNA, 22 nt, Human
ucagagaguuagugucuuagcu

SEQ ID NO: 248089 - RNA, 23 nt, Human
ucaucaaacagcugcucaagaaa

SEQ ID NO: 248090 - RNA, 22 nt, Human
aaagccaggcagccaagccagu

SEQ ID NO: 248091 - RNA, 22 nt, Human
uagcugaauauaggcacaacag

SEQ ID NO: 248092 - RNA, 22 nt, Human
cuggcugcauuggcaagucaau

SEQ ID NO: 248093 - RNA, 22 nt, Human
ucagaaauguaagcugaugacu

SEQ ID NO: 248094 - RNA, 22 nt, Human
auuguuaugaaaauaagauguu

SEQ ID NO: 248095 - RNA, 22 nt, Human
guucuucagauuccauuucagu

SEQ ID NO: 248096 - RNA, 22 nt, Human
gucauuccuuauguugauucag

SEQ ID NO: 248097 - RNA, 22 nt, Human
acuguaaauuuugguugcaggu

SEQ ID NO: 248098 - RNA, 22 nt, Human
aaaaugaacagaacaaugggga

SEQ ID NO: 248099 - RNA, 22 nt, Human
uuuuuagaguguuaccaguaua

SEQ ID NO: 248100 - RNA, 22 nt, Human
uagaaucuccagcauugguugu

SEQ ID NO: 248101 - RNA, 22 nt, Human
cuggaucugucuuuuggauccc

SEQ ID NO: 248102 - RNA, 22 nt, Human
ugcugggcuaggguggagcucu

SEQ ID NO: 248103 - RNA, 22 nt, Human
ugaggcaaaaguuaugugguag

SEQ ID NO: 248104 - RNA, 22 nt, Human
cugccuggacagcucuuaccuu

SEQ ID NO: 248105 - RNA, 22 nt, Human
aagagccaggacagauccagcu

SEQ ID NO: 248106 - RNA, 22 nt, Human
aguaaucaauuuuucgguggau

SEQ ID NO: 248107 - RNA, 22 nt, Human
cagcugcugcccuuggcugcag

SEQ ID NO: 248108 - RNA, 22 nt, Human
cugggccacaagccugugugau

SEQ ID NO: 248109 - RNA, 22 nt, Human
uuagagccccagaaaacagugg

SEQ ID NO: 248110 - RNA, 22 nt, Human
aguggcagacagagacaguacc

SEQ ID NO: 248111 - RNA, 22 nt, Human
uacauagugaacauuuacagag

SEQ ID NO: 248112 - RNA, 18 nt, Human
aagaggaggagcagguug

SEQ ID NO: 248113 - RNA, 22 nt, Human
uucaguaaaacacugcaauguc

SEQ ID NO: 248114 - RNA, 22 nt, Human
aaaaggcucuucaaaauggaag

SEQ ID NO: 248115 - RNA, 22 nt, Human
gccacaggaaagcacccuggag

SEQ ID NO: 248116 - RNA, 22 nt, Human
cccaggcacucuuggucauuuu

SEQ ID NO: 248117 - RNA, 22 nt, Human
gggagagguuacccgagcaacu

SEQ ID NO: 248118 - RNA, 22 nt, Human
gagguggcccuugcucagccuu

SEQ ID NO: 248119 - RNA, 22 nt, Human
gccugcagcaugcuaggucuug

SEQ ID NO: 248120 - RNA, 22 nt, Human
ccccagcagcaccuggggcagu

SEQ ID NO: 248121 - RNA, 22 nt, Human
aagguacaaaguauuauuuaaa

SEQ ID NO: 248122 - RNA, 22 nt, Human
agcccugcauagaagggaacac

SEQ ID NO: 248123 - RNA, 22 nt, Human
ugcaggugugguuccucagcca

SEQ ID NO: 248124 - RNA, 22 nt, Human
cacaugcucauuggcacuguuc

SEQ ID NO: 248125 - RNA, 22 nt, Human
ucucuggcuggcaccccaggga

SEQ ID NO: 248126 - RNA, 22 nt, Human
augcuguagaucuuagccucua

SEQ ID NO: 248127 - RNA, 22 nt, Human
guggccagccagggugcugaug

SEQ ID NO: 248128 - RNA, 22 nt, Human
acaguacauaauccugagucug

SEQ ID NO: 248129 - RNA, 22 nt, Human
gggagccagccauccagaaccu

SEQ ID NO: 248130 - RNA, 22 nt, Human
aagcccuggcggguggagggcc

SEQ ID NO: 248131 - RNA, 22 nt, Human
auggucaguugcagcuaauguu

SEQ ID NO: 248132 - RNA, 22 nt, Human
aagcuuagguacagaaguuaag

SEQ ID NO: 248133 - RNA, 22 nt, Human
gccagcugucuaagagaguaaa

SEQ ID NO: 248134 - RNA, 22 nt, Human
aggguggggugcuacaucuuua

SEQ ID NO: 248135 - RNA, 22 nt, Human
augaggcauauccuccuauggu

SEQ ID NO: 248136 - RNA, 22 nt, Human
gagcccucauugaaucugcauu

SEQ ID NO: 248137 - RNA, 22 nt, Human
agaaaccucacagcaauucuga

SEQ ID NO: 248138 - RNA, 22 nt, Human
ggacagagcagacgagcagcgg

SEQ ID NO: 248139 - RNA, 22 nt, Human
aacagcagcaugacagcugggu

SEQ ID NO: 248140 - RNA, 22 nt, Human
uuuguucuugcaacaguuauua

SEQ ID NO: 248141 - RNA, 23 nt, Human
agaugaaagcuucccaucacagu

SEQ ID NO: 248142 - RNA, 22 nt, Human
uauguacacauacacuuguaau

SEQ ID NO: 248143 - RNA, 22 nt, Human
ggcuucuccagguacugagcau

SEQ ID NO: 248144 - RNA, 22 nt, Human
cucugugauuuugugagccaga

SEQ ID NO: 248145 - RNA, 22 nt, Human
acagcaggauuuggcgauguug

SEQ ID NO: 248146 - RNA, 22 nt, Human
uccagugcuguuuccaauguaa

SEQ ID NO: 248147 - RNA, 22 nt, Human
acucucugucuaaaugcaguuu

SEQ ID NO: 248148 - RNA, 22 nt, Human
ucuuucccuguguuagccugua

SEQ ID NO: 248149 - RNA, 22 nt, Human
uccauuuggccucuguauugua

SEQ ID NO: 248150 - RNA, 22 nt, Human
agagaaaagaguucaggcuuug

SEQ ID NO: 248151 - RNA, 22 nt, Human
auaguacagcauuuuuccugag

SEQ ID NO: 248152 - RNA, 22 nt, Human
ggcucccuguucuauucccugg

SEQ ID NO: 248153 - RNA, 22 nt, Human
uuuuucuacugguguuggugua

SEQ ID NO: 248154 - RNA, 22 nt, Human
gcugggucuggaugcucaggug

SEQ ID NO: 248155 - RNA, 22 nt, Human
uaucuacauucuuguaucuucu

SEQ ID NO: 248156 - RNA, 22 nt, Human
acaugcaauauugagacuuucu

SEQ ID NO: 248157 - RNA, 22 nt, Human
gaggaaugucagcacaggccuc

SEQ ID NO: 248158 - RNA, 22 nt, Human
cucuguggcuacacaaaccucc

SEQ ID NO: 248159 - RNA, 22 nt, Human
ggcuaccagauaaauuacagag

SEQ ID NO: 248160 - RNA, 22 nt, Human
agcaggaaggcuuuggggguuc

SEQ ID NO: 248161 - RNA, 22 nt, Human
aacaaccaaaaagaugaaugua

SEQ ID NO: 248162 - RNA, 22 nt, Human
ccuggcuuugaccuugcuguuu

SEQ ID NO: 248163 - RNA, 22 nt, Human
acuguauugguuuucuauugcu

SEQ ID NO: 248164 - RNA, 22 nt, Human
ugucuagacauuagcuucagcu

SEQ ID NO: 248165 - RNA, 22 nt, Human
ucacaaugaaaaacacuacaua

SEQ ID NO: 248166 - RNA, 22 nt, Human
guggagggaaugaaucuucucu

SEQ ID NO: 248167 - RNA, 22 nt, Human
uaaugcuuuguuuugaucuaac

SEQ ID NO: 248168 - RNA, 22 nt, Human
cuggucagggcucuuugggagc

SEQ ID NO: 248169 - RNA, 23 nt, Human
aggcugccagaaauuggguaagg

SEQ ID NO: 248170 - RNA, 22 nt, Human
aucagagaccggucaagucaug

SEQ ID NO: 248171 - RNA, 18 nt, Human
gcuagggcaugcauggug

SEQ ID NO: 248172 - RNA, 22 nt, Human
gucaucuugcuguuuuagaucu

SEQ ID NO: 248173 - RNA, 22 nt, Human
ugugggaagagcaguggcagca

SEQ ID NO: 248174 - RNA, 22 nt, Human
ucauguuauugacucauaauau

SEQ ID NO: 248175 - RNA, 22 nt, Human
uuucccagagguaugaauaagu

SEQ ID NO: 248176 - RNA, 22 nt, Human
ugcauuaugcuugugcuguaua

SEQ ID NO: 248177 - RNA, 22 nt, Human
uuauuguuaggcuuuuggaauu

SEQ ID NO: 248178 - RNA, 22 nt, Human
uuccccaggggcuccugccuuu

SEQ ID NO: 248179 - RNA, 22 nt, Human
uucucugggguucaguaucucu

SEQ ID NO: 248180 - RNA, 22 nt, Human
aggucagaugggagaugggaug

SEQ ID NO: 248181 - RNA, 22 nt, Human
uuacaaugagacguucuuaucu

SEQ ID NO: 248182 - RNA, 22 nt, Human
ucaguaaaugaaugaauauaug

SEQ ID NO: 248183 - RNA, 22 nt, Human
ucugccaggccacacagggcac

SEQ ID NO: 248184 - RNA, 16 nt, Human
auaauuacugcuacuu

SEQ ID NO: 248185 - RNA, 22 nt, Human
uuaccuaaaauagcucaauuua

SEQ ID NO: 248186 - RNA, 22 nt, Human
aggcuccucggggcugacggcg

SEQ ID NO: 248187 - RNA, 22 nt, Human
cacaguuauauguucacaagga

SEQ ID NO: 248188 - RNA, 22 nt, Human
uggagguacauaaugagagggu

SEQ ID NO: 248189 - RNA, 22 nt, Human
ggugcugaugaagauguagccu

SEQ ID NO: 248190 - RNA, 22 nt, Human
uaauuucuucaucucugcagcu

SEQ ID NO: 248191 - RNA, 22 nt, Human
agacaugacagauaguugcuag

SEQ ID NO: 248192 - RNA, 21 nt, Human
ccaggcuccugaggcugguca

SEQ ID NO: 248193 - RNA, 22 nt, Human
ugcccuggcuccucccacgcug

SEQ ID NO: 248194 - RNA, 22 nt, Human
uuagcuuucaugaaccuggucg

SEQ ID NO: 248195 - RNA, 22 nt, Human
uucccacaguguugaauccucu

SEQ ID NO: 248196 - RNA, 22 nt, Human
gggagcugccuuagaccggagg

SEQ ID NO: 248197 - RNA, 22 nt, Human
cugggucucuuuagggugccgu

SEQ ID NO: 248198 - RNA, 22 nt, Human
ugacggcugggggcagugguca

SEQ ID NO: 248199 - RNA, 22 nt, Human
acccuggggguggccagugcca

SEQ ID NO: 248200 - RNA, 17 nt, Human
aguuuugauauaauggc

SEQ ID NO: 248201 - RNA, 22 nt, Human
uggaaggccuguuguguccuag

SEQ ID NO: 248202 - RNA, 22 nt, Human
gggucucucaugcaguugcugu

SEQ ID NO: 248203 - RNA, 22 nt, Human
gccagagcugagacacgagucc

SEQ ID NO: 248204 - RNA, 22 nt, Human
guccugguccugccuccccaug

SEQ ID NO: 248205 - RNA, 22 nt, Human
ucagagucuaugcaacagaauu

SEQ ID NO: 248206 - RNA, 22 nt, Human
gagcagguuucaaugcugaugc

SEQ ID NO: 248207 - RNA, 23 nt, Human
ucucucuggcaaauuucacauau

SEQ ID NO: 248208 - RNA, 22 nt, Human
accuucaauuauuuuuguucca

SEQ ID NO: 248209 - RNA, 22 nt, Human
acugucaugugcuaacugucca

SEQ ID NO: 248210 - RNA, 22 nt, Human
ugcugcagacgaagcccaugcc

SEQ ID NO: 248211 - RNA, 22 nt, Human
aagugcaaauuuaagaaggcau

SEQ ID NO: 248212 - RNA, 22 nt, Human
ccaaagguguuggccuucagug

SEQ ID NO: 248213 - RNA, 22 nt, Human
aggcugggaagguaaaguugua

SEQ ID NO: 248214 - RNA, 22 nt, Human
aagaacuguuuacaauuuucac

SEQ ID NO: 248215 - RNA, 22 nt, Human
ugcuccuggaugagguacucca

SEQ ID NO: 248216 - RNA, 22 nt, Human
uucaaauuaccacauuugcuua

SEQ ID NO: 248217 - RNA, 19 nt, Human
gccuuggcauucucugcuu

SEQ ID NO: 248218 - RNA, 22 nt, Human
cagcaagaggguaagguugaag

SEQ ID NO: 248219 - RNA, 22 nt, Human
aggcacaguggcucacaccugu

SEQ ID NO: 248220 - RNA, 20 nt, Human
cuccucaguuccaugggagg

SEQ ID NO: 248221 - RNA, 22 nt, Human
gaggcuguuaggagggacucug

SEQ ID NO: 248222 - RNA, 22 nt, Human
augaggcaauagaauauugaau

SEQ ID NO: 248223 - RNA, 22 nt, Human
gcacaugugagaguagaggccu

SEQ ID NO: 248224 - RNA, 22 nt, Human
aaagugaugccaggagucuggu

SEQ ID NO: 248225 - RNA, 22 nt, Human
uuucauggcuaggacuagagug

SEQ ID NO: 248226 - RNA, 22 nt, Human
cuccugggagcuguggcagagc

SEQ ID NO: 248227 - RNA, 22 nt, Human
ucacauucuuuauuugccaucc

SEQ ID NO: 248228 - RNA, 22 nt, Human
caggcccuuuccugggcauagg

SEQ ID NO: 248229 - RNA, 22 nt, Human
aaugucaguguuacugcuauug

SEQ ID NO: 248230 - RNA, 22 nt, Human
ucuaugaaguucagagaucuau

SEQ ID NO: 248231 - RNA, 22 nt, Human
auaguauuuccagaaauagucu

SEQ ID NO: 248232 - RNA, 22 nt, Human
gggugggaucuguggagccuca

SEQ ID NO: 248233 - RNA, 22 nt, Human
caggaaugacugcagauggggc

SEQ ID NO: 248234 - RNA, 22 nt, Human
aaugaugaacucagagggaacc

SEQ ID NO: 248235 - RNA, 22 nt, Human
aaguggcagccuuagaaggaga

SEQ ID NO: 248236 - RNA, 19 nt, Human
aggcuuggauuguggccaa

SEQ ID NO: 248237 - RNA, 22 nt, Human
uagaaaguacuaaauuuaacug

SEQ ID NO: 248238 - RNA, 22 nt, Human
ucucauuguccaauugaauuua

SEQ ID NO: 248239 - RNA, 22 nt, Human
ggccagcuccuuggcagugccu

SEQ ID NO: 248240 - RNA, 22 nt, Human
cuccagcugcuggucugagacu

SEQ ID NO: 248241 - RNA, 19 nt, Human
ugaucuggaaggaaccagg

SEQ ID NO: 248242 - RNA, 22 nt, Human
aagaguggagcuggaaaguggg

SEQ ID NO: 248243 - RNA, 22 nt, Human
ccauucugagucuuaugucuuu

SEQ ID NO: 248244 - RNA, 22 nt, Human
aacuggaaggauugcagauguc

SEQ ID NO: 248245 - RNA, 22 nt, Human
auuuucagaacauucauucacu

SEQ ID NO: 248246 - RNA, 22 nt, Human
uguuuaugcaucguuaauacca

SEQ ID NO: 248247 - RNA, 22 nt, Human
acaggcugccacuugcauccaa

SEQ ID NO: 248248 - RNA, 22 nt, Human
aucacaucgaggagcaaucaga

SEQ ID NO: 248249 - RNA, 22 nt, Human
uuuugcuuuuguaacacagugu

SEQ ID NO: 248250 - RNA, 22 nt, Human
aggaaacuucagaguuuugguc

SEQ ID NO: 248251 - RNA, 22 nt, Human
ugcugcagggccuucccugcau

SEQ ID NO: 248252 - RNA, 22 nt, Human
acuguacacauucgucaagacu

SEQ ID NO: 248253 - RNA, 22 nt, Human
gccugcagaacugugaggcaau

SEQ ID NO: 248254 - RNA, 22 nt, Human
agcugagccagcagcaacagga

SEQ ID NO: 248255 - RNA, 22 nt, Human
uucuucaaacaaaaguggcaug

SEQ ID NO: 248256 - RNA, 22 nt, Human
agugcaacagcaguucucuuua

SEQ ID NO: 248257 - RNA, 21 nt, Human
aaaaggaggcaggugaacagc

SEQ ID NO: 248258 - RNA, 22 nt, Human
gcugggcaaggcugaagcuacc

SEQ ID NO: 248259 - RNA, 22 nt, Human
aggugccaccucuggugcuguc

SEQ ID NO: 248260 - RNA, 22 nt, Human
agggcugaggcgagggagaugc

SEQ ID NO: 248261 - RNA, 22 nt, Human
cauuuggaccaaaauagccaac

SEQ ID NO: 248262 - RNA, 22 nt, Human
ggcuggcuggcugguagacaag

SEQ ID NO: 248263 - RNA, 22 nt, Human
gcuccaggugaauccucucacc

SEQ ID NO: 248264 - RNA, 22 nt, Human
auggcugcuuucccuuagcacc

SEQ ID NO: 248265 - RNA, 19 nt, Human
gccacaucuuuuccagagu

SEQ ID NO: 248266 - RNA, 22 nt, Human
agucugugugaaugugggcuuu

SEQ ID NO: 248267 - RNA, 22 nt, Human
gaugagguuuuugaaaugugga

SEQ ID NO: 248268 - RNA, 22 nt, Human
acuuucuuggucccauguuuga

SEQ ID NO: 248269 - RNA, 22 nt, Human
aagaagcuaagacuaucugggu

SEQ ID NO: 248270 - RNA, 22 nt, Human
uguaucuucaguuugucuuucc

SEQ ID NO: 248271 - RNA, 22 nt, Human
ucugggcuuuugcacuggccau

SEQ ID NO: 248272 - RNA, 22 nt, Human
ucaaaacaacacucagguguaa

SEQ ID NO: 248273 - RNA, 22 nt, Human
ggaccugccagaacucaggcua

SEQ ID NO: 248274 - RNA, 22 nt, Human
ccagguggacuugauuugaaua

SEQ ID NO: 248275 - RNA, 22 nt, Human
uuuacuacuucauugacuuacg

SEQ ID NO: 248276 - RNA, 19 nt, Human
acaggcagaauugggugug

SEQ ID NO: 248277 - RNA, 18 nt, Human
uccuggccacacuaccuu

SEQ ID NO: 248278 - RNA, 22 nt, Human
gaaggcuuccugaugccaacca

SEQ ID NO: 248279 - RNA, 22 nt, Human
ucugagaauggagcuaaaaauc

SEQ ID NO: 248280 - RNA, 22 nt, Human
caguuucuguuuuaaauagcag

SEQ ID NO: 248281 - RNA, 22 nt, Human
agaagcaaggucugucaguaua

SEQ ID NO: 248282 - RNA, 17 nt, Human
uuaagguggaucagcac

SEQ ID NO: 248283 - RNA, 22 nt, Human
auagaaucaucugugcacuagu

SEQ ID NO: 248284 - RNA, 22 nt, Human
agggcagcaaugcagcugcugc

SEQ ID NO: 248285 - RNA, 22 nt, Human
agcaucagcagacucucagcua

SEQ ID NO: 248286 - RNA, 22 nt, Human
ugucugugugagcaaaugacuu

SEQ ID NO: 248287 - RNA, 22 nt, Human
uucuccauuuaacuuccuuaug

SEQ ID NO: 248288 - RNA, 23 nt, Human
cagggaggagauacuguguaucu

SEQ ID NO: 248289 - RNA, 22 nt, Human
uagucagagucuucucuguugu

SEQ ID NO: 248290 - RNA, 22 nt, Human
accaggcagucaccguccagga

SEQ ID NO: 248291 - RNA, 22 nt, Human
ucccagcagcauagcucagaau

SEQ ID NO: 248292 - RNA, 20 nt, Human
uucucuagccuuccccuggg

SEQ ID NO: 248293 - RNA, 22 nt, Human
gaaugaguauucuuuauaggau

SEQ ID NO: 248294 - RNA, 22 nt, Human
aauauggcuuguuacuauguuu

SEQ ID NO: 248295 - RNA, 22 nt, Human
ggugggcagcucuuggcaggca

SEQ ID NO: 248296 - RNA, 22 nt, Human
auggcagcaaagaggccuucuu

SEQ ID NO: 248297 - RNA, 22 nt, Human
gacauucagccaauuacuuucu

SEQ ID NO: 248298 - RNA, 22 nt, Human
aucugagacugaguuuggauuu

SEQ ID NO: 248299 - RNA, 22 nt, Human
gguucaguuuacauuaaaaucu

SEQ ID NO: 248300 - RNA, 22 nt, Human
ugauuuuauugaaacuucacuu

SEQ ID NO: 248301 - RNA, 22 nt, Human
ucuagauguacugcugaagagu

SEQ ID NO: 248302 - RNA, 22 nt, Human
cuucagagcaucacuucagcug

SEQ ID NO: 248303 - RNA, 22 nt, Human
gucccuuccucauuccacuuua

SEQ ID NO: 248304 - RNA, 22 nt, Human
gaaguauuauagcauauuagcc

SEQ ID NO: 248305 - RNA, 22 nt, Human
cggcuuccaacaagcuuugcug

SEQ ID NO: 248306 - RNA, 22 nt, Human
uucuuuuaauagagauccugug

SEQ ID NO: 248307 - RNA, 22 nt, Human
uaggccaguugguggcccugga

SEQ ID NO: 248308 - RNA, 22 nt, Human
ugcccugcugugccuggagcca

SEQ ID NO: 248309 - RNA, 22 nt, Human
aacaggcaggagaauucugccu

SEQ ID NO: 248310 - RNA, 22 nt, Human
uuuucuguauuauugugcuuca

SEQ ID NO: 248311 - RNA, 18 nt, Human
gccugccuagagcuugcc

SEQ ID NO: 248312 - RNA, 22 nt, Human
cagggagcuggugccagccgac

SEQ ID NO: 248313 - RNA, 22 nt, Human
gcuuuacauuuuggaaagguga

SEQ ID NO: 248314 - RNA, 23 nt, Human
agcucugcucgggcaugcccugc

SEQ ID NO: 248315 - RNA, 22 nt, Human
ugcagagaaaguguagacaggc

SEQ ID NO: 248316 - RNA, 22 nt, Human
auuagcauauuaaauagucauu

SEQ ID NO: 248317 - RNA, 22 nt, Human
cuguuuaucccuuuggucagca

SEQ ID NO: 248318 - RNA, 21 nt, Human
gacaggugauucagagcaggg

SEQ ID NO: 248319 - RNA, 22 nt, Human
cguggggcggguggacacuugc

SEQ ID NO: 248320 - RNA, 22 nt, Human
cucuguaugaaucauauggagu

SEQ ID NO: 248321 - RNA, 22 nt, Human
agcagagcggggccuccggaag

SEQ ID NO: 248322 - RNA, 22 nt, Human
aguccagggagcccaggcuuug

SEQ ID NO: 248323 - RNA, 22 nt, Human
agcagaugggagauggagcugc

SEQ ID NO: 248324 - RNA, 22 nt, Human
uuuuuuggauaauaaacgaucu

SEQ ID NO: 248325 - RNA, 22 nt, Human
aaagacacaugucucuuagauu

SEQ ID NO: 248326 - RNA, 22 nt, Human
uaaggcagauguggaaucaauu

SEQ ID NO: 248327 - RNA, 22 nt, Human
aagugcuugaucauaguucuca

SEQ ID NO: 248328 - RNA, 22 nt, Human
cuagaacaaauuaggaggcaua

SEQ ID NO: 248329 - RNA, 22 nt, Human
agcauugucuccaagcaggucu

SEQ ID NO: 248330 - RNA, 22 nt, Human
gucuggaggcccgucagcccua

SEQ ID NO: 248331 - RNA, 22 nt, Human
agggaaauuaaugugagcaaug

SEQ ID NO: 248332 - RNA, 22 nt, Human
ugccuugcugcuuuggaguccu

SEQ ID NO: 248333 - RNA, 22 nt, Human
uccagggaagagcagaggcuac

SEQ ID NO: 248334 - RNA, 22 nt, Human
agaagcagggcagggaaaagca

SEQ ID NO: 248335 - RNA, 22 nt, Human
gccucuccuggagaaggcaggg

SEQ ID NO: 248336 - RNA, 22 nt, Human
uugcaaaagcaauugcaguuuu

SEQ ID NO: 248337 - RNA, 22 nt, Human
auuuccuaggguagaugucaca

SEQ ID NO: 248338 - RNA, 22 nt, Human
uucuauaaugcaagccacugca

SEQ ID NO: 248339 - RNA, 22 nt, Human
ccagcucuaaacggcucugugg

SEQ ID NO: 248340 - RNA, 22 nt, Human
aaggccaugaccacuugcugug

SEQ ID NO: 248341 - RNA, 22 nt, Human
agacagacguagugugagagua

SEQ ID NO: 248342 - RNA, 22 nt, Human
gccuccugaaaggaagagcucc

SEQ ID NO: 248343 - RNA, 22 nt, Human
augugcaaaguaaaguaauuuu

SEQ ID NO: 248344 - RNA, 22 nt, Human
agcacaguuucuuuuccuuguc

SEQ ID NO: 248345 - RNA, 22 nt, Human
ugagcuucuuuauuuggccaga

SEQ ID NO: 248346 - RNA, 22 nt, Human
ucagcagaggagugucuugccc

SEQ ID NO: 248347 - RNA, 20 nt, Human
gauuacaaaaugaaaugcau

SEQ ID NO: 248348 - RNA, 19 nt, Human
agcaauuaagacugugggc

SEQ ID NO: 248349 - RNA, 22 nt, Human
uuuaaagugcugcuccuauccu

SEQ ID NO: 248350 - RNA, 22 nt, Human
cuccugguucagagagcugaga

SEQ ID NO: 248351 - RNA, 22 nt, Human
caggagccccaggcugacaaua

SEQ ID NO: 248352 - RNA, 22 nt, Human
uuagagaaccaaugaauagucu

SEQ ID NO: 248353 - RNA, 22 nt, Human
uuggaauaaaaacaacucacag

SEQ ID NO: 248354 - RNA, 22 nt, Human
agacacagcagugccugccuca

SEQ ID NO: 248355 - RNA, 22 nt, Human
cagagcuggcucugcauguaca

SEQ ID NO: 248356 - RNA, 22 nt, Human
caugauguuaucuaaaucuggu

SEQ ID NO: 248357 - RNA, 22 nt, Human
cuccagguuuuacaaggucuau

SEQ ID NO: 248358 - RNA, 22 nt, Human
ugaggaauggcuuaauguggga

SEQ ID NO: 248359 - RNA, 22 nt, Human
ggcaggcuuucagcaucaaguc

SEQ ID NO: 248360 - RNA, 21 nt, Human
gccugcuguucacccugccac

SEQ ID NO: 248361 - RNA, 22 nt, Human
uucuaaagccuguccuaucaga

SEQ ID NO: 248362 - RNA, 18 nt, Human
uuugggauccucuuuucu

SEQ ID NO: 248363 - RNA, 22 nt, Human
ggccuuccuucccagccuacug

SEQ ID NO: 248364 - RNA, 22 nt, Human
gaugagcugugauuaauaagua

SEQ ID NO: 248365 - RNA, 22 nt, Human
uuccuggggcuuagcaauggag

SEQ ID NO: 248366 - RNA, 22 nt, Human
auaauaucgcuccuuuuuuuga

SEQ ID NO: 248367 - RNA, 22 nt, Human
ucagacagaaggacuauuugaa

SEQ ID NO: 248368 - RNA, 20 nt, Human
aggagccauugacugcagca

SEQ ID NO: 248369 - RNA, 22 nt, Human
uacacaugcauguacuccagga

SEQ ID NO: 248370 - RNA, 22 nt, Human
acugccuguuuggcauggcccc

SEQ ID NO: 248371 - RNA, 22 nt, Human
ugguccuggagaucaauaugca

SEQ ID NO: 248372 - RNA, 22 nt, Human
uagaaaagaauuuuauuugaua

SEQ ID NO: 248373 - RNA, 22 nt, Human
uuccugugaaauauagguccau

SEQ ID NO: 248374 - RNA, 22 nt, Human
uaaaccuuauuugaauaccaac

SEQ ID NO: 248375 - RNA, 21 nt, Human
gcaaggcaaugccaugauuuc

SEQ ID NO: 248376 - RNA, 22 nt, Human
aagugcauauuuuuguuguaga

SEQ ID NO: 248377 - RNA, 22 nt, Human
aagugguuugauucaguuuaug

SEQ ID NO: 248378 - RNA, 22 nt, Human
gguccagguauguggugugaau

SEQ ID NO: 248379 - RNA, 22 nt, Human
ggcugccagcacugguguagag

SEQ ID NO: 248380 - RNA, 22 nt, Human
auaguuuacaaaaaugaugcau

SEQ ID NO: 248381 - RNA, 22 nt, Human
aaagugguuuuucagacuuuga

SEQ ID NO: 248382 - RNA, 22 nt, Human
uuguguuucuggccaagaugga

SEQ ID NO: 248383 - RNA, 22 nt, Human
gccagggggucagcaggcacuu

SEQ ID NO: 248384 - RNA, 22 nt, Human
uggcugaggcuuuucuuaaaga

SEQ ID NO: 248385 - RNA, 22 nt, Human
aauugacaaaucauacuuguau

SEQ ID NO: 248386 - RNA, 22 nt, Human
aucugcaggaaugugugcagag

SEQ ID NO: 248387 - RNA, 22 nt, Human
gcagggcugcagagggcacugu

SEQ ID NO: 248388 - RNA, 22 nt, Human
agucuuagauuuuauuuugguc

SEQ ID NO: 248389 - RNA, 22 nt, Human
guuauucaacuugugucucuua

SEQ ID NO: 248390 - RNA, 22 nt, Human
cauucauucuguaaguaacuau

SEQ ID NO: 248391 - RNA, 20 nt, Human
ugguccaggaccuggugucc

SEQ ID NO: 248392 - RNA, 22 nt, Human
cugggacauuauaagaaacauu

SEQ ID NO: 248393 - RNA, 22 nt, Human
uacugucuuuuccuaaaugggu

SEQ ID NO: 248394 - RNA, 22 nt, Human
gccacugugguccucccaugau

SEQ ID NO: 248395 - RNA, 22 nt, Human
gcaacacagaucuucuuuguug

SEQ ID NO: 248396 - RNA, 23 nt, Human
uauucagcagugggauuuguugu

SEQ ID NO: 248397 - RNA, 22 nt, Human
guggcugcuguccucucugguu

SEQ ID NO: 248398 - RNA, 22 nt, Human
ucagcucuuaacccucuggccu

SEQ ID NO: 248399 - RNA, 22 nt, Human
ugggagagugcucaaugugcaa

SEQ ID NO: 248400 - RNA, 22 nt, Human
caaauggcuggcauccuucuac

SEQ ID NO: 248401 - RNA, 22 nt, Human
uucuucaaaauccagcaugauu

SEQ ID NO: 248402 - RNA, 23 nt, Human
ucacuugaagcuagaaucugccc

SEQ ID NO: 248403 - RNA, 22 nt, Human
uaaagucaagguacuguuucac

SEQ ID NO: 248404 - RNA, 22 nt, Human
agcaaaguggcuuuccaaacca

SEQ ID NO: 248405 - RNA, 22 nt, Human
aaggggcucuugucaggcgcag

SEQ ID NO: 248406 - RNA, 22 nt, Human
uucuguccacugcuggggccuc

SEQ ID NO: 248407 - RNA, 21 nt, Human
cugguguagcacucaggugcu

SEQ ID NO: 248408 - RNA, 22 nt, Human
uuagaacauuccaucacugggu

SEQ ID NO: 248409 - RNA, 22 nt, Human
auacgccauaggcuccucacuu

SEQ ID NO: 248410 - RNA, 20 nt, Human
uggggucuaguuggccuggg

SEQ ID NO: 248411 - RNA, 22 nt, Human
agccagagacugugucuguaau

SEQ ID NO: 248412 - RNA, 22 nt, Human
aaagcaugauuagauagaugau

SEQ ID NO: 248413 - RNA, 22 nt, Human
cauguccuucucauugccucau

SEQ ID NO: 248414 - RNA, 22 nt, Human
ucuguuaugcauaagcaucagu

SEQ ID NO: 248415 - RNA, 22 nt, Human
caguaauuccaagugcuuauac

SEQ ID NO: 248416 - RNA, 22 nt, Human
guauccucaccuauacaaugga

SEQ ID NO: 248417 - RNA, 22 nt, Human
ucucagaguuuacggggcugaa

SEQ ID NO: 248418 - RNA, 22 nt, Human
uaagaugaucaccaaaugcugg

SEQ ID NO: 248419 - RNA, 22 nt, Human
uccuggcauccgugggucugug

SEQ ID NO: 248420 - RNA, 22 nt, Human
uuugacuccugccuucuccugu

SEQ ID NO: 248421 - RNA, 22 nt, Human
gaagcaguuucuguaaugaaau

SEQ ID NO: 248422 - RNA, 22 nt, Human
ccaggagauuuuuccauagcac

SEQ ID NO: 248423 - RNA, 22 nt, Human
caaguuuaaggcacugauaagu

SEQ ID NO: 248424 - RNA, 22 nt, Human
aauuggaaaaugcuacauauca

SEQ ID NO: 248425 - RNA, 22 nt, Human
caucaaagcuuuuuucuguguu

SEQ ID NO: 248426 - RNA, 23 nt, Human
gaauacaaagcagaugguccagc

SEQ ID NO: 248427 - RNA, 18 nt, Human
cacaauagacaccgauaa

SEQ ID NO: 248428 - RNA, 22 nt, Human
agagaacacgugcaucugcaau

SEQ ID NO: 248429 - RNA, 23 nt, Human
ucaaacauauugugagacacagg

SEQ ID NO: 248430 - RNA, 22 nt, Human
ccugguggagaggggcggagcg

SEQ ID NO: 248431 - RNA, 22 nt, Human
cucuccuggggagcacacacac

SEQ ID NO: 248432 - RNA, 22 nt, Human
cuucuucagcacaauauugaug

SEQ ID NO: 248433 - RNA, 22 nt, Human
guuucaaauagguuucagcaaa

SEQ ID NO: 248434 - RNA, 22 nt, Human
ucucacaucugcccugugcugg

SEQ ID NO: 248435 - RNA, 22 nt, Human
cagggcucagaagacagaccuc

SEQ ID NO: 248436 - RNA, 22 nt, Human
acacauuauaggcaaucaaaag

SEQ ID NO: 248437 - RNA, 22 nt, Human
gaaaggcuacugucaucaauua

SEQ ID NO: 248438 - RNA, 22 nt, Human
uuucaugcacaaaugagcaagg

SEQ ID NO: 248439 - RNA, 22 nt, Human
guauuagucaauuacagugggg

SEQ ID NO: 248440 - RNA, 22 nt, Human
gugcauauaugcacauaugugu

SEQ ID NO: 248441 - RNA, 22 nt, Human
agcagcugcagggagggucugc

SEQ ID NO: 248442 - RNA, 22 nt, Human
ggcugaaaggugggaggauggc

SEQ ID NO: 248443 - RNA, 22 nt, Human
ucagaggugcaagaaguucuga

SEQ ID NO: 248444 - RNA, 22 nt, Human
ccagguguaagacaugguccua

SEQ ID NO: 248445 - RNA, 22 nt, Human
cauaacauguacauauaaaugc

SEQ ID NO: 248446 - RNA, 21 nt, Human
uuaugucucuuuggugacugg

SEQ ID NO: 248447 - RNA, 22 nt, Human
caugcaaagcguuuugaccagc

SEQ ID NO: 248448 - RNA, 22 nt, Human
gguuccagaguauuucauuuca

SEQ ID NO: 248449 - RNA, 22 nt, Human
uuacaguuuaguccaagccaga

SEQ ID NO: 248450 - RNA, 22 nt, Human
uggcuucagagacagaaucuau

SEQ ID NO: 248451 - RNA, 22 nt, Human
gacaagugcugauuuaucuccc

SEQ ID NO: 248452 - RNA, 22 nt, Human
auagaaaacagauguccuuaaa

SEQ ID NO: 248453 - RNA, 22 nt, Human
cccaggaggucgaagcugcagu

SEQ ID NO: 248454 - RNA, 22 nt, Human
cccagaaggucgaggcugcagu

SEQ ID NO: 248455 - RNA, 22 nt, Human
caguucuuuguggggaguucuc

SEQ ID NO: 248456 - RNA, 22 nt, Human
acagagacuuggagcaggcuga

SEQ ID NO: 248457 - RNA, 22 nt, Human
caguagucuuuuuccuccuaga

SEQ ID NO: 248458 - RNA, 22 nt, Human
gacaaugcagaaguacuuguuc

SEQ ID NO: 248459 - RNA, 22 nt, Human
ggccagggaggagaggccccug

SEQ ID NO: 248460 - RNA, 22 nt, Human
acaucuguccucugcagagcuc

SEQ ID NO: 248461 - RNA, 22 nt, Human
auucagugauucauuuguacaa

SEQ ID NO: 248462 - RNA, 19 nt, Human
auguuuuaugcugauggga

SEQ ID NO: 248463 - RNA, 22 nt, Human
gcucccagggaccgcagggcag

SEQ ID NO: 248464 - RNA, 22 nt, Human
gcugggcucaccaggccacuag

SEQ ID NO: 248465 - RNA, 22 nt, Human
agcagaggacaguucuuaggaa

SEQ ID NO: 248466 - RNA, 22 nt, Human
gcccagguuggagagcaguggc

SEQ ID NO: 248467 - RNA, 22 nt, Human
caggccuugucaagaaaaugcc

SEQ ID NO: 248468 - RNA, 23 nt, Human
cauguacagaguuugauaaagug

SEQ ID NO: 248469 - RNA, 22 nt, Human
gaggugggaugugugugcuacu

SEQ ID NO: 248470 - RNA, 22 nt, Human
aagcugucagugucaggcuaaa

SEQ ID NO: 248471 - RNA, 21 nt, Human
gagaggccugggcccgugagc

SEQ ID NO: 248472 - RNA, 22 nt, Human
ccagggcaacgcugucucagag

SEQ ID NO: 248473 - RNA, 22 nt, Human
uaaauggcaaccccuagagcug

SEQ ID NO: 248474 - RNA, 22 nt, Human
aauagaacaauaauuguaaacu

SEQ ID NO: 248475 - RNA, 22 nt, Human
aauagcauguucaugauaaaau

SEQ ID NO: 248476 - RNA, 22 nt, Human
gucuccagggcugcuggcgccu

SEQ ID NO: 248477 - RNA, 23 nt, Human
uguagcaucucuuauuucucagc

SEQ ID NO: 248478 - RNA, 22 nt, Human
gcuuccuggaacaacuguugcu

SEQ ID NO: 248479 - RNA, 22 nt, Human
ccugguggaaggugagugaggc

SEQ ID NO: 248480 - RNA, 22 nt, Human
agcccagcuuugaaccauauca

SEQ ID NO: 248481 - RNA, 22 nt, Human
agcaguuaccaaggaaccuggu

SEQ ID NO: 248482 - RNA, 22 nt, Human
agcauacaguugaaaguggcuu

SEQ ID NO: 248483 - RNA, 22 nt, Human
cagcacucuggcuucguuaagu

SEQ ID NO: 248484 - RNA, 22 nt, Human
aucuguagaagauacucugaga

SEQ ID NO: 248485 - RNA, 22 nt, Human
cucaggaguaguucagcagcug

SEQ ID NO: 248486 - RNA, 22 nt, Human
auuuguuaauuaugaggcauac

SEQ ID NO: 248487 - RNA, 22 nt, Human
agcaccaucggguucuugcuuu

SEQ ID NO: 248488 - RNA, 22 nt, Human
acacaucucucuuugaggagug

SEQ ID NO: 248489 - RNA, 22 nt, Human
aaaagagaguugccagucugua

SEQ ID NO: 248490 - RNA, 22 nt, Human
agacaggugcucgcccaagucc

SEQ ID NO: 248491 - RNA, 22 nt, Human
aucaaaucauugcauuaauguu

SEQ ID NO: 248492 - RNA, 22 nt, Human
cuccugggucauugccagcaaa

SEQ ID NO: 248493 - RNA, 22 nt, Human
ggaggccaagucacugaccugg

SEQ ID NO: 248494 - RNA, 22 nt, Human
uucuuuuggacucaaagagaac

SEQ ID NO: 248495 - RNA, 22 nt, Human
gagucuggaaacuuugacaaaa

SEQ ID NO: 248496 - RNA, 22 nt, Human
guuauucaauggcuuauaagga

SEQ ID NO: 248497 - RNA, 22 nt, Human
auuucuagcagggcaggaaaga

SEQ ID NO: 248498 - RNA, 22 nt, Human
gcuguguguucaauaaugugau

SEQ ID NO: 248499 - RNA, 22 nt, Human
gccagcucucauuguauaggcu

SEQ ID NO: 248500 - RNA, 22 nt, Human
agguggcucugacagcucuggu

SEQ ID NO: 248501 - RNA, 22 nt, Human
ucuggcaggccuugucaaucug

SEQ ID NO: 248502 - RNA, 22 nt, Human
ggcccaggaugcaagaacugaa

SEQ ID NO: 248503 - RNA, 20 nt, Human
cagugaggaggugcuggggg

SEQ ID NO: 248504 - RNA, 22 nt, Human
ccagccuucaccugcucugguc

SEQ ID NO: 248505 - RNA, 22 nt, Human
caagauaauuuauucugaguuu

SEQ ID NO: 248506 - RNA, 22 nt, Human
gcaggagcugcucuccugacga

SEQ ID NO: 248507 - RNA, 22 nt, Human
cuuuggaaggaagaccuuucag

SEQ ID NO: 248508 - RNA, 22 nt, Human
uggcagcugccauguccacgug

SEQ ID NO: 248509 - RNA, 22 nt, Human
caugugucaaaugauguagcug

SEQ ID NO: 248510 - RNA, 22 nt, Human
aggccagcugccacccgguccg

SEQ ID NO: 248511 - RNA, 22 nt, Human
augaguguuuagaaaacacugg

SEQ ID NO: 248512 - RNA, 22 nt, Human
cuucuguggauauguucucucu

SEQ ID NO: 248513 - RNA, 22 nt, Human
cuugucugggcagcuugggagu

SEQ ID NO: 248514 - RNA, 22 nt, Human
gcagaagcugggcagcgaggug

SEQ ID NO: 248515 - RNA, 22 nt, Human
agaugguuuugucuuuaugauu

SEQ ID NO: 248516 - RNA, 22 nt, Human
cuggaaagacagagggcauggg

SEQ ID NO: 248517 - RNA, 22 nt, Human
gaacagcagcucguucucgaug

SEQ ID NO: 248518 - RNA, 22 nt, Human
ccagccuggacugggucuugug

SEQ ID NO: 248519 - RNA, 22 nt, Human
ucaggcuggggugcuaaggugu

SEQ ID NO: 248520 - RNA, 22 nt, Human
auguccagaguaaagcacauuc

SEQ ID NO: 248521 - RNA, 22 nt, Human
uucuuaaagaggcaaaacacag

SEQ ID NO: 248522 - RNA, 22 nt, Human
agggaugauuucagugucugcc

SEQ ID NO: 248523 - RNA, 22 nt, Human
cagggagcucugggccggacuc

SEQ ID NO: 248524 - RNA, 22 nt, Human
ggcuccuguccuccuggagcuc

SEQ ID NO: 248525 - RNA, 22 nt, Human
gccaccagcagaaaaggggcca

SEQ ID NO: 248526 - RNA, 22 nt, Human
acauucaugucccacuucuagc

SEQ ID NO: 248527 - RNA, 22 nt, Human
ucagcuuuuuacaugugaaaua

SEQ ID NO: 248528 - RNA, 22 nt, Human
ucacagugcaggaucaguuaau

SEQ ID NO: 248529 - RNA, 22 nt, Human
ucugggcuuuacacugugcuua

SEQ ID NO: 248530 - RNA, 23 nt, Human
ugucuuugaaugggcuguagaca

SEQ ID NO: 248531 - RNA, 22 nt, Human
caugguuuggucuuuguagugg

SEQ ID NO: 248532 - RNA, 22 nt, Human
ggaguggccucuccugugcagg

SEQ ID NO: 248533 - RNA, 23 nt, Human
auuagaaaggcuuucuggugaaa

SEQ ID NO: 248534 - RNA, 22 nt, Human
ggcaggcagaggcugagacagg

SEQ ID NO: 248535 - RNA, 22 nt, Human
ucugcucagggagggucacuac

SEQ ID NO: 248536 - RNA, 22 nt, Human
acuucauguaguccaucagguu

SEQ ID NO: 248537 - RNA, 22 nt, Human
acaaaugcagcauaaagugaac

SEQ ID NO: 248538 - RNA, 22 nt, Human
caggccugacccugagcuucac

SEQ ID NO: 248539 - RNA, 19 nt, Human
agacuuuuguaaguugaga

SEQ ID NO: 248540 - RNA, 21 nt, Human
ucaggaggcucagacuccugc

SEQ ID NO: 248541 - RNA, 20 nt, Human
uuacagaaaugauguuauuu

SEQ ID NO: 248542 - RNA, 22 nt, Human
aucaagcagugaaaaaugcuag

SEQ ID NO: 248543 - RNA, 22 nt, Human
gacugaggagguaagguuugaa

SEQ ID NO: 248544 - RNA, 22 nt, Human
cauguucaucagaucaauugua

SEQ ID NO: 248545 - RNA, 22 nt, Human
ccucaggcuuacgggcaaugga

SEQ ID NO: 248546 - RNA, 22 nt, Human
augcuuuuccaggagaaauaua

SEQ ID NO: 248547 - RNA, 22 nt, Human
ugucauggcacugguaggagug

SEQ ID NO: 248548 - RNA, 22 nt, Human
aacagauaauuucuaaguuacu

SEQ ID NO: 248549 - RNA, 22 nt, Human
cuuuuacauuuguugaagagua

SEQ ID NO: 248550 - RNA, 22 nt, Human
aacaaugaggaucuguucugag

SEQ ID NO: 248551 - RNA, 22 nt, Human
aaaugcuguucuuuuagguaga

SEQ ID NO: 248552 - RNA, 22 nt, Human
cucugggcaaagaugccucauc

SEQ ID NO: 248553 - RNA, 22 nt, Human
agucauuuugcuaaaugagggu

SEQ ID NO: 248554 - RNA, 22 nt, Human
ucagaacagcaggguguggcug

SEQ ID NO: 248555 - RNA, 22 nt, Human
ucaugccagcuuugcuuguccc

SEQ ID NO: 248556 - RNA, 22 nt, Human
aaaaaugcugugguagcugugu

SEQ ID NO: 248557 - RNA, 22 nt, Human
uuggaauuccuguuguuucguc

SEQ ID NO: 248558 - RNA, 20 nt, Human
gcugggggugugcugaguga

SEQ ID NO: 248559 - RNA, 22 nt, Human
cugcagggauugcuucuguaua

SEQ ID NO: 248560 - RNA, 22 nt, Human
ugcuggagagccuuggccaagg

SEQ ID NO: 248561 - RNA, 22 nt, Human
auaucuuuuagagcaagcuugu

SEQ ID NO: 248562 - RNA, 22 nt, Human
agcagaagugccuuagcaauca

SEQ ID NO: 248563 - RNA, 22 nt, Human
caaaugugguuucucagcauuc

SEQ ID NO: 248564 - RNA, 22 nt, Human
gaaagcacaguucaugagacaa

SEQ ID NO: 248565 - RNA, 22 nt, Human
ccacaucuguucuuaguucuga

SEQ ID NO: 248566 - RNA, 22 nt, Human
acccugagucagacagccugac

SEQ ID NO: 248567 - RNA, 22 nt, Human
gccuggcugagguggggaggca

SEQ ID NO: 248568 - RNA, 21 nt, Human
auggugagauacugggugugg

SEQ ID NO: 248569 - RNA, 22 nt, Human
acagcagccagccacugugagc

SEQ ID NO: 248570 - RNA, 22 nt, Human
uccacaucaagggcagagaggu

SEQ ID NO: 248571 - RNA, 22 nt, Human
auuccaaagguuaaugcccauu

SEQ ID NO: 248572 - RNA, 22 nt, Human
uuuaguguggcacugauguuca

SEQ ID NO: 248573 - RNA, 22 nt, Human
aacuuagacuuguuucuuggua

SEQ ID NO: 248574 - RNA, 22 nt, Human
aucaaauacaaagggcauaagg

SEQ ID NO: 248575 - RNA, 22 nt, Human
cugggaagauggugacagaauu

SEQ ID NO: 248576 - RNA, 22 nt, Human
uaagugaugaagaccuguuugg

SEQ ID NO: 248577 - RNA, 22 nt, Human
augucacuguuuaccagcucca

SEQ ID NO: 248578 - RNA, 22 nt, Human
uucuggcuacccuccuaauguu

SEQ ID NO: 248579 - RNA, 22 nt, Human
ucuuucaaagcuguaguagauu

SEQ ID NO: 248580 - RNA, 22 nt, Human
agcuaggacagguagagauggg

SEQ ID NO: 248581 - RNA, 22 nt, Human
ccaucagacaauucuuucucuu

SEQ ID NO: 248582 - RNA, 22 nt, Human
aucuuuauauaucuccucugaa

SEQ ID NO: 248583 - RNA, 22 nt, Human
uuucugcauauguauguaugga

SEQ ID NO: 248584 - RNA, 22 nt, Human
gucauagaggccuauauaauuu

SEQ ID NO: 248585 - RNA, 22 nt, Human
uuucacauuuguuuuaagaagu

SEQ ID NO: 248586 - RNA, 22 nt, Human
auggaaugugaacaugauggca

SEQ ID NO: 248587 - RNA, 22 nt, Human
auccugggcaaaguaugcuguc

SEQ ID NO: 248588 - RNA, 22 nt, Human
uggaggcaccacuggcugcccg

SEQ ID NO: 248589 - RNA, 22 nt, Human
aggaagaggguggcagauaauc

SEQ ID NO: 248590 - RNA, 22 nt, Human
cacauguguauaugugaggggg

SEQ ID NO: 248591 - RNA, 22 nt, Human
gaggugucccgcaguccccaag

SEQ ID NO: 248592 - RNA, 21 nt, Human
ccucagucucccugcuccacu

SEQ ID NO: 248593 - RNA, 22 nt, Human
uugaggagguaugacuagguac

SEQ ID NO: 248594 - RNA, 22 nt, Human
uaauacaaggcaggaagcagua

SEQ ID NO: 248595 - RNA, 22 nt, Human
aaaggccaugguuggaguguuu

SEQ ID NO: 248596 - RNA, 19 nt, Human
aggugugggggcugcagac

SEQ ID NO: 248597 - RNA, 22 nt, Human
guggcugcuacagagcuggagg

SEQ ID NO: 248598 - RNA, 22 nt, Human
ggcagguggacgugcuaaagcu

SEQ ID NO: 248599 - RNA, 22 nt, Human
cgagcaugaugacggcuguggc

SEQ ID NO: 248600 - RNA, 19 nt, Human
uguggggagucagggggcu

SEQ ID NO: 248601 - RNA, 22 nt, Human
cauuucauuccuuugaaagugg

SEQ ID NO: 248602 - RNA, 22 nt, Human
uccuggucagugccaaacuggu

SEQ ID NO: 248603 - RNA, 22 nt, Human
gaugcaaaccuuacauggaccu

SEQ ID NO: 248604 - RNA, 22 nt, Human
agguggcagaugggggugcucg

SEQ ID NO: 248605 - RNA, 22 nt, Human
acagauuauggauauaugugga

SEQ ID NO: 248606 - RNA, 22 nt, Human
uuggcuucuuuagucaguuugg

SEQ ID NO: 248607 - RNA, 22 nt, Human
aacaggcucuucauuuccagag

SEQ ID NO: 248608 - RNA, 22 nt, Human
aggaagcccuugucauuucugu

SEQ ID NO: 248609 - RNA, 22 nt, Human
agccagaggccagccugccuca

SEQ ID NO: 248610 - RNA, 22 nt, Human
cuuguaaaugcagauucugauu

SEQ ID NO: 248611 - RNA, 22 nt, Human
gaggcccaggguacaggccgcu

SEQ ID NO: 248612 - RNA, 22 nt, Human
aucuguggauaugaccuuccug

SEQ ID NO: 248613 - RNA, 22 nt, Human
ggcaaacacaccucggugagaa

SEQ ID NO: 248614 - RNA, 22 nt, Human
aggacaguauaggcuuuaggag

SEQ ID NO: 248615 - RNA, 22 nt, Human
cuuagauacaguagaaagacuc

SEQ ID NO: 248616 - RNA, 18 nt, Human
aagaaguuggccaaagag

SEQ ID NO: 248617 - RNA, 22 nt, Human
ugaggcaagggauggccccgug

SEQ ID NO: 248618 - RNA, 22 nt, Human
caacuauagaucaaaugaguuu

SEQ ID NO: 248619 - RNA, 22 nt, Human
ugauuuacucccacuuagagcc

SEQ ID NO: 248620 - RNA, 22 nt, Human
caacagaaggaagcagggucag

SEQ ID NO: 248621 - RNA, 22 nt, Human
uuuauuuggcauccagggagaa

SEQ ID NO: 248622 - RNA, 22 nt, Human
uugagcaaagcagccauucauu

SEQ ID NO: 248623 - RNA, 22 nt, Human
guccucuccaggaggcucugau

SEQ ID NO: 248624 - RNA, 22 nt, Human
gcucagagauguucaguagcuu

SEQ ID NO: 248625 - RNA, 22 nt, Human
cugccaggugccagggcgcggc

SEQ ID NO: 248626 - RNA, 22 nt, Human
gcagguggauauugcuacuuga

SEQ ID NO: 248627 - RNA, 20 nt, Human
aggucugaaugucagggcug

SEQ ID NO: 248628 - RNA, 22 nt, Human
uucuuucaauagcuggcauaug

SEQ ID NO: 248629 - RNA, 22 nt, Human
gcuucucuuaaugccuggcuuu

SEQ ID NO: 248630 - RNA, 22 nt, Human
agaguaaaguacuuggaauacc

SEQ ID NO: 248631 - RNA, 22 nt, Human
aaguaugucuuuggguauuauu

SEQ ID NO: 248632 - RNA, 22 nt, Human
ugggccaggcaugugaucagca

SEQ ID NO: 248633 - RNA, 22 nt, Human
ugcuauuuuggucuacagcacu

SEQ ID NO: 248634 - RNA, 22 nt, Human
cuggggaaggcggugacugcgc

SEQ ID NO: 248635 - RNA, 22 nt, Human
gucaaauauacuaagagguaaa

SEQ ID NO: 248636 - RNA, 22 nt, Human
uagaauaugauuaauuuucuua

SEQ ID NO: 248637 - RNA, 22 nt, Human
uauacacaaacaagggguuaag

SEQ ID NO: 248638 - RNA, 22 nt, Human
aaaaaauuccauucugugccuu

SEQ ID NO: 248639 - RNA, 22 nt, Human
aaagaucacgucccaggacucg

SEQ ID NO: 248640 - RNA, 22 nt, Human
uugaggcagguccggguccuuc

SEQ ID NO: 248641 - RNA, 19 nt, Human
uccagccccucugugugug

SEQ ID NO: 248642 - RNA, 22 nt, Human
acauuccugaaugggcacauuu

SEQ ID NO: 248643 - RNA, 22 nt, Human
acaaugucucauauucguguuc

SEQ ID NO: 248644 - RNA, 22 nt, Human
uagaaaauguuccacugccauu

SEQ ID NO: 248645 - RNA, 22 nt, Human
ugccagaguuacaugaggguca

SEQ ID NO: 248646 - RNA, 22 nt, Human
aggucuuaggagcauggugcug

SEQ ID NO: 248647 - RNA, 22 nt, Human
uggaaucuuuaggaagcacaua

SEQ ID NO: 248648 - RNA, 22 nt, Human
aguccaggucucugagucacaa

SEQ ID NO: 248649 - RNA, 22 nt, Human
ugcaaacaccacagagacaauu

SEQ ID NO: 248650 - RNA, 22 nt, Human
acugcaauuauuuguucaccaa

SEQ ID NO: 248651 - RNA, 22 nt, Human
aaacucuuuccacgauuacuuu

SEQ ID NO: 248652 - RNA, 22 nt, Human
acccuggguauuucccaaacuu

SEQ ID NO: 248653 - RNA, 23 nt, Human
gugcaaagauauaccacauggcu

SEQ ID NO: 248654 - RNA, 22 nt, Human
gccugagccgccugagcggcgg

SEQ ID NO: 248655 - RNA, 22 nt, Human
gcagaggaggacccaggaauua

SEQ ID NO: 248656 - RNA, 22 nt, Human
aucuuugugaaucucaacuugg

SEQ ID NO: 248657 - RNA, 22 nt, Human
acagcagggaauaugggaauug

SEQ ID NO: 248658 - RNA, 17 nt, Human
aggcuccuccuaagguc

SEQ ID NO: 248659 - RNA, 22 nt, Human
gccuccugagaagccacaggcu

SEQ ID NO: 248660 - RNA, 22 nt, Human
ucucauugcacaaugcagagug

SEQ ID NO: 248661 - RNA, 22 nt, Human
acaguauaaacuccuaaaagcc

SEQ ID NO: 248662 - RNA, 22 nt, Human
uuguucaggccugggacaguuu

SEQ ID NO: 248663 - RNA, 22 nt, Human
ugcagagauagaacuacuuucu

SEQ ID NO: 248664 - RNA, 22 nt, Human
uggcaguggauaggggagcggu

SEQ ID NO: 248665 - RNA, 22 nt, Human
ggaccugcauuuuaacaagauc

SEQ ID NO: 248666 - RNA, 22 nt, Human
uucuagauugccuguaaguaaa

SEQ ID NO: 248667 - RNA, 22 nt, Human
aaagccaggguccaggccugcc

SEQ ID NO: 248668 - RNA, 22 nt, Human
agggcucuguccccagaggccc

SEQ ID NO: 248669 - RNA, 22 nt, Human
gcugguccagggccucuguggg

SEQ ID NO: 248670 - RNA, 22 nt, Human
cccugaggggaguggugaggug

SEQ ID NO: 248671 - RNA, 22 nt, Human
cucaggucacaggauggccagg

SEQ ID NO: 248672 - RNA, 22 nt, Human
cuaggcucagucucuggucugu

SEQ ID NO: 248673 - RNA, 22 nt, Human
ucaguuuagaguuauuuaaucu

SEQ ID NO: 248674 - RNA, 22 nt, Human
ggacaguagucacuaaacuaga

SEQ ID NO: 248675 - RNA, 22 nt, Human
acuucccacugcagugacugag

SEQ ID NO: 248676 - RNA, 22 nt, Human
augguggaagagcaucagaaag

SEQ ID NO: 248677 - RNA, 22 nt, Human
uuaaaugagauguucagauauu

SEQ ID NO: 248678 - RNA, 22 nt, Human
agaauauugaaaguucuugaca

SEQ ID NO: 248679 - RNA, 22 nt, Human
aagauucuuaccuauacccagu

SEQ ID NO: 248680 - RNA, 22 nt, Human
uaauccacaauagagauuaucu

SEQ ID NO: 248681 - RNA, 20 nt, Human
agaggccaguuaggagucua

SEQ ID NO: 248682 - RNA, 22 nt, Human
cauccaaagcaaauaucuuaaa

SEQ ID NO: 248683 - RNA, 22 nt, Human
ugcauaacuagaguaauuacag

SEQ ID NO: 248684 - RNA, 22 nt, Human
ugcuguguaaaaggugauugaa

SEQ ID NO: 248685 - RNA, 22 nt, Human
uaacacuugaagccauuuuugc

SEQ ID NO: 248686 - RNA, 22 nt, Human
aaaguaguuagucaugugaaaa

SEQ ID NO: 248687 - RNA, 22 nt, Human
agucacagggggccccugcaac

SEQ ID NO: 248688 - RNA, 22 nt, Human
ugagauucccugaaugauauau

SEQ ID NO: 248689 - RNA, 22 nt, Human
ggucccaagugcuuuuccugca

SEQ ID NO: 248690 - RNA, 22 nt, Human
guucugggagaucuugagcuuc

SEQ ID NO: 248691 - RNA, 22 nt, Human
ugagucuucugccuaaagaagu

SEQ ID NO: 248692 - RNA, 22 nt, Human
uagcacugagucuagcuuugga

SEQ ID NO: 248693 - RNA, 22 nt, Human
agaaagcuuaugaaugggcaag

SEQ ID NO: 248694 - RNA, 22 nt, Human
aaagucaagguuuagacuagag

SEQ ID NO: 248695 - RNA, 22 nt, Human
acagccagucaucucagcaggg

SEQ ID NO: 248696 - RNA, 22 nt, Human
cuggaaggcucugcugccuguc

SEQ ID NO: 248697 - RNA, 22 nt, Human
auuuugaaaccaaguuauuucc

SEQ ID NO: 248698 - RNA, 20 nt, Human
cugggucacuuggcugcucu

SEQ ID NO: 248699 - RNA, 22 nt, Human
uggcugagagcaauugacucug

SEQ ID NO: 248700 - RNA, 22 nt, Human
gacagcuggcaguggaaaggug

SEQ ID NO: 248701 - RNA, 22 nt, Human
aagcauaaaacguuacaacaug

SEQ ID NO: 248702 - RNA, 17 nt, Human
cucugggcagccugggg

SEQ ID NO: 248703 - RNA, 22 nt, Human
gcucuggggcccagggaucaca

SEQ ID NO: 248704 - RNA, 22 nt, Human
gacacagcuugaugagggcuuu

SEQ ID NO: 248705 - RNA, 22 nt, Human
ucagaggaugcuguucuuuaau

SEQ ID NO: 248706 - RNA, 19 nt, Human
cugggagguguucagagaa

SEQ ID NO: 248707 - RNA, 22 nt, Human
augcacagcagugaguucagug

SEQ ID NO: 248708 - RNA, 22 nt, Human
agaaccucacgagauuccuuca

SEQ ID NO: 248709 - RNA, 22 nt, Human
cuagagaagagguuaagcauga

SEQ ID NO: 248710 - RNA, 22 nt, Human
ugucccuggacuccaggagcca

SEQ ID NO: 248711 - RNA, 20 nt, Human
cuggcuucgggaacuaguuu

SEQ ID NO: 248712 - RNA, 21 nt, Human
gcacuucugcagggcugcugg

SEQ ID NO: 248713 - RNA, 22 nt, Human
gagcuuggaugucuuuuguuca

SEQ ID NO: 248714 - RNA, 22 nt, Human
ggaggugguuugauuucuauau

SEQ ID NO: 248715 - RNA, 22 nt, Human
acacugaauauacaaugaauau

SEQ ID NO: 248716 - RNA, 22 nt, Human
cacugcagcaccaugcagggcu

SEQ ID NO: 248717 - RNA, 22 nt, Human
agcugcccugggucuugcugcu

SEQ ID NO: 248718 - RNA, 22 nt, Human
gaagccagauuuggggcauauc

SEQ ID NO: 248719 - RNA, 22 nt, Human
acucaaauagcaacggugagaa

SEQ ID NO: 248720 - RNA, 23 nt, Human
ccugggcauuggcugcagcuucu

SEQ ID NO: 248721 - RNA, 20 nt, Human
ucccuggggcccuacuuccu

SEQ ID NO: 248722 - RNA, 22 nt, Human
uacuuagagcgauaauuuauac

SEQ ID NO: 248723 - RNA, 22 nt, Human
augaaaguaccuguaauauguu

SEQ ID NO: 248724 - RNA, 22 nt, Human
guccuggcuagucguccgcgac

SEQ ID NO: 248725 - RNA, 22 nt, Human
agagaagcagggagucaucugu

SEQ ID NO: 248726 - RNA, 22 nt, Human
ucaguaauauucuuuaaaauac

SEQ ID NO: 248727 - RNA, 22 nt, Human
gacacuguuauggugagguaag

SEQ ID NO: 248728 - RNA, 22 nt, Human
agugauauuagcaaaugguuau

SEQ ID NO: 248729 - RNA, 22 nt, Human
cauggcccucuucuggagcaau

SEQ ID NO: 248730 - RNA, 22 nt, Human
caaagcaaggcucaguuugaac

SEQ ID NO: 248731 - RNA, 19 nt, Human
cuggucugucaugcucccc

SEQ ID NO: 248732 - RNA, 22 nt, Human
agugcgugggcaggcauggaag

SEQ ID NO: 248733 - RNA, 22 nt, Human
uaacugguauaucaguguacac

SEQ ID NO: 248734 - RNA, 22 nt, Human
gcucuggguagccacugccugg

SEQ ID NO: 248735 - RNA, 22 nt, Human
gugcauuucucauacacuaaau

SEQ ID NO: 248736 - RNA, 22 nt, Human
agcagguggugggccagauuug

SEQ ID NO: 248737 - RNA, 22 nt, Human
uuguaaagcugauuagaaagcc

SEQ ID NO: 248738 - RNA, 22 nt, Human
ucagagguaaaaacucacugua

SEQ ID NO: 248739 - RNA, 22 nt, Human
uguucucuuuuccugcugagcc

SEQ ID NO: 248740 - RNA, 22 nt, Human
augaauguaaguggauuucuuu

SEQ ID NO: 248741 - RNA, 22 nt, Human
aguuguauacacuuaggcagau

SEQ ID NO: 248742 - RNA, 22 nt, Human
ugagcccuaauuuacaacaucu

SEQ ID NO: 248743 - RNA, 22 nt, Human
ucuuauugguaaugauggcauu

SEQ ID NO: 248744 - RNA, 22 nt, Human
cugguuuaagcuuauauaguug

SEQ ID NO: 248745 - RNA, 21 nt, Human
uaagaacauuaucuucuuccu

SEQ ID NO: 248746 - RNA, 22 nt, Human
ggcaagucaggaaguugacauu

SEQ ID NO: 248747 - RNA, 22 nt, Human
augcaucuuuucaagguauuuc

SEQ ID NO: 248748 - RNA, 22 nt, Human
cccaguggggagcuucugccuu

SEQ ID NO: 248749 - RNA, 22 nt, Human
caugacaauaagccagcagaaa

SEQ ID NO: 248750 - RNA, 23 nt, Human
agaggccaacuucuugccccucc

SEQ ID NO: 248751 - RNA, 22 nt, Human
ggccuucugccuuucagcaaug

SEQ ID NO: 248752 - RNA, 22 nt, Human
aaauacuagaauucagaguuga

SEQ ID NO: 248753 - RNA, 22 nt, Human
ccaggccaaauucagucagcag

SEQ ID NO: 248754 - RNA, 22 nt, Human
ugagcagaacacgggauccaug

SEQ ID NO: 248755 - RNA, 22 nt, Human
agaauccuggagaagcuguacc

SEQ ID NO: 248756 - RNA, 23 nt, Human
acuaaauggggcuuugcuuaaag

SEQ ID NO: 248757 - RNA, 22 nt, Human
aguggcuaauaacagcuaaaca

SEQ ID NO: 248758 - RNA, 22 nt, Human
agauuucucuuucccuggcuga

SEQ ID NO: 248759 - RNA, 22 nt, Human
caaggcuuagguggcucccugu

SEQ ID NO: 248760 - RNA, 22 nt, Human
augcaaaugucaccacuucuaa

SEQ ID NO: 248761 - RNA, 22 nt, Human
uaccauuuacuugaaaauaaaa

SEQ ID NO: 248762 - RNA, 22 nt, Human
ccagcagagucuaggaaggagg

SEQ ID NO: 248763 - RNA, 22 nt, Human
caggcccauucuaggcuugcua

SEQ ID NO: 248764 - RNA, 22 nt, Human
auggccaguguuucccucaguu

SEQ ID NO: 248765 - RNA, 22 nt, Human
ucagugcagugaaagguuuacu

SEQ ID NO: 248766 - RNA, 22 nt, Human
cucugcccucgcacaucugcca

SEQ ID NO: 248767 - RNA, 22 nt, Human
uuucuacagaagauacacugcu

SEQ ID NO: 248768 - RNA, 22 nt, Human
cgccugggaguccacaccugcu

SEQ ID NO: 248769 - RNA, 22 nt, Human
aggcuguguucugcccucuccc

SEQ ID NO: 248770 - RNA, 22 nt, Human
uuuagggacaagggucuggggu

SEQ ID NO: 248771 - RNA, 22 nt, Human
cuccugaggacuucuauugggu

SEQ ID NO: 248772 - RNA, 22 nt, Human
ggggucugggcuuagcuggaau

SEQ ID NO: 248773 - RNA, 22 nt, Human
uacaguucacaguaucauaaau

SEQ ID NO: 248774 - RNA, 22 nt, Human
auacauacauguacacauaaau

SEQ ID NO: 248775 - RNA, 22 nt, Human
ucacaucucccuggaggacaca

SEQ ID NO: 248776 - RNA, 22 nt, Human
gggucucucucggcuccacgcg

SEQ ID NO: 248777 - RNA, 22 nt, Human
cccagccaaggugcugguguug

SEQ ID NO: 248778 - RNA, 22 nt, Human
aacugucaucuuucaaggaaga

SEQ ID NO: 248779 - RNA, 22 nt, Human
cacuugaaguuugggggacucu

SEQ ID NO: 248780 - RNA, 22 nt, Human
ucagggcauacucuucaagguc

SEQ ID NO: 248781 - RNA, 22 nt, Human
uugggaaauauggauuguuauu

SEQ ID NO: 248782 - RNA, 22 nt, Human
augcagcuucaggauuaugaug

SEQ ID NO: 248783 - RNA, 22 nt, Human
aaugauaccgccaauauuacca

SEQ ID NO: 248784 - RNA, 22 nt, Human
gagaggcuccgccacugcucag

SEQ ID NO: 248785 - RNA, 22 nt, Human
uuugcaaauuagccacccuguu

SEQ ID NO: 248786 - RNA, 22 nt, Human
acuuccaaagaagugauuacag

SEQ ID NO: 248787 - RNA, 22 nt, Human
auggcccaggccuccuguggcu

SEQ ID NO: 248788 - RNA, 22 nt, Human
agcaacagcccugagguucaug

SEQ ID NO: 248789 - RNA, 22 nt, Human
cagcuucuauuuaucuuugugu

SEQ ID NO: 248790 - RNA, 21 nt, Human
uggcaggcagcuggaagcuug

SEQ ID NO: 248791 - RNA, 22 nt, Human
aggcugaggcagguggaucacc

SEQ ID NO: 248792 - RNA, 22 nt, Human
uucaggaauaauuaucauauga

SEQ ID NO: 248793 - RNA, 22 nt, Human
cuucuuaaucccuuauauauuu

SEQ ID NO: 248794 - RNA, 20 nt, Human
aaagcaguaugcaaguagag

SEQ ID NO: 248795 - RNA, 18 nt, Human
uuucacaaccuccagagg

SEQ ID NO: 248796 - RNA, 22 nt, Human
gagacugguguuugcugggcug

SEQ ID NO: 248797 - RNA, 22 nt, Human
uuauucagcagggacuuccuuu

SEQ ID NO: 248798 - RNA, 23 nt, Human
ucuaaaauucaucauuuacguuc

SEQ ID NO: 248799 - RNA, 22 nt, Human
ggacaggugacugcccagagug

SEQ ID NO: 248800 - RNA, 22 nt, Human
auuuaauuuauagauguggaua

SEQ ID NO: 248801 - RNA, 22 nt, Human
cucagggccaaggaugcuguug

SEQ ID NO: 248802 - RNA, 22 nt, Human
aguccuuugggaaaaaugacua

SEQ ID NO: 248803 - RNA, 20 nt, Human
cuugcccagggucuccugcc

SEQ ID NO: 248804 - RNA, 22 nt, Human
gcucaggagcugacagccucaa

SEQ ID NO: 248805 - RNA, 19 nt, Human
cuggccacaccugcugguu

SEQ ID NO: 248806 - RNA, 22 nt, Human
agggcagaccacgugcaaggau

SEQ ID NO: 248807 - RNA, 22 nt, Human
ccccugccagcuaucccugaac

SEQ ID NO: 248808 - RNA, 22 nt, Human
cacaagauggucacauaagugc

SEQ ID NO: 248809 - RNA, 22 nt, Human
auucacacacauuuagagcaga

SEQ ID NO: 248810 - RNA, 22 nt, Human
uccacagaauguaagauccaca

SEQ ID NO: 248811 - RNA, 22 nt, Human
cuccuuccccuacucagcaucc

SEQ ID NO: 248812 - RNA, 22 nt, Human
cuggccuggggccucagcugcu

SEQ ID NO: 248813 - RNA, 22 nt, Human
caaaacauucucugcagcaggg

SEQ ID NO: 248814 - RNA, 22 nt, Human
uguauuuucagaguggcauuuc

SEQ ID NO: 248815 - RNA, 22 nt, Human
aaaggcuugguucuuugaugac

SEQ ID NO: 248816 - RNA, 21 nt, Human
agcaggcaaaggugaagucuu

SEQ ID NO: 248817 - RNA, 22 nt, Human
ucuggcuucuccuagagcaaug

SEQ ID NO: 248818 - RNA, 22 nt, Human
uagaggagcggcgagcugagcu

SEQ ID NO: 248819 - RNA, 22 nt, Human
uugggggcagagggagcaucug

SEQ ID NO: 248820 - RNA, 22 nt, Human
aguuacucaaggcugauauaag

SEQ ID NO: 248821 - RNA, 22 nt, Human
auaaacagaguaguugcuacug

SEQ ID NO: 248822 - RNA, 22 nt, Human
ccuggcucaaggcgaggacucc

SEQ ID NO: 248823 - RNA, 23 nt, Human
uaggggaaaaaucuucugcaauu

SEQ ID NO: 248824 - RNA, 22 nt, Human
ugggucccaggaaggaccagca

SEQ ID NO: 248825 - RNA, 22 nt, Human
cacaccagagguuaccugcaaa

SEQ ID NO: 248826 - RNA, 22 nt, Human
aggcaggcccugggccaucccg

SEQ ID NO: 248827 - RNA, 22 nt, Human
agcagggcaguuaaaggguccu

SEQ ID NO: 248828 - RNA, 22 nt, Human
ugugacccagacucaucuucuu

SEQ ID NO: 248829 - RNA, 22 nt, Human
cuuaucagauuaucugggcugu

SEQ ID NO: 248830 - RNA, 22 nt, Human
agacagugauguaagcaggagu

SEQ ID NO: 248831 - RNA, 22 nt, Human
gggcaggugaccucuuguccug

SEQ ID NO: 248832 - RNA, 21 nt, Human
cccaggcugaauuaaaaauau

SEQ ID NO: 248833 - RNA, 22 nt, Human
gccuucccucucauccugcugg

SEQ ID NO: 248834 - RNA, 22 nt, Human
ggagacacauauacagaaagag

SEQ ID NO: 248835 - RNA, 22 nt, Human
cugguuuagugaaauaggccag

SEQ ID NO: 248836 - RNA, 22 nt, Human
aggcucuggaguguggugcugg

SEQ ID NO: 248837 - RNA, 22 nt, Human
uccagcagacucaucagcaagg

SEQ ID NO: 248838 - RNA, 22 nt, Human
cagucagaaggaagaugcuuaa

SEQ ID NO: 248839 - RNA, 22 nt, Human
caguuaaaagguaugcuaccaa

SEQ ID NO: 248840 - RNA, 22 nt, Human
cucagccaugucaugccuaccu

SEQ ID NO: 248841 - RNA, 22 nt, Human
caggaaaccgcaucccaguggg

SEQ ID NO: 248842 - RNA, 22 nt, Human
uagauaucagaaauagaauuua

SEQ ID NO: 248843 - RNA, 22 nt, Human
cauucauucagcaacuguuauu

SEQ ID NO: 248844 - RNA, 22 nt, Human
uauuucacagcagcucauuuaa

SEQ ID NO: 248845 - RNA, 22 nt, Human
gagaaggcugauccuuggaguu

SEQ ID NO: 248846 - RNA, 22 nt, Human
uccaggcuggacaugaggcggg

SEQ ID NO: 248847 - RNA, 22 nt, Human
auuugagaugguaaauaacuuu

SEQ ID NO: 248848 - RNA, 22 nt, Human
ucagcuuugcaaguuagaaaau

SEQ ID NO: 248849 - RNA, 22 nt, Human
gaaugauauauuagcagauuuu

SEQ ID NO: 248850 - RNA, 22 nt, Human
ugucagaggcucagggucucag

SEQ ID NO: 248851 - RNA, 22 nt, Human
aaagacauuagcuuagauguca

SEQ ID NO: 248852 - RNA, 22 nt, Human
cauacuuucuuuuucacgcaua

SEQ ID NO: 248853 - RNA, 21 nt, Human
cacucaggguaugugccaggc

SEQ ID NO: 248854 - RNA, 22 nt, Human
uuuaaaaguuaucaucugucca

SEQ ID NO: 248855 - RNA, 20 nt, Human
gcuuccagaggaggccccgu

SEQ ID NO: 248856 - RNA, 19 nt, Human
uauuuacuucuugauugca

SEQ ID NO: 248857 - RNA, 22 nt, Human
uuucauaaucugucaagugggg

SEQ ID NO: 248858 - RNA, 22 nt, Human
uccaggaugcccgcuuuugcuu

SEQ ID NO: 248859 - RNA, 19 nt, Human
ugguggaggugcaccugac

SEQ ID NO: 248860 - RNA, 18 nt, Human
cugaaggauccaggugua

SEQ ID NO: 248861 - RNA, 22 nt, Human
aaaacaguuuaggcaucacagu

SEQ ID NO: 248862 - RNA, 23 nt, Human
ucucaugucuuuccuacaagcau

SEQ ID NO: 248863 - RNA, 22 nt, Human
ucacgugagggaccugugucug

SEQ ID NO: 248864 - RNA, 22 nt, Human
uggaagggaaaguuuggggucc

SEQ ID NO: 248865 - RNA, 20 nt, Human
uuucuggguacucucccucu

SEQ ID NO: 248866 - RNA, 19 nt, Human
aagggcugggcaccucacu

SEQ ID NO: 248867 - RNA, 22 nt, Human
cacagguguccaauaccugcuu

SEQ ID NO: 248868 - RNA, 22 nt, Human
cuggugagacgguugacaggag

SEQ ID NO: 248869 - RNA, 22 nt, Human
uauuggugggggcagagagaga

SEQ ID NO: 248870 - RNA, 23 nt, Human
ucauuucauccagccuugagagu

SEQ ID NO: 248871 - RNA, 22 nt, Human
ugcaucaaauucugaaauuagc

SEQ ID NO: 248872 - RNA, 22 nt, Human
ggucagggcucuuccaguggcu

SEQ ID NO: 248873 - RNA, 23 nt, Human
ugggagcucaagggaggcugccc

SEQ ID NO: 248874 - RNA, 22 nt, Human
ugggaagauggagugacaggca

SEQ ID NO: 248875 - RNA, 22 nt, Human
gagucucugcuauguuuucucu

SEQ ID NO: 248876 - RNA, 22 nt, Human
ggcugcuggcauugagguaggu

SEQ ID NO: 248877 - RNA, 22 nt, Human
uucuggaaguuggaaauagcag

SEQ ID NO: 248878 - RNA, 22 nt, Human
aagcccucagagccucuuugac

SEQ ID NO: 248879 - RNA, 22 nt, Human
agccuggguuaggguucuuccc

SEQ ID NO: 248880 - RNA, 22 nt, Human
ucagacauauuuuuaacaaagu

SEQ ID NO: 248881 - RNA, 22 nt, Human
caucauuuuauuaaccaagaaa

SEQ ID NO: 248882 - RNA, 22 nt, Human
agucugucuaauauuauucagg

SEQ ID NO: 248883 - RNA, 22 nt, Human
gcuuugcuggcuugaaaugcug

SEQ ID NO: 248884 - RNA, 22 nt, Human
gcaggggcugagcaccagcggg

SEQ ID NO: 248885 - RNA, 22 nt, Human
gugaauuaggcuauggcagagg

SEQ ID NO: 248886 - RNA, 22 nt, Human
gguccuuugccaucucuccacc

SEQ ID NO: 248887 - RNA, 22 nt, Human
uaaagaauaauacccauggagc

SEQ ID NO: 248888 - RNA, 22 nt, Human
cagggcaaagucuucuagaacc

SEQ ID NO: 248889 - RNA, 22 nt, Human
aauauauuugaaucaggaacaa

SEQ ID NO: 248890 - RNA, 22 nt, Human
ggcacugcccacccucacaggg

SEQ ID NO: 248891 - RNA, 22 nt, Human
ucuuuuagaaaaguugaaugua

SEQ ID NO: 248892 - RNA, 22 nt, Human
ccugggcagguguggcuucccc

SEQ ID NO: 248893 - RNA, 22 nt, Human
ugcuucaaguugaaauauucuu

SEQ ID NO: 248894 - RNA, 22 nt, Human
ggccaggagauggacaccacau

SEQ ID NO: 248895 - RNA, 22 nt, Human
acauaaguuauggauaaaaugu

SEQ ID NO: 248896 - RNA, 22 nt, Human
ugccugcaagaguuggggcuac

SEQ ID NO: 248897 - RNA, 22 nt, Human
auaucugguugguaauauaaca

SEQ ID NO: 248898 - RNA, 22 nt, Human
aggcuucacgaugggugaggug

SEQ ID NO: 248899 - RNA, 22 nt, Human
uggucuuugagagaaguugauu

SEQ ID NO: 248900 - RNA, 22 nt, Human
aagggcugagaaguggggcugg

SEQ ID NO: 248901 - RNA, 22 nt, Human
acccagagcccuuagcacagac

SEQ ID NO: 248902 - RNA, 22 nt, Human
cagaggaaaguauuucuggaag

SEQ ID NO: 248903 - RNA, 18 nt, Human
agcugcagaccaggaggu

SEQ ID NO: 248904 - RNA, 22 nt, Human
cucuuuggauguuuaugauaag

SEQ ID NO: 248905 - RNA, 22 nt, Human
cuggauggucccaugagcagcu

SEQ ID NO: 248906 - RNA, 17 nt, Human
gcuggcuucuccuugcu

SEQ ID NO: 248907 - RNA, 22 nt, Human
uccuggcugaguucccaagucg

SEQ ID NO: 248908 - RNA, 22 nt, Human
accuccccacaugguagugagu

SEQ ID NO: 248909 - RNA, 22 nt, Human
gcagggaggaagagaugcuucc

SEQ ID NO: 248910 - RNA, 22 nt, Human
aaaaagauguccugaaguuuag

SEQ ID NO: 248911 - RNA, 22 nt, Human
auuuugauaaucauguuagaga

SEQ ID NO: 248912 - RNA, 20 nt, Human
ccuuuauuauuuguaugaug

SEQ ID NO: 248913 - RNA, 22 nt, Human
uuaacacugauuguagagacac

SEQ ID NO: 248914 - RNA, 19 nt, Human
ugcaggaggacugagcaga

SEQ ID NO: 248915 - RNA, 22 nt, Human
ucagcaggcugucagcaggggc

SEQ ID NO: 248916 - RNA, 22 nt, Human
auggggggaugaaggaguccaa

SEQ ID NO: 248917 - RNA, 22 nt, Human
aggguagguguaagauagcccu

SEQ ID NO: 248918 - RNA, 22 nt, Human
aagaaucuuuccaguuuugaug

SEQ ID NO: 248919 - RNA, 22 nt, Human
guccaucuagaauuuauuucua

SEQ ID NO: 248920 - RNA, 22 nt, Human
ccugccugccugcuggccggga

SEQ ID NO: 248921 - RNA, 22 nt, Human
cuauuguuucuaugcucugagg

SEQ ID NO: 248922 - RNA, 22 nt, Human
uucaugaauggaaucaaugcuc

SEQ ID NO: 248923 - RNA, 22 nt, Human
uccagggagagccgcugcucca

SEQ ID NO: 248924 - RNA, 22 nt, Human
cagcagagaaauuaaacuucug

SEQ ID NO: 248925 - RNA, 22 nt, Human
gcuccuguuuguuuguuccuga

SEQ ID NO: 248926 - RNA, 22 nt, Human
aggggaagauuauacuuuugaa

SEQ ID NO: 248927 - RNA, 22 nt, Human
acagucucuugcuugaauacua

SEQ ID NO: 248928 - RNA, 20 nt, Human
ucucugaguuuccuaauuug

SEQ ID NO: 248929 - RNA, 22 nt, Human
uugcagggauaaaacaagugaa

SEQ ID NO: 248930 - RNA, 22 nt, Human
ggagcugugcugggugaucagg

SEQ ID NO: 248931 - RNA, 22 nt, Human
aagugacauaccuuacauaugu

SEQ ID NO: 248932 - RNA, 17 nt, Human
ggccacagagcuugggg

SEQ ID NO: 248933 - RNA, 20 nt, Human
auccaucauguccaugacuu

SEQ ID NO: 248934 - RNA, 19 nt, Human
uuccugugcugcugugucc

SEQ ID NO: 248935 - RNA, 22 nt, Human
cagagcacugcuuggaggauuu

SEQ ID NO: 248936 - RNA, 22 nt, Human
cagcucuucagugccugagaua

SEQ ID NO: 248937 - RNA, 23 nt, Human
ugcuucucugcuugacaguucug

SEQ ID NO: 248938 - RNA, 22 nt, Human
uugagaaauaagcaugucuaga

SEQ ID NO: 248939 - RNA, 22 nt, Human
auugauucuguaagucaacaau

SEQ ID NO: 248940 - RNA, 22 nt, Human
gugcaggggaucagguugcagc

SEQ ID NO: 248941 - RNA, 22 nt, Human
accugcugugauucuaauuggc

SEQ ID NO: 248942 - RNA, 19 nt, Human
uggucccauacugcuggcc

SEQ ID NO: 248943 - RNA, 22 nt, Human
uaaagcugcaggcucagaaaac

SEQ ID NO: 248944 - RNA, 22 nt, Human
auauccaagaaacaauuaauuc

SEQ ID NO: 248945 - RNA, 22 nt, Human
aggaagcuuuaugaccagcuaa

SEQ ID NO: 248946 - RNA, 22 nt, Human
gccuggcugggcaccaggggag

SEQ ID NO: 248947 - RNA, 23 nt, Human
uagagcagggaaaucugucagag

SEQ ID NO: 248948 - RNA, 22 nt, Human
uuagauguggacuuauguuauu

SEQ ID NO: 248949 - RNA, 22 nt, Human
acauuucucccugcaugccugc

SEQ ID NO: 248950 - RNA, 22 nt, Human
acaggcuugcacuaggguggca

SEQ ID NO: 248951 - RNA, 22 nt, Human
agucugguaauguagcucaacc

SEQ ID NO: 248952 - RNA, 19 nt, Human
ggccaggcugacugugguc

SEQ ID NO: 248953 - RNA, 22 nt, Human
ccauuuaguaaggaagaacagc

SEQ ID NO: 248954 - RNA, 22 nt, Human
aaaggcuugcgauuccuuguaa

SEQ ID NO: 248955 - RNA, 22 nt, Human
agaaaaagucaaggaauuggac

SEQ ID NO: 248956 - RNA, 22 nt, Human
aagcacauuaaggaacauugaa

SEQ ID NO: 248957 - RNA, 22 nt, Human
cuuucuuaauuuuuaaggacac

SEQ ID NO: 248958 - RNA, 22 nt, Human
ucaggcccuuugcugcugcccc

SEQ ID NO: 248959 - RNA, 21 nt, Human
agguuccagcagccagagaau

SEQ ID NO: 248960 - RNA, 19 nt, Human
cuguacagguugcuucugg

SEQ ID NO: 248961 - RNA, 22 nt, Human
ccucuggcuguaccacuggcac

SEQ ID NO: 248962 - RNA, 22 nt, Human
guaacacuuggcugcaaccugg

SEQ ID NO: 248963 - RNA, 22 nt, Human
gagaggcccuguggucccagcu

SEQ ID NO: 248964 - RNA, 22 nt, Human
agagcugguuuacucaggaauu

SEQ ID NO: 248965 - RNA, 22 nt, Human
aggggcugggacagagccaagc

SEQ ID NO: 248966 - RNA, 22 nt, Human
ucuggcaggaccaugaagcgua

SEQ ID NO: 248967 - RNA, 22 nt, Human
uagaaucuggaaggggcuauuc

SEQ ID NO: 248968 - RNA, 22 nt, Human
ucauccaguaugacuggugucu

SEQ ID NO: 248969 - RNA, 22 nt, Human
aagcaagcaguguggaauuuua

SEQ ID NO: 248970 - RNA, 18 nt, Human
gacagcuguccugagccc

SEQ ID NO: 248971 - RNA, 22 nt, Human
aaauuagauaugugugagacuc

SEQ ID NO: 248972 - RNA, 23 nt, Human
ccagagcucuuucaugcuuccau

SEQ ID NO: 248973 - RNA, 20 nt, Human
acuccugguaacuuuuguga

SEQ ID NO: 248974 - RNA, 22 nt, Human
uuugcuuucuugauucagauua

SEQ ID NO: 248975 - RNA, 22 nt, Human
cacccaggacaggccagaugug

SEQ ID NO: 248976 - RNA, 22 nt, Human
uuuguacauauauaaaaucugu

SEQ ID NO: 248977 - RNA, 22 nt, Human
cugggccugguguggcaccugc

SEQ ID NO: 248978 - RNA, 22 nt, Human
aagagauguggaaucauuuaca

SEQ ID NO: 248979 - RNA, 22 nt, Human
gggcagcucagccaccaugcag

SEQ ID NO: 248980 - RNA, 22 nt, Human
ggcucugaacauggggaggagu

SEQ ID NO: 248981 - RNA, 22 nt, Human
agaauaaaugcuaccuaucaca

SEQ ID NO: 248982 - RNA, 22 nt, Human
aagaacaugggugugggcauuc

SEQ ID NO: 248983 - RNA, 22 nt, Human
aagugaauuucauuccaauucu

SEQ ID NO: 248984 - RNA, 22 nt, Human
cagaggacuucccacucaucug

SEQ ID NO: 248985 - RNA, 17 nt, Human
ucuggccuuccugaacu

SEQ ID NO: 248986 - RNA, 22 nt, Human
gcaggcucaaaagcugguagga

SEQ ID NO: 248987 - RNA, 22 nt, Human
agccuggccaggccugcccagg

SEQ ID NO: 248988 - RNA, 22 nt, Human
ccugccaggccagugagcuucc

SEQ ID NO: 248989 - RNA, 23 nt, Human
ugacaggcugcuucuggcugagg

SEQ ID NO: 248990 - RNA, 22 nt, Human
gaggccuggaccagccacagag

SEQ ID NO: 248991 - RNA, 22 nt, Human
uacagggaccaauaauaacuau

SEQ ID NO: 248992 - RNA, 22 nt, Human
uacccucucccgguccagcuuu

SEQ ID NO: 248993 - RNA, 22 nt, Human
guaggguuggagagcacaacca

SEQ ID NO: 248994 - RNA, 22 nt, Human
auuagugucugugaauaauucu

SEQ ID NO: 248995 - RNA, 22 nt, Human
ugagccagccuugcagcugugc

SEQ ID NO: 248996 - RNA, 23 nt, Human
guuccuucauguggucauugguu

SEQ ID NO: 248997 - RNA, 22 nt, Human
ggguggcaggauuggcaggagu

SEQ ID NO: 248998 - RNA, 22 nt, Human
ggaaucuuugaaggauuuuaag

SEQ ID NO: 248999 - RNA, 22 nt, Human
ugggccucuggguuagucccua

SEQ ID NO: 249000 - RNA, 22 nt, Human
guccuggccucuggggguaugg

SEQ ID NO: 249001 - RNA, 22 nt, Human
uagauuuguuuccuucucucca

SEQ ID NO: 249002 - RNA, 22 nt, Human
uccaggacuuggcaggagauga

SEQ ID NO: 249003 - RNA, 22 nt, Human
acacaguggugagucuggaccu

SEQ ID NO: 249004 - RNA, 22 nt, Human
ggagggcacaggaccagaaauc

SEQ ID NO: 249005 - RNA, 22 nt, Human
gagcuguggaaggcagggacca

SEQ ID NO: 249006 - RNA, 22 nt, Human
cuggcugucuuggaggaaggag

SEQ ID NO: 249007 - RNA, 22 nt, Human
uucacauuauaaucaguucugc

SEQ ID NO: 249008 - RNA, 22 nt, Human
aguuuaacuuuggaaaacuaua

SEQ ID NO: 249009 - RNA, 22 nt, Human
agcagccagagaaugaugcagu

SEQ ID NO: 249010 - RNA, 22 nt, Human
acagaauacuacagacugguua

SEQ ID NO: 249011 - RNA, 22 nt, Human
ggaagacugcauggcauaguga

SEQ ID NO: 249012 - RNA, 22 nt, Human
aucaccaguaaguuuucaguuu

SEQ ID NO: 249013 - RNA, 22 nt, Human
cucccuccaaauaagacucggg

SEQ ID NO: 249014 - RNA, 22 nt, Human
cuguccauggugcuggacgguc

SEQ ID NO: 249015 - RNA, 22 nt, Human
acagaaguggcuucaaagagca

SEQ ID NO: 249016 - RNA, 22 nt, Human
uuuucuguaagaggacuuuaau

SEQ ID NO: 249017 - RNA, 22 nt, Human
aucugaagggaaguggaaggca

SEQ ID NO: 249018 - RNA, 22 nt, Human
ccuggagggacccuggcccugu

SEQ ID NO: 249019 - RNA, 22 nt, Human
ucaggcagcauuaaacuucagc

SEQ ID NO: 249020 - RNA, 22 nt, Human
agaagcagacucugaggcaagg

SEQ ID NO: 249021 - RNA, 22 nt, Human
gguguucaaaugaacacaugca

SEQ ID NO: 249022 - RNA, 21 nt, Human
gcuuccaagauggcaccuuga

SEQ ID NO: 249023 - RNA, 22 nt, Human
auguaccucugcauuccugccu

SEQ ID NO: 249024 - RNA, 18 nt, Human
cugauagggguggcagcu

SEQ ID NO: 249025 - RNA, 17 nt, Human
caguuggagacaagucc

SEQ ID NO: 249026 - RNA, 18 nt, Human
ccagggagcuuauuagga

SEQ ID NO: 249027 - RNA, 22 nt, Human
aagccaauggauugguugcuuu

SEQ ID NO: 249028 - RNA, 22 nt, Human
agauggucugguuauuuuuagu

SEQ ID NO: 249029 - RNA, 22 nt, Human
acugguuuuggaaaucaguaca

SEQ ID NO: 249030 - RNA, 22 nt, Human
ucuuccagcuccccacgguguc

SEQ ID NO: 249031 - RNA, 20 nt, Human
cugagcccagaucccagguc

SEQ ID NO: 249032 - RNA, 22 nt, Human
guccaugguugcuuucauguaa

SEQ ID NO: 249033 - RNA, 22 nt, Human
cugagaggcagccagagaaaau

SEQ ID NO: 249034 - RNA, 22 nt, Human
uacagaggagaccaaggcucag

SEQ ID NO: 249035 - RNA, 22 nt, Human
caaaugaaaauggcgucuugga

SEQ ID NO: 249036 - RNA, 22 nt, Human
ccucaaauuggcauuaauuaag

SEQ ID NO: 249037 - RNA, 22 nt, Human
uggcccagagcacugcugggca

SEQ ID NO: 249038 - RNA, 22 nt, Human
agcuacagcuguacucugcagg

SEQ ID NO: 249039 - RNA, 21 nt, Human
ggcugcucaccuaggucccaa

SEQ ID NO: 249040 - RNA, 22 nt, Human
gcauucuucacuaggugagagc

SEQ ID NO: 249041 - RNA, 22 nt, Human
uaggcugggccugccuuccagg

SEQ ID NO: 249042 - RNA, 22 nt, Human
aaggccuugccgaaggaugcca

SEQ ID NO: 249043 - RNA, 22 nt, Human
accugccagaauccaagccaca

SEQ ID NO: 249044 - RNA, 22 nt, Human
ucaggagcuauggacugucaaa

SEQ ID NO: 249045 - RNA, 22 nt, Human
uugaaugaaauugcuguguuau

SEQ ID NO: 249046 - RNA, 22 nt, Human
agcaggcugaugggcaugcuug

SEQ ID NO: 249047 - RNA, 22 nt, Human
gugaacaguucauuuuaucaug

SEQ ID NO: 249048 - RNA, 22 nt, Human
guggcugcaucggggugaccag

SEQ ID NO: 249049 - RNA, 22 nt, Human
aguuuuguaauucucaaaaaua

SEQ ID NO: 249050 - RNA, 22 nt, Human
uugagcucccgcuucuucuuug

SEQ ID NO: 249051 - RNA, 22 nt, Human
agcugccaucugaagaacugca

SEQ ID NO: 249052 - RNA, 22 nt, Human
acugaaugaggggugaucuggg

SEQ ID NO: 249053 - RNA, 22 nt, Human
uggaggcagguggaggagugaa

SEQ ID NO: 249054 - RNA, 22 nt, Human
cagggccucauggccggggugc

SEQ ID NO: 249055 - RNA, 22 nt, Human
uacaaaugaaccaacuuugaug

SEQ ID NO: 249056 - RNA, 22 nt, Human
aaagcagcagcacguggaagag

SEQ ID NO: 249057 - RNA, 19 nt, Human
aggagccuugagcagugag

SEQ ID NO: 249058 - RNA, 22 nt, Human
acuuagaaauucaguuuuguca

SEQ ID NO: 249059 - RNA, 22 nt, Human
agaggggcucaagcaguggucu

SEQ ID NO: 249060 - RNA, 22 nt, Human
ugagaaaacucaaagacagauc

SEQ ID NO: 249061 - RNA, 22 nt, Human
cacucugagcccaagcaggcug

SEQ ID NO: 249062 - RNA, 22 nt, Human
cagugcugccaaagggaccuug

SEQ ID NO: 249063 - RNA, 20 nt, Human
gaacuugggcaaguggcuua

SEQ ID NO: 249064 - RNA, 22 nt, Human
cuugccucugcuaaugguuucu

SEQ ID NO: 249065 - RNA, 23 nt, Human
gagugcagaauagacaugcagug

SEQ ID NO: 249066 - RNA, 21 nt, Human
gcucucagcugccugcugguu

SEQ ID NO: 249067 - RNA, 22 nt, Human
aaguacauguuguucaaaagcc

SEQ ID NO: 249068 - RNA, 22 nt, Human
uaaaaugccagaccaguucacg

SEQ ID NO: 249069 - RNA, 22 nt, Human
ugggagcaguucagguguggcu

SEQ ID NO: 249070 - RNA, 22 nt, Human
aauauuauacagucaaccucuu

SEQ ID NO: 249071 - RNA, 23 nt, Human
ccagucucacguauacaggauuu

SEQ ID NO: 249072 - RNA, 22 nt, Human
gcucaugugugauuacaguuuu

SEQ ID NO: 249073 - RNA, 22 nt, Human
uuacaaagagaaguuguagaau

SEQ ID NO: 249074 - RNA, 22 nt, Human
uaacuacuaauugaugauaaug

SEQ ID NO: 249075 - RNA, 22 nt, Human
cuuuagaauuucauguuugguc

SEQ ID NO: 249076 - RNA, 22 nt, Human
cagagcucagagcugccaggca

SEQ ID NO: 249077 - RNA, 22 nt, Human
uuuuaauccaucugguaaaccu

SEQ ID NO: 249078 - RNA, 22 nt, Human
ucagcuccucagagccucaguu

SEQ ID NO: 249079 - RNA, 22 nt, Human
ucugccagugccagaguacaua

SEQ ID NO: 249080 - RNA, 22 nt, Human
cacaaauggccguguucaaaga

SEQ ID NO: 249081 - RNA, 22 nt, Human
gcccagaguggccacuuggcuc

SEQ ID NO: 249082 - RNA, 22 nt, Human
agccaugucacauauggucauc

SEQ ID NO: 249083 - RNA, 22 nt, Human
acuauacauaaaacauuugggu

SEQ ID NO: 249084 - RNA, 22 nt, Human
uuagagcugggauggauuuucc

SEQ ID NO: 249085 - RNA, 22 nt, Human
cagacaggaauucuggcguggu

SEQ ID NO: 249086 - RNA, 22 nt, Human
gagguugggaugagggauacag

SEQ ID NO: 249087 - RNA, 22 nt, Human
guccagccagcugguccuugcc

SEQ ID NO: 249088 - RNA, 22 nt, Human
auggcuggucucccauggaaaa

SEQ ID NO: 249089 - RNA, 22 nt, Human
gcugucuucacuuccugguuuc

SEQ ID NO: 249090 - RNA, 22 nt, Human
cuccuggacauggagcggagga

SEQ ID NO: 249091 - RNA, 20 nt, Human
aggggucuagcagcagugcu

SEQ ID NO: 249092 - RNA, 22 nt, Human
cagcacauuuacucagcccuca

SEQ ID NO: 249093 - RNA, 21 nt, Human
caggccccaggccuggggugc

SEQ ID NO: 249094 - RNA, 22 nt, Human
ugauucaauuaucugaugcuuu

SEQ ID NO: 249095 - RNA, 22 nt, Human
gccacagcucacguuccccauu

SEQ ID NO: 249096 - RNA, 21 nt, Human
aguucauacugaguaacaaaa

SEQ ID NO: 249097 - RNA, 22 nt, Human
uggggcugugagacuacaggau

SEQ ID NO: 249098 - RNA, 22 nt, Human
gcagcugcuguggcaucaagcu

SEQ ID NO: 249099 - RNA, 22 nt, Human
caggacaagagggaaucgauaa

SEQ ID NO: 249100 - RNA, 22 nt, Human
cagcuucuguuuauugugugcc

SEQ ID NO: 249101 - RNA, 22 nt, Human
uggcuggcugucaguaggcugu

SEQ ID NO: 249102 - RNA, 22 nt, Human
guccacagcuggccagggccuc

SEQ ID NO: 249103 - RNA, 22 nt, Human
uagcaggcuugugaauggagcc

SEQ ID NO: 249104 - RNA, 22 nt, Human
ggcucugaauuauuccugaguc

SEQ ID NO: 249105 - RNA, 22 nt, Human
aaacuucagugaaugacuuaug

SEQ ID NO: 249106 - RNA, 22 nt, Human
uuccugugccucaggucucagc

SEQ ID NO: 249107 - RNA, 22 nt, Human
cacagcagagggagccauugaa

SEQ ID NO: 249108 - RNA, 22 nt, Human
ucuuuggaugcguuacuuuuac

SEQ ID NO: 249109 - RNA, 22 nt, Human
cugcuuuauagggcuuccaugu

SEQ ID NO: 249110 - RNA, 22 nt, Human
gcaauaaacauguuugaugcgc

SEQ ID NO: 249111 - RNA, 22 nt, Human
ggacaaaauccaaacuucuuag

SEQ ID NO: 249112 - RNA, 22 nt, Human
auccacagugcagcaagggccc

SEQ ID NO: 249113 - RNA, 19 nt, Human
gcacaggacaucugaugga

SEQ ID NO: 249114 - RNA, 22 nt, Human
gcugucuugcucacucuugcag

SEQ ID NO: 249115 - RNA, 20 nt, Human
ugcagcagaagcccaugcuc

SEQ ID NO: 249116 - RNA, 22 nt, Human
auuuucauuuugcagggugaga

SEQ ID NO: 249117 - RNA, 22 nt, Human
cuggccaggcggccccugcaug

SEQ ID NO: 249118 - RNA, 22 nt, Human
aggcaguuguugcugagcagcu

SEQ ID NO: 249119 - RNA, 22 nt, Human
gaggcugguuugccuuuuggca

SEQ ID NO: 249120 - RNA, 22 nt, Human
acacauuuauuacaugcaugug

SEQ ID NO: 249121 - RNA, 22 nt, Human
caggcaaggaggcacugaggga

SEQ ID NO: 249122 - RNA, 22 nt, Human
cuccugaggggacaggacucau

SEQ ID NO: 249123 - RNA, 22 nt, Human
uccaggccaggguaagaggaga

SEQ ID NO: 249124 - RNA, 22 nt, Human
caccagcuaauuaaaacagcag

SEQ ID NO: 249125 - RNA, 22 nt, Human
caucuuugggcugcauggaagg

SEQ ID NO: 249126 - RNA, 22 nt, Human
gagggugucugcguaacuggca

SEQ ID NO: 249127 - RNA, 22 nt, Human
uuaaauuauugagggauuguca

SEQ ID NO: 249128 - RNA, 22 nt, Human
uucuuagagaugguuaaaaaua

SEQ ID NO: 249129 - RNA, 22 nt, Human
aaacaccaagagcuagcuauua

SEQ ID NO: 249130 - RNA, 22 nt, Human
aggcaucuauacauuauguuca

SEQ ID NO: 249131 - RNA, 20 nt, Human
gagcuacacaaaugcugcuu

SEQ ID NO: 249132 - RNA, 18 nt, Human
uaggccaguauacuuuuc

SEQ ID NO: 249133 - RNA, 22 nt, Human
acaugucucuucugaaagacaa

SEQ ID NO: 249134 - RNA, 22 nt, Human
aaaauaugaaguugucaguaug

SEQ ID NO: 249135 - RNA, 22 nt, Human
ucugagaacaugcuuugaucau

SEQ ID NO: 249136 - RNA, 22 nt, Human
uuuccuuccuaaggugaagcaa

SEQ ID NO: 249137 - RNA, 22 nt, Human
uucccucuuucacugugauuuu

SEQ ID NO: 249138 - RNA, 22 nt, Human
acagguggcuuauuggcugauu

SEQ ID NO: 249139 - RNA, 22 nt, Human
gucaaacaaauuaacauaucca

SEQ ID NO: 249140 - RNA, 22 nt, Human
ggaugucucccagcaccaaagu

SEQ ID NO: 249141 - RNA, 22 nt, Human
uggcucagaugcucuuccagug

SEQ ID NO: 249142 - RNA, 21 nt, Human
uacagaaugcgcuucagucug

SEQ ID NO: 249143 - RNA, 22 nt, Human
gagcugagggucuaggaggguu

SEQ ID NO: 249144 - RNA, 22 nt, Human
gauuucuacuugaacuugcuaa

SEQ ID NO: 249145 - RNA, 22 nt, Human
acagggagccccagcauuucca

SEQ ID NO: 249146 - RNA, 22 nt, Human
ccugaggucaugguccaguguu

SEQ ID NO: 249147 - RNA, 22 nt, Human
uacacauucuagggcacaguua

SEQ ID NO: 249148 - RNA, 22 nt, Human
aaaagccaagguccucuucaga

SEQ ID NO: 249149 - RNA, 22 nt, Human
agcagcauuaugauauaucuua

SEQ ID NO: 249150 - RNA, 22 nt, Human
guucuuuugguagagugugcau

SEQ ID NO: 249151 - RNA, 22 nt, Human
uaucuagaaacagaguuuuacu

SEQ ID NO: 249152 - RNA, 22 nt, Human
ccuagagcucugcuuuaucuaa

SEQ ID NO: 249153 - RNA, 22 nt, Human
uccaguuucauagcuaaggaac

SEQ ID NO: 249154 - RNA, 22 nt, Human
cuucuucaagagaaugggagac

SEQ ID NO: 249155 - RNA, 22 nt, Human
gcagccagggcuaagcugggga

SEQ ID NO: 249156 - RNA, 22 nt, Human
cuucuucuuuuaauaaaugucu

SEQ ID NO: 249157 - RNA, 23 nt, Human
aggaggccugaaacugaggcuga

SEQ ID NO: 249158 - RNA, 22 nt, Human
auaaaugaacauucacagagcu

SEQ ID NO: 249159 - RNA, 22 nt, Human
aguauuugauacagucuucuag

SEQ ID NO: 249160 - RNA, 22 nt, Human
aguucuuuuaccaaggcaaaug

SEQ ID NO: 249161 - RNA, 22 nt, Human
guuauaaaggugauaaugguca

SEQ ID NO: 249162 - RNA, 22 nt, Human
ccuuccaaaggagccacaucug

SEQ ID NO: 249163 - RNA, 22 nt, Human
cuggacccuguuucccuagguc

SEQ ID NO: 249164 - RNA, 22 nt, Human
auuacaaguagacuaacuuuca

SEQ ID NO: 249165 - RNA, 22 nt, Human
ugacaugugucuccuuccgucu

SEQ ID NO: 249166 - RNA, 22 nt, Human
aggcacagccucccuucacaug

SEQ ID NO: 249167 - RNA, 22 nt, Human
aaagguuaagguguucaagaaa

SEQ ID NO: 249168 - RNA, 22 nt, Human
caaggcuagaaguccaacauca

SEQ ID NO: 249169 - RNA, 22 nt, Human
ccauggccaggaaagccaaggu

SEQ ID NO: 249170 - RNA, 22 nt, Human
auguaauuuauguuauccauaa

SEQ ID NO: 249171 - RNA, 22 nt, Human
aagaugauagaucugucaaugu

SEQ ID NO: 249172 - RNA, 22 nt, Human
acagcugugagggucacuugua

SEQ ID NO: 249173 - RNA, 22 nt, Human
cccagggaggcccaggcucugc

SEQ ID NO: 249174 - RNA, 20 nt, Human
ccucaggccaguuuuaaagu

SEQ ID NO: 249175 - RNA, 22 nt, Human
ugcuggaggagaagguugcuca

SEQ ID NO: 249176 - RNA, 22 nt, Human
cuccuggccacguucuugcugg

SEQ ID NO: 249177 - RNA, 22 nt, Human
ucuccuggccuuuagguuaagg

SEQ ID NO: 249178 - RNA, 22 nt, Human
ugagacaguaucgccccaaggc

SEQ ID NO: 249179 - RNA, 22 nt, Human
cuguuauuuuccucugaacucu

SEQ ID NO: 249180 - RNA, 22 nt, Human
ugugugugacaaccuaguucag

SEQ ID NO: 249181 - RNA, 22 nt, Human
caaguguccaugauagucuuag

SEQ ID NO: 249182 - RNA, 23 nt, Human
cugggcugcuugagucccuggcu

SEQ ID NO: 249183 - RNA, 22 nt, Human
gccaagagaaugugagagaaau

SEQ ID NO: 249184 - RNA, 22 nt, Human
cccugggauaccagacaccaga

SEQ ID NO: 249185 - RNA, 22 nt, Human
uggcccuguccucauuucaucu

SEQ ID NO: 249186 - RNA, 22 nt, Human
aaugcacauauauguguauaca

SEQ ID NO: 249187 - RNA, 22 nt, Human
cuguaacuuagcaugguuacua

SEQ ID NO: 249188 - RNA, 22 nt, Human
uggcagagugcagaagaggcau

SEQ ID NO: 249189 - RNA, 22 nt, Human
uuugacucuuaaguggcucaau

SEQ ID NO: 249190 - RNA, 22 nt, Human
uccaggcauaaugcccaguggu

SEQ ID NO: 249191 - RNA, 20 nt, Human
cugcuugggacacugccaga

SEQ ID NO: 249192 - RNA, 19 nt, Human
ggaccagguccugggcagc

SEQ ID NO: 249193 - RNA, 22 nt, Human
gccaggagugucccacucauuu

SEQ ID NO: 249194 - RNA, 22 nt, Human
gaaaauguuuccuguuauuugc

SEQ ID NO: 249195 - RNA, 22 nt, Human
cccugugccagagaggcaggag

SEQ ID NO: 249196 - RNA, 22 nt, Human
uaagcuggagcuucccccgucc

SEQ ID NO: 249197 - RNA, 19 nt, Human
ccuuuggauuuguuuaguc

SEQ ID NO: 249198 - RNA, 22 nt, Human
gcucuguagugggcaugugauu

SEQ ID NO: 249199 - RNA, 22 nt, Human
ggagggagguuagauucaagcu

SEQ ID NO: 249200 - RNA, 22 nt, Human
uuggagggacugagcuucaguc

SEQ ID NO: 249201 - RNA, 22 nt, Human
cacagccuuacugagauccacu

SEQ ID NO: 249202 - RNA, 22 nt, Human
gcuuucuugguucugcaggggc

SEQ ID NO: 249203 - RNA, 20 nt, Human
uuucaguuaucuugaccuuc

SEQ ID NO: 249204 - RNA, 22 nt, Human
auuuggcuguaguaacuggauc

SEQ ID NO: 249205 - RNA, 22 nt, Human
accuuagaccagcaagauauuu

SEQ ID NO: 249206 - RNA, 22 nt, Human
acuggcagcagcagcccuuggg

SEQ ID NO: 249207 - RNA, 22 nt, Human
ccuccagcugccucagucucuu

SEQ ID NO: 249208 - RNA, 22 nt, Human
uacacaggcugccucuuugcau

SEQ ID NO: 249209 - RNA, 22 nt, Human
cuucuggagcucaccaacuucc

SEQ ID NO: 249210 - RNA, 23 nt, Human
ugaggaccucucaggggccaggc

SEQ ID NO: 249211 - RNA, 22 nt, Human
uuuggcuaauuaggugcugauu

SEQ ID NO: 249212 - RNA, 21 nt, Human
gaugauggcaggcagcacugg

SEQ ID NO: 249213 - RNA, 22 nt, Human
cagcccuuuccuucucagcuuu

SEQ ID NO: 249214 - RNA, 22 nt, Human
gcuuccagcaccagcagagggg

SEQ ID NO: 249215 - RNA, 22 nt, Human
guccaugacugugacucacaug

SEQ ID NO: 249216 - RNA, 22 nt, Human
uacacagggagagauuggaaac

SEQ ID NO: 249217 - RNA, 22 nt, Human
ugaguuuuggaagacaacacaa

SEQ ID NO: 249218 - RNA, 22 nt, Human
ggcuuucaaggaaaggccucau

SEQ ID NO: 249219 - RNA, 22 nt, Human
gcgagugccgagagggcagggc

SEQ ID NO: 249220 - RNA, 23 nt, Human
ugcuggcuuccagcugcucccuc

SEQ ID NO: 249221 - RNA, 22 nt, Human
uguguucaaucccuagucucag

SEQ ID NO: 249222 - RNA, 22 nt, Human
acuuagcaauuugauuaaaaga

SEQ ID NO: 249223 - RNA, 22 nt, Human
auguuucuguccuacgagauaa

SEQ ID NO: 249224 - RNA, 22 nt, Human
uccugggguguguuuugcugcu

SEQ ID NO: 249225 - RNA, 19 nt, Human
ccagagcccgccagauggg

SEQ ID NO: 249226 - RNA, 22 nt, Human
cugcucaguaauaguccuaucu

SEQ ID NO: 249227 - RNA, 22 nt, Human
gugcagcuuccuggucucagcc

SEQ ID NO: 249228 - RNA, 23 nt, Human
uuucacauuaauguuuagcagga

SEQ ID NO: 249229 - RNA, 22 nt, Human
gagaggccugagaggcugcgga

SEQ ID NO: 249230 - RNA, 22 nt, Human
acauucuuggacuccacucuag

SEQ ID NO: 249231 - RNA, 18 nt, Human
gugcaaugaauagcagag

SEQ ID NO: 249232 - RNA, 22 nt, Human
cuuauagaauuagagagauuuu

SEQ ID NO: 249233 - RNA, 22 nt, Human
cucuuagauauggagaauuacc

SEQ ID NO: 249234 - RNA, 22 nt, Human
gcuaggagauugagcucugaag

SEQ ID NO: 249235 - RNA, 22 nt, Human
aauuucaaguggcaucuuugau

SEQ ID NO: 249236 - RNA, 22 nt, Human
aaaguaacaauaagguucuauu

SEQ ID NO: 249237 - RNA, 20 nt, Human
ucuguaauuaugccaucacu

SEQ ID NO: 249238 - RNA, 22 nt, Human
augcuucugguauaagaaaaau

SEQ ID NO: 249239 - RNA, 22 nt, Human
agcccagcccgggcugcgcuuu

SEQ ID NO: 249240 - RNA, 22 nt, Human
ucccaagugucuuggaccaggg

SEQ ID NO: 249241 - RNA, 22 nt, Human
aggaaacaugaaucugccuuga

SEQ ID NO: 249242 - RNA, 20 nt, Human
uagaaaucuuauaaaagacu

SEQ ID NO: 249243 - RNA, 22 nt, Human
aaguaacaugggaacaucugaa

SEQ ID NO: 249244 - RNA, 22 nt, Human
ugccugggugcuggcuggucac

SEQ ID NO: 249245 - RNA, 22 nt, Human
acccagcaaagauaaacuuaug

SEQ ID NO: 249246 - RNA, 22 nt, Human
uuagaacauagcaacagaauua

SEQ ID NO: 249247 - RNA, 22 nt, Human
gagcagcucgagaaggaagcag

SEQ ID NO: 249248 - RNA, 22 nt, Human
aaaugcugcagcuaguguguuu

SEQ ID NO: 249249 - RNA, 22 nt, Human
caccuagcaugaaauucagcag

SEQ ID NO: 249250 - RNA, 22 nt, Human
cccagcccacgguccugggugg

SEQ ID NO: 249251 - RNA, 22 nt, Human
agugcaugcgcuugggaggggu

SEQ ID NO: 249252 - RNA, 22 nt, Human
ccaccagcuuuggcggugacag

SEQ ID NO: 249253 - RNA, 22 nt, Human
agaguuugggugggacagcuug

SEQ ID NO: 249254 - RNA, 21 nt, Human
acccccacaccuccuuaguuc

SEQ ID NO: 249255 - RNA, 22 nt, Human
aaauugcugaccaaguauauuc

SEQ ID NO: 249256 - RNA, 22 nt, Human
gcugcuggaacaaaucacccca

SEQ ID NO: 249257 - RNA, 22 nt, Human
caaugucaugauuuuccauuag

SEQ ID NO: 249258 - RNA, 22 nt, Human
ucagaagucacuuaggaaaggg

SEQ ID NO: 249259 - RNA, 22 nt, Human
acugccucuuggugcugagaga

SEQ ID NO: 249260 - RNA, 22 nt, Human
caagcagccccaacaugaggau

SEQ ID NO: 249261 - RNA, 22 nt, Human
gugaauuuaguuuguaagaagg

SEQ ID NO: 249262 - RNA, 22 nt, Human
gcuggcaggguucucacugaaa

SEQ ID NO: 249263 - RNA, 22 nt, Human
auccugaggaaggugcagagau

SEQ ID NO: 249264 - RNA, 22 nt, Human
ucagggcaucucuuaaguggug

SEQ ID NO: 249265 - RNA, 22 nt, Human
acuguuucugccacaauagccc

SEQ ID NO: 249266 - RNA, 22 nt, Human
guccuggcccaggaguacacau

SEQ ID NO: 249267 - RNA, 22 nt, Human
ucugcuggaaaaccagggaauu

SEQ ID NO: 249268 - RNA, 22 nt, Human
uggagggcuaagcugagggaua

SEQ ID NO: 249269 - RNA, 18 nt, Human
cuguccaguagacucugc

SEQ ID NO: 249270 - RNA, 22 nt, Human
aaagugcacucucagugcugcu

SEQ ID NO: 249271 - RNA, 22 nt, Human
gacaucugaggcccucagagcc

SEQ ID NO: 249272 - RNA, 22 nt, Human
cacacuuuuggcauguuugguu

SEQ ID NO: 249273 - RNA, 21 nt, Human
aacuuguauuucuccuuauuc

SEQ ID NO: 249274 - RNA, 22 nt, Human
ugucacaugacacaaauaucua

SEQ ID NO: 249275 - RNA, 22 nt, Human
uaaggaaugcuugaauguuccu

SEQ ID NO: 249276 - RNA, 22 nt, Human
guggcccucagcaguugccaag

SEQ ID NO: 249277 - RNA, 22 nt, Human
agcacagagcucggggaaugga

SEQ ID NO: 249278 - RNA, 22 nt, Human
agggagcucuaaguagagggac

SEQ ID NO: 249279 - RNA, 22 nt, Human
gcucagggaaggccacgugaga

SEQ ID NO: 249280 - RNA, 22 nt, Human
gauucaaaaauaagcuccuauu

SEQ ID NO: 249281 - RNA, 22 nt, Human
cagaaucuacacccucagaaau

SEQ ID NO: 249282 - RNA, 22 nt, Human
gcugccaguuccuucuuacucc

SEQ ID NO: 249283 - RNA, 22 nt, Human
aauacacuauuuugugcucagu

SEQ ID NO: 249284 - RNA, 22 nt, Human
cacacauuaauaucaaaggcuc

SEQ ID NO: 249285 - RNA, 22 nt, Human
agcacaggcuuuggugugaggg

SEQ ID NO: 249286 - RNA, 22 nt, Human
cagugauuaaaacaugacagcc

SEQ ID NO: 249287 - RNA, 19 nt, Human
cucgugcacccaucaccug

SEQ ID NO: 249288 - RNA, 22 nt, Human
uucugcuuagagggcauuugca

SEQ ID NO: 249289 - RNA, 22 nt, Human
aaaguaugauuggggauuauuu

SEQ ID NO: 249290 - RNA, 22 nt, Human
gucugcccugcagacaugccuc

SEQ ID NO: 249291 - RNA, 21 nt, Human
auucuagacaacacugaaauc

SEQ ID NO: 249292 - RNA, 22 nt, Human
ccugggcucgcgcacuucaccc

SEQ ID NO: 249293 - RNA, 22 nt, Human
augucagaagcuggaugacagc

SEQ ID NO: 249294 - RNA, 22 nt, Human
augcaguaaauguuaagaaaaa

SEQ ID NO: 249295 - RNA, 22 nt, Human
auauuccauugguuucccuucu

SEQ ID NO: 249296 - RNA, 22 nt, Human
uuaaaaggcaucauaggugaau

SEQ ID NO: 249297 - RNA, 23 nt, Human
aggcaguggugguaacaugucaa

SEQ ID NO: 249298 - RNA, 22 nt, Human
ucccuuucacuuaacuagccca

SEQ ID NO: 249299 - RNA, 22 nt, Human
cuuucauuugauaagaaugcca

SEQ ID NO: 249300 - RNA, 22 nt, Human
ugauacagagcaagcaucuuuu

SEQ ID NO: 249301 - RNA, 22 nt, Human
gaggagcuugaggcuaggagcc

SEQ ID NO: 249302 - RNA, 22 nt, Human
acagacaaguaguucagacaag

SEQ ID NO: 249303 - RNA, 22 nt, Human
uagaaccuccagaguggccccc

SEQ ID NO: 249304 - RNA, 21 nt, Human
cuccucaggaccagccacagg

SEQ ID NO: 249305 - RNA, 22 nt, Human
uugccauuuauacugcaaguca

SEQ ID NO: 249306 - RNA, 22 nt, Human
ggaggcugagaaguccaagauc

SEQ ID NO: 249307 - RNA, 22 nt, Human
agaagaggggugucccuguggc

SEQ ID NO: 249308 - RNA, 18 nt, Human
uuuuacucauagcaggcc

SEQ ID NO: 249309 - RNA, 22 nt, Human
ccaggagccugggccaggcugg

SEQ ID NO: 249310 - RNA, 22 nt, Human
uauauguaagcuauguaagagu

SEQ ID NO: 249311 - RNA, 22 nt, Human
uagccagugagacccagaaaua

SEQ ID NO: 249312 - RNA, 22 nt, Human
aagccauuuguuguccuucagg

SEQ ID NO: 249313 - RNA, 22 nt, Human
acccuggagcuuuucuggcccu

SEQ ID NO: 249314 - RNA, 22 nt, Human
ugccagcccaccuuggggccuc

SEQ ID NO: 249315 - RNA, 22 nt, Human
uggcagaauuuuaaagacagau

SEQ ID NO: 249316 - RNA, 22 nt, Human
uaguuuuacuugcgaugauaau

SEQ ID NO: 249317 - RNA, 22 nt, Human
aagaguuucugggucaaggauu

SEQ ID NO: 249318 - RNA, 22 nt, Human
cugcacacauauggcuucucuc

SEQ ID NO: 249319 - RNA, 22 nt, Human
caucuuuaaaaugggaacaaca

SEQ ID NO: 249320 - RNA, 22 nt, Human
gcacaguugugacaaccaucgc

SEQ ID NO: 249321 - RNA, 22 nt, Human
ugaggggccgcccaagcacuuc

SEQ ID NO: 249322 - RNA, 22 nt, Human
cagggacagcgggacucugaca

SEQ ID NO: 249323 - RNA, 22 nt, Human
auggagacugcgucugccaucc

SEQ ID NO: 249324 - RNA, 22 nt, Human
uuggaaaauguauuucuagaag

SEQ ID NO: 249325 - RNA, 22 nt, Human
guuaacauaggcuuagggguuu

SEQ ID NO: 249326 - RNA, 22 nt, Human
agaaggaagccaggagggugca

SEQ ID NO: 249327 - RNA, 22 nt, Human
uagaauguuaagaauauguaua

SEQ ID NO: 249328 - RNA, 18 nt, Human
ccauguguuccuuuuggg

SEQ ID NO: 249329 - RNA, 22 nt, Human
cagagcagugaggaguugugua

SEQ ID NO: 249330 - RNA, 22 nt, Human
uuguaaauaguaguaagaugcc

SEQ ID NO: 249331 - RNA, 22 nt, Human
aucuuucagagcuccaucaggg

SEQ ID NO: 249332 - RNA, 22 nt, Human
augaggcauuccacucaaacuc

SEQ ID NO: 249333 - RNA, 22 nt, Human
ccuuucugacagugaugggggg

SEQ ID NO: 249334 - RNA, 22 nt, Human
ggucucagcuggaguccuuggu

SEQ ID NO: 249335 - RNA, 22 nt, Human
ccaggcuagagugcaguggcgu

SEQ ID NO: 249336 - RNA, 22 nt, Human
ucacagagaaaagcuaucacaa

SEQ ID NO: 249337 - RNA, 22 nt, Human
auuucuagauauggagaguggu

SEQ ID NO: 249338 - RNA, 22 nt, Human
uuacaacagacacauauucuaa

SEQ ID NO: 249339 - RNA, 22 nt, Human
agagaccugaagagcuuccuca

SEQ ID NO: 249340 - RNA, 22 nt, Human
cccaggaugucgaggcugcagu

SEQ ID NO: 249341 - RNA, 22 nt, Human
aaccauuugccauuaucuuaag

SEQ ID NO: 249342 - RNA, 22 nt, Human
acccuuucuuacucacacgcuc

SEQ ID NO: 249343 - RNA, 22 nt, Human
gaggagcuguucccucaccucu

SEQ ID NO: 249344 - RNA, 22 nt, Human
acagcuuuguuuucccugcuga

SEQ ID NO: 249345 - RNA, 18 nt, Human
uggcuucugaacaacugc

SEQ ID NO: 249346 - RNA, 22 nt, Human
aauguggcauugucauuauugg

SEQ ID NO: 249347 - RNA, 22 nt, Human
gugacccagguagguaagcaau

SEQ ID NO: 249348 - RNA, 22 nt, Human
cccaggcuggggcuccuccagc

SEQ ID NO: 249349 - RNA, 23 nt, Human
gagcagagcgggcggggguccug

SEQ ID NO: 249350 - RNA, 17 nt, Human
aggccucugccggugcc

SEQ ID NO: 249351 - RNA, 22 nt, Human
aaacggaaugaguaagaguauc

SEQ ID NO: 249352 - RNA, 22 nt, Human
ccuggcucuucugugucagccc

SEQ ID NO: 249353 - RNA, 22 nt, Human
cagccacuguggucuagcugca

SEQ ID NO: 249354 - RNA, 22 nt, Human
auauauuacaaaagaggaagga

SEQ ID NO: 249355 - RNA, 22 nt, Human
acaguucacuuuuuauaucaaa

SEQ ID NO: 249356 - RNA, 22 nt, Human
uucuguggcaguuugggaggug

SEQ ID NO: 249357 - RNA, 22 nt, Human
ccaggccucccuuuuccagcca

SEQ ID NO: 249358 - RNA, 22 nt, Human
uuaguacagaaucaaaagcaau

SEQ ID NO: 249359 - RNA, 22 nt, Human
agcaccaguuucgucgugacaa

SEQ ID NO: 249360 - RNA, 22 nt, Human
auucaacuuacaaaggagaaga

SEQ ID NO: 249361 - RNA, 21 nt, Human
aggagccauguggucugaugg

SEQ ID NO: 249362 - RNA, 22 nt, Human
ucacagaacaagccugguggag

SEQ ID NO: 249363 - RNA, 22 nt, Human
aguacaauuauauuuagauggu

SEQ ID NO: 249364 - RNA, 20 nt, Human
uccugcagucgcuagcgccc

SEQ ID NO: 249365 - RNA, 22 nt, Human
uucuuuaaaauagugagaaaga

SEQ ID NO: 249366 - RNA, 22 nt, Human
auugucuucugucuuauaguuc

SEQ ID NO: 249367 - RNA, 22 nt, Human
cuuuauguacuguguauuugaa

SEQ ID NO: 249368 - RNA, 22 nt, Human
ugguuucucugaacucuacgac

SEQ ID NO: 249369 - RNA, 19 nt, Human
uagagcuuguuuuaggaag

SEQ ID NO: 249370 - RNA, 22 nt, Human
aaugcuguccaauaggaacaua

SEQ ID NO: 249371 - RNA, 22 nt, Human
ucugagcuuucuugugcucaag

SEQ ID NO: 249372 - RNA, 22 nt, Human
ucccucagcaggaacuggccug

SEQ ID NO: 249373 - RNA, 22 nt, Human
auuuuccucugguuuccccaga

SEQ ID NO: 249374 - RNA, 22 nt, Human
gagccaggggucagcuccgagg

SEQ ID NO: 249375 - RNA, 21 nt, Human
uccucagggccccagagcacu

SEQ ID NO: 249376 - RNA, 22 nt, Human
ucagcauguucuuaggucacag

SEQ ID NO: 249377 - RNA, 22 nt, Human
aacuuaguuggggacaccaugg

SEQ ID NO: 249378 - RNA, 23 nt, Human
ucaagcaauaauugguaauagug

SEQ ID NO: 249379 - RNA, 22 nt, Human
uguuauugagguuacuuauaag

SEQ ID NO: 249380 - RNA, 22 nt, Human
gaagacaccuacugucauuucu

SEQ ID NO: 249381 - RNA, 22 nt, Human
ugagucuuuccaaagccgucau

SEQ ID NO: 249382 - RNA, 22 nt, Human
uuccagucuaguaccuggaugc

SEQ ID NO: 249383 - RNA, 22 nt, Human
gcuugaugauaccuaggagaug

SEQ ID NO: 249384 - RNA, 23 nt, Human
acaaugucuguucauaaaauacc

SEQ ID NO: 249385 - RNA, 22 nt, Human
acaggacuuaagucauuuauaa

SEQ ID NO: 249386 - RNA, 22 nt, Human
uugcaaaaucauuucucaggau

SEQ ID NO: 249387 - RNA, 22 nt, Human
aagaggaccaguagauaaauuu

SEQ ID NO: 249388 - RNA, 22 nt, Human
agaagcacaccugaccucuagc

SEQ ID NO: 249389 - RNA, 19 nt, Human
acagaaauuaguuauuuuc

SEQ ID NO: 249390 - RNA, 22 nt, Human
uugccaggcucugguuccagcc

SEQ ID NO: 249391 - RNA, 22 nt, Human
aagaaacaaccacugcucuccu

SEQ ID NO: 249392 - RNA, 22 nt, Human
auuuauugagagggaggggaau

SEQ ID NO: 249393 - RNA, 22 nt, Human
aaagguaguacuucuagaaggg

SEQ ID NO: 249394 - RNA, 22 nt, Human
guaaauaacugguaauuggggu

SEQ ID NO: 249395 - RNA, 22 nt, Human
uggcaaagugacuccuuggggc

SEQ ID NO: 249396 - RNA, 22 nt, Human
ccagugugguagguccacaggu

SEQ ID NO: 249397 - RNA, 22 nt, Human
auaucaaacgaaguuauuuuaa

SEQ ID NO: 249398 - RNA, 22 nt, Human
aacaaguguauuaauggaaaua

SEQ ID NO: 249399 - RNA, 22 nt, Human
auaagaggaauuacagaagagg

SEQ ID NO: 249400 - RNA, 22 nt, Human
gcuccugugaggacacagccgc

SEQ ID NO: 249401 - RNA, 22 nt, Human
aaagaagguagggcuggugacu

SEQ ID NO: 249402 - RNA, 22 nt, Human
uggcuucucuguuuuaguauuu

SEQ ID NO: 249403 - RNA, 22 nt, Human
augggcaguaacaguggcaguc

SEQ ID NO: 249404 - RNA, 22 nt, Human
ucuguuaucucaagucacaaga

SEQ ID NO: 249405 - RNA, 19 nt, Human
uccagggcuuuauggcuuu

SEQ ID NO: 249406 - RNA, 22 nt, Human
uuuaggaaauacuguccuauga

SEQ ID NO: 249407 - RNA, 22 nt, Human
agagaaaguaaagauucuaccu

SEQ ID NO: 249408 - RNA, 22 nt, Human
ugugagguaacgcugcucuguu

SEQ ID NO: 249409 - RNA, 22 nt, Human
cugcugaggccuucccuguccu

SEQ ID NO: 249410 - RNA, 20 nt, Human
uuucuugucggcuguugcug

SEQ ID NO: 249411 - RNA, 22 nt, Human
gaggaauguuauuaaaggagcu

SEQ ID NO: 249412 - RNA, 22 nt, Human
uagcaauccguugaucccuugc

SEQ ID NO: 249413 - RNA, 22 nt, Human
ucuauuaugguacuuaucauga

SEQ ID NO: 249414 - RNA, 22 nt, Human
acaaaauagaguucuccccugg

SEQ ID NO: 249415 - RNA, 22 nt, Human
ugccugucuuaauaucuggaaa

SEQ ID NO: 249416 - RNA, 22 nt, Human
gcuucucucucagacugcaagc

SEQ ID NO: 249417 - RNA, 18 nt, Human
gagggaguagcugagguu

SEQ ID NO: 249418 - RNA, 22 nt, Human
acugggcugcuugagugccuuc

SEQ ID NO: 249419 - RNA, 22 nt, Human
aggucaaggccaaaagaguggu

SEQ ID NO: 249420 - RNA, 22 nt, Human
aaagcugcuuugguuucuggaa

SEQ ID NO: 249421 - RNA, 22 nt, Human
agucucuuacccaagcagaaug

SEQ ID NO: 249422 - RNA, 22 nt, Human
uugccuuacugcauucaguaaa

SEQ ID NO: 249423 - RNA, 22 nt, Human
aagccuugccuauuugaugaca

SEQ ID NO: 249424 - RNA, 22 nt, Human
aggcuucugggauucccuuggu

SEQ ID NO: 249425 - RNA, 22 nt, Human
uucaguuuucuuuagaauguag

SEQ ID NO: 249426 - RNA, 22 nt, Human
uccugggaaguggcuggcugag

SEQ ID NO: 249427 - RNA, 22 nt, Human
ucugaaauaggagccauguaga

SEQ ID NO: 249428 - RNA, 22 nt, Human
aaauguauugcauaggauauuu

SEQ ID NO: 249429 - RNA, 22 nt, Human
cuccagcuucugcccagagacu

SEQ ID NO: 249430 - RNA, 23 nt, Human
cugcuuucccacuccaugcucuu

SEQ ID NO: 249431 - RNA, 23 nt, Human
gcuuuauaguucucccaacauua

SEQ ID NO: 249432 - RNA, 22 nt, Human
gugaccauuugacauauccuug

SEQ ID NO: 249433 - RNA, 22 nt, Human
uccuuuaugugaguuguuuccc

SEQ ID NO: 249434 - RNA, 22 nt, Human
uaaaggcuucugcagggacuga

SEQ ID NO: 249435 - RNA, 22 nt, Human
ucauuugucuggcacagggaau

SEQ ID NO: 249436 - RNA, 22 nt, Human
acaaugaauaucaugaaguacu

SEQ ID NO: 249437 - RNA, 22 nt, Human
aauugcuuguuuucggucauaa

SEQ ID NO: 249438 - RNA, 21 nt, Human
ugcaggaaguauggugccuau

SEQ ID NO: 249439 - RNA, 22 nt, Human
ucauuucucccggccaaaaacu

SEQ ID NO: 249440 - RNA, 22 nt, Human
agggauguugucaaggaugugg

SEQ ID NO: 249441 - RNA, 22 nt, Human
cuuacaaaggagaggagauagg

SEQ ID NO: 249442 - RNA, 22 nt, Human
uccuucuccuccuugagugaca

SEQ ID NO: 249443 - RNA, 22 nt, Human
aguguuuaccccaaucaguuua

SEQ ID NO: 249444 - RNA, 22 nt, Human
acuccugggugcugaccagcgu

SEQ ID NO: 249445 - RNA, 22 nt, Human
uuguuauaaagacuaaauaugu

SEQ ID NO: 249446 - RNA, 22 nt, Human
aagucagugaaaaggcaucauc

SEQ ID NO: 249447 - RNA, 22 nt, Human
ugaggcaauguccuucauccuu

SEQ ID NO: 249448 - RNA, 22 nt, Human
auagacaaugguuugccaagaa

SEQ ID NO: 249449 - RNA, 22 nt, Human
agugaucugacucccaguuaga

SEQ ID NO: 249450 - RNA, 22 nt, Human
caggagggcccgagacucuucc

SEQ ID NO: 249451 - RNA, 22 nt, Human
aggcucugcuuuucuggauaua

SEQ ID NO: 249452 - RNA, 22 nt, Human
ucccccucauuaccucauucaa

SEQ ID NO: 249453 - RNA, 22 nt, Human
ccugugaggucaucugugguaa

SEQ ID NO: 249454 - RNA, 22 nt, Human
uaaauguggagacucaggaguc

SEQ ID NO: 249455 - RNA, 16 nt, Human
caggugucagucaccu

SEQ ID NO: 249456 - RNA, 22 nt, Human
ucacaugucaaaaacuacauaa

SEQ ID NO: 249457 - RNA, 19 nt, Human
ccugugcuaggagcugacc

SEQ ID NO: 249458 - RNA, 22 nt, Human
gaaggcuguuucugguagugau

SEQ ID NO: 249459 - RNA, 22 nt, Human
uaacaggguaggagggcaugaa

SEQ ID NO: 249460 - RNA, 22 nt, Human
ggagcucauaacaagguagcca

SEQ ID NO: 249461 - RNA, 22 nt, Human
ccugagagugagugccaccuua

SEQ ID NO: 249462 - RNA, 21 nt, Human
cagaaacuugcuuugccuucu

SEQ ID NO: 249463 - RNA, 22 nt, Human
gcagguggagcaguagucuggu

SEQ ID NO: 249464 - RNA, 22 nt, Human
agccaugggagacugugggaga

SEQ ID NO: 249465 - RNA, 22 nt, Human
ugcugugggauauauguucaaa

SEQ ID NO: 249466 - RNA, 22 nt, Human
uacagauacagaucuagauaca

SEQ ID NO: 249467 - RNA, 22 nt, Human
acagaacuuccugcuggagugg

SEQ ID NO: 249468 - RNA, 22 nt, Human
ggaggccaggugggagucaucu

SEQ ID NO: 249469 - RNA, 18 nt, Human
uggggggcuugucugaag

SEQ ID NO: 249470 - RNA, 22 nt, Human
agucaguuuucuccagggggcu

SEQ ID NO: 249471 - RNA, 22 nt, Human
gcccaggacucagggugucgcg

SEQ ID NO: 249472 - RNA, 20 nt, Human
gcagggcaucuuggccccca

SEQ ID NO: 249473 - RNA, 22 nt, Human
gacuaaauuccuguucgcgaug

SEQ ID NO: 249474 - RNA, 22 nt, Human
agacacagcaauaacuacuguu

SEQ ID NO: 249475 - RNA, 22 nt, Human
gaggcuccgguaguagccuuga

SEQ ID NO: 249476 - RNA, 20 nt, Human
uauuccaaggguagagaaaa

SEQ ID NO: 249477 - RNA, 22 nt, Human
cuuuucuggccaggaacuugcc

SEQ ID NO: 249478 - RNA, 22 nt, Human
ugcuggcuccaaccuggcaucu

SEQ ID NO: 249479 - RNA, 22 nt, Human
ccuggcagcccagagcgccgcu

SEQ ID NO: 249480 - RNA, 22 nt, Human
uaacucugaauccucacagcag

SEQ ID NO: 249481 - RNA, 22 nt, Human
uccagcaugacuaguuccccau

SEQ ID NO: 249482 - RNA, 16 nt, Human
aucuaagaauguagag

SEQ ID NO: 249483 - RNA, 22 nt, Human
uauauggauagugaucauaaga

SEQ ID NO: 249484 - RNA, 20 nt, Human
acucuggggcucauuagggg

SEQ ID NO: 249485 - RNA, 22 nt, Human
augcugaagaguucaugauuau

SEQ ID NO: 249486 - RNA, 22 nt, Human
agaggccacuuugccugugaug

SEQ ID NO: 249487 - RNA, 22 nt, Human
gacccagugacucgucucugug

SEQ ID NO: 249488 - RNA, 22 nt, Human
gucauuuucuagaauuauuuga

SEQ ID NO: 249489 - RNA, 22 nt, Human
aguaugaauacagauuuucucu

SEQ ID NO: 249490 - RNA, 23 nt, Human
cacaggcagaaaucaagacggua

SEQ ID NO: 249491 - RNA, 21 nt, Human
ucuuuucucagcuuugugguu

SEQ ID NO: 249492 - RNA, 22 nt, Human
aggagggugauccgggcugguc

SEQ ID NO: 249493 - RNA, 22 nt, Human
agcuggugaggguugaggggua

SEQ ID NO: 249494 - RNA, 22 nt, Human
uccuguuuccaauuuguugggu

SEQ ID NO: 249495 - RNA, 22 nt, Human
uuuacagugagagcuuagugag

SEQ ID NO: 249496 - RNA, 22 nt, Human
augguuuauaaucuagguguga

SEQ ID NO: 249497 - RNA, 22 nt, Human
ugguccuggccuugaccccagg

SEQ ID NO: 249498 - RNA, 19 nt, Human
aggguccagggagcggcuc

SEQ ID NO: 249499 - RNA, 22 nt, Human
uccuggagaagaggggcuugga

SEQ ID NO: 249500 - RNA, 22 nt, Human
uugauuaaacaggcauauucaa

SEQ ID NO: 249501 - RNA, 22 nt, Human
agcagcuguuuguugaauuggu

SEQ ID NO: 249502 - RNA, 22 nt, Human
cagccacuguggaauagccccc

SEQ ID NO: 249503 - RNA, 22 nt, Human
aaugcaaauucuagggcccuau

SEQ ID NO: 249504 - RNA, 22 nt, Human
auuagggaaacugacuugucuc

SEQ ID NO: 249505 - RNA, 22 nt, Human
gaaaagcuuacugccacuuggc

SEQ ID NO: 249506 - RNA, 22 nt, Human
gcaggugucuucauggaacucu

SEQ ID NO: 249507 - RNA, 22 nt, Human
aaaggccacacugcucuuucuc

SEQ ID NO: 249508 - RNA, 22 nt, Human
uaaagcauaaugaauaucuaga

SEQ ID NO: 249509 - RNA, 22 nt, Human
ucugcugcacaaauucaucucu

SEQ ID NO: 249510 - RNA, 22 nt, Human
cuucauguucugccuguggaag

SEQ ID NO: 249511 - RNA, 22 nt, Human
gaggcucuggaguagguacaca

SEQ ID NO: 249512 - RNA, 22 nt, Human
caccagcuccaccagggcaggu

SEQ ID NO: 249513 - RNA, 20 nt, Human
acuguuggaaguggagaaug

SEQ ID NO: 249514 - RNA, 23 nt, Human
agggugagcaagcuauggagacc

SEQ ID NO: 249515 - RNA, 22 nt, Human
cuguccuuacugcuucuggcuu

SEQ ID NO: 249516 - RNA, 18 nt, Human
uggcuggcagugggcagc

SEQ ID NO: 249517 - RNA, 22 nt, Human
uucucuuuauguauuuaguggg

SEQ ID NO: 249518 - RNA, 22 nt, Human
cuacuucuugaucugucgaccu

SEQ ID NO: 249519 - RNA, 14 nt, Human
acaggcagauuucu

SEQ ID NO: 249520 - RNA, 22 nt, Human
acaugccagcacugcuuuucag

SEQ ID NO: 249521 - RNA, 22 nt, Human
agcucaggucauuccagggaug

SEQ ID NO: 249522 - RNA, 22 nt, Human
gucaggggccaugggccaagga

SEQ ID NO: 249523 - RNA, 22 nt, Human
gcgucuuuuagauuuuacaucu

SEQ ID NO: 249524 - RNA, 22 nt, Human
gcuuaauucuggcucaguuucc

SEQ ID NO: 249525 - RNA, 22 nt, Human
gcaguccucucauuggccuccu

SEQ ID NO: 249526 - RNA, 22 nt, Human
guuccucaugaguaccccuuaa

SEQ ID NO: 249527 - RNA, 22 nt, Human
uaagaugacuacuuaccacuga

SEQ ID NO: 249528 - RNA, 22 nt, Human
cucaccacagagccuguccagc

SEQ ID NO: 249529 - RNA, 22 nt, Human
ggaugaggaaaccacagugucc

SEQ ID NO: 249530 - RNA, 22 nt, Human
cuuuuuguguaugcuacaguug

SEQ ID NO: 249531 - RNA, 22 nt, Human
acaguguguuggaggagacugu

SEQ ID NO: 249532 - RNA, 22 nt, Human
cccaggccagaacuugguugcu

SEQ ID NO: 249533 - RNA, 22 nt, Human
cuuuuagcugcaaguguucaca

SEQ ID NO: 249534 - RNA, 22 nt, Human
auaaugguagauguccacgcag

SEQ ID NO: 249535 - RNA, 22 nt, Human
cugucuguucagauucauuacu

SEQ ID NO: 249536 - RNA, 22 nt, Human
uuuucuguuacaaaguacagcg

SEQ ID NO: 249537 - RNA, 22 nt, Human
gcccuuggaacagccuccugcu

SEQ ID NO: 249538 - RNA, 22 nt, Human
cagauauauuuuauuuggucaa

SEQ ID NO: 249539 - RNA, 22 nt, Human
uguuuacuucuuuccauggcuu

SEQ ID NO: 249540 - RNA, 22 nt, Human
agaacaaaucgauggaagccug

SEQ ID NO: 249541 - RNA, 23 nt, Human
ccaggccucucagagggugugcc

SEQ ID NO: 249542 - RNA, 22 nt, Human
gccuggcaauggccucaggaag

SEQ ID NO: 249543 - RNA, 22 nt, Human
cuccaaguauguuaaaaucuaa

SEQ ID NO: 249544 - RNA, 22 nt, Human
caggaagcaccagcccggcccc

SEQ ID NO: 249545 - RNA, 22 nt, Human
ucacagacuggucagucaacuu

SEQ ID NO: 249546 - RNA, 22 nt, Human
ccuuuauucaauuaguccuaau

SEQ ID NO: 249547 - RNA, 22 nt, Human
uccugggaaguugcaucaccgu

SEQ ID NO: 249548 - RNA, 22 nt, Human
uacaaggcuucagcucagcuau

SEQ ID NO: 249549 - RNA, 22 nt, Human
cuggcugguuacuauuucuggu

SEQ ID NO: 249550 - RNA, 22 nt, Human
ggguguagacacauguucaucu

SEQ ID NO: 249551 - RNA, 22 nt, Human
guuauguaucuugauugggugg

SEQ ID NO: 249552 - RNA, 22 nt, Human
acuuuguuuucaugaaacagcu

SEQ ID NO: 249553 - RNA, 18 nt, Human
gcauucaguagugaacaa

SEQ ID NO: 249554 - RNA, 22 nt, Human
gcauacagagaggauguggcau

SEQ ID NO: 249555 - RNA, 22 nt, Human
auuucaguguuuuaagaguuca

SEQ ID NO: 249556 - RNA, 22 nt, Human
cgcuggucaccauggcguccug

SEQ ID NO: 249557 - RNA, 22 nt, Human
uccuccaagccuuugugaagug

SEQ ID NO: 249558 - RNA, 22 nt, Human
uauuuucaccauguaucccugu

SEQ ID NO: 249559 - RNA, 22 nt, Human
aucuggaacaaagcuuaggaau

SEQ ID NO: 249560 - RNA, 22 nt, Human
auaucaaaauaaacagcaugca

SEQ ID NO: 249561 - RNA, 22 nt, Human
ugcccugguuacacuggagucc

SEQ ID NO: 249562 - RNA, 22 nt, Human
gaaguacaaaggacauggaaac

SEQ ID NO: 249563 - RNA, 18 nt, Human
ugagagccugcuuguccc

SEQ ID NO: 249564 - RNA, 22 nt, Human
gaauuuuaauaaagguuuauca

SEQ ID NO: 249565 - RNA, 22 nt, Human
ucuguucagaagaggugaaagu

SEQ ID NO: 249566 - RNA, 19 nt, Human
aaaugcuguggagggcucc

SEQ ID NO: 249567 - RNA, 22 nt, Human
guauuaguuaucuacugcugug

SEQ ID NO: 249568 - RNA, 22 nt, Human
uuuuuauaggucagggcaaguc

SEQ ID NO: 249569 - RNA, 22 nt, Human
uguggcaggcaagauguacaga

SEQ ID NO: 249570 - RNA, 22 nt, Human
ugucugaugauagugucucucc

SEQ ID NO: 249571 - RNA, 22 nt, Human
gugaauaauuuuuuaguauaag

SEQ ID NO: 249572 - RNA, 22 nt, Human
guucuauuccccuuaucuguga

SEQ ID NO: 249573 - RNA, 23 nt, Human
aggccagcgcagacaccgagcac

SEQ ID NO: 249574 - RNA, 22 nt, Human
gcucaggcccagcggcuggugu

SEQ ID NO: 249575 - RNA, 22 nt, Human
acagauggccauauuacuauau

SEQ ID NO: 249576 - RNA, 22 nt, Human
guucuuuaaccuagucucauuu

SEQ ID NO: 249577 - RNA, 22 nt, Human
ccauuguaaagaguauacuuug

SEQ ID NO: 249578 - RNA, 23 nt, Human
uuucucugagaagcaguucucua

SEQ ID NO: 249579 - RNA, 22 nt, Human
uucauauuugaaacagaaguua

SEQ ID NO: 249580 - RNA, 22 nt, Human
cucggcagguggagguuguagu

SEQ ID NO: 249581 - RNA, 22 nt, Human
ggccuugauccuccagagcacu

SEQ ID NO: 249582 - RNA, 22 nt, Human
ucugggugucacuccugccugc

SEQ ID NO: 249583 - RNA, 22 nt, Human
gccaggaggcugcuguguaggc

SEQ ID NO: 249584 - RNA, 22 nt, Human
gauauauuuggaccagagcauu

SEQ ID NO: 249585 - RNA, 22 nt, Human
cucagcaggucuuggguagggg

SEQ ID NO: 249586 - RNA, 22 nt, Human
caaggccaaagggccacuguca

SEQ ID NO: 249587 - RNA, 22 nt, Human
aaaucuguaagcaauugcucag

SEQ ID NO: 249588 - RNA, 22 nt, Human
uuuguacacaggauguuauaau

SEQ ID NO: 249589 - RNA, 22 nt, Human
gccuuccaccuaggccucugcu

SEQ ID NO: 249590 - RNA, 22 nt, Human
cauguguccuagcuauucuccu

SEQ ID NO: 249591 - RNA, 20 nt, Human
uccaggagguuaguguggcu

SEQ ID NO: 249592 - RNA, 22 nt, Human
uuuuucucuaugccaggggccu

SEQ ID NO: 249593 - RNA, 22 nt, Human
ccagcauggcaccugagaugag

SEQ ID NO: 249594 - RNA, 21 nt, Human
gcccucaggggaggauggccu

SEQ ID NO: 249595 - RNA, 22 nt, Human
ggccugaucuuugacccucauc

SEQ ID NO: 249596 - RNA, 22 nt, Human
ucugaagacauaugauauggug

SEQ ID NO: 249597 - RNA, 22 nt, Human
gggaaggcugccugagggaugg

SEQ ID NO: 249598 - RNA, 22 nt, Human
gccugccuguuggcugaggugc

SEQ ID NO: 249599 - RNA, 22 nt, Human
ucugaaauaacugaugccagau

SEQ ID NO: 249600 - RNA, 22 nt, Human
cccuggcagagggggcaggugc

SEQ ID NO: 249601 - RNA, 22 nt, Human
cauacuguaagugcaaaagugu

SEQ ID NO: 249602 - RNA, 22 nt, Human
ugccagugcuugugucugagca

SEQ ID NO: 249603 - RNA, 22 nt, Human
gaggcucuucaauaggucaaug

SEQ ID NO: 249604 - RNA, 22 nt, Human
ccuuuuucccuggagggacagc

SEQ ID NO: 249605 - RNA, 22 nt, Human
auucuucagcaggggacacuau

SEQ ID NO: 249606 - RNA, 22 nt, Human
cuucuucaauagcaagcgcaua

SEQ ID NO: 249607 - RNA, 22 nt, Human
uuacaauggguauacuuccauu

SEQ ID NO: 249608 - RNA, 22 nt, Human
gccugagauucugcauuucuaa

SEQ ID NO: 249609 - RNA, 22 nt, Human
auuuccauuuucagccauuacu

SEQ ID NO: 249610 - RNA, 22 nt, Human
aaagcaucagaucugacacuuc

SEQ ID NO: 249611 - RNA, 22 nt, Human
gggcuggcucccagguguugaa

SEQ ID NO: 249612 - RNA, 22 nt, Human
cagcagaguaggugcuacuucu

SEQ ID NO: 249613 - RNA, 18 nt, Human
aagaaucucugacucuuu

SEQ ID NO: 249614 - RNA, 22 nt, Human
cagcugguugaagaggagcugg

SEQ ID NO: 249615 - RNA, 19 nt, Human
aggaaacugucuuuuccag

SEQ ID NO: 249616 - RNA, 22 nt, Human
cuauuugggguagaagauggau

SEQ ID NO: 249617 - RNA, 19 nt, Human
cuggccaggccaggggccc

SEQ ID NO: 249618 - RNA, 22 nt, Human
cuggaagggucuacuuagcaga

SEQ ID NO: 249619 - RNA, 23 nt, Human
uuauaaauauuuucagguguguu

SEQ ID NO: 249620 - RNA, 18 nt, Human
cugggucuccaggcugcc

SEQ ID NO: 249621 - RNA, 22 nt, Human
ggccugagucccaccuggcugu

SEQ ID NO: 249622 - RNA, 15 nt, Human
ucccugggagauggu

SEQ ID NO: 249623 - RNA, 22 nt, Human
ccagggcugagcugugaccaug

SEQ ID NO: 249624 - RNA, 23 nt, Human
uacuauaacgcugugucagcucc

SEQ ID NO: 249625 - RNA, 22 nt, Human
uggaagaauaggauagaagaac

SEQ ID NO: 249626 - RNA, 20 nt, Human
cugggcucaagugagccucc

SEQ ID NO: 249627 - RNA, 19 nt, Human
gggcaaagugaucguccug

SEQ ID NO: 249628 - RNA, 22 nt, Human
caucuuuggagaaacuuccguu

SEQ ID NO: 249629 - RNA, 22 nt, Human
gacacaggaaaagcuccagccc

SEQ ID NO: 249630 - RNA, 21 nt, Human
acucauuugucugcaucuaau

SEQ ID NO: 249631 - RNA, 21 nt, Human
ggcccugguuacgccuccucu

SEQ ID NO: 249632 - RNA, 22 nt, Human
cagcccuggcuagggcgagggc

SEQ ID NO: 249633 - RNA, 17 nt, Human
uuuaaacuacuacaagg

SEQ ID NO: 249634 - RNA, 22 nt, Human
auuagcaacauggugaauaugu

SEQ ID NO: 249635 - RNA, 22 nt, Human
aauugcuuaucuuguugaauag

SEQ ID NO: 249636 - RNA, 22 nt, Human
uccaggacuuucuuaaggcacu

SEQ ID NO: 249637 - RNA, 22 nt, Human
cugggucccacagccugcuggg

SEQ ID NO: 249638 - RNA, 22 nt, Human
cagccagugugaccgaggagga

SEQ ID NO: 249639 - RNA, 22 nt, Human
uugccagggcuuugguggcauc

SEQ ID NO: 249640 - RNA, 22 nt, Human
acagagcuaauguugcauaggc

SEQ ID NO: 249641 - RNA, 22 nt, Human
cuauuucugccuaaugaccugu

SEQ ID NO: 249642 - RNA, 22 nt, Human
agccuguguugcucuggcgaua

SEQ ID NO: 249643 - RNA, 22 nt, Human
augacauaaagcuaugcuaggu

SEQ ID NO: 249644 - RNA, 22 nt, Human
cugagccagcuggcaugugcua

SEQ ID NO: 249645 - RNA, 22 nt, Human
gcugggcugcccaaccucugac

SEQ ID NO: 249646 - RNA, 22 nt, Human
ggccugugcugucagcccuagu

SEQ ID NO: 249647 - RNA, 19 nt, Human
cacuuuauuucuguuuugu

SEQ ID NO: 249648 - RNA, 22 nt, Human
caucucuucauuagcauuauug

SEQ ID NO: 249649 - RNA, 22 nt, Human
cagcaugaugcucacacaaaac

SEQ ID NO: 249650 - RNA, 22 nt, Human
uaaauucccaacucugcucuuc

SEQ ID NO: 249651 - RNA, 22 nt, Human
ucucaguggcuuccucacuuuu

SEQ ID NO: 249652 - RNA, 22 nt, Human
uuugcaauuugugcugcaaaug

SEQ ID NO: 249653 - RNA, 22 nt, Human
uccugcaggggcugaggaacca

SEQ ID NO: 249654 - RNA, 22 nt, Human
aagaacuagucuuacagccuca

SEQ ID NO: 249655 - RNA, 19 nt, Human
agcagguggguaagaaaau

SEQ ID NO: 249656 - RNA, 22 nt, Human
uuuggcuagccaagaaacaaaa

SEQ ID NO: 249657 - RNA, 22 nt, Human
ucugagcugggucuugacagcu

SEQ ID NO: 249658 - RNA, 22 nt, Human
ccuccugggacaggcuggcaca

SEQ ID NO: 249659 - RNA, 22 nt, Human
ccaggagcgggaaaaggaagaa

SEQ ID NO: 249660 - RNA, 22 nt, Human
uucucagaggagucgggagcug

SEQ ID NO: 249661 - RNA, 22 nt, Human
ugagcuucaaaguuggaucuga

SEQ ID NO: 249662 - RNA, 22 nt, Human
ucagagagugcaaaauauagcu

SEQ ID NO: 249663 - RNA, 19 nt, Human
ucccagagucuagagguug

SEQ ID NO: 249664 - RNA, 23 nt, Human
gcucuggcagcuugugucagcac

SEQ ID NO: 249665 - RNA, 22 nt, Human
uucuuugggauuguagcugucu

SEQ ID NO: 249666 - RNA, 22 nt, Human
caggcagcucaaccuugggagc

SEQ ID NO: 249667 - RNA, 22 nt, Human
uggcaggguuggccaccuuacc

SEQ ID NO: 249668 - RNA, 22 nt, Human
guucuacaugacacucaacauu

SEQ ID NO: 249669 - RNA, 17 nt, Human
uuuagaauacaauguuu

SEQ ID NO: 249670 - RNA, 22 nt, Human
gcagcucugacaaugccuggaa

SEQ ID NO: 249671 - RNA, 22 nt, Human
aggcuggcuucccaagcguccu

SEQ ID NO: 249672 - RNA, 22 nt, Human
caggcagaugcugacaagaguu

SEQ ID NO: 249673 - RNA, 22 nt, Human
ucagagaaauaauugcugaguu

SEQ ID NO: 249674 - RNA, 22 nt, Human
uagaaggcccauucauuuguuc

SEQ ID NO: 249675 - RNA, 22 nt, Human
cuacaguacuggaugcucagcc

SEQ ID NO: 249676 - RNA, 22 nt, Human
gcaggguaggugacagguaguc

SEQ ID NO: 249677 - RNA, 22 nt, Human
uucuggaucugagggggaagau

SEQ ID NO: 249678 - RNA, 22 nt, Human
aguagcagugacagcugaggua

SEQ ID NO: 249679 - RNA, 22 nt, Human
uuuguuuucuguaggccuuucc

SEQ ID NO: 249680 - RNA, 22 nt, Human
acucugccuuggugucacaaga

SEQ ID NO: 249681 - RNA, 22 nt, Human
uucucugaaggccaugcucacu

SEQ ID NO: 249682 - RNA, 22 nt, Human
cgcaggcacagaguggacagcg

SEQ ID NO: 249683 - RNA, 22 nt, Human
uugcaaauucauggaucugaau

SEQ ID NO: 249684 - RNA, 17 nt, Human
aggagcuggggguggug

SEQ ID NO: 249685 - RNA, 22 nt, Human
gcaggcuuauggggagacagag

SEQ ID NO: 249686 - RNA, 22 nt, Human
ccuuccagaggcgugacacccu

SEQ ID NO: 249687 - RNA, 22 nt, Human
cugaggccagcugcagagcucu

SEQ ID NO: 249688 - RNA, 22 nt, Human
acaguaacucuuuuacccuccu

SEQ ID NO: 249689 - RNA, 21 nt, Human
acaugucucuaaucucaguga

SEQ ID NO: 249690 - RNA, 22 nt, Human
ucagugcauuaauaauaucagu

SEQ ID NO: 249691 - RNA, 22 nt, Human
aguuggugggugugagcuggac

SEQ ID NO: 249692 - RNA, 22 nt, Human
auggaacaugaauuaauauggu

SEQ ID NO: 249693 - RNA, 22 nt, Human
guucuucagcccucagguccua

SEQ ID NO: 249694 - RNA, 22 nt, Human
cauuucugggagacaugcuaga

SEQ ID NO: 249695 - RNA, 22 nt, Human
ugucuuucugacccaagguagu

SEQ ID NO: 249696 - RNA, 22 nt, Human
uaagagcuuagcuaaggaugug

SEQ ID NO: 249697 - RNA, 22 nt, Human
cugcacagggauauggggagcu

SEQ ID NO: 249698 - RNA, 22 nt, Human
uuuuauaaagagagucaguugg

SEQ ID NO: 249699 - RNA, 22 nt, Human
uuacaagacacagugcugaagg

SEQ ID NO: 249700 - RNA, 20 nt, Human
gcucuuuguaagggaauuug

SEQ ID NO: 249701 - RNA, 22 nt, Human
cuccaggccaagauuaaguaau

SEQ ID NO: 249702 - RNA, 22 nt, Human
aaccaagcccauuacuuuacuu

SEQ ID NO: 249703 - RNA, 22 nt, Human
agcaacagaagauagagugaau

SEQ ID NO: 249704 - RNA, 23 nt, Human
ggccucuguguucugcccacaug

SEQ ID NO: 249705 - RNA, 22 nt, Human
gaaccuguaaguauagaugugg

SEQ ID NO: 249706 - RNA, 22 nt, Human
uuucaaaguugggaauuguaau

SEQ ID NO: 249707 - RNA, 19 nt, Human
ggcaggugugcuuaugcuu

SEQ ID NO: 249708 - RNA, 22 nt, Human
caugaauuauuuuucacaagau

SEQ ID NO: 249709 - RNA, 22 nt, Human
uauauuauaagcccuuucagaa

SEQ ID NO: 249710 - RNA, 22 nt, Human
uuaaaacagcgugaaucuggca

SEQ ID NO: 249711 - RNA, 22 nt, Human
acaauuagcugugugucuaucu

SEQ ID NO: 249712 - RNA, 22 nt, Human
uuccaucugcuagguaaaugaa

SEQ ID NO: 249713 - RNA, 22 nt, Human
agugcuccugaagcuugaggca

SEQ ID NO: 249714 - RNA, 22 nt, Human
aggcuggcugaaaaacacccuu

SEQ ID NO: 249715 - RNA, 22 nt, Human
cuugaaugguaugagaguaauu

SEQ ID NO: 249716 - RNA, 22 nt, Human
ucugggcugcuaugaggcagag

SEQ ID NO: 249717 - RNA, 21 nt, Human
gcaugugugggacuggauccu

SEQ ID NO: 249718 - RNA, 22 nt, Human
ugacugaaauggcgacagugaa

SEQ ID NO: 249719 - RNA, 22 nt, Human
uucuguggagguuuggaacauu

SEQ ID NO: 249720 - RNA, 22 nt, Human
auucaaacaggccaauugaccu

SEQ ID NO: 249721 - RNA, 22 nt, Human
ccaaagcaagucacaugaucaa

SEQ ID NO: 249722 - RNA, 22 nt, Human
uucugggugccaccuaagacau

SEQ ID NO: 249723 - RNA, 22 nt, Human
cugagagaaacaugacucagga

SEQ ID NO: 249724 - RNA, 22 nt, Human
ucaggcugaggucaucugcauc

SEQ ID NO: 249725 - RNA, 22 nt, Human
cagccugacuauggcugcaggu

SEQ ID NO: 249726 - RNA, 22 nt, Human
gccuccucuugagggucaggga

SEQ ID NO: 249727 - RNA, 22 nt, Human
uggugcagagagggaucuaggg

SEQ ID NO: 249728 - RNA, 22 nt, Human
uacaugcuccuuaugagaaucu

SEQ ID NO: 249729 - RNA, 22 nt, Human
gugucccaaagauuagaaauca

SEQ ID NO: 249730 - RNA, 22 nt, Human
aaacaugaauagauauuaaaca

SEQ ID NO: 249731 - RNA, 18 nt, Human
agcaugagagaggcugug

SEQ ID NO: 249732 - RNA, 22 nt, Human
caaauuuaaguuagaaagcaau

SEQ ID NO: 249733 - RNA, 22 nt, Human
aucagagcugugauucccacuc

SEQ ID NO: 249734 - RNA, 22 nt, Human
gagcucagaggcgucuuugucc

SEQ ID NO: 249735 - RNA, 22 nt, Human
uaggcuggaacuuaggcagagg

SEQ ID NO: 249736 - RNA, 16 nt, Human
uuuuauugugacagcc

SEQ ID NO: 249737 - RNA, 22 nt, Human
uacaguaccagaaaugcuaaga

SEQ ID NO: 249738 - RNA, 22 nt, Human
gacacagaauuuacucccgaua

SEQ ID NO: 249739 - RNA, 22 nt, Human
cucuuaaagaauguuccagcug

SEQ ID NO: 249740 - RNA, 22 nt, Human
uuccugggcaggacgagagucu

SEQ ID NO: 249741 - RNA, 22 nt, Human
ugcacccaugucuccacguaca

SEQ ID NO: 249742 - RNA, 22 nt, Human
ggguuccaaacauagucuuccu

SEQ ID NO: 249743 - RNA, 22 nt, Human
ggacaugauauuucaggaagac

SEQ ID NO: 249744 - RNA, 20 nt, Human
uggguccugugggagaagaa

SEQ ID NO: 249745 - RNA, 22 nt, Human
ccagcaugagacgaugaugaag

SEQ ID NO: 249746 - RNA, 23 nt, Human
gugcacagucaagcccagcuuag

SEQ ID NO: 249747 - RNA, 22 nt, Human
acugccauuuugaauaauuacu

SEQ ID NO: 249748 - RNA, 22 nt, Human
aacuucugaccucaagaacugu

SEQ ID NO: 249749 - RNA, 22 nt, Human
augaggcaaucaugguccaguu

SEQ ID NO: 249750 - RNA, 22 nt, Human
aggcuucacauuuucuaggccu

SEQ ID NO: 249751 - RNA, 22 nt, Human
ugcaggugaaaauuaugaggau

SEQ ID NO: 249752 - RNA, 22 nt, Human
aauaauaagauacuaagggagu

SEQ ID NO: 249753 - RNA, 22 nt, Human
ugaaauagaaaaacaggcuucu

SEQ ID NO: 249754 - RNA, 22 nt, Human
cccagcccccgagugucuggaa

SEQ ID NO: 249755 - RNA, 22 nt, Human
gcacaguguaccacagucccua

SEQ ID NO: 249756 - RNA, 22 nt, Human
aguccuggugacacuccucuuc

SEQ ID NO: 249757 - RNA, 22 nt, Human
cccucagcuccacccucagcag

SEQ ID NO: 249758 - RNA, 22 nt, Human
ucuggcuguuaggccugaccuu

SEQ ID NO: 249759 - RNA, 22 nt, Human
ugcaggguagaugcaggcugug

SEQ ID NO: 249760 - RNA, 22 nt, Human
uaucuuugcaaauaucucuaag

SEQ ID NO: 249761 - RNA, 22 nt, Human
aggacagugguguucuggagug

SEQ ID NO: 249762 - RNA, 22 nt, Human
acagaaacccagaaaaccucuc

SEQ ID NO: 249763 - RNA, 22 nt, Human
aauguuaauucacagccaaaua

SEQ ID NO: 249764 - RNA, 22 nt, Human
aaagaacaucggagugggcggg

SEQ ID NO: 249765 - RNA, 22 nt, Human
agaagccacaggccucgucugg

SEQ ID NO: 249766 - RNA, 22 nt, Human
gcacuuucagcaggcagacaga

SEQ ID NO: 249767 - RNA, 21 nt, Human
ugucacauguggaugguauuu

SEQ ID NO: 249768 - RNA, 22 nt, Human
gugcaguaucucugggaguggg

SEQ ID NO: 249769 - RNA, 22 nt, Human
auaggacagcagacaauuagua

SEQ ID NO: 249770 - RNA, 22 nt, Human
cugugaaacuggacagcacuug

SEQ ID NO: 249771 - RNA, 22 nt, Human
ucaaagcaugguuuugaaagac

SEQ ID NO: 249772 - RNA, 22 nt, Human
uguugccugacuuuaaaaugug

SEQ ID NO: 249773 - RNA, 22 nt, Human
uuccaauuuguggugaguuaau

SEQ ID NO: 249774 - RNA, 22 nt, Human
cagcugaggucaaagaagcagg

SEQ ID NO: 249775 - RNA, 22 nt, Human
auggcagccuguggacagucaa

SEQ ID NO: 249776 - RNA, 21 nt, Human
gccagccuguuuaccuguggu

SEQ ID NO: 249777 - RNA, 20 nt, Human
uguaaauaggcauuguaguu

SEQ ID NO: 249778 - RNA, 22 nt, Human
agcagguguuuguaucauaagg

SEQ ID NO: 249779 - RNA, 22 nt, Human
uggcauuuccucagugcucaga

SEQ ID NO: 249780 - RNA, 19 nt, Human
aagagggaaagugcuaugc

SEQ ID NO: 249781 - RNA, 22 nt, Human
accaggaagcugugagaccuuu

SEQ ID NO: 249782 - RNA, 22 nt, Human
uggcuuccagagcugcuccacc

SEQ ID NO: 249783 - RNA, 22 nt, Human
cugcuccuccccaucaggcagc

SEQ ID NO: 249784 - RNA, 22 nt, Human
cccaggguugccugccucugcu

SEQ ID NO: 249785 - RNA, 22 nt, Human
ugucagguugguuuucagagaa

SEQ ID NO: 249786 - RNA, 22 nt, Human
gauggccaaggaccacgcaucg

SEQ ID NO: 249787 - RNA, 22 nt, Human
ucuccccaguauggauucucug

SEQ ID NO: 249788 - RNA, 22 nt, Human
gcucuggcagcugauauuagga

SEQ ID NO: 249789 - RNA, 22 nt, Human
cuauuaggcuuccauuucaugc

SEQ ID NO: 249790 - RNA, 22 nt, Human
ccaggcacugcucgaggugcua

SEQ ID NO: 249791 - RNA, 22 nt, Human
augucccugagggucucucuga

SEQ ID NO: 249792 - RNA, 22 nt, Human
uuagaaaauuugcuucuuugga

SEQ ID NO: 249793 - RNA, 22 nt, Human
gagauauguuggcagcugguau

SEQ ID NO: 249794 - RNA, 22 nt, Human
uauccaaacauauagucucucu

SEQ ID NO: 249795 - RNA, 22 nt, Human
uuacaguauuguuaaacucuuu

SEQ ID NO: 249796 - RNA, 22 nt, Human
acuguguugccuucccccagcc

SEQ ID NO: 249797 - RNA, 22 nt, Human
cuccaggagguugcugcuuccu

SEQ ID NO: 249798 - RNA, 22 nt, Human
cuagggacugggaccuuaguua

SEQ ID NO: 249799 - RNA, 22 nt, Human
gccucccuguucuuccacaaua

SEQ ID NO: 249800 - RNA, 22 nt, Human
cucacuggcaagacuacaggug

SEQ ID NO: 249801 - RNA, 22 nt, Human
gagaagguggaccugaaggagc

SEQ ID NO: 249802 - RNA, 21 nt, Human
cauugagauaggagagauugu

SEQ ID NO: 249803 - RNA, 19 nt, Human
agaggcagucuccaacagg

SEQ ID NO: 249804 - RNA, 22 nt, Human
uagagcuuagagaaugaguuug

SEQ ID NO: 249805 - RNA, 22 nt, Human
cucugugcuuaugcuccauggg

SEQ ID NO: 249806 - RNA, 22 nt, Human
aacaguauugguugaacucaag

SEQ ID NO: 249807 - RNA, 22 nt, Human
agaugauauacuacauggcuuc

SEQ ID NO: 249808 - RNA, 22 nt, Human
uuuugagauggugucucgcucc

SEQ ID NO: 249809 - RNA, 20 nt, Human
gcugccuuggauggcuacac

SEQ ID NO: 249810 - RNA, 22 nt, Human
guggauggcuaguugagaaggg

SEQ ID NO: 249811 - RNA, 22 nt, Human
ucccucucuggcuggggugcgg

SEQ ID NO: 249812 - RNA, 22 nt, Human
uuaugcuaguauaguccuuaga

SEQ ID NO: 249813 - RNA, 22 nt, Human
agcacacaggccaccuccacuu

SEQ ID NO: 249814 - RNA, 19 nt, Human
cacaauuaugagacacuua

SEQ ID NO: 249815 - RNA, 22 nt, Human
cagagacaacaaguuuaacuau

SEQ ID NO: 249816 - RNA, 22 nt, Human
guguucauugcuagugaggugu

SEQ ID NO: 249817 - RNA, 22 nt, Human
ugccaucuucucuggggauguu

SEQ ID NO: 249818 - RNA, 22 nt, Human
auuugggaaugugcauuauacu

SEQ ID NO: 249819 - RNA, 22 nt, Human
uagguucagagaacugaaaaua

SEQ ID NO: 249820 - RNA, 22 nt, Human
gcaccagcugcaggguggcuga

SEQ ID NO: 249821 - RNA, 22 nt, Human
uuuaucugaggaaagcagacaa

SEQ ID NO: 249822 - RNA, 22 nt, Human
cacaggaaugaacagggaaaga

SEQ ID NO: 249823 - RNA, 22 nt, Human
agaguaaauaggagaugacagc

SEQ ID NO: 249824 - RNA, 17 nt, Human
caggucugaggccaggc

SEQ ID NO: 249825 - RNA, 22 nt, Human
ggcagugaaugaaacagaggcu

SEQ ID NO: 249826 - RNA, 19 nt, Human
ugaggcaagcuuuuucuug

SEQ ID NO: 249827 - RNA, 22 nt, Human
caugacaaaucagaggggcuug

SEQ ID NO: 249828 - RNA, 22 nt, Human
gagggcacgaaacaaccacuuc

SEQ ID NO: 249829 - RNA, 22 nt, Human
ggagucuucagauagaguauuu

SEQ ID NO: 249830 - RNA, 16 nt, Human
ugccuugcugucaguc

SEQ ID NO: 249831 - RNA, 22 nt, Human
auaagcuuugcuggagagaccu

SEQ ID NO: 249832 - RNA, 22 nt, Human
uucccugguuaaccauuuucug

SEQ ID NO: 249833 - RNA, 22 nt, Human
gguuuaaaagccaugcaugggg

SEQ ID NO: 249834 - RNA, 23 nt, Human
ugucuggggcgccagaagagaga

SEQ ID NO: 249835 - RNA, 22 nt, Human
cugggcucuaggaaccauuccu

SEQ ID NO: 249836 - RNA, 22 nt, Human
uguuacaguacuacaauucugc

SEQ ID NO: 249837 - RNA, 22 nt, Human
uggcacacagagaagacacuug

SEQ ID NO: 249838 - RNA, 21 nt, Human
agcugcaagagcaacaucuuu

SEQ ID NO: 249839 - RNA, 22 nt, Human
aagaaaacguuuugaggaguuu

SEQ ID NO: 249840 - RNA, 22 nt, Human
ggacagacaaaaauaguaagca

SEQ ID NO: 249841 - RNA, 22 nt, Human
cucucccagucaggcucaggau

SEQ ID NO: 249842 - RNA, 22 nt, Human
ugcaggaauauugaugaacuua

SEQ ID NO: 249843 - RNA, 22 nt, Human
gauauaaauuaaucaagugcaa

SEQ ID NO: 249844 - RNA, 22 nt, Human
uaguuuuaugaauugguauaau

SEQ ID NO: 249845 - RNA, 22 nt, Human
cacagguggcuucuuucaucuu

SEQ ID NO: 249846 - RNA, 22 nt, Human
ggagggcaacuuuucaguaggu

SEQ ID NO: 249847 - RNA, 22 nt, Human
cagcaucauacuaccuaaauga

SEQ ID NO: 249848 - RNA, 22 nt, Human
ucugcaggacugaggccuguuu

SEQ ID NO: 249849 - RNA, 19 nt, Human
auuuuucuuccucugugca

SEQ ID NO: 249850 - RNA, 22 nt, Human
uuuaauguauucuuuggaacca

SEQ ID NO: 249851 - RNA, 22 nt, Human
agagcacuuucgagagccggag

SEQ ID NO: 249852 - RNA, 22 nt, Human
uucacacugucccggguggaaa

SEQ ID NO: 249853 - RNA, 22 nt, Human
uggggugguaauacaccguucu

SEQ ID NO: 249854 - RNA, 22 nt, Human
aaaguguggagauugaacuaaa

SEQ ID NO: 249855 - RNA, 22 nt, Human
gcucagccgaacuucagagcag

SEQ ID NO: 249856 - RNA, 22 nt, Human
uucugaaaggcagguuguuugc

SEQ ID NO: 249857 - RNA, 22 nt, Human
gcucuggguucugauuuaugag

SEQ ID NO: 249858 - RNA, 22 nt, Human
gaccauuuccaccaugggcaca

SEQ ID NO: 249859 - RNA, 22 nt, Human
cuucauuaaccaaaaugcaaua

SEQ ID NO: 249860 - RNA, 18 nt, Human
cuuuaugugcagagcuuu

SEQ ID NO: 249861 - RNA, 22 nt, Human
acaugaaaugcagccuguaacc

SEQ ID NO: 249862 - RNA, 22 nt, Human
uucucugguuugcuguuucuga

SEQ ID NO: 249863 - RNA, 20 nt, Human
aucagcaacugccacucagu

SEQ ID NO: 249864 - RNA, 22 nt, Human
gggaaaauauuaagcaggacuu

SEQ ID NO: 249865 - RNA, 22 nt, Human
ccugagccuggcucaugcacuc

SEQ ID NO: 249866 - RNA, 22 nt, Human
ucccaggcagcuucuuucauca

SEQ ID NO: 249867 - RNA, 22 nt, Human
cauuaaaauaucucaugguguu

SEQ ID NO: 249868 - RNA, 18 nt, Human
agagaugguguagaguuu

SEQ ID NO: 249869 - RNA, 22 nt, Human
cacauuuaauccuuuauaagua

SEQ ID NO: 249870 - RNA, 22 nt, Human
ggcugggaggccgugcugaccu

SEQ ID NO: 249871 - RNA, 22 nt, Human
gaccuggccugcacagcccuua

SEQ ID NO: 249872 - RNA, 22 nt, Human
uaagaaucuauuaggaauaugu

SEQ ID NO: 249873 - RNA, 22 nt, Human
gggaggaaugcaacuuauuuag

SEQ ID NO: 249874 - RNA, 22 nt, Human
uucucauguaaaugccaucauc

SEQ ID NO: 249875 - RNA, 22 nt, Human
cagaauaaagguacaauugagu

SEQ ID NO: 249876 - RNA, 22 nt, Human
uucuaauugaccuuaggcugug

SEQ ID NO: 249877 - RNA, 22 nt, Human
caguuccuugagaaugguugcu

SEQ ID NO: 249878 - RNA, 21 nt, Human
ugucagagcuuguaggacauu

SEQ ID NO: 249879 - RNA, 22 nt, Human
ccaggcugaauauguuccaggg

SEQ ID NO: 249880 - RNA, 22 nt, Human
gguccaucucuugagcccacau

SEQ ID NO: 249881 - RNA, 22 nt, Human
agcaaucaccaccucuauauuu

SEQ ID NO: 249882 - RNA, 22 nt, Human
acagcagauuucccugggcucc

SEQ ID NO: 249883 - RNA, 18 nt, Human
aggcaggcuggagugacu

SEQ ID NO: 249884 - RNA, 19 nt, Human
uggcuucuguuuucauguu

SEQ ID NO: 249885 - RNA, 22 nt, Human
uuuacagugucuuguugacugu

SEQ ID NO: 249886 - RNA, 22 nt, Human
agccucugcacuucuuacaggu

SEQ ID NO: 249887 - RNA, 22 nt, Human
guuccguuuauaugcuggauua

SEQ ID NO: 249888 - RNA, 20 nt, Human
gcaaaauaggcucuguuggu

SEQ ID NO: 249889 - RNA, 22 nt, Human
agagcucucuucauaacggccu

SEQ ID NO: 249890 - RNA, 22 nt, Human
gguggggcugcaagcaguucgg

SEQ ID NO: 249891 - RNA, 22 nt, Human
ggagaugguggaagcuggugca

SEQ ID NO: 249892 - RNA, 22 nt, Human
agaauaaauguuggacuuagga

SEQ ID NO: 249893 - RNA, 20 nt, Human
uuguauuccuugaaucaggu

SEQ ID NO: 249894 - RNA, 22 nt, Human
uccaggcuccccugcgugcucc

SEQ ID NO: 249895 - RNA, 22 nt, Human
uucuuaaaacuuauggacaggu

SEQ ID NO: 249896 - RNA, 22 nt, Human
augcugaagagagaacuacuca

SEQ ID NO: 249897 - RNA, 23 nt, Human
ugccagcagggaaugggaaggac

SEQ ID NO: 249898 - RNA, 22 nt, Human
uggcugcacuucaacacauccu

SEQ ID NO: 249899 - RNA, 22 nt, Human
gaagcaugcuaaggauucucag

SEQ ID NO: 249900 - RNA, 20 nt, Human
ccuggcuuugcagcaugaga

SEQ ID NO: 249901 - RNA, 22 nt, Human
gcuuccagaucccaugcucuua

SEQ ID NO: 249902 - RNA, 22 nt, Human
caggacagagcccagacugugu

SEQ ID NO: 249903 - RNA, 16 nt, Human
uggcuucccagagaua

SEQ ID NO: 249904 - RNA, 22 nt, Human
gagaaaaugucagacuuggucg

SEQ ID NO: 249905 - RNA, 22 nt, Human
aggagccagaauccagacucgg

SEQ ID NO: 249906 - RNA, 22 nt, Human
aaauuauuauaggcagagcuga

SEQ ID NO: 249907 - RNA, 18 nt, Human
ggcagugcagucucaggg

SEQ ID NO: 249908 - RNA, 22 nt, Human
ugcagagagcccugccuuccuc

SEQ ID NO: 249909 - RNA, 22 nt, Human
gucugcccagaagacauccccu

SEQ ID NO: 249910 - RNA, 19 nt, Human
acagaaauguaagugagac

SEQ ID NO: 249911 - RNA, 22 nt, Human
aaagacauuagauuaacguaca

SEQ ID NO: 249912 - RNA, 22 nt, Human
aggaagccugggagguuuggga

SEQ ID NO: 249913 - RNA, 22 nt, Human
aguuacaaacacuaucaguucu

SEQ ID NO: 249914 - RNA, 22 nt, Human
uaaaagacauauaacuguagga

SEQ ID NO: 249915 - RNA, 22 nt, Human
ucaaguauuuauuucugcuggc

SEQ ID NO: 249916 - RNA, 22 nt, Human
aguuacucacugaggguuuauu

SEQ ID NO: 249917 - RNA, 20 nt, Human
agucucuguagugccugaga

SEQ ID NO: 249918 - RNA, 22 nt, Human
acacagaaccucauagccucuc

SEQ ID NO: 249919 - RNA, 20 nt, Human
auauaauaaauuuugguuac

SEQ ID NO: 249920 - RNA, 22 nt, Human
cuccuucccaugagugugggca

SEQ ID NO: 249921 - RNA, 22 nt, Human
gcagcccaauggacugagacag

SEQ ID NO: 249922 - RNA, 22 nt, Human
aaucaauguuagucaugaauuu

SEQ ID NO: 249923 - RNA, 22 nt, Human
agugucuguugaguuucaaaag

SEQ ID NO: 249924 - RNA, 22 nt, Human
aguuucagaauuuaugcagaca

SEQ ID NO: 249925 - RNA, 22 nt, Human
accacuguacagcagauauagu

SEQ ID NO: 249926 - RNA, 20 nt, Human
uccccagggcaucaggagca

SEQ ID NO: 249927 - RNA, 22 nt, Human
ggaugucugucauuaugcuuuc

SEQ ID NO: 249928 - RNA, 22 nt, Human
agggccucgaaggcagagggau

SEQ ID NO: 249929 - RNA, 22 nt, Human
gaaaugcaaauucucucucgcu

SEQ ID NO: 249930 - RNA, 22 nt, Human
gcuuuugccuacaucuuggucu

SEQ ID NO: 249931 - RNA, 18 nt, Human
acugugguuuauguguag

SEQ ID NO: 249932 - RNA, 22 nt, Human
ugucuuuagccagcagucuucu

SEQ ID NO: 249933 - RNA, 22 nt, Human
uugaaugaggaagagcacuggc

SEQ ID NO: 249934 - RNA, 22 nt, Human
auucaacuauguauagucuucu

SEQ ID NO: 249935 - RNA, 22 nt, Human
gaugaucugcaagaacuacaug

SEQ ID NO: 249936 - RNA, 22 nt, Human
uccaugagagguaacuuuacaa

SEQ ID NO: 249937 - RNA, 22 nt, Human
gacccuccuacuacccuggaaa

SEQ ID NO: 249938 - RNA, 22 nt, Human
ggcuucugagugcucugcuguu

SEQ ID NO: 249939 - RNA, 22 nt, Human
aagaguuuaugauauaacaugu

SEQ ID NO: 249940 - RNA, 22 nt, Human
auccugggcaagucaauguccc

SEQ ID NO: 249941 - RNA, 20 nt, Human
uggcaggacuggcuccaccc

SEQ ID NO: 249942 - RNA, 23 nt, Human
agugcucagggcauuaggcuaga

SEQ ID NO: 249943 - RNA, 22 nt, Human
gucuuauuagguuaacccugcu

SEQ ID NO: 249944 - RNA, 22 nt, Human
cuccagcuuuuucccaguuggc

SEQ ID NO: 249945 - RNA, 22 nt, Human
gcccugagcuagugugggcagg

SEQ ID NO: 249946 - RNA, 22 nt, Human
acccagcccagaaucuggggcc

SEQ ID NO: 249947 - RNA, 22 nt, Human
uguguccuuaugaaaauacugu

SEQ ID NO: 249948 - RNA, 22 nt, Human
ugugccuggcauucugggcuuc

SEQ ID NO: 249949 - RNA, 20 nt, Human
ugaggcaggagaauggcaug

SEQ ID NO: 249950 - RNA, 22 nt, Human
cccagcaucccagugggcagca

SEQ ID NO: 249951 - RNA, 22 nt, Human
gacaaggaaauuacuagcugga

SEQ ID NO: 249952 - RNA, 22 nt, Human
aaaguucagugccuucuauaca

SEQ ID NO: 249953 - RNA, 22 nt, Human
gacccugccaugagugacaggg

SEQ ID NO: 249954 - RNA, 22 nt, Human
acugaaaguccagcaugguaca

SEQ ID NO: 249955 - RNA, 22 nt, Human
uucauguaauuccauaagguaa

SEQ ID NO: 249956 - RNA, 22 nt, Human
ggaggccagggacccagucagc

SEQ ID NO: 249957 - RNA, 22 nt, Human
augaaagaugauuuaaaguacu

SEQ ID NO: 249958 - RNA, 22 nt, Human
ccccugaagacaauggagaggu

SEQ ID NO: 249959 - RNA, 22 nt, Human
agaguacugcugcuggguacug

SEQ ID NO: 249960 - RNA, 22 nt, Human
ggccugaggcgucccagcugug

SEQ ID NO: 249961 - RNA, 22 nt, Human
ucagaacaguucuuaauauugc

SEQ ID NO: 249962 - RNA, 22 nt, Human
uagcuuuaaaaaucaucaaagc

SEQ ID NO: 249963 - RNA, 22 nt, Human
gcugguccauuggcacugcuca

SEQ ID NO: 249964 - RNA, 22 nt, Human
uuguguguagacucagccauug

SEQ ID NO: 249965 - RNA, 22 nt, Human
agcuccugaaaagcgcuugcuu

SEQ ID NO: 249966 - RNA, 21 nt, Human
uggaaacuucuagcuuacgua

SEQ ID NO: 249967 - RNA, 22 nt, Human
uugagcccaggaggccugggug

SEQ ID NO: 249968 - RNA, 22 nt, Human
uugaggagugugaggucuccca

SEQ ID NO: 249969 - RNA, 22 nt, Human
cccuaggcugggcucuuggcuu

SEQ ID NO: 249970 - RNA, 22 nt, Human
gcagggcucaacaggacacccc

SEQ ID NO: 249971 - RNA, 22 nt, Human
acuucuaagcucaaauugguau

SEQ ID NO: 249972 - RNA, 22 nt, Human
augcaugaugaacuugcuuuca

SEQ ID NO: 249973 - RNA, 22 nt, Human
ccugaggucagccauucuugcc

SEQ ID NO: 249974 - RNA, 22 nt, Human
agggucugaccaccaguaggga

SEQ ID NO: 249975 - RNA, 17 nt, Human
gcccuggagccaggcua

SEQ ID NO: 249976 - RNA, 22 nt, Human
uccauccauaccacuuggagac

SEQ ID NO: 249977 - RNA, 22 nt, Human
ggcucugcggcgugugcgcagg

SEQ ID NO: 249978 - RNA, 22 nt, Human
aacauuucuucugaaacugagu

SEQ ID NO: 249979 - RNA, 22 nt, Human
gggaccuggucuagcacugagc

SEQ ID NO: 249980 - RNA, 22 nt, Human
guuauauuggcagaagagaaga

SEQ ID NO: 249981 - RNA, 23 nt, Human
uagugucaagagggaguguaauu

SEQ ID NO: 249982 - RNA, 22 nt, Human
caauuucuaacauuccauggau

SEQ ID NO: 249983 - RNA, 22 nt, Human
ucagucuuuuucucuuaaguac

SEQ ID NO: 249984 - RNA, 22 nt, Human
ucucuaaaguagaaaagacccc

SEQ ID NO: 249985 - RNA, 22 nt, Human
uuuuagcuguugauuguucccc

SEQ ID NO: 249986 - RNA, 18 nt, Human
ucuccuggguaggggccu

SEQ ID NO: 249987 - RNA, 22 nt, Human
gacaagauuaaccauaguuaag

SEQ ID NO: 249988 - RNA, 22 nt, Human
uuacuguuuuuaacuaauugug

SEQ ID NO: 249989 - RNA, 22 nt, Human
ugggaaggugauuuuccaaaag

SEQ ID NO: 249990 - RNA, 22 nt, Human
gccuccuguuaugccaugugcc

SEQ ID NO: 249991 - RNA, 20 nt, Human
ggcugucccgcggcugccgg

SEQ ID NO: 249992 - RNA, 22 nt, Human
uaggacuugguuugaagauuuu

SEQ ID NO: 249993 - RNA, 22 nt, Human
ucuaaguaaaauuugucauuuc

SEQ ID NO: 249994 - RNA, 22 nt, Human
aggacccacgcacaggaacccc

SEQ ID NO: 249995 - RNA, 22 nt, Human
cagaccucaguccucaguagga

SEQ ID NO: 249996 - RNA, 22 nt, Human
uguuugaacugaauaacauagu

SEQ ID NO: 249997 - RNA, 22 nt, Human
aucagagauggcuccagugcuc

SEQ ID NO: 249998 - RNA, 22 nt, Human
gucagcugggcaucugcagaug

SEQ ID NO: 249999 - RNA, 22 nt, Human
uccccucccuuccaacagagcu

SEQ ID NO: 250000 - RNA, 22 nt, Human
ggcugucuugggagcucccccg

SEQ ID NO: 250001 - RNA, 22 nt, Human
uauaggaaauaggucuucugug

SEQ ID NO: 250002 - RNA, 22 nt, Human
aggagcugaagucucugcacuc

SEQ ID NO: 250003 - RNA, 22 nt, Human
ucaggaaggcuucacacgagug

SEQ ID NO: 250004 - RNA, 20 nt, Human
cagagccaagagcagcaucu

SEQ ID NO: 250005 - RNA, 22 nt, Human
agcccaggagguggagguugca

SEQ ID NO: 250006 - RNA, 22 nt, Human
uaugcacgucuauuuaugaaga

SEQ ID NO: 250007 - RNA, 22 nt, Human
gaggcugaauggccagaagcca

SEQ ID NO: 250008 - RNA, 22 nt, Human
aguuugaauugaaaugcagaug

SEQ ID NO: 250009 - RNA, 22 nt, Human
cagggagcuuucccaggacccu

SEQ ID NO: 250010 - RNA, 22 nt, Human
uggaggaaaauuacuggggucu

SEQ ID NO: 250011 - RNA, 22 nt, Human
ucuuggcuacuuaggaggauuc

SEQ ID NO: 250012 - RNA, 22 nt, Human
gacagcuguacacuccugguua

SEQ ID NO: 250013 - RNA, 22 nt, Human
cugagugauagcgauggggaac

SEQ ID NO: 250014 - RNA, 22 nt, Human
ugguuaaguccagaaaggaagc

SEQ ID NO: 250015 - RNA, 22 nt, Human
cagaggcagaggucaucucugg

SEQ ID NO: 250016 - RNA, 22 nt, Human
auacaaagacaaaucucaaucu

SEQ ID NO: 250017 - RNA, 22 nt, Human
aggguaggguaaaugaugcauc

SEQ ID NO: 250018 - RNA, 22 nt, Human
ucuggcucuuugggugauugua

SEQ ID NO: 250019 - RNA, 22 nt, Human
uaugcacagaaguuugcugaau

SEQ ID NO: 250020 - RNA, 22 nt, Human
cacagcaauagcuaacugauac

SEQ ID NO: 250021 - RNA, 22 nt, Human
aggaugaggcuggcaggucuug

SEQ ID NO: 250022 - RNA, 22 nt, Human
ccauuuuauuagugacauuuag

SEQ ID NO: 250023 - RNA, 22 nt, Human
ggcuuccuggggccuccugcaa

SEQ ID NO: 250024 - RNA, 22 nt, Human
cugugggauucaugacauuaau

SEQ ID NO: 250025 - RNA, 22 nt, Human
cagguggucaggcagaugggcu

SEQ ID NO: 250026 - RNA, 22 nt, Human
ucaucuuuccucaaaagaucca

SEQ ID NO: 250027 - RNA, 19 nt, Human
ugggugugaccaucucugc

SEQ ID NO: 250028 - RNA, 22 nt, Human
ucuuuuccuucccuacagaucu

SEQ ID NO: 250029 - RNA, 22 nt, Human
uuacaugguuuauuuaccuaag

SEQ ID NO: 250030 - RNA, 22 nt, Human
gagcuucagagaccacuuaacu

SEQ ID NO: 250031 - RNA, 22 nt, Human
ccagagagagaggucaauggca

SEQ ID NO: 250032 - RNA, 22 nt, Human
uagagaaauaagcuuugccuug

SEQ ID NO: 250033 - RNA, 22 nt, Human
acauagaaauuuauuucuuaca

SEQ ID NO: 250034 - RNA, 22 nt, Human
ucugguuagccaauaaugccaa

SEQ ID NO: 250035 - RNA, 22 nt, Human
gcccugagccuaugagccucuc

SEQ ID NO: 250036 - RNA, 22 nt, Human
caaaggcuuccacugcauccuu

SEQ ID NO: 250037 - RNA, 22 nt, Human
ucucuggguugagaacuaggac

SEQ ID NO: 250038 - RNA, 22 nt, Human
aggaaauguaguccucaucucc

SEQ ID NO: 250039 - RNA, 22 nt, Human
cugagagguaagcagcgcagug

SEQ ID NO: 250040 - RNA, 22 nt, Human
ugcaggguggagcggaagcgga

SEQ ID NO: 250041 - RNA, 22 nt, Human
uuccuccagccuggagcacuuc

SEQ ID NO: 250042 - RNA, 22 nt, Human
acagaauaacucuugcuugagu

SEQ ID NO: 250043 - RNA, 22 nt, Human
cagcaagucauccaggaugaug

SEQ ID NO: 250044 - RNA, 22 nt, Human
aggaaggacuccaugguccguc

SEQ ID NO: 250045 - RNA, 22 nt, Human
uccaguuuacaggguugcuuuu

SEQ ID NO: 250046 - RNA, 22 nt, Human
uaacauauuguguggcacuagg

SEQ ID NO: 250047 - RNA, 22 nt, Human
agggccuguccgcucccgcccg

SEQ ID NO: 250048 - RNA, 22 nt, Human
ucucucagaacugcagcugcag

SEQ ID NO: 250049 - RNA, 22 nt, Human
aauaauacaugagauuaauguu

SEQ ID NO: 250050 - RNA, 22 nt, Human
uauuucuguaacucagggucug

SEQ ID NO: 250051 - RNA, 19 nt, Human
cacaugagggcugagggac

SEQ ID NO: 250052 - RNA, 22 nt, Human
uggcuucugcauauuuuuagag

SEQ ID NO: 250053 - RNA, 22 nt, Human
uugugcugagcuucuagcugug

SEQ ID NO: 250054 - RNA, 22 nt, Human
ccucugggugggaggccgggcg

SEQ ID NO: 250055 - RNA, 22 nt, Human
guggccagcaagugcugccucu

SEQ ID NO: 250056 - RNA, 22 nt, Human
ugaguuauauauacuggcucug

SEQ ID NO: 250057 - RNA, 22 nt, Human
uccugggagcauggugccguga

SEQ ID NO: 250058 - RNA, 22 nt, Human
ucuccacaccagaaggagcuga

SEQ ID NO: 250059 - RNA, 22 nt, Human
aaagacuugggagcaguaugcu

SEQ ID NO: 250060 - RNA, 22 nt, Human
uucuucagauggugagaccucc

SEQ ID NO: 250061 - RNA, 22 nt, Human
cagcaggugcaggugcggccgc

SEQ ID NO: 250062 - RNA, 22 nt, Human
gcacacagggauuuuugaaugg

SEQ ID NO: 250063 - RNA, 22 nt, Human
aaaccacacuuagcaguuucgu

SEQ ID NO: 250064 - RNA, 21 nt, Human
accaguuuggggggcuuccug

SEQ ID NO: 250065 - RNA, 22 nt, Human
uaauuauuaugacaacaauugc

SEQ ID NO: 250066 - RNA, 22 nt, Human
auuagaaugcaggguucauugu

SEQ ID NO: 250067 - RNA, 22 nt, Human
uggcaggaggaugaggcggcua

SEQ ID NO: 250068 - RNA, 21 nt, Human
ccuaggaggcuuaauuaggcu

SEQ ID NO: 250069 - RNA, 22 nt, Human
caaaugauagagccgauuauca

SEQ ID NO: 250070 - RNA, 22 nt, Human
uguggcugggaagaagguaacu

SEQ ID NO: 250071 - RNA, 22 nt, Human
uuucugggacuggggagauucu

SEQ ID NO: 250072 - RNA, 22 nt, Human
aaggcagauaagaauucagcaa

SEQ ID NO: 250073 - RNA, 22 nt, Human
acaguauacauugauuaggacc

SEQ ID NO: 250074 - RNA, 22 nt, Human
guucaagguuuuacagagugua

SEQ ID NO: 250075 - RNA, 22 nt, Human
cucugcaggcacccaggguggg

SEQ ID NO: 250076 - RNA, 22 nt, Human
gcagguggucacucauccccag

SEQ ID NO: 250077 - RNA, 22 nt, Human
uucauguaccguguaccaggca

SEQ ID NO: 250078 - RNA, 22 nt, Human
ggcagcaguccauggcccaagg

SEQ ID NO: 250079 - RNA, 22 nt, Human
cuccugggaaaugaaggggcag

SEQ ID NO: 250080 - RNA, 22 nt, Human
cacagcagggaugaauggagug

SEQ ID NO: 250081 - RNA, 22 nt, Human
caggccacgccccggcguguga

SEQ ID NO: 250082 - RNA, 22 nt, Human
caggcucccacaagcucccagc

SEQ ID NO: 250083 - RNA, 22 nt, Human
ucccagagacagagccuccucc

SEQ ID NO: 250084 - RNA, 21 nt, Human
cagcccagcuucuuccccagu

SEQ ID NO: 250085 - RNA, 22 nt, Human
gaagcagugugaacccauguaa

SEQ ID NO: 250086 - RNA, 22 nt, Human
ugaguauuuucccuaucaaugu

SEQ ID NO: 250087 - RNA, 22 nt, Human
caaaguccuagaacagugcuug

SEQ ID NO: 250088 - RNA, 22 nt, Human
gcagcccaggacccuggacaga

SEQ ID NO: 250089 - RNA, 22 nt, Human
uggaaaacaaagcucucauuau

SEQ ID NO: 250090 - RNA, 22 nt, Human
uuccacggggcuccccgcucuu

SEQ ID NO: 250091 - RNA, 22 nt, Human
auuuaagaggcugcuagaguau

SEQ ID NO: 250092 - RNA, 22 nt, Human
uuauugccugauugaggucauu

SEQ ID NO: 250093 - RNA, 22 nt, Human
ggagccugaaaagucugcauuu

SEQ ID NO: 250094 - RNA, 22 nt, Human
acugggcuguuccuuauuucua

SEQ ID NO: 250095 - RNA, 22 nt, Human
acaggucuacuggcaagcagug

SEQ ID NO: 250096 - RNA, 22 nt, Human
cccacagggcugcugauggcag

SEQ ID NO: 250097 - RNA, 22 nt, Human
uuacagauacuuuguaggcaag

SEQ ID NO: 250098 - RNA, 22 nt, Human
caugugaauuccaaagcuaggu

SEQ ID NO: 250099 - RNA, 18 nt, Human
uaagagcagacuguaggc

SEQ ID NO: 250100 - RNA, 22 nt, Human
ccucagagcgcguggcauuauu

SEQ ID NO: 250101 - RNA, 22 nt, Human
ugccucagagugggcuugcuau

SEQ ID NO: 250102 - RNA, 22 nt, Human
gguagcugcagcaggcuggcaa

SEQ ID NO: 250103 - RNA, 22 nt, Human
ugggagagcagagaacccucuu

SEQ ID NO: 250104 - RNA, 22 nt, Human
ccagguaacuugagaacaugag

SEQ ID NO: 250105 - RNA, 22 nt, Human
uuagagaauuccaaaugacuac

SEQ ID NO: 250106 - RNA, 22 nt, Human
uugcaacacaaaguuugauucc

SEQ ID NO: 250107 - RNA, 22 nt, Human
aaauuuaaggaggugcucacuu

SEQ ID NO: 250108 - RNA, 22 nt, Human
guaucuuuuacaccaggaaauu

SEQ ID NO: 250109 - RNA, 22 nt, Human
aaggagcucuuaaaaucagaga

SEQ ID NO: 250110 - RNA, 22 nt, Human
cuggauccaucgggucccgagu

SEQ ID NO: 250111 - RNA, 20 nt, Human
uugagcuuccaagucuuugu

SEQ ID NO: 250112 - RNA, 22 nt, Human
ucucagggcucagagcucaggc

SEQ ID NO: 250113 - RNA, 22 nt, Human
cuuaauuuaagccuagaaugca

SEQ ID NO: 250114 - RNA, 22 nt, Human
uucaguuucuaaagauguuccu

SEQ ID NO: 250115 - RNA, 22 nt, Human
cacaguuuuaucuuauacugau

SEQ ID NO: 250116 - RNA, 22 nt, Human
gugugcagcagagacaggacuc

SEQ ID NO: 250117 - RNA, 22 nt, Human
ugcuucaggagaugucaccaug

SEQ ID NO: 250118 - RNA, 22 nt, Human
uacagacaaagugcuauagggu

SEQ ID NO: 250119 - RNA, 22 nt, Human
gacuggccuggggcugggcaca

SEQ ID NO: 250120 - RNA, 22 nt, Human
aaaacacugcaaagcugauugg

SEQ ID NO: 250121 - RNA, 22 nt, Human
caagugucuucaaaggcuaaaa

SEQ ID NO: 250122 - RNA, 22 nt, Human
cugggacagagcagcagugggg

SEQ ID NO: 250123 - RNA, 22 nt, Human
aggacacaccagguccagcugu

SEQ ID NO: 250124 - RNA, 22 nt, Human
cugcaccaucuggagcaccucc

SEQ ID NO: 250125 - RNA, 22 nt, Human
ccauggcuuacagauggagcau

SEQ ID NO: 250126 - RNA, 22 nt, Human
gggcuucugggcaccacucccu

SEQ ID NO: 250127 - RNA, 22 nt, Human
uugccuggcuuguagauggggg

SEQ ID NO: 250128 - RNA, 22 nt, Human
caagaacauugugaucacuuca

SEQ ID NO: 250129 - RNA, 22 nt, Human
guggagcuggcccaagaagcug

SEQ ID NO: 250130 - RNA, 22 nt, Human
augccuuauuguaaucuuucca

SEQ ID NO: 250131 - RNA, 22 nt, Human
uaaagccaacacuuuacugcuc

SEQ ID NO: 250132 - RNA, 22 nt, Human
uaugaaacauucauacaaauaa

SEQ ID NO: 250133 - RNA, 22 nt, Human
auaaagcauuuccccugugugg

SEQ ID NO: 250134 - RNA, 23 nt, Human
agaggcacuaauuauucagagau

SEQ ID NO: 250135 - RNA, 22 nt, Human
gacagguggguucucguaucug

SEQ ID NO: 250136 - RNA, 22 nt, Human
agagcuggagcagccccacugg

SEQ ID NO: 250137 - RNA, 22 nt, Human
agcugcaaccuuagcuauaggc

SEQ ID NO: 250138 - RNA, 17 nt, Human
uacaaugugauucaauc

SEQ ID NO: 250139 - RNA, 22 nt, Human
acaugggaucaaugaggcaggc

SEQ ID NO: 250140 - RNA, 22 nt, Human
guauacaugugguaaaaugcac

SEQ ID NO: 250141 - RNA, 22 nt, Human
cagggcaggacagauacauuac

SEQ ID NO: 250142 - RNA, 22 nt, Human
aaacaccagcacuguuuacaaa

SEQ ID NO: 250143 - RNA, 22 nt, Human
uccaggacuuagugaccuaaaa

SEQ ID NO: 250144 - RNA, 22 nt, Human
aaacaaacaauuaguugugugg

SEQ ID NO: 250145 - RNA, 22 nt, Human
acacaguauugugacuauaacu

SEQ ID NO: 250146 - RNA, 22 nt, Human
uguaaugauguacuuagaagga

SEQ ID NO: 250147 - RNA, 22 nt, Human
ugugcugagugaucccauuccu

SEQ ID NO: 250148 - RNA, 22 nt, Human
uguaccuuuuucugugcaugcu

SEQ ID NO: 250149 - RNA, 22 nt, Human
gaggagcuggcagcgucuccgc

SEQ ID NO: 250150 - RNA, 22 nt, Human
aacgucuucucuccaaguaaau

SEQ ID NO: 250151 - RNA, 22 nt, Human
aauacauguuuucuacuauucu

SEQ ID NO: 250152 - RNA, 22 nt, Human
acaacaguagccuuuacaaggc

SEQ ID NO: 250153 - RNA, 22 nt, Human
agccucugacugucagcaaggu

SEQ ID NO: 250154 - RNA, 22 nt, Human
uuccucaguuagugccugaggc

SEQ ID NO: 250155 - RNA, 22 nt, Human
acagaagaccagagagcuaacu

SEQ ID NO: 250156 - RNA, 22 nt, Human
gcacacagagaggugguauguc

SEQ ID NO: 250157 - RNA, 22 nt, Human
ucuuagcaaauacuacuuagaa

SEQ ID NO: 250158 - RNA, 22 nt, Human
ccaccagcagugugcaaggauu

SEQ ID NO: 250159 - RNA, 22 nt, Human
uuaauacauuucagacuguuau

SEQ ID NO: 250160 - RNA, 22 nt, Human
ucucagaggcccgacguucucc

SEQ ID NO: 250161 - RNA, 22 nt, Human
cagagcugauuggauccagaga

SEQ ID NO: 250162 - RNA, 22 nt, Human
uauguuacuucuguaucugcuu

SEQ ID NO: 250163 - RNA, 21 nt, Human
ggcugccugggaagaagaaga

SEQ ID NO: 250164 - RNA, 22 nt, Human
uugcucauacucauguugugau

SEQ ID NO: 250165 - RNA, 22 nt, Human
uuggaagcauucugaaugucca

SEQ ID NO: 250166 - RNA, 22 nt, Human
acauuuaaauaugccuuauauu

SEQ ID NO: 250167 - RNA, 22 nt, Human
cucuggaguucucaugaggaac

SEQ ID NO: 250168 - RNA, 23 nt, Human
aggcccagguauguuuguuuugg

SEQ ID NO: 250169 - RNA, 22 nt, Human
uacagacaguuuuucagauauu

SEQ ID NO: 250170 - RNA, 22 nt, Human
ccagcugucacucagaaaggcc

SEQ ID NO: 250171 - RNA, 22 nt, Human
acccauuccuuuacuucaucug

SEQ ID NO: 250172 - RNA, 22 nt, Human
ugccuuagagcacucaagagug

SEQ ID NO: 250173 - RNA, 22 nt, Human
acaggcugaggaugauugcauc

SEQ ID NO: 250174 - RNA, 22 nt, Human
uccagcagccacaccucuggac

SEQ ID NO: 250175 - RNA, 22 nt, Human
ucagagcauucgggugacaaau

SEQ ID NO: 250176 - RNA, 22 nt, Human
cagcuguguaaacacaugugua

SEQ ID NO: 250177 - RNA, 22 nt, Human
uuuauucugugcuacaugaaga

SEQ ID NO: 250178 - RNA, 22 nt, Human
guuuuauaugucucugcugaca

SEQ ID NO: 250179 - RNA, 22 nt, Human
cagggaugggauggagucaguu

SEQ ID NO: 250180 - RNA, 22 nt, Human
agcuagaauguuccuuuucauu

SEQ ID NO: 250181 - RNA, 22 nt, Human
uacagagacccacaagagacug

SEQ ID NO: 250182 - RNA, 19 nt, Human
ucagcagcacugugauuuc

SEQ ID NO: 250183 - RNA, 22 nt, Human
auuucugugcaguaaaugguga

SEQ ID NO: 250184 - RNA, 22 nt, Human
aaagcacauuacaagcucaguc

SEQ ID NO: 250185 - RNA, 22 nt, Human
uuggcuacaucgaggcuccagc

SEQ ID NO: 250186 - RNA, 22 nt, Human
uggcucagugcauucacaguaa

SEQ ID NO: 250187 - RNA, 22 nt, Human
uucaagugaggcugucuuuaga

SEQ ID NO: 250188 - RNA, 22 nt, Human
aggaagccaggcccuugggugg

SEQ ID NO: 250189 - RNA, 22 nt, Human
ccuaguuuucauucagcagccu

SEQ ID NO: 250190 - RNA, 18 nt, Human
gagcuugaaauggcuuuu

SEQ ID NO: 250191 - RNA, 22 nt, Human
uuuagcagugaagugaagugaa

SEQ ID NO: 250192 - RNA, 22 nt, Human
acaagguuugguccuauauuuu

SEQ ID NO: 250193 - RNA, 22 nt, Human
aacugcaacuuguuugauucuu

SEQ ID NO: 250194 - RNA, 22 nt, Human
auuuuucucuuuccacugagau

SEQ ID NO: 250195 - RNA, 22 nt, Human
aaagccauaucuauucuauucu

SEQ ID NO: 250196 - RNA, 22 nt, Human
aaaguguugggauuacaggcau

SEQ ID NO: 250197 - RNA, 22 nt, Human
ugcccugcagacccugcagugu

SEQ ID NO: 250198 - RNA, 18 nt, Human
ggagcccagaggacagga

SEQ ID NO: 250199 - RNA, 22 nt, Human
uuauuucauguaaaauuuaugu

SEQ ID NO: 250200 - RNA, 22 nt, Human
aaaaauguuaucuacuguccga

SEQ ID NO: 250201 - RNA, 22 nt, Human
auguccagagccggccugcuga

SEQ ID NO: 250202 - RNA, 22 nt, Human
uguggcuguguccaccugcugc

SEQ ID NO: 250203 - RNA, 22 nt, Human
acuguauuuccaacagacaaau

SEQ ID NO: 250204 - RNA, 22 nt, Human
uuugcuuuugugcucuaguggu

SEQ ID NO: 250205 - RNA, 22 nt, Human
ugcuccagcaccaagagcucca

SEQ ID NO: 250206 - RNA, 22 nt, Human
agcagggcuuugucucugugaa

SEQ ID NO: 250207 - RNA, 22 nt, Human
ugcuacagagccaggaagagug

SEQ ID NO: 250208 - RNA, 22 nt, Human
caaguacaaaaugauauuuagu

SEQ ID NO: 250209 - RNA, 22 nt, Human
cucuggaaaaccacuagcagga

SEQ ID NO: 250210 - RNA, 22 nt, Human
ucuagaaucuaaacuauaguuu

SEQ ID NO: 250211 - RNA, 22 nt, Human
ucugucuucuucauugccuaua

SEQ ID NO: 250212 - RNA, 22 nt, Human
gcugcuaagcguuucuguucca

SEQ ID NO: 250213 - RNA, 22 nt, Human
ggcuuucugagucaaacacuga

SEQ ID NO: 250214 - RNA, 18 nt, Human
cuagagaagguuacuaug

SEQ ID NO: 250215 - RNA, 22 nt, Human
augagggagggguggugccgca

SEQ ID NO: 250216 - RNA, 22 nt, Human
cagccacucggccauaaaggcu

SEQ ID NO: 250217 - RNA, 22 nt, Human
cuucccacuaguaucacagagc

SEQ ID NO: 250218 - RNA, 17 nt, Human
gcucugccccagccucu

SEQ ID NO: 250219 - RNA, 22 nt, Human
cguggcugguggaccugagggc

SEQ ID NO: 250220 - RNA, 22 nt, Human
auuucuuuucaagagggugcuu

SEQ ID NO: 250221 - RNA, 22 nt, Human
uuauugagagcuguuuuauggc

SEQ ID NO: 250222 - RNA, 22 nt, Human
aaaaugauauccugacuuuuau

SEQ ID NO: 250223 - RNA, 22 nt, Human
agcugccuggccggagccacug

SEQ ID NO: 250224 - RNA, 22 nt, Human
acauguuuaaguuuguuauaug

SEQ ID NO: 250225 - RNA, 22 nt, Human
gcaaggcagcauccuuuugagg

SEQ ID NO: 250226 - RNA, 22 nt, Human
auaugugugccauuucagcagu

SEQ ID NO: 250227 - RNA, 22 nt, Human
agguuucaugggagacaacuca

SEQ ID NO: 250228 - RNA, 20 nt, Human
uuggaacaguggaucagcag

SEQ ID NO: 250229 - RNA, 22 nt, Human
gaggaccacagaugagccugca

SEQ ID NO: 250230 - RNA, 22 nt, Human
uucuuugguguuacccagcuca

SEQ ID NO: 250231 - RNA, 22 nt, Human
ucuccagggagguagcccagug

SEQ ID NO: 250232 - RNA, 22 nt, Human
uugguuacaaguuugcucugcc

SEQ ID NO: 250233 - RNA, 23 nt, Human
gccugcugucacagcgggcccag

SEQ ID NO: 250234 - RNA, 22 nt, Human
agaaaguuuugugcuauauaug

SEQ ID NO: 250235 - RNA, 22 nt, Human
uuucauucauuauacaguagag

SEQ ID NO: 250236 - RNA, 22 nt, Human
caagugggaccugucugauucc

SEQ ID NO: 250237 - RNA, 22 nt, Human
ucuucccacugcccaugggcag

SEQ ID NO: 250238 - RNA, 22 nt, Human
gcaacaguuggauuccagagga

SEQ ID NO: 250239 - RNA, 22 nt, Human
acuggcagguccaucgcccuuu

SEQ ID NO: 250240 - RNA, 22 nt, Human
accugggagucacaccugagaa

SEQ ID NO: 250241 - RNA, 22 nt, Human
ccuugagaugagcuaauuuuuu

SEQ ID NO: 250242 - RNA, 22 nt, Human
cccacugcugcucuccauggca

SEQ ID NO: 250243 - RNA, 22 nt, Human
uggaaccuggugauguacaagu

SEQ ID NO: 250244 - RNA, 22 nt, Human
uccaauauuucucauauaugga

SEQ ID NO: 250245 - RNA, 22 nt, Human
gcugggcucagaccuagugaac

SEQ ID NO: 250246 - RNA, 22 nt, Human
uguucauuaaacuacugugugg

SEQ ID NO: 250247 - RNA, 22 nt, Human
uaagguuucuaguuucuaaacu

SEQ ID NO: 250248 - RNA, 21 nt, Human
aagcuuggcugauguuauugg

SEQ ID NO: 250249 - RNA, 22 nt, Human
gucugcccuuccucuccacgau

SEQ ID NO: 250250 - RNA, 22 nt, Human
cuccucugucuaccacgagggu

SEQ ID NO: 250251 - RNA, 22 nt, Human
uugcugauuuccccuugagugu

SEQ ID NO: 250252 - RNA, 22 nt, Human
cacuguauuauuaggaaugaca

SEQ ID NO: 250253 - RNA, 21 nt, Human
agcaggugcuguuggaggaaa

SEQ ID NO: 250254 - RNA, 22 nt, Human
uuacaauugagucuauuguaug

SEQ ID NO: 250255 - RNA, 22 nt, Human
accugcaguggccacuccuaau

SEQ ID NO: 250256 - RNA, 22 nt, Human
uucucuggcgcgcugugcuaug

SEQ ID NO: 250257 - RNA, 22 nt, Human
aggguauguuuuaggcugaguu

SEQ ID NO: 250258 - RNA, 22 nt, Human
aguguacaucagaacauaucaa

SEQ ID NO: 250259 - RNA, 22 nt, Human
ggccccaguucacuccuggccg

SEQ ID NO: 250260 - RNA, 22 nt, Human
aaagcaggcagcaggcuggauu

SEQ ID NO: 250261 - RNA, 22 nt, Human
augaaucuguuuuuugucaaua

SEQ ID NO: 250262 - RNA, 20 nt, Human
ucagugcucaggcaccaggu

SEQ ID NO: 250263 - RNA, 22 nt, Human
agagcagccugugaugaugcac

SEQ ID NO: 250264 - RNA, 22 nt, Human
acuugguugcaaaugaauuauu

SEQ ID NO: 250265 - RNA, 22 nt, Human
aauacauaauaaguuuugucug

SEQ ID NO: 250266 - RNA, 22 nt, Human
cagcugucugaagcaggagucc

SEQ ID NO: 250267 - RNA, 22 nt, Human
uauugcugacuuguucaguguu

SEQ ID NO: 250268 - RNA, 22 nt, Human
ucuggucccugcucacuucuug

SEQ ID NO: 250269 - RNA, 22 nt, Human
uauggaaagcucuuuuugauug

SEQ ID NO: 250270 - RNA, 22 nt, Human
gagaaggcuucuuuuccucuga

SEQ ID NO: 250271 - RNA, 22 nt, Human
uccauucuaugcuuacauuuau

SEQ ID NO: 250272 - RNA, 22 nt, Human
aguccaggcggguauagaggcu

SEQ ID NO: 250273 - RNA, 22 nt, Human
ucagcagggccaugcucucucu

SEQ ID NO: 250274 - RNA, 22 nt, Human
cuccuggaucuuagccagauuc

SEQ ID NO: 250275 - RNA, 22 nt, Human
auuaguaguaguuagcagccuc

SEQ ID NO: 250276 - RNA, 22 nt, Human
uccagcugcaaggggcacagcu

SEQ ID NO: 250277 - RNA, 20 nt, Human
ugugugcaucuguauguauu

SEQ ID NO: 250278 - RNA, 22 nt, Human
ggaaaauacugauucaugccau

SEQ ID NO: 250279 - RNA, 22 nt, Human
ggagucugauuuuuuaugggug

SEQ ID NO: 250280 - RNA, 22 nt, Human
cccuggugguacggcacuggca

SEQ ID NO: 250281 - RNA, 22 nt, Human
uagcaaagaaccugauacccca

SEQ ID NO: 250282 - RNA, 22 nt, Human
uguggcugugguuuucauaaau

SEQ ID NO: 250283 - RNA, 22 nt, Human
ucugggaagcugguccuguucu

SEQ ID NO: 250284 - RNA, 22 nt, Human
caguuaaauucuccaguuacca

SEQ ID NO: 250285 - RNA, 18 nt, Human
auuuugaacugggaauau

SEQ ID NO: 250286 - RNA, 22 nt, Human
agaagccagccuugccuccuuu

SEQ ID NO: 250287 - RNA, 22 nt, Human
gccagcagcugugggguggcca

SEQ ID NO: 250288 - RNA, 22 nt, Human
uuuacagauguggaaagugagc

SEQ ID NO: 250289 - RNA, 22 nt, Human
gugaagcaguugcguggguucc

SEQ ID NO: 250290 - RNA, 21 nt, Human
ccuggacuaaaaccaggccac

SEQ ID NO: 250291 - RNA, 22 nt, Human
cuccugggagcagggauggaug

SEQ ID NO: 250292 - RNA, 22 nt, Human
ucagaacauggcauguuccauc

SEQ ID NO: 250293 - RNA, 22 nt, Human
auaaaggcagaguagggaggaa

SEQ ID NO: 250294 - RNA, 22 nt, Human
cuccaggcuggauccaagucaa

SEQ ID NO: 250295 - RNA, 22 nt, Human
cauagaacagcuccuagcacau

SEQ ID NO: 250296 - RNA, 22 nt, Human
cuugccucccucagcucacagc

SEQ ID NO: 250297 - RNA, 22 nt, Human
acacaugcauaagccuucccuu

SEQ ID NO: 250298 - RNA, 22 nt, Human
cuccagugcgucuuaguaaacc

SEQ ID NO: 250299 - RNA, 22 nt, Human
ggcuucacaguuguagcagcuc

SEQ ID NO: 250300 - RNA, 22 nt, Human
uauguuuuaggaauuaauuguu

SEQ ID NO: 250301 - RNA, 22 nt, Human
uaguauagauugaagcagauca

SEQ ID NO: 250302 - RNA, 22 nt, Human
uggcuucucagaauacucugga

SEQ ID NO: 250303 - RNA, 22 nt, Human
ggccagaguugauggcaucuug

SEQ ID NO: 250304 - RNA, 22 nt, Human
uuaagacauuuuuggagauuau

SEQ ID NO: 250305 - RNA, 22 nt, Human
agcuggccggccuccaggugga

SEQ ID NO: 250306 - RNA, 22 nt, Human
guucuucaggccauccucccag

SEQ ID NO: 250307 - RNA, 23 nt, Human
cacugggcccaggguguggaggc

SEQ ID NO: 250308 - RNA, 22 nt, Human
acguuuuauucccaugcagcau

SEQ ID NO: 250309 - RNA, 22 nt, Human
cugggccucauccucagaguuu

SEQ ID NO: 250310 - RNA, 22 nt, Human
uguccugcaagcccuaaugaau

SEQ ID NO: 250311 - RNA, 22 nt, Human
agccucagcacgcagcucugug

SEQ ID NO: 250312 - RNA, 22 nt, Human
auucaguggauaucuucacuuu

SEQ ID NO: 250313 - RNA, 22 nt, Human
ccugggcuugguuguugagaac

SEQ ID NO: 250314 - RNA, 22 nt, Human
agucucagggccacccggggaa

SEQ ID NO: 250315 - RNA, 22 nt, Human
gcuuccugucccucagccauga

SEQ ID NO: 250316 - RNA, 22 nt, Human
cagggccucugugggcucucuc

SEQ ID NO: 250317 - RNA, 22 nt, Human
acagaugaaacccagcuaguug

SEQ ID NO: 250318 - RNA, 22 nt, Human
gucuuuggagaggugccauuuc

SEQ ID NO: 250319 - RNA, 22 nt, Human
ucuuuuauagugaauuuucuug

SEQ ID NO: 250320 - RNA, 22 nt, Human
gaaagugcagucagacaaggca

SEQ ID NO: 250321 - RNA, 22 nt, Human
ucuguucaugucuuuuuaagug

SEQ ID NO: 250322 - RNA, 22 nt, Human
ugcuauuugugagugucuucgu

SEQ ID NO: 250323 - RNA, 22 nt, Human
caaguuuugcauaguucuguau

SEQ ID NO: 250324 - RNA, 22 nt, Human
uuuucaguuccaucucugcucu

SEQ ID NO: 250325 - RNA, 22 nt, Human
aggcaagccgugccugucucaa

SEQ ID NO: 250326 - RNA, 22 nt, Human
uuugagaagauguaauguuaag

SEQ ID NO: 250327 - RNA, 22 nt, Human
agggcucugugacuaucacugc

SEQ ID NO: 250328 - RNA, 21 nt, Human
uggccaaacuggagcauuuga

SEQ ID NO: 250329 - RNA, 22 nt, Human
aaaacuaaauacgcuuugccuc

SEQ ID NO: 250330 - RNA, 22 nt, Human
caugcaugccgggcugacagag

SEQ ID NO: 250331 - RNA, 22 nt, Human
ucaguuaaucaauguggucuaa

SEQ ID NO: 250332 - RNA, 22 nt, Human
aacugguagcugauuaaguaua

SEQ ID NO: 250333 - RNA, 22 nt, Human
ugagaucugugcauguuaguua

SEQ ID NO: 250334 - RNA, 22 nt, Human
uuguuuauuagcaauuauccug

SEQ ID NO: 250335 - RNA, 21 nt, Human
aggggaaguagaguuuugauu

SEQ ID NO: 250336 - RNA, 22 nt, Human
ggacaggccauauggaauacau

SEQ ID NO: 250337 - RNA, 22 nt, Human
uggagcugauacagcuggcuuu

SEQ ID NO: 250338 - RNA, 22 nt, Human
auuucacagcugcuguucaggu

SEQ ID NO: 250339 - RNA, 22 nt, Human
agccaagggucagcugcacaga

SEQ ID NO: 250340 - RNA, 22 nt, Human
gagaccuggaggauguggaugg

SEQ ID NO: 250341 - RNA, 22 nt, Human
aaggcugaggagggccugcagg

SEQ ID NO: 250342 - RNA, 22 nt, Human
ccaguggguaggccauggugag

SEQ ID NO: 250343 - RNA, 23 nt, Human
aucugaaaagcauuugcaguuug

SEQ ID NO: 250344 - RNA, 22 nt, Human
aagacaggaacauagcaaaucc

SEQ ID NO: 250345 - RNA, 22 nt, Human
gaagccuuaucagucacuuaua

SEQ ID NO: 250346 - RNA, 22 nt, Human
ggcccugcaugagauuaagguu

SEQ ID NO: 250347 - RNA, 22 nt, Human
aaggaaagauucucucucuaga

SEQ ID NO: 250348 - RNA, 22 nt, Human
cuggcuggcagaugcucuugcu

SEQ ID NO: 250349 - RNA, 22 nt, Human
cugugugugucugcagcauacu

SEQ ID NO: 250350 - RNA, 22 nt, Human
uacaauacuuaaccuauuuugc

SEQ ID NO: 250351 - RNA, 22 nt, Human
aaaugaucauguaauuucagaa

SEQ ID NO: 250352 - RNA, 22 nt, Human
acacaugauuaaugccaagcau

SEQ ID NO: 250353 - RNA, 22 nt, Human
ucuccagguaaauggcauccug

SEQ ID NO: 250354 - RNA, 22 nt, Human
gcaggucuugaaggugugauuu

SEQ ID NO: 250355 - RNA, 22 nt, Human
uuggagguuugaaaauaugugu

SEQ ID NO: 250356 - RNA, 22 nt, Human
aaauaaguuagcagauuccagu

SEQ ID NO: 250357 - RNA, 22 nt, Human
cacuggaauauggcguugaacc

SEQ ID NO: 250358 - RNA, 18 nt, Human
ccucuggguuuuguuccc

SEQ ID NO: 250359 - RNA, 22 nt, Human
gugacagucaaagacaugacuu

SEQ ID NO: 250360 - RNA, 22 nt, Human
uuuguuuucaaugugucauuca

SEQ ID NO: 250361 - RNA, 22 nt, Human
gagacaggcagcuaguggguca

SEQ ID NO: 250362 - RNA, 22 nt, Human
uacauuacaggaaagauaaaga

SEQ ID NO: 250363 - RNA, 15 nt, Human
ucugggcugugagca

SEQ ID NO: 250364 - RNA, 22 nt, Human
aucugggcagggcagcaaggcg

SEQ ID NO: 250365 - RNA, 22 nt, Human
auugguuaacucugugugucaa

SEQ ID NO: 250366 - RNA, 22 nt, Human
auguucuacagauggaaagggg

SEQ ID NO: 250367 - RNA, 22 nt, Human
uccuucuggaggcucuaagggg

SEQ ID NO: 250368 - RNA, 22 nt, Human
uucugagggcuaauguacugua

SEQ ID NO: 250369 - RNA, 22 nt, Human
aaagugcagggugcucugguau

SEQ ID NO: 250370 - RNA, 20 nt, Human
agacucaguuucuaugcucu

SEQ ID NO: 250371 - RNA, 22 nt, Human
uugauucauauagauaugcgug

SEQ ID NO: 250372 - RNA, 22 nt, Human
gcuuugcuagcacugcgcuucc

SEQ ID NO: 250373 - RNA, 22 nt, Human
uucuuuuaaaagagagcagaaa

SEQ ID NO: 250374 - RNA, 21 nt, Human
ugcaaagcugcugaaguggua

SEQ ID NO: 250375 - RNA, 22 nt, Human
uuauacaguuuauacuuagaau

SEQ ID NO: 250376 - RNA, 22 nt, Human
ucugcuuucaaauucacuuagu

SEQ ID NO: 250377 - RNA, 22 nt, Human
uuuauugcccuguaguacagga

SEQ ID NO: 250378 - RNA, 22 nt, Human
uguggcugggcuaauaggcaaa

SEQ ID NO: 250379 - RNA, 22 nt, Human
agggagcuuccgaacuacagcu

SEQ ID NO: 250380 - RNA, 18 nt, Human
agagggaaagcaggcuga

SEQ ID NO: 250381 - RNA, 21 nt, Human
ugacagguauuuaucuggaaa

SEQ ID NO: 250382 - RNA, 22 nt, Human
aacaguaacgagauguccuaac

SEQ ID NO: 250383 - RNA, 18 nt, Human
ugggcugccuggccucug

SEQ ID NO: 250384 - RNA, 22 nt, Human
gcagggcagcuuagucccuguc

SEQ ID NO: 250385 - RNA, 22 nt, Human
aacccagccguguagcugccgc

SEQ ID NO: 250386 - RNA, 22 nt, Human
guauuuuacugcucaaagcucu

SEQ ID NO: 250387 - RNA, 22 nt, Human
aauguguuaguauugauuuguc

SEQ ID NO: 250388 - RNA, 21 nt, Human
cuggagucauuuucugaguag

SEQ ID NO: 250389 - RNA, 22 nt, Human
aaaggcaagcauuuauauagga

SEQ ID NO: 250390 - RNA, 22 nt, Human
auggacauuugaguuauuucca

SEQ ID NO: 250391 - RNA, 22 nt, Human
aggaaagccaaucucucuugac

SEQ ID NO: 250392 - RNA, 22 nt, Human
gagggaaaauaaaauugcagua

SEQ ID NO: 250393 - RNA, 22 nt, Human
acauauaagggaucagugacag

SEQ ID NO: 250394 - RNA, 22 nt, Human
aaguuugagaagcuuauagaua

SEQ ID NO: 250395 - RNA, 22 nt, Human
gccugggauucucaaaggggug

SEQ ID NO: 250396 - RNA, 22 nt, Human
gcaggagcagucaggggcagcu

SEQ ID NO: 250397 - RNA, 22 nt, Human
gugcagggcuggcaccggaggc

SEQ ID NO: 250398 - RNA, 22 nt, Human
agagccaggacugugucucacu

SEQ ID NO: 250399 - RNA, 22 nt, Human
aucagagcccggcaauuuauuu

SEQ ID NO: 250400 - RNA, 22 nt, Human
uacacuguguaaaaugcacuuu

SEQ ID NO: 250401 - RNA, 22 nt, Human
ggaugcccacuaucugcuggcu

SEQ ID NO: 250402 - RNA, 22 nt, Human
aaggccaugcacauccuaggca

SEQ ID NO: 250403 - RNA, 22 nt, Human
cuguguccauguucuaauuugg

SEQ ID NO: 250404 - RNA, 22 nt, Human
aaugaacaggugaaugucagau

SEQ ID NO: 250405 - RNA, 22 nt, Human
acagugcuaaugaugccaagau

SEQ ID NO: 250406 - RNA, 22 nt, Human
ccuccaucaccaucugcccuca

SEQ ID NO: 250407 - RNA, 22 nt, Human
auaugcagagagcaugaauagg

SEQ ID NO: 250408 - RNA, 21 nt, Human
aggcauuauaaauuucaccug

SEQ ID NO: 250409 - RNA, 19 nt, Human
gcaggcuugggucucccca

SEQ ID NO: 250410 - RNA, 22 nt, Human
acagaaauucaaacuggaauuu

SEQ ID NO: 250411 - RNA, 22 nt, Human
aauacuuaugugaccucauuuu

SEQ ID NO: 250412 - RNA, 22 nt, Human
ccugaguccccucauucacucu

SEQ ID NO: 250413 - RNA, 22 nt, Human
acacccagcugggccaccucca

SEQ ID NO: 250414 - RNA, 22 nt, Human
agucuuauguuugugaagaacu

SEQ ID NO: 250415 - RNA, 22 nt, Human
aucucuggcaaugcagcaucgu

SEQ ID NO: 250416 - RNA, 22 nt, Human
ucccaggacaugggcucugcuc

SEQ ID NO: 250417 - RNA, 22 nt, Human
uuagagaaauucugguaaugua

SEQ ID NO: 250418 - RNA, 22 nt, Human
uggcaguggcgggacucagggc

SEQ ID NO: 250419 - RNA, 22 nt, Human
gaggagagaagcuaacggugcu

SEQ ID NO: 250420 - RNA, 21 nt, Human
gguguccagaggaguccccag

SEQ ID NO: 250421 - RNA, 22 nt, Human
cagagcagccuccagggggagc

SEQ ID NO: 250422 - RNA, 22 nt, Human
acauaauagcauuucuaauuug

SEQ ID NO: 250423 - RNA, 22 nt, Human
gagaaagaugaagaguggcguu

SEQ ID NO: 250424 - RNA, 22 nt, Human
ucucagaguuuuuuuccaggac

SEQ ID NO: 250425 - RNA, 22 nt, Human
ugcuccugaauuacacuacuac

SEQ ID NO: 250426 - RNA, 22 nt, Human
agucaguuuucuuaaagggaag

SEQ ID NO: 250427 - RNA, 22 nt, Human
gugcccagcuccaccucacaga

SEQ ID NO: 250428 - RNA, 22 nt, Human
aauauuuguuaguguuuuaaug

SEQ ID NO: 250429 - RNA, 23 nt, Human
ucagucuuggcuucugauuuucc

SEQ ID NO: 250430 - RNA, 19 nt, Human
gcaggcagcugggguaucc

SEQ ID NO: 250431 - RNA, 22 nt, Human
augcaaacauguuuccucuaag

SEQ ID NO: 250432 - RNA, 22 nt, Human
acugucuuugagcuggaggagg

SEQ ID NO: 250433 - RNA, 22 nt, Human
gccaggcuggaaagaacagaca

SEQ ID NO: 250434 - RNA, 22 nt, Human
cuuucauucuuagauauuagug

SEQ ID NO: 250435 - RNA, 22 nt, Human
gagagcccugcuccuaucccag

SEQ ID NO: 250436 - RNA, 22 nt, Human
ucaaaguuuuugagaauuacau

SEQ ID NO: 250437 - RNA, 20 nt, Human
ggcaggugcucgcuuggucu

SEQ ID NO: 250438 - RNA, 22 nt, Human
uagggauggaaacccguuuucu

SEQ ID NO: 250439 - RNA, 22 nt, Human
acagugcugugcagucugcccu

SEQ ID NO: 250440 - RNA, 22 nt, Human
uucugggccuccuaggacaggc

SEQ ID NO: 250441 - RNA, 22 nt, Human
uucucugagauagacuaagugg

SEQ ID NO: 250442 - RNA, 22 nt, Human
agccuggccacucagggccuga

SEQ ID NO: 250443 - RNA, 22 nt, Human
uaacacuguccaaagaauucca

SEQ ID NO: 250444 - RNA, 22 nt, Human
ccacccagaccagggaucuggg

SEQ ID NO: 250445 - RNA, 22 nt, Human
ugcucaggacaguggaaccuaa

SEQ ID NO: 250446 - RNA, 22 nt, Human
aaauagcuuuucauaauucuca

SEQ ID NO: 250447 - RNA, 22 nt, Human
ggaaucuagaaagggagcaagg

SEQ ID NO: 250448 - RNA, 22 nt, Human
ugcacauuuguuauuuugaggu

SEQ ID NO: 250449 - RNA, 22 nt, Human
ggcugguccuuucucuguccua

SEQ ID NO: 250450 - RNA, 22 nt, Human
caggucagaggcgcagccccca

SEQ ID NO: 250451 - RNA, 22 nt, Human
agugggugauaagaccaaggag

SEQ ID NO: 250452 - RNA, 22 nt, Human
cagggacagggaucauuugcuu

SEQ ID NO: 250453 - RNA, 18 nt, Human
ggcaccucucuugccuua

SEQ ID NO: 250454 - RNA, 22 nt, Human
aaagacuagcauuuauauguac

SEQ ID NO: 250455 - RNA, 22 nt, Human
agcugguucauucauucauggu

SEQ ID NO: 250456 - RNA, 22 nt, Human
acaauucucucauaucuuauua

SEQ ID NO: 250457 - RNA, 16 nt, Human
acuuccaggggagccc

SEQ ID NO: 250458 - RNA, 22 nt, Human
uuuugcuguguccuugagccgg

SEQ ID NO: 250459 - RNA, 22 nt, Human
aucugaagaggucauggcugac

SEQ ID NO: 250460 - RNA, 22 nt, Human
ucccagagcaguacuccaggag

SEQ ID NO: 250461 - RNA, 22 nt, Human
gagcaggaugggagcuggggcc

SEQ ID NO: 250462 - RNA, 22 nt, Human
ccucagaguuggaaucacauuu

SEQ ID NO: 250463 - RNA, 22 nt, Human
gcuauguucccuuuugcuauaa

SEQ ID NO: 250464 - RNA, 22 nt, Human
cucugggcaaguuucuucauga

SEQ ID NO: 250465 - RNA, 22 nt, Human
uucccaguauuaccuucaggaa

SEQ ID NO: 250466 - RNA, 22 nt, Human
gggaggcgccgaggguagcuaa

SEQ ID NO: 250467 - RNA, 22 nt, Human
aagcuguuagggagugguaggu

SEQ ID NO: 250468 - RNA, 22 nt, Human
ugccucaguuucuccauaugaa

SEQ ID NO: 250469 - RNA, 22 nt, Human
aagagacaaugucuuuuggaua

SEQ ID NO: 250470 - RNA, 22 nt, Human
aaagugcagaacuguucucacu

SEQ ID NO: 250471 - RNA, 22 nt, Human
ucugucuuagcaucuuugcuca

SEQ ID NO: 250472 - RNA, 22 nt, Human
uucaauucaauucuaaauauau

SEQ ID NO: 250473 - RNA, 22 nt, Human
ugggagauauugcuguggcugu

SEQ ID NO: 250474 - RNA, 19 nt, Human
gucuuguaacacauaagug

SEQ ID NO: 250475 - RNA, 22 nt, Human
guuggccauuaauuggaggaca

SEQ ID NO: 250476 - RNA, 22 nt, Human
gaggaacagcagccacaugucc

SEQ ID NO: 250477 - RNA, 22 nt, Human
ugcauauccacaccuuaucucu

SEQ ID NO: 250478 - RNA, 22 nt, Human
cccacaucucacaucuuggaac

SEQ ID NO: 250479 - RNA, 18 nt, Human
ucucuuuccucaguggag

SEQ ID NO: 250480 - RNA, 22 nt, Human
gucagaucuuuggggaugcugu

SEQ ID NO: 250481 - RNA, 22 nt, Human
gcagggcaucccugagcgggug

SEQ ID NO: 250482 - RNA, 22 nt, Human
cacaugagacaauuaaagacuu

SEQ ID NO: 250483 - RNA, 22 nt, Human
cauuuguaucauauguaucuua

SEQ ID NO: 250484 - RNA, 22 nt, Human
auuagaucagaucggcaguaau

SEQ ID NO: 250485 - RNA, 22 nt, Human
cacaucuauagggacagcaaca

SEQ ID NO: 250486 - RNA, 22 nt, Human
ugggccuccuccgacagccggg

SEQ ID NO: 250487 - RNA, 22 nt, Human
ggccuuggauccaagcugcggc

SEQ ID NO: 250488 - RNA, 22 nt, Human
ccagggcauguccaagacuuag

SEQ ID NO: 250489 - RNA, 22 nt, Human
cacuaauuccaucuccuuuucc

SEQ ID NO: 250490 - RNA, 22 nt, Human
uucuucagagaguagaagcaag

SEQ ID NO: 250491 - RNA, 22 nt, Human
gcuguccagagcaugggagcaa

SEQ ID NO: 250492 - RNA, 22 nt, Human
auuuugaagggaauugaaguuc

SEQ ID NO: 250493 - RNA, 21 nt, Human
ccuuuacaauuuugcauuccu

SEQ ID NO: 250494 - RNA, 22 nt, Human
aggagccaaauuacuagcucug

SEQ ID NO: 250495 - RNA, 22 nt, Human
agaggcaaugaaagcagucucu

SEQ ID NO: 250496 - RNA, 22 nt, Human
ugaggcaauuggaaauuuuaac

SEQ ID NO: 250497 - RNA, 22 nt, Human
auguuuccgugagcauccuuga

SEQ ID NO: 250498 - RNA, 22 nt, Human
aacucuuuguggacauuaaauu

SEQ ID NO: 250499 - RNA, 22 nt, Human
aauaauuauuugagagcagacc

SEQ ID NO: 250500 - RNA, 22 nt, Human
uccugcagcugaagcucaugug

SEQ ID NO: 250501 - RNA, 22 nt, Human
auuugcaugcuucuauugugaa

SEQ ID NO: 250502 - RNA, 22 nt, Human
agauggcuuugcuuuuagaagc

SEQ ID NO: 250503 - RNA, 22 nt, Human
uggcauggcauuuagagaauua

SEQ ID NO: 250504 - RNA, 20 nt, Human
ggcaggaccccaguggcauc

SEQ ID NO: 250505 - RNA, 22 nt, Human
gccugggaagacuaagugggag

SEQ ID NO: 250506 - RNA, 22 nt, Human
acauuguaguuguucugcagca

SEQ ID NO: 250507 - RNA, 22 nt, Human
ggccuagggaguggccaugccu

SEQ ID NO: 250508 - RNA, 22 nt, Human
uauuggugaugacuugaggcca

SEQ ID NO: 250509 - RNA, 20 nt, Human
agucucucccagaaugagca

SEQ ID NO: 250510 - RNA, 22 nt, Human
ugggagcaccuugagggcagaa

SEQ ID NO: 250511 - RNA, 21 nt, Human
ugcacagccauacccuccuug

SEQ ID NO: 250512 - RNA, 18 nt, Human
uggagcugagggcaaugc

SEQ ID NO: 250513 - RNA, 22 nt, Human
uccagcccaguuuggugaauug

SEQ ID NO: 250514 - RNA, 22 nt, Human
caaguaaugguuuuauaauagu

SEQ ID NO: 250515 - RNA, 21 nt, Human
aaucaguacauacugcacauc

SEQ ID NO: 250516 - RNA, 22 nt, Human
uauuccaagugccuagaagagu

SEQ ID NO: 250517 - RNA, 21 nt, Human
acuguucauuugaugaacugg

SEQ ID NO: 250518 - RNA, 22 nt, Human
cccacagaaugccaaugagacc

SEQ ID NO: 250519 - RNA, 22 nt, Human
ugacucaagagccugacucauc

SEQ ID NO: 250520 - RNA, 22 nt, Human
cugaagagcaaaccaacuggac

SEQ ID NO: 250521 - RNA, 22 nt, Human
accaugacgucacagaggcuuc

SEQ ID NO: 250522 - RNA, 22 nt, Human
ugggaagaguuagagacagcug

SEQ ID NO: 250523 - RNA, 22 nt, Human
gacaagacuauguagaaaguau

SEQ ID NO: 250524 - RNA, 20 nt, Human
ucagagaagggacugagauu

SEQ ID NO: 250525 - RNA, 22 nt, Human
aaacucuggauuggaguccagc

SEQ ID NO: 250526 - RNA, 22 nt, Human
uauccauuuauuuucuaggcaa

SEQ ID NO: 250527 - RNA, 22 nt, Human
uagaugaaaggucuagcacagu

SEQ ID NO: 250528 - RNA, 22 nt, Human
agcagggccucuggcacugguc

SEQ ID NO: 250529 - RNA, 22 nt, Human
cuuuauucugcaaauugccuug

SEQ ID NO: 250530 - RNA, 22 nt, Human
auucaccuguuaguaaaaaucu

SEQ ID NO: 250531 - RNA, 22 nt, Human
aucauucugauggucaaugcua

SEQ ID NO: 250532 - RNA, 22 nt, Human
guauccaugggggauugguucc

SEQ ID NO: 250533 - RNA, 22 nt, Human
ugccaggcuccggaacgacagu

SEQ ID NO: 250534 - RNA, 22 nt, Human
aucugucuaugauauagucugu

SEQ ID NO: 250535 - RNA, 18 nt, Human
acccucuggcuucugagc

SEQ ID NO: 250536 - RNA, 22 nt, Human
ucucacagccauuucucccucu

SEQ ID NO: 250537 - RNA, 20 nt, Human
ugugcaggagagugaggcug

SEQ ID NO: 250538 - RNA, 22 nt, Human
ccaugacauuuuaauuuucacu

SEQ ID NO: 250539 - RNA, 22 nt, Human
gggaagagggagcuggaaugau

SEQ ID NO: 250540 - RNA, 22 nt, Human
aaccucuacauccaggaaagga

SEQ ID NO: 250541 - RNA, 22 nt, Human
acagaauuugcuugggcaaugg

SEQ ID NO: 250542 - RNA, 22 nt, Human
uucucuggacuauuugcacucc

SEQ ID NO: 250543 - RNA, 22 nt, Human
uuugucauaucacacaauuuug

SEQ ID NO: 250544 - RNA, 22 nt, Human
aacuuguaaugaaaggcaauag

SEQ ID NO: 250545 - RNA, 22 nt, Human
aggcagggaccaguuguuuucu

SEQ ID NO: 250546 - RNA, 22 nt, Human
ccagugcacaauggaacaacuc

SEQ ID NO: 250547 - RNA, 22 nt, Human
cagcugguagguagcagauuug

SEQ ID NO: 250548 - RNA, 22 nt, Human
acuaauugagugcaugaucuuu

SEQ ID NO: 250549 - RNA, 19 nt, Human
aagaggcaacccucgagcc

SEQ ID NO: 250550 - RNA, 22 nt, Human
gcuuuagaaauaucacugugga

SEQ ID NO: 250551 - RNA, 22 nt, Human
agccagcuggagaccacuguuu

SEQ ID NO: 250552 - RNA, 22 nt, Human
uauucuugucuuuuccagaaau

SEQ ID NO: 250553 - RNA, 22 nt, Human
acucagaggggacugguguggu

SEQ ID NO: 250554 - RNA, 22 nt, Human
agagccaggugcugcuguuuga

SEQ ID NO: 250555 - RNA, 22 nt, Human
aaugaguucugacacuucacga

SEQ ID NO: 250556 - RNA, 22 nt, Human
gcuuuaaugcaauuucaccuca

SEQ ID NO: 250557 - RNA, 19 nt, Human
uuugaauccagcugguaac

SEQ ID NO: 250558 - RNA, 22 nt, Human
uguucucuaagaaaagaagcau

SEQ ID NO: 250559 - RNA, 22 nt, Human
aggaggugacagccugcaucug

SEQ ID NO: 250560 - RNA, 22 nt, Human
aaacugcacaagggugcauagc

SEQ ID NO: 250561 - RNA, 22 nt, Human
uagcaacaauggaaguaacuuc

SEQ ID NO: 250562 - RNA, 22 nt, Human
ggcuguggcagcuggaaguggu

SEQ ID NO: 250563 - RNA, 22 nt, Human
uuaaaucuguucucaugucugu

SEQ ID NO: 250564 - RNA, 22 nt, Human
augcaguuuuaaaucauuucag

SEQ ID NO: 250565 - RNA, 22 nt, Human
uucuggguaacaaggcaagaau

SEQ ID NO: 250566 - RNA, 23 nt, Human
uugcacaguuucggaaacugagg

SEQ ID NO: 250567 - RNA, 22 nt, Human
uauuucuuucagguauguguug

SEQ ID NO: 250568 - RNA, 22 nt, Human
aaugcugcaagaggugaaaaga

SEQ ID NO: 250569 - RNA, 22 nt, Human
cacauucuuucacaguucugaa

SEQ ID NO: 250570 - RNA, 22 nt, Human
aacacaggcauacuggcuccag

SEQ ID NO: 250571 - RNA, 22 nt, Human
cccagagcugagucugauauau

SEQ ID NO: 250572 - RNA, 22 nt, Human
gagcacugagcuggaauuggag

SEQ ID NO: 250573 - RNA, 22 nt, Human
cagaaaaggguguuuguucagg

SEQ ID NO: 250574 - RNA, 22 nt, Human
aaaaguuauugaugcaggacaa

SEQ ID NO: 250575 - RNA, 22 nt, Human
ugacucucccaaguuugaggga

SEQ ID NO: 250576 - RNA, 19 nt, Human
ugaggcaagauggcucugg

SEQ ID NO: 250577 - RNA, 22 nt, Human
cauggcagggcugugggcaggu

SEQ ID NO: 250578 - RNA, 22 nt, Human
agccuucaaccuagcuagagca

SEQ ID NO: 250579 - RNA, 22 nt, Human
gugcccuggcucacagugucuc

SEQ ID NO: 250580 - RNA, 22 nt, Human
agccccaggaugggccgcagga

SEQ ID NO: 250581 - RNA, 22 nt, Human
ggcuggcgcucucccagcgcug

SEQ ID NO: 250582 - RNA, 20 nt, Human
ugcucccuugcgagucgcug

SEQ ID NO: 250583 - RNA, 22 nt, Human
agccagagauugagaugcaggc

SEQ ID NO: 250584 - RNA, 22 nt, Human
aagcacagcuggaacagcagga

SEQ ID NO: 250585 - RNA, 22 nt, Human
acagcuccuggggcuuuaaugg

SEQ ID NO: 250586 - RNA, 21 nt, Human
uccuggccagggcacuaggca

SEQ ID NO: 250587 - RNA, 22 nt, Human
ccccaugaaguagggucucuga

SEQ ID NO: 250588 - RNA, 22 nt, Human
aaucuaaggacuuagcauugcu

SEQ ID NO: 250589 - RNA, 22 nt, Human
agcccuagagaaccagccugug

SEQ ID NO: 250590 - RNA, 22 nt, Human
agguccagaacgugccuacucu

SEQ ID NO: 250591 - RNA, 22 nt, Human
aaguuacaagacuaaauggaag

SEQ ID NO: 250592 - RNA, 20 nt, Human
acugagguuagauaacaggu

SEQ ID NO: 250593 - RNA, 19 nt, Human
uggcagaggacaaggacuu

SEQ ID NO: 250594 - RNA, 22 nt, Human
aguggcuguaggcuaugagaga

SEQ ID NO: 250595 - RNA, 22 nt, Human
gcagcauccugggccacagucc

SEQ ID NO: 250596 - RNA, 22 nt, Human
ucugcagggcccuuggcuccug

SEQ ID NO: 250597 - RNA, 22 nt, Human
gaaaagaacugcaugggauuaa

SEQ ID NO: 250598 - RNA, 17 nt, Human
acacaucuuggcuuugc

SEQ ID NO: 250599 - RNA, 20 nt, Human
agagagaccuaggccuaguc

SEQ ID NO: 250600 - RNA, 22 nt, Human
aggaaaaagaguugcugccuuc

SEQ ID NO: 250601 - RNA, 22 nt, Human
ucacagaagagcauuaagauga

SEQ ID NO: 250602 - RNA, 22 nt, Human
ucugggcucacgagucuggaca

SEQ ID NO: 250603 - RNA, 22 nt, Human
uaaaggcuuuuacaggagugca

SEQ ID NO: 250604 - RNA, 22 nt, Human
acagaaugcguagugcauguug

SEQ ID NO: 250605 - RNA, 22 nt, Human
caaggcagugggcuaggaaccu

SEQ ID NO: 250606 - RNA, 21 nt, Human
cuuuuacauucagucaugaug

SEQ ID NO: 250607 - RNA, 22 nt, Human
ggucacaugagaugcugcccuc

SEQ ID NO: 250608 - RNA, 22 nt, Human
ugggguccagugccuggcaagg

SEQ ID NO: 250609 - RNA, 22 nt, Human
guucuauucauugcuccacgag

SEQ ID NO: 250610 - RNA, 22 nt, Human
uucaacuuuaggcaaagaaaac

SEQ ID NO: 250611 - RNA, 22 nt, Human
gcuggccugaccugaggcuggg

SEQ ID NO: 250612 - RNA, 22 nt, Human
ucccagaggcuccagucucuau

SEQ ID NO: 250613 - RNA, 22 nt, Human
ccagggaugcuuucccaggacu

SEQ ID NO: 250614 - RNA, 22 nt, Human
agaggguaacaagaggccugga

SEQ ID NO: 250615 - RNA, 22 nt, Human
auagacaacacuuauuauuccu

SEQ ID NO: 250616 - RNA, 22 nt, Human
guguguguacucuguauauaaa

SEQ ID NO: 250617 - RNA, 21 nt, Human
uguggcagagacaaugcuagu

SEQ ID NO: 250618 - RNA, 22 nt, Human
agcugcaauuaaagacugugaa

SEQ ID NO: 250619 - RNA, 22 nt, Human
uucacaguggcugugccauuug

SEQ ID NO: 250620 - RNA, 22 nt, Human
ucuucagugcaccugaugucuu

SEQ ID NO: 250621 - RNA, 19 nt, Human
ccagagagcuagguacaga

SEQ ID NO: 250622 - RNA, 22 nt, Human
ccaggcagagggaauagcaagu

SEQ ID NO: 250623 - RNA, 22 nt, Human
uucuccagcucaucagggaggg

SEQ ID NO: 250624 - RNA, 22 nt, Human
gagcccugcuuccaagggggca

SEQ ID NO: 250625 - RNA, 22 nt, Human
uuugauauccuauacaaguaaa

SEQ ID NO: 250626 - RNA, 22 nt, Human
ggcagccaugugggcagcgagu

SEQ ID NO: 250627 - RNA, 22 nt, Human
gcuuucugugcagugaacacua

SEQ ID NO: 250628 - RNA, 20 nt, Human
agcaaaaugcaagauuuuca

SEQ ID NO: 250629 - RNA, 22 nt, Human
ucacuaaguuacauuuaguauu

SEQ ID NO: 250630 - RNA, 20 nt, Human
auaauuacauagagauugcc

SEQ ID NO: 250631 - RNA, 22 nt, Human
ucagcuuuccuugcuuuagauu

SEQ ID NO: 250632 - RNA, 22 nt, Human
aucacgugguuugagaguacgc

SEQ ID NO: 250633 - RNA, 22 nt, Human
uccugggguccugacugcuucc

SEQ ID NO: 250634 - RNA, 22 nt, Human
uuacuugaaugcugugaucuca

SEQ ID NO: 250635 - RNA, 22 nt, Human
gcucugugguggggcagaguuu

SEQ ID NO: 250636 - RNA, 22 nt, Human
cccaggcugucuguccuuugcu

SEQ ID NO: 250637 - RNA, 22 nt, Human
gaugagggccugguggcugugc

SEQ ID NO: 250638 - RNA, 22 nt, Human
caggugcaaugagacagcucug

SEQ ID NO: 250639 - RNA, 22 nt, Human
aauagcauccuaaaacauacuu

SEQ ID NO: 250640 - RNA, 22 nt, Human
auaucuuuguaugguucagcag

SEQ ID NO: 250641 - RNA, 22 nt, Human
uuagauaaagugauguaggcua

SEQ ID NO: 250642 - RNA, 22 nt, Human
auacuguuuugugacuuaucuu

SEQ ID NO: 250643 - RNA, 22 nt, Human
guuaaagaagaauaguuccuuu

SEQ ID NO: 250644 - RNA, 22 nt, Human
ucuggcuccacucugugcaugc

SEQ ID NO: 250645 - RNA, 21 nt, Human
guagauaaagcauuuucauua

SEQ ID NO: 250646 - RNA, 22 nt, Human
acacauaagccuaaucaucucc

SEQ ID NO: 250647 - RNA, 20 nt, Human
cuuaaacacagagauagauu

SEQ ID NO: 250648 - RNA, 22 nt, Human
agcacagaaaguauugacugaa

SEQ ID NO: 250649 - RNA, 22 nt, Human
ccuggccaaucuagggcuguua

SEQ ID NO: 250650 - RNA, 22 nt, Human
ccuuggagaccugggucugugc

SEQ ID NO: 250651 - RNA, 22 nt, Human
aggcaggcccucuggaaaggua

SEQ ID NO: 250652 - RNA, 22 nt, Human
acagaauaagguuuaucucucc

SEQ ID NO: 250653 - RNA, 18 nt, Human
guucccagauggugcuga

SEQ ID NO: 250654 - RNA, 22 nt, Human
uuucuguuaggcaucauuuuaa

SEQ ID NO: 250655 - RNA, 22 nt, Human
aaugaggucauuaaugguggga

SEQ ID NO: 250656 - RNA, 22 nt, Human
uucaggaagugcugccuggugu

SEQ ID NO: 250657 - RNA, 19 nt, Human
acuccagggaugacagaag

SEQ ID NO: 250658 - RNA, 22 nt, Human
ucaaaucccagcucagccucuc

SEQ ID NO: 250659 - RNA, 22 nt, Human
aaagaccugugguagcucuaaa

SEQ ID NO: 250660 - RNA, 22 nt, Human
gguaauaagaucuguuacaugg

SEQ ID NO: 250661 - RNA, 22 nt, Human
acauggagaccagauggaagua

SEQ ID NO: 250662 - RNA, 18 nt, Human
gcagagugcgucucugug

SEQ ID NO: 250663 - RNA, 22 nt, Human
ugcuuauuaacauguauaucuc

SEQ ID NO: 250664 - RNA, 22 nt, Human
auguggauuguaggaaacugau

SEQ ID NO: 250665 - RNA, 22 nt, Human
guauauaucggcacuauuuuaa

SEQ ID NO: 250666 - RNA, 22 nt, Human
cacugagcugauagaauuccag

SEQ ID NO: 250667 - RNA, 22 nt, Human
gaggcuaagguucugccagaag

SEQ ID NO: 250668 - RNA, 22 nt, Human
caauuucuggaacuaauucuga

SEQ ID NO: 250669 - RNA, 22 nt, Human
gccugcagccccucugcaguag

SEQ ID NO: 250670 - RNA, 22 nt, Human
cugugcucuggcaucgcugcaa

SEQ ID NO: 250671 - RNA, 19 nt, Human
cacuuugcugaacucuucu

SEQ ID NO: 250672 - RNA, 22 nt, Human
aucccaccucaaucugaagcuc

SEQ ID NO: 250673 - RNA, 22 nt, Human
cccagcaggcauguugggagga

SEQ ID NO: 250674 - RNA, 22 nt, Human
accucagcuauuucaaaacaga

SEQ ID NO: 250675 - RNA, 22 nt, Human
acuucucuuuaguacuaaaugu

SEQ ID NO: 250676 - RNA, 19 nt, Human
gauaggcagccaugagccc

SEQ ID NO: 250677 - RNA, 22 nt, Human
aguguucagugauugucaaccg

SEQ ID NO: 250678 - RNA, 22 nt, Human
gccccucccagucaggagcacu

SEQ ID NO: 250679 - RNA, 22 nt, Human
gcacagacauauccauauuuac

SEQ ID NO: 250680 - RNA, 22 nt, Human
uuuguacuucauugguucuacu

SEQ ID NO: 250681 - RNA, 22 nt, Human
ugcuggcucccaggagccgcug

SEQ ID NO: 250682 - RNA, 22 nt, Human
uuagaaguacauuuagaacaua

SEQ ID NO: 250683 - RNA, 22 nt, Human
gugcugcucaagggacaggaca

SEQ ID NO: 250684 - RNA, 22 nt, Human
uggauugauaagagacaaguga

SEQ ID NO: 250685 - RNA, 21 nt, Human
ggccuuccccugcagucuccg

SEQ ID NO: 250686 - RNA, 22 nt, Human
ggcaguugcgugcaucaguggu

SEQ ID NO: 250687 - RNA, 22 nt, Human
ccugagucccauaauguugcca

SEQ ID NO: 250688 - RNA, 22 nt, Human
gcuguucacagacucugcucug

SEQ ID NO: 250689 - RNA, 22 nt, Human
aggcugccagaagccuucagga

SEQ ID NO: 250690 - RNA, 22 nt, Human
guucucucugcuuccaagaugg

SEQ ID NO: 250691 - RNA, 23 nt, Human
gacacaggagcacccagcugagc

SEQ ID NO: 250692 - RNA, 22 nt, Human
uacaguaauaaaaugagcuaca

SEQ ID NO: 250693 - RNA, 22 nt, Human
ugccaggcgauugcuaucagca

SEQ ID NO: 250694 - RNA, 22 nt, Human
gccugggugagggucuccuuca

SEQ ID NO: 250695 - RNA, 22 nt, Human
cuuguauugcaaacuggccagg

SEQ ID NO: 250696 - RNA, 22 nt, Human
cauguugaauggccuugauuuu

SEQ ID NO: 250697 - RNA, 22 nt, Human
acacaucuaucucuacacaagg

SEQ ID NO: 250698 - RNA, 22 nt, Human
aucucagggguuccuucuagag

SEQ ID NO: 250699 - RNA, 22 nt, Human
aggaagccaagccugacacuca

SEQ ID NO: 250700 - RNA, 23 nt, Human
aaauggguuucuguuuuguggac

SEQ ID NO: 250701 - RNA, 22 nt, Human
agugaauucuccacccaguagg

SEQ ID NO: 250702 - RNA, 22 nt, Human
ccugcuguccccugagccugga

SEQ ID NO: 250703 - RNA, 22 nt, Human
aggcuggagcaagggggcauau

SEQ ID NO: 250704 - RNA, 22 nt, Human
aggagcucagccauucauuuga

SEQ ID NO: 250705 - RNA, 22 nt, Human
ucugggugggcccgagaaaucu

SEQ ID NO: 250706 - RNA, 22 nt, Human
cagugugaggaauuagugucca

SEQ ID NO: 250707 - RNA, 22 nt, Human
agcagcagggugauagugccca

SEQ ID NO: 250708 - RNA, 20 nt, Human
ucucaggguucagcaaagua

SEQ ID NO: 250709 - RNA, 22 nt, Human
acccucagaguaggcacugcug

SEQ ID NO: 250710 - RNA, 22 nt, Human
cccacgucgaacuugcuccaga

SEQ ID NO: 250711 - RNA, 22 nt, Human
caauucaaguugaguacagcuu

SEQ ID NO: 250712 - RNA, 22 nt, Human
cagcaggaggugaguagcaggu

SEQ ID NO: 250713 - RNA, 22 nt, Human
gugcacaggugggaaaaugagu

SEQ ID NO: 250714 - RNA, 19 nt, Human
uucauucucuuauuguugu

SEQ ID NO: 250715 - RNA, 22 nt, Human
ucacuuuccucaucacgacuag

SEQ ID NO: 250716 - RNA, 22 nt, Human
acuguacucuuauagccaucug

SEQ ID NO: 250717 - RNA, 22 nt, Human
ggucuccauuccuucaucucac

SEQ ID NO: 250718 - RNA, 22 nt, Human
aguuauuuacuccuuugucucu

SEQ ID NO: 250719 - RNA, 23 nt, Human
uuuuaauuuggacauaagaagau

SEQ ID NO: 250720 - RNA, 22 nt, Human
acccucagacagcuguggccag

SEQ ID NO: 250721 - RNA, 22 nt, Human
cagcucuguucauagauggugc

SEQ ID NO: 250722 - RNA, 22 nt, Human
uacaucuuugucuaugaccagc

SEQ ID NO: 250723 - RNA, 22 nt, Human
cuuugcuuuacucccacugugu

SEQ ID NO: 250724 - RNA, 22 nt, Human
augaggcacaucacagccaaug

SEQ ID NO: 250725 - RNA, 22 nt, Human
auccuuagguggugcaucaggg

SEQ ID NO: 250726 - RNA, 22 nt, Human
gggcucugagcucugggaauua

SEQ ID NO: 250727 - RNA, 19 nt, Human
agcauuaggcaaauuuuga

SEQ ID NO: 250728 - RNA, 22 nt, Human
uggcugcaggggugucugacau

SEQ ID NO: 250729 - RNA, 22 nt, Human
cauggaggccaggaaacagccu

SEQ ID NO: 250730 - RNA, 22 nt, Human
uguuuaauucaccaucauguuc

SEQ ID NO: 250731 - RNA, 22 nt, Human
uauuuaaccaguuaaauuucca

SEQ ID NO: 250732 - RNA, 22 nt, Human
gcugaggcucaauccccuucug

SEQ ID NO: 250733 - RNA, 22 nt, Human
caugauuuacuaaaauuuguuu

SEQ ID NO: 250734 - RNA, 22 nt, Human
guucagcccacagagggggccg

SEQ ID NO: 250735 - RNA, 18 nt, Human
cccagccucuccuuucua

SEQ ID NO: 250736 - RNA, 22 nt, Human
ggcuggaggagaauggguguga

SEQ ID NO: 250737 - RNA, 22 nt, Human
uuucaguuuagacuaaagguag

SEQ ID NO: 250738 - RNA, 22 nt, Human
caggaggagggcagccgccucc

SEQ ID NO: 250739 - RNA, 22 nt, Human
uagaaacacagaucugguguca

SEQ ID NO: 250740 - RNA, 22 nt, Human
aaaugcagguaguauuuauuuu

SEQ ID NO: 250741 - RNA, 22 nt, Human
cugcugugaguuuggaggucua

SEQ ID NO: 250742 - RNA, 20 nt, Human
gccuccacacucaccccuua

SEQ ID NO: 250743 - RNA, 22 nt, Human
cggggucccugcccacccauac

SEQ ID NO: 250744 - RNA, 23 nt, Human
acauacauggagauaaagugaug

SEQ ID NO: 250745 - RNA, 22 nt, Human
uagaacaugugaaaauauagcc

SEQ ID NO: 250746 - RNA, 22 nt, Human
uguuaacauacugcuuucuaau

SEQ ID NO: 250747 - RNA, 22 nt, Human
cucugagguuccuuugcccucg

SEQ ID NO: 250748 - RNA, 20 nt, Human
gaugagacccaugcaugaga

SEQ ID NO: 250749 - RNA, 22 nt, Human
caugaauuuauauuauuaguga

SEQ ID NO: 250750 - RNA, 22 nt, Human
uucuuaacucaaauauauaucc

SEQ ID NO: 250751 - RNA, 22 nt, Human
ugcuagaagauagcuagaagau

SEQ ID NO: 250752 - RNA, 22 nt, Human
gcagcucuucacuuacuccuuu

SEQ ID NO: 250753 - RNA, 22 nt, Human
agcuuugggcagaagaggauuc

SEQ ID NO: 250754 - RNA, 22 nt, Human
agguuucugcacugucacuggu

SEQ ID NO: 250755 - RNA, 22 nt, Human
cauuucacaguaaagugauuuc

SEQ ID NO: 250756 - RNA, 22 nt, Human
aaacaauguugucuccaagagg

SEQ ID NO: 250757 - RNA, 22 nt, Human
aagauguaaaggcaauauaaag

SEQ ID NO: 250758 - RNA, 18 nt, Human
ugcuggcaacuacuauug

SEQ ID NO: 250759 - RNA, 22 nt, Human
aacuugguaaauugugucagau

SEQ ID NO: 250760 - RNA, 22 nt, Human
ugcagccuagacauucugguca

SEQ ID NO: 250761 - RNA, 20 nt, Human
gcccucugccucccucagcg

SEQ ID NO: 250762 - RNA, 22 nt, Human
uuuuggcuuuuccucagcaagc

SEQ ID NO: 250763 - RNA, 19 nt, Human
gggagcaggaaagcugugg

SEQ ID NO: 250764 - RNA, 22 nt, Human
agcaggcagccauuuggaaggc

SEQ ID NO: 250765 - RNA, 23 nt, Human
cauaaaauauuaguaugguagca

SEQ ID NO: 250766 - RNA, 22 nt, Human
gucuucuuuaaccuacuaaagc

SEQ ID NO: 250767 - RNA, 22 nt, Human
augggggcggcugaagcccagg

SEQ ID NO: 250768 - RNA, 22 nt, Human
auggcagcuggcuugggcaccu

SEQ ID NO: 250769 - RNA, 22 nt, Human
caccagcccccucacgcuguca

SEQ ID NO: 250770 - RNA, 22 nt, Human
ccaggcuggaaucaauauucug

SEQ ID NO: 250771 - RNA, 22 nt, Human
cggggcagaaaguugucuuuug

SEQ ID NO: 250772 - RNA, 22 nt, Human
ucuuuaaucauaaccaagaugg

SEQ ID NO: 250773 - RNA, 22 nt, Human
uagucagugcacagacacuugu

SEQ ID NO: 250774 - RNA, 21 nt, Human
ucagagggcccuggaggcuca

SEQ ID NO: 250775 - RNA, 22 nt, Human
uucucugaucuugcuagacuga

SEQ ID NO: 250776 - RNA, 19 nt, Human
uauauauuuugggguugug

SEQ ID NO: 250777 - RNA, 22 nt, Human
cuuccucugccucccgugcuca

SEQ ID NO: 250778 - RNA, 22 nt, Human
uuaaaauagccagugccccucu

SEQ ID NO: 250779 - RNA, 22 nt, Human
ugcccugugccagacuuccugg

SEQ ID NO: 250780 - RNA, 22 nt, Human
gggcuucuaagugaaaguguaa

SEQ ID NO: 250781 - RNA, 22 nt, Human
ugucugcagaagauggcauggg

SEQ ID NO: 250782 - RNA, 22 nt, Human
accaggaagcaucccuuuguaa

SEQ ID NO: 250783 - RNA, 22 nt, Human
ccaggcuccucaugaucuuguu

SEQ ID NO: 250784 - RNA, 22 nt, Human
ucgcuugaacccaggaagugga

SEQ ID NO: 250785 - RNA, 22 nt, Human
ucauguacauguaagucagaaa

SEQ ID NO: 250786 - RNA, 22 nt, Human
cucuggcuuaguaugcuccaaa

SEQ ID NO: 250787 - RNA, 22 nt, Human
uccaucauggcagcagcaguga

SEQ ID NO: 250788 - RNA, 22 nt, Human
cagagccaggccugcccucuuu

SEQ ID NO: 250789 - RNA, 22 nt, Human
ccucagagguucugugugggaa

SEQ ID NO: 250790 - RNA, 22 nt, Human
aaggcuagagagguauucaagu

SEQ ID NO: 250791 - RNA, 21 nt, Human
cagacaugagucucagcuuug

SEQ ID NO: 250792 - RNA, 22 nt, Human
auguuuuauguuccacucaagg

SEQ ID NO: 250793 - RNA, 22 nt, Human
cagcccugcagcuggaucucac

SEQ ID NO: 250794 - RNA, 22 nt, Human
aggaggccgcugaugggcuccc

SEQ ID NO: 250795 - RNA, 22 nt, Human
aguuuacaugacguguauuuca

SEQ ID NO: 250796 - RNA, 22 nt, Human
auaaauuaggaucugggguucc

SEQ ID NO: 250797 - RNA, 22 nt, Human
cuauuuggauguuagccucagu

SEQ ID NO: 250798 - RNA, 22 nt, Human
cuccuucagcugaaucccugcu

SEQ ID NO: 250799 - RNA, 22 nt, Human
aaggagugauauaugggugcua

SEQ ID NO: 250800 - RNA, 22 nt, Human
ugcagaguaaaagcagaugcua

SEQ ID NO: 250801 - RNA, 22 nt, Human
gcauggcuccugucuuacuccc

SEQ ID NO: 250802 - RNA, 22 nt, Human
guaacauuuacaguuccuagag

SEQ ID NO: 250803 - RNA, 20 nt, Human
aguguacagacacuagaaau

SEQ ID NO: 250804 - RNA, 22 nt, Human
uucucaggguagaggugacacu

SEQ ID NO: 250805 - RNA, 22 nt, Human
ccucaggcuucgucuuccaccc

SEQ ID NO: 250806 - RNA, 22 nt, Human
aauagcauagaguuaaaaugca

SEQ ID NO: 250807 - RNA, 22 nt, Human
caggucugagucacauguucau

SEQ ID NO: 250808 - RNA, 22 nt, Human
uucaaaauuguucuaagcucug

SEQ ID NO: 250809 - RNA, 22 nt, Human
acaggacaaaaaucuggauggc

SEQ ID NO: 250810 - RNA, 22 nt, Human
gcagagugaagcauuucuuucu

SEQ ID NO: 250811 - RNA, 22 nt, Human
cugagggagcugcuggccuugg

SEQ ID NO: 250812 - RNA, 22 nt, Human
cagcuggguuuaguggggugug

SEQ ID NO: 250813 - RNA, 22 nt, Human
caggaugcggccugacucuaag

SEQ ID NO: 250814 - RNA, 22 nt, Human
ugguccuguagcucucuaaguu

SEQ ID NO: 250815 - RNA, 22 nt, Human
uucuugaaggggauauaaauag

SEQ ID NO: 250816 - RNA, 22 nt, Human
ggcucugaagggugacagguuu

SEQ ID NO: 250817 - RNA, 22 nt, Human
cucucuggacuugaguaucagc

SEQ ID NO: 250818 - RNA, 22 nt, Human
auagaaccacccagagccuuuu

SEQ ID NO: 250819 - RNA, 22 nt, Human
ucuucagauugcacugagcaag

SEQ ID NO: 250820 - RNA, 22 nt, Human
ugggagaacccagggucaggcu

SEQ ID NO: 250821 - RNA, 22 nt, Human
cuacagucuggcaggaauguua

SEQ ID NO: 250822 - RNA, 22 nt, Human
auguggauuugggagugaucag

SEQ ID NO: 250823 - RNA, 22 nt, Human
gaagccaagccagcugauggag

SEQ ID NO: 250824 - RNA, 22 nt, Human
ugcaucagugacugaauaugag

SEQ ID NO: 250825 - RNA, 22 nt, Human
cagcagcaugaauucgagccac

SEQ ID NO: 250826 - RNA, 18 nt, Human
ucaggcuuugagagaauc

SEQ ID NO: 250827 - RNA, 22 nt, Human
ucuugggaggagcaccugccug

SEQ ID NO: 250828 - RNA, 22 nt, Human
uaguuaggguucugcagagaca

SEQ ID NO: 250829 - RNA, 22 nt, Human
agcuuuacaucgaaguucaguc

SEQ ID NO: 250830 - RNA, 22 nt, Human
aggagcuggccuagaaaggaga

SEQ ID NO: 250831 - RNA, 22 nt, Human
cuggguuuuauuacagugagcu

SEQ ID NO: 250832 - RNA, 22 nt, Human
ccagacaggggcuguuccugcu

SEQ ID NO: 250833 - RNA, 22 nt, Human
uagucuuuugagaaguauaucu

SEQ ID NO: 250834 - RNA, 21 nt, Human
ugcugggcugcaggggaugca

SEQ ID NO: 250835 - RNA, 22 nt, Human
uuagcaauccuaggcuggauca

SEQ ID NO: 250836 - RNA, 22 nt, Human
augaggaggucaggccuuacaa

SEQ ID NO: 250837 - RNA, 22 nt, Human
ugagaaaacaguuuguaauaau

SEQ ID NO: 250838 - RNA, 22 nt, Human
uugagggauuuuaaaugaacaa

SEQ ID NO: 250839 - RNA, 22 nt, Human
ugccaguguggaacuaggaaga

SEQ ID NO: 250840 - RNA, 22 nt, Human
uguuacaagucuugagguacuu

SEQ ID NO: 250841 - RNA, 22 nt, Human
aggggaaggccagccuguagag

SEQ ID NO: 250842 - RNA, 22 nt, Human
aagacucaaggaacaacacagu

SEQ ID NO: 250843 - RNA, 22 nt, Human
gccuggagugguccugcugccc

SEQ ID NO: 250844 - RNA, 22 nt, Human
ucauaaagcuugccugcagugu

SEQ ID NO: 250845 - RNA, 15 nt, Human
uccaggcauucauuc

SEQ ID NO: 250846 - RNA, 22 nt, Human
aagcucugguuaaaaggccugg

SEQ ID NO: 250847 - RNA, 22 nt, Human
ugcaugcaacaauucuucuaua

SEQ ID NO: 250848 - RNA, 22 nt, Human
agcucaaagcuguuacauugua

SEQ ID NO: 250849 - RNA, 22 nt, Human
agggcuccgggcaggcgaugga

SEQ ID NO: 250850 - RNA, 22 nt, Human
auaauauuugcauuacugugau

SEQ ID NO: 250851 - RNA, 22 nt, Human
uuaugcuaaaugaaucaaguca

SEQ ID NO: 250852 - RNA, 22 nt, Human
cucuguuacagcccccugccuc

SEQ ID NO: 250853 - RNA, 19 nt, Human
ggaagcccuaaaggaccua

SEQ ID NO: 250854 - RNA, 22 nt, Human
uucaaaucagaccgaaggcaac

SEQ ID NO: 250855 - RNA, 19 nt, Human
gcagugucaugguaggagc

SEQ ID NO: 250856 - RNA, 22 nt, Human
agaagcccagcauggaaccagc

SEQ ID NO: 250857 - RNA, 22 nt, Human
aaggccagaguacuagaggcug

SEQ ID NO: 250858 - RNA, 22 nt, Human
gaccuggguaaggggcugacaa

SEQ ID NO: 250859 - RNA, 22 nt, Human
cauuuaauagaugcuguuucag

SEQ ID NO: 250860 - RNA, 22 nt, Human
auuacaguggacagcuaugcac

SEQ ID NO: 250861 - RNA, 22 nt, Human
uucagcaacucaaaccuauuag

SEQ ID NO: 250862 - RNA, 22 nt, Human
gcugugcaguaguagguacagu

SEQ ID NO: 250863 - RNA, 22 nt, Human
agcagcugguaggaguggccac

SEQ ID NO: 250864 - RNA, 20 nt, Human
ucccucagcacuucuaccuc

SEQ ID NO: 250865 - RNA, 22 nt, Human
agcagcagaggucagaaaggua

SEQ ID NO: 250866 - RNA, 20 nt, Human
ucugagacuuguagugugga

SEQ ID NO: 250867 - RNA, 22 nt, Human
gggaggagggugcuggcuaaac

SEQ ID NO: 250868 - RNA, 22 nt, Human
augcuuuauuauuuugcaggga

SEQ ID NO: 250869 - RNA, 19 nt, Human
cuggcugcaaugccagggu

SEQ ID NO: 250870 - RNA, 22 nt, Human
aaagauucgagcgauguauaaa

SEQ ID NO: 250871 - RNA, 22 nt, Human
uuuggaaacugccucagcucuu

SEQ ID NO: 250872 - RNA, 22 nt, Human
acagucucuuggaauuuucaga

SEQ ID NO: 250873 - RNA, 22 nt, Human
auucucugccauugcgguggau

SEQ ID NO: 250874 - RNA, 22 nt, Human
acacaugagaaacaucaguugu

SEQ ID NO: 250875 - RNA, 22 nt, Human
cagcugcccugccuugcccuua

SEQ ID NO: 250876 - RNA, 22 nt, Human
uuccucagagagacagaaacua

SEQ ID NO: 250877 - RNA, 22 nt, Human
uuccucagcucagcgagagaga

SEQ ID NO: 250878 - RNA, 22 nt, Human
gagacagagaucuugcugaguc

SEQ ID NO: 250879 - RNA, 22 nt, Human
uauuauuaaauggcagaauuuu

SEQ ID NO: 250880 - RNA, 22 nt, Human
aggaaucugugguuuuaacagg

SEQ ID NO: 250881 - RNA, 22 nt, Human
gccuggcagauugacauagcca

SEQ ID NO: 250882 - RNA, 17 nt, Human
aguguuuccuuaucauu

SEQ ID NO: 250883 - RNA, 22 nt, Human
accaauuucuuggcuuccaaau

SEQ ID NO: 250884 - RNA, 22 nt, Human
cucugggcaggaccaguggacc

SEQ ID NO: 250885 - RNA, 22 nt, Human
ugcagguggcagcggggcacca

SEQ ID NO: 250886 - RNA, 22 nt, Human
aaacugaaacaucaucauguug

SEQ ID NO: 250887 - RNA, 22 nt, Human
aaagccacugcauguguaguau

SEQ ID NO: 250888 - RNA, 22 nt, Human
ugaaggcuugacugaggcagga

SEQ ID NO: 250889 - RNA, 22 nt, Human
gaaagggucuuugauuucccuc

SEQ ID NO: 250890 - RNA, 22 nt, Human
acuuccuuguacugacuccauu

SEQ ID NO: 250891 - RNA, 19 nt, Human
gaucuuugccaauuuaagc

SEQ ID NO: 250892 - RNA, 22 nt, Human
agcugcaggagucgccuaggau

SEQ ID NO: 250893 - RNA, 21 nt, Human
ucucugggaggacuugugaga

SEQ ID NO: 250894 - RNA, 22 nt, Human
ugggacacagaaaaggcagguu

SEQ ID NO: 250895 - RNA, 22 nt, Human
uggcuggcaaggcuggagucag

SEQ ID NO: 250896 - RNA, 22 nt, Human
ugcugagggagggguuuuccag

SEQ ID NO: 250897 - RNA, 22 nt, Human
cucugggugggcagcagaugga

SEQ ID NO: 250898 - RNA, 22 nt, Human
uggggcucaccuaggcuggaag

SEQ ID NO: 250899 - RNA, 22 nt, Human
agcacuuaacugacaguacuau

SEQ ID NO: 250900 - RNA, 22 nt, Human
uccagagccugcgcacuggcug

SEQ ID NO: 250901 - RNA, 22 nt, Human
cugaccagaccccaggaggcug

SEQ ID NO: 250902 - RNA, 22 nt, Human
ggagguggccugaaaauguggc

SEQ ID NO: 250903 - RNA, 20 nt, Human
cccaggagcugugccccauc

SEQ ID NO: 250904 - RNA, 22 nt, Human
ugggggcuccaggcuccaggga

SEQ ID NO: 250905 - RNA, 22 nt, Human
uuguuaaaaugaggucauucug

SEQ ID NO: 250906 - RNA, 22 nt, Human
uugucuaaugagcuccacuuca

SEQ ID NO: 250907 - RNA, 23 nt, Human
uugaauaggguggcaacaaacug

SEQ ID NO: 250908 - RNA, 22 nt, Human
cauuguuuguaaaauuccagua

SEQ ID NO: 250909 - RNA, 19 nt, Human
uucuaccuuacuguaggcu

SEQ ID NO: 250910 - RNA, 22 nt, Human
gcacugagcaccagccacagau

SEQ ID NO: 250911 - RNA, 22 nt, Human
ggcaugcuugccaugggccagu

SEQ ID NO: 250912 - RNA, 22 nt, Human
cccugaggaugucuccuuccug

SEQ ID NO: 250913 - RNA, 22 nt, Human
cuggcagugcccucagccccca

SEQ ID NO: 250914 - RNA, 22 nt, Human
ggcucuggugggaagguuagau

SEQ ID NO: 250915 - RNA, 22 nt, Human
agcugucucucugguguccaua

SEQ ID NO: 250916 - RNA, 22 nt, Human
aggccauguggccccagagucu

SEQ ID NO: 250917 - RNA, 22 nt, Human
caacuuuaauuugggugucaga

SEQ ID NO: 250918 - RNA, 22 nt, Human
aaagguuuauuuaaucagggag

SEQ ID NO: 250919 - RNA, 22 nt, Human
gccuugggauucuuggaugcuc

SEQ ID NO: 250920 - RNA, 22 nt, Human
gcccaguaguucaagguugcag

SEQ ID NO: 250921 - RNA, 22 nt, Human
acaggaucgcccuguugcccag

SEQ ID NO: 250922 - RNA, 22 nt, Human
cccaggacuaaugagcucuacg

SEQ ID NO: 250923 - RNA, 21 nt, Human
aacugagaccagcuaaagugg

SEQ ID NO: 250924 - RNA, 22 nt, Human
aaggaagcagcaaugcaugauu

SEQ ID NO: 250925 - RNA, 17 nt, Human
ucacaucacacaagcaa

SEQ ID NO: 250926 - RNA, 22 nt, Human
uuguacaaguauuaugugaaca

SEQ ID NO: 250927 - RNA, 21 nt, Human
cagaggcagguccugggacgg

SEQ ID NO: 250928 - RNA, 22 nt, Human
uucugacacauuacuacaugga

SEQ ID NO: 250929 - RNA, 23 nt, Human
ggcucugaggauggagcuggugg

SEQ ID NO: 250930 - RNA, 22 nt, Human
agacacauuuucagcucugcca

SEQ ID NO: 250931 - RNA, 18 nt, Human
aauuucuuugacaacuua

SEQ ID NO: 250932 - RNA, 22 nt, Human
aucagaaaggugggcaagcaga

SEQ ID NO: 250933 - RNA, 22 nt, Human
cccagugggucacugcaucuca

SEQ ID NO: 250934 - RNA, 22 nt, Human
agguuuauguuuggugcaggag

SEQ ID NO: 250935 - RNA, 22 nt, Human
agaggccagcccaggccaccga

SEQ ID NO: 250936 - RNA, 22 nt, Human
ccauucaauaccuuagagaaaa

SEQ ID NO: 250937 - RNA, 22 nt, Human
uuagaagucaucuagucuaaaa

SEQ ID NO: 250938 - RNA, 22 nt, Human
gugaauaugaucuuauuuggaa

SEQ ID NO: 250939 - RNA, 22 nt, Human
gguuucaacuucaaccucucca

SEQ ID NO: 250940 - RNA, 19 nt, Human
caccccaguccucuuuccc

SEQ ID NO: 250941 - RNA, 20 nt, Human
ugagauuuguauuauaaguc

SEQ ID NO: 250942 - RNA, 17 nt, Human
gagcucuguggcacaag

SEQ ID NO: 250943 - RNA, 22 nt, Human
uaguuaaaccaccauucuggua

SEQ ID NO: 250944 - RNA, 20 nt, Human
uguacacaguacuuuacaau

SEQ ID NO: 250945 - RNA, 22 nt, Human
aucugaaagcuaggaguucuca

SEQ ID NO: 250946 - RNA, 22 nt, Human
ucagaaauuuucucaguaguuc

SEQ ID NO: 250947 - RNA, 22 nt, Human
guguccucuuauugcucuuggc

SEQ ID NO: 250948 - RNA, 22 nt, Human
aguggcuguacuauuuuuucau

SEQ ID NO: 250949 - RNA, 22 nt, Human
ggcagcagaacuggcccuguau

SEQ ID NO: 250950 - RNA, 22 nt, Human
uccuccuuguucuuuugccuac

SEQ ID NO: 250951 - RNA, 22 nt, Human
cuaaacaaugaacaaagcacug

SEQ ID NO: 250952 - RNA, 20 nt, Human
uguccaggggaucguuggcc

SEQ ID NO: 250953 - RNA, 22 nt, Human
cucuagaaggucucccugccag

SEQ ID NO: 250954 - RNA, 22 nt, Human
uaaagcauguguuagaagugca

SEQ ID NO: 250955 - RNA, 22 nt, Human
agccuccaguagcugaagagac

SEQ ID NO: 250956 - RNA, 22 nt, Human
ucaagcaaguugcauauugcua

SEQ ID NO: 250957 - RNA, 22 nt, Human
uuuccucauuuaucugcuggga

SEQ ID NO: 250958 - RNA, 22 nt, Human
ugauucaagauugguuagcugu

SEQ ID NO: 250959 - RNA, 22 nt, Human
ggcagccagcaaugagaaguuu

SEQ ID NO: 250960 - RNA, 22 nt, Human
uucuauguucuaagucucaagg

SEQ ID NO: 250961 - RNA, 22 nt, Human
uggcaccaccagacaccaggag

SEQ ID NO: 250962 - RNA, 22 nt, Human
gggccaggaguggagauauggg

SEQ ID NO: 250963 - RNA, 22 nt, Human
acagaggguguggaggaagacg

SEQ ID NO: 250964 - RNA, 22 nt, Human
uaauuuuccacucuguuuaucu

SEQ ID NO: 250965 - RNA, 22 nt, Human
aagaaaccaacccugccagcac

SEQ ID NO: 250966 - RNA, 22 nt, Human
cugagcccgggugcucuacccc

SEQ ID NO: 250967 - RNA, 21 nt, Human
agcugccuccacuucugaggc

SEQ ID NO: 250968 - RNA, 22 nt, Human
gccucagcuguugcaggggccc

SEQ ID NO: 250969 - RNA, 22 nt, Human
agauccauuuuggugucaacuc

SEQ ID NO: 250970 - RNA, 22 nt, Human
aacaguacaacuccacaagacu

SEQ ID NO: 250971 - RNA, 22 nt, Human
auuuaauuuucucaacagugcu

SEQ ID NO: 250972 - RNA, 22 nt, Human
ccugguugugaguugaguugag

SEQ ID NO: 250973 - RNA, 22 nt, Human
aagguugcagcaguguugauga

SEQ ID NO: 250974 - RNA, 22 nt, Human
ucucuggucccaccuggccauu

SEQ ID NO: 250975 - RNA, 22 nt, Human
gaaaccagcuagaggcagaggg

SEQ ID NO: 250976 - RNA, 22 nt, Human
uuugcaaaugcucugcagagcu

SEQ ID NO: 250977 - RNA, 22 nt, Human
agggagccuuccuggcuguggu

SEQ ID NO: 250978 - RNA, 22 nt, Human
gggaagggacuuguuuaagguc

SEQ ID NO: 250979 - RNA, 22 nt, Human
ucccaccccggucaagggcuga

SEQ ID NO: 250980 - RNA, 22 nt, Human
auaucacagguguuuaccugau

SEQ ID NO: 250981 - RNA, 22 nt, Human
ugagugcuuuaaauguuauuuu

SEQ ID NO: 250982 - RNA, 22 nt, Human
ucucuuggggaaagagaagaau

SEQ ID NO: 250983 - RNA, 23 nt, Human
uccagcagagccuuccaggaggg

SEQ ID NO: 250984 - RNA, 22 nt, Human
cugcugcauuccucuuuaugag

SEQ ID NO: 250985 - RNA, 22 nt, Human
augucuuucgcaucaguagcua

SEQ ID NO: 250986 - RNA, 22 nt, Human
ucugccagaaguucugagagua

SEQ ID NO: 250987 - RNA, 22 nt, Human
ucacaggccuggggcagagggc

SEQ ID NO: 250988 - RNA, 22 nt, Human
cagggagcugacaaccaaggag

SEQ ID NO: 250989 - RNA, 22 nt, Human
aaacugaauucaaguauccagu

SEQ ID NO: 250990 - RNA, 22 nt, Human
auacagauguugaauguuauau

SEQ ID NO: 250991 - RNA, 22 nt, Human
guaaauuauuucaagaucaucu

SEQ ID NO: 250992 - RNA, 22 nt, Human
cugggguggauggguccaaguu

SEQ ID NO: 250993 - RNA, 22 nt, Human
cuggcccuugacuuacagcagg

SEQ ID NO: 250994 - RNA, 22 nt, Human
uaugucacauuguaacagugug

SEQ ID NO: 250995 - RNA, 22 nt, Human
cucugcccgugccuuucccagu

SEQ ID NO: 250996 - RNA, 22 nt, Human
cugccuuccaaccccagacucc

SEQ ID NO: 250997 - RNA, 18 nt, Human
cugggccagaguuucugc

SEQ ID NO: 250998 - RNA, 22 nt, Human
acagagacugggagcaagaggc

SEQ ID NO: 250999 - RNA, 22 nt, Human
uuucucaguuacuagcuguggu

SEQ ID NO: 251000 - RNA, 22 nt, Human
uuccuggccccaccccuggaga

SEQ ID NO: 251001 - RNA, 20 nt, Human
cccaggcagagcuagcggca

SEQ ID NO: 251002 - RNA, 22 nt, Human
uuucaugagauuccuccacauc

SEQ ID NO: 251003 - RNA, 18 nt, Human
cauuuguuauugugugug

SEQ ID NO: 251004 - RNA, 22 nt, Human
caggggaguuuuaugcaacaga

SEQ ID NO: 251005 - RNA, 22 nt, Human
ccugccagcugugggccagccu

SEQ ID NO: 251006 - RNA, 22 nt, Human
aggaagcucaaagccaugaugu

SEQ ID NO: 251007 - RNA, 22 nt, Human
auucaaacacuuugagaaguuc

SEQ ID NO: 251008 - RNA, 22 nt, Human
ucucugguggcuccaucaguag

SEQ ID NO: 251009 - RNA, 22 nt, Human
aggcugcagaacagucaggugc

SEQ ID NO: 251010 - RNA, 22 nt, Human
aucuccagaacauuuauaaacg

SEQ ID NO: 251011 - RNA, 20 nt, Human
cuuagaagggacauccuggg

SEQ ID NO: 251012 - RNA, 22 nt, Human
uugugucccuguaagacaaagc

SEQ ID NO: 251013 - RNA, 22 nt, Human
uggaauguaaaccucagguggg

SEQ ID NO: 251014 - RNA, 22 nt, Human
acacuaaugagaaaggaauuaa

SEQ ID NO: 251015 - RNA, 19 nt, Human
ucugucauuucuucuguac

SEQ ID NO: 251016 - RNA, 22 nt, Human
aguguauugauuggaacagccu

SEQ ID NO: 251017 - RNA, 22 nt, Human
caaggccagggaauuuuucugg

SEQ ID NO: 251018 - RNA, 22 nt, Human
uacaagaugacaggugcaugau

SEQ ID NO: 251019 - RNA, 22 nt, Human
uaguuuugauuaguauugucuu

SEQ ID NO: 251020 - RNA, 22 nt, Human
ucuguuuucucuguauuuugac

SEQ ID NO: 251021 - RNA, 22 nt, Human
uuguuucucuggucuugaguga

SEQ ID NO: 251022 - RNA, 22 nt, Human
cuuuuacacucaucugggaggg

SEQ ID NO: 251023 - RNA, 22 nt, Human
ggaagagagggcugggccucaa

SEQ ID NO: 251024 - RNA, 22 nt, Human
ccagcccugccucucagggccc

SEQ ID NO: 251025 - RNA, 22 nt, Human
ugcugcaggccuuggcugggaa

SEQ ID NO: 251026 - RNA, 22 nt, Human
cagauguaguagcuuuauugca

SEQ ID NO: 251027 - RNA, 22 nt, Human
ucuguauuuuaagaugcuguuu

SEQ ID NO: 251028 - RNA, 22 nt, Human
ugggcucaaucugcuucuguuu

SEQ ID NO: 251029 - RNA, 22 nt, Human
agugcuccacauugcacuauuc

SEQ ID NO: 251030 - RNA, 22 nt, Human
ccuuccuugucuacaaaagcuc

SEQ ID NO: 251031 - RNA, 22 nt, Human
caggaugagaggcccagggaag

SEQ ID NO: 251032 - RNA, 22 nt, Human
cagacagacagccguggccacc

SEQ ID NO: 251033 - RNA, 22 nt, Human
cauguucaccuguggcacuagu

SEQ ID NO: 251034 - RNA, 18 nt, Human
uggugccuuucacucuuc

SEQ ID NO: 251035 - RNA, 22 nt, Human
ccugagacaugaaccaggcucc

SEQ ID NO: 251036 - RNA, 22 nt, Human
agggcuuucuuuguaaaagaag

SEQ ID NO: 251037 - RNA, 22 nt, Human
gagguggccucaagcagucuuc

SEQ ID NO: 251038 - RNA, 22 nt, Human
uugagggacagaggugcugucu

SEQ ID NO: 251039 - RNA, 18 nt, Human
cuccaaggucucuggcuu

SEQ ID NO: 251040 - RNA, 22 nt, Human
augucaaaucaguuuuaucaga

SEQ ID NO: 251041 - RNA, 22 nt, Human
uaucuuuauuaugucuaucugc

SEQ ID NO: 251042 - RNA, 22 nt, Human
auuuccaucaucauuaggccua

SEQ ID NO: 251043 - RNA, 22 nt, Human
cuggcucaugugaugagggcaa

SEQ ID NO: 251044 - RNA, 22 nt, Human
uggagccagcgagccgaggcgg

SEQ ID NO: 251045 - RNA, 22 nt, Human
aggcuccuagccuguggcuggu

SEQ ID NO: 251046 - RNA, 22 nt, Human
cuggaggcaaagcagaggcaug

SEQ ID NO: 251047 - RNA, 22 nt, Human
uaaagcauguacugugugcuag

SEQ ID NO: 251048 - RNA, 20 nt, Human
caauaauuuacuucccuauu

SEQ ID NO: 251049 - RNA, 22 nt, Human
uuggaaggauuuagagaugucu

SEQ ID NO: 251050 - RNA, 21 nt, Human
agcagaggcugccuggugacu

SEQ ID NO: 251051 - RNA, 22 nt, Human
gcagaauugauggagaacuuaa

SEQ ID NO: 251052 - RNA, 22 nt, Human
ggccagcucaggguccuugggc

SEQ ID NO: 251053 - RNA, 19 nt, Human
ccaccccuuugcugggccc

SEQ ID NO: 251054 - RNA, 22 nt, Human
aguuugaagcacaugaauggca

SEQ ID NO: 251055 - RNA, 22 nt, Human
aaggcauuaccuaaguuuggga

SEQ ID NO: 251056 - RNA, 19 nt, Human
ucagggaguuuacagcaug

SEQ ID NO: 251057 - RNA, 22 nt, Human
gccagagccggcuucacaggau

SEQ ID NO: 251058 - RNA, 22 nt, Human
aauuaagaaaauguuuuaugau

SEQ ID NO: 251059 - RNA, 22 nt, Human
gaggagaagggcacggagaaaa

SEQ ID NO: 251060 - RNA, 22 nt, Human
uucauauuaugauuugaaaugc

SEQ ID NO: 251061 - RNA, 22 nt, Human
gacacaggggggcgcuagaaga

SEQ ID NO: 251062 - RNA, 22 nt, Human
uuccagagcaguuuucagauca

SEQ ID NO: 251063 - RNA, 22 nt, Human
ucccuguaaaccucaaguugau

SEQ ID NO: 251064 - RNA, 23 nt, Human
cucagcaggucaggccccuuccu

SEQ ID NO: 251065 - RNA, 22 nt, Human
cccaggcaggagugugguggcu

SEQ ID NO: 251066 - RNA, 22 nt, Human
aaaggcuggggacugaggaagg

SEQ ID NO: 251067 - RNA, 22 nt, Human
acagaggaaggcugagcugccc

SEQ ID NO: 251068 - RNA, 22 nt, Human
uucuguacccaacauuuuuacu

SEQ ID NO: 251069 - RNA, 22 nt, Human
uaaaugcaguacaaauuguucu

SEQ ID NO: 251070 - RNA, 22 nt, Human
cuccacagagaugcugauugua

SEQ ID NO: 251071 - RNA, 22 nt, Human
gacagacaggaggcauucaggg

SEQ ID NO: 251072 - RNA, 22 nt, Human
cuccucuggaaauuccucugcc

SEQ ID NO: 251073 - RNA, 22 nt, Human
acaauuuuccccauagguuauc

SEQ ID NO: 251074 - RNA, 22 nt, Human
aagccagugugacaggaaacuu

SEQ ID NO: 251075 - RNA, 22 nt, Human
cuuuaagacucugcucuuggug

SEQ ID NO: 251076 - RNA, 22 nt, Human
gcaggucucaaucugagcaggc

SEQ ID NO: 251077 - RNA, 22 nt, Human
ggcugcugcccaccccugcaug

SEQ ID NO: 251078 - RNA, 19 nt, Human
agucuuguauuuuucaagc

SEQ ID NO: 251079 - RNA, 22 nt, Human
gaaagcaguaaaugggucccau

SEQ ID NO: 251080 - RNA, 22 nt, Human
aaagccuucuuguaucgagcca

SEQ ID NO: 251081 - RNA, 22 nt, Human
acuucacuuguaaaugcagccu

SEQ ID NO: 251082 - RNA, 22 nt, Human
ucucugaggacuugggguugcc

SEQ ID NO: 251083 - RNA, 22 nt, Human
cagggauggccuggcgggccac

SEQ ID NO: 251084 - RNA, 17 nt, Human
gaugaaaugaugcacac

SEQ ID NO: 251085 - RNA, 22 nt, Human
gaccacuggggugagggccauc

SEQ ID NO: 251086 - RNA, 18 nt, Human
guuaauuuugaaguucau

SEQ ID NO: 251087 - RNA, 22 nt, Human
cuguguccaauggccuuagcag

SEQ ID NO: 251088 - RNA, 22 nt, Human
uguccaggcuaaagugcagugg

SEQ ID NO: 251089 - RNA, 22 nt, Human
ccugggcucuauccugacccag

SEQ ID NO: 251090 - RNA, 22 nt, Human
ccaggcaagcucugcugugccc

SEQ ID NO: 251091 - RNA, 22 nt, Human
cuggggcaucauccauucuuuc

SEQ ID NO: 251092 - RNA, 22 nt, Human
ugugggaggucuggaaggcucc

SEQ ID NO: 251093 - RNA, 22 nt, Human
agcacauucugccuugcuuugc

SEQ ID NO: 251094 - RNA, 22 nt, Human
cacaggcucuucucacuugauu

SEQ ID NO: 251095 - RNA, 22 nt, Human
ucucuccuguguucugauguuu

SEQ ID NO: 251096 - RNA, 22 nt, Human
gcucugagaggugcagcaguaa

SEQ ID NO: 251097 - RNA, 22 nt, Human
uccuaguucucugccagucgcu

SEQ ID NO: 251098 - RNA, 22 nt, Human
aucaaagugguuuucugugcuu

SEQ ID NO: 251099 - RNA, 22 nt, Human
caucuaauaccucauuuaaucu

SEQ ID NO: 251100 - RNA, 22 nt, Human
gaacuacaggugcagcaaguga

SEQ ID NO: 251101 - RNA, 22 nt, Human
aggaccagccuccaggucucuu

SEQ ID NO: 251102 - RNA, 22 nt, Human
gcuccagcuccggcuccgaagc

SEQ ID NO: 251103 - RNA, 22 nt, Human
ugcccagcuauuccuuucuuag

SEQ ID NO: 251104 - RNA, 22 nt, Human
ccaggagucaauaaaggaagcu

SEQ ID NO: 251105 - RNA, 22 nt, Human
ugacaggggcugguggauaaau

SEQ ID NO: 251106 - RNA, 22 nt, Human
gcagcuuucuaagcuuuauugc

SEQ ID NO: 251107 - RNA, 22 nt, Human
caaagagguuuugagggcagcu

SEQ ID NO: 251108 - RNA, 22 nt, Human
gccacagccucugggaaaacuc

SEQ ID NO: 251109 - RNA, 22 nt, Human
uaaaaguuuuaguuguacauaa

SEQ ID NO: 251110 - RNA, 22 nt, Human
agacagacggcuuuauacacag

SEQ ID NO: 251111 - RNA, 17 nt, Human
ugcugacagcugugugu

SEQ ID NO: 251112 - RNA, 22 nt, Human
auucaaagcccaguaaacauug

SEQ ID NO: 251113 - RNA, 22 nt, Human
auuuccaggagaaaggauuuua

SEQ ID NO: 251114 - RNA, 22 nt, Human
uggguagaguggagggauaaga

SEQ ID NO: 251115 - RNA, 22 nt, Human
agcaggagacauggggguggug

SEQ ID NO: 251116 - RNA, 19 nt, Human
uguagcaguuuaaaacaac

SEQ ID NO: 251117 - RNA, 20 nt, Human
uucacauuucuguagugauu

SEQ ID NO: 251118 - RNA, 22 nt, Human
acacucugcucugagcuucagg

SEQ ID NO: 251119 - RNA, 22 nt, Human
guacccagaggcaugaucccag

SEQ ID NO: 251120 - RNA, 22 nt, Human
acaggacaaggggaagaagaua

SEQ ID NO: 251121 - RNA, 22 nt, Human
caggacaguuggcaucugcugc

SEQ ID NO: 251122 - RNA, 22 nt, Human
uggcagggugccaguugcgagu

SEQ ID NO: 251123 - RNA, 22 nt, Human
aucugggucacaguggcaucua

SEQ ID NO: 251124 - RNA, 22 nt, Human
agggcugccccaguccagccgg

SEQ ID NO: 251125 - RNA, 22 nt, Human
acauugcaauaauaauucucuu

SEQ ID NO: 251126 - RNA, 22 nt, Human
uuuugccugugaauacuaucuu

SEQ ID NO: 251127 - RNA, 21 nt, Human
gaggaaaugcucugguguuca

SEQ ID NO: 251128 - RNA, 22 nt, Human
cugccucuauucacugaggcag

SEQ ID NO: 251129 - RNA, 22 nt, Human
uuguuuuggagaugagcuaaaa

SEQ ID NO: 251130 - RNA, 22 nt, Human
cuuguugcuaacauaugcuucu

SEQ ID NO: 251131 - RNA, 22 nt, Human
caguguggguuugggaggagua

SEQ ID NO: 251132 - RNA, 23 nt, Human
uggcaggugguuagauguuuugu

SEQ ID NO: 251133 - RNA, 22 nt, Human
cauuguuugagcaucugggauc

SEQ ID NO: 251134 - RNA, 22 nt, Human
cucugagguccuacagugaccc

SEQ ID NO: 251135 - RNA, 22 nt, Human
ccaggugugucaccauugccca

SEQ ID NO: 251136 - RNA, 22 nt, Human
ugucucuccacacagccagugc

SEQ ID NO: 251137 - RNA, 23 nt, Human
gugcgccaggacaaccugacgga

SEQ ID NO: 251138 - RNA, 22 nt, Human
aggcuacaggagacgccaggag

SEQ ID NO: 251139 - RNA, 22 nt, Human
acauuguagacuuuucauaugu

SEQ ID NO: 251140 - RNA, 21 nt, Human
ucuuguauuggaucugugugu

SEQ ID NO: 251141 - RNA, 22 nt, Human
auaagcauuucacagguguguu

SEQ ID NO: 251142 - RNA, 22 nt, Human
uccauuuucaucucauguauaa

SEQ ID NO: 251143 - RNA, 22 nt, Human
uuggaggaaagaagguugauau

SEQ ID NO: 251144 - RNA, 22 nt, Human
uugagggauuuacagagguggg

SEQ ID NO: 251145 - RNA, 22 nt, Human
ugagcaguggcaccaggucacc

SEQ ID NO: 251146 - RNA, 22 nt, Human
ucugagcugggcacagaaggcg

SEQ ID NO: 251147 - RNA, 22 nt, Human
agcaguuuuagggagacacauu

SEQ ID NO: 251148 - RNA, 22 nt, Human
uacauacauguauguguguauu

SEQ ID NO: 251149 - RNA, 22 nt, Human
ccccucagguacccgugcagca

SEQ ID NO: 251150 - RNA, 22 nt, Human
aacuaaaucuggcauuuagagc

SEQ ID NO: 251151 - RNA, 22 nt, Human
uggggccagguggcugcagguc

SEQ ID NO: 251152 - RNA, 22 nt, Human
guccugagaugucacaagguuu

SEQ ID NO: 251153 - RNA, 22 nt, Human
augacaaauucagaccauagca

SEQ ID NO: 251154 - RNA, 22 nt, Human
ucaacacucuuuggcacaguua

SEQ ID NO: 251155 - RNA, 22 nt, Human
ggggggugcugaucaguggagc

SEQ ID NO: 251156 - RNA, 22 nt, Human
cuggccagugccugugggcccc

SEQ ID NO: 251157 - RNA, 22 nt, Human
aaaugcuucaccucauuaaacu

SEQ ID NO: 251158 - RNA, 22 nt, Human
ccuugaaauguucucacugggg

SEQ ID NO: 251159 - RNA, 22 nt, Human
aaggaagcagccagagacccuc

SEQ ID NO: 251160 - RNA, 22 nt, Human
ccagcucuuuuggcugagugag

SEQ ID NO: 251161 - RNA, 22 nt, Human
uugaaucuauguauucagugua

SEQ ID NO: 251162 - RNA, 22 nt, Human
uagaaccucugauuauguuacu

SEQ ID NO: 251163 - RNA, 22 nt, Human
uuugaagacauauuguuacaua

SEQ ID NO: 251164 - RNA, 22 nt, Human
gcccaggccggagagcagugcu

SEQ ID NO: 251165 - RNA, 22 nt, Human
cugggcuuagcagcuccugguc

SEQ ID NO: 251166 - RNA, 22 nt, Human
ugaaugauaugugaaaaggaac

SEQ ID NO: 251167 - RNA, 22 nt, Human
ccuggaggcucugggagggcag

SEQ ID NO: 251168 - RNA, 22 nt, Human
ccuccagccuuccugaagagcc

SEQ ID NO: 251169 - RNA, 22 nt, Human
caaaaggccaguacuuuguuug

SEQ ID NO: 251170 - RNA, 22 nt, Human
cugguuuacucugcacugcuca

SEQ ID NO: 251171 - RNA, 22 nt, Human
agaaaucucaguaucucaggga

SEQ ID NO: 251172 - RNA, 22 nt, Human
uagaggugacacugagaccaua

SEQ ID NO: 251173 - RNA, 22 nt, Human
cagaggcucagauggcccuggc

SEQ ID NO: 251174 - RNA, 22 nt, Human
uuggaucacucugaagccuuac

SEQ ID NO: 251175 - RNA, 23 nt, Human
aggaaguuaaggcagacagacag

SEQ ID NO: 251176 - RNA, 19 nt, Human
ugaggccagcuggcauuuu

SEQ ID NO: 251177 - RNA, 20 nt, Human
agagcugggaagcucccuau

SEQ ID NO: 251178 - RNA, 22 nt, Human
uccaggcucucaggugucagca

SEQ ID NO: 251179 - RNA, 22 nt, Human
ugcugcauuuaucuucucaaac

SEQ ID NO: 251180 - RNA, 22 nt, Human
cacauucagguggcauguuaga

SEQ ID NO: 251181 - RNA, 20 nt, Human
gcucagagccugaacuucau

SEQ ID NO: 251182 - RNA, 22 nt, Human
gcuccuguaauuuuuaaaaguc

SEQ ID NO: 251183 - RNA, 22 nt, Human
cccuccagugucccagugggga

SEQ ID NO: 251184 - RNA, 22 nt, Human
aaaugguguuucuaaugcuaga

SEQ ID NO: 251185 - RNA, 22 nt, Human
ucucagguaaaaggguaucuac

SEQ ID NO: 251186 - RNA, 22 nt, Human
aagcauuuauagauaagaauuu

SEQ ID NO: 251187 - RNA, 22 nt, Human
uuguguuaaggugcaucuagug

SEQ ID NO: 251188 - RNA, 21 nt, Human
guucuauuuugcaaacuucug

SEQ ID NO: 251189 - RNA, 22 nt, Human
agacacuggugaagaaaucagg

SEQ ID NO: 251190 - RNA, 19 nt, Human
cagcucaggacucagcccc

SEQ ID NO: 251191 - RNA, 22 nt, Human
cacagcagaacuuaauuucaaa

SEQ ID NO: 251192 - RNA, 22 nt, Human
auggcagcuuucauuguccaca

SEQ ID NO: 251193 - RNA, 22 nt, Human
uuauacauguuuauaagguuga

SEQ ID NO: 251194 - RNA, 22 nt, Human
agucuagauccccagugcuguc

SEQ ID NO: 251195 - RNA, 22 nt, Human
ccugaguggugcuaagcagaua

SEQ ID NO: 251196 - RNA, 22 nt, Human
ugggcaucguucccuuggcuau

SEQ ID NO: 251197 - RNA, 22 nt, Human
cucacagcauggaauuuucugg

SEQ ID NO: 251198 - RNA, 22 nt, Human
cagcucagacgcaggucgagca

SEQ ID NO: 251199 - RNA, 22 nt, Human
uccugcagugugucuccugcac

SEQ ID NO: 251200 - RNA, 22 nt, Human
cauaauuaggcaguugaucauu

SEQ ID NO: 251201 - RNA, 22 nt, Human
uuucugaggaauuaauacagaa

SEQ ID NO: 251202 - RNA, 22 nt, Human
ugcaggcucacccuggagcuga

SEQ ID NO: 251203 - RNA, 22 nt, Human
agaaaugcauuagcacauauag

SEQ ID NO: 251204 - RNA, 22 nt, Human
ucagugucacaggaugcuaugc

SEQ ID NO: 251205 - RNA, 22 nt, Human
aaacuuuguucguccagacuca

SEQ ID NO: 251206 - RNA, 22 nt, Human
aucugguuuuggcugugucccu

SEQ ID NO: 251207 - RNA, 22 nt, Human
ucucuguacaguacaugccgug

SEQ ID NO: 251208 - RNA, 22 nt, Human
gagggcuggggcuuaggcuuag

SEQ ID NO: 251209 - RNA, 19 nt, Human
ucugaggguccagaugcau

SEQ ID NO: 251210 - RNA, 22 nt, Human
guaacugaggcagcuuuuaaga

SEQ ID NO: 251211 - RNA, 22 nt, Human
uaauucagggccagaaucccca

SEQ ID NO: 251212 - RNA, 22 nt, Human
aucuuuggggcauccaggaaaa

SEQ ID NO: 251213 - RNA, 22 nt, Human
gggggcucugacucccucagcu

SEQ ID NO: 251214 - RNA, 22 nt, Human
gagaggcugauccugcagagaa

SEQ ID NO: 251215 - RNA, 22 nt, Human
gagagguuccucccugcuuuac

SEQ ID NO: 251216 - RNA, 22 nt, Human
caguggggggacugaggccuga

SEQ ID NO: 251217 - RNA, 22 nt, Human
acuagaaauuacucagaauaaa

SEQ ID NO: 251218 - RNA, 22 nt, Human
caguucugguuugcagauauau

SEQ ID NO: 251219 - RNA, 22 nt, Human
gaucaugugauuugaaguaaug

SEQ ID NO: 251220 - RNA, 22 nt, Human
augaggagucaaggagucggag

SEQ ID NO: 251221 - RNA, 22 nt, Human
uacuuaaaaauuaucaaagugg

SEQ ID NO: 251222 - RNA, 22 nt, Human
auguuuccauagaagucacagu

SEQ ID NO: 251223 - RNA, 22 nt, Human
cagucuuugacaagcccuuuca

SEQ ID NO: 251224 - RNA, 22 nt, Human
ucuccuggcaugugggucaucu

SEQ ID NO: 251225 - RNA, 22 nt, Human
uuucauugucuacauaugacau

SEQ ID NO: 251226 - RNA, 22 nt, Human
uggaaagguguaaagcagaacc

SEQ ID NO: 251227 - RNA, 21 nt, Human
uuauuucacauggacuuccag

SEQ ID NO: 251228 - RNA, 18 nt, Human
gaguguggcacugggccc

SEQ ID NO: 251229 - RNA, 22 nt, Human
agcaccagcaacuaugggcugc

SEQ ID NO: 251230 - RNA, 22 nt, Human
uucccucuccuacucaggaaag

SEQ ID NO: 251231 - RNA, 22 nt, Human
acucacuuuccauucaagcacc

SEQ ID NO: 251232 - RNA, 22 nt, Human
cacaggccugucucuuucuaac

SEQ ID NO: 251233 - RNA, 22 nt, Human
gcagauggugggggaggaguac

SEQ ID NO: 251234 - RNA, 22 nt, Human
gugcauuccaccgugcagguug

SEQ ID NO: 251235 - RNA, 22 nt, Human
ucuucugugagaauucaagcaa

SEQ ID NO: 251236 - RNA, 22 nt, Human
ggcaucagcccgguccugggcu

SEQ ID NO: 251237 - RNA, 22 nt, Human
aagccuucaguccguugcagag

SEQ ID NO: 251238 - RNA, 19 nt, Human
gcugggcuuggguuuguag

SEQ ID NO: 251239 - RNA, 18 nt, Human
cugucccauccucagguu

SEQ ID NO: 251240 - RNA, 22 nt, Human
cugugaccuccaggaaggggug

SEQ ID NO: 251241 - RNA, 22 nt, Human
uuuccuuccauguugggcaaaa

SEQ ID NO: 251242 - RNA, 22 nt, Human
acaaaauuaugaagaggccuug

SEQ ID NO: 251243 - RNA, 22 nt, Human
ggcuccaguuugugccuucagc

SEQ ID NO: 251244 - RNA, 22 nt, Human
cagcccugcuuccccgcuaguu

SEQ ID NO: 251245 - RNA, 23 nt, Human
agcccagcagagaaccuaggucc

SEQ ID NO: 251246 - RNA, 22 nt, Human
cagggaugagcagauggagcaa

SEQ ID NO: 251247 - RNA, 22 nt, Human
ugggggugacuaucucgggaau

SEQ ID NO: 251248 - RNA, 22 nt, Human
acuggcaguagagggagcgcau

SEQ ID NO: 251249 - RNA, 22 nt, Human
ucaaaauuagugaccaaaggca

SEQ ID NO: 251250 - RNA, 22 nt, Human
ugaagcuuuccuguggucagga

SEQ ID NO: 251251 - RNA, 22 nt, Human
gcugucugggaggccuccacuu

SEQ ID NO: 251252 - RNA, 22 nt, Human
ucagggcuggcuuuugcagagc

SEQ ID NO: 251253 - RNA, 22 nt, Human
cccaggagguggagcuugcagu

SEQ ID NO: 251254 - RNA, 22 nt, Human
cucaggaaaauauugaagaagu

SEQ ID NO: 251255 - RNA, 22 nt, Human
cuggagaggcugggaacagguu

SEQ ID NO: 251256 - RNA, 22 nt, Human
gcccugagugccuguguaagaa

SEQ ID NO: 251257 - RNA, 22 nt, Human
ucaggcuuuuccugccuccuac

SEQ ID NO: 251258 - RNA, 22 nt, Human
gaagugucuccguuuuuaaagg

SEQ ID NO: 251259 - RNA, 22 nt, Human
ugaacaugcuguugauggccug

SEQ ID NO: 251260 - RNA, 22 nt, Human
gagcuuuaggagaaggagguca

SEQ ID NO: 251261 - RNA, 22 nt, Human
uucaaacucugaguaguucugc

SEQ ID NO: 251262 - RNA, 20 nt, Human
ucauccaguugguuuauggu

SEQ ID NO: 251263 - RNA, 22 nt, Human
gggcugcuugcuggagacagac

SEQ ID NO: 251264 - RNA, 22 nt, Human
ugugcuuuucucugcuccugga

SEQ ID NO: 251265 - RNA, 22 nt, Human
uagaauguagugcuucaagauu

SEQ ID NO: 251266 - RNA, 22 nt, Human
uuaaaaggguaagcagcaacuu

SEQ ID NO: 251267 - RNA, 22 nt, Human
ugcugggcuugaaagcugcuaa

SEQ ID NO: 251268 - RNA, 22 nt, Human
auguauuaugguuuuccuuaag

SEQ ID NO: 251269 - RNA, 17 nt, Human
cccuggcucuaggugga

SEQ ID NO: 251270 - RNA, 22 nt, Human
uccaguguguguccagcugcug

SEQ ID NO: 251271 - RNA, 22 nt, Human
ugacugaaggacuagauugauu

SEQ ID NO: 251272 - RNA, 22 nt, Human
ccagugccuaucuccucuggga

SEQ ID NO: 251273 - RNA, 22 nt, Human
acugugugcuggacaugauguu

SEQ ID NO: 251274 - RNA, 22 nt, Human
agauggcugggccccaccccag

SEQ ID NO: 251275 - RNA, 22 nt, Human
ggggaagggaguccaaguguua

SEQ ID NO: 251276 - RNA, 23 nt, Human
uagucaguauguaagucuaauug

SEQ ID NO: 251277 - RNA, 20 nt, Human
acaauacagguugugucuga

SEQ ID NO: 251278 - RNA, 22 nt, Human
aggcccuggcacugccugggag

SEQ ID NO: 251279 - RNA, 22 nt, Human
gcuagaaacuguuuaaucucuu

SEQ ID NO: 251280 - RNA, 22 nt, Human
uuuuccucuguaugcgugagau

SEQ ID NO: 251281 - RNA, 22 nt, Human
gaggucugggauggggccugaa

SEQ ID NO: 251282 - RNA, 22 nt, Human
ccaggugguucaggucaccaua

SEQ ID NO: 251283 - RNA, 22 nt, Human
gaugaaaaaagacgagcauaua

SEQ ID NO: 251284 - RNA, 22 nt, Human
uuuagacacacuuuguauauuu

SEQ ID NO: 251285 - RNA, 23 nt, Human
uuguccugccgaucucugagaau

SEQ ID NO: 251286 - RNA, 22 nt, Human
agccucugaugaucacaggggg

SEQ ID NO: 251287 - RNA, 20 nt, Human
cccaggagugagcagcuuua

SEQ ID NO: 251288 - RNA, 22 nt, Human
ccuggcucuucgggaguuuguu

SEQ ID NO: 251289 - RNA, 22 nt, Human
gcccuggccuccuggaacaggc

SEQ ID NO: 251290 - RNA, 22 nt, Human
ugcccuggaggggcuuacaguc

SEQ ID NO: 251291 - RNA, 22 nt, Human
gaaucauuuauuuuugacagca

SEQ ID NO: 251292 - RNA, 22 nt, Human
uaggaggcuuaaagcugcucag

SEQ ID NO: 251293 - RNA, 22 nt, Human
auucuuuggacaauaaguggug

SEQ ID NO: 251294 - RNA, 21 nt, Human
aaagcaguucuuccugccucu

SEQ ID NO: 251295 - RNA, 22 nt, Human
uagcugaaugugaccuuaaaga

SEQ ID NO: 251296 - RNA, 23 nt, Human
agggcaugaagcagaggacgugg

SEQ ID NO: 251297 - RNA, 17 nt, Human
uggucuggaagaacuga

SEQ ID NO: 251298 - RNA, 21 nt, Human
uacagaugaggagaccaaggc

SEQ ID NO: 251299 - RNA, 22 nt, Human
aaagcuuagaggccaguggagg

SEQ ID NO: 251300 - RNA, 22 nt, Human
aggcuucuugcuuccaaaugca

SEQ ID NO: 251301 - RNA, 18 nt, Human
gcugccuucccagucaag

SEQ ID NO: 251302 - RNA, 19 nt, Human
ucccucagucugccaggcc

SEQ ID NO: 251303 - RNA, 22 nt, Human
uugugagaugauuugaaagugu

SEQ ID NO: 251304 - RNA, 22 nt, Human
ucaggaagacaaucuuuggcuc

SEQ ID NO: 251305 - RNA, 20 nt, Human
agucacauugagcuuuugga

SEQ ID NO: 251306 - RNA, 22 nt, Human
uuuuaaugggcgacuauuaugg

SEQ ID NO: 251307 - RNA, 22 nt, Human
cagcaagauuuuuaaagcaagg

SEQ ID NO: 251308 - RNA, 23 nt, Human
gcucuuuguucauguggaugccu

SEQ ID NO: 251309 - RNA, 22 nt, Human
ugcugaggaauaauuguuccug

SEQ ID NO: 251310 - RNA, 22 nt, Human
uuccugggugguccugguagag

SEQ ID NO: 251311 - RNA, 22 nt, Human
cagcaggcccaggugcugguga

SEQ ID NO: 251312 - RNA, 22 nt, Human
aggauuuacaaugauucuaggu

SEQ ID NO: 251313 - RNA, 22 nt, Human
gccugccugcugucaucugccu

SEQ ID NO: 251314 - RNA, 22 nt, Human
ugcucuggaaauaaaugauuua

SEQ ID NO: 251315 - RNA, 22 nt, Human
ccugccagggccagaggccagc

SEQ ID NO: 251316 - RNA, 22 nt, Human
ugcaggcuggcagugcugaaau

SEQ ID NO: 251317 - RNA, 22 nt, Human
uuggagggacagauggcuaggc

SEQ ID NO: 251318 - RNA, 22 nt, Human
ggaagacagaagccuacagcuu

SEQ ID NO: 251319 - RNA, 22 nt, Human
auucuuuagccagcagguauau

SEQ ID NO: 251320 - RNA, 22 nt, Human
uggcugcugcucacucagccuc

SEQ ID NO: 251321 - RNA, 22 nt, Human
ucaaauuaguggaauaauaaug

SEQ ID NO: 251322 - RNA, 22 nt, Human
cuuuauauccagauguuuggug

SEQ ID NO: 251323 - RNA, 18 nt, Human
gaggagccgucccuacua

SEQ ID NO: 251324 - RNA, 22 nt, Human
aggaugagagauacauggagca

SEQ ID NO: 251325 - RNA, 22 nt, Human
uccugcaggcuugaguccucag

SEQ ID NO: 251326 - RNA, 22 nt, Human
ccucaggccucugccucauugg

SEQ ID NO: 251327 - RNA, 22 nt, Human
ggcucugcccgcggcugcccac

SEQ ID NO: 251328 - RNA, 22 nt, Human
acuuuaaaaagagccuucuaac

SEQ ID NO: 251329 - RNA, 22 nt, Human
uugaauuagacuuugcuacagg

SEQ ID NO: 251330 - RNA, 22 nt, Human
cugcuuuaacucugggaagcca

SEQ ID NO: 251331 - RNA, 22 nt, Human
caucuugugaauuucugauucu

SEQ ID NO: 251332 - RNA, 22 nt, Human
augagagccaccaugcuucugu

SEQ ID NO: 251333 - RNA, 22 nt, Human
agcuuuaucacaauauuggcua

SEQ ID NO: 251334 - RNA, 19 nt, Human
ggaaccuuagagcuucagc

SEQ ID NO: 251335 - RNA, 22 nt, Human
auaacagaugugaagugcuaau

SEQ ID NO: 251336 - RNA, 22 nt, Human
gcaacuguuuugagcacccagu

SEQ ID NO: 251337 - RNA, 22 nt, Human
ugggagaagacguacuuuagac

SEQ ID NO: 251338 - RNA, 18 nt, Human
gcagcuagccaggggggc

SEQ ID NO: 251339 - RNA, 22 nt, Human
ucucaggcucuuggaaccuguu

SEQ ID NO: 251340 - RNA, 22 nt, Human
uccuguuuuuguaaucgacucu

SEQ ID NO: 251341 - RNA, 23 nt, Human
cagcugaagcagccugggcugga

SEQ ID NO: 251342 - RNA, 22 nt, Human
aguggcugaauauauuuuacua

SEQ ID NO: 251343 - RNA, 22 nt, Human
uuuccugguuugaagcagcagc

SEQ ID NO: 251344 - RNA, 23 nt, Human
cguguccuucagggagagugugg

SEQ ID NO: 251345 - RNA, 22 nt, Human
cagaaaauaaaguuucuacgca

SEQ ID NO: 251346 - RNA, 22 nt, Human
ccagggucucugcugccugaga

SEQ ID NO: 251347 - RNA, 22 nt, Human
acaaaaauuagcugggcauggu

SEQ ID NO: 251348 - RNA, 22 nt, Human
gcagggcugacucagccacccu

SEQ ID NO: 251349 - RNA, 22 nt, Human
ucaagacaucacugugcauuuu

SEQ ID NO: 251350 - RNA, 22 nt, Human
ucagggcaaagggcagaguuug

SEQ ID NO: 251351 - RNA, 18 nt, Human
cucucuuuccacucuuug

SEQ ID NO: 251352 - RNA, 22 nt, Human
uugacaauguccuuugaauuuc

SEQ ID NO: 251353 - RNA, 22 nt, Human
acauguuagaaaugcagaaucu

SEQ ID NO: 251354 - RNA, 22 nt, Human
agguccagugcucuuggugguu

SEQ ID NO: 251355 - RNA, 22 nt, Human
ucuggggguuaagugaggacaa

SEQ ID NO: 251356 - RNA, 22 nt, Human
acagccaggcccagcacgcagg

SEQ ID NO: 251357 - RNA, 22 nt, Human
uggugagcucuggcagucugug

SEQ ID NO: 251358 - RNA, 22 nt, Human
uuagcaggaagaguuggcugga

SEQ ID NO: 251359 - RNA, 22 nt, Human
gauggcuuacagacaguuagga

SEQ ID NO: 251360 - RNA, 22 nt, Human
uucugaaauaggagauagcugu

SEQ ID NO: 251361 - RNA, 22 nt, Human
caguuuccugaagagaaagaau

SEQ ID NO: 251362 - RNA, 22 nt, Human
agaacucuaggauuggcuggau

SEQ ID NO: 251363 - RNA, 22 nt, Human
aauauuuauauuucucuucccu

SEQ ID NO: 251364 - RNA, 21 nt, Human
auauuucucauaagguuaugg

SEQ ID NO: 251365 - RNA, 22 nt, Human
uccuuucugggccucagugacu

SEQ ID NO: 251366 - RNA, 22 nt, Human
aaauuccagaaacucaguauau

SEQ ID NO: 251367 - RNA, 22 nt, Human
caaggccaugagcagcgagugu

SEQ ID NO: 251368 - RNA, 22 nt, Human
aauaagauaagauuucugcucu

SEQ ID NO: 251369 - RNA, 22 nt, Human
gaaacauuuguugaguacuugc

SEQ ID NO: 251370 - RNA, 22 nt, Human
uugccagggucaggaugagauc

SEQ ID NO: 251371 - RNA, 22 nt, Human
gagcuuggugcacagugguuaa

SEQ ID NO: 251372 - RNA, 22 nt, Human
ucucaucauuccuucaaagccc

SEQ ID NO: 251373 - RNA, 22 nt, Human
auguccuuuuauuuaaagcagg

SEQ ID NO: 251374 - RNA, 22 nt, Human
agaaauguuguggguuuuguua

SEQ ID NO: 251375 - RNA, 23 nt, Human
caguuggagguacagagacacug

SEQ ID NO: 251376 - RNA, 22 nt, Human
caccaccaggcaggacaccgaa

SEQ ID NO: 251377 - RNA, 22 nt, Human
ucaggcagagcuguggagcucu

SEQ ID NO: 251378 - RNA, 17 nt, Human
ggaaaagaagaguagga

SEQ ID NO: 251379 - RNA, 22 nt, Human
gauaaagggggaccaaaugacu

SEQ ID NO: 251380 - RNA, 21 nt, Human
ucagcaggcaccagaaggcug

SEQ ID NO: 251381 - RNA, 22 nt, Human
uuggcuaugcuuguguucaguu

SEQ ID NO: 251382 - RNA, 22 nt, Human
acugcaggagacacagcugcug

SEQ ID NO: 251383 - RNA, 22 nt, Human
aaggcagcaagaauuccagguu

SEQ ID NO: 251384 - RNA, 22 nt, Human
ggcuuuauauuguuugagcaga

SEQ ID NO: 251385 - RNA, 19 nt, Human
cucuggagaacaauagugc

SEQ ID NO: 251386 - RNA, 22 nt, Human
ucuccacauucuauuggcuaua

SEQ ID NO: 251387 - RNA, 22 nt, Human
gucccaggugcccagugggcag

SEQ ID NO: 251388 - RNA, 22 nt, Human
augcagcagccccuugaggugc

SEQ ID NO: 251389 - RNA, 22 nt, Human
aagauauacuauuaaguaccau

SEQ ID NO: 251390 - RNA, 22 nt, Human
uacagaaaaacuggcauugaag

SEQ ID NO: 251391 - RNA, 22 nt, Human
cagaagcauuccagcaaauagu

SEQ ID NO: 251392 - RNA, 22 nt, Human
uggguagaaacaaggcuggacu

SEQ ID NO: 251393 - RNA, 23 nt, Human
gcucagaggugaaauguuuuggg

SEQ ID NO: 251394 - RNA, 22 nt, Human
gaaauacugcacacccuguaag

SEQ ID NO: 251395 - RNA, 22 nt, Human
acagacagacagauugcauaug

SEQ ID NO: 251396 - RNA, 22 nt, Human
uucaaaaagguauguucaaguc

SEQ ID NO: 251397 - RNA, 22 nt, Human
guuuauuaacugucaagugauu

SEQ ID NO: 251398 - RNA, 22 nt, Human
uuacaagcuaauuguuucagcu

SEQ ID NO: 251399 - RNA, 22 nt, Human
gucugcagagggaaggcuucag

SEQ ID NO: 251400 - RNA, 22 nt, Human
gccuggcaggggccugggagug

SEQ ID NO: 251401 - RNA, 20 nt, Human
acaguuuauuuuacuugguu

SEQ ID NO: 251402 - RNA, 22 nt, Human
ugaugacaaacuuuccugaugc

SEQ ID NO: 251403 - RNA, 22 nt, Human
aggcuccuucacagcacucgcc

SEQ ID NO: 251404 - RNA, 22 nt, Human
aaagguuugcauggaauuuacc

SEQ ID NO: 251405 - RNA, 22 nt, Human
uggaaacucuaccucucuaaga

SEQ ID NO: 251406 - RNA, 22 nt, Human
uauggcuucugggccaaauuua

SEQ ID NO: 251407 - RNA, 22 nt, Human
ggaccugcucucccaguucucu

SEQ ID NO: 251408 - RNA, 22 nt, Human
ucacagugauaacuaaguccug

SEQ ID NO: 251409 - RNA, 19 nt, Human
aagagcagggaaagaauug

SEQ ID NO: 251410 - RNA, 22 nt, Human
cuaaaauuaccuaccaguuuag

SEQ ID NO: 251411 - RNA, 18 nt, Human
aggcuucccaggcaggcc

SEQ ID NO: 251412 - RNA, 22 nt, Human
caggcagcaucagucugcugua

SEQ ID NO: 251413 - RNA, 22 nt, Human
cuccauggaaaaggcuguuguu

SEQ ID NO: 251414 - RNA, 22 nt, Human
aagucucuuuucuuccuguauu

SEQ ID NO: 251415 - RNA, 22 nt, Human
aagguggugaguacaguuaggu

SEQ ID NO: 251416 - RNA, 22 nt, Human
ugcauguguuugccacagugag

SEQ ID NO: 251417 - RNA, 22 nt, Human
ucuuccaagguugcacacuauc

SEQ ID NO: 251418 - RNA, 22 nt, Human
ugagguucaguucuuggccaca

SEQ ID NO: 251419 - RNA, 22 nt, Human
cuugggucacaacucugaggug

SEQ ID NO: 251420 - RNA, 22 nt, Human
aguggggaagauuuugcaguca

SEQ ID NO: 251421 - RNA, 22 nt, Human
uuuugccugagagugaaaauaa

SEQ ID NO: 251422 - RNA, 22 nt, Human
uauagagcuuuggcauugauua

SEQ ID NO: 251423 - RNA, 22 nt, Human
uggcaggauuugcccggaagga

SEQ ID NO: 251424 - RNA, 22 nt, Human
uccaggcuggcucuucaaaauu

SEQ ID NO: 251425 - RNA, 22 nt, Human
gagcacagcuggagguagcauu

SEQ ID NO: 251426 - RNA, 22 nt, Human
aggagaaggaagugcaucacua

SEQ ID NO: 251427 - RNA, 22 nt, Human
caguggaauacgagcagauguc

SEQ ID NO: 251428 - RNA, 22 nt, Human
cagagacauccauguuaguugg

SEQ ID NO: 251429 - RNA, 23 nt, Human
ggagccuccggugugugagaggc

SEQ ID NO: 251430 - RNA, 23 nt, Human
guuaauaaugaacacuuucuccc

SEQ ID NO: 251431 - RNA, 22 nt, Human
augccugcuuacuccaggugcu

SEQ ID NO: 251432 - RNA, 22 nt, Human
cuuacauacugagaaaauaucc

SEQ ID NO: 251433 - RNA, 22 nt, Human
ucugaggguuguagagagggac

SEQ ID NO: 251434 - RNA, 22 nt, Human
uggcacaggaucucagcggcca

SEQ ID NO: 251435 - RNA, 22 nt, Human
ggcaggcuccagagcccucucc

SEQ ID NO: 251436 - RNA, 18 nt, Human
agcuccuggucucaggga

SEQ ID NO: 251437 - RNA, 22 nt, Human
uguaaacaaaugcauucuugcu

SEQ ID NO: 251438 - RNA, 22 nt, Human
aaguaccaaguuuguuugacgc

SEQ ID NO: 251439 - RNA, 22 nt, Human
ugccucucuaacccaugcccaa

SEQ ID NO: 251440 - RNA, 22 nt, Human
ggcugcagagcuggugcccugg

SEQ ID NO: 251441 - RNA, 22 nt, Human
guccagcccuugcagcuucuuu

SEQ ID NO: 251442 - RNA, 22 nt, Human
acagauuuuauuauucagguau

SEQ ID NO: 251443 - RNA, 22 nt, Human
uaacaucuuauuggcaaagaua

SEQ ID NO: 251444 - RNA, 22 nt, Human
uauuucuaagcuguaagucuga

SEQ ID NO: 251445 - RNA, 22 nt, Human
uggggucuggaguugcccauga

SEQ ID NO: 251446 - RNA, 22 nt, Human
ccuguucuguuaauuaaacuuu

SEQ ID NO: 251447 - RNA, 22 nt, Human
ggucuggaagcgcaguaggcug

SEQ ID NO: 251448 - RNA, 22 nt, Human
acagauuuggcccagccaaugc

SEQ ID NO: 251449 - RNA, 22 nt, Human
cugcuacaccggaauagugaca

SEQ ID NO: 251450 - RNA, 22 nt, Human
gccuccaccgaacgcucucuug

SEQ ID NO: 251451 - RNA, 22 nt, Human
ccuggcagguggcgcccucggc

SEQ ID NO: 251452 - RNA, 19 nt, Human
ucauugaacauaauuacuu

SEQ ID NO: 251453 - RNA, 22 nt, Human
cuuuagaaggguaacggaauua

SEQ ID NO: 251454 - RNA, 22 nt, Human
accuuggaacugaaguguuuuu

SEQ ID NO: 251455 - RNA, 22 nt, Human
auacuuuuaauuccuucugagu

SEQ ID NO: 251456 - RNA, 22 nt, Human
gaaccuuaugguaaaucuagag

SEQ ID NO: 251457 - RNA, 22 nt, Human
cuggagaguaaucucuguguua

SEQ ID NO: 251458 - RNA, 22 nt, Human
ugggagccauuuuagaggcugc

SEQ ID NO: 251459 - RNA, 22 nt, Human
ugggggugaaagucuggacagu

SEQ ID NO: 251460 - RNA, 22 nt, Human
cuggcuuccaugcuguaguggc

SEQ ID NO: 251461 - RNA, 22 nt, Human
caguggccuugaugccucauuc

SEQ ID NO: 251462 - RNA, 22 nt, Human
cacagaggucugggcccagcag

SEQ ID NO: 251463 - RNA, 22 nt, Human
aaagccuugggauuugugauca

SEQ ID NO: 251464 - RNA, 22 nt, Human
auugcugaaaugaaaggauaug

SEQ ID NO: 251465 - RNA, 22 nt, Human
gaguuaauucgaauauucuagc

SEQ ID NO: 251466 - RNA, 22 nt, Human
aacuuagagcucuccuaaauga

SEQ ID NO: 251467 - RNA, 22 nt, Human
uucuuagugguagucaucuuug

SEQ ID NO: 251468 - RNA, 22 nt, Human
aggcugaggaucguacuuucca

SEQ ID NO: 251469 - RNA, 22 nt, Human
aaaugcauuaagucagaacaau

SEQ ID NO: 251470 - RNA, 22 nt, Human
gagccagccuucuucugagguc

SEQ ID NO: 251471 - RNA, 22 nt, Human
agauaagauaguccagcacaau

SEQ ID NO: 251472 - RNA, 22 nt, Human
ucagccaagcagccaucaucug

SEQ ID NO: 251473 - RNA, 22 nt, Human
acauuugagaugccuuuuaggu

SEQ ID NO: 251474 - RNA, 22 nt, Human
ucucagagaaaugugucaccau

SEQ ID NO: 251475 - RNA, 22 nt, Human
cuucucugcccauaggaaaugc

SEQ ID NO: 251476 - RNA, 22 nt, Human
aggguggcugugaagugcuugg

SEQ ID NO: 251477 - RNA, 22 nt, Human
gggcuuggguauugugagaggu

SEQ ID NO: 251478 - RNA, 22 nt, Human
uagggauguaaacauaguaauu

SEQ ID NO: 251479 - RNA, 22 nt, Human
ucaguuaagaggccacggcagu

SEQ ID NO: 251480 - RNA, 22 nt, Human
ugacaaguacauaauuucaugu

SEQ ID NO: 251481 - RNA, 22 nt, Human
ccuugaaacccugacacucugu

SEQ ID NO: 251482 - RNA, 16 nt, Human
agcagggcgggaagga

SEQ ID NO: 251483 - RNA, 22 nt, Human
agaggcuguuacacucccagau

SEQ ID NO: 251484 - RNA, 22 nt, Human
ucugauauaaaagugacauuca

SEQ ID NO: 251485 - RNA, 22 nt, Human
uacacauguuuggcaaguaugu

SEQ ID NO: 251486 - RNA, 22 nt, Human
cuggaugcugagagguaccaag

SEQ ID NO: 251487 - RNA, 22 nt, Human
auuagcaauugugcaucuagua

SEQ ID NO: 251488 - RNA, 22 nt, Human
ugcuuucaaaggcuuucuagau

SEQ ID NO: 251489 - RNA, 22 nt, Human
agguuccagggauuaggaugug

SEQ ID NO: 251490 - RNA, 22 nt, Human
ggggcagggagguuaucgccga

SEQ ID NO: 251491 - RNA, 22 nt, Human
ugcacaccucuccaccacucuc

SEQ ID NO: 251492 - RNA, 22 nt, Human
uggggggcaugaaccuccacgg

SEQ ID NO: 251493 - RNA, 22 nt, Human
uggccaggcagguagaacggcc

SEQ ID NO: 251494 - RNA, 22 nt, Human
agauaaaaugguucaaaggcua

SEQ ID NO: 251495 - RNA, 22 nt, Human
aguacaaaggcccuugauuacu

SEQ ID NO: 251496 - RNA, 22 nt, Human
auuuccaagguaauuuugagua

SEQ ID NO: 251497 - RNA, 22 nt, Human
ucuggccccgcaugcacuuuau

SEQ ID NO: 251498 - RNA, 22 nt, Human
gacuuuauaaaugagaggcgga

SEQ ID NO: 251499 - RNA, 22 nt, Human
cagcugagagacaaugagucau

SEQ ID NO: 251500 - RNA, 22 nt, Human
ugaaggagauuuuuagggaggc

SEQ ID NO: 251501 - RNA, 22 nt, Human
acagcagguuauuguuauggca

SEQ ID NO: 251502 - RNA, 22 nt, Human
uuacuuuagaucauacugugug

SEQ ID NO: 251503 - RNA, 21 nt, Human
acucaggagacuaacuauguc

SEQ ID NO: 251504 - RNA, 22 nt, Human
uccuggcauuuacaaacccacc

SEQ ID NO: 251505 - RNA, 22 nt, Human
acacaugugucugcaugcagug

SEQ ID NO: 251506 - RNA, 22 nt, Human
gaggacaccucacagccucaca

SEQ ID NO: 251507 - RNA, 22 nt, Human
cugggacacccaaggaaagagc

SEQ ID NO: 251508 - RNA, 22 nt, Human
cccugagcgugaggaggaagua

SEQ ID NO: 251509 - RNA, 22 nt, Human
uuuuuccuaagcaguggagcug

SEQ ID NO: 251510 - RNA, 22 nt, Human
cagugagguggauggauggccu

SEQ ID NO: 251511 - RNA, 22 nt, Human
agagucagaaagcagacagggg

SEQ ID NO: 251512 - RNA, 22 nt, Human
cuccugguuccugucuuaaaua

SEQ ID NO: 251513 - RNA, 22 nt, Human
cagugcagguuuagggcugggg

SEQ ID NO: 251514 - RNA, 22 nt, Human
aucacaaucccucucucugaua

SEQ ID NO: 251515 - RNA, 22 nt, Human
aauagcaauuacccuucaacuc

SEQ ID NO: 251516 - RNA, 22 nt, Human
aauguugagcuugaaaguaggu

SEQ ID NO: 251517 - RNA, 17 nt, Human
cuuuuaauuuacuuccc

SEQ ID NO: 251518 - RNA, 22 nt, Human
ucuccccuacucuaaaucugca

SEQ ID NO: 251519 - RNA, 22 nt, Human
ucuuuguguucaggagccacgu

SEQ ID NO: 251520 - RNA, 22 nt, Human
aagagcagccuccaggggugga

SEQ ID NO: 251521 - RNA, 22 nt, Human
acugucuuguuccaagacuaaa

SEQ ID NO: 251522 - RNA, 23 nt, Human
ugcagcaggguggucuacuucuc

SEQ ID NO: 251523 - RNA, 22 nt, Human
ggagagaggagcccacugcugu

SEQ ID NO: 251524 - RNA, 22 nt, Human
uccuucaagugcaguaccugag

SEQ ID NO: 251525 - RNA, 22 nt, Human
aaguaugucaaucauacuucaa

SEQ ID NO: 251526 - RNA, 22 nt, Human
aacuucuuugagcuccaguuuu

SEQ ID NO: 251527 - RNA, 22 nt, Human
uuacuguuuugguaccucauug

SEQ ID NO: 251528 - RNA, 22 nt, Human
ccacagaaccucagcuuugagc

SEQ ID NO: 251529 - RNA, 22 nt, Human
acaugcacacgauucagucugg

SEQ ID NO: 251530 - RNA, 20 nt, Human
ucaauguaaucauaucauca

SEQ ID NO: 251531 - RNA, 22 nt, Human
cauguaaagcacuucauaacag

SEQ ID NO: 251532 - RNA, 22 nt, Human
cagccagguucaaguccuuaua

SEQ ID NO: 251533 - RNA, 22 nt, Human
gcacagccacugagugagaacc

SEQ ID NO: 251534 - RNA, 22 nt, Human
cauuaaauaucaaccuagacua

SEQ ID NO: 251535 - RNA, 22 nt, Human
aaauaucauuuauaacuuuuaa

SEQ ID NO: 251536 - RNA, 22 nt, Human
gcuuuguguagaaggaggaugg

SEQ ID NO: 251537 - RNA, 22 nt, Human
ugucucugauaaguaguucagu

SEQ ID NO: 251538 - RNA, 22 nt, Human
guacuuuagaguaaaauagacc

SEQ ID NO: 251539 - RNA, 22 nt, Human
gggcagcaaaucugagucuggu

SEQ ID NO: 251540 - RNA, 22 nt, Human
guccagaaagggcagugauuug

SEQ ID NO: 251541 - RNA, 22 nt, Human
ucuccuggcauuugguugagua

SEQ ID NO: 251542 - RNA, 22 nt, Human
uagaaagcguuaaaucuacaga

SEQ ID NO: 251543 - RNA, 22 nt, Human
uggcaguuggggaugaagugag

SEQ ID NO: 251544 - RNA, 22 nt, Human
cacaggugucucuaguagcguu

SEQ ID NO: 251545 - RNA, 22 nt, Human
cucuccagcagauguagucugu

SEQ ID NO: 251546 - RNA, 22 nt, Human
ucugcaggcuuggaguggcagc

SEQ ID NO: 251547 - RNA, 22 nt, Human
gcagaauuuaggaauuaggaaa

SEQ ID NO: 251548 - RNA, 22 nt, Human
ucagacagggagucagaaaaua

SEQ ID NO: 251549 - RNA, 22 nt, Human
aagacaauaauuuuugggcagg

SEQ ID NO: 251550 - RNA, 22 nt, Human
ucccugcugagagugcucuccc

SEQ ID NO: 251551 - RNA, 22 nt, Human
aggggcucaguuacuuuggcag

SEQ ID NO: 251552 - RNA, 16 nt, Human
ucucuggguugcacag

SEQ ID NO: 251553 - RNA, 22 nt, Human
gggcuucuguaccuaccuggaa

SEQ ID NO: 251554 - RNA, 22 nt, Human
gcuuugcuggaaucaacgaaug

SEQ ID NO: 251555 - RNA, 22 nt, Human
ucacuuuggauuauguaauuuc

SEQ ID NO: 251556 - RNA, 22 nt, Human
uuucuagcuguaggaagcugag

SEQ ID NO: 251557 - RNA, 22 nt, Human
cagagucagagcuccauggagu

SEQ ID NO: 251558 - RNA, 22 nt, Human
acccaggcuggaaugcaguggc

SEQ ID NO: 251559 - RNA, 22 nt, Human
acccaggcuggagugcagugac

SEQ ID NO: 251560 - RNA, 22 nt, Human
uggcucaguuucaguccugguu

SEQ ID NO: 251561 - RNA, 22 nt, Human
uuacauuuuaguuaaccuguga

SEQ ID NO: 251562 - RNA, 22 nt, Human
agaggucauaucucagaagaga

SEQ ID NO: 251563 - RNA, 22 nt, Human
ugaggcaggaguuaaugugcuc

SEQ ID NO: 251564 - RNA, 19 nt, Human
cagagccaggccuuuggcc

SEQ ID NO: 251565 - RNA, 22 nt, Human
cuguaaaaugaaccuagucauc

SEQ ID NO: 251566 - RNA, 22 nt, Human
uguuaacacaauucuggagaga

SEQ ID NO: 251567 - RNA, 22 nt, Human
ggcuggcuggcuuagcagagga

SEQ ID NO: 251568 - RNA, 22 nt, Human
uacauuuauaaggcuucucugu

SEQ ID NO: 251569 - RNA, 21 nt, Human
guuugcaugaacaagucagcc

SEQ ID NO: 251570 - RNA, 23 nt, Human
ccucuccagacacugggccuugu

SEQ ID NO: 251571 - RNA, 22 nt, Human
ccucagaagaaguggaauugau

SEQ ID NO: 251572 - RNA, 22 nt, Human
ugccauuuaaaaaugaccaaau

SEQ ID NO: 251573 - RNA, 22 nt, Human
ugucuucgcuacaaugaaaagg

SEQ ID NO: 251574 - RNA, 22 nt, Human
ggcaggguggcccuccagugag

SEQ ID NO: 251575 - RNA, 22 nt, Human
cauaacauuaagccucuauuuc

SEQ ID NO: 251576 - RNA, 22 nt, Human
uacaguaagaugaaauagcaau

SEQ ID NO: 251577 - RNA, 22 nt, Human
aaucacaaaugcaaguugucac

SEQ ID NO: 251578 - RNA, 22 nt, Human
gcaugugucuccccaguggagg

SEQ ID NO: 251579 - RNA, 22 nt, Human
gagcugcaugcaacucgaaaau

SEQ ID NO: 251580 - RNA, 22 nt, Human
caaggcagaauucagacucagg

SEQ ID NO: 251581 - RNA, 22 nt, Human
ugaagcaguucucagaaguggg

SEQ ID NO: 251582 - RNA, 22 nt, Human
ucugcaaacuggcucuuacugc

SEQ ID NO: 251583 - RNA, 22 nt, Human
aauucuuaaucccauaaaguga

SEQ ID NO: 251584 - RNA, 22 nt, Human
augucugucuuuguacuccaca

SEQ ID NO: 251585 - RNA, 22 nt, Human
aacuuugagucauugccucuuu

SEQ ID NO: 251586 - RNA, 22 nt, Human
ucccuccccacuucugagcuuu

SEQ ID NO: 251587 - RNA, 22 nt, Human
uucauguaacuuuucuucucca

SEQ ID NO: 251588 - RNA, 22 nt, Human
cagagcugggcauggugaaagg

SEQ ID NO: 251589 - RNA, 21 nt, Human
uagggcucuauuuuuauuuca

SEQ ID NO: 251590 - RNA, 20 nt, Human
uugaggagauauugaauacu

SEQ ID NO: 251591 - RNA, 22 nt, Human
uuuagucuaauaaaaguggagu

SEQ ID NO: 251592 - RNA, 22 nt, Human
ugaaaucuuagccauucugccu

SEQ ID NO: 251593 - RNA, 22 nt, Human
ggcugagaaucaacaaccugcu

SEQ ID NO: 251594 - RNA, 22 nt, Human
gaaaagcuaggccaguucagcu

SEQ ID NO: 251595 - RNA, 22 nt, Human
agauuuacucagcuccuggaaa

SEQ ID NO: 251596 - RNA, 22 nt, Human
uccaauauucauuaaaaugcag

SEQ ID NO: 251597 - RNA, 22 nt, Human
cuucagaauccagaaucagaau

SEQ ID NO: 251598 - RNA, 22 nt, Human
aguucaguaguccuucauugua

SEQ ID NO: 251599 - RNA, 22 nt, Human
uguucacuuauguucucccauu

SEQ ID NO: 251600 - RNA, 21 nt, Human
auaucacaaacauauggucug

SEQ ID NO: 251601 - RNA, 22 nt, Human
gaaguuuuagucaaaauguaga

SEQ ID NO: 251602 - RNA, 22 nt, Human
uucuuuucuuuaggcauugugu

SEQ ID NO: 251603 - RNA, 19 nt, Human
agcugcaaaagguggaacu

SEQ ID NO: 251604 - RNA, 22 nt, Human
gauuuuauuagcccaaacuuug

SEQ ID NO: 251605 - RNA, 22 nt, Human
cagcugaagguaggaaccagga

SEQ ID NO: 251606 - RNA, 22 nt, Human
cagcaguggaacuacccaggga

SEQ ID NO: 251607 - RNA, 19 nt, Human
agugaaauggaguauucaa

SEQ ID NO: 251608 - RNA, 22 nt, Human
caccugccugcaggggcuccac

SEQ ID NO: 251609 - RNA, 22 nt, Human
aagccugaggguguugcuagau

SEQ ID NO: 251610 - RNA, 22 nt, Human
uuccugguuugccuggaaucca

SEQ ID NO: 251611 - RNA, 22 nt, Human
uggaaggggccaggcgcggagu

SEQ ID NO: 251612 - RNA, 23 nt, Human
uguggcugagaaauugacaacuu

SEQ ID NO: 251613 - RNA, 22 nt, Human
aauagacuccagggucuauuuu

SEQ ID NO: 251614 - RNA, 22 nt, Human
aaguguccucauucaacaugca

SEQ ID NO: 251615 - RNA, 22 nt, Human
guuacaaaggucauaaaagugu

SEQ ID NO: 251616 - RNA, 22 nt, Human
ucagaaucuuucuagagucuag

SEQ ID NO: 251617 - RNA, 22 nt, Human
auauauaauacuugcugugggc

SEQ ID NO: 251618 - RNA, 22 nt, Human
auggcagcaguccauugccuca

SEQ ID NO: 251619 - RNA, 22 nt, Human
aggcuucuucugccugucuuug

SEQ ID NO: 251620 - RNA, 22 nt, Human
acacaugugauucuaagacagc

SEQ ID NO: 251621 - RNA, 22 nt, Human
caugcugaugaacuucuacuug

SEQ ID NO: 251622 - RNA, 22 nt, Human
gcuggcugccaauuucagagcu

SEQ ID NO: 251623 - RNA, 22 nt, Human
ccaggcuggaguguagucgcau

SEQ ID NO: 251624 - RNA, 22 nt, Human
ugcuccuguuucaucagcuaua

SEQ ID NO: 251625 - RNA, 20 nt, Human
ccacccugcuaagaauacac

SEQ ID NO: 251626 - RNA, 22 nt, Human
ggccuuagcggucauagcaaag

SEQ ID NO: 251627 - RNA, 22 nt, Human
ugucagggcuggacacagcugc

SEQ ID NO: 251628 - RNA, 22 nt, Human
ccugggcauaaaucacuccaag

SEQ ID NO: 251629 - RNA, 23 nt, Human
ucuccuguccuaauuaccacccc

SEQ ID NO: 251630 - RNA, 22 nt, Human
ucuguacaguaccagauaguaa

SEQ ID NO: 251631 - RNA, 22 nt, Human
aagugcuuggcuaaugguuaug

SEQ ID NO: 251632 - RNA, 22 nt, Human
acugggcucauaaugucauaga

SEQ ID NO: 251633 - RNA, 22 nt, Human
uaccaaauguaaucauucuaau

SEQ ID NO: 251634 - RNA, 22 nt, Human
ugucagaccugugauuucagca

SEQ ID NO: 251635 - RNA, 22 nt, Human
aaaguucauugaugacugaggu

SEQ ID NO: 251636 - RNA, 22 nt, Human
ggauggcagacagugaguggcu

SEQ ID NO: 251637 - RNA, 22 nt, Human
agcauccaacuuugauuagaga

SEQ ID NO: 251638 - RNA, 22 nt, Human
aaagugguucuuacauccgugg

SEQ ID NO: 251639 - RNA, 22 nt, Human
cuggcccugccuaauguacuug

SEQ ID NO: 251640 - RNA, 22 nt, Human
ggucaggaaaagacuccccaga

SEQ ID NO: 251641 - RNA, 22 nt, Human
caggacaauuuccacuugguaa

SEQ ID NO: 251642 - RNA, 22 nt, Human
gcaguggcaccgcuggcucugg

SEQ ID NO: 251643 - RNA, 22 nt, Human
cagaacugggcagggagcagag

SEQ ID NO: 251644 - RNA, 22 nt, Human
cagaggcugggaccucaggcau

SEQ ID NO: 251645 - RNA, 22 nt, Human
aaaugccuguguaaauucuagc

SEQ ID NO: 251646 - RNA, 22 nt, Human
cugcccugggaguaccuguccu

SEQ ID NO: 251647 - RNA, 22 nt, Human
ugagcugggcugggcugagcug

SEQ ID NO: 251648 - RNA, 22 nt, Human
uuuacagcauugcugaaaguuc

SEQ ID NO: 251649 - RNA, 19 nt, Human
gugaggaguguuuacagaa

SEQ ID NO: 251650 - RNA, 22 nt, Human
ccuguauuugcuuccuucugca

SEQ ID NO: 251651 - RNA, 22 nt, Human
uggcaggaaggagacucagccc

SEQ ID NO: 251652 - RNA, 22 nt, Human
gauuaaguaacugaacacuuug

SEQ ID NO: 251653 - RNA, 22 nt, Human
uuccuucuaauuuuacaccuga

SEQ ID NO: 251654 - RNA, 22 nt, Human
uuuuuccuagugcuuucuggua

SEQ ID NO: 251655 - RNA, 22 nt, Human
gaguuacauggacauucucucc

SEQ ID NO: 251656 - RNA, 22 nt, Human
ccaggcuggucugaauuucuag

SEQ ID NO: 251657 - RNA, 22 nt, Human
aacaagucuaagagaauggcag

SEQ ID NO: 251658 - RNA, 22 nt, Human
aagagguggguuggacagauac

SEQ ID NO: 251659 - RNA, 18 nt, Human
ggagaagaacagaugugg

SEQ ID NO: 251660 - RNA, 22 nt, Human
uggcaggcaaguucagcuccac

SEQ ID NO: 251661 - RNA, 22 nt, Human
aagugaauagccuauuuacuag

SEQ ID NO: 251662 - RNA, 22 nt, Human
cacaucuauggagacagagagu

SEQ ID NO: 251663 - RNA, 22 nt, Human
ucaaauaaggagucaugaccau

SEQ ID NO: 251664 - RNA, 16 nt, Human
uuauugaggccaagga

SEQ ID NO: 251665 - RNA, 22 nt, Human
uacagggacauggaacaggcuc

SEQ ID NO: 251666 - RNA, 22 nt, Human
acuacuuugggccauuuguuua

SEQ ID NO: 251667 - RNA, 22 nt, Human
gagucuggcccugaugcaucau

SEQ ID NO: 251668 - RNA, 20 nt, Human
aauccauuggucuauauguc

SEQ ID NO: 251669 - RNA, 22 nt, Human
acauccaccacaugccaggcuc

SEQ ID NO: 251670 - RNA, 18 nt, Human
gagucuuuguuacugcug

SEQ ID NO: 251671 - RNA, 22 nt, Human
accuuggaaaguuuaauugagg

SEQ ID NO: 251672 - RNA, 22 nt, Human
uggagucugugaugcucugggu

SEQ ID NO: 251673 - RNA, 22 nt, Human
gcugggagucgcgucuguggcc

SEQ ID NO: 251674 - RNA, 22 nt, Human
ugugucagaauuuuuguggcaa

SEQ ID NO: 251675 - RNA, 22 nt, Human
gcccuucauuuauaguuggaau

SEQ ID NO: 251676 - RNA, 22 nt, Human
uugcugcucccaagaggcagcu

SEQ ID NO: 251677 - RNA, 22 nt, Human
aguuucaauucuuuucacaaag

SEQ ID NO: 251678 - RNA, 22 nt, Human
ccuggucaccccucucucugca

SEQ ID NO: 251679 - RNA, 22 nt, Human
auuucuugugggaaaugcagca

SEQ ID NO: 251680 - RNA, 22 nt, Human
uaaagcagccagggucuaagcc

SEQ ID NO: 251681 - RNA, 22 nt, Human
ggcauagcggcucagcguccag

SEQ ID NO: 251682 - RNA, 22 nt, Human
ccuuggcuguguugccugcccu

SEQ ID NO: 251683 - RNA, 22 nt, Human
ccucuguaagccucaguuucuu

SEQ ID NO: 251684 - RNA, 22 nt, Human
ugcaugcauaaauguacacaca

SEQ ID NO: 251685 - RNA, 22 nt, Human
uguguacacaaguauauauaca

SEQ ID NO: 251686 - RNA, 22 nt, Human
ugcuggcucugggccaagcagg

SEQ ID NO: 251687 - RNA, 22 nt, Human
aaaagaaccuagcuccucaguc

SEQ ID NO: 251688 - RNA, 22 nt, Human
ccacucccuuccgguccagggc

SEQ ID NO: 251689 - RNA, 22 nt, Human
caaagcguccugccuccauuug

SEQ ID NO: 251690 - RNA, 22 nt, Human
uaaucuacuguuuauaugaaau

SEQ ID NO: 251691 - RNA, 22 nt, Human
ugagcccaggaggcagagguug

SEQ ID NO: 251692 - RNA, 22 nt, Human
uagcaaccuauggauagagaag

SEQ ID NO: 251693 - RNA, 22 nt, Human
cccauucauccucgcuuccuuc

SEQ ID NO: 251694 - RNA, 22 nt, Human
cagugaggaagcugucuggacc

SEQ ID NO: 251695 - RNA, 22 nt, Human
gcuuuucuccuuagugucccug

SEQ ID NO: 251696 - RNA, 22 nt, Human
uacaaaaggaagagggaucuua

SEQ ID NO: 251697 - RNA, 22 nt, Human
ucagagugaggcccagcaaucu

SEQ ID NO: 251698 - RNA, 22 nt, Human
uagaaacagcauauauuagccc

SEQ ID NO: 251699 - RNA, 22 nt, Human
ucaggccccuugucagcucugu

SEQ ID NO: 251700 - RNA, 18 nt, Human
ucugggcuucccgaggcu

SEQ ID NO: 251701 - RNA, 22 nt, Human
ucacagugucguccuugggugu

SEQ ID NO: 251702 - RNA, 22 nt, Human
cuggaaggggcagucuuugggc

SEQ ID NO: 251703 - RNA, 22 nt, Human
cuugacuuugccuuuuaaaugu

SEQ ID NO: 251704 - RNA, 22 nt, Human
caguaugucuacuggacaaagu

SEQ ID NO: 251705 - RNA, 21 nt, Human
uccagggcuuugauucucuca

SEQ ID NO: 251706 - RNA, 22 nt, Human
ccugugcauccgguggucauug

SEQ ID NO: 251707 - RNA, 22 nt, Human
auguguccucuggcagguuuag

SEQ ID NO: 251708 - RNA, 22 nt, Human
aggagugggggcgagaaguuaa

SEQ ID NO: 251709 - RNA, 22 nt, Human
ugucuaacccaguggcaggagg

SEQ ID NO: 251710 - RNA, 22 nt, Human
accagggccgcgggcgacuagc

SEQ ID NO: 251711 - RNA, 22 nt, Human
aaugucaauaacuuuaucccuc

SEQ ID NO: 251712 - RNA, 22 nt, Human
gucagcaggguccccuugagug

SEQ ID NO: 251713 - RNA, 22 nt, Human
gugccagggaguggaggagcuu

SEQ ID NO: 251714 - RNA, 22 nt, Human
uuccuggggcgacuguaucuga

SEQ ID NO: 251715 - RNA, 22 nt, Human
aauuagggagccaucauaaggu

SEQ ID NO: 251716 - RNA, 22 nt, Human
aaggcaguuaccgcaauggagg

SEQ ID NO: 251717 - RNA, 22 nt, Human
gcuuuagauacucccaaugucc

SEQ ID NO: 251718 - RNA, 16 nt, Human
uggcugagagaggguu

SEQ ID NO: 251719 - RNA, 22 nt, Human
auugaagaaacccaaauaaugg

SEQ ID NO: 251720 - RNA, 22 nt, Human
ccaccaagucccacuauaauuu

SEQ ID NO: 251721 - RNA, 22 nt, Human
ggcagcccuguggagaggccca

SEQ ID NO: 251722 - RNA, 22 nt, Human
uuccaaugacuaguggcauccu

SEQ ID NO: 251723 - RNA, 22 nt, Human
agggacccauagagagaccagu

SEQ ID NO: 251724 - RNA, 22 nt, Human
agggcagcccuucugggagggc

SEQ ID NO: 251725 - RNA, 22 nt, Human
gcaacaugaagaaaacagaacc

SEQ ID NO: 251726 - RNA, 22 nt, Human
caagcagggauacugcagggag

SEQ ID NO: 251727 - RNA, 22 nt, Human
ucugggcuggcuuuaugcugac

SEQ ID NO: 251728 - RNA, 22 nt, Human
auuuccuguaggggcuugcgaa

SEQ ID NO: 251729 - RNA, 22 nt, Human
caggaaaggugugucaugaugg

SEQ ID NO: 251730 - RNA, 22 nt, Human
aaugucuuuaaagugcaauaga

SEQ ID NO: 251731 - RNA, 20 nt, Human
uagggcucauuaugaucucc

SEQ ID NO: 251732 - RNA, 22 nt, Human
agccucugcuuaugcaaaggua

SEQ ID NO: 251733 - RNA, 22 nt, Human
augaggcauucacagaaggcac

SEQ ID NO: 251734 - RNA, 22 nt, Human
aacaaauguguuuuguaauuaa

SEQ ID NO: 251735 - RNA, 21 nt, Human
ucacaucuauguuaagcaaac

SEQ ID NO: 251736 - RNA, 22 nt, Human
accuucaaguaugugggcugaa

SEQ ID NO: 251737 - RNA, 22 nt, Human
gccagcucuguggcuguacuug

SEQ ID NO: 251738 - RNA, 22 nt, Human
gcugccugcaguguuuucccag

SEQ ID NO: 251739 - RNA, 22 nt, Human
gcccugcuguuuagagagcuac

SEQ ID NO: 251740 - RNA, 22 nt, Human
cacaucauagagacucaaucca

SEQ ID NO: 251741 - RNA, 22 nt, Human
agagacaggguuuugccauguu

SEQ ID NO: 251742 - RNA, 22 nt, Human
gcccauggcuucccuaggcaca

SEQ ID NO: 251743 - RNA, 22 nt, Human
aauuaagagagaguugaagcaa

SEQ ID NO: 251744 - RNA, 22 nt, Human
gugaggcaagggcauacuaggc

SEQ ID NO: 251745 - RNA, 22 nt, Human
uggcucaaguaacaaaaauaua

SEQ ID NO: 251746 - RNA, 22 nt, Human
auucuuaauugccaugcuguau

SEQ ID NO: 251747 - RNA, 22 nt, Human
gucugugggccaaauacagccc

SEQ ID NO: 251748 - RNA, 22 nt, Human
gcauucuucacaguauuccucc

SEQ ID NO: 251749 - RNA, 22 nt, Human
auuagaaaccaagaggcaggcu

SEQ ID NO: 251750 - RNA, 22 nt, Human
guuacagugcauguggcuucug

SEQ ID NO: 251751 - RNA, 22 nt, Human
uuguguccugauuugacacaau

SEQ ID NO: 251752 - RNA, 18 nt, Human
cacaggagccacacucac

SEQ ID NO: 251753 - RNA, 22 nt, Human
ucuccucaccaccagcagcaga

SEQ ID NO: 251754 - RNA, 22 nt, Human
uguaaacaugcugaggcuggag

SEQ ID NO: 251755 - RNA, 22 nt, Human
gaaggaaaucugugauuuaugc

SEQ ID NO: 251756 - RNA, 22 nt, Human
aagaguuagcucaauaacuuga

SEQ ID NO: 251757 - RNA, 22 nt, Human
ucaggcucccugcugggcucug

SEQ ID NO: 251758 - RNA, 22 nt, Human
cucugccaguuucuggccucag

SEQ ID NO: 251759 - RNA, 22 nt, Human
aacagugaggugaauaugcucc

SEQ ID NO: 251760 - RNA, 22 nt, Human
ccagaugucugagccacacucc

SEQ ID NO: 251761 - RNA, 22 nt, Human
guaaaguucuauuugaauuuag

SEQ ID NO: 251762 - RNA, 22 nt, Human
gucagauuaauagcaauaauaa

SEQ ID NO: 251763 - RNA, 22 nt, Human
ucagaggaaacaaucuuuagua

SEQ ID NO: 251764 - RNA, 22 nt, Human
auucagagucugcacaacagca

SEQ ID NO: 251765 - RNA, 22 nt, Human
cagaaugcaaauuuuauaauau

SEQ ID NO: 251766 - RNA, 22 nt, Human
aaagccagagcaagcugucaca

SEQ ID NO: 251767 - RNA, 23 nt, Human
gauacacucccugcugggcacug

SEQ ID NO: 251768 - RNA, 22 nt, Human
uuguuucaaauauuucagaaua

SEQ ID NO: 251769 - RNA, 22 nt, Human
caugaauuagcaauggugugca

SEQ ID NO: 251770 - RNA, 22 nt, Human
ccagguggacaaggcuuucaca

SEQ ID NO: 251771 - RNA, 22 nt, Human
uacagcacggugcauuuacuac

SEQ ID NO: 251772 - RNA, 22 nt, Human
uugugcuccuaugagaaucuaa

SEQ ID NO: 251773 - RNA, 22 nt, Human
uugugcucuuauugugcaggga

SEQ ID NO: 251774 - RNA, 22 nt, Human
ucuagaaauuuugccuuguauu

SEQ ID NO: 251775 - RNA, 22 nt, Human
acagauuuuaaaugacacuccc

SEQ ID NO: 251776 - RNA, 22 nt, Human
uuagcgcacaucacagggggaa

SEQ ID NO: 251777 - RNA, 22 nt, Human
uugauauucugagaagcugaag

SEQ ID NO: 251778 - RNA, 22 nt, Human
auucaaaugucaaauccaccag

SEQ ID NO: 251779 - RNA, 22 nt, Human
gagcugugcuuauaccaauuca

SEQ ID NO: 251780 - RNA, 22 nt, Human
uaugagaaaggagaaugacuuu

SEQ ID NO: 251781 - RNA, 17 nt, Human
agugucagaagacaguu

SEQ ID NO: 251782 - RNA, 22 nt, Human
gaaggacccacgaagucacugg

SEQ ID NO: 251783 - RNA, 22 nt, Human
ccaggcaggcgauggugcagug

SEQ ID NO: 251784 - RNA, 19 nt, Human
uccuucagucagaucuggg

SEQ ID NO: 251785 - RNA, 22 nt, Human
aauaauguaggaugauaaauga

SEQ ID NO: 251786 - RNA, 22 nt, Human
acaguugagaugcaacuuuggg

SEQ ID NO: 251787 - RNA, 22 nt, Human
agcccugggucccaguccuggc

SEQ ID NO: 251788 - RNA, 22 nt, Human
cauugcuguuaauugucucuag

SEQ ID NO: 251789 - RNA, 19 nt, Human
auagggcacccuaaggagu

SEQ ID NO: 251790 - RNA, 22 nt, Human
cuggacacaaacaucuccucug

SEQ ID NO: 251791 - RNA, 22 nt, Human
cacaguuucugaacacuuugca

SEQ ID NO: 251792 - RNA, 22 nt, Human
agcaaggcagcuuucacugcuu

SEQ ID NO: 251793 - RNA, 22 nt, Human
cagcagaaguccgacuccaguc

SEQ ID NO: 251794 - RNA, 22 nt, Human
aucacaucucaccacugcaacc

SEQ ID NO: 251795 - RNA, 22 nt, Human
cuguacaaguccuucaucaggg

SEQ ID NO: 251796 - RNA, 22 nt, Human
ugguggcagcugagugucaggu

SEQ ID NO: 251797 - RNA, 23 nt, Human
agauuuggaaagcugaguggcgu

SEQ ID NO: 251798 - RNA, 22 nt, Human
uagauccugagcccuaucuacu

SEQ ID NO: 251799 - RNA, 19 nt, Human
agucaguucugaggaggaa

SEQ ID NO: 251800 - RNA, 22 nt, Human
ggcucuggguucugcaaugcgu

SEQ ID NO: 251801 - RNA, 22 nt, Human
uggcagugaugcggcaggacau

SEQ ID NO: 251802 - RNA, 19 nt, Human
agauggggaagagugugag

SEQ ID NO: 251803 - RNA, 22 nt, Human
auacaucaugcuccauauauuu

SEQ ID NO: 251804 - RNA, 22 nt, Human
guguggcuguuuagugacuuuc

SEQ ID NO: 251805 - RNA, 21 nt, Human
uggccagcuggagucuccaca

SEQ ID NO: 251806 - RNA, 22 nt, Human
caguuuauuuccaagaugacaa

SEQ ID NO: 251807 - RNA, 22 nt, Human
agcagcagauucagcaggaaug

SEQ ID NO: 251808 - RNA, 22 nt, Human
ggccaaggaugguggcucuggu

SEQ ID NO: 251809 - RNA, 22 nt, Human
acauuucucagguaagucauuu

SEQ ID NO: 251810 - RNA, 22 nt, Human
cccuuccugggugucccggagu

SEQ ID NO: 251811 - RNA, 22 nt, Human
cagggucccaggagcugcuuuc

SEQ ID NO: 251812 - RNA, 22 nt, Human
aaagccaguuucuggaaguacc

SEQ ID NO: 251813 - RNA, 23 nt, Human
agcugaggugcagauccaaagaa

SEQ ID NO: 251814 - RNA, 22 nt, Human
gcagagaaaguuuuguccucag

SEQ ID NO: 251815 - RNA, 22 nt, Human
acaguuuaugccucugagccug

SEQ ID NO: 251816 - RNA, 22 nt, Human
aggagccuccauggucacauuc

SEQ ID NO: 251817 - RNA, 22 nt, Human
cagggaugcugcuuaggcaguu

SEQ ID NO: 251818 - RNA, 22 nt, Human
uuaaguacuucccuguuggaca

SEQ ID NO: 251819 - RNA, 22 nt, Human
ggcuccagguuuaaggguaugu

SEQ ID NO: 251820 - RNA, 22 nt, Human
gagacacacccaagguuaugag

SEQ ID NO: 251821 - RNA, 22 nt, Human
caaaggcaacauauacuuguuu

SEQ ID NO: 251822 - RNA, 22 nt, Human
gccaggagaaugcuagcagagg

SEQ ID NO: 251823 - RNA, 22 nt, Human
gaaaggcuaaaauuauaagggu

SEQ ID NO: 251824 - RNA, 22 nt, Human
cugaaauaaaguugcuaaaauu

SEQ ID NO: 251825 - RNA, 22 nt, Human
cccagagcugauuguuggagcc

SEQ ID NO: 251826 - RNA, 22 nt, Human
cucucagacacccauuuggaaa

SEQ ID NO: 251827 - RNA, 22 nt, Human
ucacucugcugcccgagggcug

SEQ ID NO: 251828 - RNA, 22 nt, Human
cacuguggcaaccugugcccaa

SEQ ID NO: 251829 - RNA, 22 nt, Human
gauuuguuucaaguuagcaucu

SEQ ID NO: 251830 - RNA, 22 nt, Human
cagcuuugcaggcuggucagug

SEQ ID NO: 251831 - RNA, 22 nt, Human
uucacauugugcagauuauggu

SEQ ID NO: 251832 - RNA, 22 nt, Human
ugagaggcgcucacucucaggu

SEQ ID NO: 251833 - RNA, 22 nt, Human
caagcugguaucagcuagagcg

SEQ ID NO: 251834 - RNA, 19 nt, Human
auggcugcugauuggggau

SEQ ID NO: 251835 - RNA, 22 nt, Human
cugagaucuuuauacgaggcac

SEQ ID NO: 251836 - RNA, 20 nt, Human
uccagcacccucacagagaa

SEQ ID NO: 251837 - RNA, 22 nt, Human
cacugagagaugugucacagca

SEQ ID NO: 251838 - RNA, 22 nt, Human
gacccagcuuaagucacauguu

SEQ ID NO: 251839 - RNA, 22 nt, Human
ucuuucaaaguaacaaccacga

SEQ ID NO: 251840 - RNA, 23 nt, Human
cuggcuucuggggccucuguuuc

SEQ ID NO: 251841 - RNA, 21 nt, Human
ggaaaacuuuccuugucugaa

SEQ ID NO: 251842 - RNA, 22 nt, Human
aaagugcuuucccacauuuguu

SEQ ID NO: 251843 - RNA, 22 nt, Human
gucucagauucagacaucuaca

SEQ ID NO: 251844 - RNA, 22 nt, Human
uccccagguccugucggcuccu

SEQ ID NO: 251845 - RNA, 22 nt, Human
uaguccuugcugggcacagagu

SEQ ID NO: 251846 - RNA, 22 nt, Human
aagaggaggacgguucccagaa

SEQ ID NO: 251847 - RNA, 22 nt, Human
acagauauuaugguuucuccuu

SEQ ID NO: 251848 - RNA, 22 nt, Human
gcucuagcuggcgcugaccugg

SEQ ID NO: 251849 - RNA, 22 nt, Human
cuggcugcuugggacagccaug

SEQ ID NO: 251850 - RNA, 22 nt, Human
aucaaaguggaaguuuacuagg

SEQ ID NO: 251851 - RNA, 22 nt, Human
cugacagguugguagcuuugga

SEQ ID NO: 251852 - RNA, 22 nt, Human
aggcuuggagguucuguagcca

SEQ ID NO: 251853 - RNA, 22 nt, Human
gcucagggaguuucacagugua

SEQ ID NO: 251854 - RNA, 22 nt, Human
uagggcugugucuccaggacca

SEQ ID NO: 251855 - RNA, 22 nt, Human
gagacacaaucucauuuacauu

SEQ ID NO: 251856 - RNA, 22 nt, Human
gcuggcuggaacuagcaguugg

SEQ ID NO: 251857 - RNA, 22 nt, Human
gccaggcauucuagaaguagug

SEQ ID NO: 251858 - RNA, 22 nt, Human
gagggaccccaggcuggcccuu

SEQ ID NO: 251859 - RNA, 21 nt, Human
agccagucauuaugagcggga

SEQ ID NO: 251860 - RNA, 22 nt, Human
ucugugcagaaucaaggagcuu

SEQ ID NO: 251861 - RNA, 22 nt, Human
uggaauguugauaaacauaggc

SEQ ID NO: 251862 - RNA, 22 nt, Human
auuuucaucauggguuuaacau

SEQ ID NO: 251863 - RNA, 22 nt, Human
ccugguuuguauuuuuaacacc

SEQ ID NO: 251864 - RNA, 22 nt, Human
gcaagagcgcucucuuucauua

SEQ ID NO: 251865 - RNA, 22 nt, Human
gaauaucccgcuaugcaaagua

SEQ ID NO: 251866 - RNA, 22 nt, Human
cugggaaauggcuucgagcuca

SEQ ID NO: 251867 - RNA, 22 nt, Human
uuauugcucuauuauggccuaa

SEQ ID NO: 251868 - RNA, 22 nt, Human
cucaaauagaacugaucuauaa

SEQ ID NO: 251869 - RNA, 22 nt, Human
auacucuuuaugacauuccagc

SEQ ID NO: 251870 - RNA, 22 nt, Human
augcaugucugccaguugcuua

SEQ ID NO: 251871 - RNA, 22 nt, Human
gcacccagagggcagggucucc

SEQ ID NO: 251872 - RNA, 22 nt, Human
uacagaaagggaugauugaucu

SEQ ID NO: 251873 - RNA, 22 nt, Human
caggguggccagguagauaaua

SEQ ID NO: 251874 - RNA, 22 nt, Human
uauagaacaaguuauuuaugcu

SEQ ID NO: 251875 - RNA, 22 nt, Human
uguugauuugugggcugcaaaa

SEQ ID NO: 251876 - RNA, 22 nt, Human
gcagggcuauuggaaggagaug

SEQ ID NO: 251877 - RNA, 22 nt, Human
aaucacaucucauucaacagcc

SEQ ID NO: 251878 - RNA, 22 nt, Human
acagcuaacuuaaacuaaccua

SEQ ID NO: 251879 - RNA, 22 nt, Human
gucccuggaauggacucugcgc

SEQ ID NO: 251880 - RNA, 22 nt, Human
agcaggcugagcacccaggggg

SEQ ID NO: 251881 - RNA, 22 nt, Human
uuuuauguuccucuuuaugcga

SEQ ID NO: 251882 - RNA, 22 nt, Human
gagaaucuuuccccacagaagg

SEQ ID NO: 251883 - RNA, 22 nt, Human
auuuggcaacauuaauugaauc

SEQ ID NO: 251884 - RNA, 22 nt, Human
gcacaugacaguaaguagagca

SEQ ID NO: 251885 - RNA, 22 nt, Human
agcccagcacugggggcccagc

SEQ ID NO: 251886 - RNA, 22 nt, Human
ucacaugucacaaaacacugcc

SEQ ID NO: 251887 - RNA, 22 nt, Human
aucaucaucaacaagaaacauu

SEQ ID NO: 251888 - RNA, 22 nt, Human
acucuguaauucuauaugcagu

SEQ ID NO: 251889 - RNA, 20 nt, Human
cccagagguugcggcaggag

SEQ ID NO: 251890 - RNA, 22 nt, Human
gcuccccauugaucugcaggcu

SEQ ID NO: 251891 - RNA, 22 nt, Human
cuguggaaauaaacaaugcuaa

SEQ ID NO: 251892 - RNA, 22 nt, Human
aaguaccucauaggguuauuuu

SEQ ID NO: 251893 - RNA, 22 nt, Human
acuguuugcugauagauauuua

SEQ ID NO: 251894 - RNA, 22 nt, Human
ggaagaaaucugguuaagagau

SEQ ID NO: 251895 - RNA, 22 nt, Human
cugagccuuauucaccagcccu

SEQ ID NO: 251896 - RNA, 22 nt, Human
aaaguauuuuugacaggcauua

SEQ ID NO: 251897 - RNA, 22 nt, Human
ggucuccuugggaaagcaggaa

SEQ ID NO: 251898 - RNA, 22 nt, Human
cugggcucuucucacccuguuu

SEQ ID NO: 251899 - RNA, 23 nt, Human
ucucugcauguccugagcacauc

SEQ ID NO: 251900 - RNA, 22 nt, Human
uuccuucuaauauucugccugu

SEQ ID NO: 251901 - RNA, 21 nt, Human
ugagagccuccaaccggcuac

SEQ ID NO: 251902 - RNA, 22 nt, Human
uaaugucaaggugauagauuug

SEQ ID NO: 251903 - RNA, 22 nt, Human
uuucuuuugaauaguguguggu

SEQ ID NO: 251904 - RNA, 22 nt, Human
ucagguguagguuguucaguuu

SEQ ID NO: 251905 - RNA, 22 nt, Human
ucccagggacaccaagcuguuu

SEQ ID NO: 251906 - RNA, 22 nt, Human
aaaauuauagaucuagugccug

SEQ ID NO: 251907 - RNA, 19 nt, Human
gcucaggcugugugugggg

SEQ ID NO: 251908 - RNA, 22 nt, Human
uucacaaaacacuauuuucugg

SEQ ID NO: 251909 - RNA, 22 nt, Human
gcugacaaacaaggugguguca

SEQ ID NO: 251910 - RNA, 22 nt, Human
ggugucagauacauaggaagua

SEQ ID NO: 251911 - RNA, 22 nt, Human
agugcagauuuuuagucagcuu

SEQ ID NO: 251912 - RNA, 22 nt, Human
aaagaaguguugaauuugcaag

SEQ ID NO: 251913 - RNA, 22 nt, Human
ugcuuugccagacaguucccuu

SEQ ID NO: 251914 - RNA, 22 nt, Human
aauuuccaaauuucugucacac

SEQ ID NO: 251915 - RNA, 22 nt, Human
cccccauccaugucaggagagg

SEQ ID NO: 251916 - RNA, 22 nt, Human
ccuagggauacagcagaguaca

SEQ ID NO: 251917 - RNA, 22 nt, Human
ugaaggcugucaccugcaccuu

SEQ ID NO: 251918 - RNA, 22 nt, Human
ccaggcccugcuccucacacca

SEQ ID NO: 251919 - RNA, 22 nt, Human
gaaccauuguugaaaagaauag

SEQ ID NO: 251920 - RNA, 22 nt, Human
aaggccuuugccccgauacagg

SEQ ID NO: 251921 - RNA, 22 nt, Human
caguguucccugaacauauguu

SEQ ID NO: 251922 - RNA, 16 nt, Human
ucaggugugacuuuuu

SEQ ID NO: 251923 - RNA, 22 nt, Human
ugcauuaagcacacuuuugaau

SEQ ID NO: 251924 - RNA, 22 nt, Human
aaucuucacucauucagaguug

SEQ ID NO: 251925 - RNA, 22 nt, Human
gggcaggucugggucagccuga

SEQ ID NO: 251926 - RNA, 22 nt, Human
gugggcuuuugacagugccugg

SEQ ID NO: 251927 - RNA, 22 nt, Human
auaugagagaggaaagauuuua

SEQ ID NO: 251928 - RNA, 22 nt, Human
uaauacaucauucaucuaagga

SEQ ID NO: 251929 - RNA, 22 nt, Human
ugcagcuguaacagaggccuca

SEQ ID NO: 251930 - RNA, 22 nt, Human
ggagaaggaauauuggaguagg

SEQ ID NO: 251931 - RNA, 20 nt, Human
auccaugagagucuggauuc

SEQ ID NO: 251932 - RNA, 22 nt, Human
ggugagggaguggaacgaggug

SEQ ID NO: 251933 - RNA, 22 nt, Human
cuuagaguuauggaaauguuga

SEQ ID NO: 251934 - RNA, 22 nt, Human
aggacagcccuugagagcacau

SEQ ID NO: 251935 - RNA, 19 nt, Human
ggaagagaggaaaggugga

SEQ ID NO: 251936 - RNA, 22 nt, Human
uuuuaaacugcagaauuuagaa

SEQ ID NO: 251937 - RNA, 22 nt, Human
ucugcccugccauucacuggaa

SEQ ID NO: 251938 - RNA, 22 nt, Human
uucugaauucaugagauuuggg

SEQ ID NO: 251939 - RNA, 22 nt, Human
auacacuuccaaauauugauua

SEQ ID NO: 251940 - RNA, 22 nt, Human
agcugagcugcagaugacugua

SEQ ID NO: 251941 - RNA, 22 nt, Human
acagagguguguguaggacagu

SEQ ID NO: 251942 - RNA, 22 nt, Human
ucuggcagggucagggcccagg

SEQ ID NO: 251943 - RNA, 22 nt, Human
uuacauguggagucugauugca

SEQ ID NO: 251944 - RNA, 22 nt, Human
ggcuggguacccuguuuccccu

SEQ ID NO: 251945 - RNA, 22 nt, Human
cugcagggaugugaggcccguu

SEQ ID NO: 251946 - RNA, 22 nt, Human
agucugggcauuuaggauguug

SEQ ID NO: 251947 - RNA, 22 nt, Human
cccugaggagagcgcuucccga

SEQ ID NO: 251948 - RNA, 23 nt, Human
uuuauauuccuaaugucuugagc

SEQ ID NO: 251949 - RNA, 22 nt, Human
agcuggguguucuugggccuaa

SEQ ID NO: 251950 - RNA, 22 nt, Human
auuauuuacagugugcucgaag

SEQ ID NO: 251951 - RNA, 22 nt, Human
ucccagggacucucugccuucc

SEQ ID NO: 251952 - RNA, 22 nt, Human
aauagcuuuggucaccaucugg

SEQ ID NO: 251953 - RNA, 22 nt, Human
uggcccaggugcacccagaggc

SEQ ID NO: 251954 - RNA, 23 nt, Human
ugcuggcugaaacagccaaagga

SEQ ID NO: 251955 - RNA, 22 nt, Human
agggugagggucuggccuugag

SEQ ID NO: 251956 - RNA, 22 nt, Human
guggcagaguugcugacuagaa

SEQ ID NO: 251957 - RNA, 22 nt, Human
cucucagaaguuuaugucagaa

SEQ ID NO: 251958 - RNA, 22 nt, Human
ggaccaggggcgcacucccugc

SEQ ID NO: 251959 - RNA, 22 nt, Human
ucucagugcagagaggcuaucu

SEQ ID NO: 251960 - RNA, 23 nt, Human
cugcuccaggacagcauggaggu

SEQ ID NO: 251961 - RNA, 22 nt, Human
acagccaggagccaugggcagg

SEQ ID NO: 251962 - RNA, 22 nt, Human
ugagcaguggcuccugcuggac

SEQ ID NO: 251963 - RNA, 16 nt, Human
gucuuuauucacuuag

SEQ ID NO: 251964 - RNA, 22 nt, Human
ucugauaucgcacuaaacucug

SEQ ID NO: 251965 - RNA, 22 nt, Human
gagaaagcuucagaaauggccu

SEQ ID NO: 251966 - RNA, 22 nt, Human
cugccauguagucuauggggcg

SEQ ID NO: 251967 - RNA, 22 nt, Human
gguuacauggaagaaauauaau

SEQ ID NO: 251968 - RNA, 22 nt, Human
ggauuuacccaauggauagaug

SEQ ID NO: 251969 - RNA, 22 nt, Human
ccaggcucuaucccuccuucuu

SEQ ID NO: 251970 - RNA, 22 nt, Human
uauugaggaucuccugcuaauu

SEQ ID NO: 251971 - RNA, 22 nt, Human
ccagcagggcagugcccuggac

SEQ ID NO: 251972 - RNA, 22 nt, Human
ucuaaugagggugaaggcccag

SEQ ID NO: 251973 - RNA, 22 nt, Human
agguggcuguggcuucccuugu

SEQ ID NO: 251974 - RNA, 22 nt, Human
acagguggcauaggcaguuuga

SEQ ID NO: 251975 - RNA, 22 nt, Human
ccuauuuguaggcugggccagu

SEQ ID NO: 251976 - RNA, 22 nt, Human
agcagcaggcuuaaggaaaagu

SEQ ID NO: 251977 - RNA, 22 nt, Human
ucucaaauggacaauauugugg

SEQ ID NO: 251978 - RNA, 22 nt, Human
caggcugggcagccuccccggc

SEQ ID NO: 251979 - RNA, 22 nt, Human
ucaggagacuggcagugcccac

SEQ ID NO: 251980 - RNA, 22 nt, Human
uguuacagaaaguuuaugaaug

SEQ ID NO: 251981 - RNA, 20 nt, Human
agacaaugagugacagaguu

SEQ ID NO: 251982 - RNA, 22 nt, Human
accuggcauaagggcuugaguc

SEQ ID NO: 251983 - RNA, 21 nt, Human
aaauccaaacacuaguccaca

SEQ ID NO: 251984 - RNA, 22 nt, Human
gcagagaguugggcugcgccag

SEQ ID NO: 251985 - RNA, 22 nt, Human
ugagaggagugauuguaaaauu

SEQ ID NO: 251986 - RNA, 22 nt, Human
ugucuugacuuuagagccagga

SEQ ID NO: 251987 - RNA, 22 nt, Human
caucacuguccucagcauucca

SEQ ID NO: 251988 - RNA, 22 nt, Human
cacagcgugaugaauguagcgu

SEQ ID NO: 251989 - RNA, 22 nt, Human
caggcuugagggcaggcccagu

SEQ ID NO: 251990 - RNA, 22 nt, Human
uucccucuccaggagcccugag

SEQ ID NO: 251991 - RNA, 22 nt, Human
aggaaaaugaaacagcaacugu

SEQ ID NO: 251992 - RNA, 22 nt, Human
cugggccugugacucccauccu

SEQ ID NO: 251993 - RNA, 22 nt, Human
aucuguggaaagguaaccagua

SEQ ID NO: 251994 - RNA, 22 nt, Human
caggcugugaaacugagaugcg

SEQ ID NO: 251995 - RNA, 22 nt, Human
ucccacagugguacagcccuga

SEQ ID NO: 251996 - RNA, 21 nt, Human
ugguccuucuuuacugccucc

SEQ ID NO: 251997 - RNA, 22 nt, Human
gguggggcccaggcaucugaug

SEQ ID NO: 251998 - RNA, 22 nt, Human
aagcaaagaguuuaguggguga

SEQ ID NO: 251999 - RNA, 22 nt, Human
augauuacauguguuaauauac

SEQ ID NO: 252000 - RNA, 20 nt, Human
ugggugagaguguuugcucu

SEQ ID NO: 252001 - RNA, 22 nt, Human
aaguucaagaucaagguuccag

SEQ ID NO: 252002 - RNA, 22 nt, Human
ggcccagagcucccuggcaccu

SEQ ID NO: 252003 - RNA, 22 nt, Human
agcagggcuuugcagacuuggg

SEQ ID NO: 252004 - RNA, 22 nt, Human
acccagcaugacaccugcacau

SEQ ID NO: 252005 - RNA, 22 nt, Human
agucugcuuccuggagaacuca

SEQ ID NO: 252006 - RNA, 22 nt, Human
ucaggacaacauguugcuaauc

SEQ ID NO: 252007 - RNA, 22 nt, Human
uuucccaggcuggaaugcagug

SEQ ID NO: 252008 - RNA, 22 nt, Human
acacagcucagugccuccaaga

SEQ ID NO: 252009 - RNA, 22 nt, Human
gcugcugggguggagaaacgcu

SEQ ID NO: 252010 - RNA, 22 nt, Human
gccuuggagaucacugcucaug

SEQ ID NO: 252011 - RNA, 22 nt, Human
caaucugaguugggaauguauu

SEQ ID NO: 252012 - RNA, 23 nt, Human
ccccucugguggcucagcuccug

SEQ ID NO: 252013 - RNA, 22 nt, Human
accaguuuguaaccuguuuuca

SEQ ID NO: 252014 - RNA, 22 nt, Human
gaacaguaucaguagugccagu

SEQ ID NO: 252015 - RNA, 22 nt, Human
aagauaauguucuagcugucag

SEQ ID NO: 252016 - RNA, 22 nt, Human
gagguacaugaggauacacagg

SEQ ID NO: 252017 - RNA, 22 nt, Human
agggaaggaggccauguguccc

SEQ ID NO: 252018 - RNA, 22 nt, Human
ucagucauaguuuggagagaau

SEQ ID NO: 252019 - RNA, 22 nt, Human
uacccaggaggaaacugaggcu

SEQ ID NO: 252020 - RNA, 22 nt, Human
ccucagaguaggucucagcugu

SEQ ID NO: 252021 - RNA, 22 nt, Human
auagaauuacaguguguuugga

SEQ ID NO: 252022 - RNA, 22 nt, Human
cucagggauggugaagcaccca

SEQ ID NO: 252023 - RNA, 22 nt, Human
gagucuucugaguuauuggaua

SEQ ID NO: 252024 - RNA, 22 nt, Human
uuuaacauguaauugcugcuuu

SEQ ID NO: 252025 - RNA, 22 nt, Human
ucuuuagaguuaacaauaauga

SEQ ID NO: 252026 - RNA, 19 nt, Human
ugggcagguucaguaaugg

SEQ ID NO: 252027 - RNA, 22 nt, Human
aucuaucaccuuuagguuuguu

SEQ ID NO: 252028 - RNA, 22 nt, Human
caggacagugcagguccauccu

SEQ ID NO: 252029 - RNA, 22 nt, Human
uuugaacuaccucuccuuagca

SEQ ID NO: 252030 - RNA, 22 nt, Human
uuuguuuagaaagagauuggug

SEQ ID NO: 252031 - RNA, 22 nt, Human
aggcacaguggcccuguuuggg

SEQ ID NO: 252032 - RNA, 19 nt, Human
gaaggggaagguggguacc

SEQ ID NO: 252033 - RNA, 22 nt, Human
cagcuugggggcgcuggccuca

SEQ ID NO: 252034 - RNA, 22 nt, Human
cccuguuuauuuuuggagagaa

SEQ ID NO: 252035 - RNA, 22 nt, Human
uaacaguugguguaauuucuug

SEQ ID NO: 252036 - RNA, 22 nt, Human
agcagguguuggcugggccauc

SEQ ID NO: 252037 - RNA, 22 nt, Human
ccagcagcucccucaggguccg

SEQ ID NO: 252038 - RNA, 22 nt, Human
gggaguggguuuggccuaggcc

SEQ ID NO: 252039 - RNA, 22 nt, Human
uacaggguauagguacagauga

SEQ ID NO: 252040 - RNA, 22 nt, Human
ggccugagaauguaccagaucu

SEQ ID NO: 252041 - RNA, 22 nt, Human
aaaaugugaucuacaaaugcaa

SEQ ID NO: 252042 - RNA, 22 nt, Human
aauggcuuuuaaaaauagcauu

SEQ ID NO: 252043 - RNA, 22 nt, Human
ccucaggcucugggugccuacc

SEQ ID NO: 252044 - RNA, 22 nt, Human
cucuggaagaugaccuggguaa

SEQ ID NO: 252045 - RNA, 22 nt, Human
accuccccugacucgaaaccca

SEQ ID NO: 252046 - RNA, 22 nt, Human
uucuucaaaacaacacuggccu

SEQ ID NO: 252047 - RNA, 22 nt, Human
ucaguguuuccuagagcauaua

SEQ ID NO: 252048 - RNA, 22 nt, Human
ccagccacugggccacugccag

SEQ ID NO: 252049 - RNA, 22 nt, Human
cuggcccagagagcagagcuua

SEQ ID NO: 252050 - RNA, 23 nt, Human
aacaccaaggcucagagagauaa

SEQ ID NO: 252051 - RNA, 22 nt, Human
aucuguaacaucaguagcagaa

SEQ ID NO: 252052 - RNA, 22 nt, Human
uggagcagaguucagcggggag

SEQ ID NO: 252053 - RNA, 22 nt, Human
aggacacacaaagagugagaac

SEQ ID NO: 252054 - RNA, 22 nt, Human
ucaagcaaagauacaaauggaa

SEQ ID NO: 252055 - RNA, 22 nt, Human
ugcuuaaaggauaguuuaaacu

SEQ ID NO: 252056 - RNA, 22 nt, Human
cccuucaggguuaaguagaggg

SEQ ID NO: 252057 - RNA, 22 nt, Human
accuguuuguguuuggacugca

SEQ ID NO: 252058 - RNA, 22 nt, Human
uagcuucuaauacuuaccaauu

SEQ ID NO: 252059 - RNA, 22 nt, Human
uucuccugggagggguugccca

SEQ ID NO: 252060 - RNA, 22 nt, Human
caggcucccgaaaucacccaug

SEQ ID NO: 252061 - RNA, 22 nt, Human
ggccugggcccacugucaagag

SEQ ID NO: 252062 - RNA, 22 nt, Human
cacugccuccccaggcuccaca

SEQ ID NO: 252063 - RNA, 22 nt, Human
ggugggagagcuugcuuugaug

SEQ ID NO: 252064 - RNA, 23 nt, Human
acuauaaaguuguucugauuuac

SEQ ID NO: 252065 - RNA, 22 nt, Human
aaggaccugauuuugagcaucu

SEQ ID NO: 252066 - RNA, 22 nt, Human
aacaaacucaaauggaagagug

SEQ ID NO: 252067 - RNA, 22 nt, Human
auccaggccccaagaccccgac

SEQ ID NO: 252068 - RNA, 22 nt, Human
aaaguuugagugauuugacaca

SEQ ID NO: 252069 - RNA, 22 nt, Human
cucucugggaauauuuuauucu

SEQ ID NO: 252070 - RNA, 22 nt, Human
gagugggcaaaagaaaguaggc

SEQ ID NO: 252071 - RNA, 22 nt, Human
ccuggaucuaaggaagcuggga

SEQ ID NO: 252072 - RNA, 22 nt, Human
gcagggcaugggcccugucugc

SEQ ID NO: 252073 - RNA, 22 nt, Human
uccagagguauguagagaguau

SEQ ID NO: 252074 - RNA, 21 nt, Human
uaugugucuguggaaaacuag

SEQ ID NO: 252075 - RNA, 23 nt, Human
uccugaggguuucccagccuugg

SEQ ID NO: 252076 - RNA, 22 nt, Human
agugaugucacaaacuauggug

SEQ ID NO: 252077 - RNA, 22 nt, Human
gcagcugggacacugaggccag

SEQ ID NO: 252078 - RNA, 22 nt, Human
cagauuuaccuaacuccaaguu

SEQ ID NO: 252079 - RNA, 22 nt, Human
ccucuuugacucucaggucuuu

SEQ ID NO: 252080 - RNA, 22 nt, Human
cugggagauugcuagagaugca

SEQ ID NO: 252081 - RNA, 22 nt, Human
cuggaugucuuggggacuccug

SEQ ID NO: 252082 - RNA, 22 nt, Human
caguguuuaaucauugugaauu

SEQ ID NO: 252083 - RNA, 22 nt, Human
aauaagacucugcuagaaauuc

SEQ ID NO: 252084 - RNA, 22 nt, Human
gcuggagugaugccugugucuc

SEQ ID NO: 252085 - RNA, 22 nt, Human
gcagggcagagggagaaucucu

SEQ ID NO: 252086 - RNA, 22 nt, Human
uuaucuguugcuuaaugcgcau

SEQ ID NO: 252087 - RNA, 22 nt, Human
cacugguauuugaaaauagaug

SEQ ID NO: 252088 - RNA, 22 nt, Human
uuuacugaccuccaaucccacu

SEQ ID NO: 252089 - RNA, 22 nt, Human
gucacaggccuggaugaggggc

SEQ ID NO: 252090 - RNA, 22 nt, Human
gcugcucugcuguguaagcagg

SEQ ID NO: 252091 - RNA, 22 nt, Human
ugaacaacugcaaaaaucucca

SEQ ID NO: 252092 - RNA, 22 nt, Human
gcuggccaaaguguaccuggag

SEQ ID NO: 252093 - RNA, 22 nt, Human
aggccagcuucuacccucuguu

SEQ ID NO: 252094 - RNA, 22 nt, Human
ggccuugguggcuuugcugaug

SEQ ID NO: 252095 - RNA, 22 nt, Human
ucuuagcauuuguuaauaccca

SEQ ID NO: 252096 - RNA, 22 nt, Human
augacuucguuuucucucugca

SEQ ID NO: 252097 - RNA, 22 nt, Human
uggauucugggagaguucuaua

SEQ ID NO: 252098 - RNA, 22 nt, Human
augaacagcauugaaauccagc

SEQ ID NO: 252099 - RNA, 22 nt, Human
acaugaaugcagccauaacacu

SEQ ID NO: 252100 - RNA, 22 nt, Human
caggccucaggggcucaggcug

SEQ ID NO: 252101 - RNA, 22 nt, Human
ugaucuuuucaaagacaagcuu

SEQ ID NO: 252102 - RNA, 20 nt, Human
caugccagaaugugagguag

SEQ ID NO: 252103 - RNA, 22 nt, Human
gcuccugugcaggucucgguug

SEQ ID NO: 252104 - RNA, 22 nt, Human
uuuggccucguuuagaaauggc

SEQ ID NO: 252105 - RNA, 22 nt, Human
gcuggcucugaugggcuccagg

SEQ ID NO: 252106 - RNA, 22 nt, Human
uagcuuuaccauagaagaguau

SEQ ID NO: 252107 - RNA, 22 nt, Human
aguaaugauuauguacagaaug

SEQ ID NO: 252108 - RNA, 22 nt, Human
ggagucugaguccucauagaca

SEQ ID NO: 252109 - RNA, 22 nt, Human
guucaaagcuccugguacagua

SEQ ID NO: 252110 - RNA, 20 nt, Human
ugguccugucccacccacuc

SEQ ID NO: 252111 - RNA, 22 nt, Human
ccugcccuaauccagagacuag

SEQ ID NO: 252112 - RNA, 22 nt, Human
ucagaggauagaaauacuuauu

SEQ ID NO: 252113 - RNA, 22 nt, Human
gauaagcacuauauaaguauuu

SEQ ID NO: 252114 - RNA, 22 nt, Human
uugcuggggugugaaaucugau

SEQ ID NO: 252115 - RNA, 22 nt, Human
gagagggccgggggccagcucc

SEQ ID NO: 252116 - RNA, 20 nt, Human
aaagagcccuuggagcaggc

SEQ ID NO: 252117 - RNA, 21 nt, Human
gggagcugacagcagcacggc

SEQ ID NO: 252118 - RNA, 22 nt, Human
aaguugaaugcguacgugacau

SEQ ID NO: 252119 - RNA, 22 nt, Human
gagcugaaggagaaagcagggg

SEQ ID NO: 252120 - RNA, 22 nt, Human
caggcccugcacagugguccug

SEQ ID NO: 252121 - RNA, 22 nt, Human
augcuaaauucagacaggguua

SEQ ID NO: 252122 - RNA, 22 nt, Human
guuugucccacuucuggcagaa

SEQ ID NO: 252123 - RNA, 22 nt, Human
gugucuuuauuccucuauguuu

SEQ ID NO: 252124 - RNA, 22 nt, Human
uuggcuucaaugucagagacag

SEQ ID NO: 252125 - RNA, 22 nt, Human
ugaucacaagucugaagaauga

SEQ ID NO: 252126 - RNA, 22 nt, Human
aacuuucuaauuuuggcugagc

SEQ ID NO: 252127 - RNA, 22 nt, Human
gaaauacaauuuugucccagcu

SEQ ID NO: 252128 - RNA, 22 nt, Human
gugcagagaggaccuuggggag

SEQ ID NO: 252129 - RNA, 22 nt, Human
uuuacugucucagagagacaaa

SEQ ID NO: 252130 - RNA, 22 nt, Human
ugaaacauugcacuguaugaau

SEQ ID NO: 252131 - RNA, 22 nt, Human
cugggcuuaggaccuggugcgg

SEQ ID NO: 252132 - RNA, 22 nt, Human
aauuuccugggauaaaaagcca

SEQ ID NO: 252133 - RNA, 22 nt, Human
uggaaggagacugggaagugug

SEQ ID NO: 252134 - RNA, 22 nt, Human
aaugaaauguagcuuauccaua

SEQ ID NO: 252135 - RNA, 22 nt, Human
agcaggcugggcaauaugggca

SEQ ID NO: 252136 - RNA, 22 nt, Human
ucugagcugugaguugcuuagg

SEQ ID NO: 252137 - RNA, 22 nt, Human
gcaggcagccacgauucccuug

SEQ ID NO: 252138 - RNA, 22 nt, Human
aagcacagcagagccuugcuug

SEQ ID NO: 252139 - RNA, 22 nt, Human
auuugcauaaggaugcuacugu

SEQ ID NO: 252140 - RNA, 22 nt, Human
cccacaggcccugcugccuuga

SEQ ID NO: 252141 - RNA, 22 nt, Human
aggagcucauguggcugccugu

SEQ ID NO: 252142 - RNA, 22 nt, Human
auccacccugugguggcuuucu

SEQ ID NO: 252143 - RNA, 22 nt, Human
agaauccuauugucagauucuu

SEQ ID NO: 252144 - RNA, 22 nt, Human
caccagcuuugcccacugccca

SEQ ID NO: 252145 - RNA, 22 nt, Human
caugaaaaauuuacuguuaaca

SEQ ID NO: 252146 - RNA, 22 nt, Human
cucugagggcugucaggaaagg

SEQ ID NO: 252147 - RNA, 22 nt, Human
ggcuucaccugugcacucuacc

SEQ ID NO: 252148 - RNA, 22 nt, Human
ucucagagauuuauggaaaacu

SEQ ID NO: 252149 - RNA, 22 nt, Human
uuugacucuucuagcaagugug

SEQ ID NO: 252150 - RNA, 18 nt, Human
ggacaucaucaggugcuu

SEQ ID NO: 252151 - RNA, 22 nt, Human
uggaggaauaacagcaaccuua

SEQ ID NO: 252152 - RNA, 18 nt, Human
aagagcuucgcauauaca

SEQ ID NO: 252153 - RNA, 20 nt, Human
uacauucaaaacaaacucug

SEQ ID NO: 252154 - RNA, 22 nt, Human
acaggcagauguuuuaguugua

SEQ ID NO: 252155 - RNA, 22 nt, Human
uguguacacgagagguuauaua

SEQ ID NO: 252156 - RNA, 22 nt, Human
uggauuuccagacagcuuaauu

SEQ ID NO: 252157 - RNA, 22 nt, Human
gcccugggauuggguggaggcu

SEQ ID NO: 252158 - RNA, 22 nt, Human
cuccccacgccuggacuaagag

SEQ ID NO: 252159 - RNA, 22 nt, Human
gcaggaguaugcagcuaugguu

SEQ ID NO: 252160 - RNA, 22 nt, Human
cuggccucuguguucaccauag

SEQ ID NO: 252161 - RNA, 22 nt, Human
gagcaguggucacagggaggga

SEQ ID NO: 252162 - RNA, 22 nt, Human
gccuccggaguugcagugucuu

SEQ ID NO: 252163 - RNA, 22 nt, Human
ucuuagaaguucauguuccagc

SEQ ID NO: 252164 - RNA, 22 nt, Human
cugggugacagagugagauggu

SEQ ID NO: 252165 - RNA, 23 nt, Human
uucuacagcuucuucaguuaagg

SEQ ID NO: 252166 - RNA, 22 nt, Human
aagaacaugaacacaauguuua

SEQ ID NO: 252167 - RNA, 22 nt, Human
uaugugucugucgugcauaaau

SEQ ID NO: 252168 - RNA, 22 nt, Human
uagaaacagauguuuuugaaga

SEQ ID NO: 252169 - RNA, 22 nt, Human
ugaaaaaacaaguuggcccauu

SEQ ID NO: 252170 - RNA, 22 nt, Human
ucugucauuuuguaucuacaug

SEQ ID NO: 252171 - RNA, 22 nt, Human
ugcauuuaguuaugagaaaaac

SEQ ID NO: 252172 - RNA, 22 nt, Human
uguaauggaaaaacauuagcau

SEQ ID NO: 252173 - RNA, 22 nt, Human
aaacugaaguagauucugaaau

SEQ ID NO: 252174 - RNA, 22 nt, Human
gugauaacucaggcagagaaua

SEQ ID NO: 252175 - RNA, 22 nt, Human
aagugauuugcaugcuuaauuc

SEQ ID NO: 252176 - RNA, 22 nt, Human
uagaaaguagggaagguaggau

SEQ ID NO: 252177 - RNA, 22 nt, Human
uggcagcagccauggaaggccc

SEQ ID NO: 252178 - RNA, 22 nt, Human
acauuucugagcagggagcugu

SEQ ID NO: 252179 - RNA, 22 nt, Human
ugugacuuauaacauagaauuu

SEQ ID NO: 252180 - RNA, 22 nt, Human
ccucugggaagccaguccugcu

SEQ ID NO: 252181 - RNA, 23 nt, Human
uucucuuuagauuuacauuacuc

SEQ ID NO: 252182 - RNA, 22 nt, Human
cacuugaaugaaagagacuccu

SEQ ID NO: 252183 - RNA, 22 nt, Human
cauuacauuucaaaauguuucc

SEQ ID NO: 252184 - RNA, 22 nt, Human
ucaggccuuguccugaccuccu

SEQ ID NO: 252185 - RNA, 22 nt, Human
ucgaaauacuguuuccccuuua

SEQ ID NO: 252186 - RNA, 22 nt, Human
acucuuugucuguugccgcuua

SEQ ID NO: 252187 - RNA, 23 nt, Human
uugauuuagcugggauugcaugc

SEQ ID NO: 252188 - RNA, 22 nt, Human
ucucugcucaggcaccagcccu

SEQ ID NO: 252189 - RNA, 20 nt, Human
auauuucagguagugugccc

SEQ ID NO: 252190 - RNA, 22 nt, Human
gaucaacaacuuuugaauagcu

SEQ ID NO: 252191 - RNA, 20 nt, Human
aaucagaaagugugagcucu

SEQ ID NO: 252192 - RNA, 20 nt, Human
agugaguuaucagcuacagu

SEQ ID NO: 252193 - RNA, 22 nt, Human
aaugccuucccauuuauacuuu

SEQ ID NO: 252194 - RNA, 22 nt, Human
ucuaggguccacagggucagcc

SEQ ID NO: 252195 - RNA, 22 nt, Human
cugaugaggauauagauacaca

SEQ ID NO: 252196 - RNA, 22 nt, Human
acagugaaaauaauaucuucaa

SEQ ID NO: 252197 - RNA, 22 nt, Human
auccaguuaagaugaggucaua

SEQ ID NO: 252198 - RNA, 23 nt, Human
uagacugcaggcuccuugagggc

SEQ ID NO: 252199 - RNA, 20 nt, Human
cagagaccugucuucacaga

SEQ ID NO: 252200 - RNA, 22 nt, Human
ccuggccugugaaucugagagc

SEQ ID NO: 252201 - RNA, 22 nt, Human
uguuccugaggcaugugucaau

SEQ ID NO: 252202 - RNA, 22 nt, Human
ugcuuugcucugucucuagcua

SEQ ID NO: 252203 - RNA, 22 nt, Human
gaaaaaggauaaauacaguguu

SEQ ID NO: 252204 - RNA, 22 nt, Human
aggagacucagagaccuggccg

SEQ ID NO: 252205 - RNA, 22 nt, Human
gccucucugggcugccgaggcu

SEQ ID NO: 252206 - RNA, 23 nt, Human
uucaaagaucuucugaaaucugu

SEQ ID NO: 252207 - RNA, 22 nt, Human
auacauguaacugcauuguaau

SEQ ID NO: 252208 - RNA, 22 nt, Human
guacaauuaagugcacaaauag

SEQ ID NO: 252209 - RNA, 22 nt, Human
aauggaggugucuggccuggua

SEQ ID NO: 252210 - RNA, 22 nt, Human
cuuucuucaucaagugccacgu

SEQ ID NO: 252211 - RNA, 22 nt, Human
uggcugagcugcagcguggcuu

SEQ ID NO: 252212 - RNA, 22 nt, Human
ucucugaauaaugcuauucuuu

SEQ ID NO: 252213 - RNA, 22 nt, Human
ugagcagacuugaugaggcagc

SEQ ID NO: 252214 - RNA, 22 nt, Human
gcagggaagaucuuggagcugc

SEQ ID NO: 252215 - RNA, 22 nt, Human
gaggcuggggucugccuuucug

SEQ ID NO: 252216 - RNA, 22 nt, Human
cucugcaguguaacagcgcuug

SEQ ID NO: 252217 - RNA, 22 nt, Human
uuugauaucuugguauacagau

SEQ ID NO: 252218 - RNA, 22 nt, Human
uggguccucuggagcagcagca

SEQ ID NO: 252219 - RNA, 22 nt, Human
cuauaauuaugcucaaaaugua

SEQ ID NO: 252220 - RNA, 22 nt, Human
cacuggcuugauggguaaugcc

SEQ ID NO: 252221 - RNA, 22 nt, Human
cucuguguucagccuagcagaa

SEQ ID NO: 252222 - RNA, 22 nt, Human
acgcgcaaccaggcaugcacau

SEQ ID NO: 252223 - RNA, 20 nt, Human
ucuucagaugcuuuuggagu

SEQ ID NO: 252224 - RNA, 22 nt, Human
uagagaaacagaaccaacaggg

SEQ ID NO: 252225 - RNA, 22 nt, Human
gugaauuaaauauagccagguc

SEQ ID NO: 252226 - RNA, 22 nt, Human
cugaagagaaagggagcucuuc

SEQ ID NO: 252227 - RNA, 22 nt, Human
agaaaauauucauugagaggcu

SEQ ID NO: 252228 - RNA, 22 nt, Human
gccuccacuuuugcuggcuucu

SEQ ID NO: 252229 - RNA, 22 nt, Human
gccugaagaacagcugugagga

SEQ ID NO: 252230 - RNA, 22 nt, Human
agacagcagaaacuagagcacu

SEQ ID NO: 252231 - RNA, 22 nt, Human
gccagaggggcucgaaggcgcg

SEQ ID NO: 252232 - RNA, 22 nt, Human
cugggcuccacucccacagugu

SEQ ID NO: 252233 - RNA, 22 nt, Human
caggcccugccuuggcaugugu

SEQ ID NO: 252234 - RNA, 22 nt, Human
ugcagguguagaguugggcucc

SEQ ID NO: 252235 - RNA, 22 nt, Human
gcugucugacuccaaguuggag

SEQ ID NO: 252236 - RNA, 22 nt, Human
cucuuuaagcuccuaacagcca

SEQ ID NO: 252237 - RNA, 22 nt, Human
ugccagggucagcugcagcucu

SEQ ID NO: 252238 - RNA, 22 nt, Human
uaaaucaagaauaucagcuugu

SEQ ID NO: 252239 - RNA, 22 nt, Human
uaccauuucauucuuuccucau

SEQ ID NO: 252240 - RNA, 22 nt, Human
acacagaagaucucuuaaugcu

SEQ ID NO: 252241 - RNA, 22 nt, Human
cucgcaggacagugcuaggacu

SEQ ID NO: 252242 - RNA, 23 nt, Human
guauuucagcauucucaguuaaa

SEQ ID NO: 252243 - RNA, 22 nt, Human
aauguacaaaagucagccaacu

SEQ ID NO: 252244 - RNA, 22 nt, Human
guaacauaguuugugcuucauc

SEQ ID NO: 252245 - RNA, 22 nt, Human
auuucucauuaagaucuuccaa

SEQ ID NO: 252246 - RNA, 21 nt, Human
aagugguuuacauccagcugu

SEQ ID NO: 252247 - RNA, 20 nt, Human
cagaaagcauguuccagggc

SEQ ID NO: 252248 - RNA, 22 nt, Human
uuacaacagcgauuuaccuguc

SEQ ID NO: 252249 - RNA, 22 nt, Human
ccaggagcauuaagagaacaua

SEQ ID NO: 252250 - RNA, 22 nt, Human
uguggccuugcagccuggaggu

SEQ ID NO: 252251 - RNA, 22 nt, Human
agcugcaguaugaggcuggugg

SEQ ID NO: 252252 - RNA, 22 nt, Human
aauaaucuugacuacugaauca

SEQ ID NO: 252253 - RNA, 18 nt, Human
guuucaugcaugugaaac

SEQ ID NO: 252254 - RNA, 22 nt, Human
acacauauauuugcauauacac

SEQ ID NO: 252255 - RNA, 22 nt, Human
cucccucauauacccagcgaga

SEQ ID NO: 252256 - RNA, 22 nt, Human
uugguuuaccagagggaacgug

SEQ ID NO: 252257 - RNA, 22 nt, Human
acuuggcuuaaaguagugaucg

SEQ ID NO: 252258 - RNA, 22 nt, Human
aucuccuaaaguuuccagaaga

SEQ ID NO: 252259 - RNA, 22 nt, Human
aacugcauucagaaagcucacu

SEQ ID NO: 252260 - RNA, 22 nt, Human
auuuccugaucuguaaaauagc

SEQ ID NO: 252261 - RNA, 22 nt, Human
uaacaauacccauucuaauuac

SEQ ID NO: 252262 - RNA, 22 nt, Human
uuaaagcccagcauauacuagg

SEQ ID NO: 252263 - RNA, 22 nt, Human
ggucuacauugagagagcugcu

SEQ ID NO: 252264 - RNA, 22 nt, Human
auucucuggaagaagauaaaaa

SEQ ID NO: 252265 - RNA, 22 nt, Human
gagcuagcuucuuccagguuuc

SEQ ID NO: 252266 - RNA, 22 nt, Human
uuaguagaagacagauaacaaa

SEQ ID NO: 252267 - RNA, 20 nt, Human
agucugucaauuuacagugg

SEQ ID NO: 252268 - RNA, 22 nt, Human
gguguccuugcuccuucagcuu

SEQ ID NO: 252269 - RNA, 22 nt, Human
uaacagagauagaaauguaaag

SEQ ID NO: 252270 - RNA, 21 nt, Human
uuugaauagaaauagugcuua

SEQ ID NO: 252271 - RNA, 22 nt, Human
uguaaagacagauaaaacagca

SEQ ID NO: 252272 - RNA, 18 nt, Human
uuuuaauuucaggggugg

SEQ ID NO: 252273 - RNA, 20 nt, Human
ucucuguaaaucuucuuuua

SEQ ID NO: 252274 - RNA, 22 nt, Human
acaguucaagucuuagacaaca

SEQ ID NO: 252275 - RNA, 22 nt, Human
aaagagucaaaggcaugucucu

SEQ ID NO: 252276 - RNA, 22 nt, Human
gcagucccauaucuuuaacaua

SEQ ID NO: 252277 - RNA, 22 nt, Human
ccucagcuugauuucugcagag

SEQ ID NO: 252278 - RNA, 22 nt, Human
acucugugaagaugcaggcuug

SEQ ID NO: 252279 - RNA, 17 nt, Human
ucugagaaugcuggagg

SEQ ID NO: 252280 - RNA, 22 nt, Human
ucaaggcacuucaugucucagu

SEQ ID NO: 252281 - RNA, 22 nt, Human
agucuagaaugugcaccaagcu

SEQ ID NO: 252282 - RNA, 22 nt, Human
aacagcugcaaaagguugccug

SEQ ID NO: 252283 - RNA, 22 nt, Human
caggaugagguagaggcagaua

SEQ ID NO: 252284 - RNA, 22 nt, Human
aaaguuuuagcuguccaguucc

SEQ ID NO: 252285 - RNA, 22 nt, Human
cagcuguggagggaggaaaugc

SEQ ID NO: 252286 - RNA, 23 nt, Human
aaucuagaaugaccuacucaucu

SEQ ID NO: 252287 - RNA, 20 nt, Human
gaguccuuaugggcugaggu

SEQ ID NO: 252288 - RNA, 22 nt, Human
caccaggcugcccaggacaggg

SEQ ID NO: 252289 - RNA, 22 nt, Human
uuguuuacaaguuacucagucu

SEQ ID NO: 252290 - RNA, 22 nt, Human
acuccugguucccaguugagau

SEQ ID NO: 252291 - RNA, 22 nt, Human
auacagccuauucuuaccauug

SEQ ID NO: 252292 - RNA, 22 nt, Human
agcacugugagcaccagcacgc

SEQ ID NO: 252293 - RNA, 22 nt, Human
uggcugcagaucugugggacac

SEQ ID NO: 252294 - RNA, 22 nt, Human
agaaugucaacagccucucaag

SEQ ID NO: 252295 - RNA, 22 nt, Human
auacuaaaguauagaacuuagu

SEQ ID NO: 252296 - RNA, 22 nt, Human
uguacaguaggaacuuguuauu

SEQ ID NO: 252297 - RNA, 21 nt, Human
gcagagaaugaacuuuggcuu

SEQ ID NO: 252298 - RNA, 20 nt, Human
auucucugacaccgcccccg

SEQ ID NO: 252299 - RNA, 22 nt, Human
gcucagaggagcaucauaagga

SEQ ID NO: 252300 - RNA, 22 nt, Human
aggcugugcaauuaggguaaga

SEQ ID NO: 252301 - RNA, 22 nt, Human
agaaccuugaucuuggacuucu

SEQ ID NO: 252302 - RNA, 22 nt, Human
ugcagagauuuggcucuuaaag

SEQ ID NO: 252303 - RNA, 22 nt, Human
cagaggugcuggagugaguccu

SEQ ID NO: 252304 - RNA, 22 nt, Human
auucucuggucauugaguauaa

SEQ ID NO: 252305 - RNA, 22 nt, Human
ucucuggcagaggcccuauccc

SEQ ID NO: 252306 - RNA, 21 nt, Human
aacucccagugccuucccagc

SEQ ID NO: 252307 - RNA, 22 nt, Human
gagcucuguguagccugagggu

SEQ ID NO: 252308 - RNA, 18 nt, Human
ucagaggagauaccuaaa

SEQ ID NO: 252309 - RNA, 22 nt, Human
ucucucagauggggcacuagua

SEQ ID NO: 252310 - RNA, 22 nt, Human
gcuuuggaaauauagacucaag

SEQ ID NO: 252311 - RNA, 18 nt, Human
ucagagagaauaguaauu

SEQ ID NO: 252312 - RNA, 22 nt, Human
uagcaaacucauacaugugggu

SEQ ID NO: 252313 - RNA, 18 nt, Human
agccucuggcagagagaa

SEQ ID NO: 252314 - RNA, 22 nt, Human
acuucauucauuuucacgaaug

SEQ ID NO: 252315 - RNA, 22 nt, Human
acuugaaacaucuuuaaaugua

SEQ ID NO: 252316 - RNA, 22 nt, Human
auguguuuguccugcagaaaua

SEQ ID NO: 252317 - RNA, 22 nt, Human
gguuugguuuuggccaucuucc

SEQ ID NO: 252318 - RNA, 22 nt, Human
gcaugcagagaauaccugugau

SEQ ID NO: 252319 - RNA, 18 nt, Human
ggguccuguucuuggaag

SEQ ID NO: 252320 - RNA, 22 nt, Human
aaauaaaggaacuguuuuccca

SEQ ID NO: 252321 - RNA, 22 nt, Human
caccaggcacagcucuccugcu

SEQ ID NO: 252322 - RNA, 22 nt, Human
agagucugaggaggaccaacag

SEQ ID NO: 252323 - RNA, 22 nt, Human
caucugaagugaauugcuuuuu

SEQ ID NO: 252324 - RNA, 22 nt, Human
aacaaaagccgaaguagguguc

SEQ ID NO: 252325 - RNA, 22 nt, Human
auuacaauaauacaugcucauu

SEQ ID NO: 252326 - RNA, 23 nt, Human
uuacaguaggaguuggaaaacca

SEQ ID NO: 252327 - RNA, 19 nt, Human
uuuagcuuacguuucauug

SEQ ID NO: 252328 - RNA, 22 nt, Human
cucccuggcuuuguccugaggc

SEQ ID NO: 252329 - RNA, 22 nt, Human
cuagaaacgccuuuagcacaac

SEQ ID NO: 252330 - RNA, 22 nt, Human
uguccuggaucaugccucugaa

SEQ ID NO: 252331 - RNA, 18 nt, Human
aguuagaaaugaaggcca

SEQ ID NO: 252332 - RNA, 22 nt, Human
aggagaaguaaggcuagaugau

SEQ ID NO: 252333 - RNA, 22 nt, Human
cuucugugagucaguguuucug

SEQ ID NO: 252334 - RNA, 22 nt, Human
aaauaauugaguuggucaauau

SEQ ID NO: 252335 - RNA, 22 nt, Human
uuacagcagugggaaggaguca

SEQ ID NO: 252336 - RNA, 22 nt, Human
cagguugggcugcgaggaggag

SEQ ID NO: 252337 - RNA, 20 nt, Human
agggucagagagcgugagug

SEQ ID NO: 252338 - RNA, 22 nt, Human
ucuguucagaaauggaagugcc

SEQ ID NO: 252339 - RNA, 21 nt, Human
cucagagcaguucagagggau

SEQ ID NO: 252340 - RNA, 21 nt, Human
uugcauuccuguuaguauaag

SEQ ID NO: 252341 - RNA, 23 nt, Human
cccaggaguuucacugcaaaggu

SEQ ID NO: 252342 - RNA, 22 nt, Human
ucccucagauuggcaauuagau

SEQ ID NO: 252343 - RNA, 22 nt, Human
uucagcaaauggcuugagauaa

SEQ ID NO: 252344 - RNA, 21 nt, Human
ucuguucaaggaacuacggau

SEQ ID NO: 252345 - RNA, 22 nt, Human
uguuaacauguguauuguauga

SEQ ID NO: 252346 - RNA, 18 nt, Human
gcagggacacagggucac

SEQ ID NO: 252347 - RNA, 22 nt, Human
ucacagacacauuaaacaugug

SEQ ID NO: 252348 - RNA, 22 nt, Human
uguguucauguugauucauagc

SEQ ID NO: 252349 - RNA, 18 nt, Human
uggcucagauggcuuuaa

SEQ ID NO: 252350 - RNA, 22 nt, Human
caacaguauugugggccaggua

SEQ ID NO: 252351 - RNA, 22 nt, Human
acuguacacagugguguacugu

SEQ ID NO: 252352 - RNA, 22 nt, Human
cucuagacaacuugcugugggu

SEQ ID NO: 252353 - RNA, 22 nt, Human
gcagcucucuggccugcccugg

SEQ ID NO: 252354 - RNA, 20 nt, Human
augccucuaauuuugcaaac

SEQ ID NO: 252355 - RNA, 22 nt, Human
gggucuggacggcugcaggaag

SEQ ID NO: 252356 - RNA, 21 nt, Human
uucuagaaccgugggcgguuc

SEQ ID NO: 252357 - RNA, 22 nt, Human
ucuuugaauccuuuacaucuga

SEQ ID NO: 252358 - RNA, 22 nt, Human
aagcgccaugguuccugcgcag

SEQ ID NO: 252359 - RNA, 22 nt, Human
gguaagcacuucauguacauga

SEQ ID NO: 252360 - RNA, 22 nt, Human
gacuccaggugcaggaggagcc

SEQ ID NO: 252361 - RNA, 22 nt, Human
gaauacaucugaaggcuaugaa

SEQ ID NO: 252362 - RNA, 22 nt, Human
acugagggugcacaggcaggca

SEQ ID NO: 252363 - RNA, 22 nt, Human
gaaaauacuucaguguucuggc

SEQ ID NO: 252364 - RNA, 22 nt, Human
aagccaguuagcacaucauugc

SEQ ID NO: 252365 - RNA, 22 nt, Human
ggcaggugcucugugggccugg

SEQ ID NO: 252366 - RNA, 22 nt, Human
guucuucagcauuagaagucau

SEQ ID NO: 252367 - RNA, 22 nt, Human
ucugcaggagagugcccuagag

SEQ ID NO: 252368 - RNA, 22 nt, Human
aucuaagagagagagcaugucu

SEQ ID NO: 252369 - RNA, 22 nt, Human
cuggaggacagaggccaugucu

SEQ ID NO: 252370 - RNA, 22 nt, Human
ucauuuuuagcgcgcaaaaguu

SEQ ID NO: 252371 - RNA, 22 nt, Human
acuguuacagagcaggaaauug

SEQ ID NO: 252372 - RNA, 22 nt, Human
gaugcaaacugugacauagagu

SEQ ID NO: 252373 - RNA, 22 nt, Human
ugggaggcagguaggugaugau

SEQ ID NO: 252374 - RNA, 22 nt, Human
uucauauaaauggaaucagaau

SEQ ID NO: 252375 - RNA, 22 nt, Human
ccaaaugugccuguuucaacaa

SEQ ID NO: 252376 - RNA, 22 nt, Human
guuucuuucuauugacugaaca

SEQ ID NO: 252377 - RNA, 22 nt, Human
auguauuugcguauggacauac

SEQ ID NO: 252378 - RNA, 22 nt, Human
cagccaggcccccgagucguug

SEQ ID NO: 252379 - RNA, 22 nt, Human
cuucuggguugcaggucuuggc

SEQ ID NO: 252380 - RNA, 22 nt, Human
gccucuggggcagcugagucau

SEQ ID NO: 252381 - RNA, 22 nt, Human
agggggcuccuccggugcuucc

SEQ ID NO: 252382 - RNA, 22 nt, Human
gagaggagacuuauccagauug

SEQ ID NO: 252383 - RNA, 22 nt, Human
gaggcucagggaguauaugaau

SEQ ID NO: 252384 - RNA, 22 nt, Human
uauuauugcaaguauauaaagu

SEQ ID NO: 252385 - RNA, 22 nt, Human
cuuggugcccagcagguggcug

SEQ ID NO: 252386 - RNA, 21 nt, Human
aggaauguguauauauacaau

SEQ ID NO: 252387 - RNA, 19 nt, Human
gggcucucgagcaaccaac

SEQ ID NO: 252388 - RNA, 20 nt, Human
ggucucugacagcugguugc

SEQ ID NO: 252389 - RNA, 22 nt, Human
acagcagaccccagugccaugg

SEQ ID NO: 252390 - RNA, 22 nt, Human
ugccuggccagacccuauagag

SEQ ID NO: 252391 - RNA, 22 nt, Human
ugccugugcccuuugcugggag

SEQ ID NO: 252392 - RNA, 22 nt, Human
ccacucugauuuuggcuccacu

SEQ ID NO: 252393 - RNA, 22 nt, Human
cauggaauuuucuaggcauaaa

SEQ ID NO: 252394 - RNA, 22 nt, Human
ucuagaaucacuguuuccaucu

SEQ ID NO: 252395 - RNA, 22 nt, Human
gagccaggcccguacuugcugu

SEQ ID NO: 252396 - RNA, 22 nt, Human
ggccuuagguucccugccucca

SEQ ID NO: 252397 - RNA, 22 nt, Human
accugcuuuauuccuccugccu

SEQ ID NO: 252398 - RNA, 22 nt, Human
aggcugugaguuuugucucaga

SEQ ID NO: 252399 - RNA, 22 nt, Human
cugagagaaucaugcugcaggu

SEQ ID NO: 252400 - RNA, 22 nt, Human
cucaggcugguuuggguuguuu

SEQ ID NO: 252401 - RNA, 22 nt, Human
acucuggcgggcgggcgagcca

SEQ ID NO: 252402 - RNA, 22 nt, Human
caggaagugugccugagcaccu

SEQ ID NO: 252403 - RNA, 22 nt, Human
cagcagaggaaagcaaaucuaa

SEQ ID NO: 252404 - RNA, 22 nt, Human
aguggcagagcugugucuugaa

SEQ ID NO: 252405 - RNA, 22 nt, Human
auuuugaugcuaucuaaugaau

SEQ ID NO: 252406 - RNA, 20 nt, Human
ugagccuugaggagugacug

SEQ ID NO: 252407 - RNA, 22 nt, Human
aacaguagguguaaccaaacaa

SEQ ID NO: 252408 - RNA, 23 nt, Human
ugcaggugugcagagggcucuug

SEQ ID NO: 252409 - RNA, 22 nt, Human
ucaggaagaaauucuguaucuu

SEQ ID NO: 252410 - RNA, 21 nt, Human
gggugggguuccagccuuuuc

SEQ ID NO: 252411 - RNA, 22 nt, Human
aauguuauuacacuugugaaau

SEQ ID NO: 252412 - RNA, 22 nt, Human
gcagauggaaagugcuugaggg

SEQ ID NO: 252413 - RNA, 22 nt, Human
agcucugggaguaguuccaccu

SEQ ID NO: 252414 - RNA, 22 nt, Human
gggucccuggaauuacuugaca

SEQ ID NO: 252415 - RNA, 22 nt, Human
cacaguuugcauaggaaaaaca

SEQ ID NO: 252416 - RNA, 22 nt, Human
gaggccagggaugcaaugagag

SEQ ID NO: 252417 - RNA, 22 nt, Human
aaguuacauuuuggucuaauug

SEQ ID NO: 252418 - RNA, 22 nt, Human
ggucagccuuggauuugguagc

SEQ ID NO: 252419 - RNA, 22 nt, Human
cuggaagcuuguuugccagucu

SEQ ID NO: 252420 - RNA, 22 nt, Human
ugcagagaagaggacaguucua

SEQ ID NO: 252421 - RNA, 17 nt, Human
uggcaagacagcucagg

SEQ ID NO: 252422 - RNA, 22 nt, Human
ucuuugguugcacugcaggugu

SEQ ID NO: 252423 - RNA, 22 nt, Human
cccugcccaccacaugcuggga

SEQ ID NO: 252424 - RNA, 17 nt, Human
ggaacaaauacuaugca

SEQ ID NO: 252425 - RNA, 22 nt, Human
cuggaggaaaacaacugcagac

SEQ ID NO: 252426 - RNA, 22 nt, Human
uucuuuggcugccagucuggag

SEQ ID NO: 252427 - RNA, 22 nt, Human
ugcccuguggggauuuccagcc

SEQ ID NO: 252428 - RNA, 22 nt, Human
ucucagcagggccauccugagc

SEQ ID NO: 252429 - RNA, 22 nt, Human
uggaaagaaaaacaggccauga

SEQ ID NO: 252430 - RNA, 22 nt, Human
acugccuugauucaugcugaug

SEQ ID NO: 252431 - RNA, 17 nt, Human
ggagcagauccaccauu

SEQ ID NO: 252432 - RNA, 22 nt, Human
caguuucuuuccauuguuaccu

SEQ ID NO: 252433 - RNA, 23 nt, Human
augaaacucaagccagauccaag

SEQ ID NO: 252434 - RNA, 22 nt, Human
ugacaagaucacagucaagugu

SEQ ID NO: 252435 - RNA, 22 nt, Human
ugauagaagcagaagcauacca

SEQ ID NO: 252436 - RNA, 22 nt, Human
cagagcuuccugcugggcuucu

SEQ ID NO: 252437 - RNA, 22 nt, Human
caaaggcaucggcaauuaggga

SEQ ID NO: 252438 - RNA, 22 nt, Human
ccugcaagaccugagacacacc

SEQ ID NO: 252439 - RNA, 22 nt, Human
aaaauuuucagcuugacuugau

SEQ ID NO: 252440 - RNA, 22 nt, Human
agcauacaggucugaaacagcu

SEQ ID NO: 252441 - RNA, 22 nt, Human
guucuucaaagugacaacuaaa

SEQ ID NO: 252442 - RNA, 22 nt, Human
ugcaaauuugagcagacuguuc

SEQ ID NO: 252443 - RNA, 22 nt, Human
ugucuccauagaguagcuugau

SEQ ID NO: 252444 - RNA, 22 nt, Human
cagaggaagcuggguguggagu

SEQ ID NO: 252445 - RNA, 22 nt, Human
agagccaguuacaacuguggag

SEQ ID NO: 252446 - RNA, 20 nt, Human
ccacaggaguccagucgacc

SEQ ID NO: 252447 - RNA, 22 nt, Human
uccugugagacuuguccauuau

SEQ ID NO: 252448 - RNA, 22 nt, Human
ugagauuuuccuaaauauaaug

SEQ ID NO: 252449 - RNA, 22 nt, Human
gagcccagcugcggcccucagc

SEQ ID NO: 252450 - RNA, 22 nt, Human
aguguucacucuguggagccca

SEQ ID NO: 252451 - RNA, 22 nt, Human
aaaaguauccacagcucaggag

SEQ ID NO: 252452 - RNA, 22 nt, Human
uaagccaucaucauggcuuugg

SEQ ID NO: 252453 - RNA, 22 nt, Human
gucuguagaugagucuuaagaa

SEQ ID NO: 252454 - RNA, 22 nt, Human
ggguuccuccaguuccuagagc

SEQ ID NO: 252455 - RNA, 22 nt, Human
uuccuucuagagcuuguuuagg

SEQ ID NO: 252456 - RNA, 22 nt, Human
uagaucuuucacuacuguguag

SEQ ID NO: 252457 - RNA, 22 nt, Human
guuucauucggcagcucauaag

SEQ ID NO: 252458 - RNA, 22 nt, Human
caagcagucagccugaagacug

SEQ ID NO: 252459 - RNA, 23 nt, Human
ccagaaucuacucauuggaauga

SEQ ID NO: 252460 - RNA, 22 nt, Human
agcugggaugaggagcauccuu

SEQ ID NO: 252461 - RNA, 22 nt, Human
ccucuuugacuauaguaguuaa

SEQ ID NO: 252462 - RNA, 22 nt, Human
acuuagcauuauguaauuacua

SEQ ID NO: 252463 - RNA, 19 nt, Human
uccagaagucccugagcgg

SEQ ID NO: 252464 - RNA, 22 nt, Human
guccuagagggugagcuaggcu

SEQ ID NO: 252465 - RNA, 17 nt, Human
aaggaaugucagaaguu

SEQ ID NO: 252466 - RNA, 22 nt, Human
guggggaggcauucuucucccu

SEQ ID NO: 252467 - RNA, 22 nt, Human
cugccuguaacuuucugaagca

SEQ ID NO: 252468 - RNA, 22 nt, Human
aacuacagcaucuauacaaaua

SEQ ID NO: 252469 - RNA, 22 nt, Human
cuuuguaucuaaauaucuugaa

SEQ ID NO: 252470 - RNA, 23 nt, Human
agcucaaggcaguccacauuucc

SEQ ID NO: 252471 - RNA, 22 nt, Human
accuggaagugggugcuauggc

SEQ ID NO: 252472 - RNA, 22 nt, Human
acacaugcagguauacauguuc

SEQ ID NO: 252473 - RNA, 22 nt, Human
auggaaaucagguucauccaag

SEQ ID NO: 252474 - RNA, 22 nt, Human
agagauguagcaaagaaccaca

SEQ ID NO: 252475 - RNA, 22 nt, Human
uucuuugcccauguuuccuaag

SEQ ID NO: 252476 - RNA, 22 nt, Human
agcccaggucuggcccagccug

SEQ ID NO: 252477 - RNA, 22 nt, Human
caggcaugaucauaggaguuua

SEQ ID NO: 252478 - RNA, 23 nt, Human
aaguaacagggauaauagcaguu

SEQ ID NO: 252479 - RNA, 22 nt, Human
cuggaggaauaaucuccuaccc

SEQ ID NO: 252480 - RNA, 22 nt, Human
cuucugggagagcuuuugcuuc

SEQ ID NO: 252481 - RNA, 20 nt, Human
gcccaagcgccggccgcaga

SEQ ID NO: 252482 - RNA, 22 nt, Human
uuucaagucauucuauaauauc

SEQ ID NO: 252483 - RNA, 22 nt, Human
cagaaguuggagcuuuccauca

SEQ ID NO: 252484 - RNA, 22 nt, Human
ucacaucacaugagugcaagga

SEQ ID NO: 252485 - RNA, 22 nt, Human
gucuucaacaauaacuaccacu

SEQ ID NO: 252486 - RNA, 22 nt, Human
acuuaaaaccagacagcgucau

SEQ ID NO: 252487 - RNA, 22 nt, Human
cuggaacuccuggggagcuggu

SEQ ID NO: 252488 - RNA, 22 nt, Human
gagucuuucugggcuuguucuu

SEQ ID NO: 252489 - RNA, 22 nt, Human
ugcugccaauuucuggucuuga

SEQ ID NO: 252490 - RNA, 22 nt, Human
caggucuggcaucagcugugug

SEQ ID NO: 252491 - RNA, 22 nt, Human
uuuuugcugauaagcagaauuc

SEQ ID NO: 252492 - RNA, 22 nt, Human
ucguccugugcaccugccugca

SEQ ID NO: 252493 - RNA, 22 nt, Human
gacaggccaggggcugaggugg

SEQ ID NO: 252494 - RNA, 21 nt, Human
ccagaagcugcuugcaggcua

SEQ ID NO: 252495 - RNA, 22 nt, Human
uuggauacagaugaaaggaagg

SEQ ID NO: 252496 - RNA, 20 nt, Human
agggcugagaagggacuagc

SEQ ID NO: 252497 - RNA, 19 nt, Human
agacacacuugauaugugu

SEQ ID NO: 252498 - RNA, 22 nt, Human
ucacagaaaaguggagagccua

SEQ ID NO: 252499 - RNA, 20 nt, Human
ucuguacacucaucuucugc

SEQ ID NO: 252500 - RNA, 22 nt, Human
aggcaggggagcuggaagggua

SEQ ID NO: 252501 - RNA, 22 nt, Human
uuugaaauguaucaguauaggu

SEQ ID NO: 252502 - RNA, 22 nt, Human
ugcugggcugcacccccagagu

SEQ ID NO: 252503 - RNA, 22 nt, Human
ugcacaggaggcuguggagaag

SEQ ID NO: 252504 - RNA, 21 nt, Human
ggacuuggaugguggcaguag

SEQ ID NO: 252505 - RNA, 22 nt, Human
uggucucccagagcagggacgc

SEQ ID NO: 252506 - RNA, 22 nt, Human
cugagccauaagggaggcuggg

SEQ ID NO: 252507 - RNA, 22 nt, Human
cuuaaauuuucaucuacaagaa

SEQ ID NO: 252508 - RNA, 22 nt, Human
ccaggaagcauaauguaguggg

SEQ ID NO: 252509 - RNA, 22 nt, Human
gcucaggcaggagugcaguggc

SEQ ID NO: 252510 - RNA, 22 nt, Human
guccagucucuuuccaagccca

SEQ ID NO: 252511 - RNA, 17 nt, Human
ggcaguggaggaagaga

SEQ ID NO: 252512 - RNA, 22 nt, Human
cuggcugcgcuaguccagaaga

SEQ ID NO: 252513 - RNA, 18 nt, Human
ugaagacaugagguuagu

SEQ ID NO: 252514 - RNA, 22 nt, Human
uucugcauuuaaaauauuacua

SEQ ID NO: 252515 - RNA, 22 nt, Human
gcugggcuucacagagccuuua

SEQ ID NO: 252516 - RNA, 22 nt, Human
gccaggcuaagaaaggugugau

SEQ ID NO: 252517 - RNA, 22 nt, Human
uuaauguuuuaaguuauagaga

SEQ ID NO: 252518 - RNA, 22 nt, Human
aaaguuuaggcuuugaaaccag

SEQ ID NO: 252519 - RNA, 22 nt, Human
ucuaaacuucacuuuaagugcu

SEQ ID NO: 252520 - RNA, 22 nt, Human
uuccuggugaccucacugguag

SEQ ID NO: 252521 - RNA, 22 nt, Human
uuucucuggccucaguuuaaca

SEQ ID NO: 252522 - RNA, 19 nt, Human
ugaggcacaugauaagaac

SEQ ID NO: 252523 - RNA, 22 nt, Human
uacagagacuuuauggcacaaa

SEQ ID NO: 252524 - RNA, 22 nt, Human
gagacacagagaggcuguguga

SEQ ID NO: 252525 - RNA, 22 nt, Human
aguaucaaucacccuuugaagu

SEQ ID NO: 252526 - RNA, 22 nt, Human
cacaagcugggcaaguguauau

SEQ ID NO: 252527 - RNA, 22 nt, Human
aggaugccuucauugcauggcc

SEQ ID NO: 252528 - RNA, 22 nt, Human
ccuuccagaguucagucugccc

SEQ ID NO: 252529 - RNA, 21 nt, Human
uuugaaagcuacaucuauagc

SEQ ID NO: 252530 - RNA, 21 nt, Human
cauuuacaugacagauugguu

SEQ ID NO: 252531 - RNA, 22 nt, Human
aacaggaccuuccaauccauca

SEQ ID NO: 252532 - RNA, 22 nt, Human
aaagcugcugccaaucaggcuu

SEQ ID NO: 252533 - RNA, 22 nt, Human
uccaggcuugagaccaggcucu

SEQ ID NO: 252534 - RNA, 22 nt, Human
uccaggccgcaggggcagcccc

SEQ ID NO: 252535 - RNA, 22 nt, Human
uuagcauuucauuucaagagga

SEQ ID NO: 252536 - RNA, 23 nt, Human
ugugcacaucugacgggugaagg

SEQ ID NO: 252537 - RNA, 22 nt, Human
uuuuauugguaaugauaaaagu

SEQ ID NO: 252538 - RNA, 22 nt, Human
aaucucuuuggcucaaggaucc

SEQ ID NO: 252539 - RNA, 23 nt, Human
aaaggcacagcauugucuagcag

SEQ ID NO: 252540 - RNA, 22 nt, Human
cacaaucucaacugccuuuuag

SEQ ID NO: 252541 - RNA, 22 nt, Human
gagguggugguggaggcauagc

SEQ ID NO: 252542 - RNA, 22 nt, Human
ccagggcaugggaagaacugaa

SEQ ID NO: 252543 - RNA, 22 nt, Human
agguugaaauagguuaucuaag

SEQ ID NO: 252544 - RNA, 20 nt, Human
ggccuuagggagggcuguaa

SEQ ID NO: 252545 - RNA, 22 nt, Human
agcugaaacccaggccucagcu

SEQ ID NO: 252546 - RNA, 21 nt, Human
acauuauaauucauauuccac

SEQ ID NO: 252547 - RNA, 22 nt, Human
cugggaggauucauugagguga

SEQ ID NO: 252548 - RNA, 23 nt, Human
agcaggaaaccgagggugauguu

SEQ ID NO: 252549 - RNA, 22 nt, Human
aggcagcuggaggcagagacua

SEQ ID NO: 252550 - RNA, 22 nt, Human
uccuggguggcucugcccggcu

SEQ ID NO: 252551 - RNA, 22 nt, Human
acaaggagagcacacaugggga

SEQ ID NO: 252552 - RNA, 22 nt, Human
uacaucuauacugaucuacauu

SEQ ID NO: 252553 - RNA, 22 nt, Human
guuuacaacaucuuguccuuca

SEQ ID NO: 252554 - RNA, 22 nt, Human
uggcccugcccucuucaucuuu

SEQ ID NO: 252555 - RNA, 17 nt, Human
uagauuaaacacggcca

SEQ ID NO: 252556 - RNA, 22 nt, Human
gaaaaccaccucccaucaagca

SEQ ID NO: 252557 - RNA, 18 nt, Human
ggcucaggcuauccuaac

SEQ ID NO: 252558 - RNA, 21 nt, Human
aggagaccggcuuguuugugc

SEQ ID NO: 252559 - RNA, 19 nt, Human
uagaaagccagaaaacaga

SEQ ID NO: 252560 - RNA, 22 nt, Human
uacuguauaugcuuguaucuga

SEQ ID NO: 252561 - RNA, 22 nt, Human
ucaugcaguuucuuaucugcca

SEQ ID NO: 252562 - RNA, 22 nt, Human
gagcccugacacugagggaguu

SEQ ID NO: 252563 - RNA, 22 nt, Human
ucugcagguaagcguucuugga

SEQ ID NO: 252564 - RNA, 22 nt, Human
ucacacauucuagguauguuga

SEQ ID NO: 252565 - RNA, 22 nt, Human
gcugagggucuguucauguugc

SEQ ID NO: 252566 - RNA, 22 nt, Human
uuugcuuucccuuguagaaagu

SEQ ID NO: 252567 - RNA, 22 nt, Human
gaauuguacgcuuuacauaggu

SEQ ID NO: 252568 - RNA, 22 nt, Human
gacaccaggucuguuguccucc

SEQ ID NO: 252569 - RNA, 22 nt, Human
acagaaauauagaagguaggaa

SEQ ID NO: 252570 - RNA, 20 nt, Human
ggcugcugguuuggcucugu

SEQ ID NO: 252571 - RNA, 22 nt, Human
cccuccugugccugaggccagc

SEQ ID NO: 252572 - RNA, 22 nt, Human
cacugagcaugagugggcugug

SEQ ID NO: 252573 - RNA, 22 nt, Human
uguuuacuagccaacauggaga

SEQ ID NO: 252574 - RNA, 22 nt, Human
caggcuccagcuuccugcucag

SEQ ID NO: 252575 - RNA, 18 nt, Human
gagacacaagggccugga

SEQ ID NO: 252576 - RNA, 22 nt, Human
uaccaggaguuacaggcagcag

SEQ ID NO: 252577 - RNA, 22 nt, Human
ugccaggcccagcagggcggcc

SEQ ID NO: 252578 - RNA, 22 nt, Human
ucugagagcuguagaagccuau

SEQ ID NO: 252579 - RNA, 22 nt, Human
acauggcuaaauuagcuuuacu

SEQ ID NO: 252580 - RNA, 22 nt, Human
uacuucugaaugugaguuuguu

SEQ ID NO: 252581 - RNA, 22 nt, Human
aaagcacagagcucccacagga

SEQ ID NO: 252582 - RNA, 22 nt, Human
auucuauagacagaaggucaau

SEQ ID NO: 252583 - RNA, 22 nt, Human
agcaugcuauauugauuguagu

SEQ ID NO: 252584 - RNA, 21 nt, Human
cugaggcaugcaggccugggc

SEQ ID NO: 252585 - RNA, 19 nt, Human
ccugggaggcggagguugc

SEQ ID NO: 252586 - RNA, 22 nt, Human
ucaugucagcuguugaugugca

SEQ ID NO: 252587 - RNA, 22 nt, Human
ccucaggcaagucacuuaacau

SEQ ID NO: 252588 - RNA, 22 nt, Human
uuacagugugcaaucccagaau

SEQ ID NO: 252589 - RNA, 22 nt, Human
cagguucuauacugaauaauuu

SEQ ID NO: 252590 - RNA, 22 nt, Human
ccauggcagccuggccuggcuu

SEQ ID NO: 252591 - RNA, 22 nt, Human
gcagagcugagcggcugcccgg

SEQ ID NO: 252592 - RNA, 22 nt, Human
aggucaccauggcaugcuccac

SEQ ID NO: 252593 - RNA, 22 nt, Human
uagaacaugcucauguauaaau

SEQ ID NO: 252594 - RNA, 22 nt, Human
gaggaggcacuugagcagaugu

SEQ ID NO: 252595 - RNA, 22 nt, Human
aguggcuguuccaggugaggac

SEQ ID NO: 252596 - RNA, 17 nt, Human
gucagcagcuugcuugu

SEQ ID NO: 252597 - RNA, 22 nt, Human
gaagcuggagaaugggucuagg

SEQ ID NO: 252598 - RNA, 22 nt, Human
uucuauguaguagcagagccaa

SEQ ID NO: 252599 - RNA, 22 nt, Human
gucucaguuuuccaaacuguca

SEQ ID NO: 252600 - RNA, 22 nt, Human
uucugaaaauugggucauacuu

SEQ ID NO: 252601 - RNA, 22 nt, Human
cuuguauucuuguaccuuucaa

SEQ ID NO: 252602 - RNA, 22 nt, Human
uagaaucaagcaguagagcaga

SEQ ID NO: 252603 - RNA, 22 nt, Human
ugcggaaggcagcgcagggugg

SEQ ID NO: 252604 - RNA, 22 nt, Human
gacccaggcccaaggcugccag

SEQ ID NO: 252605 - RNA, 22 nt, Human
ucauuuguugcuguuaccugag

SEQ ID NO: 252606 - RNA, 22 nt, Human
gcagugcaggacaaaucagugc

SEQ ID NO: 252607 - RNA, 22 nt, Human
ccauccugaauggucucagcca

SEQ ID NO: 252608 - RNA, 22 nt, Human
cuccaguggcacaaaugggugc

SEQ ID NO: 252609 - RNA, 22 nt, Human
uagacacaaaucucagugacac

SEQ ID NO: 252610 - RNA, 22 nt, Human
agcauggcuuuggaggauagca

SEQ ID NO: 252611 - RNA, 22 nt, Human
auggcagcauaguggcaaguua

SEQ ID NO: 252612 - RNA, 22 nt, Human
uucuuuggcuuacgucuggccu

SEQ ID NO: 252613 - RNA, 22 nt, Human
uugcuauuuugagagucauagu

SEQ ID NO: 252614 - RNA, 22 nt, Human
agcugggacucaacugucuggg

SEQ ID NO: 252615 - RNA, 22 nt, Human
ugauuucucuuggcaauauguu

SEQ ID NO: 252616 - RNA, 22 nt, Human
gcccccagcucucaagcucaaa

SEQ ID NO: 252617 - RNA, 22 nt, Human
aacaaauguguggcaguguggg

SEQ ID NO: 252618 - RNA, 22 nt, Human
uuaugauuugccacagauuggu

SEQ ID NO: 252619 - RNA, 22 nt, Human
guuuccuggagguuauuuuuga

SEQ ID NO: 252620 - RNA, 22 nt, Human
uccaggcccugggaugggagca

SEQ ID NO: 252621 - RNA, 22 nt, Human
uggcgugcccuccagacuuggc

SEQ ID NO: 252622 - RNA, 22 nt, Human
gcugcagagggucuuagagagg

SEQ ID NO: 252623 - RNA, 22 nt, Human
gcucagagguuguucuuggguu

SEQ ID NO: 252624 - RNA, 22 nt, Human
cagcuuuauugagguauaauug

SEQ ID NO: 252625 - RNA, 22 nt, Human
uacaguuuacaugagaggaagc

SEQ ID NO: 252626 - RNA, 22 nt, Human
cccugcagaaccacagacaaac

SEQ ID NO: 252627 - RNA, 22 nt, Human
uccuuucucccagguuaguugu

SEQ ID NO: 252628 - RNA, 22 nt, Human
ccugcagaggucaggccagaaa

SEQ ID NO: 252629 - RNA, 22 nt, Human
augguuuacuucauccaaucua

SEQ ID NO: 252630 - RNA, 22 nt, Human
uccauugugauuauauacaaaa

SEQ ID NO: 252631 - RNA, 23 nt, Human
uggcugagcccacuaucuuggcc

SEQ ID NO: 252632 - RNA, 22 nt, Human
gggcagguguuuccaaggugag

SEQ ID NO: 252633 - RNA, 22 nt, Human
gaccucagcuguggggaugcug

SEQ ID NO: 252634 - RNA, 22 nt, Human
ggagcaguuguugagcaagcca

SEQ ID NO: 252635 - RNA, 22 nt, Human
gcagggcauagaggcacggagg

SEQ ID NO: 252636 - RNA, 22 nt, Human
ugagagagcgccugggaucauu

SEQ ID NO: 252637 - RNA, 22 nt, Human
aucgaauaauugcauucuauaa

SEQ ID NO: 252638 - RNA, 22 nt, Human
aacauucuuuagcucuuccugc

SEQ ID NO: 252639 - RNA, 22 nt, Human
auugagaucugcaucauaagcu

SEQ ID NO: 252640 - RNA, 23 nt, Human
acacauauauucagauacagaug

SEQ ID NO: 252641 - RNA, 22 nt, Human
gcuucccacagcuggacugggg

SEQ ID NO: 252642 - RNA, 22 nt, Human
aaagugcaguccaugaaauuaa

SEQ ID NO: 252643 - RNA, 22 nt, Human
cuguggaaucaucaggucuuac

SEQ ID NO: 252644 - RNA, 22 nt, Human
gaggugggagggcagucccuaa

SEQ ID NO: 252645 - RNA, 22 nt, Human
gcucagagcacucagacucagc

SEQ ID NO: 252646 - RNA, 22 nt, Human
ggcugccucagauuugcugacu

SEQ ID NO: 252647 - RNA, 22 nt, Human
caaugaaaauuuaaguugcagc

SEQ ID NO: 252648 - RNA, 22 nt, Human
uuuggacuuagccugcagaauu

SEQ ID NO: 252649 - RNA, 22 nt, Human
ucuuuggaagcuuucagagaag

SEQ ID NO: 252650 - RNA, 22 nt, Human
auggcagagggauugaacagcu

SEQ ID NO: 252651 - RNA, 22 nt, Human
gggaucugauuuaggaugggag

SEQ ID NO: 252652 - RNA, 22 nt, Human
augcugaaccuuaacuuggagc

SEQ ID NO: 252653 - RNA, 22 nt, Human
acccaggaugauaauguucaca

SEQ ID NO: 252654 - RNA, 22 nt, Human
cacucccucuaguugcauucug

SEQ ID NO: 252655 - RNA, 22 nt, Human
ucagagaguccuggucauuugc

SEQ ID NO: 252656 - RNA, 22 nt, Human
cauuucaguguuauucuaauuu

SEQ ID NO: 252657 - RNA, 22 nt, Human
gagaaucuacaggaaaccgaag

SEQ ID NO: 252658 - RNA, 22 nt, Human
cugguacauaguaagaacacaa

SEQ ID NO: 252659 - RNA, 22 nt, Human
aggcugggcuccgcccaacucc

SEQ ID NO: 252660 - RNA, 22 nt, Human
uaaauguauaggcacuaaaccu

SEQ ID NO: 252661 - RNA, 22 nt, Human
gcugagaaucaagauggagagg

SEQ ID NO: 252662 - RNA, 22 nt, Human
aaaguguugggauuauaggcgu

SEQ ID NO: 252663 - RNA, 22 nt, Human
uccaugcagaggagcugguggc

SEQ ID NO: 252664 - RNA, 22 nt, Human
aggaaggaagagacaccauuug

SEQ ID NO: 252665 - RNA, 22 nt, Human
cugcaggacugaaagaugaggu

SEQ ID NO: 252666 - RNA, 22 nt, Human
auucaguuucauggcacagcua

SEQ ID NO: 252667 - RNA, 22 nt, Human
uugcuguuacaauuauuuaccc

SEQ ID NO: 252668 - RNA, 22 nt, Human
ggcucuucuguggcagccaagg

SEQ ID NO: 252669 - RNA, 22 nt, Human
uuucagaaauuauauuagaugc

SEQ ID NO: 252670 - RNA, 22 nt, Human
aagaggccacagcugacagcac

SEQ ID NO: 252671 - RNA, 22 nt, Human
gaaauauuucucuugagccccu

SEQ ID NO: 252672 - RNA, 21 nt, Human
ccauucuuagucaagugucuc

SEQ ID NO: 252673 - RNA, 22 nt, Human
aaugggaagucacuacuguuac

SEQ ID NO: 252674 - RNA, 22 nt, Human
cucaggcuaagaaggccaagug

SEQ ID NO: 252675 - RNA, 23 nt, Human
auuuaaugcugaguugaauguua

SEQ ID NO: 252676 - RNA, 22 nt, Human
uuaaauuaggacucuaguucug

SEQ ID NO: 252677 - RNA, 22 nt, Human
ucagugcuaaaagagcuggugu

SEQ ID NO: 252678 - RNA, 22 nt, Human
ucccacccauccugcaucucuu

SEQ ID NO: 252679 - RNA, 22 nt, Human
ucccagggacugggcuaggcuu

SEQ ID NO: 252680 - RNA, 22 nt, Human
uagcauuucacugaucuucacu

SEQ ID NO: 252681 - RNA, 22 nt, Human
auuucucaucuuugugaauggu

SEQ ID NO: 252682 - RNA, 22 nt, Human
uuagacauguuugcuaaaauga

SEQ ID NO: 252683 - RNA, 17 nt, Human
auuuagcaaguagacag

SEQ ID NO: 252684 - RNA, 22 nt, Human
aauguuuuaaaagagauugaga

SEQ ID NO: 252685 - RNA, 22 nt, Human
gaaggcuggcuuucugagagca

SEQ ID NO: 252686 - RNA, 22 nt, Human
ucuguuauauguuuuuucuaaa

SEQ ID NO: 252687 - RNA, 22 nt, Human
auuagcaaucacgcagucauuu

SEQ ID NO: 252688 - RNA, 22 nt, Human
cugcccucuagaggaggacuga

SEQ ID NO: 252689 - RNA, 22 nt, Human
uagagucagagaaucauuacag

SEQ ID NO: 252690 - RNA, 22 nt, Human
caaggcuagcaagcaguaguca

SEQ ID NO: 252691 - RNA, 20 nt, Human
ucuuggcugugugaggacac

SEQ ID NO: 252692 - RNA, 22 nt, Human
acauguuuaaguuuaaugaaaa

SEQ ID NO: 252693 - RNA, 22 nt, Human
uggcucagccuggcccuuucau

SEQ ID NO: 252694 - RNA, 22 nt, Human
uuaguuaguggggcugucaguc

SEQ ID NO: 252695 - RNA, 22 nt, Human
cuugggcccuccccuugugaau

SEQ ID NO: 252696 - RNA, 22 nt, Human
cagcaggcuggacuucaguccc

SEQ ID NO: 252697 - RNA, 22 nt, Human
caguuaaagcugcaugugucag

SEQ ID NO: 252698 - RNA, 22 nt, Human
ccugcagggaaucgaggcagaa

SEQ ID NO: 252699 - RNA, 19 nt, Human
caucuuuggucaccuaguc

SEQ ID NO: 252700 - RNA, 22 nt, Human
uggggccagagcugcagggagc

SEQ ID NO: 252701 - RNA, 22 nt, Human
gcuggcucuacauuugagguca

SEQ ID NO: 252702 - RNA, 22 nt, Human
ugccauauuauugagcauauua

SEQ ID NO: 252703 - RNA, 22 nt, Human
agaggggaguccuaaucugauu

SEQ ID NO: 252704 - RNA, 22 nt, Human
ucagaagcugggucucagaagc

SEQ ID NO: 252705 - RNA, 22 nt, Human
ccaggguggggcaggcccacug

SEQ ID NO: 252706 - RNA, 20 nt, Human
ugucagcaauuaggagaaaa

SEQ ID NO: 252707 - RNA, 22 nt, Human
gaaggcuuccuggaggaggugg

SEQ ID NO: 252708 - RNA, 22 nt, Human
aggcacagccucccccaacucc

SEQ ID NO: 252709 - RNA, 22 nt, Human
acauaacaaucauaggacauag

SEQ ID NO: 252710 - RNA, 22 nt, Human
cagagacaggaucucgaagacu

SEQ ID NO: 252711 - RNA, 22 nt, Human
agaaggggcccaaggaugucag

SEQ ID NO: 252712 - RNA, 22 nt, Human
cugccugcugccuguggagggu

SEQ ID NO: 252713 - RNA, 22 nt, Human
uggagggcaugcuguccauggg

SEQ ID NO: 252714 - RNA, 22 nt, Human
aaacuucauggauaauauaaag

SEQ ID NO: 252715 - RNA, 22 nt, Human
ucauaaaaguacucauguucau

SEQ ID NO: 252716 - RNA, 22 nt, Human
uuccugguuuauggaaagcaug

SEQ ID NO: 252717 - RNA, 22 nt, Human
ugcuuuauaucucucuucuuag

SEQ ID NO: 252718 - RNA, 22 nt, Human
aaacauuguuaugauaaauuac

SEQ ID NO: 252719 - RNA, 22 nt, Human
aucuuugaugacuaaugcuuug

SEQ ID NO: 252720 - RNA, 23 nt, Human
cuguggcugaguccuguuggagu

SEQ ID NO: 252721 - RNA, 22 nt, Human
aacagaauugcugcugccaaug

SEQ ID NO: 252722 - RNA, 22 nt, Human
gcaggagccagggauuccagga

SEQ ID NO: 252723 - RNA, 17 nt, Human
ggcagccucaggcguuu

SEQ ID NO: 252724 - RNA, 22 nt, Human
uauauuugugugugauuuauga

SEQ ID NO: 252725 - RNA, 22 nt, Human
ccugcuggcgcuugucugggag

SEQ ID NO: 252726 - RNA, 22 nt, Human
aucaagaauugggagcuauuga

SEQ ID NO: 252727 - RNA, 22 nt, Human
gcuccaggcugcucugucccau

SEQ ID NO: 252728 - RNA, 22 nt, Human
auguaguugaagugcuauaaag

SEQ ID NO: 252729 - RNA, 22 nt, Human
gcuggcaggauagaagucuaau

SEQ ID NO: 252730 - RNA, 22 nt, Human
ugggagcagcauugccaugugc

SEQ ID NO: 252731 - RNA, 22 nt, Human
gccuggaguuguggugaagcca

SEQ ID NO: 252732 - RNA, 22 nt, Human
uggcuucugagcauugaaacgu

SEQ ID NO: 252733 - RNA, 20 nt, Human
cacucugagggaguccaugu

SEQ ID NO: 252734 - RNA, 20 nt, Human
agugaauagagacauugccc

SEQ ID NO: 252735 - RNA, 22 nt, Human
uucaaaccuaucuaagaaauag

SEQ ID NO: 252736 - RNA, 22 nt, Human
cuggauguccuuccccugaagc

SEQ ID NO: 252737 - RNA, 22 nt, Human
aauaucacaggaggagaccaag

SEQ ID NO: 252738 - RNA, 22 nt, Human
ucugagcuucugcauuuccaac

SEQ ID NO: 252739 - RNA, 18 nt, Human
aaauuagauggaccugug

SEQ ID NO: 252740 - RNA, 22 nt, Human
ggccagguggcuguccuggcgu

SEQ ID NO: 252741 - RNA, 22 nt, Human
agaagaguaguaacagaaauua

SEQ ID NO: 252742 - RNA, 22 nt, Human
cagugcuguuguaagcucauug

SEQ ID NO: 252743 - RNA, 22 nt, Human
aguuuaaaucauguuuuguaac

SEQ ID NO: 252744 - RNA, 18 nt, Human
ccucccucauuuucccag

SEQ ID NO: 252745 - RNA, 22 nt, Human
acuuuggaaauugucuauaaga

SEQ ID NO: 252746 - RNA, 22 nt, Human
aaauaugugaucagugaauaaa

SEQ ID NO: 252747 - RNA, 22 nt, Human
uuccugagaaauuuguaccugg

SEQ ID NO: 252748 - RNA, 22 nt, Human
ucaggagcagggggaagcucug

SEQ ID NO: 252749 - RNA, 22 nt, Human
cccaggacucugacacccccaa

SEQ ID NO: 252750 - RNA, 20 nt, Human
gcucaggugacagucaggag

SEQ ID NO: 252751 - RNA, 22 nt, Human
ggguccagacacuccagaggaa

SEQ ID NO: 252752 - RNA, 22 nt, Human
gcucugggaacugacugccuuc

SEQ ID NO: 252753 - RNA, 22 nt, Human
uugaagauuauucuauuaaaag

SEQ ID NO: 252754 - RNA, 22 nt, Human
ugagacaguuuuucuauuucca

SEQ ID NO: 252755 - RNA, 22 nt, Human
ggcugcucugccuuccagcugg

SEQ ID NO: 252756 - RNA, 22 nt, Human
augaggcagguggaggcugcca

SEQ ID NO: 252757 - RNA, 22 nt, Human
ucuauuuacagaaagcagaauu

SEQ ID NO: 252758 - RNA, 22 nt, Human
ucccagccuccugacaguuuug

SEQ ID NO: 252759 - RNA, 22 nt, Human
uuaugcuaagugcaacaagcca

SEQ ID NO: 252760 - RNA, 22 nt, Human
gaggcuccagcgacaccuaggc

SEQ ID NO: 252761 - RNA, 22 nt, Human
auucuuaauuccaaagacugag

SEQ ID NO: 252762 - RNA, 22 nt, Human
gcagcucuggggcaggccugag

SEQ ID NO: 252763 - RNA, 22 nt, Human
uuuccagagggugcucagggcg

SEQ ID NO: 252764 - RNA, 20 nt, Human
aggaaggagaaucugagcaa

SEQ ID NO: 252765 - RNA, 22 nt, Human
gagccuggauugaagugggugg

SEQ ID NO: 252766 - RNA, 22 nt, Human
gcagggcugagucaugugugcc

SEQ ID NO: 252767 - RNA, 22 nt, Human
gcugcccauuccacuggauggu

SEQ ID NO: 252768 - RNA, 22 nt, Human
cuccaggagggggauggcugua

SEQ ID NO: 252769 - RNA, 22 nt, Human
ccauucugugucucuccacagc

SEQ ID NO: 252770 - RNA, 22 nt, Human
ugaaauagacacagugcuauac

SEQ ID NO: 252771 - RNA, 20 nt, Human
ggcagggcaucaacagcucu

SEQ ID NO: 252772 - RNA, 22 nt, Human
guuuuacacaccuaugaaagac

SEQ ID NO: 252773 - RNA, 22 nt, Human
ucagaugagugcuuucagcugc

SEQ ID NO: 252774 - RNA, 22 nt, Human
auaauggauucagaaccgucaa

SEQ ID NO: 252775 - RNA, 22 nt, Human
ugcugcuguaucaugccuucau

SEQ ID NO: 252776 - RNA, 22 nt, Human
gcucacagucuggcauagucuc

SEQ ID NO: 252777 - RNA, 22 nt, Human
auuaacaugcagccagacacac

SEQ ID NO: 252778 - RNA, 22 nt, Human
aaauacacguacauguguaaaa

SEQ ID NO: 252779 - RNA, 22 nt, Human
cagucucugugccagauccugg

SEQ ID NO: 252780 - RNA, 20 nt, Human
agggccuguugcaagcguuu

SEQ ID NO: 252781 - RNA, 17 nt, Human
cccagcuggcagugccg

SEQ ID NO: 252782 - RNA, 22 nt, Human
ugguccugagcaccagccugac

SEQ ID NO: 252783 - RNA, 22 nt, Human
uggaauguuuuccuaaaucaga

SEQ ID NO: 252784 - RNA, 22 nt, Human
cucuucuuuaguccagaccauc

SEQ ID NO: 252785 - RNA, 22 nt, Human
gcgacagugcggccaccuucau

SEQ ID NO: 252786 - RNA, 22 nt, Human
gccuggcauauaguaguugugc

SEQ ID NO: 252787 - RNA, 22 nt, Human
agaagcagaaggaagcagggcc

SEQ ID NO: 252788 - RNA, 22 nt, Human
ggcugcccucggggucgcaggc

SEQ ID NO: 252789 - RNA, 22 nt, Human
cuuaauaaaugguagcuguuau

SEQ ID NO: 252790 - RNA, 22 nt, Human
guccucaggaaggcuuucugac

SEQ ID NO: 252791 - RNA, 22 nt, Human
caggcugccgaggcugcagaau

SEQ ID NO: 252792 - RNA, 22 nt, Human
aauuaauucaguuuuuaaggga

SEQ ID NO: 252793 - RNA, 22 nt, Human
uggcccaggaggccagagggca

SEQ ID NO: 252794 - RNA, 22 nt, Human
ucuugagaagcggcugucucag

SEQ ID NO: 252795 - RNA, 22 nt, Human
uaaggguucagaaugcaguggu

SEQ ID NO: 252796 - RNA, 22 nt, Human
guagcaacuguagcccaaauuc

SEQ ID NO: 252797 - RNA, 22 nt, Human
ucaggcuuuucuucccucagug

SEQ ID NO: 252798 - RNA, 22 nt, Human
uagcaagaaaacacaagaauua

SEQ ID NO: 252799 - RNA, 22 nt, Human
uagucaguugggucuaguggca

SEQ ID NO: 252800 - RNA, 22 nt, Human
aaucuauaugcuuuucacauac

SEQ ID NO: 252801 - RNA, 22 nt, Human
auccagugagugcagcuguugu

SEQ ID NO: 252802 - RNA, 22 nt, Human
ucuugaaaggagauuggaggca

SEQ ID NO: 252803 - RNA, 22 nt, Human
cuggccuggcaggggaccucua

SEQ ID NO: 252804 - RNA, 22 nt, Human
ucuuauuuagagaggacuagag

SEQ ID NO: 252805 - RNA, 22 nt, Human
ugcucugggauucagcagccug

SEQ ID NO: 252806 - RNA, 22 nt, Human
aaaaucuugugacuuaggaagg

SEQ ID NO: 252807 - RNA, 22 nt, Human
caacauuucaaggucuuuagga

SEQ ID NO: 252808 - RNA, 19 nt, Human
ucacaggcaucuccccaga

SEQ ID NO: 252809 - RNA, 20 nt, Human
ugucuguaugcagucauaua

SEQ ID NO: 252810 - RNA, 22 nt, Human
caguggagugggacuggucuga

SEQ ID NO: 252811 - RNA, 22 nt, Human
cucagagagguugaacaacuug

SEQ ID NO: 252812 - RNA, 22 nt, Human
caaaaguaccuugugugcuuug

SEQ ID NO: 252813 - RNA, 19 nt, Human
aauggacaggcaauagucu

SEQ ID NO: 252814 - RNA, 22 nt, Human
aaucagaacuccuaccacagag

SEQ ID NO: 252815 - RNA, 22 nt, Human
gggcugagagugacuguucugu

SEQ ID NO: 252816 - RNA, 22 nt, Human
auguacaaucuaucacaagaag

SEQ ID NO: 252817 - RNA, 22 nt, Human
uugauaaaaugauaucuucuuu

SEQ ID NO: 252818 - RNA, 22 nt, Human
gaggcugaguagcuuugugcuc

SEQ ID NO: 252819 - RNA, 22 nt, Human
caggguuucaccauguuagcag

SEQ ID NO: 252820 - RNA, 23 nt, Human
agccacagccagagcuaucucca

SEQ ID NO: 252821 - RNA, 22 nt, Human
caggagaagucucuagggggug

SEQ ID NO: 252822 - RNA, 22 nt, Human
auggucuucucaagcaacacug

SEQ ID NO: 252823 - RNA, 20 nt, Human
agagcagcaguuggugaggu

SEQ ID NO: 252824 - RNA, 22 nt, Human
ugggaccagauaaagggagguc

SEQ ID NO: 252825 - RNA, 22 nt, Human
gacccugaggaugcaccagcag

SEQ ID NO: 252826 - RNA, 22 nt, Human
ugucacaucagggguguugaca

SEQ ID NO: 252827 - RNA, 18 nt, Human
ccuggaggucuucggggu

SEQ ID NO: 252828 - RNA, 22 nt, Human
gauguuaagaaggaauugaagu

SEQ ID NO: 252829 - RNA, 22 nt, Human
uguaggucaaguccauugugcu

SEQ ID NO: 252830 - RNA, 22 nt, Human
cagcauuuagaauuugaagugu

SEQ ID NO: 252831 - RNA, 22 nt, Human
cuggcucaggaaaguugcugcu

SEQ ID NO: 252832 - RNA, 22 nt, Human
cugaggcaggagaauugcugga

SEQ ID NO: 252833 - RNA, 22 nt, Human
agggggcccuugcaggugagcg

SEQ ID NO: 252834 - RNA, 22 nt, Human
uagaggagaacacaaauuauag

SEQ ID NO: 252835 - RNA, 22 nt, Human
uuucagauggagguuuaggaca

SEQ ID NO: 252836 - RNA, 22 nt, Human
aagccaguguggucugcccauu

SEQ ID NO: 252837 - RNA, 22 nt, Human
uauauuguaggugcuauuugaa

SEQ ID NO: 252838 - RNA, 22 nt, Human
gcuggcacugggaaggacugag

SEQ ID NO: 252839 - RNA, 22 nt, Human
aacacugcugcuggguucugug

SEQ ID NO: 252840 - RNA, 22 nt, Human
agcuucucucaggguaucuuuc

SEQ ID NO: 252841 - RNA, 22 nt, Human
cugaaggcuaaaauggacugaa

SEQ ID NO: 252842 - RNA, 22 nt, Human
acagaauagucagcuguaggcc

SEQ ID NO: 252843 - RNA, 22 nt, Human
auauuauaaguuauuucaaguu

SEQ ID NO: 252844 - RNA, 22 nt, Human
ucugcccacugcucugcugccc

SEQ ID NO: 252845 - RNA, 22 nt, Human
uuuuaacacucagcacuaucuc

SEQ ID NO: 252846 - RNA, 22 nt, Human
ugggcuccggcggccucaggcu

SEQ ID NO: 252847 - RNA, 23 nt, Human
aaggccagagagaggcuaguguc

SEQ ID NO: 252848 - RNA, 22 nt, Human
uucccucucuccagggcugccu

SEQ ID NO: 252849 - RNA, 22 nt, Human
ggaaacacaugaucagacaucu

SEQ ID NO: 252850 - RNA, 22 nt, Human
cuuuacagauaggaacuacuca

SEQ ID NO: 252851 - RNA, 22 nt, Human
cugggcgugucuuccagcuggc

SEQ ID NO: 252852 - RNA, 22 nt, Human
agggccagagucuguguagaua

SEQ ID NO: 252853 - RNA, 22 nt, Human
cagaagcaaguagugauucuuu

SEQ ID NO: 252854 - RNA, 22 nt, Human
acaggcacucucauuaaaauag

SEQ ID NO: 252855 - RNA, 22 nt, Human
augaggagcuccuugaaaugag

SEQ ID NO: 252856 - RNA, 18 nt, Human
ucucaaucgcugcagucu

SEQ ID NO: 252857 - RNA, 22 nt, Human
ugucccaguuuaucugggacug

SEQ ID NO: 252858 - RNA, 22 nt, Human
ugccaggcuguccugggccugg

SEQ ID NO: 252859 - RNA, 22 nt, Human
caggccagaggcuguuguugcg

SEQ ID NO: 252860 - RNA, 18 nt, Human
gcuuugcacucauguugu

SEQ ID NO: 252861 - RNA, 22 nt, Human
acucagaggaccaaaaggaaag

SEQ ID NO: 252862 - RNA, 22 nt, Human
gccuggagaauuaaaaggaagg

SEQ ID NO: 252863 - RNA, 22 nt, Human
uuaaaggcugaucuuaauauua

SEQ ID NO: 252864 - RNA, 20 nt, Human
caaaugaagcuguuggccuc

SEQ ID NO: 252865 - RNA, 22 nt, Human
caaauguuuuuauucuacaaca

SEQ ID NO: 252866 - RNA, 22 nt, Human
acacgguggccagcaguaggug

SEQ ID NO: 252867 - RNA, 22 nt, Human
gugcugucguggaacugggcug

SEQ ID NO: 252868 - RNA, 22 nt, Human
cuccuguguucaagcgauucuc

SEQ ID NO: 252869 - RNA, 22 nt, Human
caacauucaaccaacauuuaug

SEQ ID NO: 252870 - RNA, 22 nt, Human
gcugcucugaaaaugacuguug

SEQ ID NO: 252871 - RNA, 22 nt, Human
ggcagcuggggcagugcccugu

SEQ ID NO: 252872 - RNA, 20 nt, Human
ggcuuucugugauccucagu

SEQ ID NO: 252873 - RNA, 22 nt, Human
ggcaggaauaaauuauggacuu

SEQ ID NO: 252874 - RNA, 20 nt, Human
acucaaaucaccugccucaa

SEQ ID NO: 252875 - RNA, 22 nt, Human
ucuuuuucugcacacguguccc

SEQ ID NO: 252876 - RNA, 22 nt, Human
auaaagaggauguauuuacagc

SEQ ID NO: 252877 - RNA, 22 nt, Human
gugagcaaagguuaaacauuua

SEQ ID NO: 252878 - RNA, 22 nt, Human
acaggcagcacuaaucucuggu

SEQ ID NO: 252879 - RNA, 22 nt, Human
uugagacacaaggcacaguaag

SEQ ID NO: 252880 - RNA, 22 nt, Human
agcaccuggauuugauagucag

SEQ ID NO: 252881 - RNA, 22 nt, Human
gguggcagagaggagguaguuu

SEQ ID NO: 252882 - RNA, 22 nt, Human
ccuccccucagacagagacugg

SEQ ID NO: 252883 - RNA, 22 nt, Human
uucucaggugaggcugaggcug

SEQ ID NO: 252884 - RNA, 22 nt, Human
augcugagcagagcugacaugc

SEQ ID NO: 252885 - RNA, 22 nt, Human
auguacaguggaaacuaacaaa

SEQ ID NO: 252886 - RNA, 22 nt, Human
uccaagaguaagaggacucuuu

SEQ ID NO: 252887 - RNA, 22 nt, Human
gcuuggccagcagccgggaugc

SEQ ID NO: 252888 - RNA, 22 nt, Human
ggagggaaccuuggcuggauug

SEQ ID NO: 252889 - RNA, 20 nt, Human
gcaggcuccgggcuugggag

SEQ ID NO: 252890 - RNA, 22 nt, Human
ugccuggcaccccagucugcac

SEQ ID NO: 252891 - RNA, 22 nt, Human
gaaggugcaguggcuggaggcu

SEQ ID NO: 252892 - RNA, 23 nt, Human
aggggcagcaaguuuugguguua

SEQ ID NO: 252893 - RNA, 22 nt, Human
gggcuucuugagcugccggccc

SEQ ID NO: 252894 - RNA, 22 nt, Human
gaggccugcuuuggcacucugg

SEQ ID NO: 252895 - RNA, 22 nt, Human
auuuccauagagcgucucacag

SEQ ID NO: 252896 - RNA, 22 nt, Human
gcucagcugagcgaaggacaug

SEQ ID NO: 252897 - RNA, 22 nt, Human
gaaauauacauugcaggaagag

SEQ ID NO: 252898 - RNA, 22 nt, Human
gccaggacugagaaugggagca

SEQ ID NO: 252899 - RNA, 22 nt, Human
gguacagggcuuccuggacaag

SEQ ID NO: 252900 - RNA, 22 nt, Human
uuuaucugucauuucccauauc

SEQ ID NO: 252901 - RNA, 22 nt, Human
ugcaauuagcauuguauucuua

SEQ ID NO: 252902 - RNA, 22 nt, Human
auugaaaaaugacuauugcuua

SEQ ID NO: 252903 - RNA, 22 nt, Human
ccaggagggaggaguuccugag

SEQ ID NO: 252904 - RNA, 22 nt, Human
gccugggauucccagaggggca

SEQ ID NO: 252905 - RNA, 22 nt, Human
cccugccccaggcggcuucacu

SEQ ID NO: 252906 - RNA, 23 nt, Human
ugucuggcucauggugggucuca

SEQ ID NO: 252907 - RNA, 22 nt, Human
cugagcagcaauugcuggccca

SEQ ID NO: 252908 - RNA, 22 nt, Human
ugggcagguuguuauuugacau

SEQ ID NO: 252909 - RNA, 17 nt, Human
cugcuuggccucugggg

SEQ ID NO: 252910 - RNA, 22 nt, Human
agaagaauuucucucaugauuu

SEQ ID NO: 252911 - RNA, 22 nt, Human
uaaggcuacugucagcuucagg

SEQ ID NO: 252912 - RNA, 22 nt, Human
accugggaagaucuuugaagcu

SEQ ID NO: 252913 - RNA, 22 nt, Human
ugagaagcccacacucuuuccu

SEQ ID NO: 252914 - RNA, 22 nt, Human
ggacagcauucuacuguaggca

SEQ ID NO: 252915 - RNA, 22 nt, Human
ugcagaagaccuuccagggcug

SEQ ID NO: 252916 - RNA, 22 nt, Human
aaacagagggccacugaggcuc

SEQ ID NO: 252917 - RNA, 22 nt, Human
gauguguccuuuucuccaucca

SEQ ID NO: 252918 - RNA, 22 nt, Human
augcagagacagauguggcaug

SEQ ID NO: 252919 - RNA, 22 nt, Human
agaggagugggaagcagugcaa

SEQ ID NO: 252920 - RNA, 22 nt, Human
agacagaccauggcuauucaga

SEQ ID NO: 252921 - RNA, 22 nt, Human
uucucacaggcuggaaugauga

SEQ ID NO: 252922 - RNA, 22 nt, Human
aacucaguguguuucuuaguau

SEQ ID NO: 252923 - RNA, 22 nt, Human
acaauguaggauauguacuugu

SEQ ID NO: 252924 - RNA, 22 nt, Human
accccagguccagguuacagag

SEQ ID NO: 252925 - RNA, 22 nt, Human
uccagcccugcccauucucucg

SEQ ID NO: 252926 - RNA, 22 nt, Human
augcagggcagaguacguuagc

SEQ ID NO: 252927 - RNA, 22 nt, Human
ggaccaggacuggugguaucuc

SEQ ID NO: 252928 - RNA, 22 nt, Human
uucuuuuacauuaagauuucag

SEQ ID NO: 252929 - RNA, 22 nt, Human
ccugcuguagggccccuggggc

SEQ ID NO: 252930 - RNA, 22 nt, Human
uggacagguugaguaggaggag

SEQ ID NO: 252931 - RNA, 22 nt, Human
uugcauuccaugguuuuccuuc

SEQ ID NO: 252932 - RNA, 22 nt, Human
uaaaaggauuagcaggaugggc

SEQ ID NO: 252933 - RNA, 22 nt, Human
aaacuggugucacugagggcug

SEQ ID NO: 252934 - RNA, 22 nt, Human
uuuguucauuuugagcucauca

SEQ ID NO: 252935 - RNA, 22 nt, Human
cuuccugggcaauguucugcuu

SEQ ID NO: 252936 - RNA, 22 nt, Human
uggcaguuauuaaucaagucuu

SEQ ID NO: 252937 - RNA, 22 nt, Human
uaacaacugcugagguauuuga

SEQ ID NO: 252938 - RNA, 22 nt, Human
uccugggaggcugugccuggcu

SEQ ID NO: 252939 - RNA, 22 nt, Human
uaaugcugccaagccaugcaga

SEQ ID NO: 252940 - RNA, 22 nt, Human
gcucucucuuggggauucagca

SEQ ID NO: 252941 - RNA, 22 nt, Human
aggagugagcuuuggggucaga

SEQ ID NO: 252942 - RNA, 22 nt, Human
ucuggcuggcagugauggugug

SEQ ID NO: 252943 - RNA, 22 nt, Human
cuucuucauguauugauagucu

SEQ ID NO: 252944 - RNA, 22 nt, Human
acauauuuugaaagcuuucuaa

SEQ ID NO: 252945 - RNA, 22 nt, Human
acaggcucacagucauuucauu

SEQ ID NO: 252946 - RNA, 22 nt, Human
agagcccagucuuugugugaag

SEQ ID NO: 252947 - RNA, 22 nt, Human
uuugaaacucaugaucaucacu

SEQ ID NO: 252948 - RNA, 22 nt, Human
uuuuauugucucccaguucugg

SEQ ID NO: 252949 - RNA, 22 nt, Human
aguucuuugugaguaauacaga

SEQ ID NO: 252950 - RNA, 22 nt, Human
aucauuuuauggcugagaggac

SEQ ID NO: 252951 - RNA, 22 nt, Human
uggcugagccuuuggggcuuuc

SEQ ID NO: 252952 - RNA, 22 nt, Human
cagggcuggauuucauuucuag

SEQ ID NO: 252953 - RNA, 18 nt, Human
ucagagagcagcuuuauu

SEQ ID NO: 252954 - RNA, 22 nt, Human
cccuggccccucacuccgaggc

SEQ ID NO: 252955 - RNA, 22 nt, Human
ugccagugaaacauggaagaau

SEQ ID NO: 252956 - RNA, 22 nt, Human
uauugucaagaaguuuauagug

SEQ ID NO: 252957 - RNA, 22 nt, Human
cucccagaaaauucucagacaa

SEQ ID NO: 252958 - RNA, 22 nt, Human
cuauugcuaucauucugguggu

SEQ ID NO: 252959 - RNA, 22 nt, Human
cacuggcccagccaggccuguu

SEQ ID NO: 252960 - RNA, 22 nt, Human
cccaggcugugcaaacuucaaa

SEQ ID NO: 252961 - RNA, 22 nt, Human
aaggugguuugcuaaucccaac

SEQ ID NO: 252962 - RNA, 22 nt, Human
ucuggcaaaggcaaccacaguu

SEQ ID NO: 252963 - RNA, 22 nt, Human
caaguauuugcggaguuccacg

SEQ ID NO: 252964 - RNA, 22 nt, Human
gcugcagguuugucuagucugg

SEQ ID NO: 252965 - RNA, 20 nt, Human
uucaaguugggucucuggcu

SEQ ID NO: 252966 - RNA, 22 nt, Human
uuacagugacucacauuaacaa

SEQ ID NO: 252967 - RNA, 22 nt, Human
gagaggaacucccagugccugg

SEQ ID NO: 252968 - RNA, 22 nt, Human
guauucauauuaaacauaucaa

SEQ ID NO: 252969 - RNA, 22 nt, Human
uuggaggaugcaaugagggagu

SEQ ID NO: 252970 - RNA, 20 nt, Human
cugaagaguggccugaucug

SEQ ID NO: 252971 - RNA, 21 nt, Human
caaauagacauggcuagagga

SEQ ID NO: 252972 - RNA, 22 nt, Human
uaaaagagaauggauaacagag

SEQ ID NO: 252973 - RNA, 22 nt, Human
ucugggcugggagcguguggac

SEQ ID NO: 252974 - RNA, 22 nt, Human
ccuggcacacgguggcauucaa

SEQ ID NO: 252975 - RNA, 22 nt, Human
aauguauucugggaaaauguua

SEQ ID NO: 252976 - RNA, 22 nt, Human
agcacagauaacauggagugga

SEQ ID NO: 252977 - RNA, 22 nt, Human
gugcgggccuggggguuucucu

SEQ ID NO: 252978 - RNA, 22 nt, Human
cuugccuucagugucccuuugc

SEQ ID NO: 252979 - RNA, 22 nt, Human
aaauuucuugaggcucucuagc

SEQ ID NO: 252980 - RNA, 22 nt, Human
gaggugaugguugcacaaugcu

SEQ ID NO: 252981 - RNA, 22 nt, Human
cuggagagagaaaaagccuuaa

SEQ ID NO: 252982 - RNA, 22 nt, Human
caaauucucuuacuguuugaca

SEQ ID NO: 252983 - RNA, 22 nt, Human
cugaggcagaaaaagcaagggu

SEQ ID NO: 252984 - RNA, 22 nt, Human
accugcagcuaaagauguaggg

SEQ ID NO: 252985 - RNA, 22 nt, Human
uaagcaagggucucuguaucag

SEQ ID NO: 252986 - RNA, 22 nt, Human
ugaggccagcuucagcagugga

SEQ ID NO: 252987 - RNA, 22 nt, Human
ugggggagagugcaagcaugaa

SEQ ID NO: 252988 - RNA, 22 nt, Human
ugcaaauuucuuuaguacauaa

SEQ ID NO: 252989 - RNA, 22 nt, Human
auggcagaccugggcuggagaa

SEQ ID NO: 252990 - RNA, 22 nt, Human
auagccuugacucacagcucuu

SEQ ID NO: 252991 - RNA, 22 nt, Human
cucucuggaauuaaagcccaau

SEQ ID NO: 252992 - RNA, 22 nt, Human
auggcauuugaaucugucuuuu

SEQ ID NO: 252993 - RNA, 22 nt, Human
ugagcuggagucuguggcuccu

SEQ ID NO: 252994 - RNA, 22 nt, Human
cugagaauuacucugaugagua

SEQ ID NO: 252995 - RNA, 22 nt, Human
ggcccugaagugauugugaguu

SEQ ID NO: 252996 - RNA, 22 nt, Human
caaggcagcccgcugaaccaca

SEQ ID NO: 252997 - RNA, 22 nt, Human
uaagauaauaaguaugucuaug

SEQ ID NO: 252998 - RNA, 22 nt, Human
uccuuuguuaaggagguuuguu

SEQ ID NO: 252999 - RNA, 22 nt, Human
aagcauggcuguucuagcuaua

SEQ ID NO: 253000 - RNA, 22 nt, Human
ccagcuggucugugcucauguu

SEQ ID NO: 253001 - RNA, 22 nt, Human
ucccguugaugacggugcaucc

SEQ ID NO: 253002 - RNA, 22 nt, Human
aaacagcagcuguuuaauuugc

SEQ ID NO: 253003 - RNA, 22 nt, Human
ucuuuucuggacucugcaugga

SEQ ID NO: 253004 - RNA, 22 nt, Human
aucuaagauuuugcuaagauca

SEQ ID NO: 253005 - RNA, 22 nt, Human
gugcucagaaacuugcucauuu

SEQ ID NO: 253006 - RNA, 20 nt, Human
auguggcuuuuugaccugcu

SEQ ID NO: 253007 - RNA, 22 nt, Human
guggcagaaacuggcagaggag

SEQ ID NO: 253008 - RNA, 22 nt, Human
uucacaaucuggcuuagcauug

SEQ ID NO: 253009 - RNA, 20 nt, Human
uacaggcucugagagaugau

SEQ ID NO: 253010 - RNA, 22 nt, Human
auguucuaaucccugcuaugua

SEQ ID NO: 253011 - RNA, 22 nt, Human
aaacauguaaguucagaucacc

SEQ ID NO: 253012 - RNA, 22 nt, Human
cugggagcuagcucugagcuga

SEQ ID NO: 253013 - RNA, 22 nt, Human
ugucugggagggacagggcuac

SEQ ID NO: 253014 - RNA, 22 nt, Human
ggggccaguaggagugauguac

SEQ ID NO: 253015 - RNA, 22 nt, Human
uggcucagcugacucggcuucu

SEQ ID NO: 253016 - RNA, 22 nt, Human
uuuccagugaauuagucuguuu

SEQ ID NO: 253017 - RNA, 22 nt, Human
uugacuucccagacuuguguuu

SEQ ID NO: 253018 - RNA, 20 nt, Human
uaugauaauuacaaaauagu

SEQ ID NO: 253019 - RNA, 22 nt, Human
uaguugacuucucuaucccagc

SEQ ID NO: 253020 - RNA, 22 nt, Human
cagagcucucuuugcuacuaca

SEQ ID NO: 253021 - RNA, 22 nt, Human
ugcuuuauguuaucagaagggu

SEQ ID NO: 253022 - RNA, 22 nt, Human
aagggcugaaugaaggguugaa

SEQ ID NO: 253023 - RNA, 20 nt, Human
gccagcccugacacaggagc

SEQ ID NO: 253024 - RNA, 22 nt, Human
caagaucuuccucaauagaccu

SEQ ID NO: 253025 - RNA, 22 nt, Human
uuauagcaggugacuaaugagu

SEQ ID NO: 253026 - RNA, 21 nt, Human
ucucuuugggaacauuaauca

SEQ ID NO: 253027 - RNA, 22 nt, Human
caggcacgggggcauggccucu

SEQ ID NO: 253028 - RNA, 22 nt, Human
gggcuucuggcuacuguaugag

SEQ ID NO: 253029 - RNA, 22 nt, Human
auaaggcagaaaugauucuagu

SEQ ID NO: 253030 - RNA, 22 nt, Human
cucugugcccuacugcucagcu

SEQ ID NO: 253031 - RNA, 22 nt, Human
auggcagcuuugaauuucuuga

SEQ ID NO: 253032 - RNA, 23 nt, Human
ucuguucuuuuagcugaucauuu

SEQ ID NO: 253033 - RNA, 21 nt, Human
gcugcucgagauccagugcuu

SEQ ID NO: 253034 - RNA, 22 nt, Human
caugcucacaaaagauggcaaa

SEQ ID NO: 253035 - RNA, 22 nt, Human
gacaguuuagguucaaaucuca

SEQ ID NO: 253036 - RNA, 22 nt, Human
cuggaggucauguaauauggaa

SEQ ID NO: 253037 - RNA, 22 nt, Human
ggucuccaaagcugcauugaug

SEQ ID NO: 253038 - RNA, 22 nt, Human
cuucuuaaagauuacacaauga

SEQ ID NO: 253039 - RNA, 22 nt, Human
gauuagaaugggaagauacaag

SEQ ID NO: 253040 - RNA, 23 nt, Human
cugaaauaccagaaaaucagugu

SEQ ID NO: 253041 - RNA, 22 nt, Human
ccagugggagggagcuaggcca

SEQ ID NO: 253042 - RNA, 22 nt, Human
ugaguaaaagugaaucuuaugu

SEQ ID NO: 253043 - RNA, 22 nt, Human
uccaggcccauggagcagagcu

SEQ ID NO: 253044 - RNA, 22 nt, Human
acagaacuucaguaguauuccc

SEQ ID NO: 253045 - RNA, 22 nt, Human
ugccugucuccucugcagggug

SEQ ID NO: 253046 - RNA, 22 nt, Human
gugcuggggagauaggaagaga

SEQ ID NO: 253047 - RNA, 22 nt, Human
agugcucacucuccacagugcc

SEQ ID NO: 253048 - RNA, 22 nt, Human
acauaauggacaauaaugcauc

SEQ ID NO: 253049 - RNA, 23 nt, Human
uccuccagaggcccuccuuggcc

SEQ ID NO: 253050 - RNA, 22 nt, Human
uaugugcaugcugacuugagga

SEQ ID NO: 253051 - RNA, 22 nt, Human
cacuggaauagcauugauucuu

SEQ ID NO: 253052 - RNA, 22 nt, Human
ucccagugagaugaaacaggua

SEQ ID NO: 253053 - RNA, 22 nt, Human
ccacagaaaauaaagcacgauu

SEQ ID NO: 253054 - RNA, 22 nt, Human
cagcggaggacagaugggagcu

SEQ ID NO: 253055 - RNA, 22 nt, Human
acuucaaacaauuaacagagaa

SEQ ID NO: 253056 - RNA, 22 nt, Human
ugagccaggcacugcuccugga

SEQ ID NO: 253057 - RNA, 22 nt, Human
uuacuaguggagaaacugaggc

SEQ ID NO: 253058 - RNA, 18 nt, Human
caggucagccuggccuca

SEQ ID NO: 253059 - RNA, 22 nt, Human
gcuucccagcagaggaaagacu

SEQ ID NO: 253060 - RNA, 22 nt, Human
agggaagaaaauccaucgcugc

SEQ ID NO: 253061 - RNA, 22 nt, Human
caaauuuaagugaggucuuugu

SEQ ID NO: 253062 - RNA, 22 nt, Human
ucugcagaauugucucaagcua

SEQ ID NO: 253063 - RNA, 22 nt, Human
auaccauuuccauguuacauua

SEQ ID NO: 253064 - RNA, 22 nt, Human
agcuuuggagcugggugaaaga

SEQ ID NO: 253065 - RNA, 22 nt, Human
gcccaaggucccauggcagcac

SEQ ID NO: 253066 - RNA, 22 nt, Human
aacaucagaauauccauguugg

SEQ ID NO: 253067 - RNA, 22 nt, Human
aucuagaacaauuauugucaca

SEQ ID NO: 253068 - RNA, 22 nt, Human
uucagcaaacacgaugcuuguu

SEQ ID NO: 253069 - RNA, 22 nt, Human
uuuaaaguuuuugcacauucug

SEQ ID NO: 253070 - RNA, 22 nt, Human
gcucagagaauuuacugcugcc

SEQ ID NO: 253071 - RNA, 22 nt, Human
guggcagggugcucaucaugca

SEQ ID NO: 253072 - RNA, 22 nt, Human
acacuuuguuguggcauauacg

SEQ ID NO: 253073 - RNA, 22 nt, Human
aaauaagcacuuaacuguauca

SEQ ID NO: 253074 - RNA, 22 nt, Human
acuugguugaugucauaagguu

SEQ ID NO: 253075 - RNA, 22 nt, Human
gccuguccacuaaacagccaag

SEQ ID NO: 253076 - RNA, 22 nt, Human
augaguucauacuuucaguacc

SEQ ID NO: 253077 - RNA, 22 nt, Human
agggggcucagcauggauggag

SEQ ID NO: 253078 - RNA, 22 nt, Human
agcuggagaaaccugggagggu

SEQ ID NO: 253079 - RNA, 22 nt, Human
gaccagcuacuuguacaguuca

SEQ ID NO: 253080 - RNA, 22 nt, Human
aaaguacuaaugaauauuuugc

SEQ ID NO: 253081 - RNA, 22 nt, Human
agcugccacagagccuggccag

SEQ ID NO: 253082 - RNA, 20 nt, Human
aggccccagguggacacuag

SEQ ID NO: 253083 - RNA, 20 nt, Human
ugccuggccuuucucugccc

SEQ ID NO: 253084 - RNA, 22 nt, Human
cacagaauaaauugguaucaga

SEQ ID NO: 253085 - RNA, 22 nt, Human
ucauguguguuucauguaugga

SEQ ID NO: 253086 - RNA, 22 nt, Human
agggaagccccgaggaggcacc

SEQ ID NO: 253087 - RNA, 23 nt, Human
uacugucuucuauuaaguaagga

SEQ ID NO: 253088 - RNA, 22 nt, Human
auuauagaggguuacaguuaau

SEQ ID NO: 253089 - RNA, 22 nt, Human
gcagggaccagggccagaucca

SEQ ID NO: 253090 - RNA, 22 nt, Human
uuucaaacauaucuucauuacu

SEQ ID NO: 253091 - RNA, 21 nt, Human
ugcacaaacuuucuguggcuu

SEQ ID NO: 253092 - RNA, 22 nt, Human
aaacugcagagccaugguucaa

SEQ ID NO: 253093 - RNA, 22 nt, Human
uccaggaaucugugccuagccc

SEQ ID NO: 253094 - RNA, 22 nt, Human
gguguccuuguccuuugguacc

SEQ ID NO: 253095 - RNA, 22 nt, Human
aagcaauuugacaguacauauc

SEQ ID NO: 253096 - RNA, 22 nt, Human
cugagggacccugugaguaccu

SEQ ID NO: 253097 - RNA, 22 nt, Human
gucugggcuccuggcaggcagc

SEQ ID NO: 253098 - RNA, 22 nt, Human
ggcaugcucuggggguccuccg

SEQ ID NO: 253099 - RNA, 22 nt, Human
agggccaguaaauguuuccuca

SEQ ID NO: 253100 - RNA, 22 nt, Human
guuuuuacuaagguugcuaagu

SEQ ID NO: 253101 - RNA, 22 nt, Human
uuacagugacaguugcuaugau

SEQ ID NO: 253102 - RNA, 23 nt, Human
acugggucuaucuccagagaaga

SEQ ID NO: 253103 - RNA, 17 nt, Human
uaagugauuaucucaua

SEQ ID NO: 253104 - RNA, 18 nt, Human
cagugcuguuaacaguga

SEQ ID NO: 253105 - RNA, 18 nt, Human
uguuuauucuccugacag

SEQ ID NO: 253106 - RNA, 22 nt, Human
ugcuggagcaacauuauugugc

SEQ ID NO: 253107 - RNA, 22 nt, Human
uuagagguucuaugugucugga

SEQ ID NO: 253108 - RNA, 22 nt, Human
gcugcgagcucuuguucugaga

SEQ ID NO: 253109 - RNA, 22 nt, Human
gcacacauauauaugagcaugu

SEQ ID NO: 253110 - RNA, 22 nt, Human
ucaguuuauggucuaguucaug

SEQ ID NO: 253111 - RNA, 22 nt, Human
cuggugaauggauaaacuguug

SEQ ID NO: 253112 - RNA, 19 nt, Human
aggcuggaugcccaucuua

SEQ ID NO: 253113 - RNA, 19 nt, Human
uuggggugaaugccagaca

SEQ ID NO: 253114 - RNA, 22 nt, Human
uuauuuguaaagguccauagua

SEQ ID NO: 253115 - RNA, 22 nt, Human
cagaaauguacugacaugcagu

SEQ ID NO: 253116 - RNA, 22 nt, Human
augauucuggcaaauuuauuau

SEQ ID NO: 253117 - RNA, 22 nt, Human
ccaaggccacaaacagccuggc

SEQ ID NO: 253118 - RNA, 22 nt, Human
cgcccagcugaaaucuccaggc

SEQ ID NO: 253119 - RNA, 22 nt, Human
ugacaagagcauucccacaccu

SEQ ID NO: 253120 - RNA, 22 nt, Human
aauagacaagcacccugguaaa

SEQ ID NO: 253121 - RNA, 22 nt, Human
ggccaggaggcaggggcucaau

SEQ ID NO: 253122 - RNA, 22 nt, Human
caacuuuucugugaauuuaagu

SEQ ID NO: 253123 - RNA, 22 nt, Human
cugagacacaguggcugaaaag

SEQ ID NO: 253124 - RNA, 22 nt, Human
guacaaaugaaaauagaccacu

SEQ ID NO: 253125 - RNA, 22 nt, Human
cacugauuaagucugcuagagg

SEQ ID NO: 253126 - RNA, 22 nt, Human
agggaggaaggauguuccaaag

SEQ ID NO: 253127 - RNA, 22 nt, Human
gacacagauaucucugagauua

SEQ ID NO: 253128 - RNA, 22 nt, Human
auuagcagugccuugccugucu

SEQ ID NO: 253129 - RNA, 22 nt, Human
ucuccugucuucucagcacccc

SEQ ID NO: 253130 - RNA, 22 nt, Human
cauucaaaugugccacuguccu

SEQ ID NO: 253131 - RNA, 22 nt, Human
ucucagauggcaucagcuagag

SEQ ID NO: 253132 - RNA, 22 nt, Human
cugaggcugggcauggggucca

SEQ ID NO: 253133 - RNA, 21 nt, Human
cccaccccauaaggcagaacc

SEQ ID NO: 253134 - RNA, 22 nt, Human
caaugauugcuauuuacauaaa

SEQ ID NO: 253135 - RNA, 22 nt, Human
ggcagcugagcauggcuaccuu

SEQ ID NO: 253136 - RNA, 22 nt, Human
gcagggucuugagaggcagcca

SEQ ID NO: 253137 - RNA, 19 nt, Human
gcucagagucccccugcgg

SEQ ID NO: 253138 - RNA, 21 nt, Human
agcagcagcaguggggcuucu

SEQ ID NO: 253139 - RNA, 22 nt, Human
aacucacagcuguuuggauuag

SEQ ID NO: 253140 - RNA, 22 nt, Human
gacauaauccuccucaccuacu

SEQ ID NO: 253141 - RNA, 22 nt, Human
uuuguauuuuucccagcuagcu

SEQ ID NO: 253142 - RNA, 22 nt, Human
uccugggucugggugucugagg

SEQ ID NO: 253143 - RNA, 22 nt, Human
ggcucagcuuaucugggcaggc

SEQ ID NO: 253144 - RNA, 22 nt, Human
guuuauaaauucugcuuuuguu

SEQ ID NO: 253145 - RNA, 22 nt, Human
ugcaauuagcguauuaguuuau

SEQ ID NO: 253146 - RNA, 22 nt, Human
ggcuguccaccuaccaugccgg

SEQ ID NO: 253147 - RNA, 22 nt, Human
auuuccaugaauucccacucau

SEQ ID NO: 253148 - RNA, 22 nt, Human
cacaugcaccagaaaucaacau

SEQ ID NO: 253149 - RNA, 22 nt, Human
uuucuauugaucuaauaaacau

SEQ ID NO: 253150 - RNA, 22 nt, Human
cuagggcaaugacucaaagcgg

SEQ ID NO: 253151 - RNA, 21 nt, Human
aaacugaagagacaggaacuu

SEQ ID NO: 253152 - RNA, 22 nt, Human
ugguccuggaagguccugaggg

SEQ ID NO: 253153 - RNA, 20 nt, Human
aacuaugaauagaagagauu

SEQ ID NO: 253154 - RNA, 22 nt, Human
acugggccggugcagaguaguu

SEQ ID NO: 253155 - RNA, 22 nt, Human
ccuggcucaggcacgcauggcu

SEQ ID NO: 253156 - RNA, 22 nt, Human
cuaaaugacagguaccauagug

SEQ ID NO: 253157 - RNA, 22 nt, Human
ugaaauguuaaacaaguggcuc

SEQ ID NO: 253158 - RNA, 22 nt, Human
aaggcuuguugaguaucuacug

SEQ ID NO: 253159 - RNA, 22 nt, Human
cuccuccacuaggcaaaaugug

SEQ ID NO: 253160 - RNA, 21 nt, Human
ugcucaugagcccacagcugc

SEQ ID NO: 253161 - RNA, 22 nt, Human
cacacaugaaucccuaguaccu

SEQ ID NO: 253162 - RNA, 22 nt, Human
caccccagcuucucaggauaga

SEQ ID NO: 253163 - RNA, 22 nt, Human
cugcagguugagcagccagguu

SEQ ID NO: 253164 - RNA, 22 nt, Human
gaaaggagugcuuuccaggucu

SEQ ID NO: 253165 - RNA, 22 nt, Human
ucaaucaaugugucaguuccca

SEQ ID NO: 253166 - RNA, 22 nt, Human
caggguugcaugcaucuguggg

SEQ ID NO: 253167 - RNA, 22 nt, Human
gauccucuuuuccuaggaaggu

SEQ ID NO: 253168 - RNA, 22 nt, Human
aucuaaaaggagcucuuuaucu

SEQ ID NO: 253169 - RNA, 22 nt, Human
cacaauuuggacuucacugguu

SEQ ID NO: 253170 - RNA, 22 nt, Human
ggaggacaggggcugcagcaca

SEQ ID NO: 253171 - RNA, 22 nt, Human
cagcuuggcuucacauucugua

SEQ ID NO: 253172 - RNA, 22 nt, Human
caggaaaucacucugauuuugg

SEQ ID NO: 253173 - RNA, 22 nt, Human
uucucagaaaauguagagaaaa

SEQ ID NO: 253174 - RNA, 21 nt, Human
uacaagaccggauucgggccc

SEQ ID NO: 253175 - RNA, 22 nt, Human
cuuuggauggcuguguguuuau

SEQ ID NO: 253176 - RNA, 19 nt, Human
cagaugagaaaagugaggu

SEQ ID NO: 253177 - RNA, 22 nt, Human
ugccaggcccucccacagauua

SEQ ID NO: 253178 - RNA, 22 nt, Human
auccugugaggauaagcccuug

SEQ ID NO: 253179 - RNA, 23 nt, Human
acaggcaggcauggccaaaugug

SEQ ID NO: 253180 - RNA, 22 nt, Human
uucugggcccacuguagcaucc

SEQ ID NO: 253181 - RNA, 22 nt, Human
gagugugggucucagcuuuaag

SEQ ID NO: 253182 - RNA, 22 nt, Human
ucugugauaguuuuucagcuau

SEQ ID NO: 253183 - RNA, 22 nt, Human
ggcaggugcugggagcaucuca

SEQ ID NO: 253184 - RNA, 23 nt, Human
aggaagcccauuuuagucuaccu

SEQ ID NO: 253185 - RNA, 22 nt, Human
gggagcagccugccucccaccu

SEQ ID NO: 253186 - RNA, 22 nt, Human
caaaugaauagggagugugaug

SEQ ID NO: 253187 - RNA, 22 nt, Human
aguaaaugaaagcaauuuuaga

SEQ ID NO: 253188 - RNA, 22 nt, Human
cuggaaauuggagaugauguuu

SEQ ID NO: 253189 - RNA, 22 nt, Human
agaaccuucagauuaggaggug

SEQ ID NO: 253190 - RNA, 18 nt, Human
uccugggaaaggcauaca

SEQ ID NO: 253191 - RNA, 22 nt, Human
gcugccagcucacucuccugag

SEQ ID NO: 253192 - RNA, 22 nt, Human
uagaugaaggcugagcaccugu

SEQ ID NO: 253193 - RNA, 22 nt, Human
gccagccaggaagaaaguaaga

SEQ ID NO: 253194 - RNA, 19 nt, Human
aguuauuucuaaauuuacc

SEQ ID NO: 253195 - RNA, 22 nt, Human
aguguacacuaaaugaauacaa

SEQ ID NO: 253196 - RNA, 22 nt, Human
ugguccuugcuauagagugaua

SEQ ID NO: 253197 - RNA, 22 nt, Human
cacaggaggaggccagagcgua

SEQ ID NO: 253198 - RNA, 22 nt, Human
auucuuuaauucaauugaagga

SEQ ID NO: 253199 - RNA, 22 nt, Human
cacugggcaauucugagccuaa

SEQ ID NO: 253200 - RNA, 22 nt, Human
ucaggccugcccugaaagcaca

SEQ ID NO: 253201 - RNA, 22 nt, Human
aggccaggaauccuugucccag

SEQ ID NO: 253202 - RNA, 22 nt, Human
cuuauguaaacuacagauaaua

SEQ ID NO: 253203 - RNA, 22 nt, Human
uuuuaugagaaugcgccacuug

SEQ ID NO: 253204 - RNA, 22 nt, Human
aaagacugaggggaaagugaug

SEQ ID NO: 253205 - RNA, 22 nt, Human
aacaggccuuguuuuuguucau

SEQ ID NO: 253206 - RNA, 22 nt, Human
auuaaggugucaauguauuugg

SEQ ID NO: 253207 - RNA, 22 nt, Human
ccaguucuucuugacacgaaag

SEQ ID NO: 253208 - RNA, 22 nt, Human
gacacagucaagaguggaggaa

SEQ ID NO: 253209 - RNA, 22 nt, Human
agaggggaggcgaaccagaguc

SEQ ID NO: 253210 - RNA, 22 nt, Human
uggaauguuuccccagccugca

SEQ ID NO: 253211 - RNA, 22 nt, Human
caggcugauaggguccaaaguu

SEQ ID NO: 253212 - RNA, 22 nt, Human
caagucauuguuuagucauguu

SEQ ID NO: 253213 - RNA, 22 nt, Human
uaagacaaauacuauuucaaga

SEQ ID NO: 253214 - RNA, 22 nt, Human
ugccuggcccugacagcccugg

SEQ ID NO: 253215 - RNA, 22 nt, Human
ugaagaggccaaacuaucauug

SEQ ID NO: 253216 - RNA, 22 nt, Human
caggaagcugagcugcacugca

SEQ ID NO: 253217 - RNA, 22 nt, Human
ucuacagcugcugcuucucaug

SEQ ID NO: 253218 - RNA, 22 nt, Human
gacacuuuaggauuuaaaaguc

SEQ ID NO: 253219 - RNA, 20 nt, Human
aggcucugccugcaggccca

SEQ ID NO: 253220 - RNA, 22 nt, Human
acauagaagugaugcuuaucca

SEQ ID NO: 253221 - RNA, 22 nt, Human
gcugccauguugugaggacacu

SEQ ID NO: 253222 - RNA, 22 nt, Human
agcauaauuccugacacacaag

SEQ ID NO: 253223 - RNA, 22 nt, Human
ugcaauaacuacuuuaauguug

SEQ ID NO: 253224 - RNA, 20 nt, Human
ccugggcucaaagcauccuc

SEQ ID NO: 253225 - RNA, 22 nt, Human
ucagagaauucgauuaaaugca

SEQ ID NO: 253226 - RNA, 19 nt, Human
caggugguaaucugagccu

SEQ ID NO: 253227 - RNA, 22 nt, Human
cuggaggggccauccacagucu

SEQ ID NO: 253228 - RNA, 22 nt, Human
ugcuggagaaaguuuuucugaa

SEQ ID NO: 253229 - RNA, 22 nt, Human
cugccuguggucugugaucuaa

SEQ ID NO: 253230 - RNA, 22 nt, Human
uguaaauaaugcauguaaauca

SEQ ID NO: 253231 - RNA, 21 nt, Human
ugcaguucaagucaaucuacu

SEQ ID NO: 253232 - RNA, 22 nt, Human
guuugccuuuuagauaggaaug

SEQ ID NO: 253233 - RNA, 22 nt, Human
gucacacucaaaagcuaggaug

SEQ ID NO: 253234 - RNA, 22 nt, Human
gacccagaaggagugcccuaga

SEQ ID NO: 253235 - RNA, 22 nt, Human
uagaaguucaugcgaauuauuu

SEQ ID NO: 253236 - RNA, 22 nt, Human
aggccucuguagggcccugaag

SEQ ID NO: 253237 - RNA, 22 nt, Human
auccauaucuggacucuacccc

SEQ ID NO: 253238 - RNA, 22 nt, Human
guuagggagggugcauaugugu

SEQ ID NO: 253239 - RNA, 22 nt, Human
ucaggcucucagaccaacagca

SEQ ID NO: 253240 - RNA, 22 nt, Human
acauaucuguuagacacagcag

SEQ ID NO: 253241 - RNA, 22 nt, Human
ccuuggcuugcacacggccacc

SEQ ID NO: 253242 - RNA, 22 nt, Human
uuccugugugacucaagugguu

SEQ ID NO: 253243 - RNA, 22 nt, Human
cuggcuuuaacccuacaaaccu

SEQ ID NO: 253244 - RNA, 22 nt, Human
gagcccucuucccuagugaucg

SEQ ID NO: 253245 - RNA, 22 nt, Human
ucagagucauugcaaguagaag

SEQ ID NO: 253246 - RNA, 22 nt, Human
augcuacuauccuucugcuuaa

SEQ ID NO: 253247 - RNA, 22 nt, Human
cagggacagagacugcaccuug

SEQ ID NO: 253248 - RNA, 22 nt, Human
gggagggaaagcuugaucuguc

SEQ ID NO: 253249 - RNA, 16 nt, Human
accuccagucaagggu

SEQ ID NO: 253250 - RNA, 22 nt, Human
cagaugaggacagaugacuggg

SEQ ID NO: 253251 - RNA, 22 nt, Human
gcuaaaaggagcacuagagauu

SEQ ID NO: 253252 - RNA, 22 nt, Human
agccugguuuaagcauuuuaua

SEQ ID NO: 253253 - RNA, 22 nt, Human
cgcaccacugaauuccagccug

SEQ ID NO: 253254 - RNA, 22 nt, Human
ucacacagguuugcaaugauuu

SEQ ID NO: 253255 - RNA, 22 nt, Human
acagcuguguuuuauaaucagc

SEQ ID NO: 253256 - RNA, 22 nt, Human
ucugggcuuuaguuuguuaucu

SEQ ID NO: 253257 - RNA, 21 nt, Human
ucucaggcgagaauucuuuua

SEQ ID NO: 253258 - RNA, 22 nt, Human
guugaguggguuaggaugcuga

SEQ ID NO: 253259 - RNA, 22 nt, Human
aggcuccagcccaaggcugcag

SEQ ID NO: 253260 - RNA, 22 nt, Human
aaaugcuagggagaaacucucc

SEQ ID NO: 253261 - RNA, 22 nt, Human
cuuuucaugccagcccaucaca

SEQ ID NO: 253262 - RNA, 22 nt, Human
gaggcugugucuugggguggaa

SEQ ID NO: 253263 - RNA, 22 nt, Human
gcccucagaaugggcucuaauc

SEQ ID NO: 253264 - RNA, 22 nt, Human
uccugaaaugugcacaugacau

SEQ ID NO: 253265 - RNA, 20 nt, Human
uuggaugugcauggccgugc

SEQ ID NO: 253266 - RNA, 22 nt, Human
aagagcauggaauggagaucca

SEQ ID NO: 253267 - RNA, 22 nt, Human
aggaggcugcaacccugaggcc

SEQ ID NO: 253268 - RNA, 22 nt, Human
auaagguaugaaaaguaaaugg

SEQ ID NO: 253269 - RNA, 22 nt, Human
ucuccacagaagguuccaggcc

SEQ ID NO: 253270 - RNA, 23 nt, Human
ggacacaggccuugucugcgccu

SEQ ID NO: 253271 - RNA, 22 nt, Human
ugagucugauuuuucuagcauu

SEQ ID NO: 253272 - RNA, 22 nt, Human
gcauuuauuucuuuacugcauc

SEQ ID NO: 253273 - RNA, 22 nt, Human
gaaaaaugcuccaaaucugugg

SEQ ID NO: 253274 - RNA, 22 nt, Human
aguggcaguagaugagcugguu

SEQ ID NO: 253275 - RNA, 22 nt, Human
aguuuuauuccaaugugcagca

SEQ ID NO: 253276 - RNA, 22 nt, Human
cugugcccaccuggcucugagg

SEQ ID NO: 253277 - RNA, 22 nt, Human
cuggcugugucuuggaggagcu

SEQ ID NO: 253278 - RNA, 22 nt, Human
agaguggcuugcucagcuagca

SEQ ID NO: 253279 - RNA, 22 nt, Human
cacagaggacuguagcggggag

SEQ ID NO: 253280 - RNA, 22 nt, Human
augaggcaaggaucagguaagg

SEQ ID NO: 253281 - RNA, 22 nt, Human
uccccacaucucugcaucaggc

SEQ ID NO: 253282 - RNA, 22 nt, Human
aaugauggucauggcaacuuuu

SEQ ID NO: 253283 - RNA, 22 nt, Human
cugauacaaugcuaauaaauuu

SEQ ID NO: 253284 - RNA, 19 nt, Human
ggaacuuggccuuuaccca

SEQ ID NO: 253285 - RNA, 22 nt, Human
aaguuacagucagagguuaaca

SEQ ID NO: 253286 - RNA, 22 nt, Human
auaugaaguuacagguaagaaa

SEQ ID NO: 253287 - RNA, 22 nt, Human
ugaacuuacaaauuaaaagacu

SEQ ID NO: 253288 - RNA, 22 nt, Human
cuccucugucuggcccugagcc

SEQ ID NO: 253289 - RNA, 22 nt, Human
aaaugcauguauguaauaugcu

SEQ ID NO: 253290 - RNA, 22 nt, Human
aggccacaguacuuugcagacc

SEQ ID NO: 253291 - RNA, 22 nt, Human
cugugggagcagcaccaaggac

SEQ ID NO: 253292 - RNA, 22 nt, Human
gcacugaugcaaaaaucacuca

SEQ ID NO: 253293 - RNA, 22 nt, Human
aggacccagaaggugcagcaga

SEQ ID NO: 253294 - RNA, 22 nt, Human
ucccuccuuuaucaaaaagaga

SEQ ID NO: 253295 - RNA, 22 nt, Human
gcagcccagagcgcaggacccc

SEQ ID NO: 253296 - RNA, 22 nt, Human
uucugcauguguuucaaauacu

SEQ ID NO: 253297 - RNA, 22 nt, Human
ccagagagaguacugggcucug

SEQ ID NO: 253298 - RNA, 22 nt, Human
gugaggagucugaagcacauaa

SEQ ID NO: 253299 - RNA, 22 nt, Human
acaggcucucagccaguuggca

SEQ ID NO: 253300 - RNA, 19 nt, Human
caacaguugcaacacuguc

SEQ ID NO: 253301 - RNA, 22 nt, Human
acugagcacuugguauauuucc

SEQ ID NO: 253302 - RNA, 20 nt, Human
auguaaaauuauaaggcuga

SEQ ID NO: 253303 - RNA, 22 nt, Human
auuugcuuucagguauaaaagg

SEQ ID NO: 253304 - RNA, 22 nt, Human
acagaacaggcugagaaaaaca

SEQ ID NO: 253305 - RNA, 22 nt, Human
ucugaggguaagguuaagguag

SEQ ID NO: 253306 - RNA, 22 nt, Human
cucagagcacuuuugaaagcuc

SEQ ID NO: 253307 - RNA, 22 nt, Human
gcagugucuuugaccuccaccc

SEQ ID NO: 253308 - RNA, 22 nt, Human
ggucuagaguggggccuggaaa

SEQ ID NO: 253309 - RNA, 22 nt, Human
aaagaacuuaagaaauuaggcu

SEQ ID NO: 253310 - RNA, 22 nt, Human
ugacagacuuuacuucuccuau

SEQ ID NO: 253311 - RNA, 22 nt, Human
ccuucagaaugaaauucuaaug

SEQ ID NO: 253312 - RNA, 22 nt, Human
aacaugugucuugcauuucuug

SEQ ID NO: 253313 - RNA, 22 nt, Human
agcuuugggggagguagucugu

SEQ ID NO: 253314 - RNA, 22 nt, Human
ccucccagugccuccagagcag

SEQ ID NO: 253315 - RNA, 22 nt, Human
cugaauuacugaaggucaacuu

SEQ ID NO: 253316 - RNA, 22 nt, Human
aaauugcaaaaguacuuuuagg

SEQ ID NO: 253317 - RNA, 22 nt, Human
aaguguauuaagcaacguuauu

SEQ ID NO: 253318 - RNA, 22 nt, Human
aaaucugaaauagugugaagua

SEQ ID NO: 253319 - RNA, 23 nt, Human
auguauuuaaauuucagugauga

SEQ ID NO: 253320 - RNA, 20 nt, Human
ugaaggugacuccuuucuug

SEQ ID NO: 253321 - RNA, 20 nt, Human
cugcccacuagaacuaccug

SEQ ID NO: 253322 - RNA, 22 nt, Human
ucagggcagccuaaggcaccuc

SEQ ID NO: 253323 - RNA, 22 nt, Human
gauccuguuagaucccauuaga

SEQ ID NO: 253324 - RNA, 23 nt, Human
agcagcuguggaguuuugcauuu

SEQ ID NO: 253325 - RNA, 22 nt, Human
accagagcuggcucugagcacc

SEQ ID NO: 253326 - RNA, 22 nt, Human
aacugcauaauauaucaugcag

SEQ ID NO: 253327 - RNA, 22 nt, Human
uguaaacauauguauguaugua

SEQ ID NO: 253328 - RNA, 22 nt, Human
uguucagaacaaagguaaauga

SEQ ID NO: 253329 - RNA, 22 nt, Human
caccauuuaguagcaagagcuc

SEQ ID NO: 253330 - RNA, 19 nt, Human
cuugaaaugagacugaagg

SEQ ID NO: 253331 - RNA, 22 nt, Human
aggcuggcuuugguagcauggu

SEQ ID NO: 253332 - RNA, 22 nt, Human
gcagcuggagccagccagacac

SEQ ID NO: 253333 - RNA, 22 nt, Human
acucuggguccugccauucacu

SEQ ID NO: 253334 - RNA, 22 nt, Human
aagacucuguaucaugagggag

SEQ ID NO: 253335 - RNA, 22 nt, Human
gaggccagaagucugagaucag

SEQ ID NO: 253336 - RNA, 22 nt, Human
gaggaaggaaugcaguguaugc

SEQ ID NO: 253337 - RNA, 22 nt, Human
acccuggggucacccuucucug

SEQ ID NO: 253338 - RNA, 17 nt, Human
uggcaucuuuugcucau

SEQ ID NO: 253339 - RNA, 19 nt, Human
uucauucuuucuacuuacc

SEQ ID NO: 253340 - RNA, 22 nt, Human
cucagcaucaugguaucugggg

SEQ ID NO: 253341 - RNA, 22 nt, Human
gcagccaagaccccaagaacug

SEQ ID NO: 253342 - RNA, 22 nt, Human
agucaguuguggagauuuaacu

SEQ ID NO: 253343 - RNA, 22 nt, Human
agcuggucugcugcauggagug

SEQ ID NO: 253344 - RNA, 22 nt, Human
ggcucuguggcuggccaugaug

SEQ ID NO: 253345 - RNA, 22 nt, Human
agagacuucugccuuagcaaga

SEQ ID NO: 253346 - RNA, 22 nt, Human
acauauguguuguacaugcaug

SEQ ID NO: 253347 - RNA, 22 nt, Human
agguggcaaggggcgccucucu

SEQ ID NO: 253348 - RNA, 22 nt, Human
auuugguagugauugaaauuau

SEQ ID NO: 253349 - RNA, 22 nt, Human
ccaggugucuguggccagcccu

SEQ ID NO: 253350 - RNA, 18 nt, Human
acauuucuaggugaaagc

SEQ ID NO: 253351 - RNA, 19 nt, Human
cuccacagggauugugauu

SEQ ID NO: 253352 - RNA, 22 nt, Human
ugagcccuaccugcucaucucc

SEQ ID NO: 253353 - RNA, 21 nt, Human
uuccuuuuuauggcuuagugg

SEQ ID NO: 253354 - RNA, 22 nt, Human
agucacacacugucaguucugc

SEQ ID NO: 253355 - RNA, 22 nt, Human
uuucaaauggagucgugaaaug

SEQ ID NO: 253356 - RNA, 22 nt, Human
acacauaagaaacuacaaagag

SEQ ID NO: 253357 - RNA, 22 nt, Human
gggcaguggguggcugcagccu

SEQ ID NO: 253358 - RNA, 22 nt, Human
caagaugaaauugugauauuuu

SEQ ID NO: 253359 - RNA, 22 nt, Human
uacaguuacccuggaaagaaau

SEQ ID NO: 253360 - RNA, 22 nt, Human
agauuugggggcuagggcuggu

SEQ ID NO: 253361 - RNA, 22 nt, Human
guuuccugaaguuauuucaucc

SEQ ID NO: 253362 - RNA, 23 nt, Human
auuuuuugucuuuguaacuagau

SEQ ID NO: 253363 - RNA, 22 nt, Human
uccuguggggaaaagccuaucu

SEQ ID NO: 253364 - RNA, 19 nt, Human
gaauacagauaauaagcag

SEQ ID NO: 253365 - RNA, 22 nt, Human
accuccaggaagcucuugguac

SEQ ID NO: 253366 - RNA, 22 nt, Human
gaguuaaaggaaaauaacuuua

SEQ ID NO: 253367 - RNA, 22 nt, Human
cccaggaggcagaaguugcagu

SEQ ID NO: 253368 - RNA, 22 nt, Human
ucccacaugugaauccucaggu

SEQ ID NO: 253369 - RNA, 22 nt, Human
ccaggagcaggagcugcagcug

SEQ ID NO: 253370 - RNA, 22 nt, Human
augggacagggcuggcuggucc

SEQ ID NO: 253371 - RNA, 22 nt, Human
acuccuggggcugccaucacag

SEQ ID NO: 253372 - RNA, 22 nt, Human
ugcagccccuaucgcggacagg

SEQ ID NO: 253373 - RNA, 19 nt, Human
ccuggccagacuucugccc

SEQ ID NO: 253374 - RNA, 22 nt, Human
accaucuuuuccucugccuccu

SEQ ID NO: 253375 - RNA, 22 nt, Human
agcagugccgcaucuugugacc

SEQ ID NO: 253376 - RNA, 22 nt, Human
uucuaguuuccauuuuaagaca

SEQ ID NO: 253377 - RNA, 22 nt, Human
aacugaaacggugaucuuuuaa

SEQ ID NO: 253378 - RNA, 18 nt, Human
uugugaaauauuggaguc

SEQ ID NO: 253379 - RNA, 22 nt, Human
augguauacaauuauggacugu

SEQ ID NO: 253380 - RNA, 22 nt, Human
acagaacuuccagggaacauac

SEQ ID NO: 253381 - RNA, 22 nt, Human
cucugggccaccgcugguguau

SEQ ID NO: 253382 - RNA, 22 nt, Human
cagaggcaggauaagaacugcg

SEQ ID NO: 253383 - RNA, 22 nt, Human
ugcccagcagggagcuaccugg

SEQ ID NO: 253384 - RNA, 22 nt, Human
ugaguggacgugaggcugagua

SEQ ID NO: 253385 - RNA, 22 nt, Human
augugcaugcacuuacaugugu

SEQ ID NO: 253386 - RNA, 23 nt, Human
cagcuccagugcacucagguagc

SEQ ID NO: 253387 - RNA, 22 nt, Human
cuggcugccacuucagggucuu

SEQ ID NO: 253388 - RNA, 22 nt, Human
aagggcuguuauguuuuuauac

SEQ ID NO: 253389 - RNA, 20 nt, Human
aauguauauuuuaugccagg

SEQ ID NO: 253390 - RNA, 19 nt, Human
gggcaugcuggcucuagag

SEQ ID NO: 253391 - RNA, 15 nt, Human
gcaggcagaucaccg

SEQ ID NO: 253392 - RNA, 22 nt, Human
gagggcucuacucaccacccug

SEQ ID NO: 253393 - RNA, 22 nt, Human
uccacaggaaagcaccucccau

SEQ ID NO: 253394 - RNA, 22 nt, Human
acacacaugccuuuccuaagua

SEQ ID NO: 253395 - RNA, 22 nt, Human
gccacagggcagaugcgcagag

SEQ ID NO: 253396 - RNA, 22 nt, Human
caguuaccaucuucagugauga

SEQ ID NO: 253397 - RNA, 22 nt, Human
cugaauuauuuaaggugaaggg

SEQ ID NO: 253398 - RNA, 22 nt, Human
aagacuugaccagguugaaggc

SEQ ID NO: 253399 - RNA, 19 nt, Human
cagcagccagggggccccu

SEQ ID NO: 253400 - RNA, 22 nt, Human
gagaaaggcauuccuaugcaaa

SEQ ID NO: 253401 - RNA, 22 nt, Human
uaguuucagcuccuucauccug

SEQ ID NO: 253402 - RNA, 22 nt, Human
ccugagcuagggaaggaagacc

SEQ ID NO: 253403 - RNA, 22 nt, Human
ugccuguguccccuucuuggca

SEQ ID NO: 253404 - RNA, 22 nt, Human
ggcuguggucauuaggagguug

SEQ ID NO: 253405 - RNA, 22 nt, Human
cccaggcuggagugcaauggug

SEQ ID NO: 253406 - RNA, 22 nt, Human
cuacauguagguuuccuuaauu

SEQ ID NO: 253407 - RNA, 22 nt, Human
cugucccaggauccugacucca

SEQ ID NO: 253408 - RNA, 22 nt, Human
auccacuuggcugguuguucua

SEQ ID NO: 253409 - RNA, 22 nt, Human
cacuucaaauauggcuucauga

SEQ ID NO: 253410 - RNA, 19 nt, Human
gagcccucuccauggccac

SEQ ID NO: 253411 - RNA, 22 nt, Human
gaaaaugagccucagcuacauu

SEQ ID NO: 253412 - RNA, 22 nt, Human
ugaagagugcuugagauuuuaa

SEQ ID NO: 253413 - RNA, 22 nt, Human
accacaggacccaugagucagu

SEQ ID NO: 253414 - RNA, 22 nt, Human
cuggggcuguaggaggacuuau

SEQ ID NO: 253415 - RNA, 22 nt, Human
uacaugagggcacucugcaucu

SEQ ID NO: 253416 - RNA, 22 nt, Human
agccucugguccucccucagcu

SEQ ID NO: 253417 - RNA, 23 nt, Human
uuuaacauuugaacauguggcca

SEQ ID NO: 253418 - RNA, 22 nt, Human
uggaggcauuugauguucauaa

SEQ ID NO: 253419 - RNA, 22 nt, Human
gcuacagacugagcauggcucu

SEQ ID NO: 253420 - RNA, 20 nt, Human
cuucuucagccuaugcuuca

SEQ ID NO: 253421 - RNA, 23 nt, Human
ggguccagagacaggcaugggug

SEQ ID NO: 253422 - RNA, 22 nt, Human
ucugucuuagccaucucaggcu

SEQ ID NO: 253423 - RNA, 22 nt, Human
aauucaugaguagaaucuauau

SEQ ID NO: 253424 - RNA, 22 nt, Human
ucagagcacuuggcucauggca

SEQ ID NO: 253425 - RNA, 22 nt, Human
augcacuacuuggcuuuacuga

SEQ ID NO: 253426 - RNA, 22 nt, Human
aauauacuauacuacuuucugg

SEQ ID NO: 253427 - RNA, 22 nt, Human
agggcugaagggaggugcucau

SEQ ID NO: 253428 - RNA, 22 nt, Human
augucagauccucagaaagucu

SEQ ID NO: 253429 - RNA, 22 nt, Human
aggcugcugccuuggagagugu

SEQ ID NO: 253430 - RNA, 22 nt, Human
acccaggggcgaagcuggccac

SEQ ID NO: 253431 - RNA, 22 nt, Human
uuauacacaauucuuuuacuac

SEQ ID NO: 253432 - RNA, 22 nt, Human
ucagaacagcucucagauaucc

SEQ ID NO: 253433 - RNA, 22 nt, Human
uaaugcaacgugagauaauuaa

SEQ ID NO: 253434 - RNA, 20 nt, Human
uugaaugaaugucuggcuca

SEQ ID NO: 253435 - RNA, 22 nt, Human
acagcagguagcuuugugccuc

SEQ ID NO: 253436 - RNA, 23 nt, Human
gugugcaggauuauuugcagaca

SEQ ID NO: 253437 - RNA, 22 nt, Human
ccagaagauggcucaaaccaug

SEQ ID NO: 253438 - RNA, 22 nt, Human
ggagcucagaagugagugaguu

SEQ ID NO: 253439 - RNA, 22 nt, Human
auucauuagccacuaacuagca

SEQ ID NO: 253440 - RNA, 22 nt, Human
gggcuggcaucgguugcugaga

SEQ ID NO: 253441 - RNA, 22 nt, Human
aacacuucucaucacugcaagc

SEQ ID NO: 253442 - RNA, 22 nt, Human
caguuucuacgaaggucaaccc

SEQ ID NO: 253443 - RNA, 22 nt, Human
gcuuccugagaaacaaucugau

SEQ ID NO: 253444 - RNA, 22 nt, Human
aaauugcugacacuugaccauu

SEQ ID NO: 253445 - RNA, 22 nt, Human
ugcucgagguccccaccggcuc

SEQ ID NO: 253446 - RNA, 16 nt, Human
agcagccagcacugga

SEQ ID NO: 253447 - RNA, 22 nt, Human
caagacuuagagcaucuugaaa

SEQ ID NO: 253448 - RNA, 21 nt, Human
auaguuuggagugggaaaguc

SEQ ID NO: 253449 - RNA, 22 nt, Human
cugccuagcgccaucugccucu

SEQ ID NO: 253450 - RNA, 22 nt, Human
ucacauuugcaauugcauuguu

SEQ ID NO: 253451 - RNA, 22 nt, Human
accauuuaaggaaaauguauca

SEQ ID NO: 253452 - RNA, 22 nt, Human
gggacauggaggcgcgcaggca

SEQ ID NO: 253453 - RNA, 22 nt, Human
auagacaaacacgaagaugaca

SEQ ID NO: 253454 - RNA, 22 nt, Human
aauauaauuuuauuccuagagu

SEQ ID NO: 253455 - RNA, 22 nt, Human
cagcucuggcagagcccaaccc

SEQ ID NO: 253456 - RNA, 22 nt, Human
agaaacucuaggucaauugagg

SEQ ID NO: 253457 - RNA, 22 nt, Human
ugagagccagaagggccugagg

SEQ ID NO: 253458 - RNA, 22 nt, Human
agaggcaugcacagaugugcug

SEQ ID NO: 253459 - RNA, 22 nt, Human
gcuggcaggauaacuucuaagc

SEQ ID NO: 253460 - RNA, 22 nt, Human
ugcuggcuuauuuaguaaaugu

SEQ ID NO: 253461 - RNA, 22 nt, Human
ugaguccugcucugggcagggu

SEQ ID NO: 253462 - RNA, 22 nt, Human
cuggaucuaaagguggauguag

SEQ ID NO: 253463 - RNA, 22 nt, Human
uggcugagaaaaugguuuuagg

SEQ ID NO: 253464 - RNA, 22 nt, Human
gcccucagaguuccccacagug

SEQ ID NO: 253465 - RNA, 22 nt, Human
cugggaggcaccgcgucgugcu

SEQ ID NO: 253466 - RNA, 22 nt, Human
ugaugugugauucauucucaaa

SEQ ID NO: 253467 - RNA, 22 nt, Human
cuuccuggaugagcaggcugau

SEQ ID NO: 253468 - RNA, 22 nt, Human
guuaucaugcuucaucaucacu

SEQ ID NO: 253469 - RNA, 22 nt, Human
cucugaaaguuagagaaaauag

SEQ ID NO: 253470 - RNA, 22 nt, Human
gaagaacgucuuauaaauucac

SEQ ID NO: 253471 - RNA, 22 nt, Human
ucuguggaguuagacugguauc

SEQ ID NO: 253472 - RNA, 22 nt, Human
uauucagaguauuccaugaggu

SEQ ID NO: 253473 - RNA, 22 nt, Human
aacccaggucuuuggcuuccag

SEQ ID NO: 253474 - RNA, 22 nt, Human
aaugccaaugggcagaacuaga

SEQ ID NO: 253475 - RNA, 22 nt, Human
uuacacaacagugcaucagcag

SEQ ID NO: 253476 - RNA, 22 nt, Human
caggaugagaagggcucuuacg

SEQ ID NO: 253477 - RNA, 22 nt, Human
caucacauuagucucaagagaa

SEQ ID NO: 253478 - RNA, 21 nt, Human
caggaaacugaggccaugggg

SEQ ID NO: 253479 - RNA, 22 nt, Human
aguggcuggagccccaggcugg

SEQ ID NO: 253480 - RNA, 19 nt, Human
uccauaaugaagauagagg

SEQ ID NO: 253481 - RNA, 19 nt, Human
ucuugcagccccagcaggc

SEQ ID NO: 253482 - RNA, 22 nt, Human
ugcucaucaacaugaugaucau

SEQ ID NO: 253483 - RNA, 22 nt, Human
gggccaagggugcguggcagga

SEQ ID NO: 253484 - RNA, 22 nt, Human
augcaauauagggaagauagau

SEQ ID NO: 253485 - RNA, 22 nt, Human
aaauauaauuucugccucaaua

SEQ ID NO: 253486 - RNA, 22 nt, Human
agauggggcagaauggagccau

SEQ ID NO: 253487 - RNA, 22 nt, Human
cuccaggcgccgcuuuugcagu

SEQ ID NO: 253488 - RNA, 22 nt, Human
ucuccaggugaaacuugcaggg

SEQ ID NO: 253489 - RNA, 22 nt, Human
cuuccucaugugcaaugcaagc

SEQ ID NO: 253490 - RNA, 22 nt, Human
aagggccauugcugagagcagu

SEQ ID NO: 253491 - RNA, 22 nt, Human
acauaugugcuuauauccauga

SEQ ID NO: 253492 - RNA, 20 nt, Human
gugcccugugggcuauuuuc

SEQ ID NO: 253493 - RNA, 21 nt, Human
uccagcuccugccacuccuua

SEQ ID NO: 253494 - RNA, 22 nt, Human
ugacaguauugauggcaggauu

SEQ ID NO: 253495 - RNA, 22 nt, Human
uccauucuuuuuaccucucaga

SEQ ID NO: 253496 - RNA, 22 nt, Human
ugucuccauuuucaaguagcag

SEQ ID NO: 253497 - RNA, 22 nt, Human
agcaccaggaaagaaggggcca

SEQ ID NO: 253498 - RNA, 22 nt, Human
ucaggguaaaccuucacuguga

SEQ ID NO: 253499 - RNA, 22 nt, Human
agugucuuacucccucaggcac

SEQ ID NO: 253500 - RNA, 22 nt, Human
gcagcagggagcagggguguca

SEQ ID NO: 253501 - RNA, 22 nt, Human
agagacacaucauauaaguaua

SEQ ID NO: 253502 - RNA, 22 nt, Human
acuccuggaaaagaacgcaggg

SEQ ID NO: 253503 - RNA, 22 nt, Human
gcuggcuuuauggggcuugugg

SEQ ID NO: 253504 - RNA, 22 nt, Human
ucacaggacagccuuccacccg

SEQ ID NO: 253505 - RNA, 22 nt, Human
uuacuaaggacucuaaguucua

SEQ ID NO: 253506 - RNA, 22 nt, Human
ggcuucccugccucacuuauuc

SEQ ID NO: 253507 - RNA, 19 nt, Human
cagccucaaucccucgggc

SEQ ID NO: 253508 - RNA, 17 nt, Human
cugggccuccccugucc

SEQ ID NO: 253509 - RNA, 20 nt, Human
ccagagcugauggcugcccg

SEQ ID NO: 253510 - RNA, 22 nt, Human
guacauuuuacuuuguuugaau

SEQ ID NO: 253511 - RNA, 22 nt, Human
agacccucuccucauggacaug

SEQ ID NO: 253512 - RNA, 22 nt, Human
ugcugcaguucacccugccguc

SEQ ID NO: 253513 - RNA, 22 nt, Human
cacuuaaaacuccuggaauugu

SEQ ID NO: 253514 - RNA, 22 nt, Human
agugugaguuugguugagacuu

SEQ ID NO: 253515 - RNA, 19 nt, Human
gcaggacucccagcuccuc

SEQ ID NO: 253516 - RNA, 22 nt, Human
cugcaggacgaccgccucaucu

SEQ ID NO: 253517 - RNA, 22 nt, Human
aauucauugccagaaucuauga

SEQ ID NO: 253518 - RNA, 20 nt, Human
ucacaauaugagcucauaca

SEQ ID NO: 253519 - RNA, 22 nt, Human
agcccagaugguagcccuagaa

SEQ ID NO: 253520 - RNA, 22 nt, Human
cugcugcccuagacccaguccu

SEQ ID NO: 253521 - RNA, 22 nt, Human
cccucucucaggcugacagccu

SEQ ID NO: 253522 - RNA, 22 nt, Human
ucacacacauaaucuaagauua

SEQ ID NO: 253523 - RNA, 22 nt, Human
gaguccuuuucucuguccacug

SEQ ID NO: 253524 - RNA, 22 nt, Human
gggacaggccccucgcuagcuu

SEQ ID NO: 253525 - RNA, 22 nt, Human
agcagguguagggcucuuugua

SEQ ID NO: 253526 - RNA, 17 nt, Human
aaccagcuguccccucc

SEQ ID NO: 253527 - RNA, 22 nt, Human
ccagcacucuauugaauauucu

SEQ ID NO: 253528 - RNA, 22 nt, Human
uccugcuggaaacuuccucuug

SEQ ID NO: 253529 - RNA, 22 nt, Human
uucaacaucaagaaugcaugga

SEQ ID NO: 253530 - RNA, 22 nt, Human
gacuuuauccugccugaccacg

SEQ ID NO: 253531 - RNA, 22 nt, Human
acuguccaagcaugccuggcuu

SEQ ID NO: 253532 - RNA, 20 nt, Human
uuugacucaggccuuuagcc

SEQ ID NO: 253533 - RNA, 22 nt, Human
acaugccaugaagguauuuuug

SEQ ID NO: 253534 - RNA, 22 nt, Human
ucaacagaagugauagcuauua

SEQ ID NO: 253535 - RNA, 22 nt, Human
cuauuucauugugcugagucug

SEQ ID NO: 253536 - RNA, 17 nt, Human
cugaggagaacagaaag

SEQ ID NO: 253537 - RNA, 22 nt, Human
agcuggcuauacuugaaaaguc

SEQ ID NO: 253538 - RNA, 22 nt, Human
ugggggcugaguaagaugagau

SEQ ID NO: 253539 - RNA, 22 nt, Human
ugaaacaggaaguaaacagaca

SEQ ID NO: 253540 - RNA, 22 nt, Human
cuuucugauuuuaagcucuaau

SEQ ID NO: 253541 - RNA, 22 nt, Human
guugugcagaagugccucagua

SEQ ID NO: 253542 - RNA, 22 nt, Human
agguuacagugauuauagguuu

SEQ ID NO: 253543 - RNA, 22 nt, Human
guguggcagggcguuugcagac

SEQ ID NO: 253544 - RNA, 22 nt, Human
agcaggucuugcucucaacagg

SEQ ID NO: 253545 - RNA, 22 nt, Human
caguucugacuuucauaauguc

SEQ ID NO: 253546 - RNA, 22 nt, Human
cagcugaguggacccuagaggc

SEQ ID NO: 253547 - RNA, 22 nt, Human
gcccaggagaggccagggcuga

SEQ ID NO: 253548 - RNA, 22 nt, Human
ugcuuuaaaauggacuguuuug

SEQ ID NO: 253549 - RNA, 22 nt, Human
ggauaguucuggauauuuuaag

SEQ ID NO: 253550 - RNA, 22 nt, Human
aucuuuggacggucccaacuga

SEQ ID NO: 253551 - RNA, 22 nt, Human
uaucaucuuguugucaugcagc

SEQ ID NO: 253552 - RNA, 22 nt, Human
accaggaguuuugaccaggggc

SEQ ID NO: 253553 - RNA, 20 nt, Human
augcacccucagggucccug

SEQ ID NO: 253554 - RNA, 22 nt, Human
ccaguuugaggaagaaguagau

SEQ ID NO: 253555 - RNA, 22 nt, Human
ugagcucuucuaacuaauugug

SEQ ID NO: 253556 - RNA, 22 nt, Human
cuggcuucugggccagggcaga

SEQ ID NO: 253557 - RNA, 22 nt, Human
uagcagagcagggaucagagcc

SEQ ID NO: 253558 - RNA, 22 nt, Human
gacaggcuuugagucccagaac

SEQ ID NO: 253559 - RNA, 22 nt, Human
ugacaccaaggaaguaucauuu

SEQ ID NO: 253560 - RNA, 22 nt, Human
ugcccaggaucuggcgaugcuc

SEQ ID NO: 253561 - RNA, 21 nt, Human
aaucaagaguacugguguggc

SEQ ID NO: 253562 - RNA, 22 nt, Human
auuacaguaaaugcuacaggca

SEQ ID NO: 253563 - RNA, 22 nt, Human
uuaacacuaucugucauaauua

SEQ ID NO: 253564 - RNA, 22 nt, Human
acagugucaucaguuucucaac

SEQ ID NO: 253565 - RNA, 22 nt, Human
gcccuccaccuggucucucugg

SEQ ID NO: 253566 - RNA, 22 nt, Human
aucagcaaucucguguauuagg

SEQ ID NO: 253567 - RNA, 22 nt, Human
ccagccuuacugcccuucagug

SEQ ID NO: 253568 - RNA, 22 nt, Human
gccuguuuguuugcaaaggagc

SEQ ID NO: 253569 - RNA, 18 nt, Human
aagggcuggccuuuggag

SEQ ID NO: 253570 - RNA, 22 nt, Human
auuugcuggugaauguauagcu

SEQ ID NO: 253571 - RNA, 22 nt, Human
agcagaguuucucaacaucagc

SEQ ID NO: 253572 - RNA, 22 nt, Human
ccugagaggcccucucacuguc

SEQ ID NO: 253573 - RNA, 22 nt, Human
gcaugcaguaaaauucagcaac

SEQ ID NO: 253574 - RNA, 22 nt, Human
ugcacuacugugauacacagcc

SEQ ID NO: 253575 - RNA, 19 nt, Human
ugcuuugcucuuggacuca

SEQ ID NO: 253576 - RNA, 22 nt, Human
acaugacagggaaugaggugaa

SEQ ID NO: 253577 - RNA, 22 nt, Human
ugcagauucaaaugaaaugcaa

SEQ ID NO: 253578 - RNA, 22 nt, Human
agugucugagccagaauuagaa

SEQ ID NO: 253579 - RNA, 19 nt, Human
ugggaaaguaacauacaaa

SEQ ID NO: 253580 - RNA, 22 nt, Human
gccugagagucugcauuucuaa

SEQ ID NO: 253581 - RNA, 22 nt, Human
uuucacaucaugggauggaagc

SEQ ID NO: 253582 - RNA, 22 nt, Human
uguguauguuuugagguugcua

SEQ ID NO: 253583 - RNA, 22 nt, Human
acaaagauucauuugcauuauu

SEQ ID NO: 253584 - RNA, 22 nt, Human
gucaaaaaguagucauuucugu

SEQ ID NO: 253585 - RNA, 22 nt, Human
ccaggcugagcaugauuggagc

SEQ ID NO: 253586 - RNA, 22 nt, Human
augaaaagcauaaacgcugaag

SEQ ID NO: 253587 - RNA, 20 nt, Human
gaaaauaggccagccaggua

SEQ ID NO: 253588 - RNA, 22 nt, Human
cuucccagcaccucagucuggc

SEQ ID NO: 253589 - RNA, 22 nt, Human
aaagccagggacagugugcaug

SEQ ID NO: 253590 - RNA, 22 nt, Human
agagaagggguaaagaguccug

SEQ ID NO: 253591 - RNA, 22 nt, Human
auagggcugccaucacagaaga

SEQ ID NO: 253592 - RNA, 22 nt, Human
aauaguguuguucacucaggag

SEQ ID NO: 253593 - RNA, 22 nt, Human
aggcuagaggcuucuggcuuca

SEQ ID NO: 253594 - RNA, 22 nt, Human
auuguuuaaagauacaucccug

SEQ ID NO: 253595 - RNA, 22 nt, Human
ggcucaggaccugggauugcca

SEQ ID NO: 253596 - RNA, 22 nt, Human
ggcuccaggcuccuauuucacu

SEQ ID NO: 253597 - RNA, 20 nt, Human
uuucuguagcucaguauuca

SEQ ID NO: 253598 - RNA, 22 nt, Human
aguauuugaucagaugauagua

SEQ ID NO: 253599 - RNA, 22 nt, Human
agcauuagauuaaaaauuuaga

SEQ ID NO: 253600 - RNA, 22 nt, Human
ugacaaagugaggucuucagua

SEQ ID NO: 253601 - RNA, 22 nt, Human
uugcauucccagccaaguuagu

SEQ ID NO: 253602 - RNA, 22 nt, Human
aaaaaagauugaugguggaugc

SEQ ID NO: 253603 - RNA, 22 nt, Human
ccucuuugagauucaguuuucc

SEQ ID NO: 253604 - RNA, 22 nt, Human
aagcauuucagguagagauauu

SEQ ID NO: 253605 - RNA, 22 nt, Human
uaaaugcaaugugcuuuaccag

SEQ ID NO: 253606 - RNA, 22 nt, Human
auuaagacugcccauguuuuua

SEQ ID NO: 253607 - RNA, 22 nt, Human
uguaauuuccugauguuagaac

SEQ ID NO: 253608 - RNA, 22 nt, Human
uuaauuuuaaccuguuuguguc

SEQ ID NO: 253609 - RNA, 22 nt, Human
ugacacagauuagagacauacc

SEQ ID NO: 253610 - RNA, 19 nt, Human
ugaagcaggcagagaagau

SEQ ID NO: 253611 - RNA, 22 nt, Human
caaagcugacgaggucagcauc

SEQ ID NO: 253612 - RNA, 22 nt, Human
uccagcagguguuugccaacuu

SEQ ID NO: 253613 - RNA, 20 nt, Human
gggcuagguagccauuuggc

SEQ ID NO: 253614 - RNA, 22 nt, Human
augcacaggcugugggcugguu

SEQ ID NO: 253615 - RNA, 17 nt, Human
cuccuggccaccccucu

SEQ ID NO: 253616 - RNA, 22 nt, Human
gacuuucuguccagugauuucu

SEQ ID NO: 253617 - RNA, 22 nt, Human
aaaguagcuuaguugauauuuc

SEQ ID NO: 253618 - RNA, 18 nt, Human
cugggcucgagagauccu

SEQ ID NO: 253619 - RNA, 22 nt, Human
uaucagcaccgcggacagcauc

SEQ ID NO: 253620 - RNA, 22 nt, Human
uuucuaggacaugauaggauau

SEQ ID NO: 253621 - RNA, 20 nt, Human
agugacugggagaauggauu

SEQ ID NO: 253622 - RNA, 22 nt, Human
caguuacaugcucaugucauca

SEQ ID NO: 253623 - RNA, 22 nt, Human
ucauuuacauagaaacaauaua

SEQ ID NO: 253624 - RNA, 22 nt, Human
auuauauuugaaagguuggaag

SEQ ID NO: 253625 - RNA, 22 nt, Human
ggguugaggcggaugucggcgg

SEQ ID NO: 253626 - RNA, 22 nt, Human
ucucauuugccucaucuauaaa

SEQ ID NO: 253627 - RNA, 22 nt, Human
uucuguaucucuguguuucuug

SEQ ID NO: 253628 - RNA, 22 nt, Human
ccagcaggggaauauuuuuagg

SEQ ID NO: 253629 - RNA, 22 nt, Human
cuguccugggggugguccuugc

SEQ ID NO: 253630 - RNA, 22 nt, Human
uuccuccuucccauuccugggg

SEQ ID NO: 253631 - RNA, 22 nt, Human
ugagacaggcuuccuucuuggg

SEQ ID NO: 253632 - RNA, 22 nt, Human
uacaguuucccagcagaugcaa

SEQ ID NO: 253633 - RNA, 22 nt, Human
gcaggagguugagccaggacug

SEQ ID NO: 253634 - RNA, 22 nt, Human
caggacuggcucgcagugggug

SEQ ID NO: 253635 - RNA, 22 nt, Human
cgcugcagacgcgcuggcgaaa

SEQ ID NO: 253636 - RNA, 22 nt, Human
aggaagaaaacuaauuagaugg

SEQ ID NO: 253637 - RNA, 22 nt, Human
caacuuuagcaauguuaguaua

SEQ ID NO: 253638 - RNA, 22 nt, Human
cuguuuauaaaccaccaguuua

SEQ ID NO: 253639 - RNA, 21 nt, Human
aggcccuggaggucagagaaa

SEQ ID NO: 253640 - RNA, 22 nt, Human
cuccugagaggaucucuguugu

SEQ ID NO: 253641 - RNA, 20 nt, Human
cagucccaauccagggccag

SEQ ID NO: 253642 - RNA, 22 nt, Human
aggcaguuggucauugcucuuu

SEQ ID NO: 253643 - RNA, 22 nt, Human
cuucauuucaggcugaagaaua

SEQ ID NO: 253644 - RNA, 22 nt, Human
aggcuggggaauugaauuugcu

SEQ ID NO: 253645 - RNA, 22 nt, Human
gaaaagaguccugugugaggag

SEQ ID NO: 253646 - RNA, 22 nt, Human
guggaaugaauagauuugcauu

SEQ ID NO: 253647 - RNA, 22 nt, Human
caaaggcaaucuuguucucugg

SEQ ID NO: 253648 - RNA, 22 nt, Human
aagguacaguuuuaagaauaag

SEQ ID NO: 253649 - RNA, 22 nt, Human
augauuuuucagcagaggaucu

SEQ ID NO: 253650 - RNA, 22 nt, Human
ccugagcaaaggaaggaugacu

SEQ ID NO: 253651 - RNA, 22 nt, Human
gucuggaaauuuaagguaugag

SEQ ID NO: 253652 - RNA, 22 nt, Human
cucuccaggcgagguccuacug

SEQ ID NO: 253653 - RNA, 22 nt, Human
cugccaaaaggugcaccugcug

SEQ ID NO: 253654 - RNA, 22 nt, Human
guuagacaugcagaaucucagg

SEQ ID NO: 253655 - RNA, 20 nt, Human
uccaggcuccuccacuuagu

SEQ ID NO: 253656 - RNA, 22 nt, Human
cuagagaaacgccgugggagga

SEQ ID NO: 253657 - RNA, 22 nt, Human
gccuccugguugcuucuccaac

SEQ ID NO: 253658 - RNA, 22 nt, Human
uaaauucuacaacuucaaagau

SEQ ID NO: 253659 - RNA, 22 nt, Human
ggcaagaaggcuucagguagcu

SEQ ID NO: 253660 - RNA, 22 nt, Human
ucuggcccaugauccugcuaac

SEQ ID NO: 253661 - RNA, 22 nt, Human
uacuucugcaccaaccuuaaua

SEQ ID NO: 253662 - RNA, 22 nt, Human
aacaggcuaguuuuaaagcaua

SEQ ID NO: 253663 - RNA, 19 nt, Human
auagagacagaguuuaauc

SEQ ID NO: 253664 - RNA, 22 nt, Human
uucucacaggaaguaggacuuu

SEQ ID NO: 253665 - RNA, 22 nt, Human
cacagaaauuauuaggaugcuu

SEQ ID NO: 253666 - RNA, 22 nt, Human
cagcuccucagcccugccuugg

SEQ ID NO: 253667 - RNA, 22 nt, Human
uagggcuauucugaguaauaau

SEQ ID NO: 253668 - RNA, 22 nt, Human
gccucugggcucugccccuggc

SEQ ID NO: 253669 - RNA, 22 nt, Human
uuccugggcuuuccccucuggu

SEQ ID NO: 253670 - RNA, 22 nt, Human
uugauacauuuuuaggauaaac

SEQ ID NO: 253671 - RNA, 22 nt, Human
cacugagaaagugaccugccaa

SEQ ID NO: 253672 - RNA, 22 nt, Human
uagcaaaaaaacuggcaucucc

SEQ ID NO: 253673 - RNA, 22 nt, Human
aguguggcugcguagggcucuc

SEQ ID NO: 253674 - RNA, 22 nt, Human
acagaacugcaggaggaaaagc

SEQ ID NO: 253675 - RNA, 22 nt, Human
ucuggcugcugcgugagugcuu

SEQ ID NO: 253676 - RNA, 22 nt, Human
uaacacacugaaggugagaugg

SEQ ID NO: 253677 - RNA, 22 nt, Human
ucaguuuauaaauuguauuuag

SEQ ID NO: 253678 - RNA, 22 nt, Human
uacaguuuguuacauuguuagu

SEQ ID NO: 253679 - RNA, 20 nt, Human
uaaagacauaagcuacuauc

SEQ ID NO: 253680 - RNA, 22 nt, Human
uacauuuucuaggggaccaaga

SEQ ID NO: 253681 - RNA, 22 nt, Human
cacacaggaugaagcagcagaa

SEQ ID NO: 253682 - RNA, 22 nt, Human
uuaccaaaugaaauagagauuu

SEQ ID NO: 253683 - RNA, 22 nt, Human
acauggcacccagaucucaaaa

SEQ ID NO: 253684 - RNA, 22 nt, Human
auccaggcuggguguggcuacu

SEQ ID NO: 253685 - RNA, 22 nt, Human
aagcaucuaggugacugacaua

SEQ ID NO: 253686 - RNA, 22 nt, Human
uaguuucuaaagcuuccuaggu

SEQ ID NO: 253687 - RNA, 22 nt, Human
gacccuuagaaugugaucuuau

SEQ ID NO: 253688 - RNA, 19 nt, Human
aaccuuagcuucucaggcc

SEQ ID NO: 253689 - RNA, 22 nt, Human
cccugagaugccucacccuagu

SEQ ID NO: 253690 - RNA, 22 nt, Human
ucugaagccaccucugcuuguc

SEQ ID NO: 253691 - RNA, 22 nt, Human
gauuucuaaggaggcugaacuu

SEQ ID NO: 253692 - RNA, 22 nt, Human
gaaucuaugccucauauagacc

SEQ ID NO: 253693 - RNA, 22 nt, Human
uacagcgaaaauuuagcuugau

SEQ ID NO: 253694 - RNA, 22 nt, Human
uggagggaacaaaggaguccca

SEQ ID NO: 253695 - RNA, 22 nt, Human
ucagagcuaaggggagagcaaa

SEQ ID NO: 253696 - RNA, 22 nt, Human
uggcugggccgggccuugugcc

SEQ ID NO: 253697 - RNA, 22 nt, Human
gagggcugcaaugagacagaga

SEQ ID NO: 253698 - RNA, 18 nt, Human
gccaggcaggguggggaa

SEQ ID NO: 253699 - RNA, 22 nt, Human
uucugggacaucuggacaguuu

SEQ ID NO: 253700 - RNA, 22 nt, Human
aaagcaagaugcauccgucaag

SEQ ID NO: 253701 - RNA, 22 nt, Human
gagucucugggagggaaagaag

SEQ ID NO: 253702 - RNA, 22 nt, Human
ggcuuuauuaagcaggguaagu

SEQ ID NO: 253703 - RNA, 22 nt, Human
ucagucaggagaugccagagau

SEQ ID NO: 253704 - RNA, 22 nt, Human
acacucuacagagcaaucuacc

SEQ ID NO: 253705 - RNA, 22 nt, Human
ggcaguggcauguggguagugg

SEQ ID NO: 253706 - RNA, 22 nt, Human
agaauuuuugauuaucuacucg

SEQ ID NO: 253707 - RNA, 22 nt, Human
uaaaauagcaugugcagugaaa

SEQ ID NO: 253708 - RNA, 22 nt, Human
gaggcuucccgcccaugcugga

SEQ ID NO: 253709 - RNA, 22 nt, Human
uccaggaguccuggguggcccc

SEQ ID NO: 253710 - RNA, 22 nt, Human
gcucagagcagaugguacucag

SEQ ID NO: 253711 - RNA, 20 nt, Human
ucacacauaagugaacgcac

SEQ ID NO: 253712 - RNA, 20 nt, Human
ccaggcuggcaaaugggggc

SEQ ID NO: 253713 - RNA, 22 nt, Human
ugcagggaaaguguuggcagca

SEQ ID NO: 253714 - RNA, 22 nt, Human
uucacaauuaacuuuauacuua

SEQ ID NO: 253715 - RNA, 22 nt, Human
ggaucugggcucugccaaucag

SEQ ID NO: 253716 - RNA, 22 nt, Human
uggaugugagaaggaucaggcu

SEQ ID NO: 253717 - RNA, 22 nt, Human
gaugagugauguugaagaaggu

SEQ ID NO: 253718 - RNA, 20 nt, Human
uuccagccgccacuuccgcc

SEQ ID NO: 253719 - RNA, 22 nt, Human
ccucaggcugucuuccuucugg

SEQ ID NO: 253720 - RNA, 22 nt, Human
aaauguuucuacuugugagcau

SEQ ID NO: 253721 - RNA, 22 nt, Human
ucuuaguuguuugcugucuaac

SEQ ID NO: 253722 - RNA, 22 nt, Human
uacaugcauguguguaaauaua

SEQ ID NO: 253723 - RNA, 22 nt, Human
ugggagcacccugaggagcuuc

SEQ ID NO: 253724 - RNA, 22 nt, Human
uuacauguucucauacacagag

SEQ ID NO: 253725 - RNA, 22 nt, Human
agaucagauucugccuuuguga

SEQ ID NO: 253726 - RNA, 22 nt, Human
gcugggcuggccgccgagaucg

SEQ ID NO: 253727 - RNA, 22 nt, Human
acagguggacacagcagcaguc

SEQ ID NO: 253728 - RNA, 22 nt, Human
gcuuagcaaugugacaagaugc

SEQ ID NO: 253729 - RNA, 22 nt, Human
ccuggcucaguguugaaggggu

SEQ ID NO: 253730 - RNA, 19 nt, Human
ucuccaggugccccaaaca

SEQ ID NO: 253731 - RNA, 20 nt, Human
agcaccuguguagaagcauc

SEQ ID NO: 253732 - RNA, 22 nt, Human
caccaggcugagccucucaucu

SEQ ID NO: 253733 - RNA, 22 nt, Human
uggggguguccuggugcacaca

SEQ ID NO: 253734 - RNA, 22 nt, Human
gggcucuggacccaggcaagag

SEQ ID NO: 253735 - RNA, 22 nt, Human
uguuuaacuaguuuucacacuu

SEQ ID NO: 253736 - RNA, 20 nt, Human
aggcugggguguuuugccca

SEQ ID NO: 253737 - RNA, 22 nt, Human
uaguaagcacauggacaagugg

SEQ ID NO: 253738 - RNA, 22 nt, Human
gugcaagcaguacacucaaagc

SEQ ID NO: 253739 - RNA, 22 nt, Human
uaggguacaugugcacaacaug

SEQ ID NO: 253740 - RNA, 22 nt, Human
ucuguacaccaggggccauucu

SEQ ID NO: 253741 - RNA, 22 nt, Human
uuucuacaauuuuuggcaugag

SEQ ID NO: 253742 - RNA, 22 nt, Human
aacauuuaugguagucauugca

SEQ ID NO: 253743 - RNA, 22 nt, Human
acuucucuuccccggaacucua

SEQ ID NO: 253744 - RNA, 22 nt, Human
ccugccagucacuaugucaccu

SEQ ID NO: 253745 - RNA, 23 nt, Human
uugaggcaaacucuuuucugaaa

SEQ ID NO: 253746 - RNA, 22 nt, Human
uauugcugccaggacccuaucc

SEQ ID NO: 253747 - RNA, 22 nt, Human
cccaggcagggacgugcucugg

SEQ ID NO: 253748 - RNA, 22 nt, Human
aacaaauuaguugcaagacugg

SEQ ID NO: 253749 - RNA, 22 nt, Human
cuguccugauggugccacuggu

SEQ ID NO: 253750 - RNA, 22 nt, Human
agucugugacucauuggaucuc

SEQ ID NO: 253751 - RNA, 22 nt, Human
ugggauaauaaauagaggcaga

SEQ ID NO: 253752 - RNA, 22 nt, Human
uccugaccacacugccuucugc

SEQ ID NO: 253753 - RNA, 22 nt, Human
cuccuggugcuggggcugccgc

SEQ ID NO: 253754 - RNA, 17 nt, Human
gaaagcaucacaugcuc

SEQ ID NO: 253755 - RNA, 22 nt, Human
uuucagaugugugucucugaag

SEQ ID NO: 253756 - RNA, 22 nt, Human
ugaugaaaaccagaacucucau

SEQ ID NO: 253757 - RNA, 22 nt, Human
aaguaguuggaaauaagacaga

SEQ ID NO: 253758 - RNA, 22 nt, Human
auauuaaugggauuuagucagg

SEQ ID NO: 253759 - RNA, 23 nt, Human
acuuaaaugguucuuuaucucag

SEQ ID NO: 253760 - RNA, 21 nt, Human
ccaggcagagcugugaguucu

SEQ ID NO: 253761 - RNA, 22 nt, Human
gagaggccauggcugugcagug

SEQ ID NO: 253762 - RNA, 22 nt, Human
ggcugugaaguagcaggggcag

SEQ ID NO: 253763 - RNA, 22 nt, Human
gaucuuuucagguuucucuagu

SEQ ID NO: 253764 - RNA, 22 nt, Human
aaaagcaguuuauagucaguug

SEQ ID NO: 253765 - RNA, 23 nt, Human
agagcaaggaaaugaggugugau

SEQ ID NO: 253766 - RNA, 22 nt, Human
gaugaggggucauuggcuggga

SEQ ID NO: 253767 - RNA, 22 nt, Human
cucagaagaaucagcagcuauu

SEQ ID NO: 253768 - RNA, 23 nt, Human
uccaggcaugagcucuggaugga

SEQ ID NO: 253769 - RNA, 22 nt, Human
uaguuacacauggguagggaau

SEQ ID NO: 253770 - RNA, 22 nt, Human
aauuucagaacccaaauuagcg

SEQ ID NO: 253771 - RNA, 22 nt, Human
ccuguaggauauuguagaauac

SEQ ID NO: 253772 - RNA, 22 nt, Human
uuuaaauguuuauagagaguac

SEQ ID NO: 253773 - RNA, 22 nt, Human
aguggcugcuucugguugcucc

SEQ ID NO: 253774 - RNA, 22 nt, Human
gaggcucccuuuagguccagau

SEQ ID NO: 253775 - RNA, 22 nt, Human
caggaggugacuuccagggguu

SEQ ID NO: 253776 - RNA, 22 nt, Human
uuuaaauuauaguuaaugucug

SEQ ID NO: 253777 - RNA, 16 nt, Human
aagccuaaauuacaga

SEQ ID NO: 253778 - RNA, 20 nt, Human
aaugucuugagacauuucag

SEQ ID NO: 253779 - RNA, 22 nt, Human
agcuugacagacagaugguagc

SEQ ID NO: 253780 - RNA, 22 nt, Human
cagagcugguguuacaagucca

SEQ ID NO: 253781 - RNA, 22 nt, Human
ucuagggagaguuguuaugggu

SEQ ID NO: 253782 - RNA, 22 nt, Human
ucacagaaguguagugaggaaa

SEQ ID NO: 253783 - RNA, 22 nt, Human
agugguauaagucugaagauca

SEQ ID NO: 253784 - RNA, 22 nt, Human
caauagaaaacucaauacuuaa

SEQ ID NO: 253785 - RNA, 22 nt, Human
aaagcaguccuucccuuaaggu

SEQ ID NO: 253786 - RNA, 22 nt, Human
gccagaugccguaaagaugggc

SEQ ID NO: 253787 - RNA, 22 nt, Human
gcugcagggcucucacaggggg

SEQ ID NO: 253788 - RNA, 22 nt, Human
gaaagcacaguucugaccaugu

SEQ ID NO: 253789 - RNA, 22 nt, Human
uauugcugacugucuucugagu

SEQ ID NO: 253790 - RNA, 22 nt, Human
uugucugacuucuuuaguuacu

SEQ ID NO: 253791 - RNA, 22 nt, Human
aaucuacauagagaucaaauga

SEQ ID NO: 253792 - RNA, 22 nt, Human
cuccugagaauuuucaguugga

SEQ ID NO: 253793 - RNA, 22 nt, Human
cccugaccaccagcuccauuug

SEQ ID NO: 253794 - RNA, 22 nt, Human
ggaacuuuuuaacaagcugcug

SEQ ID NO: 253795 - RNA, 22 nt, Human
agaaucagaugaagacuccugc

SEQ ID NO: 253796 - RNA, 22 nt, Human
ggccccagguagaagauauaga

SEQ ID NO: 253797 - RNA, 22 nt, Human
uaguuacagaucuaggacuguu

SEQ ID NO: 253798 - RNA, 22 nt, Human
aaggcagagggcuggaucagag

SEQ ID NO: 253799 - RNA, 22 nt, Human
ugcuuuaaccaucuuguuugga

SEQ ID NO: 253800 - RNA, 20 nt, Human
augugagggguugaaguggg

SEQ ID NO: 253801 - RNA, 22 nt, Human
agucagaguucuuggggagaca

SEQ ID NO: 253802 - RNA, 22 nt, Human
acuacaauacucuuaguaaaag

SEQ ID NO: 253803 - RNA, 22 nt, Human
aacuuugggccuaaguacuguu

SEQ ID NO: 253804 - RNA, 22 nt, Human
ucagugucagucuuuuagauau

SEQ ID NO: 253805 - RNA, 22 nt, Human
gaagggcuuggcugggaggcca

SEQ ID NO: 253806 - RNA, 22 nt, Human
aggagcccuccguugcuucauc

SEQ ID NO: 253807 - RNA, 22 nt, Human
acuggcagagacccugauggcc

SEQ ID NO: 253808 - RNA, 22 nt, Human
uauggaaauaauuagacaagug

SEQ ID NO: 253809 - RNA, 21 nt, Human
ucacaugcccauuacuggagc

SEQ ID NO: 253810 - RNA, 22 nt, Human
gacaauuagaucauuccuuuga

SEQ ID NO: 253811 - RNA, 22 nt, Human
aucuaauuuucacucauuugcu

SEQ ID NO: 253812 - RNA, 19 nt, Human
cagcucaguuugauucucu

SEQ ID NO: 253813 - RNA, 22 nt, Human
agauguuuuggagacacuaacc

SEQ ID NO: 253814 - RNA, 22 nt, Human
ucccuucacagaugcgauguuu

SEQ ID NO: 253815 - RNA, 22 nt, Human
ugugaagguaagguuugcuuga

SEQ ID NO: 253816 - RNA, 22 nt, Human
ugucuuuacuuagaaguucagg

SEQ ID NO: 253817 - RNA, 22 nt, Human
caaaaguucucacccagacaug

SEQ ID NO: 253818 - RNA, 18 nt, Human
ucaggcuggaaguuugcc

SEQ ID NO: 253819 - RNA, 23 nt, Human
gcccugcugggaccuccugcuac

SEQ ID NO: 253820 - RNA, 22 nt, Human
agacagacuugaaaauguucuu

SEQ ID NO: 253821 - RNA, 19 nt, Human
acugagaccacagacaagu

SEQ ID NO: 253822 - RNA, 22 nt, Human
cuccagugcacuggucuuuuca

SEQ ID NO: 253823 - RNA, 22 nt, Human
uccugaggcacaauccuagaau

SEQ ID NO: 253824 - RNA, 17 nt, Human
cuggagcuguguaaccu

SEQ ID NO: 253825 - RNA, 22 nt, Human
gaauucaucgucuuagcugcca

SEQ ID NO: 253826 - RNA, 20 nt, Human
aggucugauuccagaaucag

SEQ ID NO: 253827 - RNA, 22 nt, Human
aggcugaggaucccuguguucu

SEQ ID NO: 253828 - RNA, 22 nt, Human
ucagggaagagagaucuccuag

SEQ ID NO: 253829 - RNA, 22 nt, Human
uaguuucauaugcaaaauagua

SEQ ID NO: 253830 - RNA, 22 nt, Human
cauauaaauacaacauguguua

SEQ ID NO: 253831 - RNA, 22 nt, Human
cagugcaugaaacaauaugcag

SEQ ID NO: 253832 - RNA, 22 nt, Human
uguggcugcucaggugcagacc

SEQ ID NO: 253833 - RNA, 22 nt, Human
ugugcuugucguggagccaggc

SEQ ID NO: 253834 - RNA, 22 nt, Human
cuuuaugguaaguauagaugac

SEQ ID NO: 253835 - RNA, 22 nt, Human
guccugggggcagcugugucca

SEQ ID NO: 253836 - RNA, 22 nt, Human
cuuguccagauguuuguuaggu

SEQ ID NO: 253837 - RNA, 22 nt, Human
ccagggaggagcauuucauggu

SEQ ID NO: 253838 - RNA, 22 nt, Human
ggaaggguuuaagcaggagagu

SEQ ID NO: 253839 - RNA, 22 nt, Human
aaauagauuuccuagcauugga

SEQ ID NO: 253840 - RNA, 22 nt, Human
cucugaccauucccuugauuuu

SEQ ID NO: 253841 - RNA, 22 nt, Human
aaguacauccuagucucuuuca

SEQ ID NO: 253842 - RNA, 22 nt, Human
gcugaggcucaagucauggguc

SEQ ID NO: 253843 - RNA, 22 nt, Human
agagccaggcucccauggggca

SEQ ID NO: 253844 - RNA, 21 nt, Human
caagacauaugaguacucugg

SEQ ID NO: 253845 - RNA, 22 nt, Human
uauuucuuguuauucucguuga

SEQ ID NO: 253846 - RNA, 22 nt, Human
uugucugugaaauggaaauagu

SEQ ID NO: 253847 - RNA, 22 nt, Human
uggguccucgucuuccaaggca

SEQ ID NO: 253848 - RNA, 22 nt, Human
uucuucuuucccccugugguac

SEQ ID NO: 253849 - RNA, 22 nt, Human
acagccugcugccugcuucuug

SEQ ID NO: 253850 - RNA, 22 nt, Human
ggacauuugcaccuaccucagc

SEQ ID NO: 253851 - RNA, 18 nt, Human
ugacauuuccagagugua

SEQ ID NO: 253852 - RNA, 17 nt, Human
acuccuggucugaaggg

SEQ ID NO: 253853 - RNA, 22 nt, Human
gguguugcaguugaagacuggu

SEQ ID NO: 253854 - RNA, 22 nt, Human
ggcugggcaggucugcacaggg

SEQ ID NO: 253855 - RNA, 22 nt, Human
cugcaaaaguaauugcagguuu

SEQ ID NO: 253856 - RNA, 22 nt, Human
caucuuauuuucuucuagugcu

SEQ ID NO: 253857 - RNA, 18 nt, Human
agaggcuggacaggggau

SEQ ID NO: 253858 - RNA, 22 nt, Human
aucuagauuagguauaagagcu

SEQ ID NO: 253859 - RNA, 22 nt, Human
cuuucaaugugccugccuuggg

SEQ ID NO: 253860 - RNA, 20 nt, Human
caguccugucccugcugccc

SEQ ID NO: 253861 - RNA, 22 nt, Human
agggccagcuagagcccucgcc

SEQ ID NO: 253862 - RNA, 20 nt, Human
gcuuccaggagggcugauau

SEQ ID NO: 253863 - RNA, 22 nt, Human
caaagccaggcuuucuaaugua

SEQ ID NO: 253864 - RNA, 22 nt, Human
ucccagggauccuccgggucgc

SEQ ID NO: 253865 - RNA, 22 nt, Human
caccagccagagugacagcucc

SEQ ID NO: 253866 - RNA, 22 nt, Human
gaacaaacagucaggacagucu

SEQ ID NO: 253867 - RNA, 22 nt, Human
agucucaggcagaggaaggcua

SEQ ID NO: 253868 - RNA, 22 nt, Human
uacagugcacauuucuuaggaa

SEQ ID NO: 253869 - RNA, 22 nt, Human
uuucauguuggggaguugagug

SEQ ID NO: 253870 - RNA, 22 nt, Human
aaagccaggaggagggcgcucg

SEQ ID NO: 253871 - RNA, 23 nt, Human
uuuggcuccauggguggcucauu

SEQ ID NO: 253872 - RNA, 19 nt, Human
gcuguuaaggacccucgga

SEQ ID NO: 253873 - RNA, 23 nt, Human
agcaggcugcuucuccacagcug

SEQ ID NO: 253874 - RNA, 22 nt, Human
cugccagacacguuaugcucau

SEQ ID NO: 253875 - RNA, 22 nt, Human
auuuaagauugcguauucaugu

SEQ ID NO: 253876 - RNA, 22 nt, Human
ucagagaguuacacaaauuguu

SEQ ID NO: 253877 - RNA, 22 nt, Human
gcggguugaagggcgcaucgaa

SEQ ID NO: 253878 - RNA, 21 nt, Human
gaguccuuccaauguccucag

SEQ ID NO: 253879 - RNA, 22 nt, Human
agaagaacuuagcuuucuaucu

SEQ ID NO: 253880 - RNA, 22 nt, Human
agcuggggcugcagagaacagg

SEQ ID NO: 253881 - RNA, 22 nt, Human
caaauagacuucaaucucuuga

SEQ ID NO: 253882 - RNA, 22 nt, Human
uuugaagggcacgacaauaguu

SEQ ID NO: 253883 - RNA, 22 nt, Human
ccuguucacgguguguuguuag

SEQ ID NO: 253884 - RNA, 22 nt, Human
uauccaaaguuucucagaaacu

SEQ ID NO: 253885 - RNA, 21 nt, Human
uucccuucugguuuugagaga

SEQ ID NO: 253886 - RNA, 22 nt, Human
aagcugcagaugugccugugga

SEQ ID NO: 253887 - RNA, 22 nt, Human
ggagggagggcuagaccaaaga

SEQ ID NO: 253888 - RNA, 22 nt, Human
uagcucuggagucuucucagaa

SEQ ID NO: 253889 - RNA, 22 nt, Human
gucucugugguacguuucaucc

SEQ ID NO: 253890 - RNA, 22 nt, Human
ucccacacuugaaacaaggcug

SEQ ID NO: 253891 - RNA, 22 nt, Human
auaaagccuuucuguuuucagg

SEQ ID NO: 253892 - RNA, 22 nt, Human
uagaaaugaauguuuaaaaguc

SEQ ID NO: 253893 - RNA, 19 nt, Human
acccagcccaggaguggca

SEQ ID NO: 253894 - RNA, 22 nt, Human
ucccugcuugcucucagcccuu

SEQ ID NO: 253895 - RNA, 20 nt, Human
gggagaagggcugaugagag

SEQ ID NO: 253896 - RNA, 22 nt, Human
aaucaaagaaugggcuaguugg

SEQ ID NO: 253897 - RNA, 22 nt, Human
uauuuaguuaucuuucauaaaa

SEQ ID NO: 253898 - RNA, 22 nt, Human
auggcugcuucaguaccaguuc

SEQ ID NO: 253899 - RNA, 22 nt, Human
ugaggucugcagggcugugcau

SEQ ID NO: 253900 - RNA, 22 nt, Human
ggccaggagaggagggcacuga

SEQ ID NO: 253901 - RNA, 22 nt, Human
caaaagcagcaaguuuauaugu

SEQ ID NO: 253902 - RNA, 22 nt, Human
ucaauucugguccucaggaacu

SEQ ID NO: 253903 - RNA, 22 nt, Human
uucaaguacuguagauuucagg

SEQ ID NO: 253904 - RNA, 22 nt, Human
ucaauacuuaagcuuaauucua

SEQ ID NO: 253905 - RNA, 22 nt, Human
uugacauuuugucauauugaca

SEQ ID NO: 253906 - RNA, 22 nt, Human
uccuuggaaauuucaucagaca

SEQ ID NO: 253907 - RNA, 22 nt, Human
ugugcacauaaaacaguacuag

SEQ ID NO: 253908 - RNA, 22 nt, Human
uggucugguuauuucuuaauga

SEQ ID NO: 253909 - RNA, 22 nt, Human
ggcuuggcagaggugggugcuu

SEQ ID NO: 253910 - RNA, 22 nt, Human
ucaaaaauggucuuugagcugc

SEQ ID NO: 253911 - RNA, 22 nt, Human
aggacaugaagaaagggcaagg

SEQ ID NO: 253912 - RNA, 22 nt, Human
cagauucugggcccagcuuguc

SEQ ID NO: 253913 - RNA, 22 nt, Human
gacagcaguccuggaguuccca

SEQ ID NO: 253914 - RNA, 22 nt, Human
uucuccugcccuuggacuucca

SEQ ID NO: 253915 - RNA, 22 nt, Human
auuguaaauagugccacaauaa

SEQ ID NO: 253916 - RNA, 22 nt, Human
agugcuccuuucauugcugccc

SEQ ID NO: 253917 - RNA, 22 nt, Human
gcagcugcagacccucagugcu

SEQ ID NO: 253918 - RNA, 22 nt, Human
aacuacaguauguccaaagaau

SEQ ID NO: 253919 - RNA, 22 nt, Human
aggcuaggccuugcccuggaac

SEQ ID NO: 253920 - RNA, 22 nt, Human
uuauuauuccccaagucauuau

SEQ ID NO: 253921 - RNA, 22 nt, Human
uggccugguuguugcugccguu

SEQ ID NO: 253922 - RNA, 22 nt, Human
uuucaguguaucuuccaaaagc

SEQ ID NO: 253923 - RNA, 18 nt, Human
uucuggcucacucaugcu

SEQ ID NO: 253924 - RNA, 22 nt, Human
cccugaggaccaggaaggaggg

SEQ ID NO: 253925 - RNA, 17 nt, Human
uucucugagcuguauug

SEQ ID NO: 253926 - RNA, 22 nt, Human
agaugagggguagaaaggacuu

SEQ ID NO: 253927 - RNA, 20 nt, Human
gacaggagaguuagguaggu

SEQ ID NO: 253928 - RNA, 22 nt, Human
ccuggcacaagagcagcauugg

SEQ ID NO: 253929 - RNA, 23 nt, Human
ggaaagagaggaguugugcauag

SEQ ID NO: 253930 - RNA, 22 nt, Human
gcaugcagaaaaugaacaacga

SEQ ID NO: 253931 - RNA, 22 nt, Human
gcuccaggaggcucccgcgucu

SEQ ID NO: 253932 - RNA, 22 nt, Human
uaaaggcucguauuguugugug

SEQ ID NO: 253933 - RNA, 22 nt, Human
ucuuacaccauucaaauauuuu

SEQ ID NO: 253934 - RNA, 22 nt, Human
acacagcuaugggguaggaaac

SEQ ID NO: 253935 - RNA, 22 nt, Human
uuaucauugucgcagucuaauu

SEQ ID NO: 253936 - RNA, 21 nt, Human
aaaguguucagaccaguucug

SEQ ID NO: 253937 - RNA, 22 nt, Human
ucauuucaaguucugacagcua

SEQ ID NO: 253938 - RNA, 22 nt, Human
ucucugggacacugggucaguu

SEQ ID NO: 253939 - RNA, 22 nt, Human
aaaggcuuaacagaagaccuuu

SEQ ID NO: 253940 - RNA, 22 nt, Human
gugauaggcauuuaacucuaag

SEQ ID NO: 253941 - RNA, 18 nt, Human
ugccugccccguaagggu

SEQ ID NO: 253942 - RNA, 23 nt, Human
aaagccaagucagucuacuggaa

SEQ ID NO: 253943 - RNA, 22 nt, Human
caggaaaugaaagcuagcuaau

SEQ ID NO: 253944 - RNA, 21 nt, Human
auucagaaagggaauaaacuc

SEQ ID NO: 253945 - RNA, 22 nt, Human
ccaggacagugaacauguaaga

SEQ ID NO: 253946 - RNA, 22 nt, Human
aaaguuuggauccagcaaaaga

SEQ ID NO: 253947 - RNA, 16 nt, Human
cuuuuucuccccucuu

SEQ ID NO: 253948 - RNA, 22 nt, Human
cuguucagaaaaaaucuucaug

SEQ ID NO: 253949 - RNA, 22 nt, Human
aagaugcagcuuccacuuuugc

SEQ ID NO: 253950 - RNA, 22 nt, Human
aguacaaagugcuccugguucu

SEQ ID NO: 253951 - RNA, 22 nt, Human
aaaggcuaugauaguccagugg

SEQ ID NO: 253952 - RNA, 22 nt, Human
ugaggcucuuccuccccugcuc

SEQ ID NO: 253953 - RNA, 22 nt, Human
ugcaguuuugccaggcaaugga

SEQ ID NO: 253954 - RNA, 22 nt, Human
agggagcaaagguuucaggguu

SEQ ID NO: 253955 - RNA, 22 nt, Human
agguggcagccgagacauaagg

SEQ ID NO: 253956 - RNA, 22 nt, Human
gcuugucauaguuguuacaaau

SEQ ID NO: 253957 - RNA, 22 nt, Human
auggcccaagugcccugaccug

SEQ ID NO: 253958 - RNA, 22 nt, Human
augcaaaaguaacugugauuuu

SEQ ID NO: 253959 - RNA, 22 nt, Human
gcagugugucuggaguacaugg

SEQ ID NO: 253960 - RNA, 22 nt, Human
uuagauacccaaguggaucugu

SEQ ID NO: 253961 - RNA, 23 nt, Human
guaggaauuuucacuuccucuug

SEQ ID NO: 253962 - RNA, 22 nt, Human
uucuuacagaguuuacagagcc

SEQ ID NO: 253963 - RNA, 22 nt, Human
aaauaauuauagcgagucuauc

SEQ ID NO: 253964 - RNA, 22 nt, Human
agucacaugaucccugggccug

SEQ ID NO: 253965 - RNA, 22 nt, Human
auguuucugaaguuuacagaua

SEQ ID NO: 253966 - RNA, 22 nt, Human
caggcucccacuuggcuuaaag

SEQ ID NO: 253967 - RNA, 22 nt, Human
cuuguucaguugccucuccugc

SEQ ID NO: 253968 - RNA, 22 nt, Human
ugucucuggcccaugagcagag

SEQ ID NO: 253969 - RNA, 22 nt, Human
cagagccaggugguguuggggc

SEQ ID NO: 253970 - RNA, 18 nt, Human
ucuuggcagcaucuggca

SEQ ID NO: 253971 - RNA, 20 nt, Human
ugcacagggugggaagcaac

SEQ ID NO: 253972 - RNA, 23 nt, Human
ucccuguguacagccugcaugag

SEQ ID NO: 253973 - RNA, 22 nt, Human
cugcagggacccaagucuuugg

SEQ ID NO: 253974 - RNA, 22 nt, Human
cugcaggacagggaggagcaag

SEQ ID NO: 253975 - RNA, 22 nt, Human
aggcucucucugccagccgugc

SEQ ID NO: 253976 - RNA, 22 nt, Human
gcucugagccgggggccugucc

SEQ ID NO: 253977 - RNA, 18 nt, Human
gcuccuggagucugacuc

SEQ ID NO: 253978 - RNA, 20 nt, Human
ugcuuccuggccacugcggg

SEQ ID NO: 253979 - RNA, 22 nt, Human
uacaaacucuuuauauuucaua

SEQ ID NO: 253980 - RNA, 22 nt, Human
uccagccaugcaugacaaucac

SEQ ID NO: 253981 - RNA, 22 nt, Human
gagagaagggggauaugagccu

SEQ ID NO: 253982 - RNA, 22 nt, Human
gucaccucucaucacaugcuac

SEQ ID NO: 253983 - RNA, 22 nt, Human
uugauuuuuuucuacuaugcgc

SEQ ID NO: 253984 - RNA, 22 nt, Human
gcgcaggcccgggucagggccg

SEQ ID NO: 253985 - RNA, 21 nt, Human
uucucaguguccauguuaguu

SEQ ID NO: 253986 - RNA, 20 nt, Human
uuucuauggggccagcacau

SEQ ID NO: 253987 - RNA, 22 nt, Human
gcuggguggaucggaggcucug

SEQ ID NO: 253988 - RNA, 22 nt, Human
ugccuggcucuaucaguggugg

SEQ ID NO: 253989 - RNA, 22 nt, Human
ugagggagucaugauuaaggaa

SEQ ID NO: 253990 - RNA, 22 nt, Human
gacuuugguuugagcaagucag

SEQ ID NO: 253991 - RNA, 18 nt, Human
cagagcuccuggaugcag

SEQ ID NO: 253992 - RNA, 22 nt, Human
ucugauuuacuggaaaaaagga

SEQ ID NO: 253993 - RNA, 22 nt, Human
cacugucuccuagggggacuuc

SEQ ID NO: 253994 - RNA, 22 nt, Human
uuguuuacuaagaaccugguca

SEQ ID NO: 253995 - RNA, 22 nt, Human
uaaaaaguugaaaggacuuauc

SEQ ID NO: 253996 - RNA, 22 nt, Human
cuccuugguguaguacugagca

SEQ ID NO: 253997 - RNA, 20 nt, Human
uguuucuuuuaaugagcggc

SEQ ID NO: 253998 - RNA, 22 nt, Human
uaacugccuacugugcaaauau

SEQ ID NO: 253999 - RNA, 22 nt, Human
uggcagguuggccuuugguuca

SEQ ID NO: 254000 - RNA, 22 nt, Human
uggcaguuucaugugauucaac

SEQ ID NO: 254001 - RNA, 22 nt, Human
gaacugaaacuugguuuaaagc

SEQ ID NO: 254002 - RNA, 23 nt, Human
ugacaggccagaagagcagcugg

SEQ ID NO: 254003 - RNA, 22 nt, Human
auugcugggaggauguguguuc

SEQ ID NO: 254004 - RNA, 22 nt, Human
cuccuccacagaguccuugcca

SEQ ID NO: 254005 - RNA, 18 nt, Human
caucuacaaaugccagaa

SEQ ID NO: 254006 - RNA, 22 nt, Human
agaaaugugagccccuuaucaa

SEQ ID NO: 254007 - RNA, 22 nt, Human
agaguggcucugcugggcacag

SEQ ID NO: 254008 - RNA, 22 nt, Human
uagcaacagaaaauaggagugc

SEQ ID NO: 254009 - RNA, 22 nt, Human
uagaaacccauguuuauucagu

SEQ ID NO: 254010 - RNA, 22 nt, Human
aaacauuagacaccauaugcuc

SEQ ID NO: 254011 - RNA, 23 nt, Human
ccugucugugcuggguggacaca

SEQ ID NO: 254012 - RNA, 22 nt, Human
aaggcagccauagcaccaucca

SEQ ID NO: 254013 - RNA, 22 nt, Human
aaauacagauuccagggucuua

SEQ ID NO: 254014 - RNA, 21 nt, Human
auggcucaggccaucaaugga

SEQ ID NO: 254015 - RNA, 22 nt, Human
gccugagauucccggagccgug

SEQ ID NO: 254016 - RNA, 22 nt, Human
uagaacuugauagacaguacaa

SEQ ID NO: 254017 - RNA, 22 nt, Human
gaguuuguaaacuauucacuaa

SEQ ID NO: 254018 - RNA, 22 nt, Human
agaaagggagagccagcacacg

SEQ ID NO: 254019 - RNA, 22 nt, Human
ucauuguugcguuaaugucuuc

SEQ ID NO: 254020 - RNA, 22 nt, Human
cauuaagauuuuuuucuacugg

SEQ ID NO: 254021 - RNA, 20 nt, Human
cagcaacuuuggacugaguu

SEQ ID NO: 254022 - RNA, 22 nt, Human
ggcuccaggaaccuccucuccu

SEQ ID NO: 254023 - RNA, 22 nt, Human
gcaggagcaaacugcagugugg

SEQ ID NO: 254024 - RNA, 22 nt, Human
cagcuucugcuaucgaacaucu

SEQ ID NO: 254025 - RNA, 22 nt, Human
aggggcagccucacaauccucu

SEQ ID NO: 254026 - RNA, 22 nt, Human
gcaggaguucaauugcccauga

SEQ ID NO: 254027 - RNA, 18 nt, Human
uccaaagcugcugguuuu

SEQ ID NO: 254028 - RNA, 22 nt, Human
aagcacaauuucaccuucuugu

SEQ ID NO: 254029 - RNA, 22 nt, Human
auauaacauacauacagaaaag

SEQ ID NO: 254030 - RNA, 22 nt, Human
aaauguguuucuuugugaaugg

SEQ ID NO: 254031 - RNA, 22 nt, Human
auacaguauaacuaauaaaccc

SEQ ID NO: 254032 - RNA, 21 nt, Human
uucuucaguuuaauauaaaau

SEQ ID NO: 254033 - RNA, 18 nt, Human
uguuaaaugaagauuugc

SEQ ID NO: 254034 - RNA, 22 nt, Human
uauucuuguaccuuaaaugauu

SEQ ID NO: 254035 - RNA, 22 nt, Human
ucauucaugaggugcuagugcu

SEQ ID NO: 254036 - RNA, 19 nt, Human
ccacaaaauuauuuuaguu

SEQ ID NO: 254037 - RNA, 22 nt, Human
ucucacagugagccugaggucg

SEQ ID NO: 254038 - RNA, 22 nt, Human
gcaggguccauggaggcagccc

SEQ ID NO: 254039 - RNA, 22 nt, Human
uguuacugauuugauauacagu

SEQ ID NO: 254040 - RNA, 21 nt, Human
gcugggcuccagucugccgcu

SEQ ID NO: 254041 - RNA, 22 nt, Human
cacacauugaauucauucuugu

SEQ ID NO: 254042 - RNA, 23 nt, Human
aucuuagcauagacuugaguccc

SEQ ID NO: 254043 - RNA, 20 nt, Human
gccucagaggguuugaguuu

SEQ ID NO: 254044 - RNA, 22 nt, Human
cuguccugagauaaagaugagg

SEQ ID NO: 254045 - RNA, 22 nt, Human
auuguugggucucacuccuaga

SEQ ID NO: 254046 - RNA, 22 nt, Human
agaacaucuaaauaucugagac

SEQ ID NO: 254047 - RNA, 22 nt, Human
gcuugggaagggcccuguguac

SEQ ID NO: 254048 - RNA, 22 nt, Human
uguggcagggauacugaggcag

SEQ ID NO: 254049 - RNA, 18 nt, Human
uggcaggaaaugcacuuu

SEQ ID NO: 254050 - RNA, 22 nt, Human
cccaggaugaucgagaguggga

SEQ ID NO: 254051 - RNA, 22 nt, Human
uacagaaagaccucucgggaaa

SEQ ID NO: 254052 - RNA, 22 nt, Human
agaauagaauucucauagaauu

SEQ ID NO: 254053 - RNA, 22 nt, Human
ugcuucucaaaaggagguaggu

SEQ ID NO: 254054 - RNA, 22 nt, Human
gagucuggaaugaugaagaccu

SEQ ID NO: 254055 - RNA, 20 nt, Human
agguccugguucucugggau

SEQ ID NO: 254056 - RNA, 22 nt, Human
uaucugauacaacagaauaaca

SEQ ID NO: 254057 - RNA, 22 nt, Human
gaggaggcuguuucucugcauu

SEQ ID NO: 254058 - RNA, 21 nt, Human
aucacugaaugccuucaagga

SEQ ID NO: 254059 - RNA, 22 nt, Human
uguguacauaucuauccuagau

SEQ ID NO: 254060 - RNA, 22 nt, Human
ucuuuacuuguguauuguauau

SEQ ID NO: 254061 - RNA, 22 nt, Human
guguacagugauuugaguucac

SEQ ID NO: 254062 - RNA, 22 nt, Human
uggugcaguagaaggccgacuu

SEQ ID NO: 254063 - RNA, 22 nt, Human
uuaacagagugccuggcaugua

SEQ ID NO: 254064 - RNA, 22 nt, Human
cugggucugugcccagggaccu

SEQ ID NO: 254065 - RNA, 22 nt, Human
uuauuuuuaaaaguucacacag

SEQ ID NO: 254066 - RNA, 22 nt, Human
acaggcagguugagaaacauuu

SEQ ID NO: 254067 - RNA, 22 nt, Human
gcaguguuuacauauuagaaac

SEQ ID NO: 254068 - RNA, 22 nt, Human
ucuccacaaguguugagaguac

SEQ ID NO: 254069 - RNA, 22 nt, Human
agagguggagcucuuggcauca

SEQ ID NO: 254070 - RNA, 22 nt, Human
cccuccccagggucauauugaa

SEQ ID NO: 254071 - RNA, 22 nt, Human
aggugacaggacaggagcuggu

SEQ ID NO: 254072 - RNA, 22 nt, Human
uggcagcucccagagcuuccaa

SEQ ID NO: 254073 - RNA, 22 nt, Human
gggaaaggaucagugggaggcu

SEQ ID NO: 254074 - RNA, 21 nt, Human
ggacagaggagaaggcacccu

SEQ ID NO: 254075 - RNA, 22 nt, Human
ggucaagacgggcucugcccuu

SEQ ID NO: 254076 - RNA, 22 nt, Human
ccucuuugacaaguaccugccc

SEQ ID NO: 254077 - RNA, 22 nt, Human
uaggaagauaaacauuuguaug

SEQ ID NO: 254078 - RNA, 22 nt, Human
ccagguucaaauagcuguguga

SEQ ID NO: 254079 - RNA, 22 nt, Human
gugaggcaggcauucuccuuuc

SEQ ID NO: 254080 - RNA, 22 nt, Human
ugagaaucagcugcacagaggu

SEQ ID NO: 254081 - RNA, 22 nt, Human
aagaaucuaugguacauccaag

SEQ ID NO: 254082 - RNA, 22 nt, Human
aguagcaccagggaagcagggc

SEQ ID NO: 254083 - RNA, 22 nt, Human
uggcaaagcuagacauucccuc

SEQ ID NO: 254084 - RNA, 17 nt, Human
agugagaaugucaugua

SEQ ID NO: 254085 - RNA, 22 nt, Human
caugaaaauaacauuguuguga

SEQ ID NO: 254086 - RNA, 22 nt, Human
ucugaacauccagcaaugcaca

SEQ ID NO: 254087 - RNA, 19 nt, Human
ggcaccuuucugcuguguc

SEQ ID NO: 254088 - RNA, 22 nt, Human
cugacauguauaagcuuuaagu

SEQ ID NO: 254089 - RNA, 22 nt, Human
uguuuccuaagugucucugaag

SEQ ID NO: 254090 - RNA, 22 nt, Human
guaauaaugguccccaaacacu

SEQ ID NO: 254091 - RNA, 19 nt, Human
cugcugggugcugagggag

SEQ ID NO: 254092 - RNA, 22 nt, Human
auuacugugacuagccaucugg

SEQ ID NO: 254093 - RNA, 22 nt, Human
cucuuuuaauugucauaacaac

SEQ ID NO: 254094 - RNA, 21 nt, Human
uggaucugugaucuggggcac

SEQ ID NO: 254095 - RNA, 22 nt, Human
uaacuguacaacugguuaguca

SEQ ID NO: 254096 - RNA, 20 nt, Human
aguaacuuagcaacucuagg

SEQ ID NO: 254097 - RNA, 22 nt, Human
uagcaugggucgcgucucugga

SEQ ID NO: 254098 - RNA, 22 nt, Human
cuuccagagauccaugaauacc

SEQ ID NO: 254099 - RNA, 22 nt, Human
cauaacuuuaaagacagugugg

SEQ ID NO: 254100 - RNA, 22 nt, Human
uccaggcucagcacuugcuacu

SEQ ID NO: 254101 - RNA, 22 nt, Human
uucuuuucccaauauuuugcug

SEQ ID NO: 254102 - RNA, 22 nt, Human
aggucugacucuuugccacaua

SEQ ID NO: 254103 - RNA, 19 nt, Human
aggcucugagcuccuggag

SEQ ID NO: 254104 - RNA, 17 nt, Human
ugggccaguagaaggga

SEQ ID NO: 254105 - RNA, 22 nt, Human
ggcucccuagggagagugggag

SEQ ID NO: 254106 - RNA, 22 nt, Human
caggaaagagcugccaggcagg

SEQ ID NO: 254107 - RNA, 22 nt, Human
aggacccaagcacaguuccugg

SEQ ID NO: 254108 - RNA, 21 nt, Human
uacuacagucucuuuaucagu

SEQ ID NO: 254109 - RNA, 21 nt, Human
agagcugggacuugccugaga

SEQ ID NO: 254110 - RNA, 22 nt, Human
ucaguuagggccucagaagaca

SEQ ID NO: 254111 - RNA, 22 nt, Human
aauuuccagaucagaugacuca

SEQ ID NO: 254112 - RNA, 22 nt, Human
cagagccaggucuaggagucuc

SEQ ID NO: 254113 - RNA, 22 nt, Human
uaucaguuuauucuauaaauag

SEQ ID NO: 254114 - RNA, 22 nt, Human
ugccugccuugcugcuggacag

SEQ ID NO: 254115 - RNA, 22 nt, Human
gggcagguaggugaaauaauga

SEQ ID NO: 254116 - RNA, 22 nt, Human
augaaacagaguacuuaauaua

SEQ ID NO: 254117 - RNA, 22 nt, Human
aaauuuaaaaagcagcauugca

SEQ ID NO: 254118 - RNA, 22 nt, Human
auuuaaugucgagcuauuguag

SEQ ID NO: 254119 - RNA, 22 nt, Human
ugacagguucguuagucauguu

SEQ ID NO: 254120 - RNA, 22 nt, Human
uacaucuagccuuacaauuauu

SEQ ID NO: 254121 - RNA, 22 nt, Human
ugagcucuguuagggcuggaac

SEQ ID NO: 254122 - RNA, 22 nt, Human
ucagaaguuucaaucccagcug

SEQ ID NO: 254123 - RNA, 22 nt, Human
aacauuucauaacuugacuuuu

SEQ ID NO: 254124 - RNA, 22 nt, Human
uccugugucaauuccucauucu

SEQ ID NO: 254125 - RNA, 22 nt, Human
agcacaggaacauggagauggg

SEQ ID NO: 254126 - RNA, 22 nt, Human
aaugaugagaacuggaguaauu

SEQ ID NO: 254127 - RNA, 22 nt, Human
agugucugcgggcagaggagcg

SEQ ID NO: 254128 - RNA, 22 nt, Human
uucaggcccagcacagcgcgug

SEQ ID NO: 254129 - RNA, 22 nt, Human
uagaacaugacuuauuuuugga

SEQ ID NO: 254130 - RNA, 22 nt, Human
gcaggggaguggaugauggauu

SEQ ID NO: 254131 - RNA, 20 nt, Human
agucacaggccuggaacaug

SEQ ID NO: 254132 - RNA, 22 nt, Human
cucuucaguaaaugacacuguu

SEQ ID NO: 254133 - RNA, 22 nt, Human
uauuuuguaauuggucauagcu

SEQ ID NO: 254134 - RNA, 22 nt, Human
cuucagaaacuaguaacagcua

SEQ ID NO: 254135 - RNA, 22 nt, Human
ucagguguguuguauuuuacca

SEQ ID NO: 254136 - RNA, 22 nt, Human
ggaagcuguuaucaucuguauc

SEQ ID NO: 254137 - RNA, 19 nt, Human
aauaagcuuggguaaaacu

SEQ ID NO: 254138 - RNA, 22 nt, Human
uccuuaaauauuuacuguuaac

SEQ ID NO: 254139 - RNA, 22 nt, Human
gguuucucuagggcugaccagu

SEQ ID NO: 254140 - RNA, 22 nt, Human
cuuccuucuguaagaccaguug

SEQ ID NO: 254141 - RNA, 22 nt, Human
cagcuucuccauucuucuggcu

SEQ ID NO: 254142 - RNA, 22 nt, Human
uaagagcacugaagucuucuua

SEQ ID NO: 254143 - RNA, 22 nt, Human
acaauuacucaacuuugcugcu

SEQ ID NO: 254144 - RNA, 22 nt, Human
ggcaggugacggggaugaguau

SEQ ID NO: 254145 - RNA, 22 nt, Human
cucacagguuaguuguguggau

SEQ ID NO: 254146 - RNA, 22 nt, Human
uuguagaaaauucucuuggaua

SEQ ID NO: 254147 - RNA, 22 nt, Human
auuccacauaggccuucaugac

SEQ ID NO: 254148 - RNA, 22 nt, Human
auggcagggaccaagcugucau

SEQ ID NO: 254149 - RNA, 22 nt, Human
guagauaaggauugauuuuuau

SEQ ID NO: 254150 - RNA, 22 nt, Human
acccugagaaagucacaugcau

SEQ ID NO: 254151 - RNA, 22 nt, Human
caucuuuaaaggggagacaccc

SEQ ID NO: 254152 - RNA, 22 nt, Human
aaaugcucuccaaaaugaaagu

SEQ ID NO: 254153 - RNA, 22 nt, Human
cagaagaaaucauuaucuggac

SEQ ID NO: 254154 - RNA, 22 nt, Human
acauucaaaauauuucugaugu

SEQ ID NO: 254155 - RNA, 22 nt, Human
cccuuggcuucuauggguuuuc

SEQ ID NO: 254156 - RNA, 17 nt, Human
ugcuggcaacauacaaa

SEQ ID NO: 254157 - RNA, 22 nt, Human
gcugccucuguagcuuuggacc

SEQ ID NO: 254158 - RNA, 21 nt, Human
aggcaugagcccugcauggac

SEQ ID NO: 254159 - RNA, 22 nt, Human
auuuagcaaaaaaugaugaagc

SEQ ID NO: 254160 - RNA, 22 nt, Human
acugcaccuugcgguccugugg

SEQ ID NO: 254161 - RNA, 23 nt, Human
cacaccaggagccgucugggcca

SEQ ID NO: 254162 - RNA, 21 nt, Human
uacaguaaguugggugguccu

SEQ ID NO: 254163 - RNA, 22 nt, Human
uccaaagccccaugcacuuucu

SEQ ID NO: 254164 - RNA, 22 nt, Human
cugggacauggugcugucuuua

SEQ ID NO: 254165 - RNA, 22 nt, Human
ucccagccauuccuuuaggugu

SEQ ID NO: 254166 - RNA, 22 nt, Human
ucagcccuugauguuugggggu

SEQ ID NO: 254167 - RNA, 17 nt, Human
gcuucuggagcuucugu

SEQ ID NO: 254168 - RNA, 22 nt, Human
uaaggacauuagaaaugaugcu

SEQ ID NO: 254169 - RNA, 22 nt, Human
ucagagaaaugacaauauauag

SEQ ID NO: 254170 - RNA, 22 nt, Human
gggguugaucacagaggggucu

SEQ ID NO: 254171 - RNA, 23 nt, Human
agugcucccaggaccuggggcag

SEQ ID NO: 254172 - RNA, 22 nt, Human
aaguuuaagguggaaguggugg

SEQ ID NO: 254173 - RNA, 22 nt, Human
acagguggggcacuuggagccu

SEQ ID NO: 254174 - RNA, 22 nt, Human
gugaccauaauagauuaugagu

SEQ ID NO: 254175 - RNA, 20 nt, Human
aaagcauuuacuugugauug

SEQ ID NO: 254176 - RNA, 22 nt, Human
acacacugagugccauaggacc

SEQ ID NO: 254177 - RNA, 22 nt, Human
ccaggacaaguguggccauggc

SEQ ID NO: 254178 - RNA, 22 nt, Human
ugcugcucaagcugcagcaaaa

SEQ ID NO: 254179 - RNA, 22 nt, Human
ugaaaaacugaauaguugagua

SEQ ID NO: 254180 - RNA, 22 nt, Human
aaugaauucugaagucuuccaa

SEQ ID NO: 254181 - RNA, 22 nt, Human
accuucaaacuagauagaaguu

SEQ ID NO: 254182 - RNA, 22 nt, Human
uuuauuguugggucuuaagcug

SEQ ID NO: 254183 - RNA, 22 nt, Human
ccuggcucugcgugcagcuccg

SEQ ID NO: 254184 - RNA, 22 nt, Human
cugugaccuuagcaagggaaau

SEQ ID NO: 254185 - RNA, 22 nt, Human
ucaggagcagcuguaggaaggg

SEQ ID NO: 254186 - RNA, 20 nt, Human
aggcuugugcuuugucacuc

SEQ ID NO: 254187 - RNA, 22 nt, Human
gggauggaucuuggcugaggcu

SEQ ID NO: 254188 - RNA, 22 nt, Human
uucccuugaccccagacccugg

SEQ ID NO: 254189 - RNA, 22 nt, Human
ucuuuagagcacgggaaaaaca

SEQ ID NO: 254190 - RNA, 22 nt, Human
gaguggguaaaggugcuuggcu

SEQ ID NO: 254191 - RNA, 22 nt, Human
agccuuguuggucugaguuugg

SEQ ID NO: 254192 - RNA, 22 nt, Human
acugcaaucuggauccuagaag

SEQ ID NO: 254193 - RNA, 19 nt, Human
aggaaggcggcggcugccc

SEQ ID NO: 254194 - RNA, 22 nt, Human
aggcagcuagagagugaaacug

SEQ ID NO: 254195 - RNA, 22 nt, Human
uagcuuuaagacauggugaaug

SEQ ID NO: 254196 - RNA, 22 nt, Human
uacagugcgauuuuuaggccuc

SEQ ID NO: 254197 - RNA, 22 nt, Human
acaguuuauaaaaauaaugagg

SEQ ID NO: 254198 - RNA, 22 nt, Human
gaggccagauacucucuucugc

SEQ ID NO: 254199 - RNA, 22 nt, Human
ccugucuuagggaaagacugga

SEQ ID NO: 254200 - RNA, 22 nt, Human
ugggagagcacugcagccccgg

SEQ ID NO: 254201 - RNA, 22 nt, Human
cacaugagguggagaugaauga

SEQ ID NO: 254202 - RNA, 22 nt, Human
ucucuggccgagagucccuggg

SEQ ID NO: 254203 - RNA, 22 nt, Human
cuuucuaguaggaaguagauca

SEQ ID NO: 254204 - RNA, 20 nt, Human
uguaggaaggacccugucug

SEQ ID NO: 254205 - RNA, 22 nt, Human
acugaugaguaggcagacaagg

SEQ ID NO: 254206 - RNA, 22 nt, Human
ucauugaauuugguucaauaug

SEQ ID NO: 254207 - RNA, 22 nt, Human
cauaacuugguguuggaaacug

SEQ ID NO: 254208 - RNA, 22 nt, Human
gagagaaaugugcaguuugggc

SEQ ID NO: 254209 - RNA, 22 nt, Human
guccuuccugcagggauggaug

SEQ ID NO: 254210 - RNA, 22 nt, Human
aaagcagguugcaauuacagug

SEQ ID NO: 254211 - RNA, 22 nt, Human
guucuucagucacaucacagaa

SEQ ID NO: 254212 - RNA, 19 nt, Human
cccucauucacuuauucuc

SEQ ID NO: 254213 - RNA, 22 nt, Human
aaguauucuggcagucauucag

SEQ ID NO: 254214 - RNA, 22 nt, Human
ucuuauaugcacauacauuggg

SEQ ID NO: 254215 - RNA, 22 nt, Human
acuaucaacaucauugcucuag

SEQ ID NO: 254216 - RNA, 22 nt, Human
cauguacaaggaugcucagagu

SEQ ID NO: 254217 - RNA, 23 nt, Human
uccaauucaauugggucaggaag

SEQ ID NO: 254218 - RNA, 22 nt, Human
uagaauaaguugaugauauaug

SEQ ID NO: 254219 - RNA, 22 nt, Human
uuagagaagcuguaauuauuca

SEQ ID NO: 254220 - RNA, 21 nt, Human
agaagccugaugaggucugcu

SEQ ID NO: 254221 - RNA, 22 nt, Human
cagguccucgggggaggccggc

SEQ ID NO: 254222 - RNA, 21 nt, Human
gcugcagggcccagggcaccc

SEQ ID NO: 254223 - RNA, 22 nt, Human
cccauuuagauaacaguucaaa

SEQ ID NO: 254224 - RNA, 22 nt, Human
ugcccuggugaagugcucuccu

SEQ ID NO: 254225 - RNA, 22 nt, Human
acugcauugagguuucauacuu

SEQ ID NO: 254226 - RNA, 22 nt, Human
cuucucuugguaguucuuguug

SEQ ID NO: 254227 - RNA, 22 nt, Human
uuacagagauaaacuguaagug

SEQ ID NO: 254228 - RNA, 22 nt, Human
aaggacagguuggggcuucagg

SEQ ID NO: 254229 - RNA, 22 nt, Human
auccacagucagaacgggccua

SEQ ID NO: 254230 - RNA, 22 nt, Human
auuauuucucacucacauaaua

SEQ ID NO: 254231 - RNA, 20 nt, Human
cugccgaccacagccaugga

SEQ ID NO: 254232 - RNA, 22 nt, Human
acagagcaugcucaguguguga

SEQ ID NO: 254233 - RNA, 22 nt, Human
gaagccuugaacugcaaacccc

SEQ ID NO: 254234 - RNA, 22 nt, Human
ugccagccagguucugaggcua

SEQ ID NO: 254235 - RNA, 22 nt, Human
gugcuuuaaaccacugugcugu

SEQ ID NO: 254236 - RNA, 22 nt, Human
gggaggcauguguuauccacuu

SEQ ID NO: 254237 - RNA, 22 nt, Human
ucuuucuuauuagccauuguuc

SEQ ID NO: 254238 - RNA, 22 nt, Human
gugcacaucgugcagguuuguu

SEQ ID NO: 254239 - RNA, 22 nt, Human
caaagagcuguucagugucgcu

SEQ ID NO: 254240 - RNA, 21 nt, Human
aguccaggagucacccaagcc

SEQ ID NO: 254241 - RNA, 22 nt, Human
cccccacuaaguugagggcccu

SEQ ID NO: 254242 - RNA, 22 nt, Human
uggaaacuaacaacagagcaga

SEQ ID NO: 254243 - RNA, 22 nt, Human
aggcucugccaauuccuuccuc

SEQ ID NO: 254244 - RNA, 22 nt, Human
cuccagggagcuguggagguuu

SEQ ID NO: 254245 - RNA, 21 nt, Human
agcagcugggcaacauggagg

SEQ ID NO: 254246 - RNA, 22 nt, Human
aggaggagguaagaaaagcaua

SEQ ID NO: 254247 - RNA, 22 nt, Human
uuuccagucccuggauuuaacc

SEQ ID NO: 254248 - RNA, 22 nt, Human
uguaggcauauucauagaguug

SEQ ID NO: 254249 - RNA, 22 nt, Human
aaagacuaaacaaccaauaucu

SEQ ID NO: 254250 - RNA, 22 nt, Human
caggaggguguggaaaacuggg

SEQ ID NO: 254251 - RNA, 22 nt, Human
gagguaucuuagagaguguaga

SEQ ID NO: 254252 - RNA, 22 nt, Human
uuuguguuguuuuaagccacua

SEQ ID NO: 254253 - RNA, 16 nt, Human
aucuaagaugugcauu

SEQ ID NO: 254254 - RNA, 22 nt, Human
aaaggacugaugcugaguaccu

SEQ ID NO: 254255 - RNA, 22 nt, Human
cacauuucuggaauugacuugg

SEQ ID NO: 254256 - RNA, 22 nt, Human
gagcuuggugcugccuguuguc

SEQ ID NO: 254257 - RNA, 22 nt, Human
acagaagugacaauuucuuggg

SEQ ID NO: 254258 - RNA, 22 nt, Human
uuucucucuuaaggaguuuaaa

SEQ ID NO: 254259 - RNA, 22 nt, Human
gcuggcaggagaccauacccua

SEQ ID NO: 254260 - RNA, 22 nt, Human
uucuuuauguuaaugaaucuau

SEQ ID NO: 254261 - RNA, 22 nt, Human
ucaggaagaagacggggcagga

SEQ ID NO: 254262 - RNA, 19 nt, Human
gaggaggcuucagcuuucu

SEQ ID NO: 254263 - RNA, 22 nt, Human
aggacuaaaaagaugcucuccc

SEQ ID NO: 254264 - RNA, 22 nt, Human
uuugcacuagcauuuguccaug

SEQ ID NO: 254265 - RNA, 22 nt, Human
uucuggauaugggagagggagc

SEQ ID NO: 254266 - RNA, 22 nt, Human
ugaggcaaggcugaaugaaggc

SEQ ID NO: 254267 - RNA, 21 nt, Human
ugcagaaaugguuuuucuaag

SEQ ID NO: 254268 - RNA, 22 nt, Human
aagcagcuggaagaguaagaug

SEQ ID NO: 254269 - RNA, 22 nt, Human
uccugggacuuucaaggcuagg

SEQ ID NO: 254270 - RNA, 22 nt, Human
ugcaucagaguuugcugcugcu

SEQ ID NO: 254271 - RNA, 22 nt, Human
uagggacccucccugcucuaac

SEQ ID NO: 254272 - RNA, 23 nt, Human
gccuucagcucgggaaggcuccc

SEQ ID NO: 254273 - RNA, 22 nt, Human
uugaccugggcacagugagcau

SEQ ID NO: 254274 - RNA, 17 nt, Human
aagagaggcugagcugg

SEQ ID NO: 254275 - RNA, 22 nt, Human
gacugguaagguauuggaauuc

SEQ ID NO: 254276 - RNA, 21 nt, Human
ugacaggcacccuggcuguga

SEQ ID NO: 254277 - RNA, 22 nt, Human
ugcugaggaauuugguuuaugu

SEQ ID NO: 254278 - RNA, 22 nt, Human
cagaaagaccugauuggcaguu

SEQ ID NO: 254279 - RNA, 22 nt, Human
gccugaaggagucagagagggc

SEQ ID NO: 254280 - RNA, 22 nt, Human
auggauaaauacuuggugguau

SEQ ID NO: 254281 - RNA, 22 nt, Human
agcagccuugcaggggucgcac

SEQ ID NO: 254282 - RNA, 20 nt, Human
agccuggcaaacacccccag

SEQ ID NO: 254283 - RNA, 22 nt, Human
aggagcugguagucucauuggg

SEQ ID NO: 254284 - RNA, 20 nt, Human
uugaggcaugucuagaagua

SEQ ID NO: 254285 - RNA, 22 nt, Human
cauuuguauagugcuuagacca

SEQ ID NO: 254286 - RNA, 22 nt, Human
ucacagacacagggagaagcau

SEQ ID NO: 254287 - RNA, 22 nt, Human
uucuuguacuggagauacauga

SEQ ID NO: 254288 - RNA, 21 nt, Human
ugcuccagggcagcuuccagc

SEQ ID NO: 254289 - RNA, 19 nt, Human
gccugcagaaaaggcaggg

SEQ ID NO: 254290 - RNA, 22 nt, Human
ugcuuauuuagguagauauuaa

SEQ ID NO: 254291 - RNA, 22 nt, Human
acagagguuuccauugagguuu

SEQ ID NO: 254292 - RNA, 22 nt, Human
uguacagugccaugcaguuugc

SEQ ID NO: 254293 - RNA, 22 nt, Human
gcaaauucuuaacuggacugug

SEQ ID NO: 254294 - RNA, 22 nt, Human
ggagaggugaauggcugcucua

SEQ ID NO: 254295 - RNA, 23 nt, Human
uggcucugagagguucagaugcu

SEQ ID NO: 254296 - RNA, 21 nt, Human
aucauuaauugcugagugaca

SEQ ID NO: 254297 - RNA, 22 nt, Human
caaaccuuguuccagucaacuc

SEQ ID NO: 254298 - RNA, 22 nt, Human
auacacuuuagaaaaacgcugc

SEQ ID NO: 254299 - RNA, 22 nt, Human
cacaucagguagaccuacagag

SEQ ID NO: 254300 - RNA, 22 nt, Human
aucaugaaucuuguguucuaug

SEQ ID NO: 254301 - RNA, 22 nt, Human
acuuuguuuggcuauuagaguc

SEQ ID NO: 254302 - RNA, 22 nt, Human
uggauaaaaugacauuaccuga

SEQ ID NO: 254303 - RNA, 22 nt, Human
aaacagaaauuuccucaugcuc

SEQ ID NO: 254304 - RNA, 22 nt, Human
ccuccuguuguccugcuggggc

SEQ ID NO: 254305 - RNA, 22 nt, Human
agccccaguucccuggaagucu

SEQ ID NO: 254306 - RNA, 22 nt, Human
agcuggggguagugagaaauaa

SEQ ID NO: 254307 - RNA, 22 nt, Human
gagccuuucuagauaauccagg

SEQ ID NO: 254308 - RNA, 22 nt, Human
uaaauguaccuucugccuuacu

SEQ ID NO: 254309 - RNA, 22 nt, Human
agcagcaaguguaacugaauau

SEQ ID NO: 254310 - RNA, 22 nt, Human
gcuuaucuugaaauccaccagc

SEQ ID NO: 254311 - RNA, 22 nt, Human
uggcuucauucagcaugacagu

SEQ ID NO: 254312 - RNA, 22 nt, Human
ggccaugcaggucagagguggg

SEQ ID NO: 254313 - RNA, 22 nt, Human
ccaccuccucggccaugugacg

SEQ ID NO: 254314 - RNA, 23 nt, Human
cuucaugagagcccugaggaaaa

SEQ ID NO: 254315 - RNA, 22 nt, Human
aggccagugccuuuccagggcu

SEQ ID NO: 254316 - RNA, 22 nt, Human
acaguguguucugggaccucca

SEQ ID NO: 254317 - RNA, 22 nt, Human
gaggaggaggaaguggaaccca

SEQ ID NO: 254318 - RNA, 22 nt, Human
gcaaagcaucaguagaaauguu

SEQ ID NO: 254319 - RNA, 22 nt, Human
uagagagguuugaauuggcugc

SEQ ID NO: 254320 - RNA, 22 nt, Human
uaugaaaugguaguaggaaggg

SEQ ID NO: 254321 - RNA, 22 nt, Human
uaauaccacugugcucauuaua

SEQ ID NO: 254322 - RNA, 22 nt, Human
auuguuaaacugaagcauuacu

SEQ ID NO: 254323 - RNA, 22 nt, Human
auacuucuuuaagaguaagucu

SEQ ID NO: 254324 - RNA, 22 nt, Human
uggguccuugcuaacuucuaug

SEQ ID NO: 254325 - RNA, 22 nt, Human
ugcaaauguguuuuaaaccaaa

SEQ ID NO: 254326 - RNA, 22 nt, Human
cccugguggggccagacuugcu

SEQ ID NO: 254327 - RNA, 22 nt, Human
cuuuaguuauuuagacuacagu

SEQ ID NO: 254328 - RNA, 22 nt, Human
guuugaaugcaguaugcauuuu

SEQ ID NO: 254329 - RNA, 22 nt, Human
caguuucuguggucucuuuuca

SEQ ID NO: 254330 - RNA, 22 nt, Human
agaaguuugguccuauaaacuc

SEQ ID NO: 254331 - RNA, 22 nt, Human
aauauguucaaaauagaucacu

SEQ ID NO: 254332 - RNA, 22 nt, Human
ggaggccaccauggagucacuu

SEQ ID NO: 254333 - RNA, 18 nt, Human
acagggaugggguaagug

SEQ ID NO: 254334 - RNA, 22 nt, Human
uagaauacaguuuaagaacuac

SEQ ID NO: 254335 - RNA, 22 nt, Human
acugucacuaacuaagucuagu

SEQ ID NO: 254336 - RNA, 22 nt, Human
cgcagggccgcgagcgggacca

SEQ ID NO: 254337 - RNA, 22 nt, Human
uccugucuaaagaccugcaggc

SEQ ID NO: 254338 - RNA, 20 nt, Human
acugcuguagaccaucugca

SEQ ID NO: 254339 - RNA, 22 nt, Human
aggggagaggugagcaacuucu

SEQ ID NO: 254340 - RNA, 22 nt, Human
augaggcagcuggcuuucuccc

SEQ ID NO: 254341 - RNA, 22 nt, Human
uucauucuuauuugugaucugg

SEQ ID NO: 254342 - RNA, 22 nt, Human
agucaguugcaaacaucaggca

SEQ ID NO: 254343 - RNA, 20 nt, Human
cugaagagacuggaggggca

SEQ ID NO: 254344 - RNA, 22 nt, Human
caauuuuuguacuuauaguacu

SEQ ID NO: 254345 - RNA, 22 nt, Human
cuuagaagaaugccuaggacag

SEQ ID NO: 254346 - RNA, 22 nt, Human
guguguccucauaagauggagg

SEQ ID NO: 254347 - RNA, 22 nt, Human
acaaggcuguuggucacaaacc

SEQ ID NO: 254348 - RNA, 22 nt, Human
ucaguguguacacugagcauuu

SEQ ID NO: 254349 - RNA, 22 nt, Human
ugaggcaguugagcuuccugag

SEQ ID NO: 254350 - RNA, 22 nt, Human
cccuuggccacugcgccaguga

SEQ ID NO: 254351 - RNA, 22 nt, Human
uuggccuucugguguucauuuu

SEQ ID NO: 254352 - RNA, 22 nt, Human
cucagagagggcaccagggcca

SEQ ID NO: 254353 - RNA, 21 nt, Human
uuuagggaccaggucauaggc

SEQ ID NO: 254354 - RNA, 22 nt, Human
uuucuuuuccaauaucccuacu

SEQ ID NO: 254355 - RNA, 22 nt, Human
aguggcagagaccccagccagc

SEQ ID NO: 254356 - RNA, 22 nt, Human
uggggucccaacucugauugau

SEQ ID NO: 254357 - RNA, 22 nt, Human
agcagagcgccugcucagaggg

SEQ ID NO: 254358 - RNA, 22 nt, Human
gaggaagaagcaaaccagcuaa

SEQ ID NO: 254359 - RNA, 22 nt, Human
cccuuggaagguagcuggcagu

SEQ ID NO: 254360 - RNA, 22 nt, Human
agagaaaagccaucccagccaa

SEQ ID NO: 254361 - RNA, 22 nt, Human
uucuagaaacuggagcaaacag

SEQ ID NO: 254362 - RNA, 22 nt, Human
ucaacaguugcacuggagaggu

SEQ ID NO: 254363 - RNA, 22 nt, Human
gcugccugccuugccuggagga

SEQ ID NO: 254364 - RNA, 22 nt, Human
caagaauccuguucuugaagau

SEQ ID NO: 254365 - RNA, 22 nt, Human
aagugguuauuuugaucuagaa

SEQ ID NO: 254366 - RNA, 22 nt, Human
gagcaugagggaaggcagcaga

SEQ ID NO: 254367 - RNA, 22 nt, Human
ucugaaaugcaggcaauuugcu

SEQ ID NO: 254368 - RNA, 22 nt, Human
uauugauaaggauggcugcaau

SEQ ID NO: 254369 - RNA, 22 nt, Human
ugaaagaagccucccuuuggag

SEQ ID NO: 254370 - RNA, 22 nt, Human
uagauuugccugggaaagcuca

SEQ ID NO: 254371 - RNA, 22 nt, Human
cagugaggaguccagggcagag

SEQ ID NO: 254372 - RNA, 22 nt, Human
uucaaacucuugcucugcuagu

SEQ ID NO: 254373 - RNA, 22 nt, Human
cugccugcaggacaccucgcua

SEQ ID NO: 254374 - RNA, 23 nt, Human
ucugugccaguuuccaugucugu

SEQ ID NO: 254375 - RNA, 23 nt, Human
uccagcagccaagaaggguagaa

SEQ ID NO: 254376 - RNA, 22 nt, Human
uguauuuucugaggagcauuag

SEQ ID NO: 254377 - RNA, 22 nt, Human
agaugcuggggccccucggaug

SEQ ID NO: 254378 - RNA, 22 nt, Human
ugggccagcucccugccccugg

SEQ ID NO: 254379 - RNA, 22 nt, Human
aaacucagaagguacagaaggg

SEQ ID NO: 254380 - RNA, 22 nt, Human
uguuugugcugccuggugggca

SEQ ID NO: 254381 - RNA, 22 nt, Human
gaauucauuagggaagcuaucu

SEQ ID NO: 254382 - RNA, 22 nt, Human
acugugauguuugugaucaucu

SEQ ID NO: 254383 - RNA, 22 nt, Human
uucuguuacaagugaaaaaaug

SEQ ID NO: 254384 - RNA, 22 nt, Human
uaugauuuguagacauuugauu

SEQ ID NO: 254385 - RNA, 22 nt, Human
ugcagaagcugcaggucagugg

SEQ ID NO: 254386 - RNA, 22 nt, Human
cuccugggcugggaacucagcc

SEQ ID NO: 254387 - RNA, 22 nt, Human
aagacauguuuuaagaauauuu

SEQ ID NO: 254388 - RNA, 22 nt, Human
ucagcaggucugaggcggggcc

SEQ ID NO: 254389 - RNA, 22 nt, Human
uccacagggaugccugcggcuu

SEQ ID NO: 254390 - RNA, 22 nt, Human
uagaaauggagaacagauuaau

SEQ ID NO: 254391 - RNA, 22 nt, Human
ucuagaauucccuuuugacaau

SEQ ID NO: 254392 - RNA, 22 nt, Human
ccacugcucugccaggagcugg

SEQ ID NO: 254393 - RNA, 16 nt, Human
gcagagcucagggacu

SEQ ID NO: 254394 - RNA, 22 nt, Human
gcuugggagaggguccccagga

SEQ ID NO: 254395 - RNA, 23 nt, Human
uuccugugguauauuuuauaggg

SEQ ID NO: 254396 - RNA, 20 nt, Human
ucugugugccaucaccuaac

SEQ ID NO: 254397 - RNA, 22 nt, Human
uuuuuacacuuagcauugagcg

SEQ ID NO: 254398 - RNA, 22 nt, Human
uggcuccucaucacaguuggug

SEQ ID NO: 254399 - RNA, 20 nt, Human
uuuauucagccuacccucuu

SEQ ID NO: 254400 - RNA, 22 nt, Human
uucugggcacacaggcccuggu

SEQ ID NO: 254401 - RNA, 22 nt, Human
ucaaauguucccuguacuggcc

SEQ ID NO: 254402 - RNA, 22 nt, Human
ucgugcaaaggcccaugugggu

SEQ ID NO: 254403 - RNA, 22 nt, Human
cagcugccuaugaccuagccuc

SEQ ID NO: 254404 - RNA, 23 nt, Human
ucucagugaaucucagaauucgc

SEQ ID NO: 254405 - RNA, 22 nt, Human
acauucauggguuuuacauuau

SEQ ID NO: 254406 - RNA, 22 nt, Human
gugguggaugucuguaaucuca

SEQ ID NO: 254407 - RNA, 22 nt, Human
acuuagaauauguucaagauuu

SEQ ID NO: 254408 - RNA, 22 nt, Human
ucuggaucucccucauccuggg

SEQ ID NO: 254409 - RNA, 22 nt, Human
gccccaggggaggugcccugca

SEQ ID NO: 254410 - RNA, 19 nt, Human
uaguacaaaagcagccaua

SEQ ID NO: 254411 - RNA, 22 nt, Human
cugccccagccuggggccuucu

SEQ ID NO: 254412 - RNA, 22 nt, Human
gcucagagaaagauuagucccu

SEQ ID NO: 254413 - RNA, 21 nt, Human
cagugcagggguuagcgugua

SEQ ID NO: 254414 - RNA, 22 nt, Human
ucugaaaucuaaugcucugugg

SEQ ID NO: 254415 - RNA, 22 nt, Human
ucuucagaagaucacaucagug

SEQ ID NO: 254416 - RNA, 22 nt, Human
ugaaugauuaaaacccggacua

SEQ ID NO: 254417 - RNA, 22 nt, Human
gcacacaugcaugcacaggagu

SEQ ID NO: 254418 - RNA, 22 nt, Human
accugagacuugggaugggaau

SEQ ID NO: 254419 - RNA, 22 nt, Human
aggcagaauguuggaaaggaag

SEQ ID NO: 254420 - RNA, 22 nt, Human
ucagagagaaauaguuuuugac

SEQ ID NO: 254421 - RNA, 22 nt, Human
ucuacuuuauaaguauauaagu

SEQ ID NO: 254422 - RNA, 22 nt, Human
agaugaaauuuguguugaguug

SEQ ID NO: 254423 - RNA, 21 nt, Human
aacacauccagaguauuugac

SEQ ID NO: 254424 - RNA, 22 nt, Human
uuuucucuacaaaauaaccagc

SEQ ID NO: 254425 - RNA, 22 nt, Human
ucucaacuaauggugcaagaug

SEQ ID NO: 254426 - RNA, 22 nt, Human
ucagggcacugucaccugauau

SEQ ID NO: 254427 - RNA, 22 nt, Human
acuaucucuuuugucugcagcu

SEQ ID NO: 254428 - RNA, 22 nt, Human
ccuugccuugguccuucgcagg

SEQ ID NO: 254429 - RNA, 22 nt, Human
ucugggcugcuucagccuucgc

SEQ ID NO: 254430 - RNA, 22 nt, Human
gccagccccuuagggcucuccc

SEQ ID NO: 254431 - RNA, 22 nt, Human
aguucuucauaaccuuacugug

SEQ ID NO: 254432 - RNA, 21 nt, Human
cucaaaauucuuucuguugga

SEQ ID NO: 254433 - RNA, 22 nt, Human
cggccaagccggggccccgaag

SEQ ID NO: 254434 - RNA, 22 nt, Human
gccugagaucagccaagccccu

SEQ ID NO: 254435 - RNA, 22 nt, Human
aaugucacucuguuuccucugc

SEQ ID NO: 254436 - RNA, 20 nt, Human
uggaccugucucuuuaggga

SEQ ID NO: 254437 - RNA, 22 nt, Human
cugaaggauuagagagcacuua

SEQ ID NO: 254438 - RNA, 22 nt, Human
caggccugagacaucugagaua

SEQ ID NO: 254439 - RNA, 22 nt, Human
ucucaaauguaaagcaugauuu

SEQ ID NO: 254440 - RNA, 22 nt, Human
cucaaaagacuuaaacauaaga

SEQ ID NO: 254441 - RNA, 22 nt, Human
ccugcaagacuauuuaguucca

SEQ ID NO: 254442 - RNA, 22 nt, Human
ggcaguuucaucaggagaaaag

SEQ ID NO: 254443 - RNA, 22 nt, Human
aguggcagagccaggguuggga

SEQ ID NO: 254444 - RNA, 22 nt, Human
acaggcagggaccuuggcuaag

SEQ ID NO: 254445 - RNA, 22 nt, Human
ugggugugcccagauggugucc

SEQ ID NO: 254446 - RNA, 22 nt, Human
gcagagguuggauuggugacuu

SEQ ID NO: 254447 - RNA, 22 nt, Human
uccugcaggccuguucccagua

SEQ ID NO: 254448 - RNA, 22 nt, Human
uaaggcuuggacuucuccaacc

SEQ ID NO: 254449 - RNA, 22 nt, Human
caucagaauuacuuggggagcu

SEQ ID NO: 254450 - RNA, 22 nt, Human
aagcauguacaaugagugucuc

SEQ ID NO: 254451 - RNA, 22 nt, Human
aggaaucagaauucuuagaauu

SEQ ID NO: 254452 - RNA, 22 nt, Human
aucuuuuugacauggugauggu

SEQ ID NO: 254453 - RNA, 22 nt, Human
aggaaaaaccuguuaaugguag

SEQ ID NO: 254454 - RNA, 22 nt, Human
cuggcuuccugaguccauuacc

SEQ ID NO: 254455 - RNA, 22 nt, Human
agaggcucugccgccucaggua

SEQ ID NO: 254456 - RNA, 22 nt, Human
ccucagagaaagguauggcuga

SEQ ID NO: 254457 - RNA, 22 nt, Human
uuuggcuuaacuuacaugauau

SEQ ID NO: 254458 - RNA, 22 nt, Human
aauuuaacugagaguacuuuua

SEQ ID NO: 254459 - RNA, 22 nt, Human
cagcuaggagaaaagguguuuu

SEQ ID NO: 254460 - RNA, 22 nt, Human
ugcagcaggcacaggacggaag

SEQ ID NO: 254461 - RNA, 22 nt, Human
uuuuggcuguagcuggaaaucu

SEQ ID NO: 254462 - RNA, 22 nt, Human
uggccaguagauaggcaggcaa

SEQ ID NO: 254463 - RNA, 22 nt, Human
gcagaauacauuuuguuuuccu

SEQ ID NO: 254464 - RNA, 23 nt, Human
uucaaagcuuaagcucuuuccac

SEQ ID NO: 254465 - RNA, 22 nt, Human
auaacagacuuagaguuacaag

SEQ ID NO: 254466 - RNA, 22 nt, Human
gaaaucaaacccuuuucugaua

SEQ ID NO: 254467 - RNA, 22 nt, Human
gcauucuuuagacugagagaua

SEQ ID NO: 254468 - RNA, 22 nt, Human
ggugugacucgcccucagggac

SEQ ID NO: 254469 - RNA, 22 nt, Human
cagacucugaugcagccuugug

SEQ ID NO: 254470 - RNA, 22 nt, Human
ggacacagguaaauaccacuga

SEQ ID NO: 254471 - RNA, 19 nt, Human
cuguuauugucagagcucc

SEQ ID NO: 254472 - RNA, 22 nt, Human
gggcugaguuccugccucacuc

SEQ ID NO: 254473 - RNA, 22 nt, Human
gacccuccugucuucuaaccaa

SEQ ID NO: 254474 - RNA, 22 nt, Human
cuccugggcugucggcgcucug

SEQ ID NO: 254475 - RNA, 22 nt, Human
uucaucuguaguuuuuccaagg

SEQ ID NO: 254476 - RNA, 22 nt, Human
aaccauucacaguguagccaaa

SEQ ID NO: 254477 - RNA, 22 nt, Human
aaauccaugguaaucuguuaca

SEQ ID NO: 254478 - RNA, 22 nt, Human
cugagcagucuagccagguguu

SEQ ID NO: 254479 - RNA, 22 nt, Human
cuggcagcauuaacagagagca

SEQ ID NO: 254480 - RNA, 22 nt, Human
cuuccuccgaagaaguugcugg

SEQ ID NO: 254481 - RNA, 22 nt, Human
ugcaggagcaccagcucacccu

SEQ ID NO: 254482 - RNA, 22 nt, Human
augggaggcagcagagcccagc

SEQ ID NO: 254483 - RNA, 22 nt, Human
aagcaauauacugauaugauua

SEQ ID NO: 254484 - RNA, 22 nt, Human
acugcugauuauugaaguagag

SEQ ID NO: 254485 - RNA, 22 nt, Human
auacacuuguacauuuuuuaau

SEQ ID NO: 254486 - RNA, 22 nt, Human
guggcugcucgggcuccggccc

SEQ ID NO: 254487 - RNA, 22 nt, Human
uagagggaaggaagaauggauu

SEQ ID NO: 254488 - RNA, 22 nt, Human
uacagaauguguaucauuacca

SEQ ID NO: 254489 - RNA, 22 nt, Human
cuguccucaucugccccaaggg

SEQ ID NO: 254490 - RNA, 22 nt, Human
cuggaaagugcugagacaauug

SEQ ID NO: 254491 - RNA, 22 nt, Human
aagcuguauguuaccacuguca

SEQ ID NO: 254492 - RNA, 22 nt, Human
cacugagaggucucauuuccaa

SEQ ID NO: 254493 - RNA, 22 nt, Human
agaaacugaauuauuucugagg

SEQ ID NO: 254494 - RNA, 22 nt, Human
ucagcacaggucuugcaaaaca

SEQ ID NO: 254495 - RNA, 23 nt, Human
uccagggcaguggcugggucugc

SEQ ID NO: 254496 - RNA, 22 nt, Human
gguguccuacugcuugguugcu

SEQ ID NO: 254497 - RNA, 22 nt, Human
ugcaaacaauuuccuauaaagu

SEQ ID NO: 254498 - RNA, 22 nt, Human
uuuuccuuucaucaggacaaag

SEQ ID NO: 254499 - RNA, 22 nt, Human
gguagaaagauggaacguugaa

SEQ ID NO: 254500 - RNA, 22 nt, Human
uugguuuagagagugugguuac

SEQ ID NO: 254501 - RNA, 22 nt, Human
cccuggcugccagucaccagac

SEQ ID NO: 254502 - RNA, 22 nt, Human
uuaggaaaaugaaauuaccugu

SEQ ID NO: 254503 - RNA, 22 nt, Human
uuuacuuugugucaagucaaga

SEQ ID NO: 254504 - RNA, 22 nt, Human
uacagagaacucauagaaagaa

SEQ ID NO: 254505 - RNA, 22 nt, Human
aguuuauguagaauuggcaaua

SEQ ID NO: 254506 - RNA, 19 nt, Human
agaguauugaauuugcccu

SEQ ID NO: 254507 - RNA, 21 nt, Human
cauuucaaagagcuggaaauc

SEQ ID NO: 254508 - RNA, 22 nt, Human
cauaucauuugcuuauaaaucu

SEQ ID NO: 254509 - RNA, 22 nt, Human
uacagaacugaaguagugaaaa

SEQ ID NO: 254510 - RNA, 22 nt, Human
caggcucaaggcugacuuccau

SEQ ID NO: 254511 - RNA, 21 nt, Human
aagaguggcugaggaggugau

SEQ ID NO: 254512 - RNA, 22 nt, Human
gauguguccuaguacggguggg

SEQ ID NO: 254513 - RNA, 22 nt, Human
uaggccaguggcagguugugug

SEQ ID NO: 254514 - RNA, 22 nt, Human
auagucagugucuauaucguug

SEQ ID NO: 254515 - RNA, 22 nt, Human
ccugcagaaaggguccccagga

SEQ ID NO: 254516 - RNA, 22 nt, Human
uccagcacccaauguggcuaag

SEQ ID NO: 254517 - RNA, 22 nt, Human
cagcaggugucuagcaaggguc

SEQ ID NO: 254518 - RNA, 22 nt, Human
cagucccaccaggaucgcucuu

SEQ ID NO: 254519 - RNA, 22 nt, Human
ucucuuugacccuuuagcucca

SEQ ID NO: 254520 - RNA, 22 nt, Human
uaaguguuucuccagugucuuu

SEQ ID NO: 254521 - RNA, 22 nt, Human
auacuuuggggguuaguguaga

SEQ ID NO: 254522 - RNA, 22 nt, Human
guggcagggcaaugcucccucu

SEQ ID NO: 254523 - RNA, 22 nt, Human
aagcugccagcugagcugaggc

SEQ ID NO: 254524 - RNA, 23 nt, Human
agacagaggcugaggcuggccgc

SEQ ID NO: 254525 - RNA, 22 nt, Human
uaguuuacuguucacuuugccc

SEQ ID NO: 254526 - RNA, 19 nt, Human
gcuggcagaauuuugaacc

SEQ ID NO: 254527 - RNA, 22 nt, Human
agggccuggcuucacuuucuca

SEQ ID NO: 254528 - RNA, 22 nt, Human
uggcacaguuaaaguuguagaa

SEQ ID NO: 254529 - RNA, 21 nt, Human
aaggcuggagaugcaggucug

SEQ ID NO: 254530 - RNA, 22 nt, Human
cuuccaaaauuuauauguugaa

SEQ ID NO: 254531 - RNA, 22 nt, Human
uuagaacuuuucaacuccauuc

SEQ ID NO: 254532 - RNA, 22 nt, Human
agcagcaggaggccauugucuu

SEQ ID NO: 254533 - RNA, 22 nt, Human
agggccagaggcaccuugcagc

SEQ ID NO: 254534 - RNA, 22 nt, Human
auucuagaugcuguaaguagca

SEQ ID NO: 254535 - RNA, 22 nt, Human
uacauguguucuguuucaaguu

SEQ ID NO: 254536 - RNA, 22 nt, Human
aaaaugacauuccagugauauu

SEQ ID NO: 254537 - RNA, 23 nt, Human
cuuucauugugguuucacagagc

SEQ ID NO: 254538 - RNA, 22 nt, Human
cuguccuggccgcccuugugag

SEQ ID NO: 254539 - RNA, 20 nt, Human
uuauuucaguugcuagauug

SEQ ID NO: 254540 - RNA, 21 nt, Human
uucuucaugaugauuaauggc

SEQ ID NO: 254541 - RNA, 22 nt, Human
gggucuggcaugcugagaugga

SEQ ID NO: 254542 - RNA, 22 nt, Human
ccuucaaucagcagucuagcuu

SEQ ID NO: 254543 - RNA, 23 nt, Human
acauguggagagaacagauaucu

SEQ ID NO: 254544 - RNA, 22 nt, Human
cuccucagucaggucuaggguc

SEQ ID NO: 254545 - RNA, 22 nt, Human
auguguuuauaauuacucaauc

SEQ ID NO: 254546 - RNA, 22 nt, Human
gaaggaggcuccccaaagucug

SEQ ID NO: 254547 - RNA, 22 nt, Human
gcagggcagugugucugugggg

SEQ ID NO: 254548 - RNA, 22 nt, Human
acaguauauauagucuaaaagc

SEQ ID NO: 254549 - RNA, 22 nt, Human
uagaaucuggaucugggcgcau

SEQ ID NO: 254550 - RNA, 22 nt, Human
uagaugaagcaacauguguaau

SEQ ID NO: 254551 - RNA, 22 nt, Human
ggcagaagauaggacagggaau

SEQ ID NO: 254552 - RNA, 22 nt, Human
uguguguccuugaccucagugg

SEQ ID NO: 254553 - RNA, 22 nt, Human
cauuuacacacagaggugugcu

SEQ ID NO: 254554 - RNA, 18 nt, Human
gagcucugccucccaguc

SEQ ID NO: 254555 - RNA, 22 nt, Human
accauccugaaaccuucaugcu

SEQ ID NO: 254556 - RNA, 20 nt, Human
cuucuucauuaacccuacug

SEQ ID NO: 254557 - RNA, 22 nt, Human
acaggagcucuagggacagcac

SEQ ID NO: 254558 - RNA, 22 nt, Human
agcagcaauaauaaaguaauac

SEQ ID NO: 254559 - RNA, 22 nt, Human
ggaauguucuggaacaccgcuu

SEQ ID NO: 254560 - RNA, 22 nt, Human
uaauaucuggcauucaaacaug

SEQ ID NO: 254561 - RNA, 22 nt, Human
ugggagcaagcuacuuagggaa

SEQ ID NO: 254562 - RNA, 22 nt, Human
cuguccugugcauugucagaug

SEQ ID NO: 254563 - RNA, 22 nt, Human
cccaggucugugccagcucuga

SEQ ID NO: 254564 - RNA, 21 nt, Human
cugggcucaagcaauccuuuc

SEQ ID NO: 254565 - RNA, 21 nt, Human
uggcucaguugcugggcacag

SEQ ID NO: 254566 - RNA, 22 nt, Human
gaauuacauuguuagccuuccu

SEQ ID NO: 254567 - RNA, 22 nt, Human
cagguucuggagaugcagagau

SEQ ID NO: 254568 - RNA, 22 nt, Human
uggcuaugcaaaccugaggcug

SEQ ID NO: 254569 - RNA, 22 nt, Human
aacauucuauuuugcuaaaaca

SEQ ID NO: 254570 - RNA, 22 nt, Human
cacagaacauccuuagcucaug

SEQ ID NO: 254571 - RNA, 22 nt, Human
cuugguuauacuccaggaacca

SEQ ID NO: 254572 - RNA, 22 nt, Human
aaagcagacugauuugcaucac

SEQ ID NO: 254573 - RNA, 21 nt, Human
agggccugugcucuccagguc

SEQ ID NO: 254574 - RNA, 21 nt, Human
cacuuuaaaaauaucuuuaua

SEQ ID NO: 254575 - RNA, 22 nt, Human
ucagaacauuaaggauuugaag

SEQ ID NO: 254576 - RNA, 22 nt, Human
agggcagcugugagccacugug

SEQ ID NO: 254577 - RNA, 22 nt, Human
cugaggccucucccacuccagc

SEQ ID NO: 254578 - RNA, 22 nt, Human
aauugcuuuacaagccguuuaa

SEQ ID NO: 254579 - RNA, 22 nt, Human
uguaauucauucaacugaagaa

SEQ ID NO: 254580 - RNA, 22 nt, Human
aauacaguaauuuugaugaguu

SEQ ID NO: 254581 - RNA, 22 nt, Human
cugcugagaugccaggagcucu

SEQ ID NO: 254582 - RNA, 22 nt, Human
auccaugauuaguaggauaaag

SEQ ID NO: 254583 - RNA, 22 nt, Human
caguuggaggaaugaggcugua

SEQ ID NO: 254584 - RNA, 22 nt, Human
gacagguugaaguaucaaaggu

SEQ ID NO: 254585 - RNA, 22 nt, Human
cuugaaguugcaaaacauuaau

SEQ ID NO: 254586 - RNA, 16 nt, Human
ccccucaggaaguaca

SEQ ID NO: 254587 - RNA, 22 nt, Human
cccuggcacuagcgacggccau

SEQ ID NO: 254588 - RNA, 22 nt, Human
gaguccuuccagcaggcauuua

SEQ ID NO: 254589 - RNA, 22 nt, Human
uggccuuggagaggcacggccc

SEQ ID NO: 254590 - RNA, 22 nt, Human
uuaagagcaacauauggugaca

SEQ ID NO: 254591 - RNA, 22 nt, Human
ugagcuuauucauaaaagugca

SEQ ID NO: 254592 - RNA, 22 nt, Human
uuuugcuugagugcacaaaaug

SEQ ID NO: 254593 - RNA, 22 nt, Human
uaagacuuccaggaaaaggugg

SEQ ID NO: 254594 - RNA, 22 nt, Human
uguccauggauagagcugcucg

SEQ ID NO: 254595 - RNA, 22 nt, Human
uuuaauugcauuuaaagaugga

SEQ ID NO: 254596 - RNA, 22 nt, Human
ugggugaggagaggcugucuaa

SEQ ID NO: 254597 - RNA, 22 nt, Human
uguaaaguuacuuuugaaagga

SEQ ID NO: 254598 - RNA, 22 nt, Human
agagcagauggagcuggaagag

SEQ ID NO: 254599 - RNA, 22 nt, Human
cguugugagcuugguagacacu

SEQ ID NO: 254600 - RNA, 22 nt, Human
cucucucuuguguugcugcaga

SEQ ID NO: 254601 - RNA, 19 nt, Human
ccuguucuuggcugaggcu

SEQ ID NO: 254602 - RNA, 22 nt, Human
ucagacagugugaucagucucu

SEQ ID NO: 254603 - RNA, 22 nt, Human
uucccuggcucuucuacaucgu

SEQ ID NO: 254604 - RNA, 22 nt, Human
aguuuagacaaagucuugcauu

SEQ ID NO: 254605 - RNA, 22 nt, Human
uuccucagggaggcuagcagua

SEQ ID NO: 254606 - RNA, 22 nt, Human
aauaagaucuuaaagguuauau

SEQ ID NO: 254607 - RNA, 22 nt, Human
ugagcugauggcaucccuguuu

SEQ ID NO: 254608 - RNA, 22 nt, Human
cugcccugggugcuggggaucc

SEQ ID NO: 254609 - RNA, 22 nt, Human
caggagccgccaggcacguugg

SEQ ID NO: 254610 - RNA, 22 nt, Human
ucucuaaaucugguucacuugc

SEQ ID NO: 254611 - RNA, 22 nt, Human
gaaaaguacacagcccaaacau

SEQ ID NO: 254612 - RNA, 22 nt, Human
gccuggcugucuggcaagguuc

SEQ ID NO: 254613 - RNA, 22 nt, Human
auguccuuccugagaucccugu

SEQ ID NO: 254614 - RNA, 22 nt, Human
ggccucucuggcauggcugccc

SEQ ID NO: 254615 - RNA, 22 nt, Human
gagaaucucuuugacaagcaga

SEQ ID NO: 254616 - RNA, 22 nt, Human
acaaaguguuuucugaaggccu

SEQ ID NO: 254617 - RNA, 22 nt, Human
aaaugucauauuuaaguaggaa

SEQ ID NO: 254618 - RNA, 22 nt, Human
agaugguucagaauuauaaaga

SEQ ID NO: 254619 - RNA, 22 nt, Human
uaaugaauaaacuugagaguca

SEQ ID NO: 254620 - RNA, 19 nt, Human
gagcaggccacacaugugu

SEQ ID NO: 254621 - RNA, 23 nt, Human
agcugaggcugugggugucagag

SEQ ID NO: 254622 - RNA, 21 nt, Human
uugcuuauggcacugcuuugc

SEQ ID NO: 254623 - RNA, 18 nt, Human
ugcuggguaacuguaugg

SEQ ID NO: 254624 - RNA, 23 nt, Human
agcaccugugauuuccuagcucu

SEQ ID NO: 254625 - RNA, 22 nt, Human
cuaagaaaauagaagcaugcua

SEQ ID NO: 254626 - RNA, 22 nt, Human
uucugcugagugggcaggugca

SEQ ID NO: 254627 - RNA, 22 nt, Human
aggaagcuagaaggucuucuuu

SEQ ID NO: 254628 - RNA, 22 nt, Human
ccugggcaggccggacgcuggg

SEQ ID NO: 254629 - RNA, 22 nt, Human
uaacacaaaagaauaugugugu

SEQ ID NO: 254630 - RNA, 22 nt, Human
aggagacccagaauguugcugu

SEQ ID NO: 254631 - RNA, 22 nt, Human
gaaugcuauuauuucugugugu

SEQ ID NO: 254632 - RNA, 20 nt, Human
aggcugucauuucuggcagg

SEQ ID NO: 254633 - RNA, 22 nt, Human
uuauuaaaaugcggauuuggcu

SEQ ID NO: 254634 - RNA, 22 nt, Human
uccuggaggagauccaaucuga

SEQ ID NO: 254635 - RNA, 22 nt, Human
agcggucaggagaaauaagcau

SEQ ID NO: 254636 - RNA, 19 nt, Human
aaugcauggaaguuggaga

SEQ ID NO: 254637 - RNA, 22 nt, Human
agcaggggcaggguuuugugcu

SEQ ID NO: 254638 - RNA, 22 nt, Human
ugugauucucagaagagggaag

SEQ ID NO: 254639 - RNA, 22 nt, Human
ggucugagcuugagcccaugcu

SEQ ID NO: 254640 - RNA, 22 nt, Human
agcuggcagcucucagggguac

SEQ ID NO: 254641 - RNA, 22 nt, Human
gugauaaaauucaaauagcucu

SEQ ID NO: 254642 - RNA, 22 nt, Human
agggcccaguggagagcugagc

SEQ ID NO: 254643 - RNA, 22 nt, Human
uucagcaccuggaauagcaccu

SEQ ID NO: 254644 - RNA, 22 nt, Human
aggaauguggcaaucuucaagu

SEQ ID NO: 254645 - RNA, 22 nt, Human
agggaggaucugcuccuugucu

SEQ ID NO: 254646 - RNA, 22 nt, Human
aagcacagagaugggcacgccu

SEQ ID NO: 254647 - RNA, 22 nt, Human
gucuguacccacguccugcuag

SEQ ID NO: 254648 - RNA, 22 nt, Human
augcaguuuaaggcacaauuag

SEQ ID NO: 254649 - RNA, 22 nt, Human
ucaggugggaccugcuaggaca

SEQ ID NO: 254650 - RNA, 22 nt, Human
caauuacugguccacagaaauu

SEQ ID NO: 254651 - RNA, 21 nt, Human
ggcaauuaggcuucugaguau

SEQ ID NO: 254652 - RNA, 22 nt, Human
gaagggaaggaaagaaccagca

SEQ ID NO: 254653 - RNA, 22 nt, Human
agagacaaacacugcaacuucu

SEQ ID NO: 254654 - RNA, 22 nt, Human
aagggagaaaacuuguggcuua

SEQ ID NO: 254655 - RNA, 22 nt, Human
caauuucucgaacucuaaucca

SEQ ID NO: 254656 - RNA, 22 nt, Human
ugggcucucagucagacuggca

SEQ ID NO: 254657 - RNA, 22 nt, Human
uucauagcagucccuuucuggg

SEQ ID NO: 254658 - RNA, 22 nt, Human
cuguacaggugaggagggggcu

SEQ ID NO: 254659 - RNA, 22 nt, Human
ucucagagagcuguguuuuccu

SEQ ID NO: 254660 - RNA, 22 nt, Human
cuguagcagacagacccuaggu

SEQ ID NO: 254661 - RNA, 22 nt, Human
uuaaacugcagacucaguguuc

SEQ ID NO: 254662 - RNA, 18 nt, Human
cagggcuguggggucacu

SEQ ID NO: 254663 - RNA, 22 nt, Human
uucaagaaagaguggcuauucc

SEQ ID NO: 254664 - RNA, 22 nt, Human
ucugggagcacacgcagugauc

SEQ ID NO: 254665 - RNA, 22 nt, Human
ugcaauccacuauucuaaagcc

SEQ ID NO: 254666 - RNA, 22 nt, Human
cccugagagugagugccaccuu

SEQ ID NO: 254667 - RNA, 22 nt, Human
cuggagcuaggaaguccaagau

SEQ ID NO: 254668 - RNA, 19 nt, Human
gcacacaguagggcuggca

SEQ ID NO: 254669 - RNA, 22 nt, Human
agcugaaacuucccauuaauug

SEQ ID NO: 254670 - RNA, 22 nt, Human
acacacguauauauacguaugu

SEQ ID NO: 254671 - RNA, 22 nt, Human
aaauuagaucaguggauuuucu

SEQ ID NO: 254672 - RNA, 22 nt, Human
uuuggacaaaugucugacuuuc

SEQ ID NO: 254673 - RNA, 22 nt, Human
aggcagaggagaaugaucuucc

SEQ ID NO: 254674 - RNA, 22 nt, Human
aauuucuucagcucuaaaaugg

SEQ ID NO: 254675 - RNA, 22 nt, Human
gcguccagggaaggcccagcug

SEQ ID NO: 254676 - RNA, 22 nt, Human
gugcugaggagagggggugguc

SEQ ID NO: 254677 - RNA, 22 nt, Human
augguggacgggagacaggacu

SEQ ID NO: 254678 - RNA, 21 nt, Human
gauaaggcaggaggauaagua

SEQ ID NO: 254679 - RNA, 22 nt, Human
aaugauuuccccuacacagaag

SEQ ID NO: 254680 - RNA, 22 nt, Human
gggggcaggucuggaacuuuga

SEQ ID NO: 254681 - RNA, 22 nt, Human
acagggggucccauggccugga

SEQ ID NO: 254682 - RNA, 22 nt, Human
uccugccaccugcacagcuccc

SEQ ID NO: 254683 - RNA, 22 nt, Human
gaaauaaccucaugcaccauga

SEQ ID NO: 254684 - RNA, 22 nt, Human
guugaauauuuuaagaguuuug

SEQ ID NO: 254685 - RNA, 21 nt, Human
uucugcuguucaccaccaccc

SEQ ID NO: 254686 - RNA, 22 nt, Human
gucuggagacuugggucaucaa

SEQ ID NO: 254687 - RNA, 22 nt, Human
agucaguggauuuaccaugcgu

SEQ ID NO: 254688 - RNA, 22 nt, Human
gcuuuagaagacacucuguuuu

SEQ ID NO: 254689 - RNA, 22 nt, Human
ucaaucaaagccagauguccuu

SEQ ID NO: 254690 - RNA, 22 nt, Human
ugcaacagacuuuauuaacucu

SEQ ID NO: 254691 - RNA, 22 nt, Human
aagauucagccaaauuguucau

SEQ ID NO: 254692 - RNA, 22 nt, Human
acucaguuaucauguguccaca

SEQ ID NO: 254693 - RNA, 22 nt, Human
acauguauacaauguguaauga

SEQ ID NO: 254694 - RNA, 22 nt, Human
ccaggucugucuucuuagcuca

SEQ ID NO: 254695 - RNA, 22 nt, Human
cagagccacugcauuuuacagc

SEQ ID NO: 254696 - RNA, 22 nt, Human
gaugcugauuauuucuugcuag

SEQ ID NO: 254697 - RNA, 22 nt, Human
agcaggcauagaguagcacuca

SEQ ID NO: 254698 - RNA, 21 nt, Human
agaagccuggggaauguggcu

SEQ ID NO: 254699 - RNA, 22 nt, Human
cccagccagccucuucccauau

SEQ ID NO: 254700 - RNA, 21 nt, Human
aggcccaggaauaugcauuuu

SEQ ID NO: 254701 - RNA, 22 nt, Human
ucuggcuccguguccgcuccca

SEQ ID NO: 254702 - RNA, 22 nt, Human
ucaguguuggcauucagaaaug

SEQ ID NO: 254703 - RNA, 22 nt, Human
gguguccuugcagaaggcggcg

SEQ ID NO: 254704 - RNA, 22 nt, Human
gcaaacaugugcucauuuugug

SEQ ID NO: 254705 - RNA, 22 nt, Human
agcuccagagccacauccauca

SEQ ID NO: 254706 - RNA, 22 nt, Human
accugggaaagccguggaaagg

SEQ ID NO: 254707 - RNA, 22 nt, Human
auugcaaaggucccauucaaga

SEQ ID NO: 254708 - RNA, 22 nt, Human
auucagagauuguuauucagac

SEQ ID NO: 254709 - RNA, 22 nt, Human
aauuauauugaaguugaauguc

SEQ ID NO: 254710 - RNA, 22 nt, Human
agucuagauguguacuagguua

SEQ ID NO: 254711 - RNA, 22 nt, Human
uuggcuucuguuuuggcucugu

SEQ ID NO: 254712 - RNA, 22 nt, Human
aauuagaagcuguuagcaaaau

SEQ ID NO: 254713 - RNA, 22 nt, Human
caauguuuuuccuuccuuaaua

SEQ ID NO: 254714 - RNA, 22 nt, Human
ucuggagaagcagugagaguca

SEQ ID NO: 254715 - RNA, 22 nt, Human
ucucugcagcuaagaaauuaau

SEQ ID NO: 254716 - RNA, 18 nt, Human
cugaggcccagagagggc

SEQ ID NO: 254717 - RNA, 23 nt, Human
ugcuggguaaauagcugaguaac

SEQ ID NO: 254718 - RNA, 22 nt, Human
auuuugacagaagaggcccuaa

SEQ ID NO: 254719 - RNA, 22 nt, Human
ucagggagggaccugaggcugg

SEQ ID NO: 254720 - RNA, 22 nt, Human
aagauauagauggugguauaaa

SEQ ID NO: 254721 - RNA, 22 nt, Human
caagccaguuuguaguucucuc

SEQ ID NO: 254722 - RNA, 22 nt, Human
aacauguaaccagcauucaucu

SEQ ID NO: 254723 - RNA, 22 nt, Human
guccagcccgggcuccgccagc

SEQ ID NO: 254724 - RNA, 22 nt, Human
ccacugcccaccccgacgucua

SEQ ID NO: 254725 - RNA, 22 nt, Human
ucaggcugagaaaaucuggacc

SEQ ID NO: 254726 - RNA, 22 nt, Human
augcagggagguaagaggugcc

SEQ ID NO: 254727 - RNA, 22 nt, Human
aucuguucuucaaaauauuaca

SEQ ID NO: 254728 - RNA, 22 nt, Human
aaggaaauacaacauguauuca

SEQ ID NO: 254729 - RNA, 22 nt, Human
agguccagguuccguuucugcg

SEQ ID NO: 254730 - RNA, 22 nt, Human
ccuggagaccugauggcagcgg

SEQ ID NO: 254731 - RNA, 22 nt, Human
aaagaucugacuuagacacaga

SEQ ID NO: 254732 - RNA, 22 nt, Human
ucaggcugggagacaaucacug

SEQ ID NO: 254733 - RNA, 22 nt, Human
augagauuuuaaaacuucacuu

SEQ ID NO: 254734 - RNA, 22 nt, Human
ucauuucaugucucaggcacug

SEQ ID NO: 254735 - RNA, 22 nt, Human
acacauguuuguguagucaguu

SEQ ID NO: 254736 - RNA, 22 nt, Human
aacaugcucuuccuggcuaguc

SEQ ID NO: 254737 - RNA, 22 nt, Human
auguggggacaaaaugauggcc

SEQ ID NO: 254738 - RNA, 18 nt, Human
ucauucaaagucuacuga

SEQ ID NO: 254739 - RNA, 22 nt, Human
gagcuuggcuggaccucacgga

SEQ ID NO: 254740 - RNA, 22 nt, Human
uccaggaggcucugguugacgu

SEQ ID NO: 254741 - RNA, 22 nt, Human
uacuuuuugucucuuugaaugu

SEQ ID NO: 254742 - RNA, 22 nt, Human
cucuggagagguucccauggga

SEQ ID NO: 254743 - RNA, 22 nt, Human
gcccuggauggcaggagccauc

SEQ ID NO: 254744 - RNA, 18 nt, Human
ggcaucugcacagcagcc

SEQ ID NO: 254745 - RNA, 22 nt, Human
ucugccuuggcaaccacagcuu

SEQ ID NO: 254746 - RNA, 22 nt, Human
aguguucuagcgcugugcuugu

SEQ ID NO: 254747 - RNA, 22 nt, Human
aguauuuagagacacaagaugg

SEQ ID NO: 254748 - RNA, 22 nt, Human
cuggguggagccuggucaucug

SEQ ID NO: 254749 - RNA, 22 nt, Human
uacaaaguuugagaaugcuuuc

SEQ ID NO: 254750 - RNA, 20 nt, Human
gccucagccaacccaugggg

SEQ ID NO: 254751 - RNA, 22 nt, Human
caguguuuguauagaauaugca

SEQ ID NO: 254752 - RNA, 22 nt, Human
uugaggagucaggggcacggaa

SEQ ID NO: 254753 - RNA, 19 nt, Human
ucucccagcugagaagggc

SEQ ID NO: 254754 - RNA, 22 nt, Human
gggucagggcuggcugucguca

SEQ ID NO: 254755 - RNA, 22 nt, Human
gaaggggguugcagucuagggu

SEQ ID NO: 254756 - RNA, 22 nt, Human
ucaggcugguccccacagugga

SEQ ID NO: 254757 - RNA, 22 nt, Human
uugcucugaaccacaccaucac

SEQ ID NO: 254758 - RNA, 22 nt, Human
auggaacaucagguuaagaaau

SEQ ID NO: 254759 - RNA, 22 nt, Human
agaaaucaugacuaagagcagu

SEQ ID NO: 254760 - RNA, 22 nt, Human
uuuugccuaggguugacccguu

SEQ ID NO: 254761 - RNA, 22 nt, Human
aucuucaaagggauguccaugg

SEQ ID NO: 254762 - RNA, 22 nt, Human
aggagccugugccuggcacucc

SEQ ID NO: 254763 - RNA, 22 nt, Human
gccugggugaauuugauccuaa

SEQ ID NO: 254764 - RNA, 22 nt, Human
gugcaaaaguaauggcaguuuu

SEQ ID NO: 254765 - RNA, 22 nt, Human
aguggcuguaucagucaacccu

SEQ ID NO: 254766 - RNA, 22 nt, Human
gcuggccugggcagaggcuaug

SEQ ID NO: 254767 - RNA, 22 nt, Human
cccuuccuccucgccugucaga

SEQ ID NO: 254768 - RNA, 22 nt, Human
gagccaagcaauauacccaacc

SEQ ID NO: 254769 - RNA, 22 nt, Human
uaaaaggagguugaagcuguca

SEQ ID NO: 254770 - RNA, 22 nt, Human
gcuggcauuacaggagagaacc

SEQ ID NO: 254771 - RNA, 22 nt, Human
ucauauaccugcaugugcaugu

SEQ ID NO: 254772 - RNA, 18 nt, Human
ugcaaauggcuguuugau

SEQ ID NO: 254773 - RNA, 22 nt, Human
uggagcugagagccaggcuggc

SEQ ID NO: 254774 - RNA, 22 nt, Human
auuagagcuguuagugaagugc

SEQ ID NO: 254775 - RNA, 22 nt, Human
cauauccaauaugacuaguguu

SEQ ID NO: 254776 - RNA, 22 nt, Human
ucucaggcccacuguguugaaa

SEQ ID NO: 254777 - RNA, 21 nt, Human
gaggaaugguuugcaaagcac

SEQ ID NO: 254778 - RNA, 22 nt, Human
cagcacagugaccagacccacu

SEQ ID NO: 254779 - RNA, 22 nt, Human
caggugguuaugaggaagguga

SEQ ID NO: 254780 - RNA, 22 nt, Human
aaggaggcagaacucacaugga

SEQ ID NO: 254781 - RNA, 22 nt, Human
aaaaguaauugcaauuuuguag

SEQ ID NO: 254782 - RNA, 22 nt, Human
gcauuuuaaugagguuuaugag

SEQ ID NO: 254783 - RNA, 22 nt, Human
ucuuucccuuagaacauuaaca

SEQ ID NO: 254784 - RNA, 22 nt, Human
cagagccugccaccuuucuccc

SEQ ID NO: 254785 - RNA, 22 nt, Human
caggcacaaauuucuagauaag

SEQ ID NO: 254786 - RNA, 22 nt, Human
cagagcugcacauucuaugaug

SEQ ID NO: 254787 - RNA, 22 nt, Human
uggaagaauuuggggauaaauu

SEQ ID NO: 254788 - RNA, 22 nt, Human
auguacaaaaugccacugaauu

SEQ ID NO: 254789 - RNA, 22 nt, Human
ugguccugcuugcugcuuaaga

SEQ ID NO: 254790 - RNA, 22 nt, Human
auguuuacagaggaagugccuc

SEQ ID NO: 254791 - RNA, 17 nt, Human
acagugucuaugaaaug

SEQ ID NO: 254792 - RNA, 20 nt, Human
cauacacuauucuguauagu

SEQ ID NO: 254793 - RNA, 22 nt, Human
aguggugaugacagcaguuucu

SEQ ID NO: 254794 - RNA, 22 nt, Human
gccagcugggccuuagggcugg

SEQ ID NO: 254795 - RNA, 22 nt, Human
gacagacaugggacuucauacu

SEQ ID NO: 254796 - RNA, 22 nt, Human
gaaucccuugcaaguuguugua

SEQ ID NO: 254797 - RNA, 21 nt, Human
ugcucagucugucuccagcuu

SEQ ID NO: 254798 - RNA, 22 nt, Human
uccgggcaacugaagggagguu

SEQ ID NO: 254799 - RNA, 22 nt, Human
ggucucagagguuucugcucag

SEQ ID NO: 254800 - RNA, 21 nt, Human
agcugggugggcugagugaca

SEQ ID NO: 254801 - RNA, 22 nt, Human
augcaguuuucaaagacuauuc

SEQ ID NO: 254802 - RNA, 22 nt, Human
gaagaacaagcagugcuuuccu

SEQ ID NO: 254803 - RNA, 22 nt, Human
caggcccugggcaggcacagag

SEQ ID NO: 254804 - RNA, 22 nt, Human
caggccucagagaguggcgggg

SEQ ID NO: 254805 - RNA, 22 nt, Human
auucucugaagucaauggaaau

SEQ ID NO: 254806 - RNA, 22 nt, Human
uuuuuugucuugaagaaauggu

SEQ ID NO: 254807 - RNA, 20 nt, Human
cugcuccacccggcucucag

SEQ ID NO: 254808 - RNA, 22 nt, Human
cagcagcugauggggaagugau

SEQ ID NO: 254809 - RNA, 22 nt, Human
acuuugcaaugggcagaaccca

SEQ ID NO: 254810 - RNA, 16 nt, Human
ggugggaggugaggug

SEQ ID NO: 254811 - RNA, 21 nt, Human
uucugggccggagaaggggcg

SEQ ID NO: 254812 - RNA, 22 nt, Human
ggggacagucgaucuagugauu

SEQ ID NO: 254813 - RNA, 22 nt, Human
uagggcaggggaggaaucugaa

SEQ ID NO: 254814 - RNA, 22 nt, Human
caagauuuagccugcugccugu

SEQ ID NO: 254815 - RNA, 22 nt, Human
uccucagaauggauggcagggg

SEQ ID NO: 254816 - RNA, 22 nt, Human
ucuggucccuuuuccugcaguc

SEQ ID NO: 254817 - RNA, 22 nt, Human
cuagaaacauuacauguguuaa

SEQ ID NO: 254818 - RNA, 22 nt, Human
auuauuauauagggaaaguccc

SEQ ID NO: 254819 - RNA, 22 nt, Human
gugugagagaagcugccaugga

SEQ ID NO: 254820 - RNA, 22 nt, Human
ucagacagaaagaugaguaugg

SEQ ID NO: 254821 - RNA, 22 nt, Human
aacaugagugauaaaauuaccu

SEQ ID NO: 254822 - RNA, 21 nt, Human
acauaacugucaaguaacguu

SEQ ID NO: 254823 - RNA, 22 nt, Human
acagagguguuccagaccuagg

SEQ ID NO: 254824 - RNA, 22 nt, Human
aggcccaguagucgacggcgcu

SEQ ID NO: 254825 - RNA, 22 nt, Human
gaacauucacagacucaccauu

SEQ ID NO: 254826 - RNA, 22 nt, Human
ucacaucugauuagugacugau

SEQ ID NO: 254827 - RNA, 22 nt, Human
ugaggacauuaggaagugaagg

SEQ ID NO: 254828 - RNA, 19 nt, Human
uacaggcaguuucuacaau

SEQ ID NO: 254829 - RNA, 22 nt, Human
cugggcuguaauguggcacuga

SEQ ID NO: 254830 - RNA, 22 nt, Human
gcacaggaugauggguugaggg

SEQ ID NO: 254831 - RNA, 22 nt, Human
uauugcauaaaaucagguuaga

SEQ ID NO: 254832 - RNA, 22 nt, Human
cacauguaguaagcaggcaaug

SEQ ID NO: 254833 - RNA, 22 nt, Human
uaguacaacucacuugauuuua

SEQ ID NO: 254834 - RNA, 22 nt, Human
uccuggcuggaauuucucacuc

SEQ ID NO: 254835 - RNA, 22 nt, Human
agaaagcaucuccauuguaggu

SEQ ID NO: 254836 - RNA, 22 nt, Human
gcuguucuccgaugaccccgug

SEQ ID NO: 254837 - RNA, 21 nt, Human
cauuaaguaccagggcacugu

SEQ ID NO: 254838 - RNA, 22 nt, Human
cugcuccagacaccugcagggg

SEQ ID NO: 254839 - RNA, 22 nt, Human
ucucuucccuuuaugguaugug

SEQ ID NO: 254840 - RNA, 22 nt, Human
agcagggcuuuggcuggcuuuc

SEQ ID NO: 254841 - RNA, 22 nt, Human
uuccucagugcccccauacggu

SEQ ID NO: 254842 - RNA, 22 nt, Human
auuagcaauugcccugugcaau

SEQ ID NO: 254843 - RNA, 22 nt, Human
ggaacuggguuagggucucuuc

SEQ ID NO: 254844 - RNA, 22 nt, Human
caugccauucccugauccuaac

SEQ ID NO: 254845 - RNA, 22 nt, Human
ccuggcucugguucccucagcu

SEQ ID NO: 254846 - RNA, 22 nt, Human
ggcagaguggagugcggccucc

SEQ ID NO: 254847 - RNA, 22 nt, Human
caguuuuaaauuguuagauaau

SEQ ID NO: 254848 - RNA, 22 nt, Human
ucagcuuuggucacauugaguu

SEQ ID NO: 254849 - RNA, 22 nt, Human
guccauaugucaggugugaauu

SEQ ID NO: 254850 - RNA, 21 nt, Human
ugucacagauucucagcuugc

SEQ ID NO: 254851 - RNA, 22 nt, Human
ccagagagucgaugggggacac

SEQ ID NO: 254852 - RNA, 22 nt, Human
auacagagaagggguagaggau

SEQ ID NO: 254853 - RNA, 22 nt, Human
aaacacugguaugauguauagu

SEQ ID NO: 254854 - RNA, 22 nt, Human
aaaagagaauccuguacagaga

SEQ ID NO: 254855 - RNA, 23 nt, Human
ccaggcucuuucaccugcuauuc

SEQ ID NO: 254856 - RNA, 19 nt, Human
ggaugagggucaggcauag

SEQ ID NO: 254857 - RNA, 22 nt, Human
aguguaugcagguuuucaaugu

SEQ ID NO: 254858 - RNA, 22 nt, Human
gucaggagagaucaggacagca

SEQ ID NO: 254859 - RNA, 22 nt, Human
gaauuccacuuuggcuuuuggg

SEQ ID NO: 254860 - RNA, 22 nt, Human
uggaaacuauccucacaacuag

SEQ ID NO: 254861 - RNA, 22 nt, Human
gggcugagaauucagcuuuccu

SEQ ID NO: 254862 - RNA, 22 nt, Human
ucuugcagaggcacugugucag

SEQ ID NO: 254863 - RNA, 22 nt, Human
agagggagcccagucauagcug

SEQ ID NO: 254864 - RNA, 22 nt, Human
agaacauuugucgaucaauuug

SEQ ID NO: 254865 - RNA, 22 nt, Human
ggagaagguggcucagcaaagg

SEQ ID NO: 254866 - RNA, 22 nt, Human
ccuguacaucugcucucauugc

SEQ ID NO: 254867 - RNA, 22 nt, Human
auuucaaguguugagcucauaa

SEQ ID NO: 254868 - RNA, 22 nt, Human
agcacagggacaaugccaggug

SEQ ID NO: 254869 - RNA, 22 nt, Human
ucugugcugagcucugagaugu

SEQ ID NO: 254870 - RNA, 22 nt, Human
gacauuucaaucucauuauggg

SEQ ID NO: 254871 - RNA, 20 nt, Human
ugaauaugaccuuauuugga

SEQ ID NO: 254872 - RNA, 22 nt, Human
cccuccagccauggacccaggu

SEQ ID NO: 254873 - RNA, 22 nt, Human
auuagcuuaucacacaagcugc

SEQ ID NO: 254874 - RNA, 22 nt, Human
ugaggcaggagaauggcgggaa

SEQ ID NO: 254875 - RNA, 22 nt, Human
aaugggcuuuggccaguaggag

SEQ ID NO: 254876 - RNA, 22 nt, Human
cccugcagaucagugagaacuu

SEQ ID NO: 254877 - RNA, 22 nt, Human
uggcagcauuuuuuccagaaca

SEQ ID NO: 254878 - RNA, 22 nt, Human
aagcuguggcuuggaggaaaca

SEQ ID NO: 254879 - RNA, 22 nt, Human
acugccuggccuggccucacug

SEQ ID NO: 254880 - RNA, 22 nt, Human
uuccuuucccuugcuucugugc

SEQ ID NO: 254881 - RNA, 22 nt, Human
gaggcuguguuucagugaggcc

SEQ ID NO: 254882 - RNA, 22 nt, Human
gccaggcagcaggaagccagug

SEQ ID NO: 254883 - RNA, 22 nt, Human
uauuaaguaucuugaugacaaa

SEQ ID NO: 254884 - RNA, 22 nt, Human
uuccaagugcccauauuucauc

SEQ ID NO: 254885 - RNA, 22 nt, Human
ucccucagcaggaauguggcag

SEQ ID NO: 254886 - RNA, 22 nt, Human
gccagcuggagacuggcagggg

SEQ ID NO: 254887 - RNA, 22 nt, Human
caugcaggccuauggagcagug

SEQ ID NO: 254888 - RNA, 22 nt, Human
aaaaccugauugaauucuauuu

SEQ ID NO: 254889 - RNA, 22 nt, Human
ccuuuagagcaaacgccaccua

SEQ ID NO: 254890 - RNA, 22 nt, Human
caugcaaaugguggcuaaaugg

SEQ ID NO: 254891 - RNA, 22 nt, Human
ccaggugggaggaaagcagaga

SEQ ID NO: 254892 - RNA, 20 nt, Human
auuucaguguuugcaauuuc

SEQ ID NO: 254893 - RNA, 22 nt, Human
ucugggccuuggaguggggaga

SEQ ID NO: 254894 - RNA, 18 nt, Human
ugaacuuuggugucucuc

SEQ ID NO: 254895 - RNA, 23 nt, Human
ugggaccuguuugcccacagaug

SEQ ID NO: 254896 - RNA, 20 nt, Human
auacacuugcccagcuugug

SEQ ID NO: 254897 - RNA, 22 nt, Human
agcagagucuucaagggcaggc

SEQ ID NO: 254898 - RNA, 22 nt, Human
caggccaaagaucccauugaca

SEQ ID NO: 254899 - RNA, 22 nt, Human
cagacaugauguaagcagaggc

SEQ ID NO: 254900 - RNA, 22 nt, Human
ugcugcucaaugagaugccauc

SEQ ID NO: 254901 - RNA, 22 nt, Human
cagugcuggaggggugcuugca

SEQ ID NO: 254902 - RNA, 22 nt, Human
ccugagcagggcucugcagggc

SEQ ID NO: 254903 - RNA, 20 nt, Human
caggcacacucauuccugcu

SEQ ID NO: 254904 - RNA, 22 nt, Human
ucugaggccccugggcaggaug

SEQ ID NO: 254905 - RNA, 20 nt, Human
ugccugggaaggcguggagg

SEQ ID NO: 254906 - RNA, 22 nt, Human
ucaucugugcaggacucagaag

SEQ ID NO: 254907 - RNA, 22 nt, Human
aacauuucagcaaauaagaaca

SEQ ID NO: 254908 - RNA, 22 nt, Human
aaaucucaauuugaauuguagc

SEQ ID NO: 254909 - RNA, 22 nt, Human
cauuuauuggcauguaguaggu

SEQ ID NO: 254910 - RNA, 22 nt, Human
uucagcaagaccaccauguacc

SEQ ID NO: 254911 - RNA, 22 nt, Human
acugagcagaagagaucuguga

SEQ ID NO: 254912 - RNA, 22 nt, Human
gaagauuucaguuaaguaucua

SEQ ID NO: 254913 - RNA, 21 nt, Human
ucuggucugcuguggaccugg

SEQ ID NO: 254914 - RNA, 22 nt, Human
ucugccuuucucaagggcaaaa

SEQ ID NO: 254915 - RNA, 22 nt, Human
guaggaagcucugaggcuaguu

SEQ ID NO: 254916 - RNA, 22 nt, Human
acaaucuggaaaaguuaacuau

SEQ ID NO: 254917 - RNA, 22 nt, Human
augcaccugaacuccaucagcu

SEQ ID NO: 254918 - RNA, 22 nt, Human
uggcugaguuacgaacagagca

SEQ ID NO: 254919 - RNA, 22 nt, Human
auaaaaguaggaccaacuuaca

SEQ ID NO: 254920 - RNA, 22 nt, Human
gggcacagaagucuaagacauc

SEQ ID NO: 254921 - RNA, 22 nt, Human
ccaucuccaaauaccaucacau

SEQ ID NO: 254922 - RNA, 22 nt, Human
uuuucucuccagguggggugau

SEQ ID NO: 254923 - RNA, 22 nt, Human
uuggauuacaugaaaugcagaa

SEQ ID NO: 254924 - RNA, 22 nt, Human
gcacagaacagagaaauagcca

SEQ ID NO: 254925 - RNA, 22 nt, Human
ggagcagcacugccacacagag

SEQ ID NO: 254926 - RNA, 22 nt, Human
uguccagcggccuggcugcuga

SEQ ID NO: 254927 - RNA, 22 nt, Human
cuggcaguuugccaggagcucg

SEQ ID NO: 254928 - RNA, 22 nt, Human
cucuuuggugcaccuugcaguc

SEQ ID NO: 254929 - RNA, 22 nt, Human
ccugcugugaccggggagcagg

SEQ ID NO: 254930 - RNA, 22 nt, Human
gggcuucucccuaaggacucug

SEQ ID NO: 254931 - RNA, 22 nt, Human
uuuauauagagauuugugcaug

SEQ ID NO: 254932 - RNA, 22 nt, Human
acaguuauucuuuaugcaacca

SEQ ID NO: 254933 - RNA, 22 nt, Human
cuuuggaacaagaagaaauggc

SEQ ID NO: 254934 - RNA, 23 nt, Human
cuugaaugggauggaauucacug

SEQ ID NO: 254935 - RNA, 20 nt, Human
cugcccugcccuggguccug

SEQ ID NO: 254936 - RNA, 22 nt, Human
gaaucucaguggaagcaggaag

SEQ ID NO: 254937 - RNA, 21 nt, Human
ugcuugggggcuucaggagcu

SEQ ID NO: 254938 - RNA, 22 nt, Human
ggaguggcacucugaggcgggg

SEQ ID NO: 254939 - RNA, 22 nt, Human
ggcuacagaggccgugagccug

SEQ ID NO: 254940 - RNA, 22 nt, Human
cuguuaaaugagaaagcagacu

SEQ ID NO: 254941 - RNA, 22 nt, Human
ucuuuggccuuaggagcccuug

SEQ ID NO: 254942 - RNA, 22 nt, Human
gccuggggaacuugauccuguc

SEQ ID NO: 254943 - RNA, 22 nt, Human
ucugugugguaguuucagugaa

SEQ ID NO: 254944 - RNA, 22 nt, Human
uggcucagucuggguugacuga

SEQ ID NO: 254945 - RNA, 22 nt, Human
agggcagcagcugucccugaga

SEQ ID NO: 254946 - RNA, 22 nt, Human
ggcuguaccugccucuccucua

SEQ ID NO: 254947 - RNA, 22 nt, Human
gagugcagaugccagccccagu

SEQ ID NO: 254948 - RNA, 22 nt, Human
cagaggcugaugugggaugggc

SEQ ID NO: 254949 - RNA, 22 nt, Human
ugcagagugggagaggugcggg

SEQ ID NO: 254950 - RNA, 22 nt, Human
gggacaugccccucagugggug

SEQ ID NO: 254951 - RNA, 22 nt, Human
gcaggugggggucggugcaucu

SEQ ID NO: 254952 - RNA, 22 nt, Human
gcuggcagagacaagaagacua

SEQ ID NO: 254953 - RNA, 22 nt, Human
uuaagucauuucugauuauaga

SEQ ID NO: 254954 - RNA, 22 nt, Human
uuccuggcacacuccugaaugu

SEQ ID NO: 254955 - RNA, 22 nt, Human
ucuaugaaaagucuauucauuc

SEQ ID NO: 254956 - RNA, 22 nt, Human
ucaucuugcaguguguguucug

SEQ ID NO: 254957 - RNA, 22 nt, Human
ucacagacucuugauugucuaa

SEQ ID NO: 254958 - RNA, 22 nt, Human
accaggaauauuuugcucauuu

SEQ ID NO: 254959 - RNA, 22 nt, Human
acuguacuuuagaaaguguagu

SEQ ID NO: 254960 - RNA, 22 nt, Human
ggcagguguuuuuauauuaaag

SEQ ID NO: 254961 - RNA, 22 nt, Human
ccugcaccacacucacugcuca

SEQ ID NO: 254962 - RNA, 22 nt, Human
ucagacagagaaguacaaugag

SEQ ID NO: 254963 - RNA, 22 nt, Human
aggaaggggagaaguuaaagcu

SEQ ID NO: 254964 - RNA, 22 nt, Human
agcuaagacuuagugacuuagu

SEQ ID NO: 254965 - RNA, 22 nt, Human
gcuggcuuugucaagggcagca

SEQ ID NO: 254966 - RNA, 22 nt, Human
ggacaagccugugaguggguuu

SEQ ID NO: 254967 - RNA, 22 nt, Human
uuaaaugacuuuuauuauucuc

SEQ ID NO: 254968 - RNA, 22 nt, Human
uacagugcauagaggcaugaua

SEQ ID NO: 254969 - RNA, 22 nt, Human
uuucaggagagaccagaaauga

SEQ ID NO: 254970 - RNA, 22 nt, Human
gcaggaagggaaagguugacuc

SEQ ID NO: 254971 - RNA, 22 nt, Human
cccugaggauagggcaggaccc

SEQ ID NO: 254972 - RNA, 22 nt, Human
accagcuccaggccccugcuga

SEQ ID NO: 254973 - RNA, 22 nt, Human
ucccagggcucuagagugcugg

SEQ ID NO: 254974 - RNA, 22 nt, Human
ccuuuagaugaucucuuggaca

SEQ ID NO: 254975 - RNA, 22 nt, Human
uguauguaugcaucuuuuaugu

SEQ ID NO: 254976 - RNA, 22 nt, Human
acugggcucaagugauuguccu

SEQ ID NO: 254977 - RNA, 22 nt, Human
ugccugggccuucccaccucug

SEQ ID NO: 254978 - RNA, 18 nt, Human
ccuguggcucagcccaca

SEQ ID NO: 254979 - RNA, 22 nt, Human
ccuuagaaauguaccaaaggaa

SEQ ID NO: 254980 - RNA, 22 nt, Human
ggaaggcuuuaagcaccaaagc

SEQ ID NO: 254981 - RNA, 22 nt, Human
gccaggugcauggcugagucuc

SEQ ID NO: 254982 - RNA, 19 nt, Human
agcaggcagguggcccagg

SEQ ID NO: 254983 - RNA, 22 nt, Human
gcugagcuagaaaaggaccaca

SEQ ID NO: 254984 - RNA, 22 nt, Human
gcuuucuggagccugggggaac

SEQ ID NO: 254985 - RNA, 22 nt, Human
gggccugccaggcuuucagcau

SEQ ID NO: 254986 - RNA, 22 nt, Human
ccaggaagccuuuuucuuugac

SEQ ID NO: 254987 - RNA, 22 nt, Human
gcaaggacucccugggucauuc

SEQ ID NO: 254988 - RNA, 22 nt, Human
agccuaggggguccugggccac

SEQ ID NO: 254989 - RNA, 22 nt, Human
augcuccaccuuuugcaggaac

SEQ ID NO: 254990 - RNA, 22 nt, Human
cagguccuggcaucaggcaggu

SEQ ID NO: 254991 - RNA, 22 nt, Human
agcuucucaggagucugaggca

SEQ ID NO: 254992 - RNA, 22 nt, Human
uggauucugggcuguuugcauu

SEQ ID NO: 254993 - RNA, 22 nt, Human
cacagcagaaauaugaaggcag

SEQ ID NO: 254994 - RNA, 22 nt, Human
acuucauauuguuuccacuaga

SEQ ID NO: 254995 - RNA, 22 nt, Human
gcugcccucucuggccccacac

SEQ ID NO: 254996 - RNA, 17 nt, Human
cccaggccgccgggagc

SEQ ID NO: 254997 - RNA, 22 nt, Human
ucaugccauccacaucuguuuc

SEQ ID NO: 254998 - RNA, 17 nt, Human
ucaggcugggugcagug

SEQ ID NO: 254999 - RNA, 22 nt, Human
accaugaucugcucugguguuu

SEQ ID NO: 255000 - RNA, 22 nt, Human
ggccuugauguucuugggagau

SEQ ID NO: 255001 - RNA, 22 nt, Human
acauuagagaagcuuggagaug

SEQ ID NO: 255002 - RNA, 20 nt, Human
ggcuuccccgccaucuuccg

SEQ ID NO: 255003 - RNA, 22 nt, Human
agaauacaguaugcaaaaagau

SEQ ID NO: 255004 - RNA, 22 nt, Human
aaugucuauuugcuacaaagcc

SEQ ID NO: 255005 - RNA, 22 nt, Human
cccuggagugugacgaggcauu

SEQ ID NO: 255006 - RNA, 21 nt, Human
agugucauuugaucauuguua

SEQ ID NO: 255007 - RNA, 18 nt, Human
gacacaggagagaguccc

SEQ ID NO: 255008 - RNA, 22 nt, Human
uucuuuguuguacuuuccuaca

SEQ ID NO: 255009 - RNA, 22 nt, Human
aggaagagguagcugucaaggg

SEQ ID NO: 255010 - RNA, 22 nt, Human
cagggcccauggcucagguagg

SEQ ID NO: 255011 - RNA, 22 nt, Human
acaaaccagcuuaagcaagaug

SEQ ID NO: 255012 - RNA, 22 nt, Human
aagaacuuuuggcaaguguuau

SEQ ID NO: 255013 - RNA, 22 nt, Human
acauuucuuugcuagacagcag

SEQ ID NO: 255014 - RNA, 22 nt, Human
ccaaggaggccccaggucagcu

SEQ ID NO: 255015 - RNA, 22 nt, Human
aagugucuucugauggggugug

SEQ ID NO: 255016 - RNA, 20 nt, Human
ucuguaggcaaguuagcagg

SEQ ID NO: 255017 - RNA, 22 nt, Human
augggcaggcaagguggcgagu

SEQ ID NO: 255018 - RNA, 22 nt, Human
aggcccaguccucugccgucug

SEQ ID NO: 255019 - RNA, 22 nt, Human
gagcuggcuccgccaugcugcu

SEQ ID NO: 255020 - RNA, 22 nt, Human
cuuuaauucagauuugaaggga

SEQ ID NO: 255021 - RNA, 22 nt, Human
aagaaagugcuuuguaaauuau

SEQ ID NO: 255022 - RNA, 22 nt, Human
guauaaaggcacagguuuucug

SEQ ID NO: 255023 - RNA, 20 nt, Human
ugcaaacacagaguguauga

SEQ ID NO: 255024 - RNA, 22 nt, Human
accaaucuccuauuuuguuuca

SEQ ID NO: 255025 - RNA, 22 nt, Human
guuuauuggguauuguggagcc

SEQ ID NO: 255026 - RNA, 22 nt, Human
uuuaaaaucagaugggaguugg

SEQ ID NO: 255027 - RNA, 22 nt, Human
guagaaauauuuaucucugaga

SEQ ID NO: 255028 - RNA, 22 nt, Human
aguuacugcuuucaggaaguuu

SEQ ID NO: 255029 - RNA, 19 nt, Human
guagggacagugguucuga

SEQ ID NO: 255030 - RNA, 22 nt, Human
uagaagauucauuuccucugaa

SEQ ID NO: 255031 - RNA, 21 nt, Human
ccuucuccacagggucuccgg

SEQ ID NO: 255032 - RNA, 22 nt, Human
gagacagaucucggcuccaugc

SEQ ID NO: 255033 - RNA, 22 nt, Human
ucucagaguuccucuggagucc

SEQ ID NO: 255034 - RNA, 22 nt, Human
aaccccaggcuggaggagucuc

SEQ ID NO: 255035 - RNA, 22 nt, Human
ggcuagaugguauauaaggaug

SEQ ID NO: 255036 - RNA, 22 nt, Human
uagaacuugugaaauaucaaug

SEQ ID NO: 255037 - RNA, 22 nt, Human
aaauacaaaaauuagccaggca

SEQ ID NO: 255038 - RNA, 17 nt, Human
ucugagaacuugaagca

SEQ ID NO: 255039 - RNA, 22 nt, Human
guacaggccaccacugaauuuu

SEQ ID NO: 255040 - RNA, 22 nt, Human
agggguuggauuuggccuagag

SEQ ID NO: 255041 - RNA, 22 nt, Human
ggucugcccacuacucuccauu

SEQ ID NO: 255042 - RNA, 22 nt, Human
acaugacagugacuuuauaaga

SEQ ID NO: 255043 - RNA, 18 nt, Human
cuucagugacagucuggc

SEQ ID NO: 255044 - RNA, 22 nt, Human
auucuucauacagacaaguccu

SEQ ID NO: 255045 - RNA, 22 nt, Human
ugcaauaauguaugucacuccc

SEQ ID NO: 255046 - RNA, 22 nt, Human
auugcaaaugagucuuaauaua

SEQ ID NO: 255047 - RNA, 22 nt, Human
ggaaacaugccugcuggacagu

SEQ ID NO: 255048 - RNA, 22 nt, Human
uacuccacacgcuauuauaaug

SEQ ID NO: 255049 - RNA, 17 nt, Human
ucugggcuucagugguc

SEQ ID NO: 255050 - RNA, 22 nt, Human
caugccagguuugaguaucuug

SEQ ID NO: 255051 - RNA, 22 nt, Human
aaauauaccaguugccugcauc

SEQ ID NO: 255052 - RNA, 22 nt, Human
caucuuuucagaagccauucug

SEQ ID NO: 255053 - RNA, 21 nt, Human
aggguccuacagggcucagga

SEQ ID NO: 255054 - RNA, 22 nt, Human
cuuuauuccuacaagauuuucu

SEQ ID NO: 255055 - RNA, 22 nt, Human
aaaaggacaagcuuuggaguua

SEQ ID NO: 255056 - RNA, 17 nt, Human
aggccucaggugaaacc

SEQ ID NO: 255057 - RNA, 22 nt, Human
gggguggccuguaggcagcaug

SEQ ID NO: 255058 - RNA, 22 nt, Human
aagugccccaggcuguuaacau

SEQ ID NO: 255059 - RNA, 22 nt, Human
cuggcaccuccagcucauggcc

SEQ ID NO: 255060 - RNA, 22 nt, Human
uuaucugucaucaggcagacag

SEQ ID NO: 255061 - RNA, 22 nt, Human
guggguggagacugggugcaag

SEQ ID NO: 255062 - RNA, 22 nt, Human
auguuuacaauucaguauuaca

SEQ ID NO: 255063 - RNA, 18 nt, Human
uacuuuauucccccucca

SEQ ID NO: 255064 - RNA, 22 nt, Human
ucuuugcaggagcccuuugaac

SEQ ID NO: 255065 - RNA, 22 nt, Human
ucaggcaggaucccagggaagg

SEQ ID NO: 255066 - RNA, 21 nt, Human
cagcagaagcaucuauggaag

SEQ ID NO: 255067 - RNA, 22 nt, Human
uugaaucucucugagauucagu

SEQ ID NO: 255068 - RNA, 22 nt, Human
uguauacaugucugugugcaca

SEQ ID NO: 255069 - RNA, 22 nt, Human
gucugcuguucagagauguugc

SEQ ID NO: 255070 - RNA, 22 nt, Human
caagauuuccaacccuggguaa

SEQ ID NO: 255071 - RNA, 21 nt, Human
gcauggcaggucacuggggca

SEQ ID NO: 255072 - RNA, 22 nt, Human
aguggcugugaaauacauggga

SEQ ID NO: 255073 - RNA, 22 nt, Human
aaauguguguauguacauauau

SEQ ID NO: 255074 - RNA, 22 nt, Human
ugcagaagcagagccgguggcc

SEQ ID NO: 255075 - RNA, 22 nt, Human
agcagaugcgucugagugggag

SEQ ID NO: 255076 - RNA, 19 nt, Human
uuucccagcccuugcugug

SEQ ID NO: 255077 - RNA, 20 nt, Human
acacacagagacaugcgcau

SEQ ID NO: 255078 - RNA, 22 nt, Human
gugggggcuggcucguccugug

SEQ ID NO: 255079 - RNA, 22 nt, Human
ggugagggacaucacucagcca

SEQ ID NO: 255080 - RNA, 22 nt, Human
ugaggccugcuuggaauugaau

SEQ ID NO: 255081 - RNA, 22 nt, Human
cggcugagacggccauagacac

SEQ ID NO: 255082 - RNA, 22 nt, Human
agggagccaggggccagcuauu

SEQ ID NO: 255083 - RNA, 22 nt, Human
caaaauuagaaaugcagcuguu

SEQ ID NO: 255084 - RNA, 22 nt, Human
ucauuuuucucuuacacguaga

SEQ ID NO: 255085 - RNA, 22 nt, Human
cugccuguauugucugcuuggg

SEQ ID NO: 255086 - RNA, 22 nt, Human
acugcccuggagacagcagagu

SEQ ID NO: 255087 - RNA, 22 nt, Human
caaggaaaaagcgagcucgggg

SEQ ID NO: 255088 - RNA, 22 nt, Human
auacuucuagaaauacuaugca

SEQ ID NO: 255089 - RNA, 22 nt, Human
uccagggaugguaaugagcagu

SEQ ID NO: 255090 - RNA, 22 nt, Human
uuuggcaugggcuauuugcuuu

SEQ ID NO: 255091 - RNA, 22 nt, Human
ccccagccagcaggaccucuga

SEQ ID NO: 255092 - RNA, 22 nt, Human
gaggccuggcucugcccuccug

SEQ ID NO: 255093 - RNA, 22 nt, Human
gcccagggugaagugcaguugu

SEQ ID NO: 255094 - RNA, 16 nt, Human
acccuggguaguccug

SEQ ID NO: 255095 - RNA, 22 nt, Human
auguccaggaucuauccccaga

SEQ ID NO: 255096 - RNA, 22 nt, Human
caaagguauaaguuaauauaca

SEQ ID NO: 255097 - RNA, 22 nt, Human
aaccagcuccucaccccauugu

SEQ ID NO: 255098 - RNA, 22 nt, Human
auguuuccagauaugucacccu

SEQ ID NO: 255099 - RNA, 22 nt, Human
acucccuggcaggucuuuaucu

SEQ ID NO: 255100 - RNA, 22 nt, Human
caguuaaauuuggcuguuuucu

SEQ ID NO: 255101 - RNA, 22 nt, Human
caggaaacauucuugguaagga

SEQ ID NO: 255102 - RNA, 22 nt, Human
caguucuaucauuuuagagaug

SEQ ID NO: 255103 - RNA, 22 nt, Human
cugcagggcagggccuccuggc

SEQ ID NO: 255104 - RNA, 23 nt, Human
uuuguucaucauuagagucuagc

SEQ ID NO: 255105 - RNA, 22 nt, Human
cuuacauugugugcaugagggg

SEQ ID NO: 255106 - RNA, 22 nt, Human
ugggagaauauauuuaaaacuu

SEQ ID NO: 255107 - RNA, 22 nt, Human
ucuggaauucucaaguccugga

SEQ ID NO: 255108 - RNA, 22 nt, Human
aaaguguuuugugagcagucug

SEQ ID NO: 255109 - RNA, 23 nt, Human
uggagcugacagucagagggagg

SEQ ID NO: 255110 - RNA, 22 nt, Human
aacuuucuguuacguccccaga

SEQ ID NO: 255111 - RNA, 22 nt, Human
ccagaggagcaggcuggcucca

SEQ ID NO: 255112 - RNA, 22 nt, Human
ggucuggccaauagacagcccc

SEQ ID NO: 255113 - RNA, 22 nt, Human
cagggacuacagccagcccucc

SEQ ID NO: 255114 - RNA, 22 nt, Human
uuccaaagucauguugcugaua

SEQ ID NO: 255115 - RNA, 22 nt, Human
uagugucaggagggaaaugcaa

SEQ ID NO: 255116 - RNA, 22 nt, Human
uauggcagaggagaggcacuag

SEQ ID NO: 255117 - RNA, 22 nt, Human
auccaaaguagauuaagucaca

SEQ ID NO: 255118 - RNA, 22 nt, Human
agcuaaggacuggaggguuucu

SEQ ID NO: 255119 - RNA, 22 nt, Human
agugugagaugauugaggagca

SEQ ID NO: 255120 - RNA, 22 nt, Human
gaauuccucugagcuaggagau

SEQ ID NO: 255121 - RNA, 22 nt, Human
auaaacagcuccauuuagugcc

SEQ ID NO: 255122 - RNA, 22 nt, Human
ccugcuguaaugugucuuuauu

SEQ ID NO: 255123 - RNA, 22 nt, Human
ucaggcugugucuuuaaacaau

SEQ ID NO: 255124 - RNA, 22 nt, Human
ggugagcacugcccugggucuc

SEQ ID NO: 255125 - RNA, 21 nt, Human
uuagaagcuaaugcagcuggu

SEQ ID NO: 255126 - RNA, 22 nt, Human
uuaaaucaggcaucauuucagu

SEQ ID NO: 255127 - RNA, 22 nt, Human
cagcccagcagucuuagccugc

SEQ ID NO: 255128 - RNA, 22 nt, Human
aggccacagucagugggugcug

SEQ ID NO: 255129 - RNA, 22 nt, Human
ucagggcaaaagggaaaccauu

SEQ ID NO: 255130 - RNA, 22 nt, Human
cuucugggccauggccuuccuc

SEQ ID NO: 255131 - RNA, 22 nt, Human
ggguccugcgugggcccaggac

SEQ ID NO: 255132 - RNA, 22 nt, Human
cuccuaggacgccgcugcuccu

SEQ ID NO: 255133 - RNA, 22 nt, Human
cuuuucauuguuuguacaugca

SEQ ID NO: 255134 - RNA, 22 nt, Human
ggcucugcgccugcggggacuu

SEQ ID NO: 255135 - RNA, 22 nt, Human
aaggcauacauauuguuauagg

SEQ ID NO: 255136 - RNA, 22 nt, Human
cuucuucaguugcauguauugg

SEQ ID NO: 255137 - RNA, 22 nt, Human
uacaagagguauauagaaacag

SEQ ID NO: 255138 - RNA, 22 nt, Human
ccuggacucaggcugugggcac

SEQ ID NO: 255139 - RNA, 22 nt, Human
uauacaguuugaguucuugcau

SEQ ID NO: 255140 - RNA, 22 nt, Human
gcaacaggcaguuugcucaugu

SEQ ID NO: 255141 - RNA, 22 nt, Human
uacaagagaacuaauguaaguc

SEQ ID NO: 255142 - RNA, 22 nt, Human
ucucauugguaugauguguaga

SEQ ID NO: 255143 - RNA, 21 nt, Human
uggcagguucaaaggccuauc

SEQ ID NO: 255144 - RNA, 22 nt, Human
uuucacaugguacugccuguuu

SEQ ID NO: 255145 - RNA, 22 nt, Human
uacacaggguauggcuugagga

SEQ ID NO: 255146 - RNA, 22 nt, Human
uccugcuccaccgugggcugga

SEQ ID NO: 255147 - RNA, 20 nt, Human
ucucuggguucucacucagc

SEQ ID NO: 255148 - RNA, 22 nt, Human
ccuccuggcuuuucccauugaa

SEQ ID NO: 255149 - RNA, 22 nt, Human
auugauaaauugcaauggggcu

SEQ ID NO: 255150 - RNA, 22 nt, Human
uuccuucuuccaaacccaucau

SEQ ID NO: 255151 - RNA, 22 nt, Human
ggcauggucuuugcuugcagga

SEQ ID NO: 255152 - RNA, 22 nt, Human
agcugccuccuggugccccauc

SEQ ID NO: 255153 - RNA, 22 nt, Human
ugaggcaagucucaaucuuuga

SEQ ID NO: 255154 - RNA, 22 nt, Human
aggccaggaccauuagcccaga

SEQ ID NO: 255155 - RNA, 22 nt, Human
uuguaagaauaugaauacaaau

SEQ ID NO: 255156 - RNA, 22 nt, Human
ucugcaggaagcuggcggcuga

SEQ ID NO: 255157 - RNA, 22 nt, Human
caaggcaggccaguuucaaggc

SEQ ID NO: 255158 - RNA, 22 nt, Human
ugcaggagaaaguacggagcgu

SEQ ID NO: 255159 - RNA, 22 nt, Human
ucccaagcaaugagucagggcc

SEQ ID NO: 255160 - RNA, 22 nt, Human
agugcauucuggcagaacaggu

SEQ ID NO: 255161 - RNA, 22 nt, Human
agggaaaguaagcauuucauua

SEQ ID NO: 255162 - RNA, 21 nt, Human
agauuugucccuucccauuua

SEQ ID NO: 255163 - RNA, 22 nt, Human
ucuggcucggauuugucuagca

SEQ ID NO: 255164 - RNA, 22 nt, Human
uggcuccuuccgcagcaugccu

SEQ ID NO: 255165 - RNA, 19 nt, Human
gaauuuaucucuucagucc

SEQ ID NO: 255166 - RNA, 22 nt, Human
gcauuagagcccaucaccugua

SEQ ID NO: 255167 - RNA, 22 nt, Human
aaguccuuuaauaucacauagu

SEQ ID NO: 255168 - RNA, 22 nt, Human
gacagacaggagcucacaggca

SEQ ID NO: 255169 - RNA, 22 nt, Human
cauuugauuacuaaagauaauu

SEQ ID NO: 255170 - RNA, 22 nt, Human
acauuaaacuugcuuggcugua

SEQ ID NO: 255171 - RNA, 22 nt, Human
agggucuguauuucuggcaagc

SEQ ID NO: 255172 - RNA, 22 nt, Human
ucacaggaaccaucagagaaau

SEQ ID NO: 255173 - RNA, 22 nt, Human
uguacaguauauuucaaagcca

SEQ ID NO: 255174 - RNA, 20 nt, Human
agaaggcuccuuuugccaag

SEQ ID NO: 255175 - RNA, 22 nt, Human
uguccaggugugucuaaagaga

SEQ ID NO: 255176 - RNA, 22 nt, Human
cucagugugagugagaagugca

SEQ ID NO: 255177 - RNA, 22 nt, Human
aguuagaaaguaaaucauuuga

SEQ ID NO: 255178 - RNA, 22 nt, Human
ucccagccuuucuuucuccagc

SEQ ID NO: 255179 - RNA, 19 nt, Human
uuuauucaccuuuaccuug

SEQ ID NO: 255180 - RNA, 22 nt, Human
uaguuuuuucaacaaauggugc

SEQ ID NO: 255181 - RNA, 22 nt, Human
ccaagcagaaccauucaggcac

SEQ ID NO: 255182 - RNA, 22 nt, Human
cagccucuguggcugccacacc

SEQ ID NO: 255183 - RNA, 22 nt, Human
uagugugguaaauaaauguuuu

SEQ ID NO: 255184 - RNA, 22 nt, Human
aacauuugcaugcuuuauuaga

SEQ ID NO: 255185 - RNA, 22 nt, Human
cuccugggaugacucuuucuuu

SEQ ID NO: 255186 - RNA, 22 nt, Human
auggugguuugggagaaaaagc

SEQ ID NO: 255187 - RNA, 22 nt, Human
guggguggaucaccugagguca

SEQ ID NO: 255188 - RNA, 22 nt, Human
gugcaauagacugugguauuaa

SEQ ID NO: 255189 - RNA, 22 nt, Human
ggccucaguuucuccauggguu

SEQ ID NO: 255190 - RNA, 22 nt, Human
caagauuuggcauucugaggag

SEQ ID NO: 255191 - RNA, 22 nt, Human
ccaguguauuauuugagaaauu

SEQ ID NO: 255192 - RNA, 22 nt, Human
cugagcugggacucaguagcaa

SEQ ID NO: 255193 - RNA, 22 nt, Human
ggccucaggguugggcccauua

SEQ ID NO: 255194 - RNA, 22 nt, Human
ccucugaguccucccugguugc

SEQ ID NO: 255195 - RNA, 19 nt, Human
uaagacacaaaugcaagcc

SEQ ID NO: 255196 - RNA, 22 nt, Human
accaccccagaauuuuucaagg

SEQ ID NO: 255197 - RNA, 22 nt, Human
agaauuuagcuccuuggucaua

SEQ ID NO: 255198 - RNA, 22 nt, Human
aaucagaacuucucaggguggg

SEQ ID NO: 255199 - RNA, 19 nt, Human
cugucccagacucugcucu

SEQ ID NO: 255200 - RNA, 22 nt, Human
gauuaagagaaguuucuuaucg

SEQ ID NO: 255201 - RNA, 22 nt, Human
gcagcccaggcucgcucacugc

SEQ ID NO: 255202 - RNA, 20 nt, Human
uacauauuauaucagcugca

SEQ ID NO: 255203 - RNA, 22 nt, Human
aaucuucauuuugacaagauuc

SEQ ID NO: 255204 - RNA, 22 nt, Human
cucaccugggucagacaguugu

SEQ ID NO: 255205 - RNA, 21 nt, Human
cucuagaaaucgaauaaccuu

SEQ ID NO: 255206 - RNA, 22 nt, Human
uccuggcacauugcaggggcuc

SEQ ID NO: 255207 - RNA, 23 nt, Human
auaauaacgucugucuugucucu

SEQ ID NO: 255208 - RNA, 22 nt, Human
uuacaacaccaggcaguauccu

SEQ ID NO: 255209 - RNA, 18 nt, Human
agaacacuugguuagauc

SEQ ID NO: 255210 - RNA, 22 nt, Human
acuuagcagaguugaauguacu

SEQ ID NO: 255211 - RNA, 22 nt, Human
ucuuacauauacgucauuuagu

SEQ ID NO: 255212 - RNA, 22 nt, Human
uguuuccauggugacagcagcu

SEQ ID NO: 255213 - RNA, 22 nt, Human
uccaggccugccugguguuugc

SEQ ID NO: 255214 - RNA, 22 nt, Human
uccugaggcccuguuagggucu

SEQ ID NO: 255215 - RNA, 22 nt, Human
aucuguguccuuauaagagaca

SEQ ID NO: 255216 - RNA, 22 nt, Human
cagaaacacuuguagagaaguu

SEQ ID NO: 255217 - RNA, 22 nt, Human
aggcucuguuauucuagagggc

SEQ ID NO: 255218 - RNA, 22 nt, Human
uccuggaucagcgggggcaggc

SEQ ID NO: 255219 - RNA, 18 nt, Human
ugauucaaguugcccucc

SEQ ID NO: 255220 - RNA, 22 nt, Human
uauucaaagugcgaggucaggg

SEQ ID NO: 255221 - RNA, 22 nt, Human
agagucuuaucuuuuacaagua

SEQ ID NO: 255222 - RNA, 22 nt, Human
cagcauggugccagugagucca

SEQ ID NO: 255223 - RNA, 22 nt, Human
guaaagaaggcaaccugguuau

SEQ ID NO: 255224 - RNA, 20 nt, Human
cccuggccuguuucaugccc

SEQ ID NO: 255225 - RNA, 22 nt, Human
gagggcugauguugccaccuca

SEQ ID NO: 255226 - RNA, 22 nt, Human
acugguggcccucaguguucuc

SEQ ID NO: 255227 - RNA, 22 nt, Human
ucugagggugggagaaggagcu

SEQ ID NO: 255228 - RNA, 22 nt, Human
aagagaacagucaccaugcaca

SEQ ID NO: 255229 - RNA, 22 nt, Human
uacagugcuagaaccugcugua

SEQ ID NO: 255230 - RNA, 22 nt, Human
ucagacaguuugcagugugccu

SEQ ID NO: 255231 - RNA, 22 nt, Human
agggaggagaauggacuccuuc

SEQ ID NO: 255232 - RNA, 22 nt, Human
cuucaggaguaguuaccuagca

SEQ ID NO: 255233 - RNA, 22 nt, Human
ugacaauugugggcaguuugug

SEQ ID NO: 255234 - RNA, 22 nt, Human
uuggcagaggggccaccugccc

SEQ ID NO: 255235 - RNA, 22 nt, Human
ugccuauucaauauaugcauuu

SEQ ID NO: 255236 - RNA, 22 nt, Human
acaggauggagauaauagaaaa

SEQ ID NO: 255237 - RNA, 22 nt, Human
ucagggaguaguuugugcuaug

SEQ ID NO: 255238 - RNA, 22 nt, Human
ccaggcucugagaggaauguga

SEQ ID NO: 255239 - RNA, 22 nt, Human
ucucauugccuucacucuucag

SEQ ID NO: 255240 - RNA, 22 nt, Human
caaauguuucuugaacaccaac

SEQ ID NO: 255241 - RNA, 22 nt, Human
ccuccaagcuucaucucaacca

SEQ ID NO: 255242 - RNA, 18 nt, Human
uuugaaggauggccugga

SEQ ID NO: 255243 - RNA, 18 nt, Human
cacuggaagauuaggguc

SEQ ID NO: 255244 - RNA, 22 nt, Human
caggccucuuccaugcagcagc

SEQ ID NO: 255245 - RNA, 22 nt, Human
gguaggggaagacaagugaaaa

SEQ ID NO: 255246 - RNA, 22 nt, Human
cuguggaauugaugcuuagugu

SEQ ID NO: 255247 - RNA, 22 nt, Human
uagaacugacguuagggaagaa

SEQ ID NO: 255248 - RNA, 22 nt, Human
cugggccagaccuuguggucuu

SEQ ID NO: 255249 - RNA, 20 nt, Human
gcuggcagaugucuugagau

SEQ ID NO: 255250 - RNA, 22 nt, Human
uuucuguagggauuucacaguu

SEQ ID NO: 255251 - RNA, 22 nt, Human
caguccugaggaagagcugcug

SEQ ID NO: 255252 - RNA, 22 nt, Human
gaaagacuuccuuugagaguac

SEQ ID NO: 255253 - RNA, 22 nt, Human
ccuggcagacagcacugaagcu

SEQ ID NO: 255254 - RNA, 22 nt, Human
gugcuacagacugaguacacuu

SEQ ID NO: 255255 - RNA, 22 nt, Human
gagaggccaaaaucccugcccc

SEQ ID NO: 255256 - RNA, 22 nt, Human
aggccagggccagauuagccac

SEQ ID NO: 255257 - RNA, 22 nt, Human
uuagcagcggucaguuuugaag

SEQ ID NO: 255258 - RNA, 22 nt, Human
auaagcucuggacagccacauu

SEQ ID NO: 255259 - RNA, 20 nt, Human
uaggaaauauguuuuuaccc

SEQ ID NO: 255260 - RNA, 22 nt, Human
uuggaggaggcauuggaggauu

SEQ ID NO: 255261 - RNA, 22 nt, Human
augcgagugaugcagaguggcu

SEQ ID NO: 255262 - RNA, 22 nt, Human
ggccaggagcugcacagggcuc

SEQ ID NO: 255263 - RNA, 22 nt, Human
acucuauaaagauaccucaauu

SEQ ID NO: 255264 - RNA, 22 nt, Human
ugcauagggaaccucaugcauu

SEQ ID NO: 255265 - RNA, 22 nt, Human
ucaggcugaaaggacuccaguu

SEQ ID NO: 255266 - RNA, 22 nt, Human
cuauuagaaagcaucuucuaua

SEQ ID NO: 255267 - RNA, 22 nt, Human
aaacuguauauuuauggcaugu

SEQ ID NO: 255268 - RNA, 22 nt, Human
ucagaaaggaguuagaggucuc

SEQ ID NO: 255269 - RNA, 22 nt, Human
uuuacaguaagguggaugguac

SEQ ID NO: 255270 - RNA, 22 nt, Human
gugggguagaucuuucucagga

SEQ ID NO: 255271 - RNA, 21 nt, Human
aguacaaaaauuccuuucuca

SEQ ID NO: 255272 - RNA, 22 nt, Human
ggugcaaaaguaauuugguuuu

SEQ ID NO: 255273 - RNA, 23 nt, Human
ggcagcucucaucugaugacuga

SEQ ID NO: 255274 - RNA, 22 nt, Human
uggcucugguaacauuggguag

SEQ ID NO: 255275 - RNA, 22 nt, Human
aagagaaggugaggaagccggu

SEQ ID NO: 255276 - RNA, 22 nt, Human
ugcuacuacuugucaacgguca

SEQ ID NO: 255277 - RNA, 22 nt, Human
cagguccuuuaguguccagaac

SEQ ID NO: 255278 - RNA, 22 nt, Human
cucccaggcagggcugcccacu

SEQ ID NO: 255279 - RNA, 22 nt, Human
acaaaguuaacaguuggauagu

SEQ ID NO: 255280 - RNA, 22 nt, Human
cuccugggcucaagugauccuc

SEQ ID NO: 255281 - RNA, 22 nt, Human
gggaaacugcaacucagagagg

SEQ ID NO: 255282 - RNA, 22 nt, Human
gacaucuccaaggcaaccuguu

SEQ ID NO: 255283 - RNA, 22 nt, Human
aagcugcacuacuugagggacc

SEQ ID NO: 255284 - RNA, 18 nt, Human
gaggauggaaggagaugc

SEQ ID NO: 255285 - RNA, 22 nt, Human
uccugggcagccucucuggaag

SEQ ID NO: 255286 - RNA, 21 nt, Human
aggaaguggccagauugggaa

SEQ ID NO: 255287 - RNA, 22 nt, Human
cagguggcaugacugccuacaa

SEQ ID NO: 255288 - RNA, 22 nt, Human
agcauguguaaucucaauaccu

SEQ ID NO: 255289 - RNA, 18 nt, Human
gagcugagaagaggaugc

SEQ ID NO: 255290 - RNA, 22 nt, Human
uuuguaaauagcaguacucaug

SEQ ID NO: 255291 - RNA, 22 nt, Human
cucuggaagugauggcagguca

SEQ ID NO: 255292 - RNA, 22 nt, Human
gauguacaagauuguaggaaug

SEQ ID NO: 255293 - RNA, 22 nt, Human
caggagaccugguaagccaagu

SEQ ID NO: 255294 - RNA, 22 nt, Human
aagauauucaaagauuuauuag

SEQ ID NO: 255295 - RNA, 19 nt, Human
uacauugcugguggggaug

SEQ ID NO: 255296 - RNA, 22 nt, Human
acaagguauccacauuaaaugu

SEQ ID NO: 255297 - RNA, 22 nt, Human
aagaaagccaaaguucauaccu

SEQ ID NO: 255298 - RNA, 22 nt, Human
agucugguugauuccuuugcac

SEQ ID NO: 255299 - RNA, 22 nt, Human
aggcacagaauggcauucagug

SEQ ID NO: 255300 - RNA, 22 nt, Human
gggucugagcugaggggaaauc

SEQ ID NO: 255301 - RNA, 22 nt, Human
acagcugugacuuagagaaguu

SEQ ID NO: 255302 - RNA, 20 nt, Human
ccagcauguacacaugugga

SEQ ID NO: 255303 - RNA, 22 nt, Human
agcacuuaaguuaauugaacug

SEQ ID NO: 255304 - RNA, 22 nt, Human
ucagggcaagucucagaagguu

SEQ ID NO: 255305 - RNA, 22 nt, Human
uccucuuucucaacauuaguua

SEQ ID NO: 255306 - RNA, 22 nt, Human
ucaggcugcaucuguaagggug

SEQ ID NO: 255307 - RNA, 22 nt, Human
uuaauuaacuagccaaccacua

SEQ ID NO: 255308 - RNA, 22 nt, Human
aaggccuugguucugagcaaua

SEQ ID NO: 255309 - RNA, 22 nt, Human
cagcucuccacccuccugguuc

SEQ ID NO: 255310 - RNA, 22 nt, Human
uaaaagcucuucuguugaguua

SEQ ID NO: 255311 - RNA, 22 nt, Human
uccuggagaauccugccaccug

SEQ ID NO: 255312 - RNA, 22 nt, Human
cugcugccccugagcucagccu

SEQ ID NO: 255313 - RNA, 22 nt, Human
caauagcagcuucugaaugcaa

SEQ ID NO: 255314 - RNA, 22 nt, Human
auuacaguaacagcuacaaugc

SEQ ID NO: 255315 - RNA, 22 nt, Human
gaagggagaagguugggugacg

SEQ ID NO: 255316 - RNA, 19 nt, Human
ucuuucauuucuagcucug

SEQ ID NO: 255317 - RNA, 22 nt, Human
gacacuuucucagguaaagcau

SEQ ID NO: 255318 - RNA, 22 nt, Human
gccuggcugcuagccagaggca

SEQ ID NO: 255319 - RNA, 22 nt, Human
accuugucuuuuauagaacaag

SEQ ID NO: 255320 - RNA, 22 nt, Human
uuuauugaacacuugcacuggc

SEQ ID NO: 255321 - RNA, 22 nt, Human
uggcagaggagaauuaagauua

SEQ ID NO: 255322 - RNA, 22 nt, Human
aaagacucaauuguucccuaau

SEQ ID NO: 255323 - RNA, 22 nt, Human
ccuuggggaauauccauucuuc

SEQ ID NO: 255324 - RNA, 22 nt, Human
aacauugaaauauuugcaauag

SEQ ID NO: 255325 - RNA, 22 nt, Human
cccagccugugacagccguccu

SEQ ID NO: 255326 - RNA, 22 nt, Human
aaaugcacagagccuuagagau

SEQ ID NO: 255327 - RNA, 22 nt, Human
guuuucaugucuauugggcaua

SEQ ID NO: 255328 - RNA, 22 nt, Human
gacucguucauaguuccaauuu

SEQ ID NO: 255329 - RNA, 22 nt, Human
uuggcuuccaggggcuuuuaca

SEQ ID NO: 255330 - RNA, 20 nt, Human
agggcagcuugaggagccgg

SEQ ID NO: 255331 - RNA, 22 nt, Human
ucuggcuguuguuagguuccug

SEQ ID NO: 255332 - RNA, 22 nt, Human
ucuagaacuucucuaaaaugaa

SEQ ID NO: 255333 - RNA, 21 nt, Human
ucagaaucugugagcuaucuc

SEQ ID NO: 255334 - RNA, 22 nt, Human
ugacagggugauuaugagagcu

SEQ ID NO: 255335 - RNA, 22 nt, Human
auugucauuggcuucuaugucu

SEQ ID NO: 255336 - RNA, 22 nt, Human
ugacuaaaauaggacauuaacu

SEQ ID NO: 255337 - RNA, 21 nt, Human
auucugaguugucagucuuca

SEQ ID NO: 255338 - RNA, 22 nt, Human
ccucugaguuggccugucuugu

SEQ ID NO: 255339 - RNA, 22 nt, Human
uacagauugagguuuuuaauau

SEQ ID NO: 255340 - RNA, 22 nt, Human
aaaugcugggaaccauuggauc

SEQ ID NO: 255341 - RNA, 22 nt, Human
guggcugcaguaguguaggguc

SEQ ID NO: 255342 - RNA, 17 nt, Human
ugauaguucauuuuaag

SEQ ID NO: 255343 - RNA, 22 nt, Human
acagagcugggaucugaaccca

SEQ ID NO: 255344 - RNA, 22 nt, Human
auguuaaaugguuuauuauuaa

SEQ ID NO: 255345 - RNA, 22 nt, Human
ggagcugagguaacagugagug

SEQ ID NO: 255346 - RNA, 22 nt, Human
cugaaggcuuguuguuuucuua

SEQ ID NO: 255347 - RNA, 22 nt, Human
uauucugguuuccggaucucua

SEQ ID NO: 255348 - RNA, 22 nt, Human
ucagcucugcacuccacugugg

SEQ ID NO: 255349 - RNA, 22 nt, Human
uauaaagaaggcacagcaagac

SEQ ID NO: 255350 - RNA, 23 nt, Human
auggaaauagcaugugucauuua

SEQ ID NO: 255351 - RNA, 22 nt, Human
agauuuaaagcaguauucgcaa

SEQ ID NO: 255352 - RNA, 22 nt, Human
uuagaaaugucacagaucugau

SEQ ID NO: 255353 - RNA, 22 nt, Human
uaucuguuccaggcacucagcu

SEQ ID NO: 255354 - RNA, 22 nt, Human
ucucagaaggguggugcuggag

SEQ ID NO: 255355 - RNA, 22 nt, Human
ucuguuggacauucaucugcag

SEQ ID NO: 255356 - RNA, 22 nt, Human
ucaggcuugaggucuguaugug

SEQ ID NO: 255357 - RNA, 22 nt, Human
agucugguagaggaagaggccu

SEQ ID NO: 255358 - RNA, 22 nt, Human
caggcacaauuauuucccuuuc

SEQ ID NO: 255359 - RNA, 22 nt, Human
uucuccugaguucccaggucua

SEQ ID NO: 255360 - RNA, 22 nt, Human
uucugcauaggcuauauuuguu

SEQ ID NO: 255361 - RNA, 21 nt, Human
cacugguagauggcccgcagg

SEQ ID NO: 255362 - RNA, 22 nt, Human
cucuuugguuaaucacacagau

SEQ ID NO: 255363 - RNA, 21 nt, Human
guuuucaugauagagucugua

SEQ ID NO: 255364 - RNA, 22 nt, Human
uaguaacaacaacuagcauuuu

SEQ ID NO: 255365 - RNA, 22 nt, Human
aaucuucagcacuccagagacu

SEQ ID NO: 255366 - RNA, 22 nt, Human
gaucacaugaauggaauagaag

SEQ ID NO: 255367 - RNA, 22 nt, Human
agccugagcugccugccgccuc

SEQ ID NO: 255368 - RNA, 22 nt, Human
aggagcagauugguaagaucau

SEQ ID NO: 255369 - RNA, 22 nt, Human
ccuccuggauggauuuggugga

SEQ ID NO: 255370 - RNA, 17 nt, Human
agacagguuauaguuga

SEQ ID NO: 255371 - RNA, 22 nt, Human
uuuccuucccuggaugagaagu

SEQ ID NO: 255372 - RNA, 22 nt, Human
auagauuagcccuauaguuuua

SEQ ID NO: 255373 - RNA, 22 nt, Human
gaggcuccauggaggaguaugg

SEQ ID NO: 255374 - RNA, 22 nt, Human
uuucagaagucacaguugacug

SEQ ID NO: 255375 - RNA, 22 nt, Human
aguuucuaccgguacauucagg

SEQ ID NO: 255376 - RNA, 22 nt, Human
guaagauuuaaaauagcaauug

SEQ ID NO: 255377 - RNA, 22 nt, Human
aaugauauagcagacauagccu

SEQ ID NO: 255378 - RNA, 21 nt, Human
ugucagaaauaagcaugugau

SEQ ID NO: 255379 - RNA, 22 nt, Human
cugaggagaugauaaugucauu

SEQ ID NO: 255380 - RNA, 22 nt, Human
cugagggaacuugggcaagucu

SEQ ID NO: 255381 - RNA, 22 nt, Human
auacagaaaaugaugcagaguu

SEQ ID NO: 255382 - RNA, 22 nt, Human
agcuguguuuccagaugguagc

SEQ ID NO: 255383 - RNA, 22 nt, Human
aaaauacuacugucuucuuccc

SEQ ID NO: 255384 - RNA, 19 nt, Human
aacuagaaagguuuugaga

SEQ ID NO: 255385 - RNA, 22 nt, Human
acuccugugagguagguggcaa

SEQ ID NO: 255386 - RNA, 21 nt, Human
uucagcaguccucuagagaua

SEQ ID NO: 255387 - RNA, 22 nt, Human
aagauguucuauuuucacuuuu

SEQ ID NO: 255388 - RNA, 18 nt, Human
gcuuucuguagaaaaggg

SEQ ID NO: 255389 - RNA, 22 nt, Human
gguggggcucagcaaucugugu

SEQ ID NO: 255390 - RNA, 22 nt, Human
cagcaggucugcauuugagguc

SEQ ID NO: 255391 - RNA, 22 nt, Human
ugugugcauucacaugcaugcc

SEQ ID NO: 255392 - RNA, 20 nt, Human
cugugaccagagacccagga

SEQ ID NO: 255393 - RNA, 22 nt, Human
acugaaauggggacaguccuua

SEQ ID NO: 255394 - RNA, 22 nt, Human
uuggcuucuugugaaaucugag

SEQ ID NO: 255395 - RNA, 22 nt, Human
uuaauugagccagaaaguaucu

SEQ ID NO: 255396 - RNA, 22 nt, Human
gaggcuguuggcugaucugagu

SEQ ID NO: 255397 - RNA, 22 nt, Human
ucaacaguggcaaagaggcacg

SEQ ID NO: 255398 - RNA, 22 nt, Human
cuucauagaacagaaauuuaau

SEQ ID NO: 255399 - RNA, 22 nt, Human
cuacauuauguuuauugggacu

SEQ ID NO: 255400 - RNA, 22 nt, Human
uucauagagcagcucacugaau

SEQ ID NO: 255401 - RNA, 23 nt, Human
caggaagcagaugggguagaaga

SEQ ID NO: 255402 - RNA, 22 nt, Human
uucacuguuaugaagcucuggg

SEQ ID NO: 255403 - RNA, 22 nt, Human
aaaugcuuuggugcugguacag

SEQ ID NO: 255404 - RNA, 22 nt, Human
uucugugucuucuuguucugug

SEQ ID NO: 255405 - RNA, 22 nt, Human
cugcagaguggagccucggcug

SEQ ID NO: 255406 - RNA, 22 nt, Human
gcaggcaggaaggacuaaguaa

SEQ ID NO: 255407 - RNA, 22 nt, Human
ugcugucuguuuacuggcuaua

SEQ ID NO: 255408 - RNA, 22 nt, Human
uccugguggauagaagccaagg

SEQ ID NO: 255409 - RNA, 22 nt, Human
gugcagaggucacaaaagugaa

SEQ ID NO: 255410 - RNA, 22 nt, Human
ucugcaggagcagggcguggag

SEQ ID NO: 255411 - RNA, 22 nt, Human
aucaaaauggaagaauuuggcu

SEQ ID NO: 255412 - RNA, 17 nt, Human
aagacccuagucuaccc

SEQ ID NO: 255413 - RNA, 22 nt, Human
uguugacuugaaccaaaguguu

SEQ ID NO: 255414 - RNA, 22 nt, Human
auuuugaaucaccuuggaagaa

SEQ ID NO: 255415 - RNA, 22 nt, Human
ugugacagaucuuuaaauaaug

SEQ ID NO: 255416 - RNA, 22 nt, Human
cagugcagaggugcaagcaugu

SEQ ID NO: 255417 - RNA, 22 nt, Human
uauguucaugucaaacaaaugc

SEQ ID NO: 255418 - RNA, 22 nt, Human
aagcaguuuagauaggcaaagg

SEQ ID NO: 255419 - RNA, 22 nt, Human
gacaugugcugucucuuaaauu

SEQ ID NO: 255420 - RNA, 22 nt, Human
gcagaggggaagcugaggaauu

SEQ ID NO: 255421 - RNA, 22 nt, Human
caggccuugggacccagacugg

SEQ ID NO: 255422 - RNA, 22 nt, Human
uuccaggaggcauucuuaguuu

SEQ ID NO: 255423 - RNA, 20 nt, Human
uggaagacacugaagggcca

SEQ ID NO: 255424 - RNA, 22 nt, Human
ucugcaggaucagagccagagg

SEQ ID NO: 255425 - RNA, 22 nt, Human
cuggccuucagacucggacuga

SEQ ID NO: 255426 - RNA, 22 nt, Human
cucauuuaccuuugcaaucaag

SEQ ID NO: 255427 - RNA, 22 nt, Human
uuuaagcuguggcauuaauucu

SEQ ID NO: 255428 - RNA, 21 nt, Human
acagccugucaucucaugguc

SEQ ID NO: 255429 - RNA, 22 nt, Human
cuagagaauggcaaagauuaga

SEQ ID NO: 255430 - RNA, 22 nt, Human
augcuaauuccaugagcacagg

SEQ ID NO: 255431 - RNA, 22 nt, Human
ugagaacauuugcagggagagu

SEQ ID NO: 255432 - RNA, 22 nt, Human
ugcuggcuaauggaaaccagau

SEQ ID NO: 255433 - RNA, 22 nt, Human
gcucuagaucauaggucauuau

SEQ ID NO: 255434 - RNA, 18 nt, Human
ggcuucccuacucacuuc

SEQ ID NO: 255435 - RNA, 22 nt, Human
ccaggaagcugucugauaugaa

SEQ ID NO: 255436 - RNA, 22 nt, Human
ugaaugauuucuuaggcaauug

SEQ ID NO: 255437 - RNA, 22 nt, Human
agggcugugucccuaggggagc

SEQ ID NO: 255438 - RNA, 22 nt, Human
aggcagaaccagcugggacuuu

SEQ ID NO: 255439 - RNA, 22 nt, Human
ugcuaacaaagucuaaaucaua

SEQ ID NO: 255440 - RNA, 22 nt, Human
acccaggguagagugcaguggc

SEQ ID NO: 255441 - RNA, 22 nt, Human
uuacauguaaucuaaaauaauu

SEQ ID NO: 255442 - RNA, 22 nt, Human
ugagccaguucuucagauccau

SEQ ID NO: 255443 - RNA, 22 nt, Human
ccucuggguaucuguggaagua

SEQ ID NO: 255444 - RNA, 22 nt, Human
auucaguuccuugaggguauag

SEQ ID NO: 255445 - RNA, 22 nt, Human
gcuccaggaggaugaccuuccu

SEQ ID NO: 255446 - RNA, 19 nt, Human
uuccaaaaucaggauuuga

SEQ ID NO: 255447 - RNA, 22 nt, Human
ccagggccuacagcuuaagucc

SEQ ID NO: 255448 - RNA, 22 nt, Human
agggagaguuugauguuuccuc

SEQ ID NO: 255449 - RNA, 22 nt, Human
cagaaagcccuauguacagugg

SEQ ID NO: 255450 - RNA, 22 nt, Human
augagcucaggugugcaaaaua

SEQ ID NO: 255451 - RNA, 22 nt, Human
guguuuuaucagacaaaguaua

SEQ ID NO: 255452 - RNA, 22 nt, Human
gccaccccaaccucccuaaguu

SEQ ID NO: 255453 - RNA, 22 nt, Human
uuccuucuuuuacaccauaaau

SEQ ID NO: 255454 - RNA, 22 nt, Human
auguccaguuucuacacacaua

SEQ ID NO: 255455 - RNA, 22 nt, Human
uccugggagguaaaccagcauc

SEQ ID NO: 255456 - RNA, 22 nt, Human
acagcuccuaacaaaggcucuc

SEQ ID NO: 255457 - RNA, 21 nt, Human
caagccagaccaauagcagcc

SEQ ID NO: 255458 - RNA, 22 nt, Human
uuaaagaggcagguuaaauaau

SEQ ID NO: 255459 - RNA, 23 nt, Human
uugauuucaaaugcagagaacac

SEQ ID NO: 255460 - RNA, 22 nt, Human
ugcccaggauugugaggucagg

SEQ ID NO: 255461 - RNA, 22 nt, Human
cugccuuuucaucugagcugga

SEQ ID NO: 255462 - RNA, 22 nt, Human
agcccuggauucugagguccaa

SEQ ID NO: 255463 - RNA, 22 nt, Human
agcugggcugggcugagcugag

SEQ ID NO: 255464 - RNA, 23 nt, Human
ucaucuguaaguaucuguggagu

SEQ ID NO: 255465 - RNA, 22 nt, Human
acagaggccucguagguacaac

SEQ ID NO: 255466 - RNA, 22 nt, Human
cucccagagaccaagcugagaa

SEQ ID NO: 255467 - RNA, 22 nt, Human
uggcucuguugugcugagccag

SEQ ID NO: 255468 - RNA, 22 nt, Human
cuugaauguccuguggcaaagu

SEQ ID NO: 255469 - RNA, 22 nt, Human
acacuuucuggagcugcacaua

SEQ ID NO: 255470 - RNA, 22 nt, Human
cugagacuguaccacuuccucc

SEQ ID NO: 255471 - RNA, 22 nt, Human
acagcugggaaucagcugggga

SEQ ID NO: 255472 - RNA, 22 nt, Human
gggaccuggcaccuuugcucug

SEQ ID NO: 255473 - RNA, 22 nt, Human
agcucagaaaugccaguaggua

SEQ ID NO: 255474 - RNA, 22 nt, Human
ucuggcugggugagagcuucuc

SEQ ID NO: 255475 - RNA, 22 nt, Human
ggaccacaauauuugugagguu

SEQ ID NO: 255476 - RNA, 21 nt, Human
uaaggccaagucuauuucugu

SEQ ID NO: 255477 - RNA, 22 nt, Human
aaauguagaccuauagggaccu

SEQ ID NO: 255478 - RNA, 22 nt, Human
cucugaggcuccaugcaggcuu

SEQ ID NO: 255479 - RNA, 22 nt, Human
agaaagcacucugucuuuuacc

SEQ ID NO: 255480 - RNA, 22 nt, Human
caacaauaugccagacucaauu

SEQ ID NO: 255481 - RNA, 22 nt, Human
ucuggcaucacucgcaagagca

SEQ ID NO: 255482 - RNA, 22 nt, Human
ugcagggagcucuggggugcag

SEQ ID NO: 255483 - RNA, 22 nt, Human
auuaauaaaauaccacuuuguu

SEQ ID NO: 255484 - RNA, 22 nt, Human
uuguauuggcaaagaacuugag

SEQ ID NO: 255485 - RNA, 22 nt, Human
auuuauugagccuuuccuaugu

SEQ ID NO: 255486 - RNA, 22 nt, Human
cauuucugucacguucuuuuau

SEQ ID NO: 255487 - RNA, 22 nt, Human
caucacaucagugugaacaguu

SEQ ID NO: 255488 - RNA, 22 nt, Human
ugccuggggauugcucugggcc

SEQ ID NO: 255489 - RNA, 22 nt, Human
uugcaaaucacaagagcagagc

SEQ ID NO: 255490 - RNA, 22 nt, Human
caaaauaccacgacuuguuuua

SEQ ID NO: 255491 - RNA, 22 nt, Human
agcccagccugauucuacaccc

SEQ ID NO: 255492 - RNA, 22 nt, Human
ucccaauuaacagguaucaggc

SEQ ID NO: 255493 - RNA, 22 nt, Human
acccagggcucaagcguaggca

SEQ ID NO: 255494 - RNA, 22 nt, Human
ugcugcagggauuucagagaca

SEQ ID NO: 255495 - RNA, 22 nt, Human
uggccaccuucccacuucugcc

SEQ ID NO: 255496 - RNA, 22 nt, Human
uccuuagacaaagagugggcuu

SEQ ID NO: 255497 - RNA, 22 nt, Human
ucuuggagacucuuguauauuu

SEQ ID NO: 255498 - RNA, 21 nt, Human
caagcugccugagggugguug

SEQ ID NO: 255499 - RNA, 20 nt, Human
ugugccuggcuuuguccuga

SEQ ID NO: 255500 - RNA, 22 nt, Human
acucugcuguuuacucucuaua

SEQ ID NO: 255501 - RNA, 22 nt, Human
uuuacacauaccucuuuaaagu

SEQ ID NO: 255502 - RNA, 18 nt, Human
uacaugcauaaaugaagc

SEQ ID NO: 255503 - RNA, 22 nt, Human
uucacauuagccaagagaugga

SEQ ID NO: 255504 - RNA, 22 nt, Human
gcaaggaagcagaguugcuauc

SEQ ID NO: 255505 - RNA, 22 nt, Human
uuuggugagcugcgagugagga

SEQ ID NO: 255506 - RNA, 22 nt, Human
aaagccagcucugagcugcacc

SEQ ID NO: 255507 - RNA, 22 nt, Human
agguggcuaugaggaugcaguc

SEQ ID NO: 255508 - RNA, 22 nt, Human
aaugcaaacuucuuguuacuug

SEQ ID NO: 255509 - RNA, 22 nt, Human
uuagaaccagcauuuguccugg

SEQ ID NO: 255510 - RNA, 22 nt, Human
augucuguggcaauuguugaug

SEQ ID NO: 255511 - RNA, 22 nt, Human
gcugggcucuuuaccccuguac

SEQ ID NO: 255512 - RNA, 22 nt, Human
gaugggcguggcgcguuuggug

SEQ ID NO: 255513 - RNA, 22 nt, Human
guauagguuuggcucucuccag

SEQ ID NO: 255514 - RNA, 22 nt, Human
uccugggcgaguggugguacac

SEQ ID NO: 255515 - RNA, 19 nt, Human
agacacacuuacguggaau

SEQ ID NO: 255516 - RNA, 22 nt, Human
agcaggcuuguuaugucugaga

SEQ ID NO: 255517 - RNA, 22 nt, Human
uuauacauguguuuugagauga

SEQ ID NO: 255518 - RNA, 22 nt, Human
ucauucuugaucacuaguuagu

SEQ ID NO: 255519 - RNA, 22 nt, Human
cagggcaguuuuacuucucucu

SEQ ID NO: 255520 - RNA, 22 nt, Human
aacugcaaguggggcuugucau

SEQ ID NO: 255521 - RNA, 22 nt, Human
ggcaggcucuuggccuuaugag

SEQ ID NO: 255522 - RNA, 22 nt, Human
auguagaaaguucauagaugcg

SEQ ID NO: 255523 - RNA, 22 nt, Human
gccugucaauuuuguguacaau

SEQ ID NO: 255524 - RNA, 22 nt, Human
aauuuuaucucuaagcaggcuu

SEQ ID NO: 255525 - RNA, 22 nt, Human
gcucucuugguggcuguccugg

SEQ ID NO: 255526 - RNA, 22 nt, Human
agauuuacugagaacugauuac

SEQ ID NO: 255527 - RNA, 22 nt, Human
gcagaagcugggagaagggauu

SEQ ID NO: 255528 - RNA, 22 nt, Human
uuucaaaccuacuuguauguuu

SEQ ID NO: 255529 - RNA, 22 nt, Human
ugcacaguuggcuacaucgugg

SEQ ID NO: 255530 - RNA, 22 nt, Human
gaucuuuucagaauuuaucagu

SEQ ID NO: 255531 - RNA, 22 nt, Human
ccuggcagguuacaaccaguua

SEQ ID NO: 255532 - RNA, 22 nt, Human
ccagagggaacugggccucauu

SEQ ID NO: 255533 - RNA, 22 nt, Human
accuuauuaaaaugaugaugua

SEQ ID NO: 255534 - RNA, 18 nt, Human
ggcugagguugacuagaa

SEQ ID NO: 255535 - RNA, 20 nt, Human
cacccucccagcaccuaugc

SEQ ID NO: 255536 - RNA, 22 nt, Human
cuggucuggcuacccagcgaau

SEQ ID NO: 255537 - RNA, 22 nt, Human
uauacagauuaacagauuuaaa

SEQ ID NO: 255538 - RNA, 22 nt, Human
gugguccucauaauucagugag

SEQ ID NO: 255539 - RNA, 22 nt, Human
ucccugaaacaucucuguggau

SEQ ID NO: 255540 - RNA, 22 nt, Human
agaaagcuggaagagcugggau

SEQ ID NO: 255541 - RNA, 22 nt, Human
cuaggcuggagugcaguggcau

SEQ ID NO: 255542 - RNA, 22 nt, Human
uuugggcauauagcuguucccu

SEQ ID NO: 255543 - RNA, 22 nt, Human
gacuccugccuccucuguuugc

SEQ ID NO: 255544 - RNA, 22 nt, Human
cucucuggcacuucauugcugu

SEQ ID NO: 255545 - RNA, 22 nt, Human
aaggcuccuuuguaguucuuuu

SEQ ID NO: 255546 - RNA, 22 nt, Human
accugggagagaggagccggcg

SEQ ID NO: 255547 - RNA, 22 nt, Human
cccuccagagcuugaccugcug

SEQ ID NO: 255548 - RNA, 22 nt, Human
gcugggaggaauuuggggaaua

SEQ ID NO: 255549 - RNA, 22 nt, Human
auuggucugugagcuguugaca

SEQ ID NO: 255550 - RNA, 22 nt, Human
agcaagauuuaaacccagguca

SEQ ID NO: 255551 - RNA, 22 nt, Human
gagguggauguugcagugagcu

SEQ ID NO: 255552 - RNA, 22 nt, Human
cagcuccucuguuagcccuggg

SEQ ID NO: 255553 - RNA, 19 nt, Human
uuggccuuguuucauaucu

SEQ ID NO: 255554 - RNA, 20 nt, Human
augccuuugauagucaggcu

SEQ ID NO: 255555 - RNA, 22 nt, Human
cagguguauaaacucagugacu

SEQ ID NO: 255556 - RNA, 20 nt, Human
auuauucauacaugugugac

SEQ ID NO: 255557 - RNA, 22 nt, Human
caauaaagaagauuuuugcaau

SEQ ID NO: 255558 - RNA, 22 nt, Human
ccaggcagcaaauuuucugaau

SEQ ID NO: 255559 - RNA, 22 nt, Human
ugccuuccugcuuugaguucug

SEQ ID NO: 255560 - RNA, 22 nt, Human
auacagaaaaguggauagccag

SEQ ID NO: 255561 - RNA, 19 nt, Human
caaggccaccauuucuccg

SEQ ID NO: 255562 - RNA, 22 nt, Human
ugucucagcugugcuucauugg

SEQ ID NO: 255563 - RNA, 22 nt, Human
ugaggggagguuggggcacauc

SEQ ID NO: 255564 - RNA, 22 nt, Human
ugauucuuugaccaaaaaauug

SEQ ID NO: 255565 - RNA, 22 nt, Human
ggcacuuugauuuugagaugca

SEQ ID NO: 255566 - RNA, 21 nt, Human
cuggcaugaggagcuuuguuu

SEQ ID NO: 255567 - RNA, 22 nt, Human
guccagccaggccugucucugg

SEQ ID NO: 255568 - RNA, 22 nt, Human
ugcugggucagugagagcaggg

SEQ ID NO: 255569 - RNA, 19 nt, Human
aggcucuguaggagagggc

SEQ ID NO: 255570 - RNA, 22 nt, Human
aagagcauuuccacuggcacug

SEQ ID NO: 255571 - RNA, 22 nt, Human
ucuuugaaaagggagauagaaa

SEQ ID NO: 255572 - RNA, 22 nt, Human
acacuucucuuugaagaacaau

SEQ ID NO: 255573 - RNA, 22 nt, Human
gcucccuguucucagccaugau

SEQ ID NO: 255574 - RNA, 22 nt, Human
uccaggcagagcaacaaaauau

SEQ ID NO: 255575 - RNA, 18 nt, Human
ccccaaaagucacccugg

SEQ ID NO: 255576 - RNA, 22 nt, Human
cauuggaaugcauuugaagaga

SEQ ID NO: 255577 - RNA, 17 nt, Human
cucuguacaggaaagag

SEQ ID NO: 255578 - RNA, 22 nt, Human
ucagggaccccucugaguggag

SEQ ID NO: 255579 - RNA, 22 nt, Human
augacacuuggugauacuuugu

SEQ ID NO: 255580 - RNA, 22 nt, Human
gucuucuggggccaggcccgcu

SEQ ID NO: 255581 - RNA, 22 nt, Human
uacuuguucuuucaagagauag

SEQ ID NO: 255582 - RNA, 22 nt, Human
gaaucuuauuuuuaaaucuucc

SEQ ID NO: 255583 - RNA, 22 nt, Human
ggaccaggcaagcugaggcggg

SEQ ID NO: 255584 - RNA, 22 nt, Human
gcagaaguuaaucgaaggccau

SEQ ID NO: 255585 - RNA, 22 nt, Human
cucagaguccccacaucugggu

SEQ ID NO: 255586 - RNA, 22 nt, Human
cuaauuguaagcuccuugaggg

SEQ ID NO: 255587 - RNA, 22 nt, Human
acugggcugguuaguuuuacua

SEQ ID NO: 255588 - RNA, 22 nt, Human
ucccaggcucuucaaggaagac

SEQ ID NO: 255589 - RNA, 22 nt, Human
ugugaauagucagcauuuuguu

SEQ ID NO: 255590 - RNA, 23 nt, Human
cugcaacucagucuggagcaguu

SEQ ID NO: 255591 - RNA, 22 nt, Human
aaagcaauagguuaggucaaga

SEQ ID NO: 255592 - RNA, 22 nt, Human
aggaauucaagaccagcugggc

SEQ ID NO: 255593 - RNA, 22 nt, Human
cauuugcauaugaagaaguaag

SEQ ID NO: 255594 - RNA, 22 nt, Human
ucccugagggcagcucaagucc

SEQ ID NO: 255595 - RNA, 22 nt, Human
cagagggaguuucugagguugc

SEQ ID NO: 255596 - RNA, 22 nt, Human
gcacugugcuagaagccagggg

SEQ ID NO: 255597 - RNA, 22 nt, Human
uccaggguugugggcuucagca

SEQ ID NO: 255598 - RNA, 22 nt, Human
ggucuggaauaagguccaggaa

SEQ ID NO: 255599 - RNA, 21 nt, Human
uucaacaaagggaauaaguuu

SEQ ID NO: 255600 - RNA, 22 nt, Human
cuugcaggauuuugcugcugua

SEQ ID NO: 255601 - RNA, 22 nt, Human
uaacaaaguaccauagacugga

SEQ ID NO: 255602 - RNA, 23 nt, Human
cccagcagagaugaggagggguc

SEQ ID NO: 255603 - RNA, 22 nt, Human
agcagccaagguaaccugugcu

SEQ ID NO: 255604 - RNA, 22 nt, Human
ucuagaaaaccaauauuacaug

SEQ ID NO: 255605 - RNA, 22 nt, Human
acuagaaagaaguuuuuugaga

SEQ ID NO: 255606 - RNA, 22 nt, Human
ucucagagggaaacaugaguga

SEQ ID NO: 255607 - RNA, 22 nt, Human
ugggagcaagcuggugcuggag

SEQ ID NO: 255608 - RNA, 20 nt, Human
accuacauguauagugaggg

SEQ ID NO: 255609 - RNA, 22 nt, Human
cacagcugcccuaacuguacuc

SEQ ID NO: 255610 - RNA, 22 nt, Human
gaggccugucgcuaggccucug

SEQ ID NO: 255611 - RNA, 22 nt, Human
aggaggaacucagaaagaaggu

SEQ ID NO: 255612 - RNA, 22 nt, Human
caggagcagaggguggucagca

SEQ ID NO: 255613 - RNA, 22 nt, Human
cagagcagagugauuguucugg

SEQ ID NO: 255614 - RNA, 22 nt, Human
ggagccagaaaugcugugguug

SEQ ID NO: 255615 - RNA, 22 nt, Human
ccuccaguacuccaguccagcg

SEQ ID NO: 255616 - RNA, 22 nt, Human
auuaggaaguaaguaucacaag

SEQ ID NO: 255617 - RNA, 22 nt, Human
ugcuuucuuuagcuccugaguc

SEQ ID NO: 255618 - RNA, 22 nt, Human
ccuccacucuggccucucaggu

SEQ ID NO: 255619 - RNA, 22 nt, Human
uccugagggcauuuuggugacu

SEQ ID NO: 255620 - RNA, 22 nt, Human
ucccaaggugcucggcaacagg

SEQ ID NO: 255621 - RNA, 19 nt, Human
uuuuuacaaguagguguga

SEQ ID NO: 255622 - RNA, 22 nt, Human
ucuuuggcaucagggccagcua

SEQ ID NO: 255623 - RNA, 22 nt, Human
uuuccaaaaugaaucuaaugca

SEQ ID NO: 255624 - RNA, 22 nt, Human
aucuguggucaaaauagaaacu

SEQ ID NO: 255625 - RNA, 22 nt, Human
ucuggguaugaccuauuuuucc

SEQ ID NO: 255626 - RNA, 22 nt, Human
aaauacgugcacauacauacau

SEQ ID NO: 255627 - RNA, 22 nt, Human
gagaacugauuagcauuugcca

SEQ ID NO: 255628 - RNA, 23 nt, Human
uuuaaccuuggucaagaauuucc

SEQ ID NO: 255629 - RNA, 22 nt, Human
uccugaggaaaguucaugaaug

SEQ ID NO: 255630 - RNA, 22 nt, Human
ucugcccuggggucagccucca

SEQ ID NO: 255631 - RNA, 22 nt, Human
uaccagcaacuggaagucagau

SEQ ID NO: 255632 - RNA, 22 nt, Human
gggucucuccuccccagcugug

SEQ ID NO: 255633 - RNA, 22 nt, Human
caggaggaaacuggauucacuu

SEQ ID NO: 255634 - RNA, 22 nt, Human
caggagcucuuaaggaugugau

SEQ ID NO: 255635 - RNA, 22 nt, Human
aaagaacaaaugauauaugguu

SEQ ID NO: 255636 - RNA, 22 nt, Human
gagguucagcugcugccuggua

SEQ ID NO: 255637 - RNA, 22 nt, Human
agagccuuuggagcugcuauua

SEQ ID NO: 255638 - RNA, 22 nt, Human
ugcaaacagaaaagcuacuuug

SEQ ID NO: 255639 - RNA, 22 nt, Human
gaggacaggagacucacuguuu

SEQ ID NO: 255640 - RNA, 20 nt, Human
uuuuccagaaaguaucauug

SEQ ID NO: 255641 - RNA, 22 nt, Human
gugcuuuuaaaggcaauuagua

SEQ ID NO: 255642 - RNA, 22 nt, Human
cggagggguuugaacagaggag

SEQ ID NO: 255643 - RNA, 22 nt, Human
agacaaaugguaauuaugucua

SEQ ID NO: 255644 - RNA, 22 nt, Human
ucuuuagaaacuuuucuucaug

SEQ ID NO: 255645 - RNA, 22 nt, Human
uccugggacucaacuuagaagg

SEQ ID NO: 255646 - RNA, 22 nt, Human
agccuuguagaccauuuuaagg

SEQ ID NO: 255647 - RNA, 22 nt, Human
uuagcuucuuacauuucauccu

SEQ ID NO: 255648 - RNA, 22 nt, Human
cagucugauguucgcaggugaa

SEQ ID NO: 255649 - RNA, 22 nt, Human
gcucacuggccugaagaggacg

SEQ ID NO: 255650 - RNA, 22 nt, Human
ucucuucacauuccuggcaaac

SEQ ID NO: 255651 - RNA, 22 nt, Human
gcccagggcuucaaagagagaa

SEQ ID NO: 255652 - RNA, 19 nt, Human
ggcugggucuggcagguuc

SEQ ID NO: 255653 - RNA, 20 nt, Human
ucccucccuccagcucuggg

SEQ ID NO: 255654 - RNA, 22 nt, Human
caguuacauauuuaguagguua

SEQ ID NO: 255655 - RNA, 22 nt, Human
ccccucauucucugagcuaguu

SEQ ID NO: 255656 - RNA, 22 nt, Human
ucugagugaguguaggccugac

SEQ ID NO: 255657 - RNA, 22 nt, Human
aguccuggccccaaggaaggau

SEQ ID NO: 255658 - RNA, 22 nt, Human
aacaggcaaacugugggauccc

SEQ ID NO: 255659 - RNA, 22 nt, Human
agaggccucuagggccccucag

SEQ ID NO: 255660 - RNA, 21 nt, Human
gagcccaggcaucucauuaau

SEQ ID NO: 255661 - RNA, 22 nt, Human
caggaggcaucauggagcggac

SEQ ID NO: 255662 - RNA, 22 nt, Human
cccugaugacacgggcaucagg

SEQ ID NO: 255663 - RNA, 21 nt, Human
uuccuggcggcagaaacguga

SEQ ID NO: 255664 - RNA, 22 nt, Human
gggccuggcaugcagccccguu

SEQ ID NO: 255665 - RNA, 22 nt, Human
gagcaaagcuuuuagggccuuu

SEQ ID NO: 255666 - RNA, 21 nt, Human
agugugugauaggcaggaaga

SEQ ID NO: 255667 - RNA, 20 nt, Human
acaggagaucugaggaaagg

SEQ ID NO: 255668 - RNA, 22 nt, Human
auuauaaaccuuugaggguggg

SEQ ID NO: 255669 - RNA, 22 nt, Human
cucacaggagaaagucaugguc

SEQ ID NO: 255670 - RNA, 20 nt, Human
agaucuuuucuauagaagug

SEQ ID NO: 255671 - RNA, 22 nt, Human
ggguguggcugcgugccaauaa

SEQ ID NO: 255672 - RNA, 22 nt, Human
aaagaugaucuacaaguucauu

SEQ ID NO: 255673 - RNA, 22 nt, Human
uuguuaaaauuggagccgagag

SEQ ID NO: 255674 - RNA, 22 nt, Human
cagcugguacucaguucuuguc

SEQ ID NO: 255675 - RNA, 22 nt, Human
guuaaacaauaacuggcacaca

SEQ ID NO: 255676 - RNA, 22 nt, Human
aggaagaggugugcaauggugu

SEQ ID NO: 255677 - RNA, 22 nt, Human
acacagauauuuugaauacaua

SEQ ID NO: 255678 - RNA, 22 nt, Human
uagggggcuguccugugcauua

SEQ ID NO: 255679 - RNA, 20 nt, Human
caaguguuauugugcauuua

SEQ ID NO: 255680 - RNA, 19 nt, Human
agugugagacuccaucuca

SEQ ID NO: 255681 - RNA, 22 nt, Human
cucccucaggccuuagcccugc

SEQ ID NO: 255682 - RNA, 22 nt, Human
aggcucugugaugugccaggca

SEQ ID NO: 255683 - RNA, 22 nt, Human
gagugcaggccugagcaccauc

SEQ ID NO: 255684 - RNA, 22 nt, Human
uuaaacagucccagaggcugac

SEQ ID NO: 255685 - RNA, 22 nt, Human
aguauacauauauuagccuucg

SEQ ID NO: 255686 - RNA, 22 nt, Human
uuugcaguguucaucaguauuu

SEQ ID NO: 255687 - RNA, 22 nt, Human
agguccugacgcccuuugaaau

SEQ ID NO: 255688 - RNA, 20 nt, Human
gauguguccucagcaguggu

SEQ ID NO: 255689 - RNA, 22 nt, Human
aaggauucaagaaaugguguag

SEQ ID NO: 255690 - RNA, 22 nt, Human
aagucucugacucacacaaugu

SEQ ID NO: 255691 - RNA, 23 nt, Human
gggaucuguaaaccuggagaacc

SEQ ID NO: 255692 - RNA, 22 nt, Human
augaggaggccaguaagagccu

SEQ ID NO: 255693 - RNA, 22 nt, Human
ggcugucucugugacugccacc

SEQ ID NO: 255694 - RNA, 22 nt, Human
uuguauguuucugugcacauga

SEQ ID NO: 255695 - RNA, 22 nt, Human
cuugggauguaaccuuuguucc

SEQ ID NO: 255696 - RNA, 20 nt, Human
gaggcccagagaggugaagc

SEQ ID NO: 255697 - RNA, 22 nt, Human
uugccuggaugguccccagaga

SEQ ID NO: 255698 - RNA, 22 nt, Human
ucugagaggcaucugcacuucu

SEQ ID NO: 255699 - RNA, 22 nt, Human
guggcucuccauugacauggaa

SEQ ID NO: 255700 - RNA, 22 nt, Human
uugggcucaggaguuugagacc

SEQ ID NO: 255701 - RNA, 22 nt, Human
uacauacagagaugcuaguuaa

SEQ ID NO: 255702 - RNA, 22 nt, Human
uaagaauuaucucauggauaau

SEQ ID NO: 255703 - RNA, 17 nt, Human
gauuagaaaacacauga

SEQ ID NO: 255704 - RNA, 22 nt, Human
ggcuuucugucugcgucugugu

SEQ ID NO: 255705 - RNA, 22 nt, Human
uguccugggaaaucccuuaggc

SEQ ID NO: 255706 - RNA, 22 nt, Human
uucaaguuuacuuugaaguuua

SEQ ID NO: 255707 - RNA, 22 nt, Human
aacacaaaaauucucaggggca

SEQ ID NO: 255708 - RNA, 20 nt, Human
accagagcucucaguaugug

SEQ ID NO: 255709 - RNA, 22 nt, Human
gggagccaaggagagaggccuu

SEQ ID NO: 255710 - RNA, 22 nt, Human
aguguacaaaaugauagauaaa

SEQ ID NO: 255711 - RNA, 22 nt, Human
ugccucugguuaucugguaccu

SEQ ID NO: 255712 - RNA, 22 nt, Human
uuccaggacuggguguuugaag

SEQ ID NO: 255713 - RNA, 22 nt, Human
accgggaaguccugcacugggc

SEQ ID NO: 255714 - RNA, 22 nt, Human
ucuucuuuuugucccacagaau

SEQ ID NO: 255715 - RNA, 19 nt, Human
cuccuucccugguuucugu

SEQ ID NO: 255716 - RNA, 22 nt, Human
cucuggccugcuuccucaggua

SEQ ID NO: 255717 - RNA, 22 nt, Human
gcauaggccacuagugccagga

SEQ ID NO: 255718 - RNA, 22 nt, Human
auucacacuuuacuucuuucca

SEQ ID NO: 255719 - RNA, 23 nt, Human
aauuacaaccaagaacuggaagg

SEQ ID NO: 255720 - RNA, 22 nt, Human
gagacugcauagauggccacaa

SEQ ID NO: 255721 - RNA, 22 nt, Human
ccucagggucauccuaguaaua

SEQ ID NO: 255722 - RNA, 22 nt, Human
uaggugcaggucacaagggaug

SEQ ID NO: 255723 - RNA, 17 nt, Human
cagcccugccguuccca

SEQ ID NO: 255724 - RNA, 22 nt, Human
ccagguccuguuuucaccacag

SEQ ID NO: 255725 - RNA, 22 nt, Human
cuaaggaaaggaaauacaguaa

SEQ ID NO: 255726 - RNA, 22 nt, Human
uuaagcauaauuaaagugaaau

SEQ ID NO: 255727 - RNA, 20 nt, Human
caggcaguuugugguuaggg

SEQ ID NO: 255728 - RNA, 22 nt, Human
acuuugcacuucaauauaacuu

SEQ ID NO: 255729 - RNA, 22 nt, Human
uagggaccuuagaauuguaugu

SEQ ID NO: 255730 - RNA, 22 nt, Human
ugcaggugucucugucuagcgu

SEQ ID NO: 255731 - RNA, 22 nt, Human
gaggccugaggcugccuggagc

SEQ ID NO: 255732 - RNA, 21 nt, Human
gaguccuggcuaggguggcag

SEQ ID NO: 255733 - RNA, 22 nt, Human
gagacagugguugcagaagcuc

SEQ ID NO: 255734 - RNA, 17 nt, Human
gucaacaggauuucuuu

SEQ ID NO: 255735 - RNA, 22 nt, Human
ugaggccagccacagccacccu

SEQ ID NO: 255736 - RNA, 22 nt, Human
auguuuuaugcuucagaugagg

SEQ ID NO: 255737 - RNA, 22 nt, Human
gggccagguggaccccagccuc

SEQ ID NO: 255738 - RNA, 22 nt, Human
gggcuugguggagagaaugcug

SEQ ID NO: 255739 - RNA, 22 nt, Human
aaaguugaccgaaagauuuuga

SEQ ID NO: 255740 - RNA, 22 nt, Human
uggcaggaagacguggggcacc

SEQ ID NO: 255741 - RNA, 22 nt, Human
ccccucugcaaauagccaggcu

SEQ ID NO: 255742 - RNA, 22 nt, Human
gccagcaguggccaccaccagg

SEQ ID NO: 255743 - RNA, 22 nt, Human
ucucuucuauuugagacuauuu

SEQ ID NO: 255744 - RNA, 22 nt, Human
ggcagagguagcuggaaccagg

SEQ ID NO: 255745 - RNA, 22 nt, Human
ccugggagaacugcuggguugg

SEQ ID NO: 255746 - RNA, 22 nt, Human
ggaguccuggacuccaucucac

SEQ ID NO: 255747 - RNA, 22 nt, Human
cuccccauccaggcagcaggug

SEQ ID NO: 255748 - RNA, 22 nt, Human
acgagucugcucuugaaaaagu

SEQ ID NO: 255749 - RNA, 22 nt, Human
cccagguggguuggccucuguc

SEQ ID NO: 255750 - RNA, 22 nt, Human
ccauuuacauuguacucuguga

SEQ ID NO: 255751 - RNA, 22 nt, Human
ccaggcuucugauuccaggcac

SEQ ID NO: 255752 - RNA, 22 nt, Human
gaaaugcauaaucuuaguagau

SEQ ID NO: 255753 - RNA, 22 nt, Human
uggaaggaaagguagcagagaa

SEQ ID NO: 255754 - RNA, 22 nt, Human
acacaggaacucugagaggugg

SEQ ID NO: 255755 - RNA, 22 nt, Human
acagaauugauggaaaucucag

SEQ ID NO: 255756 - RNA, 22 nt, Human
auguguaggugaaucgaggcug

SEQ ID NO: 255757 - RNA, 22 nt, Human
ccuggcugguggcagcgacaag

SEQ ID NO: 255758 - RNA, 22 nt, Human
ucauuguuucugcuuuucauga

SEQ ID NO: 255759 - RNA, 22 nt, Human
ccugagggaucuguggaauagc

SEQ ID NO: 255760 - RNA, 22 nt, Human
uuuaauuauaucugggcaguua

SEQ ID NO: 255761 - RNA, 22 nt, Human
gcgacuguacagaauugccccu

SEQ ID NO: 255762 - RNA, 22 nt, Human
aaacauagcacacacagcucuu

SEQ ID NO: 255763 - RNA, 22 nt, Human
aaacugcacuuuauuuugucaa

SEQ ID NO: 255764 - RNA, 22 nt, Human
aagaguuauauaauguguaguu

SEQ ID NO: 255765 - RNA, 22 nt, Human
aacauuuuuaagaccaagugcu

SEQ ID NO: 255766 - RNA, 22 nt, Human
ucccacauaugcaauccugaau

SEQ ID NO: 255767 - RNA, 22 nt, Human
aggggagcaaggccguggugua

SEQ ID NO: 255768 - RNA, 16 nt, Human
ggggaaggcaagaggg

SEQ ID NO: 255769 - RNA, 22 nt, Human
uuaggaaagucucuuggcuggg

SEQ ID NO: 255770 - RNA, 22 nt, Human
agcugggugcgguggcucaugc

SEQ ID NO: 255771 - RNA, 22 nt, Human
ucaaaucucacucugcauuucu

SEQ ID NO: 255772 - RNA, 22 nt, Human
acagcuuuugaaaaauuacugg

SEQ ID NO: 255773 - RNA, 21 nt, Human
ugcuuuaugggaaaaauguca

SEQ ID NO: 255774 - RNA, 22 nt, Human
acaauuuuaagccagagugggu

SEQ ID NO: 255775 - RNA, 22 nt, Human
ugcaaaaacagccuugaggccu

SEQ ID NO: 255776 - RNA, 22 nt, Human
gaaaauuauugaaaauggcucu

SEQ ID NO: 255777 - RNA, 22 nt, Human
uggaagaauauggggguacaga

SEQ ID NO: 255778 - RNA, 22 nt, Human
ugcaucuuacguuuugaaaggg

SEQ ID NO: 255779 - RNA, 22 nt, Human
ggagggcccugggugcagcucu

SEQ ID NO: 255780 - RNA, 22 nt, Human
ggggggcagcuguccuggccau

SEQ ID NO: 255781 - RNA, 22 nt, Human
cccaggcagccugcagggaagg

SEQ ID NO: 255782 - RNA, 22 nt, Human
ugguggcagcugggacagaggu

SEQ ID NO: 255783 - RNA, 21 nt, Human
uugaggagugagaguggguuu

SEQ ID NO: 255784 - RNA, 22 nt, Human
gcucuuuggauuccuuuacaaa

SEQ ID NO: 255785 - RNA, 22 nt, Human
ucuuacccggcaacgugugucg

SEQ ID NO: 255786 - RNA, 22 nt, Human
uuagaacaguagaagaaagggu

SEQ ID NO: 255787 - RNA, 22 nt, Human
gaagaggaugacaggagccggu

SEQ ID NO: 255788 - RNA, 22 nt, Human
gucugcccucacaugcacucuu

SEQ ID NO: 255789 - RNA, 22 nt, Human
uggaagccguaggguuugggaa

SEQ ID NO: 255790 - RNA, 22 nt, Human
aucaaaguucguaacugauaac

SEQ ID NO: 255791 - RNA, 22 nt, Human
agacagcuguuccuucauguuu

SEQ ID NO: 255792 - RNA, 22 nt, Human
agugcaggccccaggccaggcc

SEQ ID NO: 255793 - RNA, 22 nt, Human
uuguagcuagguuuuuguagaa

SEQ ID NO: 255794 - RNA, 22 nt, Human
guucaguuaugugaccucaaaa

SEQ ID NO: 255795 - RNA, 22 nt, Human
cagcuucugucugauuagcaag

SEQ ID NO: 255796 - RNA, 22 nt, Human
ggugacgaauccauagcaucga

SEQ ID NO: 255797 - RNA, 22 nt, Human
acaguaaaucaacagaauaucu

SEQ ID NO: 255798 - RNA, 22 nt, Human
uaacagaagaaaacauauugga

SEQ ID NO: 255799 - RNA, 22 nt, Human
ugcccugcuugguuuauuuuca

SEQ ID NO: 255800 - RNA, 20 nt, Human
cuuugccuauucucugccug

SEQ ID NO: 255801 - RNA, 22 nt, Human
uucuccagagggcucugcagga

SEQ ID NO: 255802 - RNA, 22 nt, Human
auucaguaggugugaacuuauu

SEQ ID NO: 255803 - RNA, 22 nt, Human
ucuagaagggugccgaucuuag

SEQ ID NO: 255804 - RNA, 22 nt, Human
uccuggcccaaucugcccauga

SEQ ID NO: 255805 - RNA, 22 nt, Human
ucacuccaucuuugcuacuggu

SEQ ID NO: 255806 - RNA, 19 nt, Human
ccaggccucuggggccugu

SEQ ID NO: 255807 - RNA, 22 nt, Human
ugagggcuccccgcugcugugu

SEQ ID NO: 255808 - RNA, 19 nt, Human
uggaggaaguauauuucau

SEQ ID NO: 255809 - RNA, 22 nt, Human
caggccccauuccucuugggac

SEQ ID NO: 255810 - RNA, 22 nt, Human
accagcucagaagccagaaaga

SEQ ID NO: 255811 - RNA, 22 nt, Human
ggcuccaggagggccuuggcca

SEQ ID NO: 255812 - RNA, 22 nt, Human
ucuggcucuauaacuccuagcu

SEQ ID NO: 255813 - RNA, 22 nt, Human
agagacaggauaucugcucaug

SEQ ID NO: 255814 - RNA, 22 nt, Human
gaugaaggggcuggugcccucu

SEQ ID NO: 255815 - RNA, 22 nt, Human
uguccaggacccuauucucacu

SEQ ID NO: 255816 - RNA, 21 nt, Human
uaaaucucuguauucuucagu

SEQ ID NO: 255817 - RNA, 22 nt, Human
uccuggccuagaguuuguguuc

SEQ ID NO: 255818 - RNA, 22 nt, Human
cucuuugggaugggcucugcug

SEQ ID NO: 255819 - RNA, 22 nt, Human
aaaacauaaacugacagcccau

SEQ ID NO: 255820 - RNA, 22 nt, Human
agcagcuggggccugugacgau

SEQ ID NO: 255821 - RNA, 22 nt, Human
auuuaugacaaccaaagaguga

SEQ ID NO: 255822 - RNA, 22 nt, Human
aaaggcuaguggauucauugau

SEQ ID NO: 255823 - RNA, 22 nt, Human
uuuaaaagggguauuaagucca

SEQ ID NO: 255824 - RNA, 22 nt, Human
caguuuauagcucuagcagcuu

SEQ ID NO: 255825 - RNA, 22 nt, Human
cugcuuggguccuggcaugggu

SEQ ID NO: 255826 - RNA, 22 nt, Human
ucucauguuucugguacuccuu

SEQ ID NO: 255827 - RNA, 22 nt, Human
gaggagggagcuggaagcucuu

SEQ ID NO: 255828 - RNA, 22 nt, Human
acaaggacgucacuuccacggu

SEQ ID NO: 255829 - RNA, 22 nt, Human
cuuucgaucaagggucccuuca

SEQ ID NO: 255830 - RNA, 22 nt, Human
ugaaaugcuugggaccagaagu

SEQ ID NO: 255831 - RNA, 20 nt, Human
ccagguggugccuggagagg

SEQ ID NO: 255832 - RNA, 22 nt, Human
gagcacguugaagcgcacuguc

SEQ ID NO: 255833 - RNA, 22 nt, Human
acuaaaacaguggcuaguagac

SEQ ID NO: 255834 - RNA, 22 nt, Human
ggcaggugugagcuguaaagga

SEQ ID NO: 255835 - RNA, 22 nt, Human
uccugcacauuaguauuuuuua

SEQ ID NO: 255836 - RNA, 22 nt, Human
ucuuaaaccacaaaauucagag

SEQ ID NO: 255837 - RNA, 22 nt, Human
uauucaugucggcugaaaaagc

SEQ ID NO: 255838 - RNA, 22 nt, Human
cuggcuuugaaggucuuuccua

SEQ ID NO: 255839 - RNA, 22 nt, Human
cagcugagaagugauagcugca

SEQ ID NO: 255840 - RNA, 22 nt, Human
ugauucaauaggaauugaguag

SEQ ID NO: 255841 - RNA, 22 nt, Human
augacuuuccuggcaaaaguug

SEQ ID NO: 255842 - RNA, 22 nt, Human
ugucacaugaaacuugcucauc

SEQ ID NO: 255843 - RNA, 22 nt, Human
gcagggauugugcagggggcua

SEQ ID NO: 255844 - RNA, 18 nt, Human
acucugggaccuguuauu

SEQ ID NO: 255845 - RNA, 20 nt, Human
acugugaaugcugaauuagc

SEQ ID NO: 255846 - RNA, 22 nt, Human
ccaggcccaccuuggccacuua

SEQ ID NO: 255847 - RNA, 22 nt, Human
aagcagcaugcuaugcuggugg

SEQ ID NO: 255848 - RNA, 22 nt, Human
aaauacucucaauaaagaaagu

SEQ ID NO: 255849 - RNA, 22 nt, Human
ucucagagggaaaggccaauuu

SEQ ID NO: 255850 - RNA, 22 nt, Human
ugagucucugcacuaaggagag

SEQ ID NO: 255851 - RNA, 22 nt, Human
agucaguguucuggguuguaau

SEQ ID NO: 255852 - RNA, 22 nt, Human
gaggccuggugugucucccgcu

SEQ ID NO: 255853 - RNA, 19 nt, Human
aguguauuuuuuucuguag

SEQ ID NO: 255854 - RNA, 22 nt, Human
uacacaguagaguauaaugcgu

SEQ ID NO: 255855 - RNA, 21 nt, Human
cccaggucguggucuucccag

SEQ ID NO: 255856 - RNA, 22 nt, Human
acccucagcuucuuggauuaau

SEQ ID NO: 255857 - RNA, 22 nt, Human
aaucauaauuguauacauucau

SEQ ID NO: 255858 - RNA, 21 nt, Human
gccaccccuggcacaggugcu

SEQ ID NO: 255859 - RNA, 22 nt, Human
ccaggcuguuuucaaacuuggg

SEQ ID NO: 255860 - RNA, 22 nt, Human
gccccagcucugccacaacuag

SEQ ID NO: 255861 - RNA, 22 nt, Human
uuuuccucugcagagcaguuag

SEQ ID NO: 255862 - RNA, 22 nt, Human
ucccagggcacucacccucccu

SEQ ID NO: 255863 - RNA, 19 nt, Human
cacagcucugcucagggaa

SEQ ID NO: 255864 - RNA, 22 nt, Human
aggagcugcuuuggugcgguuu

SEQ ID NO: 255865 - RNA, 22 nt, Human
uuucacauaugguuguugauug

SEQ ID NO: 255866 - RNA, 22 nt, Human
ucaaacauaggcacacauucag

SEQ ID NO: 255867 - RNA, 22 nt, Human
uggcaaaggaaaugauuuaaga

SEQ ID NO: 255868 - RNA, 22 nt, Human
uggaagcuguggcauaacugag

SEQ ID NO: 255869 - RNA, 22 nt, Human
agcacauaccagaaccacaggu

SEQ ID NO: 255870 - RNA, 22 nt, Human
ugagucacagccuugccuuggu

SEQ ID NO: 255871 - RNA, 18 nt, Human
gcagggcugcacacgcau

SEQ ID NO: 255872 - RNA, 22 nt, Human
uccuccaaggcagggggagaga

SEQ ID NO: 255873 - RNA, 22 nt, Human
ucucuuuguggccaggagagga

SEQ ID NO: 255874 - RNA, 22 nt, Human
ggucucagacuggcaggcagug

SEQ ID NO: 255875 - RNA, 22 nt, Human
aggagggacaccaauauauguu

SEQ ID NO: 255876 - RNA, 22 nt, Human
uccaggccgcauaguuacucug

SEQ ID NO: 255877 - RNA, 23 nt, Human
auagaagauuauugcaacagucc

SEQ ID NO: 255878 - RNA, 18 nt, Human
uccuaacuuagauacucc

SEQ ID NO: 255879 - RNA, 22 nt, Human
cucuaggccauccagggccauu

SEQ ID NO: 255880 - RNA, 22 nt, Human
uucuuuuuaaaguguguaugca

SEQ ID NO: 255881 - RNA, 22 nt, Human
cuggaagggucagagugaugag

SEQ ID NO: 255882 - RNA, 20 nt, Human
aggcccugccagggacggag

SEQ ID NO: 255883 - RNA, 22 nt, Human
ggccaugccuggucuggcacca

SEQ ID NO: 255884 - RNA, 22 nt, Human
uugagaaauguuuuuuaagcug

SEQ ID NO: 255885 - RNA, 22 nt, Human
guuagaaacacauucuuauuga

SEQ ID NO: 255886 - RNA, 22 nt, Human
cuguuacuguauuuaaucaucu

SEQ ID NO: 255887 - RNA, 22 nt, Human
gggcucaggccuggccucucac

SEQ ID NO: 255888 - RNA, 22 nt, Human
cauugaaagagauaaagccuuu

SEQ ID NO: 255889 - RNA, 22 nt, Human
ucccucagucccuggacaggca

SEQ ID NO: 255890 - RNA, 22 nt, Human
acagaguggaguucaguaaaua

SEQ ID NO: 255891 - RNA, 22 nt, Human
ucagacaggcuggacagcuugc

SEQ ID NO: 255892 - RNA, 18 nt, Human
cccagaggaaugccugga

SEQ ID NO: 255893 - RNA, 22 nt, Human
auucuggacaaugagaaacugg

SEQ ID NO: 255894 - RNA, 22 nt, Human
uauaaaucuuuguuccuagaau

SEQ ID NO: 255895 - RNA, 22 nt, Human
guccugugucccagagaaagag

SEQ ID NO: 255896 - RNA, 22 nt, Human
agcccagccggauucccaguuc

SEQ ID NO: 255897 - RNA, 22 nt, Human
uauccaaaguggcauauuauag

SEQ ID NO: 255898 - RNA, 22 nt, Human
uccagaggcuccaaagggagau

SEQ ID NO: 255899 - RNA, 22 nt, Human
cuaguacaauuuuagcaagaug

SEQ ID NO: 255900 - RNA, 22 nt, Human
uaaaacugaauacauacugagg

SEQ ID NO: 255901 - RNA, 22 nt, Human
aaauguaguugaaaaguuaagg

SEQ ID NO: 255902 - RNA, 22 nt, Human
cugggcagugguggcaucuuug

SEQ ID NO: 255903 - RNA, 22 nt, Human
gacccauauaggacccuccaaa

SEQ ID NO: 255904 - RNA, 18 nt, Human
agccugggcucugccugg

SEQ ID NO: 255905 - RNA, 22 nt, Human
aguauguagugcaaucagucag

SEQ ID NO: 255906 - RNA, 22 nt, Human
cuuauagauggcgaucuucuug

SEQ ID NO: 255907 - RNA, 22 nt, Human
guggcaggagagacacagccau

SEQ ID NO: 255908 - RNA, 18 nt, Human
cucuagaaugggagauuu

SEQ ID NO: 255909 - RNA, 21 nt, Human
aauuagggugccucuuauaau

SEQ ID NO: 255910 - RNA, 22 nt, Human
gcagccucugaugauggccgua

SEQ ID NO: 255911 - RNA, 22 nt, Human
uccaggcagcccuuccugacuc

SEQ ID NO: 255912 - RNA, 22 nt, Human
guucaauuuagaaagcacaguu

SEQ ID NO: 255913 - RNA, 22 nt, Human
uggaggaaguggcuggccagaa

SEQ ID NO: 255914 - RNA, 22 nt, Human
uggagggcgcuuagauggaggg

SEQ ID NO: 255915 - RNA, 22 nt, Human
cugccuguuuccucuugcuccc

SEQ ID NO: 255916 - RNA, 22 nt, Human
acauuucuugaugccucuguga

SEQ ID NO: 255917 - RNA, 22 nt, Human
uagacuuuucaaaaucuagacc

SEQ ID NO: 255918 - RNA, 22 nt, Human
gggaccugggccagaggacagu

SEQ ID NO: 255919 - RNA, 22 nt, Human
aagugcuuaaaaggguggucua

SEQ ID NO: 255920 - RNA, 22 nt, Human
agugaaaaccuaaucaugcagu

SEQ ID NO: 255921 - RNA, 22 nt, Human
uaagguuuguggggagcaaaag

SEQ ID NO: 255922 - RNA, 22 nt, Human
cccaggagacauauagaaggac

SEQ ID NO: 255923 - RNA, 22 nt, Human
ggcugugggaugcauaggagcu

SEQ ID NO: 255924 - RNA, 22 nt, Human
cagguucucagaaggcagucac

SEQ ID NO: 255925 - RNA, 21 nt, Human
aaacagagcugaguaauagau

SEQ ID NO: 255926 - RNA, 22 nt, Human
aaucuucuacuugacaguucuc

SEQ ID NO: 255927 - RNA, 22 nt, Human
uaaaguguuuguaugcagauaa

SEQ ID NO: 255928 - RNA, 18 nt, Human
uggcagguccagcugugg

SEQ ID NO: 255929 - RNA, 22 nt, Human
auauacacaucuuuuuaaauau

SEQ ID NO: 255930 - RNA, 22 nt, Human
aggacacagugguggggaaaag

SEQ ID NO: 255931 - RNA, 22 nt, Human
gccugcuucacggacaggccuc

SEQ ID NO: 255932 - RNA, 22 nt, Human
ucaggagauguaaccuuagcug

SEQ ID NO: 255933 - RNA, 22 nt, Human
uuaaaaugaauauugauuagca

SEQ ID NO: 255934 - RNA, 22 nt, Human
uggcauugcuagugacccagca

SEQ ID NO: 255935 - RNA, 22 nt, Human
cuuggagucaauaagaucuaga

SEQ ID NO: 255936 - RNA, 22 nt, Human
caggcagaggaagucugggucu

SEQ ID NO: 255937 - RNA, 22 nt, Human
ugcaaaacuucucagagccuuu

SEQ ID NO: 255938 - RNA, 22 nt, Human
agucuugaaagcacauuagagu

SEQ ID NO: 255939 - RNA, 22 nt, Human
uaccauaacguaaugaacuuga

SEQ ID NO: 255940 - RNA, 22 nt, Human
uuucuaggucuuccauacugcc

SEQ ID NO: 255941 - RNA, 20 nt, Human
uacaauauucccacuuugcu

SEQ ID NO: 255942 - RNA, 22 nt, Human
auuccacuccaauaagugucaa

SEQ ID NO: 255943 - RNA, 22 nt, Human
agaggaauuucuggaaggaggc

SEQ ID NO: 255944 - RNA, 22 nt, Human
caggcugcguuugugaaaggua

SEQ ID NO: 255945 - RNA, 21 nt, Human
gccagcugcagggcuuccuug

SEQ ID NO: 255946 - RNA, 22 nt, Human
acucuggccaggugcgguaugu

SEQ ID NO: 255947 - RNA, 20 nt, Human
aacuuuagacauaaucucuu

SEQ ID NO: 255948 - RNA, 22 nt, Human
gcagcccaagccugagcauccu

SEQ ID NO: 255949 - RNA, 22 nt, Human
gcucugagcugucuugcagguc

SEQ ID NO: 255950 - RNA, 22 nt, Human
uauuccaguucaccuuuucauc

SEQ ID NO: 255951 - RNA, 22 nt, Human
ugcaaaagaauauagauauugu

SEQ ID NO: 255952 - RNA, 22 nt, Human
cagcauuuucuuaauguaggug

SEQ ID NO: 255953 - RNA, 21 nt, Human
caguuuaauaacaaagaagga

SEQ ID NO: 255954 - RNA, 22 nt, Human
augugcaacuuuucugucuuuu

SEQ ID NO: 255955 - RNA, 22 nt, Human
cucuucaaaagucuaauccuua

SEQ ID NO: 255956 - RNA, 22 nt, Human
gagaugaagaggcccuuggagu

SEQ ID NO: 255957 - RNA, 22 nt, Human
agcuacaagucaucagcuauca

SEQ ID NO: 255958 - RNA, 22 nt, Human
uauuuaaaaagaggccagcugg

SEQ ID NO: 255959 - RNA, 22 nt, Human
agagugcagaggucaaagaaca

SEQ ID NO: 255960 - RNA, 22 nt, Human
agacaggagagggaacugccgg

SEQ ID NO: 255961 - RNA, 22 nt, Human
uuugcucaguucucuguauuuu

SEQ ID NO: 255962 - RNA, 22 nt, Human
aaacucugaugcuuauugggaa

SEQ ID NO: 255963 - RNA, 22 nt, Human
agagccagauggagccgugugu

SEQ ID NO: 255964 - RNA, 22 nt, Human
uuccucaacaacuucccuacag

SEQ ID NO: 255965 - RNA, 22 nt, Human
uuuguucacugagcaaugauua

SEQ ID NO: 255966 - RNA, 22 nt, Human
auccaggcuuaaugggagccac

SEQ ID NO: 255967 - RNA, 20 nt, Human
uuucacaaugaacaugucuc

SEQ ID NO: 255968 - RNA, 22 nt, Human
uuuccucuuugugacacagcug

SEQ ID NO: 255969 - RNA, 22 nt, Human
cucugcaacuucuagcaguguc

SEQ ID NO: 255970 - RNA, 20 nt, Human
auuccucagccccagccuca

SEQ ID NO: 255971 - RNA, 23 nt, Human
aggcagcagguuguccaggguga

SEQ ID NO: 255972 - RNA, 22 nt, Human
uuuaucugagcugauagauagu

SEQ ID NO: 255973 - RNA, 22 nt, Human
aggaggccuguguuugucugua

SEQ ID NO: 255974 - RNA, 22 nt, Human
aaguaucucaaaaacaguaauc

SEQ ID NO: 255975 - RNA, 22 nt, Human
ugaggcagaaaauagcaguuca

SEQ ID NO: 255976 - RNA, 22 nt, Human
agcaccugucacaagcagaagg

SEQ ID NO: 255977 - RNA, 22 nt, Human
ucuagaauagauucugcugauc

SEQ ID NO: 255978 - RNA, 22 nt, Human
uauacauguuuuacauaaguga

SEQ ID NO: 255979 - RNA, 23 nt, Human
agacugaggcugccagggucaga

SEQ ID NO: 255980 - RNA, 18 nt, Human
acauuucuccuucugacc

SEQ ID NO: 255981 - RNA, 22 nt, Human
ucaaaugccagugguguggauc

SEQ ID NO: 255982 - RNA, 20 nt, Human
gaggagucuuguagaaaaug

SEQ ID NO: 255983 - RNA, 22 nt, Human
cagcuugaaauauuaggagaug

SEQ ID NO: 255984 - RNA, 22 nt, Human
uacuucuguucuuaaaccaaga

SEQ ID NO: 255985 - RNA, 22 nt, Human
ugcaugugcccacucuggcuua

SEQ ID NO: 255986 - RNA, 22 nt, Human
uguaaacauaccagagccaagu

SEQ ID NO: 255987 - RNA, 22 nt, Human
ugcuugucccucuuuaugaugg

SEQ ID NO: 255988 - RNA, 22 nt, Human
ggucagagccguuagcauucag

SEQ ID NO: 255989 - RNA, 22 nt, Human
auuucauagauuguaaaucccu

SEQ ID NO: 255990 - RNA, 22 nt, Human
uucaaagugcauguuccucaga

SEQ ID NO: 255991 - RNA, 22 nt, Human
guggggaguguucugugauugg

SEQ ID NO: 255992 - RNA, 17 nt, Human
ggcagcugccacuuuuu

SEQ ID NO: 255993 - RNA, 22 nt, Human
acugcuuuagaccuagagcucu

SEQ ID NO: 255994 - RNA, 22 nt, Human
aggcacagguggacuucacagu

SEQ ID NO: 255995 - RNA, 22 nt, Human
aaaugguagguuuucuuaagaa

SEQ ID NO: 255996 - RNA, 22 nt, Human
ugauguuuaauacuaugcuuuu

SEQ ID NO: 255997 - RNA, 22 nt, Human
aacaaucaaguuucuaaaugac

SEQ ID NO: 255998 - RNA, 22 nt, Human
cauggcggucaggauguaggug

SEQ ID NO: 255999 - RNA, 22 nt, Human
uuaguaaauaaagucuacuuuc

SEQ ID NO: 256000 - RNA, 22 nt, Human
uuagugcuaaauacucccacag

SEQ ID NO: 256001 - RNA, 22 nt, Human
uuggcccagcaugcgggucugu

SEQ ID NO: 256002 - RNA, 19 nt, Human
gcaggcacagcccugggug

SEQ ID NO: 256003 - RNA, 22 nt, Human
cuggccagguuuugaacaguug

SEQ ID NO: 256004 - RNA, 22 nt, Human
aagaguuaaaugaaugaguggg

SEQ ID NO: 256005 - RNA, 18 nt, Human
cuccuggcugauggugag

SEQ ID NO: 256006 - RNA, 22 nt, Human
ucagaacauuuaaaaagugguu

SEQ ID NO: 256007 - RNA, 22 nt, Human
ggaggugggcuaaggacucucu

SEQ ID NO: 256008 - RNA, 22 nt, Human
acacauuaaaacgucuacaaug

SEQ ID NO: 256009 - RNA, 22 nt, Human
cccagacauugcagggacuggu

SEQ ID NO: 256010 - RNA, 22 nt, Human
uucucagaugauucagauaaac

SEQ ID NO: 256011 - RNA, 22 nt, Human
uagcaaguaugauacuccauga

SEQ ID NO: 256012 - RNA, 22 nt, Human
uauuuccagcaguaagaagaca

SEQ ID NO: 256013 - RNA, 22 nt, Human
uguuuacauggagguuuucagc

SEQ ID NO: 256014 - RNA, 22 nt, Human
cagacaucuguacccagccugu

SEQ ID NO: 256015 - RNA, 22 nt, Human
agggggugaucaaggugcggcg

SEQ ID NO: 256016 - RNA, 22 nt, Human
gcagggcuaauggggcaaguag

SEQ ID NO: 256017 - RNA, 22 nt, Human
uuugcugauauuuugcugauac

SEQ ID NO: 256018 - RNA, 22 nt, Human
caggaggcagaggaugcccagu

SEQ ID NO: 256019 - RNA, 22 nt, Human
acacugucugggacucaggagu

SEQ ID NO: 256020 - RNA, 22 nt, Human
guguucauggaugucaauuuga

SEQ ID NO: 256021 - RNA, 22 nt, Human
gauuaaaaauaacccaugcuga

SEQ ID NO: 256022 - RNA, 22 nt, Human
acuugguggcgaacgaggguca

SEQ ID NO: 256023 - RNA, 22 nt, Human
augaugugugcugaucaagcuu

SEQ ID NO: 256024 - RNA, 22 nt, Human
auguguccacaggugugagaga

SEQ ID NO: 256025 - RNA, 22 nt, Human
uuuuauuaucuuugaaugggac

SEQ ID NO: 256026 - RNA, 23 nt, Human
gaaagucaauaugguagcuuuga

SEQ ID NO: 256027 - RNA, 22 nt, Human
gaacagaauuaccgaagaucug

SEQ ID NO: 256028 - RNA, 22 nt, Human
uguuauuuauuucaccuccaga

SEQ ID NO: 256029 - RNA, 20 nt, Human
cccuggacuccugagcaaac

SEQ ID NO: 256030 - RNA, 18 nt, Human
uccaggccugaagugucc

SEQ ID NO: 256031 - RNA, 22 nt, Human
guuuaaguuucagaagcuaaga

SEQ ID NO: 256032 - RNA, 22 nt, Human
aauguguagauguugcauuccu

SEQ ID NO: 256033 - RNA, 22 nt, Human
ccaggaagaaacagucuuuaua

SEQ ID NO: 256034 - RNA, 22 nt, Human
ugccugucagggggagugggaa

SEQ ID NO: 256035 - RNA, 22 nt, Human
uccuggccagaggacaaagcug

SEQ ID NO: 256036 - RNA, 22 nt, Human
cuaauaauagagguggcauuug

SEQ ID NO: 256037 - RNA, 22 nt, Human
augaggcagcacaugggauugu

SEQ ID NO: 256038 - RNA, 22 nt, Human
ugguaucguguuggcacucagu

SEQ ID NO: 256039 - RNA, 17 nt, Human
auuuccucagggcugag

SEQ ID NO: 256040 - RNA, 22 nt, Human
cugcacccucaaacuccugggc

SEQ ID NO: 256041 - RNA, 22 nt, Human
gguccagucuuucccuucuaga

SEQ ID NO: 256042 - RNA, 20 nt, Human
agguauaagaaaugugauuu

SEQ ID NO: 256043 - RNA, 22 nt, Human
aguaaugucccuuaaauguggu

SEQ ID NO: 256044 - RNA, 22 nt, Human
cagagcuggguuugggaaaccu

SEQ ID NO: 256045 - RNA, 22 nt, Human
gguggcaguggucucugacaga

SEQ ID NO: 256046 - RNA, 22 nt, Human
gggaccucuggagucggccuua

SEQ ID NO: 256047 - RNA, 23 nt, Human
gggggccguccuggggauuauag

SEQ ID NO: 256048 - RNA, 22 nt, Human
ugcuauuugggggcuacaugau

SEQ ID NO: 256049 - RNA, 22 nt, Human
ugggugugccauauuccauuuc

SEQ ID NO: 256050 - RNA, 22 nt, Human
auuuguuccacacauauuuacu

SEQ ID NO: 256051 - RNA, 19 nt, Human
ucuguucacauuguuucgc

SEQ ID NO: 256052 - RNA, 22 nt, Human
ucaagaauuuggauaagaaaug

SEQ ID NO: 256053 - RNA, 22 nt, Human
uagcuucucauaauuuaugcug

SEQ ID NO: 256054 - RNA, 22 nt, Human
aaagcagaggugauaugacuua

SEQ ID NO: 256055 - RNA, 17 nt, Human
ccagggaggggccgcgc

SEQ ID NO: 256056 - RNA, 22 nt, Human
aacauucuacuguacugcauug

SEQ ID NO: 256057 - RNA, 22 nt, Human
uucuauguguugacaagccuga

SEQ ID NO: 256058 - RNA, 22 nt, Human
aagaauguucauuaaacuguug

SEQ ID NO: 256059 - RNA, 22 nt, Human
gagugaggcuggaaucauggcu

SEQ ID NO: 256060 - RNA, 22 nt, Human
ucagcuuuccugcagcuaaggg

SEQ ID NO: 256061 - RNA, 22 nt, Human
aaggaacugcugauguggugac

SEQ ID NO: 256062 - RNA, 23 nt, Human
ucuagaaaaugaaagaaugcagu

SEQ ID NO: 256063 - RNA, 22 nt, Human
auuuaugacuggugaauagaac

SEQ ID NO: 256064 - RNA, 22 nt, Human
gcaggucuguugauuacaguca

SEQ ID NO: 256065 - RNA, 22 nt, Human
uagcccagaugauugaaccaug

SEQ ID NO: 256066 - RNA, 22 nt, Human
acagcaugucuaguuaaauacu

SEQ ID NO: 256067 - RNA, 22 nt, Human
caaagguaaagaucugcugugg

SEQ ID NO: 256068 - RNA, 22 nt, Human
ggagcugggguuggcaucuucc

SEQ ID NO: 256069 - RNA, 22 nt, Human
auacauguucguguacauguuc

SEQ ID NO: 256070 - RNA, 22 nt, Human
cugugggcgccugucagccuca

SEQ ID NO: 256071 - RNA, 22 nt, Human
aacauguagcagaaacgacuaa

SEQ ID NO: 256072 - RNA, 22 nt, Human
ccagccagaugauaagcucuau

SEQ ID NO: 256073 - RNA, 22 nt, Human
ucagauagugauaauagcaugu

SEQ ID NO: 256074 - RNA, 22 nt, Human
uagauaauuuggcaucauauug

SEQ ID NO: 256075 - RNA, 22 nt, Human
guccugugugagugcaccaccu

SEQ ID NO: 256076 - RNA, 22 nt, Human
gcugaaaggggugacauucuuu

SEQ ID NO: 256077 - RNA, 22 nt, Human
accauucugucucuuuacaaau

SEQ ID NO: 256078 - RNA, 22 nt, Human
cucaaguaagaaacagaauugg

SEQ ID NO: 256079 - RNA, 22 nt, Human
gagcaagacccuggguucucuc

SEQ ID NO: 256080 - RNA, 22 nt, Human
gccugggagaaugaccuccaac

SEQ ID NO: 256081 - RNA, 17 nt, Human
gccuggcccagccuggc

SEQ ID NO: 256082 - RNA, 22 nt, Human
ucugagagcaaggcauuagcag

SEQ ID NO: 256083 - RNA, 22 nt, Human
uuacaugcagagggaagggaga

SEQ ID NO: 256084 - RNA, 18 nt, Human
gugggguguugugaggau

SEQ ID NO: 256085 - RNA, 22 nt, Human
uaauuauucuagucacauagca

SEQ ID NO: 256086 - RNA, 20 nt, Human
ucaaaauaggugugggcgga

SEQ ID NO: 256087 - RNA, 22 nt, Human
gcugcgccggaucccacguucc

SEQ ID NO: 256088 - RNA, 22 nt, Human
caggcucccugcaggccaguga

SEQ ID NO: 256089 - RNA, 22 nt, Human
cuaaugaagcugcuuucuauga

SEQ ID NO: 256090 - RNA, 22 nt, Human
cagcaguuuccuaugguucagc

SEQ ID NO: 256091 - RNA, 22 nt, Human
uuccaguuaaggaagcuauucu

SEQ ID NO: 256092 - RNA, 22 nt, Human
cccaggcaucccauuaaggagc

SEQ ID NO: 256093 - RNA, 18 nt, Human
ugagcaggggcugaccuu

SEQ ID NO: 256094 - RNA, 22 nt, Human
cccagugugguucuuuggagaa

SEQ ID NO: 256095 - RNA, 22 nt, Human
acagcauggauaacaaggcacu

SEQ ID NO: 256096 - RNA, 22 nt, Human
uuuagacagcaucuggugacuu

SEQ ID NO: 256097 - RNA, 22 nt, Human
gcugccuagucugcugagcaga

SEQ ID NO: 256098 - RNA, 22 nt, Human
ggagcugagacccaguggcuga

SEQ ID NO: 256099 - RNA, 22 nt, Human
aauguauaaaguguuaauaacu

SEQ ID NO: 256100 - RNA, 22 nt, Human
aggguccuucuguuccugagca

SEQ ID NO: 256101 - RNA, 22 nt, Human
agaggcacuguucuuagcgacu

SEQ ID NO: 256102 - RNA, 22 nt, Human
aaggcauaugcuguguacaguu

SEQ ID NO: 256103 - RNA, 22 nt, Human
auuuggaagaaaucugucacag

SEQ ID NO: 256104 - RNA, 22 nt, Human
ucugcccugcagggagcaguaa

SEQ ID NO: 256105 - RNA, 22 nt, Human
ugagcugcauuacagccucugu

SEQ ID NO: 256106 - RNA, 22 nt, Human
auuccagauggcuucaaguaag

SEQ ID NO: 256107 - RNA, 22 nt, Human
cauguucagugacaguuauuga

SEQ ID NO: 256108 - RNA, 22 nt, Human
agggcagcagcuccuccuagcu

SEQ ID NO: 256109 - RNA, 22 nt, Human
gagcaagauuuuauaaguugug

SEQ ID NO: 256110 - RNA, 22 nt, Human
ugcagggaaucuguggcuggac

SEQ ID NO: 256111 - RNA, 22 nt, Human
uuuagcaaguucucugagagaa

SEQ ID NO: 256112 - RNA, 22 nt, Human
ugcagggcacggugcgcguggg

SEQ ID NO: 256113 - RNA, 22 nt, Human
gcagguggauuaucagaagugc

SEQ ID NO: 256114 - RNA, 22 nt, Human
cucucagggucccugcggagga

SEQ ID NO: 256115 - RNA, 22 nt, Human
auuccacaggacuaccaaugug

SEQ ID NO: 256116 - RNA, 22 nt, Human
agccuuagauaaaugcuagcuc

SEQ ID NO: 256117 - RNA, 20 nt, Human
cugcugugugugccucagcc

SEQ ID NO: 256118 - RNA, 22 nt, Human
uguggcugccacccugaagccg

SEQ ID NO: 256119 - RNA, 22 nt, Human
acucuguacucuagaggaagug

SEQ ID NO: 256120 - RNA, 22 nt, Human
gaaaguuucuucauuaagaugu

SEQ ID NO: 256121 - RNA, 22 nt, Human
aaagaucagucugaagcaacau

SEQ ID NO: 256122 - RNA, 22 nt, Human
uccuggcugccgucguccugcg

SEQ ID NO: 256123 - RNA, 22 nt, Human
uaugugcaguuugcucuuaaca

SEQ ID NO: 256124 - RNA, 22 nt, Human
aaaucccaaugcuagacccggu

SEQ ID NO: 256125 - RNA, 22 nt, Human
ccaggucuggaaccaccagggc

SEQ ID NO: 256126 - RNA, 22 nt, Human
uggcucaguggcagccgcagcu

SEQ ID NO: 256127 - RNA, 22 nt, Human
auguucuuccaaaucuguaaca

SEQ ID NO: 256128 - RNA, 22 nt, Human
gaugcacaugugaguauagaag

SEQ ID NO: 256129 - RNA, 22 nt, Human
agucagagcaaacuggacagac

SEQ ID NO: 256130 - RNA, 22 nt, Human
gaggcugcuuugaugacaggag

SEQ ID NO: 256131 - RNA, 22 nt, Human
ucaggcaggcagagggcaaaug

SEQ ID NO: 256132 - RNA, 18 nt, Human
aaaaagugcucaggccua

SEQ ID NO: 256133 - RNA, 22 nt, Human
gccagccacuucagcuauggcu

SEQ ID NO: 256134 - RNA, 20 nt, Human
cuggacuugcugcucaccug

SEQ ID NO: 256135 - RNA, 22 nt, Human
uagccaugagcagaucacuaua

SEQ ID NO: 256136 - RNA, 20 nt, Human
aacaaacuacaaaauuaugu

SEQ ID NO: 256137 - RNA, 22 nt, Human
gcugcccuccaguucccacagu

SEQ ID NO: 256138 - RNA, 22 nt, Human
ucucucugagcccugcuuuuuc

SEQ ID NO: 256139 - RNA, 22 nt, Human
uuucagugcuucuguuuaccgg

SEQ ID NO: 256140 - RNA, 22 nt, Human
gcugagcacagccuguguccuc

SEQ ID NO: 256141 - RNA, 22 nt, Human
guucacuguacuggugaugguu

SEQ ID NO: 256142 - RNA, 22 nt, Human
augcuauacauaugacaucaca

SEQ ID NO: 256143 - RNA, 22 nt, Human
cuacagagaacucagcugcccu

SEQ ID NO: 256144 - RNA, 22 nt, Human
uuucacauaaauggaguaaaga

SEQ ID NO: 256145 - RNA, 22 nt, Human
ucucuuggacauguggcucugc

SEQ ID NO: 256146 - RNA, 22 nt, Human
cuguuaaaagcacugccauccu

SEQ ID NO: 256147 - RNA, 22 nt, Human
uuucagaaccaagagagacauc

SEQ ID NO: 256148 - RNA, 22 nt, Human
gagcuuggaagcagauccucac

SEQ ID NO: 256149 - RNA, 22 nt, Human
auuugaaguaaguaaugaguau

SEQ ID NO: 256150 - RNA, 22 nt, Human
uuuggaaagugugauuucaagg

SEQ ID NO: 256151 - RNA, 22 nt, Human
uuuguucacugauguaucccaa

SEQ ID NO: 256152 - RNA, 22 nt, Human
gguucacacuaagcuuaagugg

SEQ ID NO: 256153 - RNA, 22 nt, Human
aaguuugacagaaguuucuaau

SEQ ID NO: 256154 - RNA, 23 nt, Human
uagaaucuguauuucugcaguuc

SEQ ID NO: 256155 - RNA, 22 nt, Human
ugguucagauauggagcuggga

SEQ ID NO: 256156 - RNA, 22 nt, Human
ugugucuuacauaauuacaugu

SEQ ID NO: 256157 - RNA, 22 nt, Human
ccucuccagcggccucagggcc

SEQ ID NO: 256158 - RNA, 22 nt, Human
uaagcauuaugguaaagaagua

SEQ ID NO: 256159 - RNA, 22 nt, Human
uguguccucagggaagcagaga

SEQ ID NO: 256160 - RNA, 22 nt, Human
gccuccuccuucccgagggucu

SEQ ID NO: 256161 - RNA, 22 nt, Human
cuguguccuccccaucacuucu

SEQ ID NO: 256162 - RNA, 22 nt, Human
gcgugugugauaugccucugca

SEQ ID NO: 256163 - RNA, 22 nt, Human
ccugccagcccgcguucaugcc

SEQ ID NO: 256164 - RNA, 22 nt, Human
gcagggcucugcuguaguccua

SEQ ID NO: 256165 - RNA, 22 nt, Human
acaucuagaagaucugggagau

SEQ ID NO: 256166 - RNA, 22 nt, Human
acacauuugcuaaaaugagcuc

SEQ ID NO: 256167 - RNA, 22 nt, Human
guccagcuccagggaggcaggc

SEQ ID NO: 256168 - RNA, 22 nt, Human
ucuggcagaucuucccacguuu

SEQ ID NO: 256169 - RNA, 22 nt, Human
uuuuacauugggaaaugccucu

SEQ ID NO: 256170 - RNA, 22 nt, Human
ccucuguaguaagagaacauau

SEQ ID NO: 256171 - RNA, 22 nt, Human
augaggcagcugcuggagaacg

SEQ ID NO: 256172 - RNA, 22 nt, Human
uggcacugaaaaaggagagguu

SEQ ID NO: 256173 - RNA, 22 nt, Human
agaccucaauaccaggcaccac

SEQ ID NO: 256174 - RNA, 22 nt, Human
agcccugagcuggccugggcuu

SEQ ID NO: 256175 - RNA, 22 nt, Human
uagcacaaguaucugcuuuucc

SEQ ID NO: 256176 - RNA, 22 nt, Human
aucuuuaggaaccuaaccuauu

SEQ ID NO: 256177 - RNA, 22 nt, Human
ggacagagcccugguggccuaa

SEQ ID NO: 256178 - RNA, 22 nt, Human
gcucugggguuggaaagugauc

SEQ ID NO: 256179 - RNA, 22 nt, Human
cuggcugcgucugcucugacag

SEQ ID NO: 256180 - RNA, 22 nt, Human
cuccuggcucucuguuuagugu

SEQ ID NO: 256181 - RNA, 22 nt, Human
ggcuuuauuauguggccaugug

SEQ ID NO: 256182 - RNA, 22 nt, Human
agacaaagacagcaucucaggu

SEQ ID NO: 256183 - RNA, 22 nt, Human
agcuucuuuaauucagcaugau

SEQ ID NO: 256184 - RNA, 22 nt, Human
aagaaacugaaaguggcuucau

SEQ ID NO: 256185 - RNA, 22 nt, Human
agcccugcaggaggugggagag

SEQ ID NO: 256186 - RNA, 22 nt, Human
caacagaaaucaauuuucccau

SEQ ID NO: 256187 - RNA, 22 nt, Human
uccugccuaccuugcggaggug

SEQ ID NO: 256188 - RNA, 22 nt, Human
guuacacagcuaagcuucuccu

SEQ ID NO: 256189 - RNA, 22 nt, Human
ccaggagcuggagggugcagug

SEQ ID NO: 256190 - RNA, 22 nt, Human
cagccaggccuggugaccaaag

SEQ ID NO: 256191 - RNA, 22 nt, Human
ucuggagaacuugcaagaggau

SEQ ID NO: 256192 - RNA, 22 nt, Human
augaagauacaggcagggccau

SEQ ID NO: 256193 - RNA, 20 nt, Human
cuggggagcugcucccacga

SEQ ID NO: 256194 - RNA, 22 nt, Human
uggugggaguccgcugugcugc

SEQ ID NO: 256195 - RNA, 23 nt, Human
uaggccagggugaccuggggaga

SEQ ID NO: 256196 - RNA, 22 nt, Human
cugaggcaggauggccuggcug

SEQ ID NO: 256197 - RNA, 22 nt, Human
uggcaaaguuuaucaggaauau

SEQ ID NO: 256198 - RNA, 22 nt, Human
ucuguguauuugugaccuguau

SEQ ID NO: 256199 - RNA, 22 nt, Human
uaggcccaguuccgccucccgg

SEQ ID NO: 256200 - RNA, 22 nt, Human
ccccaggagauuugggagcaca

SEQ ID NO: 256201 - RNA, 22 nt, Human
auauuguacuaggguuacaugu

SEQ ID NO: 256202 - RNA, 22 nt, Human
gggcuacugagcuggaacuggg

SEQ ID NO: 256203 - RNA, 22 nt, Human
uugcaggggagaggaacaaaca

SEQ ID NO: 256204 - RNA, 22 nt, Human
uuucuaguucuaccacaguaau

SEQ ID NO: 256205 - RNA, 22 nt, Human
aagccuuaaauguuucuaauau

SEQ ID NO: 256206 - RNA, 22 nt, Human
uggcucccacaaacucacuacu

SEQ ID NO: 256207 - RNA, 19 nt, Human
ugcagggcugcgccugggg

SEQ ID NO: 256208 - RNA, 22 nt, Human
cacacaucaaccuagacauugu

SEQ ID NO: 256209 - RNA, 22 nt, Human
aauggccagcaacaggagugaa

SEQ ID NO: 256210 - RNA, 22 nt, Human
agcuguggcaaccuugucagac

SEQ ID NO: 256211 - RNA, 22 nt, Human
ucagagcaacuuuuccugcuuu

SEQ ID NO: 256212 - RNA, 22 nt, Human
guauacaauacacaaugcucug

SEQ ID NO: 256213 - RNA, 22 nt, Human
guacagggccccucagcagggc

SEQ ID NO: 256214 - RNA, 21 nt, Human
ucugagagcaacugcccuuua

SEQ ID NO: 256215 - RNA, 22 nt, Human
guccuuauuucacuuaaacgua

SEQ ID NO: 256216 - RNA, 22 nt, Human
gggaggaaaugugcagcgaauu

SEQ ID NO: 256217 - RNA, 22 nt, Human
agauucauuauuaaugugaucu

SEQ ID NO: 256218 - RNA, 22 nt, Human
uggugggacaucugaggagagg

SEQ ID NO: 256219 - RNA, 22 nt, Human
auggaacagacagcugagacaa

SEQ ID NO: 256220 - RNA, 22 nt, Human
ucuguaguagguuguaguucuu

SEQ ID NO: 256221 - RNA, 22 nt, Human
uugauucagaaaaagauggaga

SEQ ID NO: 256222 - RNA, 22 nt, Human
caguaucuugcuuauagacaca

SEQ ID NO: 256223 - RNA, 22 nt, Human
uuuauucauuguuucgucgcag

SEQ ID NO: 256224 - RNA, 22 nt, Human
gcagggcuggguccugucucau

SEQ ID NO: 256225 - RNA, 22 nt, Human
gagagcugggcuuugggugaag

SEQ ID NO: 256226 - RNA, 22 nt, Human
gcaggcugaugacuggaguugg

SEQ ID NO: 256227 - RNA, 22 nt, Human
caaggcaggucugaggagguug

SEQ ID NO: 256228 - RNA, 22 nt, Human
uccaggacagaguagaagcagc

SEQ ID NO: 256229 - RNA, 20 nt, Human
agauggcugucauuucuguc

SEQ ID NO: 256230 - RNA, 22 nt, Human
uagcauuccuuguggcuucuga

SEQ ID NO: 256231 - RNA, 22 nt, Human
auguuucaccagcaaauuaccu

SEQ ID NO: 256232 - RNA, 22 nt, Human
aagccggcugggccgaggcugc

SEQ ID NO: 256233 - RNA, 22 nt, Human
aucagagcugcauuuuagagcc

SEQ ID NO: 256234 - RNA, 22 nt, Human
acugaaggcuuaacucuuucau

SEQ ID NO: 256235 - RNA, 22 nt, Human
aguuccugaacuucuuaaugac

SEQ ID NO: 256236 - RNA, 22 nt, Human
aggcucugcagaccccagcugu

SEQ ID NO: 256237 - RNA, 22 nt, Human
cugaagcaaaugaaacagcucu

SEQ ID NO: 256238 - RNA, 22 nt, Human
uauggaaagggaguuuaauuug

SEQ ID NO: 256239 - RNA, 22 nt, Human
aggccacacaacucuuagagau

SEQ ID NO: 256240 - RNA, 22 nt, Human
uacauaauugucuuuguccuca

SEQ ID NO: 256241 - RNA, 22 nt, Human
ggcaagcucaggccucaggugu

SEQ ID NO: 256242 - RNA, 22 nt, Human
ugucugguggguugacaggcag

SEQ ID NO: 256243 - RNA, 22 nt, Human
auacuguuggcuuuggugaugg

SEQ ID NO: 256244 - RNA, 22 nt, Human
aggcagcugcccucuccuuccu

SEQ ID NO: 256245 - RNA, 22 nt, Human
aggaaagaaguacauucucaug

SEQ ID NO: 256246 - RNA, 22 nt, Human
uugugaauagugcugcaauaaa

SEQ ID NO: 256247 - RNA, 22 nt, Human
ccuucugcucccuggccagggc

SEQ ID NO: 256248 - RNA, 22 nt, Human
gccaggcagauaugugagcuua

SEQ ID NO: 256249 - RNA, 22 nt, Human
uguccagugauucucaugagcc

SEQ ID NO: 256250 - RNA, 22 nt, Human
cucugggcuuccuuuguggguu

SEQ ID NO: 256251 - RNA, 22 nt, Human
cugcggcucugcgggcagcugg

SEQ ID NO: 256252 - RNA, 19 nt, Human
cacuucaauccuuuaucaa

SEQ ID NO: 256253 - RNA, 22 nt, Human
gacuuuaucuuguccuuccugc

SEQ ID NO: 256254 - RNA, 22 nt, Human
gacagguguguguauauuaggg

SEQ ID NO: 256255 - RNA, 20 nt, Human
aucaaaggcugauucagucc

SEQ ID NO: 256256 - RNA, 22 nt, Human
aaagagcaagggcuuugaggcu

SEQ ID NO: 256257 - RNA, 22 nt, Human
acaguacaccacuguguacagu

SEQ ID NO: 256258 - RNA, 22 nt, Human
acugucaaaagagauuauauua

SEQ ID NO: 256259 - RNA, 22 nt, Human
ucuuuaaugugauuguaauuau

SEQ ID NO: 256260 - RNA, 22 nt, Human
cuguagguuugcucugaccugg

SEQ ID NO: 256261 - RNA, 22 nt, Human
cccacagguccccaugaacucg

SEQ ID NO: 256262 - RNA, 22 nt, Human
cagggacccgcacagguagcau

SEQ ID NO: 256263 - RNA, 22 nt, Human
gugcccugaugcaauugucuca

SEQ ID NO: 256264 - RNA, 22 nt, Human
aucagcaagauguaauuucuau

SEQ ID NO: 256265 - RNA, 22 nt, Human
gggcugagccauuugaaccuug

SEQ ID NO: 256266 - RNA, 22 nt, Human
gacacuccagcuuuuggcucaa

SEQ ID NO: 256267 - RNA, 22 nt, Human
aaagguuuucaucacagcaaga

SEQ ID NO: 256268 - RNA, 22 nt, Human
uucuguauuuaguuugaggaca

SEQ ID NO: 256269 - RNA, 22 nt, Human
agucuucuuucauuuacucagu

SEQ ID NO: 256270 - RNA, 22 nt, Human
auugauucucauaggaccaucu

SEQ ID NO: 256271 - RNA, 22 nt, Human
uucuuacaaguauuccaggucc

SEQ ID NO: 256272 - RNA, 18 nt, Human
ugcccagaaaagcaggga

SEQ ID NO: 256273 - RNA, 22 nt, Human
ucucagugaagaguauaacaaa

SEQ ID NO: 256274 - RNA, 22 nt, Human
ggcucuugggagcucagaguug

SEQ ID NO: 256275 - RNA, 22 nt, Human
guccuugcuugagacaggcagu

SEQ ID NO: 256276 - RNA, 22 nt, Human
uucugacaauucaguaacagca

SEQ ID NO: 256277 - RNA, 22 nt, Human
cuguauaaacauauuuucaagu

SEQ ID NO: 256278 - RNA, 22 nt, Human
gagcuccagaguuagacacccg

SEQ ID NO: 256279 - RNA, 21 nt, Human
ccagagagagggaaguggguu

SEQ ID NO: 256280 - RNA, 22 nt, Human
gaugcuggccuggccaucuggg

SEQ ID NO: 256281 - RNA, 22 nt, Human
aaacuguaagagaauaaacuac

SEQ ID NO: 256282 - RNA, 22 nt, Human
guuuuauaguucgggaccuguu

SEQ ID NO: 256283 - RNA, 22 nt, Human
aauggcaagcugaacucagaag

SEQ ID NO: 256284 - RNA, 20 nt, Human
ugagccagucaagcuacauu

SEQ ID NO: 256285 - RNA, 22 nt, Human
gucugcccuuggcucagccaua

SEQ ID NO: 256286 - RNA, 22 nt, Human
uggcacagacagaucaggaguc

SEQ ID NO: 256287 - RNA, 22 nt, Human
gcuuaguccccaagagagacca

SEQ ID NO: 256288 - RNA, 22 nt, Human
acaguauuugcgauacugauga

SEQ ID NO: 256289 - RNA, 22 nt, Human
ccuggagaggcgcugcagagga

SEQ ID NO: 256290 - RNA, 22 nt, Human
gaugaugggauccagcaaugua

SEQ ID NO: 256291 - RNA, 22 nt, Human
ucugaacagaaaagaugcacaa

SEQ ID NO: 256292 - RNA, 22 nt, Human
gaagaggcaauugaauaagcua

SEQ ID NO: 256293 - RNA, 21 nt, Human
acuuuaauauacaugaggagg

SEQ ID NO: 256294 - RNA, 22 nt, Human
cauucacaaaaccacaugccau

SEQ ID NO: 256295 - RNA, 22 nt, Human
ggggcucaguucggacagccug

SEQ ID NO: 256296 - RNA, 22 nt, Human
ugcauggacucaucagacaaga

SEQ ID NO: 256297 - RNA, 23 nt, Human
aggcagguuugggcucuucuugu

SEQ ID NO: 256298 - RNA, 22 nt, Human
gaagccaggggccugacaggca

SEQ ID NO: 256299 - RNA, 22 nt, Human
agcuccaggauaagacaggugc

SEQ ID NO: 256300 - RNA, 22 nt, Human
cagaagcugcagugaucuggga

SEQ ID NO: 256301 - RNA, 22 nt, Human
aaaugcacagaggccagagagg

SEQ ID NO: 256302 - RNA, 22 nt, Human
auuuguuucagggccuugguau

SEQ ID NO: 256303 - RNA, 22 nt, Human
aaaugcugaguguuuagagauc

SEQ ID NO: 256304 - RNA, 22 nt, Human
ugaggaugagaugagauaacac

SEQ ID NO: 256305 - RNA, 22 nt, Human
ugucugugacagaccuuugcua

SEQ ID NO: 256306 - RNA, 22 nt, Human
gggcuucuagaccagcagugag

SEQ ID NO: 256307 - RNA, 22 nt, Human
ucucuggguucucacucagcac

SEQ ID NO: 256308 - RNA, 22 nt, Human
caacuaauauagggcaugagaa

SEQ ID NO: 256309 - RNA, 22 nt, Human
cugggagagacacuucugauua

SEQ ID NO: 256310 - RNA, 22 nt, Human
aaacaucaauugcaucucccaa

SEQ ID NO: 256311 - RNA, 22 nt, Human
caugauaacuucauuacacaau

SEQ ID NO: 256312 - RNA, 22 nt, Human
gguggggcuaggaccucaggau

SEQ ID NO: 256313 - RNA, 22 nt, Human
ggccagggccaaggcuuuccca

SEQ ID NO: 256314 - RNA, 22 nt, Human
uccugggauuaagguggugauu

SEQ ID NO: 256315 - RNA, 22 nt, Human
acauuuccuaacguauacacug

SEQ ID NO: 256316 - RNA, 22 nt, Human
acucuucauucaaguaugcaaa

SEQ ID NO: 256317 - RNA, 22 nt, Human
aagacaucagugaugacauuug

SEQ ID NO: 256318 - RNA, 22 nt, Human
uucuuuuaauguucugaaguuu

SEQ ID NO: 256319 - RNA, 22 nt, Human
agcggcugcuccgcaggcuggc

SEQ ID NO: 256320 - RNA, 19 nt, Human
aggcagcaggccagggaug

SEQ ID NO: 256321 - RNA, 22 nt, Human
aaaugauggaaaugaggcugaa

SEQ ID NO: 256322 - RNA, 22 nt, Human
ggccuugcagccacagaacaca

SEQ ID NO: 256323 - RNA, 22 nt, Human
uacacaucaaccuggcuuuggc

SEQ ID NO: 256324 - RNA, 22 nt, Human
uggagaugggaaaaaggaggua

SEQ ID NO: 256325 - RNA, 22 nt, Human
cuguagcaaguuauucaauaaa

SEQ ID NO: 256326 - RNA, 22 nt, Human
acaguuuacuggccuugccguu

SEQ ID NO: 256327 - RNA, 22 nt, Human
gacuggccuggagaugcagcug

SEQ ID NO: 256328 - RNA, 22 nt, Human
uguacaguggaaaauggauucg

SEQ ID NO: 256329 - RNA, 18 nt, Human
gucuuuggaguggaggua

SEQ ID NO: 256330 - RNA, 22 nt, Human
aaucuucuuucuuaacaguaca

SEQ ID NO: 256331 - RNA, 23 nt, Human
uucuggauguucuagucugagag

SEQ ID NO: 256332 - RNA, 22 nt, Human
agcugguugucauucagaauug

SEQ ID NO: 256333 - RNA, 22 nt, Human
uuacauguuuacggauacacuu

SEQ ID NO: 256334 - RNA, 19 nt, Human
aagcugagggcuguccacc

SEQ ID NO: 256335 - RNA, 22 nt, Human
acugcagguggauggcacuuua

SEQ ID NO: 256336 - RNA, 22 nt, Human
cagcuacagucugauugguuca

SEQ ID NO: 256337 - RNA, 23 nt, Human
ccagggaaggccaucuucaacug

SEQ ID NO: 256338 - RNA, 22 nt, Human
gaggcugggaaguccaauauca

SEQ ID NO: 256339 - RNA, 22 nt, Human
uucuagaaggcaggcugggcca

SEQ ID NO: 256340 - RNA, 22 nt, Human
caggcucagcucuggccagugc

SEQ ID NO: 256341 - RNA, 22 nt, Human
cuguccugaguucuuggagguc

SEQ ID NO: 256342 - RNA, 22 nt, Human
uaacacugguauuucauuuagu

SEQ ID NO: 256343 - RNA, 19 nt, Human
uggcugagcuggacugagg

SEQ ID NO: 256344 - RNA, 22 nt, Human
agcccaaaccugcgagcagagc

SEQ ID NO: 256345 - RNA, 22 nt, Human
uugcugauucuguauuuaaggu

SEQ ID NO: 256346 - RNA, 22 nt, Human
cucagcacugacccaggagaug

SEQ ID NO: 256347 - RNA, 22 nt, Human
ugaucuagguuggcuucaacug

SEQ ID NO: 256348 - RNA, 22 nt, Human
ugaggcuuagauuugguaacuc

SEQ ID NO: 256349 - RNA, 22 nt, Human
gcuggccuccugcuagauggaa

SEQ ID NO: 256350 - RNA, 22 nt, Human
agcaagcagugaaguugaaugu

SEQ ID NO: 256351 - RNA, 22 nt, Human
uaaaggcuucggagugcacacu

SEQ ID NO: 256352 - RNA, 22 nt, Human
ugcccugccaagaccaaguggu

SEQ ID NO: 256353 - RNA, 22 nt, Human
acagaguauuggaaaggcagug

SEQ ID NO: 256354 - RNA, 22 nt, Human
caggcuggagugcagugucgcc

SEQ ID NO: 256355 - RNA, 22 nt, Human
ugcagggccgcuggaggucaug

SEQ ID NO: 256356 - RNA, 22 nt, Human
cacagacagugucccuuuguug

SEQ ID NO: 256357 - RNA, 22 nt, Human
cauuguuaccaucuuuuaccua

SEQ ID NO: 256358 - RNA, 22 nt, Human
gguggcacacuggggagcucgg

SEQ ID NO: 256359 - RNA, 22 nt, Human
cuucuuuccuuccuccaguggc

SEQ ID NO: 256360 - RNA, 22 nt, Human
aauagcuuauugacagugaauu

SEQ ID NO: 256361 - RNA, 22 nt, Human
caagagcuagacuuugucagga

SEQ ID NO: 256362 - RNA, 22 nt, Human
ggcuggguacagggcagugugc

SEQ ID NO: 256363 - RNA, 22 nt, Human
guaacacuagcucugucacuuu

SEQ ID NO: 256364 - RNA, 20 nt, Human
ucagagucaucaaagauggu

SEQ ID NO: 256365 - RNA, 22 nt, Human
ugaaagauugugauucaauaug

SEQ ID NO: 256366 - RNA, 22 nt, Human
caguuauaggagccauuguaua

SEQ ID NO: 256367 - RNA, 22 nt, Human
aagugcauaguaauggagucaa

SEQ ID NO: 256368 - RNA, 22 nt, Human
cauuuaaucuggcucaugagca

SEQ ID NO: 256369 - RNA, 22 nt, Human
aucaaugcucuguacccagaau

SEQ ID NO: 256370 - RNA, 22 nt, Human
auaaagacaugcuuacuugccc

SEQ ID NO: 256371 - RNA, 22 nt, Human
cagcccuugaugauaauuuauc

SEQ ID NO: 256372 - RNA, 22 nt, Human
gcagagcagcaaauggaaagga

SEQ ID NO: 256373 - RNA, 22 nt, Human
auugaaaauaaggccagaaaca

SEQ ID NO: 256374 - RNA, 22 nt, Human
acacagagggcagaagauacau

SEQ ID NO: 256375 - RNA, 22 nt, Human
auuguucauuguacaccuagua

SEQ ID NO: 256376 - RNA, 22 nt, Human
agccuugaucuugguaacagga

SEQ ID NO: 256377 - RNA, 22 nt, Human
ccagugccuauccuucuccugu

SEQ ID NO: 256378 - RNA, 22 nt, Human
acuuggccuuauuuccacagaa

SEQ ID NO: 256379 - RNA, 22 nt, Human
uacaggugcucuacagacagga

SEQ ID NO: 256380 - RNA, 22 nt, Human
acagcuggaggggcugcagagg

SEQ ID NO: 256381 - RNA, 22 nt, Human
aagugcaauuugaaauucugca

SEQ ID NO: 256382 - RNA, 22 nt, Human
uacaaacuguccagcccagagg

SEQ ID NO: 256383 - RNA, 22 nt, Human
uacagaaaaacaucuggagccg

SEQ ID NO: 256384 - RNA, 22 nt, Human
caggcugcagcagcaguggccc

SEQ ID NO: 256385 - RNA, 22 nt, Human
cacagaacaccaaagaaccuuc

SEQ ID NO: 256386 - RNA, 22 nt, Human
uaaagccacgcuggaaaucagg

SEQ ID NO: 256387 - RNA, 22 nt, Human
cacaggcugcccgcagcuggga

SEQ ID NO: 256388 - RNA, 22 nt, Human
caccuguuguuuauucaucucu

SEQ ID NO: 256389 - RNA, 22 nt, Human
gagcugcauagcugggauccuc

SEQ ID NO: 256390 - RNA, 22 nt, Human
acugugcacccuggacaguguc

SEQ ID NO: 256391 - RNA, 22 nt, Human
ucucagagccuaacuaaccuaa

SEQ ID NO: 256392 - RNA, 22 nt, Human
gcacugugacccagagcaggug

SEQ ID NO: 256393 - RNA, 17 nt, Human
ggcucugggugucacau

SEQ ID NO: 256394 - RNA, 22 nt, Human
gccugcagggcccuuguggguc

SEQ ID NO: 256395 - RNA, 22 nt, Human
accaggagaggcacuugcaaug

SEQ ID NO: 256396 - RNA, 22 nt, Human
guuacaaaugccaaagcugaga

SEQ ID NO: 256397 - RNA, 22 nt, Human
ucaaaucuuuaacaugugcaaa

SEQ ID NO: 256398 - RNA, 22 nt, Human
agaaccauuuugacagauauac

SEQ ID NO: 256399 - RNA, 22 nt, Human
guccagaguagucgaguauucu

SEQ ID NO: 256400 - RNA, 22 nt, Human
caagacaugcaauugccacuuu

SEQ ID NO: 256401 - RNA, 22 nt, Human
caggcugccgugaagcaggccu

SEQ ID NO: 256402 - RNA, 22 nt, Human
ucaugcaguuugaaguucaggg

SEQ ID NO: 256403 - RNA, 22 nt, Human
cagcuuccaucuccacugcccu

SEQ ID NO: 256404 - RNA, 22 nt, Human
agccagagaguguuggagaugu

SEQ ID NO: 256405 - RNA, 22 nt, Human
guggauggagcagugacccagg

SEQ ID NO: 256406 - RNA, 22 nt, Human
cugaggcacagugaacuucucc

SEQ ID NO: 256407 - RNA, 22 nt, Human
aauaaugucugcuauuuuaaaa

SEQ ID NO: 256408 - RNA, 22 nt, Human
aggaggcugguucaggccauau

SEQ ID NO: 256409 - RNA, 18 nt, Human
ucuucaucuccugagcug

SEQ ID NO: 256410 - RNA, 22 nt, Human
uagaaaauggccaagcaggacu

SEQ ID NO: 256411 - RNA, 22 nt, Human
uacaggagcauggggaagggau

SEQ ID NO: 256412 - RNA, 22 nt, Human
guuaaugucuuccuauucuaca

SEQ ID NO: 256413 - RNA, 22 nt, Human
acacuuuagauauucccuucug

SEQ ID NO: 256414 - RNA, 22 nt, Human
guaagcaucugucucuucugca

SEQ ID NO: 256415 - RNA, 22 nt, Human
ugugccugagucucggcccacc

SEQ ID NO: 256416 - RNA, 22 nt, Human
ugaauaugcuuugcaauccuaa

SEQ ID NO: 256417 - RNA, 22 nt, Human
uucaguuugaauucuguagaac

SEQ ID NO: 256418 - RNA, 22 nt, Human
aggucugccucacucacuucug

SEQ ID NO: 256419 - RNA, 22 nt, Human
gggcugcaucagcaggacccgg

SEQ ID NO: 256420 - RNA, 20 nt, Human
ucucaggccccaguuuucuu

SEQ ID NO: 256421 - RNA, 22 nt, Human
auuuauuccuuuauggcuggag

SEQ ID NO: 256422 - RNA, 22 nt, Human
auaugcauguacgugugcacaa

SEQ ID NO: 256423 - RNA, 22 nt, Human
augccaggccccacgcugggca

SEQ ID NO: 256424 - RNA, 22 nt, Human
ucugaaagggcuaaauaauuug

SEQ ID NO: 256425 - RNA, 22 nt, Human
uucauugaaggagggacuugcu

SEQ ID NO: 256426 - RNA, 22 nt, Human
gugcauuugacgaauacucacu

SEQ ID NO: 256427 - RNA, 22 nt, Human
ggagcugaaccccaucgugcug

SEQ ID NO: 256428 - RNA, 22 nt, Human
gguggcagugcuugcgggucua

SEQ ID NO: 256429 - RNA, 22 nt, Human
ccagagaguaaacauuuuccgg

SEQ ID NO: 256430 - RNA, 22 nt, Human
caggcuugaagcuucagaguau

SEQ ID NO: 256431 - RNA, 22 nt, Human
uccaggaccaaagacacaugua

SEQ ID NO: 256432 - RNA, 22 nt, Human
cacaccagcauggucucagugu

SEQ ID NO: 256433 - RNA, 22 nt, Human
aggagccaaauuuuagacucug

SEQ ID NO: 256434 - RNA, 22 nt, Human
agugucaauucucaaaucucgg

SEQ ID NO: 256435 - RNA, 22 nt, Human
uucaguguacagugaagggauu

SEQ ID NO: 256436 - RNA, 21 nt, Human
gggcuuuuuauuuagcacugu

SEQ ID NO: 256437 - RNA, 22 nt, Human
acuuccaaauaccaucacauug

SEQ ID NO: 256438 - RNA, 22 nt, Human
cucagcaccccgacaggacauu

SEQ ID NO: 256439 - RNA, 22 nt, Human
uacuguuuuugccucuuuagaa

SEQ ID NO: 256440 - RNA, 21 nt, Human
ucuccaguauccuucucugag

SEQ ID NO: 256441 - RNA, 22 nt, Human
cuguucuggagacacugaugaa

SEQ ID NO: 256442 - RNA, 22 nt, Human
aacaaugccaacagcaugcugg

SEQ ID NO: 256443 - RNA, 22 nt, Human
caauaacugcugaggagaagca

SEQ ID NO: 256444 - RNA, 22 nt, Human
gaggagcuucagaggaaucuua

SEQ ID NO: 256445 - RNA, 22 nt, Human
uagggcagccacccaggcugcu

SEQ ID NO: 256446 - RNA, 22 nt, Human
caggcucacuuucucagucaca

SEQ ID NO: 256447 - RNA, 22 nt, Human
agaccaggaaggccuacagaua

SEQ ID NO: 256448 - RNA, 22 nt, Human
agcagggcacuggaaggcacug

SEQ ID NO: 256449 - RNA, 22 nt, Human
uggcccugcagaacuagccugg

SEQ ID NO: 256450 - RNA, 22 nt, Human
aguguguuuggagcgagggagg

SEQ ID NO: 256451 - RNA, 22 nt, Human
cuuuaguucuagaaagugaaac

SEQ ID NO: 256452 - RNA, 22 nt, Human
gagaagggauauggcuucuuga

SEQ ID NO: 256453 - RNA, 22 nt, Human
gucccaggcagagucaggaggg

SEQ ID NO: 256454 - RNA, 22 nt, Human
acagcugugaaaauccacagga

SEQ ID NO: 256455 - RNA, 22 nt, Human
ucccugagcuucaucaggcuuu

SEQ ID NO: 256456 - RNA, 22 nt, Human
ggcucugggucuguggggagcg

SEQ ID NO: 256457 - RNA, 22 nt, Human
uggcagcaauuugugauguuga

SEQ ID NO: 256458 - RNA, 22 nt, Human
uuuaccacaauuuuaaacaaug

SEQ ID NO: 256459 - RNA, 22 nt, Human
agauggggcugaaaguuccaau

SEQ ID NO: 256460 - RNA, 22 nt, Human
uuuuagacuuguauguaaagcc

SEQ ID NO: 256461 - RNA, 22 nt, Human
aagcugcaugaaguugaguaga

SEQ ID NO: 256462 - RNA, 22 nt, Human
ucccagaaucuccagugcuaca

SEQ ID NO: 256463 - RNA, 22 nt, Human
uacauucauaugugugcauaca

SEQ ID NO: 256464 - RNA, 22 nt, Human
gaucucuggguccuguuggccu

SEQ ID NO: 256465 - RNA, 22 nt, Human
caaauuguguuugcuuuucucu

SEQ ID NO: 256466 - RNA, 22 nt, Human
uagaaggcuuugagagauacuu

SEQ ID NO: 256467 - RNA, 22 nt, Human
cugccaggugccuuugugcagu

SEQ ID NO: 256468 - RNA, 22 nt, Human
ccaggccugugcaaggagggag

SEQ ID NO: 256469 - RNA, 22 nt, Human
ugguccagaagauauucaacca

SEQ ID NO: 256470 - RNA, 22 nt, Human
aguggcaguuugggagcuacag

SEQ ID NO: 256471 - RNA, 22 nt, Human
uucccuuccucacucuacuugu

SEQ ID NO: 256472 - RNA, 22 nt, Human
uuacacagaugguuaguagagg

SEQ ID NO: 256473 - RNA, 22 nt, Human
aacaguuuaugauaaauucuua

SEQ ID NO: 256474 - RNA, 22 nt, Human
aggggcucugagugggccagga

SEQ ID NO: 256475 - RNA, 22 nt, Human
uucuacacuuuucauuagcuag

SEQ ID NO: 256476 - RNA, 22 nt, Human
ucaaaauuucagcacuagcccu

SEQ ID NO: 256477 - RNA, 22 nt, Human
uugauucaaaggggacaagugg

SEQ ID NO: 256478 - RNA, 20 nt, Human
aucugggcaucaauuuugug

SEQ ID NO: 256479 - RNA, 22 nt, Human
ucacuagcauuguugaaggacu

SEQ ID NO: 256480 - RNA, 22 nt, Human
aguuuacauaaaaaggcagagg

SEQ ID NO: 256481 - RNA, 22 nt, Human
ucaggaaauggcuucaugguuu

SEQ ID NO: 256482 - RNA, 22 nt, Human
ggcacagcaagaagggaaauga

SEQ ID NO: 256483 - RNA, 22 nt, Human
uguuggaauaagugcuugaagg

SEQ ID NO: 256484 - RNA, 22 nt, Human
cagggcucuucaucacacagua

SEQ ID NO: 256485 - RNA, 22 nt, Human
ggucacaugguugagcuugauc

SEQ ID NO: 256486 - RNA, 22 nt, Human
ucaggccugagaaaaauccuuu

SEQ ID NO: 256487 - RNA, 22 nt, Human
ggucaguguauguauugauaag

SEQ ID NO: 256488 - RNA, 22 nt, Human
aauaauauuccucugugugcgu

SEQ ID NO: 256489 - RNA, 22 nt, Human
caggaggagcauuagcgucuca

SEQ ID NO: 256490 - RNA, 22 nt, Human
ucaugcagaggaaggcuaguuu

SEQ ID NO: 256491 - RNA, 22 nt, Human
gcugagcugggacaguccuggg

SEQ ID NO: 256492 - RNA, 22 nt, Human
caugccuguauuucugaucuau

SEQ ID NO: 256493 - RNA, 22 nt, Human
acucuggcagcagaaccagugu

SEQ ID NO: 256494 - RNA, 22 nt, Human
auucaaguccagcuucucuaca

SEQ ID NO: 256495 - RNA, 22 nt, Human
cuggcaguauuaagagaaguga

SEQ ID NO: 256496 - RNA, 22 nt, Human
aggcaggugagucaaaacagac

SEQ ID NO: 256497 - RNA, 21 nt, Human
uauuugcugccaucuuugagg

SEQ ID NO: 256498 - RNA, 22 nt, Human
uuaaaauuauggcccauuugga

SEQ ID NO: 256499 - RNA, 20 nt, Human
agcuucauuauagcccacag

SEQ ID NO: 256500 - RNA, 22 nt, Human
gucuagaaaucauguacuguga

SEQ ID NO: 256501 - RNA, 22 nt, Human
guacuaagucaggagaagaauu

SEQ ID NO: 256502 - RNA, 22 nt, Human
gggugagagucaggcagagauu

SEQ ID NO: 256503 - RNA, 22 nt, Human
cuggguaaguuccuaaggcuca

SEQ ID NO: 256504 - RNA, 22 nt, Human
ugcauuuaguuuuaauaaagga

SEQ ID NO: 256505 - RNA, 22 nt, Human
uugacuucagccuguacuugua

SEQ ID NO: 256506 - RNA, 22 nt, Human
ccuccugggccuugcucuguga

SEQ ID NO: 256507 - RNA, 22 nt, Human
gacaagacugguuuauuuaagg

SEQ ID NO: 256508 - RNA, 20 nt, Human
acaguggguggggagcacug

SEQ ID NO: 256509 - RNA, 22 nt, Human
uggaagaauagaagaugguuga

SEQ ID NO: 256510 - RNA, 22 nt, Human
accugaggccuccccagcagac

SEQ ID NO: 256511 - RNA, 22 nt, Human
agcuccagccucuucuggaggu

SEQ ID NO: 256512 - RNA, 22 nt, Human
aagugguuuuaagagguuccuu

SEQ ID NO: 256513 - RNA, 22 nt, Human
ggcaggugcgcauguugcauua

SEQ ID NO: 256514 - RNA, 22 nt, Human
uucuagaacaggcaaaaccaau

SEQ ID NO: 256515 - RNA, 22 nt, Human
ucaaucaaugguuuccaaauuu

SEQ ID NO: 256516 - RNA, 22 nt, Human
uuauccuggauuauauauguga

SEQ ID NO: 256517 - RNA, 22 nt, Human
cagcugaagcccaggcagaacc

SEQ ID NO: 256518 - RNA, 22 nt, Human
gcucccaggcauggagguaauu

SEQ ID NO: 256519 - RNA, 22 nt, Human
gagggcguucagucagugucuc

SEQ ID NO: 256520 - RNA, 22 nt, Human
cagagcagaagcgguccucaca

SEQ ID NO: 256521 - RNA, 22 nt, Human
ucuguuuaugcauauuuaaaac

SEQ ID NO: 256522 - RNA, 22 nt, Human
ucaggccugugcuggaggagau

SEQ ID NO: 256523 - RNA, 22 nt, Human
gcaggcaggcuuccuugaacug

SEQ ID NO: 256524 - RNA, 22 nt, Human
uuauugaguuuacagcuuuaga

SEQ ID NO: 256525 - RNA, 22 nt, Human
caagcugggucccaacaauuac

SEQ ID NO: 256526 - RNA, 22 nt, Human
ggccucugaggacagccuuggc

SEQ ID NO: 256527 - RNA, 21 nt, Human
ucacaggcucagggagagagu

SEQ ID NO: 256528 - RNA, 22 nt, Human
guuagacaugagugugcuuaca

SEQ ID NO: 256529 - RNA, 22 nt, Human
ccuccaggauaagucagggccu

SEQ ID NO: 256530 - RNA, 22 nt, Human
agaagagaaauagugccacugu

SEQ ID NO: 256531 - RNA, 22 nt, Human
guuacucuuccccggggucugg

SEQ ID NO: 256532 - RNA, 17 nt, Human
uugggagagaaagguau

SEQ ID NO: 256533 - RNA, 22 nt, Human
guuuguuagaagagcagaaucu

SEQ ID NO: 256534 - RNA, 22 nt, Human
gcagcucaagagaggugcuaug

SEQ ID NO: 256535 - RNA, 22 nt, Human
caaaugcauaguuuauaagaag

SEQ ID NO: 256536 - RNA, 22 nt, Human
guaugaaaauuguaaaguucuu

SEQ ID NO: 256537 - RNA, 22 nt, Human
aaggugucaggcuugggaaagu

SEQ ID NO: 256538 - RNA, 22 nt, Human
aauaauagcagaguuuacaauc

SEQ ID NO: 256539 - RNA, 22 nt, Human
aggcugggaaauguauuccagc

SEQ ID NO: 256540 - RNA, 22 nt, Human
cuuggagcaacacaugacaucu

SEQ ID NO: 256541 - RNA, 22 nt, Human
accaggacauuuuagucaucuu

SEQ ID NO: 256542 - RNA, 22 nt, Human
uaguuacaaaccaacaggcagc

SEQ ID NO: 256543 - RNA, 22 nt, Human
uguaaagguaggugcaaaauga

SEQ ID NO: 256544 - RNA, 22 nt, Human
guauuuauaggggaaugagagu

SEQ ID NO: 256545 - RNA, 22 nt, Human
ugccagagaagacccagucacu

SEQ ID NO: 256546 - RNA, 20 nt, Human
aaccaacagaaucaugucuc

SEQ ID NO: 256547 - RNA, 22 nt, Human
gcugcugguccucagagcucau

SEQ ID NO: 256548 - RNA, 22 nt, Human
ggccuuccaucugccucuguuu

SEQ ID NO: 256549 - RNA, 22 nt, Human
gaggagagagggacugucugca

SEQ ID NO: 256550 - RNA, 22 nt, Human
aaggaaaugagguugauggaug

SEQ ID NO: 256551 - RNA, 22 nt, Human
uccaggucccuggggagauuuu

SEQ ID NO: 256552 - RNA, 22 nt, Human
aaaaccuucuagacuuuauauu

SEQ ID NO: 256553 - RNA, 22 nt, Human
cucucagauggagugugaaugg

SEQ ID NO: 256554 - RNA, 20 nt, Human
caaaagcaaugaaguuauga

SEQ ID NO: 256555 - RNA, 22 nt, Human
cagcacuuuagcggaggcauca

SEQ ID NO: 256556 - RNA, 22 nt, Human
ggacagguucagcaguuuauaa

SEQ ID NO: 256557 - RNA, 22 nt, Human
guggcugggcuccgagcggcuu

SEQ ID NO: 256558 - RNA, 23 nt, Human
guaacuggggaauuugagcuaug

SEQ ID NO: 256559 - RNA, 23 nt, Human
cuguggagcccuuuguugggaga

SEQ ID NO: 256560 - RNA, 22 nt, Human
uggggugggcaugcgcuguccu

SEQ ID NO: 256561 - RNA, 22 nt, Human
ccacccaugugacuaccucaug

SEQ ID NO: 256562 - RNA, 22 nt, Human
uuucacauaucaacucuauccu

SEQ ID NO: 256563 - RNA, 22 nt, Human
uaacaucuuaacuggauacuuc

SEQ ID NO: 256564 - RNA, 22 nt, Human
uuugacucagcaaauucacagg

SEQ ID NO: 256565 - RNA, 22 nt, Human
gggagcugaauggcaauggaga

SEQ ID NO: 256566 - RNA, 22 nt, Human
agcaugcaguaaguacccugug

SEQ ID NO: 256567 - RNA, 20 nt, Human
uuguuuuaaauccuggauga

SEQ ID NO: 256568 - RNA, 22 nt, Human
ggccucucauguccugggcuuc

SEQ ID NO: 256569 - RNA, 22 nt, Human
cagcuucaccagggccaugguu

SEQ ID NO: 256570 - RNA, 22 nt, Human
ucugcagguguuggaaggguca

SEQ ID NO: 256571 - RNA, 22 nt, Human
acucuaaauagauaaccaugca

SEQ ID NO: 256572 - RNA, 22 nt, Human
aggcugaggcagguggaucauu

SEQ ID NO: 256573 - RNA, 22 nt, Human
guauuaggaggaacacaggccu

SEQ ID NO: 256574 - RNA, 22 nt, Human
acucauugaaacuuaagaucua

SEQ ID NO: 256575 - RNA, 22 nt, Human
uuuaaagaaauuccucaucuuu

SEQ ID NO: 256576 - RNA, 22 nt, Human
cugcagggcuuaccuugcucug

SEQ ID NO: 256577 - RNA, 22 nt, Human
gaaauagaucucugggaugcaa

SEQ ID NO: 256578 - RNA, 22 nt, Human
uuagucuucucauaguaaaacu

SEQ ID NO: 256579 - RNA, 22 nt, Human
uugggaaguuuaaugacagacu

SEQ ID NO: 256580 - RNA, 20 nt, Human
auguuaaauagcauuuagag

SEQ ID NO: 256581 - RNA, 22 nt, Human
ugccagcuuguggucagaggcu

SEQ ID NO: 256582 - RNA, 22 nt, Human
aagggcuggccacauucugggu

SEQ ID NO: 256583 - RNA, 22 nt, Human
uugauuacuauguguugaaagc

SEQ ID NO: 256584 - RNA, 22 nt, Human
uucuguaucuuucuucaagauu

SEQ ID NO: 256585 - RNA, 22 nt, Human
agaagccaaaggggccagauau

SEQ ID NO: 256586 - RNA, 22 nt, Human
uuccaucuuucagcuuuguugg

SEQ ID NO: 256587 - RNA, 22 nt, Human
cuggucugcaaggccauauaga

SEQ ID NO: 256588 - RNA, 22 nt, Human
uggcugagaaugggaugaugcc

SEQ ID NO: 256589 - RNA, 22 nt, Human
cacaaaguguuagaugccacuc

SEQ ID NO: 256590 - RNA, 22 nt, Human
guauaugagaaccauggaggug

SEQ ID NO: 256591 - RNA, 22 nt, Human
cagcugcauuaauuuuagugaa

SEQ ID NO: 256592 - RNA, 22 nt, Human
aauucaaagccgcuugggaauc

SEQ ID NO: 256593 - RNA, 22 nt, Human
ucugucugagugguguuagagu

SEQ ID NO: 256594 - RNA, 22 nt, Human
agccuaggucugggucuagcag

SEQ ID NO: 256595 - RNA, 22 nt, Human
auauaaagagcuuaguauagug

SEQ ID NO: 256596 - RNA, 22 nt, Human
ucucuguaucagcaccugcugg

SEQ ID NO: 256597 - RNA, 22 nt, Human
uacccagcuucaagucaggacu

SEQ ID NO: 256598 - RNA, 22 nt, Human
ccucuccuugcacccgucccgc

SEQ ID NO: 256599 - RNA, 22 nt, Human
aaaugaccagaauacaggcuuc

SEQ ID NO: 256600 - RNA, 22 nt, Human
acauguuaaacaucauggaaug

SEQ ID NO: 256601 - RNA, 22 nt, Human
uuucuaguaaaagcuaauuacc

SEQ ID NO: 256602 - RNA, 22 nt, Human
gaaugaguagaguauaaacaaa

SEQ ID NO: 256603 - RNA, 22 nt, Human
ggcugaaauucagaguaaauuc

SEQ ID NO: 256604 - RNA, 21 nt, Human
ucuguacaucauugagucccc

SEQ ID NO: 256605 - RNA, 22 nt, Human
uguggcugcuccugggugguca

SEQ ID NO: 256606 - RNA, 22 nt, Human
uugcaggguugaccaauaggcu

SEQ ID NO: 256607 - RNA, 22 nt, Human
uaaagguacgaagugagggauu

SEQ ID NO: 256608 - RNA, 19 nt, Human
ggccucugcaggccgcccc

SEQ ID NO: 256609 - RNA, 22 nt, Human
cuuguuuaaauaagauagcagu

SEQ ID NO: 256610 - RNA, 22 nt, Human
uuaagacauucagauauuucua

SEQ ID NO: 256611 - RNA, 21 nt, Human
gcucaaagggcuugccaugcu

SEQ ID NO: 256612 - RNA, 22 nt, Human
auagcaauuaagcuccagaauu

SEQ ID NO: 256613 - RNA, 19 nt, Human
agcuccugggcucugggcc

SEQ ID NO: 256614 - RNA, 22 nt, Human
ggcugaaaccguuauccacuga

SEQ ID NO: 256615 - RNA, 22 nt, Human
ccacagaaugaugacacuucag

SEQ ID NO: 256616 - RNA, 22 nt, Human
gacagucccccagcagcaaacc

SEQ ID NO: 256617 - RNA, 23 nt, Human
aguucucauucaucacggccuau

SEQ ID NO: 256618 - RNA, 22 nt, Human
uguuggaauuaggauacagagg

SEQ ID NO: 256619 - RNA, 22 nt, Human
uaacagaagagcaggcagcccu

SEQ ID NO: 256620 - RNA, 22 nt, Human
uugaaucucuugaaucucuguu

SEQ ID NO: 256621 - RNA, 22 nt, Human
uuaccacacuuauuuacauugg

SEQ ID NO: 256622 - RNA, 22 nt, Human
caggccugcuucuuacccuuca

SEQ ID NO: 256623 - RNA, 22 nt, Human
acacugagauuuuccugacacc

SEQ ID NO: 256624 - RNA, 17 nt, Human
gucucugucuugcuuuu

SEQ ID NO: 256625 - RNA, 22 nt, Human
cuggcagauuggggucagcagu

SEQ ID NO: 256626 - RNA, 22 nt, Human
caggcucugcugcuacagcugu

SEQ ID NO: 256627 - RNA, 22 nt, Human
gccucaagacauuuuuaauugc

SEQ ID NO: 256628 - RNA, 22 nt, Human
auggggagagaagggcugagcu

SEQ ID NO: 256629 - RNA, 22 nt, Human
uacaucucaucugugcucuccg

SEQ ID NO: 256630 - RNA, 22 nt, Human
uucugucaugcucauguaauug

SEQ ID NO: 256631 - RNA, 22 nt, Human
augcuauguaacuggcagauag

SEQ ID NO: 256632 - RNA, 22 nt, Human
uggggcucuccacagugucuca

SEQ ID NO: 256633 - RNA, 22 nt, Human
cuauaacuggguauuagacuac

SEQ ID NO: 256634 - RNA, 22 nt, Human
cugggucuggaggccaagggug

SEQ ID NO: 256635 - RNA, 22 nt, Human
gccagugggacccgcugugggc

SEQ ID NO: 256636 - RNA, 22 nt, Human
uccaggaguccugggagugauu

SEQ ID NO: 256637 - RNA, 22 nt, Human
cuuugaaaacacacgaauagac

SEQ ID NO: 256638 - RNA, 22 nt, Human
ugaacauuaguugaguaaaguc

SEQ ID NO: 256639 - RNA, 22 nt, Human
agagccugagccugaaagcccu

SEQ ID NO: 256640 - RNA, 23 nt, Human
ucucagaggauuccugggccuug

SEQ ID NO: 256641 - RNA, 22 nt, Human
caggugaggcugaacagaugaa

SEQ ID NO: 256642 - RNA, 22 nt, Human
aacaaagucguugccuagaaga

SEQ ID NO: 256643 - RNA, 22 nt, Human
uauuuguugaauaccccugucu

SEQ ID NO: 256644 - RNA, 22 nt, Human
ucuccacagucccaccucgcuu

SEQ ID NO: 256645 - RNA, 22 nt, Human
ggagugggaacaaugacauggu

SEQ ID NO: 256646 - RNA, 22 nt, Human
gagggauggugugagaggcuca

SEQ ID NO: 256647 - RNA, 22 nt, Human
agaaggaaaaccugucuuaugu

SEQ ID NO: 256648 - RNA, 22 nt, Human
gacuucuguuaacuuguaagag

SEQ ID NO: 256649 - RNA, 20 nt, Human
ugggagaagaacacuggaac

SEQ ID NO: 256650 - RNA, 22 nt, Human
agaggccuccgaaaggugggcu

SEQ ID NO: 256651 - RNA, 22 nt, Human
gagagccagcucacuccagggc

SEQ ID NO: 256652 - RNA, 22 nt, Human
cagguucuuguuucaaacagac

SEQ ID NO: 256653 - RNA, 22 nt, Human
acagaugaggcccaucagucug

SEQ ID NO: 256654 - RNA, 22 nt, Human
acugggccuguacagagaaaac

SEQ ID NO: 256655 - RNA, 22 nt, Human
aaguaacaucugaacaugaugu

SEQ ID NO: 256656 - RNA, 22 nt, Human
aucucagaaggcauuuccaaga

SEQ ID NO: 256657 - RNA, 19 nt, Human
acuggcaguuucugcaugg

SEQ ID NO: 256658 - RNA, 22 nt, Human
ggcuucuggugggagcaugacu

SEQ ID NO: 256659 - RNA, 22 nt, Human
cacaggcacgccucuggccagg

SEQ ID NO: 256660 - RNA, 22 nt, Human
ccaugaguagcgauuucauuuu

SEQ ID NO: 256661 - RNA, 22 nt, Human
caggaaauauaggaaaaggaac

SEQ ID NO: 256662 - RNA, 22 nt, Human
ccagaagucaaugcagauguga

SEQ ID NO: 256663 - RNA, 22 nt, Human
ggccuccucacccugcucaggc

SEQ ID NO: 256664 - RNA, 22 nt, Human
uguaauuaaacugaagacagaa

SEQ ID NO: 256665 - RNA, 22 nt, Human
uuucauguauuucccaaagcuu

SEQ ID NO: 256666 - RNA, 22 nt, Human
gauugcugggucccacucccag

SEQ ID NO: 256667 - RNA, 22 nt, Human
uugucuguccaggcaccccaag

SEQ ID NO: 256668 - RNA, 22 nt, Human
uagacagagugaagacaagugg

SEQ ID NO: 256669 - RNA, 22 nt, Human
ccacagaaaguugucuagagua

SEQ ID NO: 256670 - RNA, 22 nt, Human
gccagguggcugagcagcugca

SEQ ID NO: 256671 - RNA, 22 nt, Human
uccucagagcauagcgcugucu

SEQ ID NO: 256672 - RNA, 22 nt, Human
ucaggagcuuagaugcuuugac

SEQ ID NO: 256673 - RNA, 22 nt, Human
ggagcugggaauuggaucaucu

SEQ ID NO: 256674 - RNA, 22 nt, Human
aguaacaugaguuuuucuaaug

SEQ ID NO: 256675 - RNA, 22 nt, Human
uuuggagauggagagagggcau

SEQ ID NO: 256676 - RNA, 22 nt, Human
guacauuucaguuuccuuaaga

SEQ ID NO: 256677 - RNA, 22 nt, Human
uggcccugucugcacacaggau

SEQ ID NO: 256678 - RNA, 22 nt, Human
augcauacagauuuaaaauuuu

SEQ ID NO: 256679 - RNA, 23 nt, Human
aaauucaguccuucaacucugag

SEQ ID NO: 256680 - RNA, 22 nt, Human
ucagcucuacacacaccugugu

SEQ ID NO: 256681 - RNA, 22 nt, Human
caaauucaaauuucaucagugu

SEQ ID NO: 256682 - RNA, 22 nt, Human
ugcccuggggucuggagcagca

SEQ ID NO: 256683 - RNA, 22 nt, Human
augccaaagcccaaguucauca

SEQ ID NO: 256684 - RNA, 22 nt, Human
uaaagaacacagggaauagcac

SEQ ID NO: 256685 - RNA, 22 nt, Human
ggucuggauuuuaucuacugua

SEQ ID NO: 256686 - RNA, 22 nt, Human
gauuuucauuugcacucuagaa

SEQ ID NO: 256687 - RNA, 22 nt, Human
caggugucaaaauacuaagugg

SEQ ID NO: 256688 - RNA, 22 nt, Human
caccugcagggggagucaagag

SEQ ID NO: 256689 - RNA, 22 nt, Human
cugguuuagucauaauggagaa

SEQ ID NO: 256690 - RNA, 22 nt, Human
uaaaugagauguacauaacuca

SEQ ID NO: 256691 - RNA, 22 nt, Human
aagaacaacugcuuuaaaagca

SEQ ID NO: 256692 - RNA, 22 nt, Human
aagagcauauuaauaguggaga

SEQ ID NO: 256693 - RNA, 22 nt, Human
cccaggaggcagauguugcagu

SEQ ID NO: 256694 - RNA, 22 nt, Human
auaagguauaaggccuauuuuu

SEQ ID NO: 256695 - RNA, 22 nt, Human
cgccggcuugaggcaggcggca

SEQ ID NO: 256696 - RNA, 22 nt, Human
aacuuuagcuauuuaaucugau

SEQ ID NO: 256697 - RNA, 21 nt, Human
ccuguucacagaucuguaacu

SEQ ID NO: 256698 - RNA, 22 nt, Human
aucaagaaaagugcuuucggcu

SEQ ID NO: 256699 - RNA, 22 nt, Human
agcacaggaccaaggaagcugu

SEQ ID NO: 256700 - RNA, 23 nt, Human
cugauuugagcagaauaaaauag

SEQ ID NO: 256701 - RNA, 22 nt, Human
ugguugccucucagagauuccg

SEQ ID NO: 256702 - RNA, 22 nt, Human
gcuuuuucaaaugaaagcuggu

SEQ ID NO: 256703 - RNA, 22 nt, Human
ggcagugggaaauaagugagaa

SEQ ID NO: 256704 - RNA, 22 nt, Human
agggcucaccacugugcacucc

SEQ ID NO: 256705 - RNA, 22 nt, Human
aucuaagaguuaacaucaagaa

SEQ ID NO: 256706 - RNA, 22 nt, Human
uaguuuaugauuuuuuggaagg

SEQ ID NO: 256707 - RNA, 22 nt, Human
ggcuccugggagauagagguca

SEQ ID NO: 256708 - RNA, 21 nt, Human
cucccagggugacuguucaac

SEQ ID NO: 256709 - RNA, 22 nt, Human
cuuauucagcacuugcucugua

SEQ ID NO: 256710 - RNA, 22 nt, Human
ugcuuagaugaggcagcaggag

SEQ ID NO: 256711 - RNA, 22 nt, Human
uagaagaaagugaagcugggga

SEQ ID NO: 256712 - RNA, 20 nt, Human
gcuaggcuguguccugccca

SEQ ID NO: 256713 - RNA, 22 nt, Human
ucucuggcuccugccgggucca

SEQ ID NO: 256714 - RNA, 22 nt, Human
agguggggaguauauguaauug

SEQ ID NO: 256715 - RNA, 22 nt, Human
acaaguuaccaaaaaagauuca

SEQ ID NO: 256716 - RNA, 22 nt, Human
aaguuacacagaguuggaggcu

SEQ ID NO: 256717 - RNA, 22 nt, Human
guuaauuuaguagaguccagau

SEQ ID NO: 256718 - RNA, 22 nt, Human
agcuccugggccaucacaacca

SEQ ID NO: 256719 - RNA, 22 nt, Human
ugcaugaaauauuuucuguagg

SEQ ID NO: 256720 - RNA, 20 nt, Human
guggaugaucaguguagugg

SEQ ID NO: 256721 - RNA, 22 nt, Human
ggcacagcuacuugcucacucu

SEQ ID NO: 256722 - RNA, 22 nt, Human
aaguuucugccauacuguggug

SEQ ID NO: 256723 - RNA, 22 nt, Human
aucuccagggugcccuuguucu

SEQ ID NO: 256724 - RNA, 22 nt, Human
uagucaguagcaagguauuuug

SEQ ID NO: 256725 - RNA, 22 nt, Human
aaaaauagcuucucuugucccu

SEQ ID NO: 256726 - RNA, 22 nt, Human
uugccucauuuucuggugaaau

SEQ ID NO: 256727 - RNA, 22 nt, Human
ucucugggaauuuuuuggacau

SEQ ID NO: 256728 - RNA, 22 nt, Human
auuugcuucugcuaaacaacuu

SEQ ID NO: 256729 - RNA, 22 nt, Human
augccuggucccaccucuaggu

SEQ ID NO: 256730 - RNA, 22 nt, Human
cauuugaauggcauuucacuuu

SEQ ID NO: 256731 - RNA, 22 nt, Human
uguauacaggauuacucauagc

SEQ ID NO: 256732 - RNA, 22 nt, Human
uuuacaguuaagaaauguuacc

SEQ ID NO: 256733 - RNA, 21 nt, Human
acugggcuagccugacuucug

SEQ ID NO: 256734 - RNA, 19 nt, Human
uggcugggugccaauggcc

SEQ ID NO: 256735 - RNA, 22 nt, Human
aacauucaaaacccaguucagu

SEQ ID NO: 256736 - RNA, 20 nt, Human
ugccccaggccugcaccugc

SEQ ID NO: 256737 - RNA, 22 nt, Human
uguguucauguauguauacaua

SEQ ID NO: 256738 - RNA, 22 nt, Human
uggcucugucgccguuuggaau

SEQ ID NO: 256739 - RNA, 22 nt, Human
ccuuucagguacaccagggaug

SEQ ID NO: 256740 - RNA, 22 nt, Human
uuuaaaugcagacguugauuca

SEQ ID NO: 256741 - RNA, 22 nt, Human
ugaggggccagaccccaccuag

SEQ ID NO: 256742 - RNA, 22 nt, Human
cagagcagugggguuggucaga

SEQ ID NO: 256743 - RNA, 22 nt, Human
gaggcugcagcuaucagacauu

SEQ ID NO: 256744 - RNA, 22 nt, Human
ucauacaacuaagaguuucaga

SEQ ID NO: 256745 - RNA, 22 nt, Human
uggcaggggaggugcuugcuua

SEQ ID NO: 256746 - RNA, 22 nt, Human
gcugccuguugaagggucugug

SEQ ID NO: 256747 - RNA, 21 nt, Human
gcccacagugaggaggauccc

SEQ ID NO: 256748 - RNA, 22 nt, Human
uguccaggaguaaaaagaccug

SEQ ID NO: 256749 - RNA, 22 nt, Human
cuggcccuggagggcugugcga

SEQ ID NO: 256750 - RNA, 22 nt, Human
uccacccccagacagcugguga

SEQ ID NO: 256751 - RNA, 22 nt, Human
ggcuggccucaggguccucgcu

SEQ ID NO: 256752 - RNA, 19 nt, Human
aucuacaauuauucucagu

SEQ ID NO: 256753 - RNA, 22 nt, Human
acauuacagcaaguuuacguua

SEQ ID NO: 256754 - RNA, 23 nt, Human
auauggcuguuguguguuaacau

SEQ ID NO: 256755 - RNA, 22 nt, Human
aggcugagugcuccccuagaug

SEQ ID NO: 256756 - RNA, 22 nt, Human
auucugggucugggugugauca

SEQ ID NO: 256757 - RNA, 22 nt, Human
uucugcaucugaauuuaaguac

SEQ ID NO: 256758 - RNA, 23 nt, Human
aggagccaugaguuggauauguu

SEQ ID NO: 256759 - RNA, 23 nt, Human
ccuggcuggauucucugcauuca

SEQ ID NO: 256760 - RNA, 22 nt, Human
uucuucagcuucuaccugcguc

SEQ ID NO: 256761 - RNA, 22 nt, Human
uaaaacuagugguugggacuaa

SEQ ID NO: 256762 - RNA, 22 nt, Human
uggcaggcugaguuggccuggu

SEQ ID NO: 256763 - RNA, 22 nt, Human
uacaaaguaauguauaauaucg

SEQ ID NO: 256764 - RNA, 22 nt, Human
aaaucuagaaguuuaaaaggau

SEQ ID NO: 256765 - RNA, 17 nt, Human
ccugaaggcacuuccag

SEQ ID NO: 256766 - RNA, 22 nt, Human
caggaaggcgcggcugugccug

SEQ ID NO: 256767 - RNA, 22 nt, Human
agcuggcaauguaagucccugg

SEQ ID NO: 256768 - RNA, 22 nt, Human
acugaggucucagguggggaag

SEQ ID NO: 256769 - RNA, 22 nt, Human
gcucagagaguuucacaaguuu

SEQ ID NO: 256770 - RNA, 22 nt, Human
caacuuggcucucuggcuaucc

SEQ ID NO: 256771 - RNA, 22 nt, Human
uccaccagcagccugucagccu

SEQ ID NO: 256772 - RNA, 22 nt, Human
aagcaggcucacgccaggcagu

SEQ ID NO: 256773 - RNA, 22 nt, Human
uuuauucuauaggcauuaagca

SEQ ID NO: 256774 - RNA, 22 nt, Human
agggacucccugggccgacacg

SEQ ID NO: 256775 - RNA, 22 nt, Human
ccugcaccacaaggcuucagag

SEQ ID NO: 256776 - RNA, 22 nt, Human
agucucuuaaugggcagaaagu

SEQ ID NO: 256777 - RNA, 20 nt, Human
aacucagagaugaaaaagac

SEQ ID NO: 256778 - RNA, 22 nt, Human
ucagccuggugauuccucuguc

SEQ ID NO: 256779 - RNA, 22 nt, Human
aucuuucuccauauacaucuuu

SEQ ID NO: 256780 - RNA, 22 nt, Human
agaguggcccguuggccugaac

SEQ ID NO: 256781 - RNA, 22 nt, Human
aguguccuagcaagccgguccu

SEQ ID NO: 256782 - RNA, 22 nt, Human
ccagggaggguccuguggcuuc

SEQ ID NO: 256783 - RNA, 22 nt, Human
ucacagacgcauccucagguag

SEQ ID NO: 256784 - RNA, 22 nt, Human
uucucuagguuuuagaugaaga

SEQ ID NO: 256785 - RNA, 22 nt, Human
uuuagaaugugacuguauuuga

SEQ ID NO: 256786 - RNA, 22 nt, Human
cuuucacagcacaagccugccu

SEQ ID NO: 256787 - RNA, 22 nt, Human
cucugggaccauggcaagugcg

SEQ ID NO: 256788 - RNA, 22 nt, Human
uauuucugggaguucagaaauu

SEQ ID NO: 256789 - RNA, 22 nt, Human
gauuuucaugauaaacuuguga

SEQ ID NO: 256790 - RNA, 22 nt, Human
gggcuggcaggaccugggcuga

SEQ ID NO: 256791 - RNA, 22 nt, Human
ucucacaagcucaaggauuagu

SEQ ID NO: 256792 - RNA, 20 nt, Human
cauugcaaaguagcagacug

SEQ ID NO: 256793 - RNA, 22 nt, Human
uaaaucccuacaucuguguuuu

SEQ ID NO: 256794 - RNA, 16 nt, Human
guuccuucccacaccu

SEQ ID NO: 256795 - RNA, 22 nt, Human
ugacauguaagauggaaaagcg

SEQ ID NO: 256796 - RNA, 22 nt, Human
acugaggacagugaggagggcu

SEQ ID NO: 256797 - RNA, 22 nt, Human
ucuguggaguugaggaagguug

SEQ ID NO: 256798 - RNA, 22 nt, Human
ugcagaagaaugagcuuggagu

SEQ ID NO: 256799 - RNA, 22 nt, Human
caggucccugcgccccggccuc

SEQ ID NO: 256800 - RNA, 22 nt, Human
ucugugaacaucacauugacag

SEQ ID NO: 256801 - RNA, 22 nt, Human
acaggcuguugggguccagggu

SEQ ID NO: 256802 - RNA, 19 nt, Human
caucucugcaaggagcugc

SEQ ID NO: 256803 - RNA, 22 nt, Human
gagccgugccagcccugucucg

SEQ ID NO: 256804 - RNA, 22 nt, Human
ucuacccugcggucuuggggca

SEQ ID NO: 256805 - RNA, 22 nt, Human
gcugccucacuccagcccaaua

SEQ ID NO: 256806 - RNA, 19 nt, Human
uugaaauuguuugauaugg

SEQ ID NO: 256807 - RNA, 22 nt, Human
aacugcaaucacuuuugcacca

SEQ ID NO: 256808 - RNA, 22 nt, Human
gucaacaagugguuauugggau

SEQ ID NO: 256809 - RNA, 22 nt, Human
uuugucuuguguccuuaggacc

SEQ ID NO: 256810 - RNA, 22 nt, Human
gucaggaagcaagguugggcau

SEQ ID NO: 256811 - RNA, 22 nt, Human
acuuccagaauuagaauuuaag

SEQ ID NO: 256812 - RNA, 22 nt, Human
agucucaagggaugucucuaua

SEQ ID NO: 256813 - RNA, 22 nt, Human
cuuccucccggcccaugcucug

SEQ ID NO: 256814 - RNA, 22 nt, Human
ggcuuugcauuuugauggaggu

SEQ ID NO: 256815 - RNA, 19 nt, Human
gccaggagggcucuggcug

SEQ ID NO: 256816 - RNA, 22 nt, Human
uguggcugucuguucuccuagg

SEQ ID NO: 256817 - RNA, 18 nt, Human
gcucaggcccuagucagu

SEQ ID NO: 256818 - RNA, 22 nt, Human
uuauauguaugcuuauaaacca

SEQ ID NO: 256819 - RNA, 22 nt, Human
acuaguuugaaaauaucugauu

SEQ ID NO: 256820 - RNA, 22 nt, Human
ucugggagauccaagcagaacu

SEQ ID NO: 256821 - RNA, 22 nt, Human
uggcugaguuucaugcaucaug

SEQ ID NO: 256822 - RNA, 22 nt, Human
cugaggagagaucacguggugu

SEQ ID NO: 256823 - RNA, 22 nt, Human
ugagccaaggccucaagaauuu

SEQ ID NO: 256824 - RNA, 22 nt, Human
ucagggaaccucuccuguuucu

SEQ ID NO: 256825 - RNA, 22 nt, Human
uuauacagcauugcuagugaug

SEQ ID NO: 256826 - RNA, 22 nt, Human
uaaggcagugagaagaaacagg

SEQ ID NO: 256827 - RNA, 22 nt, Human
uucuccagaguuucucucacug

SEQ ID NO: 256828 - RNA, 22 nt, Human
aggaagggcuguuucuccaaga

SEQ ID NO: 256829 - RNA, 22 nt, Human
ucagggcccagagcucaggcaa

SEQ ID NO: 256830 - RNA, 22 nt, Human
augcuugcccauguuucugaag

SEQ ID NO: 256831 - RNA, 22 nt, Human
gggacuuaaugcagagagggac

SEQ ID NO: 256832 - RNA, 22 nt, Human
uuauaauucuggcauaggcugu

SEQ ID NO: 256833 - RNA, 22 nt, Human
ccauggcuaaguaucuguagaa

SEQ ID NO: 256834 - RNA, 22 nt, Human
aacacagcuaauuucugucaau

SEQ ID NO: 256835 - RNA, 16 nt, Human
gaggggagcaguaggc

SEQ ID NO: 256836 - RNA, 22 nt, Human
auuccaaaggcuggccuggagg

SEQ ID NO: 256837 - RNA, 22 nt, Human
ggaggcugagaggucgcagugg

SEQ ID NO: 256838 - RNA, 22 nt, Human
acaguuuaugguguuuuauaua

SEQ ID NO: 256839 - RNA, 22 nt, Human
cuuuuuguuguccacacuagga

SEQ ID NO: 256840 - RNA, 22 nt, Human
aaggaacucacagucuguuggg

SEQ ID NO: 256841 - RNA, 22 nt, Human
uagcaucuguucuuucauuaaa

SEQ ID NO: 256842 - RNA, 22 nt, Human
gcagaggagugauuaugccgug

SEQ ID NO: 256843 - RNA, 22 nt, Human
gagcugcacaucugaggcuaau

SEQ ID NO: 256844 - RNA, 22 nt, Human
ucaggaagaaagaagggagugu

SEQ ID NO: 256845 - RNA, 22 nt, Human
acaggcagagucagguuggguu

SEQ ID NO: 256846 - RNA, 22 nt, Human
cccugggaggcuuccaggcaga

SEQ ID NO: 256847 - RNA, 22 nt, Human
acaguaaugauucugagucucu

SEQ ID NO: 256848 - RNA, 22 nt, Human
uguaaagaaauagcauuuguag

SEQ ID NO: 256849 - RNA, 22 nt, Human
cucacauuccacuugugccaac

SEQ ID NO: 256850 - RNA, 22 nt, Human
agcugagaaucuuccccagugu

SEQ ID NO: 256851 - RNA, 22 nt, Human
gugaggcagagaugccaaaacu

SEQ ID NO: 256852 - RNA, 22 nt, Human
uagacugugagcuccuugaggg

SEQ ID NO: 256853 - RNA, 22 nt, Human
cuguguccucccgcugcaccca

SEQ ID NO: 256854 - RNA, 22 nt, Human
gcuucugcuguugaagccacca

SEQ ID NO: 256855 - RNA, 22 nt, Human
uugcauuguaggauguuagaag

SEQ ID NO: 256856 - RNA, 22 nt, Human
caugcuuugggucagaaaugcc

SEQ ID NO: 256857 - RNA, 21 nt, Human
ucucuccucaagcucgacccc

SEQ ID NO: 256858 - RNA, 22 nt, Human
uccugggaggaacauuuaccua

SEQ ID NO: 256859 - RNA, 22 nt, Human
cccucucccugcagaauguggc

SEQ ID NO: 256860 - RNA, 22 nt, Human
auguagcaugaggcacugugcc

SEQ ID NO: 256861 - RNA, 22 nt, Human
cuggcuccucuacacacccaaa

SEQ ID NO: 256862 - RNA, 20 nt, Human
uugcuuuaucagacaugaua

SEQ ID NO: 256863 - RNA, 22 nt, Human
guacauuucucccaacacuaaa

SEQ ID NO: 256864 - RNA, 22 nt, Human
ugcugaaagaccguauuuaucu

SEQ ID NO: 256865 - RNA, 22 nt, Human
ucugcaggauggaugcucagaa

SEQ ID NO: 256866 - RNA, 22 nt, Human
ggagcuggccgccuaugugcag

SEQ ID NO: 256867 - RNA, 22 nt, Human
aaaguuaguaaaaugggauaua

SEQ ID NO: 256868 - RNA, 22 nt, Human
uuuuucaucugauugauaacuc

SEQ ID NO: 256869 - RNA, 22 nt, Human
aagcaggagagccugggugagc

SEQ ID NO: 256870 - RNA, 22 nt, Human
agcuguaugcccaagaugcuau

SEQ ID NO: 256871 - RNA, 22 nt, Human
cuuugucauuuugucucucagu

SEQ ID NO: 256872 - RNA, 22 nt, Human
guaucuuuugguggaaaaauaa

SEQ ID NO: 256873 - RNA, 22 nt, Human
ccacagcaugcaggccugacac

SEQ ID NO: 256874 - RNA, 22 nt, Human
guuaacauaggaguuuguugua

SEQ ID NO: 256875 - RNA, 22 nt, Human
agggccuccagggcagcagugg

SEQ ID NO: 256876 - RNA, 22 nt, Human
uuaguuaaaauucugcugacau

SEQ ID NO: 256877 - RNA, 22 nt, Human
ugcauuaaaaccaucgaccauc

SEQ ID NO: 256878 - RNA, 22 nt, Human
ugcaaggcacccacucugcuuu

SEQ ID NO: 256879 - RNA, 22 nt, Human
ccaguccagugccaugcauggc

SEQ ID NO: 256880 - RNA, 22 nt, Human
gccugaccucuucugcccuggg

SEQ ID NO: 256881 - RNA, 22 nt, Human
ccagcucucaaggcucccuggg

SEQ ID NO: 256882 - RNA, 22 nt, Human
gaugggguuuugccaggcuggu

SEQ ID NO: 256883 - RNA, 22 nt, Human
uugucaagauugagagaugacu

SEQ ID NO: 256884 - RNA, 22 nt, Human
uagcuuuaagaugagaugugga

SEQ ID NO: 256885 - RNA, 22 nt, Human
aaaagagucuuaggcagucaua

SEQ ID NO: 256886 - RNA, 22 nt, Human
gccugguggacacugggcauca

SEQ ID NO: 256887 - RNA, 22 nt, Human
augggggccugaacaggcaaaa

SEQ ID NO: 256888 - RNA, 22 nt, Human
augggaggcaaagaucgcagaa

SEQ ID NO: 256889 - RNA, 22 nt, Human
agauauuaaucguacauaaggu

SEQ ID NO: 256890 - RNA, 22 nt, Human
gggaagaguaacuagcccaugu

SEQ ID NO: 256891 - RNA, 22 nt, Human
gcagaugggagccccaggggag

SEQ ID NO: 256892 - RNA, 22 nt, Human
ucagggccaucuuuugccucaa

SEQ ID NO: 256893 - RNA, 22 nt, Human
agggaaagguagugaggucaca

SEQ ID NO: 256894 - RNA, 20 nt, Human
augcaucugguaucuuuccu

SEQ ID NO: 256895 - RNA, 22 nt, Human
gcucagguguuaccuccucuag

SEQ ID NO: 256896 - RNA, 22 nt, Human
cagggcucccucuggcucccag

SEQ ID NO: 256897 - RNA, 22 nt, Human
cauaaugucugacacaguaaga

SEQ ID NO: 256898 - RNA, 19 nt, Human
aggcuaguguuacaccugc

SEQ ID NO: 256899 - RNA, 22 nt, Human
cagggccugagggcugcucugc

SEQ ID NO: 256900 - RNA, 22 nt, Human
auauauaaccuggauaaggcuu

SEQ ID NO: 256901 - RNA, 22 nt, Human
gcucaggggaaugggcugccgu

SEQ ID NO: 256902 - RNA, 22 nt, Human
cccagugucauucuaagggagg

SEQ ID NO: 256903 - RNA, 22 nt, Human
uuucuaagugaacauucaaguu

SEQ ID NO: 256904 - RNA, 22 nt, Human
aauagcuuucucaugacuucac

SEQ ID NO: 256905 - RNA, 22 nt, Human
ggcuuuauuucacuguaccaua

SEQ ID NO: 256906 - RNA, 22 nt, Human
uugcagcuucuugcaucagaaa

SEQ ID NO: 256907 - RNA, 22 nt, Human
cauggccccaaaucccaugcau

SEQ ID NO: 256908 - RNA, 22 nt, Human
uaggguccugccuacagagaca

SEQ ID NO: 256909 - RNA, 22 nt, Human
aggagcugugaaugggaggggu

SEQ ID NO: 256910 - RNA, 22 nt, Human
gcagagaaggauugaaaccaga

SEQ ID NO: 256911 - RNA, 23 nt, Human
agaaguggaauggccgugggguc

SEQ ID NO: 256912 - RNA, 22 nt, Human
guggccuggcuggcaccaccuc

SEQ ID NO: 256913 - RNA, 22 nt, Human
uacuucugccuuagagaacacu

SEQ ID NO: 256914 - RNA, 22 nt, Human
agacaauauauaauuuuaguug

SEQ ID NO: 256915 - RNA, 22 nt, Human
ccuugagaggaaguuuguagaa

SEQ ID NO: 256916 - RNA, 22 nt, Human
uggcagagacaaggccgggccu

SEQ ID NO: 256917 - RNA, 18 nt, Human
ccauggcucccuccugcc

SEQ ID NO: 256918 - RNA, 22 nt, Human
aucucugguccaaauguuaccu

SEQ ID NO: 256919 - RNA, 19 nt, Human
cagaggcacuuucucuuag

SEQ ID NO: 256920 - RNA, 22 nt, Human
cguccucagaggccauccgaaa

SEQ ID NO: 256921 - RNA, 22 nt, Human
aaugagucaugaagauuagcaa

SEQ ID NO: 256922 - RNA, 22 nt, Human
aggcagguuggugagaagacug

SEQ ID NO: 256923 - RNA, 18 nt, Human
agcaagcaguuuucaugu

SEQ ID NO: 256924 - RNA, 22 nt, Human
gacaagacaugugaugacauca

SEQ ID NO: 256925 - RNA, 22 nt, Human
uacaguaacauguuguacaagc

SEQ ID NO: 256926 - RNA, 22 nt, Human
auaaaaggaaagccuguuguga

SEQ ID NO: 256927 - RNA, 22 nt, Human
aggcauggggcugcagucaggu

SEQ ID NO: 256928 - RNA, 22 nt, Human
aggaagcuuggggcagggcuac

SEQ ID NO: 256929 - RNA, 22 nt, Human
gggcugugaggugagaacuuac

SEQ ID NO: 256930 - RNA, 22 nt, Human
uacucaguuuaugauuucaagu

SEQ ID NO: 256931 - RNA, 22 nt, Human
ugucucagggcagcagcagggg

SEQ ID NO: 256932 - RNA, 22 nt, Human
acuccagggguugcuauuuaca

SEQ ID NO: 256933 - RNA, 22 nt, Human
gggcaggugugcagagcuguug

SEQ ID NO: 256934 - RNA, 22 nt, Human
agcuuugcagcugugggaggag

SEQ ID NO: 256935 - RNA, 22 nt, Human
aaaugcacaggagaaccaauuc

SEQ ID NO: 256936 - RNA, 22 nt, Human
uaacaguauccccauuugcaag

SEQ ID NO: 256937 - RNA, 22 nt, Human
uuuguuuagaugguaaaucagu

SEQ ID NO: 256938 - RNA, 22 nt, Human
uccagccucauuucuccugcuu

SEQ ID NO: 256939 - RNA, 22 nt, Human
acuuguucauugaguacauaug

SEQ ID NO: 256940 - RNA, 22 nt, Human
cuaaagacacaauaaguagcuu

SEQ ID NO: 256941 - RNA, 22 nt, Human
ccugaggacacacgcugcagga

SEQ ID NO: 256942 - RNA, 22 nt, Human
agcaacagggggauggccacug

SEQ ID NO: 256943 - RNA, 22 nt, Human
uccccacacagauacagaguag

SEQ ID NO: 256944 - RNA, 22 nt, Human
uacuaguuuuuaggaaaaguga

SEQ ID NO: 256945 - RNA, 22 nt, Human
cagaauccagaauugcugaggu

SEQ ID NO: 256946 - RNA, 22 nt, Human
gaggagagggcugcgggcccac

SEQ ID NO: 256947 - RNA, 22 nt, Human
cuuuuucuaaucauaauugucu

SEQ ID NO: 256948 - RNA, 22 nt, Human
ucugcagaaggaaucagcugag

SEQ ID NO: 256949 - RNA, 22 nt, Human
accagucuguuguugcagagug

SEQ ID NO: 256950 - RNA, 22 nt, Human
gccaggcauuuauugauugaau

SEQ ID NO: 256951 - RNA, 22 nt, Human
ucacaggacccugaggguggcg

SEQ ID NO: 256952 - RNA, 22 nt, Human
cuggcaccaggcaugcugggag

SEQ ID NO: 256953 - RNA, 22 nt, Human
gugggggcuggaaaucuugcca

SEQ ID NO: 256954 - RNA, 22 nt, Human
aagcacauuguacauuugugcu

SEQ ID NO: 256955 - RNA, 22 nt, Human
ugccugucucugacugccauua

SEQ ID NO: 256956 - RNA, 22 nt, Human
cugccugggccaugcccagucc

SEQ ID NO: 256957 - RNA, 22 nt, Human
ggcaaacaccaggcgagggagc

SEQ ID NO: 256958 - RNA, 22 nt, Human
ucaguuaauggauucugucaga

SEQ ID NO: 256959 - RNA, 22 nt, Human
gacaauacagaaagggacaugc

SEQ ID NO: 256960 - RNA, 22 nt, Human
acaagcaguaaaggccacaguc

SEQ ID NO: 256961 - RNA, 22 nt, Human
cugcccgucccuuugcucucgc

SEQ ID NO: 256962 - RNA, 22 nt, Human
ggcuggcagaagugugcuggcu

SEQ ID NO: 256963 - RNA, 22 nt, Human
gagagcaggcucucgggggcca

SEQ ID NO: 256964 - RNA, 22 nt, Human
ucugaaaucuguaagcacuagc

SEQ ID NO: 256965 - RNA, 22 nt, Human
cuggccugugggcugucuccgg

SEQ ID NO: 256966 - RNA, 18 nt, Human
agcagguggauuuauugg

SEQ ID NO: 256967 - RNA, 22 nt, Human
guguguccaggcgggagucaag

SEQ ID NO: 256968 - RNA, 22 nt, Human
gcccugagugguaccugugggu

SEQ ID NO: 256969 - RNA, 22 nt, Human
ugaagacaagaaaacacugggg

SEQ ID NO: 256970 - RNA, 22 nt, Human
gcucugagauugagccuuuggu

SEQ ID NO: 256971 - RNA, 20 nt, Human
ucuuauacagaaaacauuuu

SEQ ID NO: 256972 - RNA, 18 nt, Human
gcagagcagaagcucaag

SEQ ID NO: 256973 - RNA, 21 nt, Human
cuacuuaaguaggggauuagg

SEQ ID NO: 256974 - RNA, 22 nt, Human
uuugaaguaccugguucugacu

SEQ ID NO: 256975 - RNA, 19 nt, Human
agucucaguguacagaggc

SEQ ID NO: 256976 - RNA, 22 nt, Human
acaccagccucgcccguguguu

SEQ ID NO: 256977 - RNA, 22 nt, Human
ugcucagggagcuuccuggugg

SEQ ID NO: 256978 - RNA, 22 nt, Human
ucaggaaauggugauuugguug

SEQ ID NO: 256979 - RNA, 22 nt, Human
cagggagcuggcuggcugugcc

SEQ ID NO: 256980 - RNA, 22 nt, Human
agacauauauugcaauucacug

SEQ ID NO: 256981 - RNA, 22 nt, Human
uaccuggcagucagucuuuccg

SEQ ID NO: 256982 - RNA, 22 nt, Human
aagucuuuuguucaggcuggca

SEQ ID NO: 256983 - RNA, 22 nt, Human
gcuuuaaaccucuacucugucc

SEQ ID NO: 256984 - RNA, 17 nt, Human
gccuuccuuccuccaca

SEQ ID NO: 256985 - RNA, 22 nt, Human
uucuguguugugacauucuaga

SEQ ID NO: 256986 - RNA, 22 nt, Human
acacggcacuuuaggaaggggc

SEQ ID NO: 256987 - RNA, 22 nt, Human
ugucugugauuuaggccagggc

SEQ ID NO: 256988 - RNA, 22 nt, Human
agcuucuggaagccuggcagca

SEQ ID NO: 256989 - RNA, 22 nt, Human
ccugggccuugaccucgugggc

SEQ ID NO: 256990 - RNA, 20 nt, Human
cucuggaagaguuuaaaugg

SEQ ID NO: 256991 - RNA, 22 nt, Human
ugcuggaggccagaagucugag

SEQ ID NO: 256992 - RNA, 22 nt, Human
uagggaugauggagccuaugua

SEQ ID NO: 256993 - RNA, 22 nt, Human
ccuaggcccuaggcuuccauca

SEQ ID NO: 256994 - RNA, 22 nt, Human
ucccaggcuaggccucugcguu

SEQ ID NO: 256995 - RNA, 22 nt, Human
auccaaaccuggacaugagugg

SEQ ID NO: 256996 - RNA, 19 nt, Human
acagccuguugguggggcu

SEQ ID NO: 256997 - RNA, 22 nt, Human
cugagaggggaccaggguguuu

SEQ ID NO: 256998 - RNA, 22 nt, Human
cuccugggcucauaucauucag

SEQ ID NO: 256999 - RNA, 22 nt, Human
uuggcuggcuucucgacuuguu

SEQ ID NO: 257000 - RNA, 22 nt, Human
agcuguuuguacuuagauagua

SEQ ID NO: 257001 - RNA, 22 nt, Human
ucauucagguugggcaaguguc

SEQ ID NO: 257002 - RNA, 22 nt, Human
uucaugugaauauauuugucuu

SEQ ID NO: 257003 - RNA, 22 nt, Human
uuaugacaggaaaaucacagaa

SEQ ID NO: 257004 - RNA, 22 nt, Human
gagcucagguggucaaaacaau

SEQ ID NO: 257005 - RNA, 22 nt, Human
caugguuuuuacccuacaccau

SEQ ID NO: 257006 - RNA, 22 nt, Human
ucuuagcagugcugagaagaau

SEQ ID NO: 257007 - RNA, 22 nt, Human
cuucccaguucugcuugagggg

SEQ ID NO: 257008 - RNA, 22 nt, Human
cucaggaggccauucucaaggu

SEQ ID NO: 257009 - RNA, 22 nt, Human
accuguuuggaggagguguuag

SEQ ID NO: 257010 - RNA, 22 nt, Human
ggagccugacagugcccagcau

SEQ ID NO: 257011 - RNA, 22 nt, Human
auuuugaaauacuugaaggaaa

SEQ ID NO: 257012 - RNA, 21 nt, Human
ccagcuuucccaagucccuuu

SEQ ID NO: 257013 - RNA, 22 nt, Human
auagagcuauaagaauuuugug

SEQ ID NO: 257014 - RNA, 22 nt, Human
cuuucuuccauagggcccaguc

SEQ ID NO: 257015 - RNA, 22 nt, Human
cagcugagcucccaggccauca

SEQ ID NO: 257016 - RNA, 22 nt, Human
ccugagagagaagcgaccuggu

SEQ ID NO: 257017 - RNA, 22 nt, Human
gugcaaaaguaauugcaguacu

SEQ ID NO: 257018 - RNA, 22 nt, Human
aagcuacauuaagcagauuuac

SEQ ID NO: 257019 - RNA, 21 nt, Human
agcuggcagugccuggaccuc

SEQ ID NO: 257020 - RNA, 21 nt, Human
uugcacagaaaaccauagaga

SEQ ID NO: 257021 - RNA, 22 nt, Human
gccuguuuguuaugucauggua

SEQ ID NO: 257022 - RNA, 22 nt, Human
aaugaguuauuuaauagaaagg

SEQ ID NO: 257023 - RNA, 22 nt, Human
cacugucuuuugugaagacaau

SEQ ID NO: 257024 - RNA, 22 nt, Human
acaguaauuaaaauggaucugc

SEQ ID NO: 257025 - RNA, 18 nt, Human
agugucuggauauuuggg

SEQ ID NO: 257026 - RNA, 22 nt, Human
gggccaugagagguucaucaac

SEQ ID NO: 257027 - RNA, 21 nt, Human
ugcaggcaggcagagaugcug

SEQ ID NO: 257028 - RNA, 22 nt, Human
auguuuccauuuucuuguauca

SEQ ID NO: 257029 - RNA, 22 nt, Human
uuuggaauucugcagcucaugu

SEQ ID NO: 257030 - RNA, 22 nt, Human
ucugccugugguggaggaaguu

SEQ ID NO: 257031 - RNA, 22 nt, Human
gagggagggacuagcauucucu

SEQ ID NO: 257032 - RNA, 22 nt, Human
aauuguaacuacauugagaaca

SEQ ID NO: 257033 - RNA, 22 nt, Human
cuuccuggcaugggucucauga

SEQ ID NO: 257034 - RNA, 22 nt, Human
ugugaaaaaaguucuagaagga

SEQ ID NO: 257035 - RNA, 21 nt, Human
uggcuucugccaauguuaaga

SEQ ID NO: 257036 - RNA, 22 nt, Human
augcaugagucacucagugcag

SEQ ID NO: 257037 - RNA, 22 nt, Human
uaaaggaagaauucucugugau

SEQ ID NO: 257038 - RNA, 20 nt, Human
cccagagccauagccagaca

SEQ ID NO: 257039 - RNA, 22 nt, Human
caucaucucuggcccuugaagu

SEQ ID NO: 257040 - RNA, 22 nt, Human
uuucgagggccuuaaguauucc

SEQ ID NO: 257041 - RNA, 23 nt, Human
ucagaacaguucuuggugcauag

SEQ ID NO: 257042 - RNA, 22 nt, Human
ugcaggugccaucgcugcucau

SEQ ID NO: 257043 - RNA, 22 nt, Human
uuccugugguguuucccagaca

SEQ ID NO: 257044 - RNA, 22 nt, Human
uaacacugugguguucuuuguc

SEQ ID NO: 257045 - RNA, 22 nt, Human
uguguacacaaugauugcagag

SEQ ID NO: 257046 - RNA, 22 nt, Human
ccugcccacagagagggugcau

SEQ ID NO: 257047 - RNA, 22 nt, Human
uguggggccucgugcuagcugg

SEQ ID NO: 257048 - RNA, 20 nt, Human
ugcuuuaugcuauacuuugu

SEQ ID NO: 257049 - RNA, 22 nt, Human
agugggagcggcagucggggac

SEQ ID NO: 257050 - RNA, 19 nt, Human
ccuggcugcugugggaugc

SEQ ID NO: 257051 - RNA, 22 nt, Human
ucauugcagacuaacaaucuca

SEQ ID NO: 257052 - RNA, 22 nt, Human
cccaguguuccuugaggggcug

SEQ ID NO: 257053 - RNA, 22 nt, Human
acaugcuguccugucuuuguca

SEQ ID NO: 257054 - RNA, 22 nt, Human
uaggaaacaaagcuuagcagga

SEQ ID NO: 257055 - RNA, 19 nt, Human
gguccucagcagagcaugc

SEQ ID NO: 257056 - RNA, 19 nt, Human
agggaauccggcugaggga

SEQ ID NO: 257057 - RNA, 22 nt, Human
gggcuucuugccauggggacgg

SEQ ID NO: 257058 - RNA, 22 nt, Human
gauucuuaugagugaacuuuac

SEQ ID NO: 257059 - RNA, 22 nt, Human
acaguuuggcgugauugauagu

SEQ ID NO: 257060 - RNA, 22 nt, Human
aagcccuggcaaugucagauga

SEQ ID NO: 257061 - RNA, 22 nt, Human
guaguuauugcuguuuacuucu

SEQ ID NO: 257062 - RNA, 22 nt, Human
uucuggguuuacaucugacuuc

SEQ ID NO: 257063 - RNA, 18 nt, Human
uaagcaaugacauugcaa

SEQ ID NO: 257064 - RNA, 22 nt, Human
uggcuccucuucuggguguccc

SEQ ID NO: 257065 - RNA, 22 nt, Human
gggcaugcaggacuguggcaga

SEQ ID NO: 257066 - RNA, 22 nt, Human
ucucagggagggcgagucagcg

SEQ ID NO: 257067 - RNA, 22 nt, Human
ggagccagggaagcugcuuccu

SEQ ID NO: 257068 - RNA, 22 nt, Human
ggucccaaucuaaucacaugag

SEQ ID NO: 257069 - RNA, 22 nt, Human
gccaagccuguagacacaagcu

SEQ ID NO: 257070 - RNA, 22 nt, Human
acagcagaggaaaagucugaua

SEQ ID NO: 257071 - RNA, 22 nt, Human
ccucugggggcuuccuuacccu

SEQ ID NO: 257072 - RNA, 22 nt, Human
auuuuaacccucuuauauauac

SEQ ID NO: 257073 - RNA, 22 nt, Human
agggcgcugucuggccagcggu

SEQ ID NO: 257074 - RNA, 22 nt, Human
caagcaggaugaagcccaggga

SEQ ID NO: 257075 - RNA, 22 nt, Human
gaggagaggccaucguuguuau

SEQ ID NO: 257076 - RNA, 22 nt, Human
gaggaggcuuccgggaggcacg

SEQ ID NO: 257077 - RNA, 22 nt, Human
ucuuuggaucccaacuggcugg

SEQ ID NO: 257078 - RNA, 22 nt, Human
gcuggcaggagaaacggggugc

SEQ ID NO: 257079 - RNA, 22 nt, Human
uuuaaacaucuuguugccuuaa

SEQ ID NO: 257080 - RNA, 22 nt, Human
ccuccuggaggcucuaagggag

SEQ ID NO: 257081 - RNA, 22 nt, Human
aagcauggcugagugcaauggu

SEQ ID NO: 257082 - RNA, 22 nt, Human
ggucacauauccucgguuugga

SEQ ID NO: 257083 - RNA, 22 nt, Human
aaauagaaaccaacaaggucag

SEQ ID NO: 257084 - RNA, 19 nt, Human
cagaacagaggucauggcc

SEQ ID NO: 257085 - RNA, 22 nt, Human
gcugugcugcgggaggauuccg

SEQ ID NO: 257086 - RNA, 22 nt, Human
agacagacaugcuaguuuucuu

SEQ ID NO: 257087 - RNA, 22 nt, Human
ucucaaauauuuggagagagga

SEQ ID NO: 257088 - RNA, 22 nt, Human
uggggagugaugccucggauaa

SEQ ID NO: 257089 - RNA, 22 nt, Human
cuccugcaagccuccccaagca

SEQ ID NO: 257090 - RNA, 22 nt, Human
cugaaauauuuuaaucucagga

SEQ ID NO: 257091 - RNA, 22 nt, Human
gcaggagcuggaaagugauguu

SEQ ID NO: 257092 - RNA, 22 nt, Human
caggauggucucgaucuccuga

SEQ ID NO: 257093 - RNA, 17 nt, Human
agcagaagucagaggga

SEQ ID NO: 257094 - RNA, 22 nt, Human
uccuugagauuaauuaaucacc

SEQ ID NO: 257095 - RNA, 22 nt, Human
augaguaaaaccacuauuuaca

SEQ ID NO: 257096 - RNA, 22 nt, Human
auugugaauagugccgcaguaa

SEQ ID NO: 257097 - RNA, 17 nt, Human
auggcuuccauugacca

SEQ ID NO: 257098 - RNA, 22 nt, Human
uugcccagaguccacagcguac

SEQ ID NO: 257099 - RNA, 22 nt, Human
agauuugcggcuuuacuuugca

SEQ ID NO: 257100 - RNA, 18 nt, Human
gccagugcccuggcucac

SEQ ID NO: 257101 - RNA, 22 nt, Human
auuaaugucuaccaguugugug

SEQ ID NO: 257102 - RNA, 22 nt, Human
cauuaggguaauugaacacuua

SEQ ID NO: 257103 - RNA, 22 nt, Human
caggguagggcaagggaaccug

SEQ ID NO: 257104 - RNA, 22 nt, Human
uggcagcagacaucugaggucu

SEQ ID NO: 257105 - RNA, 22 nt, Human
agcucugccuugacaccuucuc

SEQ ID NO: 257106 - RNA, 22 nt, Human
gggcccucagucccaggccuuc

SEQ ID NO: 257107 - RNA, 18 nt, Human
ugaauuaguuugugguuu

SEQ ID NO: 257108 - RNA, 21 nt, Human
uccuggcuuuaugcuaccucu

SEQ ID NO: 257109 - RNA, 22 nt, Human
ucuuauaaaaggacucccauuu

SEQ ID NO: 257110 - RNA, 22 nt, Human
gcugacagcaaggggcugcccu

SEQ ID NO: 257111 - RNA, 22 nt, Human
ggcuggacugccucccagaguc

SEQ ID NO: 257112 - RNA, 22 nt, Human
gagcugggcacacgccacuuga

SEQ ID NO: 257113 - RNA, 22 nt, Human
caccugguucuagugaaagucu

SEQ ID NO: 257114 - RNA, 22 nt, Human
acaugauuggacuccuuccccu

SEQ ID NO: 257115 - RNA, 22 nt, Human
ucaccaggauugggcuguaggc

SEQ ID NO: 257116 - RNA, 22 nt, Human
gcuggagcugaguucccugggc

SEQ ID NO: 257117 - RNA, 22 nt, Human
uugaaucauuacaauagauaag

SEQ ID NO: 257118 - RNA, 22 nt, Human
aggacagagcccuaguuucaua

SEQ ID NO: 257119 - RNA, 21 nt, Human
ucagcagcaucugccuagagu

SEQ ID NO: 257120 - RNA, 22 nt, Human
gggagcugccaccaccccuggg

SEQ ID NO: 257121 - RNA, 18 nt, Human
agacccucuaagggcagu

SEQ ID NO: 257122 - RNA, 22 nt, Human
aggguucugccagugucuugag

SEQ ID NO: 257123 - RNA, 22 nt, Human
ugucaacaccaaagccucccag

SEQ ID NO: 257124 - RNA, 22 nt, Human
uggcugccuuucaccucaucuc

SEQ ID NO: 257125 - RNA, 22 nt, Human
cugcagggagguuccuuguucu

SEQ ID NO: 257126 - RNA, 22 nt, Human
gugaggagggcuggucccaggc

SEQ ID NO: 257127 - RNA, 22 nt, Human
aucugacaaggccacauauucu

SEQ ID NO: 257128 - RNA, 22 nt, Human
ugcugggcccagggagccucug

SEQ ID NO: 257129 - RNA, 22 nt, Human
ucccagccacagguguagcccu

SEQ ID NO: 257130 - RNA, 22 nt, Human
ucccuguauaucacaagggcua

SEQ ID NO: 257131 - RNA, 22 nt, Human
gagacaggccaggugguacuua

SEQ ID NO: 257132 - RNA, 22 nt, Human
gaggaugguaugaggcaagcaa

SEQ ID NO: 257133 - RNA, 22 nt, Human
agcugaaagugcuuugaggacu

SEQ ID NO: 257134 - RNA, 22 nt, Human
acauacauauguuuaaaugcau

SEQ ID NO: 257135 - RNA, 23 nt, Human
uggggagggaagucauuucugua

SEQ ID NO: 257136 - RNA, 22 nt, Human
cagaguguggcaucuuccaacu

SEQ ID NO: 257137 - RNA, 22 nt, Human
cagcaagagaggcagggcaaau

SEQ ID NO: 257138 - RNA, 22 nt, Human
cauucauaagacuuugcucuug

SEQ ID NO: 257139 - RNA, 22 nt, Human
gccuucagcggccgcucgcugc

SEQ ID NO: 257140 - RNA, 16 nt, Human
auuuccagauuaugca

SEQ ID NO: 257141 - RNA, 22 nt, Human
ccaggcagucaggguugugugu

SEQ ID NO: 257142 - RNA, 22 nt, Human
ugagacgaagucuugcucuguu

SEQ ID NO: 257143 - RNA, 19 nt, Human
aaaagucuauucaauuaca

SEQ ID NO: 257144 - RNA, 22 nt, Human
acagccaacgucuuucuuacuu

SEQ ID NO: 257145 - RNA, 22 nt, Human
gcuccuguccuuagccccagag

SEQ ID NO: 257146 - RNA, 22 nt, Human
auugcacaaacacagucagacu

SEQ ID NO: 257147 - RNA, 18 nt, Human
ggcugcuccucucccuac

SEQ ID NO: 257148 - RNA, 22 nt, Human
ucaggccaaagaaacagcauga

SEQ ID NO: 257149 - RNA, 22 nt, Human
ucaggagaaucagggcuguccu

SEQ ID NO: 257150 - RNA, 22 nt, Human
uaacaagauuuguaaaauugua

SEQ ID NO: 257151 - RNA, 21 nt, Human
gcuuucuguggacucugcacc

SEQ ID NO: 257152 - RNA, 22 nt, Human
cuguggcugcagccuugguccu

SEQ ID NO: 257153 - RNA, 22 nt, Human
uggucccauuguucugcccagg

SEQ ID NO: 257154 - RNA, 22 nt, Human
agcaagaugaaggauucaagac

SEQ ID NO: 257155 - RNA, 22 nt, Human
uagggcuuagaaaagaauuuac

SEQ ID NO: 257156 - RNA, 17 nt, Human
gagccacccugugcgag

SEQ ID NO: 257157 - RNA, 22 nt, Human
guuuauuauacaacaaaagcua

SEQ ID NO: 257158 - RNA, 22 nt, Human
cgugggaguggugggugcucag

SEQ ID NO: 257159 - RNA, 22 nt, Human
aaacaguggccaauucuggaga

SEQ ID NO: 257160 - RNA, 22 nt, Human
augcauuuguaaaauauaaucg

SEQ ID NO: 257161 - RNA, 22 nt, Human
auguuacacauaggcauaaaug

SEQ ID NO: 257162 - RNA, 22 nt, Human
uuuggcaaagaucaacauguua

SEQ ID NO: 257163 - RNA, 22 nt, Human
agaccugggugcccugugcuuu

SEQ ID NO: 257164 - RNA, 22 nt, Human
gaucucuguggacucuuagcac

SEQ ID NO: 257165 - RNA, 22 nt, Human
cuguuuauacgacagguggagg

SEQ ID NO: 257166 - RNA, 22 nt, Human
aagguguucagguuuucccauu

SEQ ID NO: 257167 - RNA, 21 nt, Human
uaagcaaggaaagggcagccc

SEQ ID NO: 257168 - RNA, 22 nt, Human
ucuucccuaaucaccaucuuca

SEQ ID NO: 257169 - RNA, 18 nt, Human
ggccagagggaggguccc

SEQ ID NO: 257170 - RNA, 22 nt, Human
uaaauuaugucacaugacucug

SEQ ID NO: 257171 - RNA, 22 nt, Human
gaaggcuucuccagggcuuacu

SEQ ID NO: 257172 - RNA, 21 nt, Human
cuggaggguagaguugggcug

SEQ ID NO: 257173 - RNA, 22 nt, Human
uccauacaguccacacggugca

SEQ ID NO: 257174 - RNA, 22 nt, Human
cagauuuacucccugcugcugc

SEQ ID NO: 257175 - RNA, 22 nt, Human
gccaaaguccuccagccaugca

SEQ ID NO: 257176 - RNA, 22 nt, Human
ggaaggagggcggcaaugauga

SEQ ID NO: 257177 - RNA, 22 nt, Human
agggaccucuucuugcagcuga

SEQ ID NO: 257178 - RNA, 22 nt, Human
acuguacucuucuagccaucug

SEQ ID NO: 257179 - RNA, 23 nt, Human
ugguaauagggagcagaagguag

SEQ ID NO: 257180 - RNA, 22 nt, Human
ccacaagugaaguacaccugcc

SEQ ID NO: 257181 - RNA, 22 nt, Human
acacaaacugcuagaaaauugg

SEQ ID NO: 257182 - RNA, 22 nt, Human
uugaaaauaucacaggagcagc

SEQ ID NO: 257183 - RNA, 22 nt, Human
uaaggccaggcuguggucggca

SEQ ID NO: 257184 - RNA, 22 nt, Human
gaggccuggguuaccuacucgu

SEQ ID NO: 257185 - RNA, 22 nt, Human
ccuuccagauguaagagcugau

SEQ ID NO: 257186 - RNA, 22 nt, Human
agggcucccgcgguguccggga

SEQ ID NO: 257187 - RNA, 21 nt, Human
ccuggcagaagccugauaugc

SEQ ID NO: 257188 - RNA, 22 nt, Human
cucacaggcaucucaucaggcu

SEQ ID NO: 257189 - RNA, 22 nt, Human
uggggcuggcacagucucuauu

SEQ ID NO: 257190 - RNA, 22 nt, Human
ucaggagaguguucaguggagg

SEQ ID NO: 257191 - RNA, 22 nt, Human
cugggccucauccagccacaac

SEQ ID NO: 257192 - RNA, 22 nt, Human
gcccuggauguacaggcauguu

SEQ ID NO: 257193 - RNA, 22 nt, Human
agaaacugacaggaaaugaauu

SEQ ID NO: 257194 - RNA, 22 nt, Human
ucucugugucuuagugaaggga

SEQ ID NO: 257195 - RNA, 23 nt, Human
uugcuugagcccaggaaguggag

SEQ ID NO: 257196 - RNA, 22 nt, Human
cguccagggcgggcuccccuca

SEQ ID NO: 257197 - RNA, 22 nt, Human
cccauauacuuuuucuggucca

SEQ ID NO: 257198 - RNA, 22 nt, Human
gagcuucagcugccaugacugu

SEQ ID NO: 257199 - RNA, 22 nt, Human
cagcugaauucuucagacucca

SEQ ID NO: 257200 - RNA, 22 nt, Human
cuggcucaccuccgcuccagca

SEQ ID NO: 257201 - RNA, 22 nt, Human
uaaggcuuuuguucagcguggg

SEQ ID NO: 257202 - RNA, 21 nt, Human
uaaauaauaaguugcugagau

SEQ ID NO: 257203 - RNA, 22 nt, Human
uauguacauggagagcaauuga

SEQ ID NO: 257204 - RNA, 22 nt, Human
cuacccuuaaguuucugugggg

SEQ ID NO: 257205 - RNA, 22 nt, Human
gguguccuuguugaacgaaaau

SEQ ID NO: 257206 - RNA, 22 nt, Human
gcuucugcgccuagccucaggu

SEQ ID NO: 257207 - RNA, 22 nt, Human
ucuuguauguguauuuugcugu

SEQ ID NO: 257208 - RNA, 21 nt, Human
cacagagauauuggugagccu

SEQ ID NO: 257209 - RNA, 21 nt, Human
uggcugagccaggugugugga

SEQ ID NO: 257210 - RNA, 22 nt, Human
cacagugugacugaccuucagc

SEQ ID NO: 257211 - RNA, 22 nt, Human
aaugcacaugucuuggccucac

SEQ ID NO: 257212 - RNA, 20 nt, Human
gagggcucguggauggauaa

SEQ ID NO: 257213 - RNA, 22 nt, Human
cccgagugucuacucacuccca

SEQ ID NO: 257214 - RNA, 22 nt, Human
agagauggauguuauuaugggu

SEQ ID NO: 257215 - RNA, 22 nt, Human
aagcagagcaagcguauuuauu

SEQ ID NO: 257216 - RNA, 19 nt, Human
agcugcagaccagaagugc

SEQ ID NO: 257217 - RNA, 22 nt, Human
gaccucagauuuucccaggcca

SEQ ID NO: 257218 - RNA, 22 nt, Human
aggacacaggcaggaggagauc

SEQ ID NO: 257219 - RNA, 22 nt, Human
agcuggcuaugcccugugaacc

SEQ ID NO: 257220 - RNA, 22 nt, Human
gagucaggcaugaagguaauua

SEQ ID NO: 257221 - RNA, 22 nt, Human
gucauauacacugcauguaauc

SEQ ID NO: 257222 - RNA, 22 nt, Human
caggcccucguggugagcuggg

SEQ ID NO: 257223 - RNA, 22 nt, Human
ccagcuuuggaguguuguugcu

SEQ ID NO: 257224 - RNA, 22 nt, Human
gcccagggcagggcaagaguga

SEQ ID NO: 257225 - RNA, 22 nt, Human
uauaauauuccuuguuguaggu

SEQ ID NO: 257226 - RNA, 22 nt, Human
gcucucugcaagucagcagccu

SEQ ID NO: 257227 - RNA, 22 nt, Human
ccagcccuguuuaugugucacu

SEQ ID NO: 257228 - RNA, 22 nt, Human
uaauuaacauacaaaacagcug

SEQ ID NO: 257229 - RNA, 22 nt, Human
ugcagggccaugguggcggcug

SEQ ID NO: 257230 - RNA, 22 nt, Human
uauuuugacuauuaaaccaaca

SEQ ID NO: 257231 - RNA, 22 nt, Human
acuguaaaaugagauauguaua

SEQ ID NO: 257232 - RNA, 22 nt, Human
ccucugcccuuuuccuguauca

SEQ ID NO: 257233 - RNA, 22 nt, Human
gucuuuauuugagauugucauu

SEQ ID NO: 257234 - RNA, 22 nt, Human
aaagcaguaguuuucaaauagu

SEQ ID NO: 257235 - RNA, 22 nt, Human
uaggugucaggccuccuccagc

SEQ ID NO: 257236 - RNA, 19 nt, Human
auuuauuguaugauuccau

SEQ ID NO: 257237 - RNA, 22 nt, Human
acugucuuuauuagaaucuuau

SEQ ID NO: 257238 - RNA, 22 nt, Human
agaguguaccaaauauccuaca

SEQ ID NO: 257239 - RNA, 22 nt, Human
auggcagaaaggcaugugggcc

SEQ ID NO: 257240 - RNA, 22 nt, Human
agauuagguaugguuuaaguag

SEQ ID NO: 257241 - RNA, 22 nt, Human
ugggaguccaagguuuuuauag

SEQ ID NO: 257242 - RNA, 23 nt, Human
ccucccaggcugcgagucccgag

SEQ ID NO: 257243 - RNA, 22 nt, Human
uggaagaauguuugccuuauaa

SEQ ID NO: 257244 - RNA, 22 nt, Human
ugugaaaggggucacagggaaa

SEQ ID NO: 257245 - RNA, 22 nt, Human
uggcuuccugcacagugucugc

SEQ ID NO: 257246 - RNA, 22 nt, Human
uguguauuaccauuuuacagcu

SEQ ID NO: 257247 - RNA, 22 nt, Human
uuagaaaucaccucugaagauc

SEQ ID NO: 257248 - RNA, 22 nt, Human
uuggcugcuuuacucugacggg

SEQ ID NO: 257249 - RNA, 22 nt, Human
aggacaugugccuccagggcag

SEQ ID NO: 257250 - RNA, 19 nt, Human
guucuuucauaguaagagc

SEQ ID NO: 257251 - RNA, 22 nt, Human
gaggaguggaguugcuggguug

SEQ ID NO: 257252 - RNA, 20 nt, Human
ugcagcacgggcccuuucca

SEQ ID NO: 257253 - RNA, 20 nt, Human
uauuuacaacuuagagccuc

SEQ ID NO: 257254 - RNA, 21 nt, Human
ggcuggucgcgugcaugucuc

SEQ ID NO: 257255 - RNA, 21 nt, Human
aagcaggacauaugaugcccu

SEQ ID NO: 257256 - RNA, 22 nt, Human
ucagcacuuggauuucagagau

SEQ ID NO: 257257 - RNA, 23 nt, Human
cugggcuguccugaggucaccuc

SEQ ID NO: 257258 - RNA, 22 nt, Human
agucucagaaaagaagcaugga

SEQ ID NO: 257259 - RNA, 19 nt, Human
agaaucaucuugaagugau

SEQ ID NO: 257260 - RNA, 22 nt, Human
ccacaucugcagucccuucugu

SEQ ID NO: 257261 - RNA, 22 nt, Human
ucugucugagggagugacauuu

SEQ ID NO: 257262 - RNA, 22 nt, Human
ucagcacugauagaagucaaua

SEQ ID NO: 257263 - RNA, 22 nt, Human
aaggaacuuggugcccgugccc

SEQ ID NO: 257264 - RNA, 22 nt, Human
uuggcagaaugggcagcuugag

SEQ ID NO: 257265 - RNA, 22 nt, Human
ugcuggccugggcugcaccuug

SEQ ID NO: 257266 - RNA, 22 nt, Human
uuggcagaugaacacaacugga

SEQ ID NO: 257267 - RNA, 18 nt, Human
ucugaaagcaccggugaa

SEQ ID NO: 257268 - RNA, 22 nt, Human
cagggcuguggcuuugugcugu

SEQ ID NO: 257269 - RNA, 22 nt, Human
cuuccuggcucggugccucacc

SEQ ID NO: 257270 - RNA, 19 nt, Human
uaauaagcaauauggaagu

SEQ ID NO: 257271 - RNA, 22 nt, Human
gcaacacaauaucccaguacau

SEQ ID NO: 257272 - RNA, 22 nt, Human
ccuggacucagaggugcuggug

SEQ ID NO: 257273 - RNA, 22 nt, Human
uaacacaugguucugucaggaa

SEQ ID NO: 257274 - RNA, 22 nt, Human
caagauguuaaaaccacccuug

SEQ ID NO: 257275 - RNA, 22 nt, Human
uucccucugcgcauugaauuuc

SEQ ID NO: 257276 - RNA, 22 nt, Human
gccccagccaaggugacacgaa

SEQ ID NO: 257277 - RNA, 22 nt, Human
ccuccucuggugcugccaaccc

SEQ ID NO: 257278 - RNA, 22 nt, Human
ucugaggaccaucggggagcug

SEQ ID NO: 257279 - RNA, 18 nt, Human
ggcggguguuuuauucac

SEQ ID NO: 257280 - RNA, 17 nt, Human
ggccuguguggcugcag

SEQ ID NO: 257281 - RNA, 22 nt, Human
uaaacaugugagugugcauaua

SEQ ID NO: 257282 - RNA, 22 nt, Human
cauuuaagagaaauauuuaguu

SEQ ID NO: 257283 - RNA, 22 nt, Human
cacgcgcacacucaggucaagu

SEQ ID NO: 257284 - RNA, 22 nt, Human
gggagagaaauuauagcaauga

SEQ ID NO: 257285 - RNA, 22 nt, Human
cugcagcaucgccaccugccuc

SEQ ID NO: 257286 - RNA, 22 nt, Human
auggcuggaggccgggcuuccu

SEQ ID NO: 257287 - RNA, 22 nt, Human
aaagacacacagccagcaagug

SEQ ID NO: 257288 - RNA, 22 nt, Human
cccuggcauaaaacuucuccag

SEQ ID NO: 257289 - RNA, 22 nt, Human
uuuauugggugcagugcccaca

SEQ ID NO: 257290 - RNA, 22 nt, Human
cacugcucgcugcagcauggcc

SEQ ID NO: 257291 - RNA, 22 nt, Human
uggcacagagggacccagcagc

SEQ ID NO: 257292 - RNA, 22 nt, Human
aggccaugggauuuccaauugg

SEQ ID NO: 257293 - RNA, 22 nt, Human
cagccgucagaugugccgcagc

SEQ ID NO: 257294 - RNA, 22 nt, Human
uaauucuagauugacauuuuga

SEQ ID NO: 257295 - RNA, 22 nt, Human
ucaucucagagagguauguuag

SEQ ID NO: 257296 - RNA, 22 nt, Human
ugaggccagugacauauauuaa

SEQ ID NO: 257297 - RNA, 22 nt, Human
guacaauuauuuaaauggugaa

SEQ ID NO: 257298 - RNA, 22 nt, Human
ugcuggcaucuuaauguucugu

SEQ ID NO: 257299 - RNA, 22 nt, Human
auauuuuguaacuuggaauagg

SEQ ID NO: 257300 - RNA, 22 nt, Human
ugagucuagguagagaaaugca

SEQ ID NO: 257301 - RNA, 22 nt, Human
uguuuucuggguggaagguacu

SEQ ID NO: 257302 - RNA, 22 nt, Human
uucagcacuuuguuuugcucau

SEQ ID NO: 257303 - RNA, 22 nt, Human
aggaugagccgcgcaagcugac

SEQ ID NO: 257304 - RNA, 22 nt, Human
cagcugugaauugucuuaucua

SEQ ID NO: 257305 - RNA, 22 nt, Human
cagcucauuccucaaucuagga

SEQ ID NO: 257306 - RNA, 23 nt, Human
ugagucuugagcuuuggauucug

SEQ ID NO: 257307 - RNA, 22 nt, Human
gcagcagcucaguucugggagg

SEQ ID NO: 257308 - RNA, 22 nt, Human
uuagaauuucugcucacuuuga

SEQ ID NO: 257309 - RNA, 22 nt, Human
aaagagcacccucaaugucuga

SEQ ID NO: 257310 - RNA, 22 nt, Human
aagcugccuuccaugugaggaa

SEQ ID NO: 257311 - RNA, 22 nt, Human
gaguauucaauauauacaaaug

SEQ ID NO: 257312 - RNA, 22 nt, Human
gaaauuuauuaucuacaucauu

SEQ ID NO: 257313 - RNA, 22 nt, Human
aaaaugaggaacggaucauggc

SEQ ID NO: 257314 - RNA, 22 nt, Human
ucuagagacaaaggaaggaggg

SEQ ID NO: 257315 - RNA, 22 nt, Human
acacaggcauagccauacaugu

SEQ ID NO: 257316 - RNA, 22 nt, Human
uuucuguauuuaaaagaucugg

SEQ ID NO: 257317 - RNA, 22 nt, Human
ccagggaugccaagcuuuacca

SEQ ID NO: 257318 - RNA, 22 nt, Human
cugccucuauaggaguccacca

SEQ ID NO: 257319 - RNA, 22 nt, Human
ccugccagugccucccacuggu

SEQ ID NO: 257320 - RNA, 22 nt, Human
acagagcugggugcccccugga

SEQ ID NO: 257321 - RNA, 23 nt, Human
uccugcagauaagcugguugaca

SEQ ID NO: 257322 - RNA, 22 nt, Human
gccugggauagaggcaaugcau

SEQ ID NO: 257323 - RNA, 22 nt, Human
uccaggagguagugcuuaauuu

SEQ ID NO: 257324 - RNA, 22 nt, Human
caguuacacaccauugugaaca

SEQ ID NO: 257325 - RNA, 22 nt, Human
cagaaugggaaggacugcaguu

SEQ ID NO: 257326 - RNA, 17 nt, Human
uuacaacaauucaugag

SEQ ID NO: 257327 - RNA, 22 nt, Human
uugagggaacaugagaaucauc

SEQ ID NO: 257328 - RNA, 22 nt, Human
aucaguuuggugcuuucaguga

SEQ ID NO: 257329 - RNA, 22 nt, Human
gcuggcaguuuccucaccgagg

SEQ ID NO: 257330 - RNA, 22 nt, Human
ucaaggaauuuaguuuaguaaa

SEQ ID NO: 257331 - RNA, 22 nt, Human
cuauugcuuuugugugcuccca

SEQ ID NO: 257332 - RNA, 22 nt, Human
ccagaaaacucuacaugcuugu

SEQ ID NO: 257333 - RNA, 23 nt, Human
gggagcuguggugaaaagaggug

SEQ ID NO: 257334 - RNA, 22 nt, Human
gggugcagugguucacgccugu

SEQ ID NO: 257335 - RNA, 22 nt, Human
uggggcaguuaauaaacauucu

SEQ ID NO: 257336 - RNA, 22 nt, Human
cugcagaaauauggaugugaua

SEQ ID NO: 257337 - RNA, 22 nt, Human
ccaggucuucacuuuacugaag

SEQ ID NO: 257338 - RNA, 22 nt, Human
uagaaacauucaguugcagucc

SEQ ID NO: 257339 - RNA, 22 nt, Human
augugggagauuucaggaggug

SEQ ID NO: 257340 - RNA, 22 nt, Human
gaaaggcuugcuuuugcucggu

SEQ ID NO: 257341 - RNA, 22 nt, Human
ggccagcugggccaccaggugc

SEQ ID NO: 257342 - RNA, 22 nt, Human
gcauuuaaauuugaacuucaga

SEQ ID NO: 257343 - RNA, 22 nt, Human
gaaaguuucucacacaugcaga

SEQ ID NO: 257344 - RNA, 22 nt, Human
aacacucucuguugguaaggcu

SEQ ID NO: 257345 - RNA, 22 nt, Human
cugccucagcguuguggcccua

SEQ ID NO: 257346 - RNA, 22 nt, Human
gcagagcuggaacugguacuca

SEQ ID NO: 257347 - RNA, 22 nt, Human
acauuaaaauggagaauuuuga

SEQ ID NO: 257348 - RNA, 22 nt, Human
aagcugugaagagcaagugagg

SEQ ID NO: 257349 - RNA, 22 nt, Human
ugauuucucauauuguucaaaa

SEQ ID NO: 257350 - RNA, 22 nt, Human
agguccugugguuuggguaaaa

SEQ ID NO: 257351 - RNA, 22 nt, Human
gggaucugggacaacagguggu

SEQ ID NO: 257352 - RNA, 19 nt, Human
acagugucuguauauaaau

SEQ ID NO: 257353 - RNA, 22 nt, Human
caccaggcacauaguaggcacu

SEQ ID NO: 257354 - RNA, 22 nt, Human
cagggcaaagagagcacaugcu

SEQ ID NO: 257355 - RNA, 22 nt, Human
cacaguuuugucuugguuucca

SEQ ID NO: 257356 - RNA, 22 nt, Human
cuucuuugaaaaaggcagucag

SEQ ID NO: 257357 - RNA, 22 nt, Human
aacuucuggauguuucaaaugu

SEQ ID NO: 257358 - RNA, 22 nt, Human
ucucugagcucaggagcugcag

SEQ ID NO: 257359 - RNA, 17 nt, Human
caucaaagaaauuucca

SEQ ID NO: 257360 - RNA, 22 nt, Human
cugaggagucagcuuacucacu

SEQ ID NO: 257361 - RNA, 22 nt, Human
gcuaggaguggugggucaagga

SEQ ID NO: 257362 - RNA, 22 nt, Human
cugcaggaauucaaagugagcu

SEQ ID NO: 257363 - RNA, 22 nt, Human
ccagcauccucagcucacuucu

SEQ ID NO: 257364 - RNA, 22 nt, Human
uaaacagccuaaaacuuucuuu

SEQ ID NO: 257365 - RNA, 22 nt, Human
aacacagaucaaaauauuuccu

SEQ ID NO: 257366 - RNA, 22 nt, Human
uuggcauuuauucuaaggucaa

SEQ ID NO: 257367 - RNA, 17 nt, Human
agcuccugcccauggcu

SEQ ID NO: 257368 - RNA, 22 nt, Human
cagcaucuucuagauccaggcu

SEQ ID NO: 257369 - RNA, 22 nt, Human
ggaugggagcagaggacgacca

SEQ ID NO: 257370 - RNA, 22 nt, Human
uaaaguagcaaguuuagacuga

SEQ ID NO: 257371 - RNA, 22 nt, Human
gggcuccagcagaggcagccgg

SEQ ID NO: 257372 - RNA, 22 nt, Human
cccuaggcugaggccagggugc

SEQ ID NO: 257373 - RNA, 22 nt, Human
acucagagucaauguuaauggc

SEQ ID NO: 257374 - RNA, 22 nt, Human
gaaacauucagucaacaguguu

SEQ ID NO: 257375 - RNA, 21 nt, Human
aggcugcuggcucaggguccu

SEQ ID NO: 257376 - RNA, 22 nt, Human
uuacacaugcucacuuauuugu

SEQ ID NO: 257377 - RNA, 19 nt, Human
uuuucucagcuucuagcgg

SEQ ID NO: 257378 - RNA, 20 nt, Human
acaggaugccugccauuuca

SEQ ID NO: 257379 - RNA, 22 nt, Human
aauguguauacuggcaauuaag

SEQ ID NO: 257380 - RNA, 22 nt, Human
agccugcuugagaguccuggcu

SEQ ID NO: 257381 - RNA, 22 nt, Human
uaaucacaucaggguaaauggg

SEQ ID NO: 257382 - RNA, 22 nt, Human
ugcauuaagugucugcauaugg

SEQ ID NO: 257383 - RNA, 22 nt, Human
caguggccugagccaggcuucc

SEQ ID NO: 257384 - RNA, 22 nt, Human
gcaaagugaaauggggcagaga

SEQ ID NO: 257385 - RNA, 22 nt, Human
uuugaaauaugugaugagagag

SEQ ID NO: 257386 - RNA, 22 nt, Human
acaaaagcuuuuggaggguugu

SEQ ID NO: 257387 - RNA, 22 nt, Human
ugcuuccugaggccgucuucuc

SEQ ID NO: 257388 - RNA, 22 nt, Human
cauuugcuguauuuucagauuc

SEQ ID NO: 257389 - RNA, 20 nt, Human
acucaucuacuccagacccu

SEQ ID NO: 257390 - RNA, 22 nt, Human
uacagaaaucacaucgcuuuga

SEQ ID NO: 257391 - RNA, 22 nt, Human
cugggagcccugacuagccugg

SEQ ID NO: 257392 - RNA, 22 nt, Human
cuggcucccaugagcucucacg

SEQ ID NO: 257393 - RNA, 22 nt, Human
agggcugagugggagagaguug

SEQ ID NO: 257394 - RNA, 22 nt, Human
agcccaggcagagggaugcuug

SEQ ID NO: 257395 - RNA, 22 nt, Human
uauugguaugguaagaauugaa

SEQ ID NO: 257396 - RNA, 22 nt, Human
agaaucuacauuuuaacaagau

SEQ ID NO: 257397 - RNA, 22 nt, Human
cagguggguguaugaaugcaaa

SEQ ID NO: 257398 - RNA, 22 nt, Human
gaggccaaguuggagaccaggu

SEQ ID NO: 257399 - RNA, 22 nt, Human
gagacacucaacaaagauauga

SEQ ID NO: 257400 - RNA, 17 nt, Human
uguuaauuccaaugaua

SEQ ID NO: 257401 - RNA, 22 nt, Human
cuggugguucaggagaauggcu

SEQ ID NO: 257402 - RNA, 22 nt, Human
cacaauguguuggguuaaguuu

SEQ ID NO: 257403 - RNA, 17 nt, Human
cuucucuggcagaagau

SEQ ID NO: 257404 - RNA, 22 nt, Human
uauaguuaguuucauaaucaug

SEQ ID NO: 257405 - RNA, 22 nt, Human
ugccccucagggaacggguauc

SEQ ID NO: 257406 - RNA, 22 nt, Human
ccugggucuauagacuucaaga

SEQ ID NO: 257407 - RNA, 22 nt, Human
agaucauaugaaaaauuucaag

SEQ ID NO: 257408 - RNA, 22 nt, Human
ggcugccuuuagaacggaugcu

SEQ ID NO: 257409 - RNA, 22 nt, Human
cucccaggguagggagagacua

SEQ ID NO: 257410 - RNA, 22 nt, Human
ugcccagagccucuuaccucca

SEQ ID NO: 257411 - RNA, 22 nt, Human
cccaguggugcuggcaucugug

SEQ ID NO: 257412 - RNA, 22 nt, Human
gcaggugggagccgcugccuga

SEQ ID NO: 257413 - RNA, 22 nt, Human
uaugugcaaaaugcuagacuag

SEQ ID NO: 257414 - RNA, 22 nt, Human
guuuaucacaauaaauaauucu

SEQ ID NO: 257415 - RNA, 22 nt, Human
uagcaggugcucauuuaacucc

SEQ ID NO: 257416 - RNA, 19 nt, Human
aggaaggaaccugagucug

SEQ ID NO: 257417 - RNA, 22 nt, Human
auguuuacugguuuauagaaua

SEQ ID NO: 257418 - RNA, 23 nt, Human
agcuccagggaacaggcaguagg

SEQ ID NO: 257419 - RNA, 22 nt, Human
ugccuggcugggcugcucaugg

SEQ ID NO: 257420 - RNA, 22 nt, Human
ggaagagagaucccauagaugu

SEQ ID NO: 257421 - RNA, 22 nt, Human
agcauucauugcuagaauguaa

SEQ ID NO: 257422 - RNA, 22 nt, Human
uagaagaacaugucaaacuaua

SEQ ID NO: 257423 - RNA, 23 nt, Human
aaacugcaucucugagccucagc

SEQ ID NO: 257424 - RNA, 22 nt, Human
uuccugugcuuaauucucacug

SEQ ID NO: 257425 - RNA, 22 nt, Human
gcuguagguuuuuccaggaguu

SEQ ID NO: 257426 - RNA, 22 nt, Human
gaggcucaaaccuggacagagc

SEQ ID NO: 257427 - RNA, 22 nt, Human
ccugggcugcaugauggcauuu

SEQ ID NO: 257428 - RNA, 22 nt, Human
guuucacugcaaacugacuuuu

SEQ ID NO: 257429 - RNA, 22 nt, Human
cugggccugagcucugaagagu

SEQ ID NO: 257430 - RNA, 23 nt, Human
aaaguguagccagguuaagaacc

SEQ ID NO: 257431 - RNA, 23 nt, Human
cccugcagucagggugagauggu

SEQ ID NO: 257432 - RNA, 22 nt, Human
uacaagcuggcgcaguuaagau

SEQ ID NO: 257433 - RNA, 22 nt, Human
uuccaagugaaaguagcuuugu

SEQ ID NO: 257434 - RNA, 22 nt, Human
aucaaaaccuugacuuuuaaug

SEQ ID NO: 257435 - RNA, 22 nt, Human
cccagcucugccaucuacccac

SEQ ID NO: 257436 - RNA, 22 nt, Human
ggacugggagaauggaggcaag

SEQ ID NO: 257437 - RNA, 22 nt, Human
cugagcagcaccuucaagaaac

SEQ ID NO: 257438 - RNA, 22 nt, Human
uuguauauauucuuaaagaugu

SEQ ID NO: 257439 - RNA, 22 nt, Human
cugcagcuccuucuggcaugug

SEQ ID NO: 257440 - RNA, 20 nt, Human
caucuccugccuccauguuc

SEQ ID NO: 257441 - RNA, 22 nt, Human
cucagcaagauuaagcagcuug

SEQ ID NO: 257442 - RNA, 22 nt, Human
guacuucuuuagucaauaugua

SEQ ID NO: 257443 - RNA, 19 nt, Human
guguccauggagcauggag

SEQ ID NO: 257444 - RNA, 22 nt, Human
agcgcaggaacacgucugccuu

SEQ ID NO: 257445 - RNA, 22 nt, Human
agaugaaaagauaagcagcaau

SEQ ID NO: 257446 - RNA, 22 nt, Human
cuaaaugcccuacaaugacugg

SEQ ID NO: 257447 - RNA, 22 nt, Human
acacaguugauugucacucagg

SEQ ID NO: 257448 - RNA, 22 nt, Human
uacaguaaaugugguagaaacu

SEQ ID NO: 257449 - RNA, 22 nt, Human
aaggcuuuuaacuacuguuuua

SEQ ID NO: 257450 - RNA, 21 nt, Human
uggcagagugcagucuauaca

SEQ ID NO: 257451 - RNA, 22 nt, Human
ugcagcuucuuguccugugauu

SEQ ID NO: 257452 - RNA, 22 nt, Human
uuccuacaucaccagggggagu

SEQ ID NO: 257453 - RNA, 22 nt, Human
auugaaaauauaauucuaggag

SEQ ID NO: 257454 - RNA, 22 nt, Human
ggaucuggggcucugcugcuca

SEQ ID NO: 257455 - RNA, 22 nt, Human
caggugucggucaggcgguuuu

SEQ ID NO: 257456 - RNA, 22 nt, Human
gaggccagugugcuguguuuuc

SEQ ID NO: 257457 - RNA, 22 nt, Human
aguacaaacuguuucaaaguag

SEQ ID NO: 257458 - RNA, 22 nt, Human
aagaugcaugcugaagcuggcu

SEQ ID NO: 257459 - RNA, 22 nt, Human
uauagauagacugacgauacag

SEQ ID NO: 257460 - RNA, 22 nt, Human
ugucugagucaugcagagauau

SEQ ID NO: 257461 - RNA, 22 nt, Human
agcagggcagcugaugcgcacg

SEQ ID NO: 257462 - RNA, 22 nt, Human
uggcucaggauaauuuucccaa

SEQ ID NO: 257463 - RNA, 22 nt, Human
agccauggcgccacuagaggga

SEQ ID NO: 257464 - RNA, 22 nt, Human
gccagcagcucuugggcgggca

SEQ ID NO: 257465 - RNA, 22 nt, Human
auacaaauuuauagaugcauuu

SEQ ID NO: 257466 - RNA, 19 nt, Human
ucaaaggcuuuuaggagac

SEQ ID NO: 257467 - RNA, 20 nt, Human
agguuccagccacaaccagc

SEQ ID NO: 257468 - RNA, 22 nt, Human
uauucauggggguccagguacc

SEQ ID NO: 257469 - RNA, 22 nt, Human
ugcuuaucguuuaguacauugc

SEQ ID NO: 257470 - RNA, 22 nt, Human
acugcagggcauccuggccaag

SEQ ID NO: 257471 - RNA, 22 nt, Human
aagcccugggauguucagcagu

SEQ ID NO: 257472 - RNA, 22 nt, Human
auuucuaaagagggugguuugg

SEQ ID NO: 257473 - RNA, 20 nt, Human
gggaucuuccaggcucuccu

SEQ ID NO: 257474 - RNA, 22 nt, Human
agggggcaggagagaccugcug

SEQ ID NO: 257475 - RNA, 22 nt, Human
agagucuuggcugagaacaaga

SEQ ID NO: 257476 - RNA, 22 nt, Human
auaaaauuugcuacuguuaaau

SEQ ID NO: 257477 - RNA, 22 nt, Human
gacauucagguguucaaugcca

SEQ ID NO: 257478 - RNA, 22 nt, Human
aggcacuucucaaauucaugcc

SEQ ID NO: 257479 - RNA, 22 nt, Human
cugcucuggcuguguacuucag

SEQ ID NO: 257480 - RNA, 22 nt, Human
ggucucugagugaggaccuggg

SEQ ID NO: 257481 - RNA, 22 nt, Human
agguccaggagauuuggcaauu

SEQ ID NO: 257482 - RNA, 22 nt, Human
cugacuucagggauaaaaagua

SEQ ID NO: 257483 - RNA, 22 nt, Human
ucagaggucacacagcaaguuu

SEQ ID NO: 257484 - RNA, 22 nt, Human
cucagagaaaaggagcaagggu

SEQ ID NO: 257485 - RNA, 22 nt, Human
ccagacccuuucuuggcaugug

SEQ ID NO: 257486 - RNA, 22 nt, Human
gcugggcuugguuucccugcuu

SEQ ID NO: 257487 - RNA, 19 nt, Human
auuugaaagcugugcuugc

SEQ ID NO: 257488 - RNA, 22 nt, Human
acugugaacggacugaagccca

SEQ ID NO: 257489 - RNA, 23 nt, Human
accuagaaauacguuuuacaugg

SEQ ID NO: 257490 - RNA, 21 nt, Human
acaguagcugacacacaguuu

SEQ ID NO: 257491 - RNA, 22 nt, Human
ugucacaaaaaucaguaauugc

SEQ ID NO: 257492 - RNA, 22 nt, Human
auaaacugguaggaaaacagua

SEQ ID NO: 257493 - RNA, 22 nt, Human
auucucugaugcagguggaaga

SEQ ID NO: 257494 - RNA, 22 nt, Human
aagaugacagaugcuuagaguc

SEQ ID NO: 257495 - RNA, 22 nt, Human
cucaggccaauaagcuccagcc

SEQ ID NO: 257496 - RNA, 22 nt, Human
uugauucaaaacaggagguagg

SEQ ID NO: 257497 - RNA, 22 nt, Human
ggaaaagaaagggacugauugg

SEQ ID NO: 257498 - RNA, 22 nt, Human
ucuggugguauacaucuaggag

SEQ ID NO: 257499 - RNA, 22 nt, Human
ucagguguuuaaggauagugau

SEQ ID NO: 257500 - RNA, 22 nt, Human
guggcuucaccccaguugucuc

SEQ ID NO: 257501 - RNA, 23 nt, Human
ggcaccaggccauggagcgggag

SEQ ID NO: 257502 - RNA, 23 nt, Human
cccagaggagcagggcgugagau

SEQ ID NO: 257503 - RNA, 22 nt, Human
augcaguuuaucuccaaaucau

SEQ ID NO: 257504 - RNA, 22 nt, Human
aucgagggugaguacagcggac

SEQ ID NO: 257505 - RNA, 22 nt, Human
uggcauguauacuugaguagga

SEQ ID NO: 257506 - RNA, 16 nt, Human
aagccaguucagcauu

SEQ ID NO: 257507 - RNA, 16 nt, Human
uucuagaaaagaaggu

SEQ ID NO: 257508 - RNA, 22 nt, Human
uugagggagaaagcugaggugu

SEQ ID NO: 257509 - RNA, 22 nt, Human
cauuuauugaguggccacagug

SEQ ID NO: 257510 - RNA, 22 nt, Human
ucugaggagugacccucuugca

SEQ ID NO: 257511 - RNA, 22 nt, Human
uuaaagcuggcguuacaguuug

SEQ ID NO: 257512 - RNA, 22 nt, Human
ucucuuucuauaugugagucuu

SEQ ID NO: 257513 - RNA, 22 nt, Human
ugcuggagaacugcucuguguu

SEQ ID NO: 257514 - RNA, 22 nt, Human
aaugucuacauucugaauucgu

SEQ ID NO: 257515 - RNA, 22 nt, Human
aacuuccuucuaguucauaugu

SEQ ID NO: 257516 - RNA, 22 nt, Human
gagcccugcugggccuugucuc

SEQ ID NO: 257517 - RNA, 22 nt, Human
aggugggguguuggauguuuau

SEQ ID NO: 257518 - RNA, 22 nt, Human
aagauacauaaagguagagucu

SEQ ID NO: 257519 - RNA, 22 nt, Human
cugggcacuugcucacagcucu

SEQ ID NO: 257520 - RNA, 22 nt, Human
aucauuugaacagaauuuguuu

SEQ ID NO: 257521 - RNA, 19 nt, Human
auuugcuugucugcucugc

SEQ ID NO: 257522 - RNA, 22 nt, Human
ggaaggcuacaggaauccagcg

SEQ ID NO: 257523 - RNA, 22 nt, Human
uucuauugacauucacuguaac

SEQ ID NO: 257524 - RNA, 22 nt, Human
acuugguucuaacuaguguaua

SEQ ID NO: 257525 - RNA, 22 nt, Human
uacaagaaugucuuaaaagcuc

SEQ ID NO: 257526 - RNA, 22 nt, Human
gugcucagcccggaugagauca

SEQ ID NO: 257527 - RNA, 22 nt, Human
aaagugaggacuugaguacugu

SEQ ID NO: 257528 - RNA, 22 nt, Human
cccagagaaucuuucagaaagg

SEQ ID NO: 257529 - RNA, 22 nt, Human
uccuggcaguucagcccccuaa

SEQ ID NO: 257530 - RNA, 22 nt, Human
guggcccacacagacagcaucu

SEQ ID NO: 257531 - RNA, 22 nt, Human
uccauuuacuauucucauaucg

SEQ ID NO: 257532 - RNA, 22 nt, Human
gagggggaaagucccuggaguc

SEQ ID NO: 257533 - RNA, 21 nt, Human
ggaaagaaggcaaggcucagg

SEQ ID NO: 257534 - RNA, 22 nt, Human
caccacuucauaggcuuuaagg

SEQ ID NO: 257535 - RNA, 22 nt, Human
uugucuggucaaaucacuugua

SEQ ID NO: 257536 - RNA, 22 nt, Human
uuauucagcauuuagaggaagg

SEQ ID NO: 257537 - RNA, 22 nt, Human
agccuucaguaagggcuuagca

SEQ ID NO: 257538 - RNA, 22 nt, Human
ccagcagccagagaaggaccuc

SEQ ID NO: 257539 - RNA, 20 nt, Human
ucacagaaugccugaagaag

SEQ ID NO: 257540 - RNA, 22 nt, Human
ugcaggaguuaagugcucuccu

SEQ ID NO: 257541 - RNA, 22 nt, Human
auacaguaauuuguaacucauc

SEQ ID NO: 257542 - RNA, 22 nt, Human
gcagaggagcaaguugcuacag

SEQ ID NO: 257543 - RNA, 22 nt, Human
agaucuuuagaagauagaauca

SEQ ID NO: 257544 - RNA, 18 nt, Human
augaucuuagcaaauauu

SEQ ID NO: 257545 - RNA, 22 nt, Human
gaauacaaacuuaaggcuuuac

SEQ ID NO: 257546 - RNA, 22 nt, Human
auauaacucuccauuaagggcc

SEQ ID NO: 257547 - RNA, 22 nt, Human
uuucuuaggcucuaaaaugacu

SEQ ID NO: 257548 - RNA, 22 nt, Human
uagguuuacugaauuaguggaa

SEQ ID NO: 257549 - RNA, 22 nt, Human
ggucaggauccaagucugugcu

SEQ ID NO: 257550 - RNA, 22 nt, Human
ugaggagaaaugcucagagcca

SEQ ID NO: 257551 - RNA, 22 nt, Human
gcagcuuucuugcccuaaucuu

SEQ ID NO: 257552 - RNA, 22 nt, Human
gacaggcuagguugcuguccuc

SEQ ID NO: 257553 - RNA, 22 nt, Human
guccaggcugcccaggguccug

SEQ ID NO: 257554 - RNA, 22 nt, Human
ucucugggaguugagcagcagc

SEQ ID NO: 257555 - RNA, 22 nt, Human
aagcccagguaaguggcucaug

SEQ ID NO: 257556 - RNA, 22 nt, Human
uccugggauuugcccuuuucuc

SEQ ID NO: 257557 - RNA, 22 nt, Human
aacauuaauuacagucaaacau

SEQ ID NO: 257558 - RNA, 20 nt, Human
accaggagauggaggcaggg

SEQ ID NO: 257559 - RNA, 22 nt, Human
gaaggccaguuuugagauaggu

SEQ ID NO: 257560 - RNA, 22 nt, Human
cuggcccuucucuugcuuccug

SEQ ID NO: 257561 - RNA, 22 nt, Human
auccauauaggcagauggcaca

SEQ ID NO: 257562 - RNA, 22 nt, Human
aaaaauugcugagaacggaauu

SEQ ID NO: 257563 - RNA, 22 nt, Human
cagaagucacccucagaauaac

SEQ ID NO: 257564 - RNA, 22 nt, Human
ccacaucuaucuuuaguaugaa

SEQ ID NO: 257565 - RNA, 22 nt, Human
aaggaaagacauauaaaugacu

SEQ ID NO: 257566 - RNA, 22 nt, Human
ugcacagagagaugagacacgu

SEQ ID NO: 257567 - RNA, 22 nt, Human
uucuuauaaguuaauauuucca

SEQ ID NO: 257568 - RNA, 22 nt, Human
uauccauuaggucuauggucaa

SEQ ID NO: 257569 - RNA, 22 nt, Human
cucuucuugcuagacugagugc

SEQ ID NO: 257570 - RNA, 22 nt, Human
aaggccagccugagagcuaaca

SEQ ID NO: 257571 - RNA, 21 nt, Human
agcauucaaaagaugccauaa

SEQ ID NO: 257572 - RNA, 22 nt, Human
gcuggcagguccaagauagagc

SEQ ID NO: 257573 - RNA, 22 nt, Human
ugcucagcugcucuguauucuu

SEQ ID NO: 257574 - RNA, 22 nt, Human
gagccaagcucuucuccaugag

SEQ ID NO: 257575 - RNA, 22 nt, Human
auaaaggccaaaauuugcauuu

SEQ ID NO: 257576 - RNA, 22 nt, Human
gaacuacaguaagaauugaugu

SEQ ID NO: 257577 - RNA, 22 nt, Human
uaauguauaacaaauacucauc

SEQ ID NO: 257578 - RNA, 22 nt, Human
gugcaaaaguaauugcgguuuu

SEQ ID NO: 257579 - RNA, 22 nt, Human
caaauguauucucacuucaggg

SEQ ID NO: 257580 - RNA, 22 nt, Human
cagcaggaccauugaggcauca

SEQ ID NO: 257581 - RNA, 22 nt, Human
uggaggcaggagacagggcaaa

SEQ ID NO: 257582 - RNA, 22 nt, Human
gcuuacagauaaugaggagacu

SEQ ID NO: 257583 - RNA, 22 nt, Human
ugcuggcuggccuggccuggac

SEQ ID NO: 257584 - RNA, 22 nt, Human
auuugcuucauagaucugugga

SEQ ID NO: 257585 - RNA, 22 nt, Human
uccacauuauguuucuccuuuc

SEQ ID NO: 257586 - RNA, 22 nt, Human
uuucauaauagugcaguuuguu

SEQ ID NO: 257587 - RNA, 19 nt, Human
ugacaggcuguugccuuga

SEQ ID NO: 257588 - RNA, 22 nt, Human
aaacacauuuuaggaaaaucua

SEQ ID NO: 257589 - RNA, 22 nt, Human
auccacagucuuagccaucaaa

SEQ ID NO: 257590 - RNA, 22 nt, Human
gcauccaggcugccccucugcg

SEQ ID NO: 257591 - RNA, 22 nt, Human
ugaaguaggcagcaugcugaga

SEQ ID NO: 257592 - RNA, 22 nt, Human
aguauggggcugugugugcaca

SEQ ID NO: 257593 - RNA, 22 nt, Human
agugcccuggacggcggcccca

SEQ ID NO: 257594 - RNA, 22 nt, Human
gucucauugguucugccagagu

SEQ ID NO: 257595 - RNA, 22 nt, Human
cuucucuggcagaugugugucc

SEQ ID NO: 257596 - RNA, 22 nt, Human
uugcucaggcuggugugcagug

SEQ ID NO: 257597 - RNA, 22 nt, Human
guuauuaguaagacucgcacau

SEQ ID NO: 257598 - RNA, 22 nt, Human
ggcccaggcuggagugcggugg

SEQ ID NO: 257599 - RNA, 21 nt, Human
cagagcugaaggguguagugu

SEQ ID NO: 257600 - RNA, 22 nt, Human
cugcccugaccugccucagagu

SEQ ID NO: 257601 - RNA, 22 nt, Human
uuggcugccgagcgcaucccgg

SEQ ID NO: 257602 - RNA, 22 nt, Human
aaaauuaagugucugggaagcc

SEQ ID NO: 257603 - RNA, 22 nt, Human
ucagaggucagcagcuugccca

SEQ ID NO: 257604 - RNA, 22 nt, Human
gacccaggguauccagagcugc

SEQ ID NO: 257605 - RNA, 22 nt, Human
cacaugcuuagauuucagugga

SEQ ID NO: 257606 - RNA, 22 nt, Human
gcccugagcacugcugcugggg

SEQ ID NO: 257607 - RNA, 22 nt, Human
ccauagcaagaggagcagaaau

SEQ ID NO: 257608 - RNA, 22 nt, Human
uuucagaauagcaaagcaagcu

SEQ ID NO: 257609 - RNA, 22 nt, Human
agcaccaggcaccaaagggccu

SEQ ID NO: 257610 - RNA, 22 nt, Human
gcucuguguaaauguagggucc

SEQ ID NO: 257611 - RNA, 18 nt, Human
caggccuuugagacagaa

SEQ ID NO: 257612 - RNA, 22 nt, Human
agggcagcauugccuuucucca

SEQ ID NO: 257613 - RNA, 22 nt, Human
uuccugugucccgggcacccug

SEQ ID NO: 257614 - RNA, 22 nt, Human
ggacccuggagacccacuggga

SEQ ID NO: 257615 - RNA, 22 nt, Human
aaggaggaauaaagagguggug

SEQ ID NO: 257616 - RNA, 22 nt, Human
uucuggaaggguggaguagcuu

SEQ ID NO: 257617 - RNA, 22 nt, Human
ucuccugcagucagcagucuca

SEQ ID NO: 257618 - RNA, 22 nt, Human
agaggaauguauuucccugcaa

SEQ ID NO: 257619 - RNA, 22 nt, Human
uuuccauauucugcgucugcca

SEQ ID NO: 257620 - RNA, 22 nt, Human
ugcucagggagcauagugaauu

SEQ ID NO: 257621 - RNA, 22 nt, Human
gacaggaggcagagcucaggug

SEQ ID NO: 257622 - RNA, 22 nt, Human
acaguuuauugcacagguaacc

SEQ ID NO: 257623 - RNA, 22 nt, Human
cacauaauugaacgugaugagu

SEQ ID NO: 257624 - RNA, 22 nt, Human
gagggggucuaugagguagagc

SEQ ID NO: 257625 - RNA, 22 nt, Human
uuucaguugcagugguugucua

SEQ ID NO: 257626 - RNA, 22 nt, Human
auauucacaguaaguguagcag

SEQ ID NO: 257627 - RNA, 22 nt, Human
agaggccaauaguagguggcau

SEQ ID NO: 257628 - RNA, 22 nt, Human
gcuuccaguaaguugcugccau

SEQ ID NO: 257629 - RNA, 22 nt, Human
acauugaaagcauauuaucucc

SEQ ID NO: 257630 - RNA, 18 nt, Human
gggcccuggcguccgccc

SEQ ID NO: 257631 - RNA, 22 nt, Human
cccaggcacauccacucuguga

SEQ ID NO: 257632 - RNA, 22 nt, Human
ugucuuuaagcaaacaguguuu

SEQ ID NO: 257633 - RNA, 22 nt, Human
agggugcagucacaggaaaugu

SEQ ID NO: 257634 - RNA, 22 nt, Human
cuuuuccucaggaggagacgcg

SEQ ID NO: 257635 - RNA, 22 nt, Human
uuaaaugaacgagauaugcaac

SEQ ID NO: 257636 - RNA, 22 nt, Human
uccaggcugcagucuugcccuc

SEQ ID NO: 257637 - RNA, 17 nt, Human
uauacacagacagacug

SEQ ID NO: 257638 - RNA, 19 nt, Human
uguccucacagagcauaac

SEQ ID NO: 257639 - RNA, 22 nt, Human
acuucucugguugagguccaau

SEQ ID NO: 257640 - RNA, 21 nt, Human
uuggaacaagcagcaguuugc

SEQ ID NO: 257641 - RNA, 22 nt, Human
gguugcaaacuccugggaucaa

SEQ ID NO: 257642 - RNA, 22 nt, Human
agcaugaaaggcgugccaacuu

SEQ ID NO: 257643 - RNA, 22 nt, Human
uuggcagagccccagccuugga

SEQ ID NO: 257644 - RNA, 22 nt, Human
auuccucauuauuuacugagga

SEQ ID NO: 257645 - RNA, 22 nt, Human
ccugccaggcuuucagguuugg

SEQ ID NO: 257646 - RNA, 22 nt, Human
agcaaaauaagguaauuuauug

SEQ ID NO: 257647 - RNA, 22 nt, Human
cucuggccgcagcucagcucug

SEQ ID NO: 257648 - RNA, 22 nt, Human
aaagccuucaaguagauguaag

SEQ ID NO: 257649 - RNA, 22 nt, Human
cagcaucuuucucuucuggagu

SEQ ID NO: 257650 - RNA, 22 nt, Human
acaguucaagacaucaguauga

SEQ ID NO: 257651 - RNA, 22 nt, Human
aaaguuguucaguaagaaacuc

SEQ ID NO: 257652 - RNA, 22 nt, Human
cugcccagaagccagaugggca

SEQ ID NO: 257653 - RNA, 22 nt, Human
aucagaaauagucauguuacuu

SEQ ID NO: 257654 - RNA, 22 nt, Human
ccauggcauuuuaugugucuua

SEQ ID NO: 257655 - RNA, 22 nt, Human
gugcagggcccuccuaacaucu

SEQ ID NO: 257656 - RNA, 22 nt, Human
cacauuaaaauccuaacuucca

SEQ ID NO: 257657 - RNA, 22 nt, Human
uagcuucuggaguguuugaaaa

SEQ ID NO: 257658 - RNA, 22 nt, Human
gaaaugugaccuacuuccuugu

SEQ ID NO: 257659 - RNA, 22 nt, Human
uacaggcuagggagagugacug

SEQ ID NO: 257660 - RNA, 22 nt, Human
uuacaguggucauuugggaaaa

SEQ ID NO: 257661 - RNA, 22 nt, Human
uccaaggcuccggcccuggcgu

SEQ ID NO: 257662 - RNA, 22 nt, Human
ucuucccagcugcugcgaugcc

SEQ ID NO: 257663 - RNA, 22 nt, Human
ugagaggaacaggcaguagguu

SEQ ID NO: 257664 - RNA, 22 nt, Human
caggcuggacauuagauacaua

SEQ ID NO: 257665 - RNA, 22 nt, Human
agaaggcagguuuuaaaauguc

SEQ ID NO: 257666 - RNA, 22 nt, Human
augacagcauucaagacauaga

SEQ ID NO: 257667 - RNA, 22 nt, Human
aacaaauuuagcucugagugcu

SEQ ID NO: 257668 - RNA, 22 nt, Human
ucauuuauauuguauucuguag

SEQ ID NO: 257669 - RNA, 22 nt, Human
ugggggagccuucacaguagcu

SEQ ID NO: 257670 - RNA, 22 nt, Human
aggaagcaguuuauaaugcauu

SEQ ID NO: 257671 - RNA, 22 nt, Human
uuaaauuauuucuagugaggug

SEQ ID NO: 257672 - RNA, 22 nt, Human
uuggcacacaguaagcccuaag

SEQ ID NO: 257673 - RNA, 22 nt, Human
auagcuuuuugucauagagucu

SEQ ID NO: 257674 - RNA, 22 nt, Human
agcagggcuucugugccugugc

SEQ ID NO: 257675 - RNA, 22 nt, Human
uuucuucagagagagcuuuccc

SEQ ID NO: 257676 - RNA, 22 nt, Human
ccuggagguggagguugcagug

SEQ ID NO: 257677 - RNA, 22 nt, Human
uggcccugccacucacugcuga

SEQ ID NO: 257678 - RNA, 22 nt, Human
uauucucagcaacacacaugga

SEQ ID NO: 257679 - RNA, 22 nt, Human
agaagggagagaaaguugguua

SEQ ID NO: 257680 - RNA, 22 nt, Human
ccucagaccccugcugagcuuc

SEQ ID NO: 257681 - RNA, 22 nt, Human
gcugaagauaagugaagaggcu

SEQ ID NO: 257682 - RNA, 22 nt, Human
aggaauguggccuagggaggag

SEQ ID NO: 257683 - RNA, 22 nt, Human
ccagcaccuugaucuuggaguu

SEQ ID NO: 257684 - RNA, 22 nt, Human
acaacugucuucuucaugcucc

SEQ ID NO: 257685 - RNA, 22 nt, Human
accaggcagagcugggccuuaa

SEQ ID NO: 257686 - RNA, 22 nt, Human
uucuaacaaguggcuuguuagu

SEQ ID NO: 257687 - RNA, 22 nt, Human
aucuuuagucaggcguggguau

SEQ ID NO: 257688 - RNA, 22 nt, Human
uagccaguuucuuuaacagcaa

SEQ ID NO: 257689 - RNA, 22 nt, Human
uucuuauucuugaaauguggga

SEQ ID NO: 257690 - RNA, 22 nt, Human
ucagcuccagaguugcacagug

SEQ ID NO: 257691 - RNA, 22 nt, Human
cuguggaaggccuguccugaaa

SEQ ID NO: 257692 - RNA, 22 nt, Human
aacugcucauuugagaguaugc

SEQ ID NO: 257693 - RNA, 22 nt, Human
gugaauuaggacaaaagggcuu

SEQ ID NO: 257694 - RNA, 22 nt, Human
uccaggcauguugggaagauga

SEQ ID NO: 257695 - RNA, 22 nt, Human
aauuuguuuucaagucacugga

SEQ ID NO: 257696 - RNA, 22 nt, Human
aaggcugcuuuuaacaugcaua

SEQ ID NO: 257697 - RNA, 21 nt, Human
cucugcugagcuccauuuuca

SEQ ID NO: 257698 - RNA, 22 nt, Human
guccaugauucuguguaguaga

SEQ ID NO: 257699 - RNA, 22 nt, Human
uuugcugucagccgcuauuuuc

SEQ ID NO: 257700 - RNA, 22 nt, Human
ggcagggguucauuuugucuua

SEQ ID NO: 257701 - RNA, 22 nt, Human
gagaaaugcaugcaugucauca

SEQ ID NO: 257702 - RNA, 22 nt, Human
uggcuccacaggccagggugug

SEQ ID NO: 257703 - RNA, 22 nt, Human
acuguccuggagcucacacucu

SEQ ID NO: 257704 - RNA, 22 nt, Human
ugcagccucucugcuucaggaa

SEQ ID NO: 257705 - RNA, 22 nt, Human
cauaggccacggucagcccaca

SEQ ID NO: 257706 - RNA, 22 nt, Human
gcaccugcuggggcugaugaga

SEQ ID NO: 257707 - RNA, 22 nt, Human
agcugucugugaacacagcauu

SEQ ID NO: 257708 - RNA, 22 nt, Human
auggcuccauagcuucguuuag

SEQ ID NO: 257709 - RNA, 22 nt, Human
uacauucaacaugucacuaugu

SEQ ID NO: 257710 - RNA, 22 nt, Human
cagaguggcagucccaggccca

SEQ ID NO: 257711 - RNA, 22 nt, Human
uggugaucagucaacugucuuc

SEQ ID NO: 257712 - RNA, 22 nt, Human
auggccaugccaguuuacagcc

SEQ ID NO: 257713 - RNA, 22 nt, Human
cauaaagucucauaauucacuu

SEQ ID NO: 257714 - RNA, 22 nt, Human
cugcacagaggucggucugcca

SEQ ID NO: 257715 - RNA, 22 nt, Human
uuaauuaagagauacugcagua

SEQ ID NO: 257716 - RNA, 21 nt, Human
aggaggggucuuucccacuga

SEQ ID NO: 257717 - RNA, 22 nt, Human
ggcuccuguuauuuaaugagga

SEQ ID NO: 257718 - RNA, 22 nt, Human
cucuuuuaugugacguguguga

SEQ ID NO: 257719 - RNA, 22 nt, Human
aaagcaguauaaguaacggaag

SEQ ID NO: 257720 - RNA, 23 nt, Human
gagggcucugagugcuugggcca

SEQ ID NO: 257721 - RNA, 17 nt, Human
ucugucugugguccacu

SEQ ID NO: 257722 - RNA, 22 nt, Human
cagugcugggcagaggagagcg

SEQ ID NO: 257723 - RNA, 22 nt, Human
uuuaauagggcccaaugagacu

SEQ ID NO: 257724 - RNA, 18 nt, Human
gcuucucauuucuaagca

SEQ ID NO: 257725 - RNA, 22 nt, Human
ugucuuuugccaaagaucaguu

SEQ ID NO: 257726 - RNA, 22 nt, Human
ucucugcuaagauugugucuag

SEQ ID NO: 257727 - RNA, 22 nt, Human
cuggaggagaacuugaggaagg

SEQ ID NO: 257728 - RNA, 22 nt, Human
cuauuuggccaagcugcccaca

SEQ ID NO: 257729 - RNA, 22 nt, Human
uccuccaagcagaggcccugaa

SEQ ID NO: 257730 - RNA, 22 nt, Human
ugucucugucuuccagggcugu

SEQ ID NO: 257731 - RNA, 22 nt, Human
cccagacucaucccugggagcu

SEQ ID NO: 257732 - RNA, 22 nt, Human
uggcccagacucugcucuuauc

SEQ ID NO: 257733 - RNA, 22 nt, Human
agggacacugaugagaaauucu

SEQ ID NO: 257734 - RNA, 22 nt, Human
gccagugccugcugcucagggc

SEQ ID NO: 257735 - RNA, 22 nt, Human
ucuggggagcagcccuggugag

SEQ ID NO: 257736 - RNA, 22 nt, Human
gaccccagaggaaggggcgccg

SEQ ID NO: 257737 - RNA, 22 nt, Human
uucucuguaguugccuggugga

SEQ ID NO: 257738 - RNA, 22 nt, Human
uuuuccagagcugucucuugca

SEQ ID NO: 257739 - RNA, 22 nt, Human
aauuacuguaauuuucuacagc

SEQ ID NO: 257740 - RNA, 22 nt, Human
ugguuccaaucgcacuggcuca

SEQ ID NO: 257741 - RNA, 22 nt, Human
caggcccuccugugaucugccu

SEQ ID NO: 257742 - RNA, 22 nt, Human
guggccucuguuggcuccuagg

SEQ ID NO: 257743 - RNA, 22 nt, Human
gaaucuuauccccaguccuuaa

SEQ ID NO: 257744 - RNA, 18 nt, Human
gacccagcagaugggcuu

SEQ ID NO: 257745 - RNA, 22 nt, Human
acauuucgugcucuguuuuguu

SEQ ID NO: 257746 - RNA, 20 nt, Human
agaaaaaguguggaaauuuc

SEQ ID NO: 257747 - RNA, 22 nt, Human
uuaaaguucauuaaaugagcca

SEQ ID NO: 257748 - RNA, 21 nt, Human
ucauuugugaucugauuucca

SEQ ID NO: 257749 - RNA, 22 nt, Human
uagaaugagaaaguguagcagg

SEQ ID NO: 257750 - RNA, 20 nt, Human
uuucugugauagagaggugu

SEQ ID NO: 257751 - RNA, 22 nt, Human
uuucuccacgccagcuugcuua

SEQ ID NO: 257752 - RNA, 17 nt, Human
auccuucuguucuuucu

SEQ ID NO: 257753 - RNA, 22 nt, Human
uucccaaaauauaacaguuaac

SEQ ID NO: 257754 - RNA, 22 nt, Human
gacuuccuaagauucaggaaug

SEQ ID NO: 257755 - RNA, 22 nt, Human
uggcucugugcuucuaguaucu

SEQ ID NO: 257756 - RNA, 22 nt, Human
uauaaauuaaugugcccaugag

SEQ ID NO: 257757 - RNA, 21 nt, Human
aggaggagagcuuggccuacc

SEQ ID NO: 257758 - RNA, 22 nt, Human
ggcaggcaaugaggaugggaag

SEQ ID NO: 257759 - RNA, 19 nt, Human
uuucccagucccaggagug

SEQ ID NO: 257760 - RNA, 17 nt, Human
cgggcauggagggcagg

SEQ ID NO: 257761 - RNA, 22 nt, Human
aguuacaucuguuauguguguu

SEQ ID NO: 257762 - RNA, 22 nt, Human
aagccauggcugcaucagccug

SEQ ID NO: 257763 - RNA, 22 nt, Human
uacaagaaauuucugcauauau

SEQ ID NO: 257764 - RNA, 19 nt, Human
acaaauuggcaaaaugcaa

SEQ ID NO: 257765 - RNA, 22 nt, Human
aauuaugagguagauaucacau

SEQ ID NO: 257766 - RNA, 22 nt, Human
caacauauaauauuugaguucu

SEQ ID NO: 257767 - RNA, 22 nt, Human
gaaaucaaggcuacauucaggu

SEQ ID NO: 257768 - RNA, 22 nt, Human
acauucucuuuuagaaagcugu

SEQ ID NO: 257769 - RNA, 19 nt, Human
aguguucugaguacuccuc

SEQ ID NO: 257770 - RNA, 19 nt, Human
ucucugccgaucagggccc

SEQ ID NO: 257771 - RNA, 22 nt, Human
cagauucaaccuaagacaaucu

SEQ ID NO: 257772 - RNA, 22 nt, Human
cgggcuccgggucuuugcaguc

SEQ ID NO: 257773 - RNA, 22 nt, Human
aaauacuauugaccaggucucu

SEQ ID NO: 257774 - RNA, 20 nt, Human
agcccuguaaauccccugga

SEQ ID NO: 257775 - RNA, 22 nt, Human
ggggcugagucagugggaagag

SEQ ID NO: 257776 - RNA, 22 nt, Human
gcugacucagaugcagcuggau

SEQ ID NO: 257777 - RNA, 22 nt, Human
uuugagaaggugacaaauucua

SEQ ID NO: 257778 - RNA, 22 nt, Human
uaccaccuccauccuccuuuca

SEQ ID NO: 257779 - RNA, 22 nt, Human
ucagcuggaagauggugcagaa

SEQ ID NO: 257780 - RNA, 22 nt, Human
gugcucagguucccaugagugc

SEQ ID NO: 257781 - RNA, 17 nt, Human
aggcauggucuggggug

SEQ ID NO: 257782 - RNA, 22 nt, Human
uguuccuguuuaaugugcucau

SEQ ID NO: 257783 - RNA, 22 nt, Human
cugggaaagcaagguuguggau

SEQ ID NO: 257784 - RNA, 22 nt, Human
ggcuccuuaucucuccuaugcc

SEQ ID NO: 257785 - RNA, 22 nt, Human
acauagaaccuggcacauagua

SEQ ID NO: 257786 - RNA, 22 nt, Human
cacagcugaaguagccaugugg

SEQ ID NO: 257787 - RNA, 18 nt, Human
gaaagccaugcagcagug

SEQ ID NO: 257788 - RNA, 22 nt, Human
ggguccuggaaucugcauuuua

SEQ ID NO: 257789 - RNA, 22 nt, Human
agaacuuuuggagacuuuuagu

SEQ ID NO: 257790 - RNA, 22 nt, Human
ugauacagagaaagcaucuuuu

SEQ ID NO: 257791 - RNA, 22 nt, Human
agguccugaugaucucugagag

SEQ ID NO: 257792 - RNA, 22 nt, Human
gggccagcucugugauguaggg

SEQ ID NO: 257793 - RNA, 22 nt, Human
aacaccuugcagggauuaugac

SEQ ID NO: 257794 - RNA, 22 nt, Human
ugcagaggcgccgugggugggg

SEQ ID NO: 257795 - RNA, 22 nt, Human
uuuagcaauuagaauccagcau

SEQ ID NO: 257796 - RNA, 22 nt, Human
ccaggcauugugagugggcagg

SEQ ID NO: 257797 - RNA, 22 nt, Human
uuuauauguuuguacaauuaag

SEQ ID NO: 257798 - RNA, 22 nt, Human
uguguaaauuuauuuacauaaa

SEQ ID NO: 257799 - RNA, 22 nt, Human
uccugagggcgauucagcaggu

SEQ ID NO: 257800 - RNA, 22 nt, Human
agaagcuauaacaacaauuaua

SEQ ID NO: 257801 - RNA, 22 nt, Human
caugucugaguagagugugauu

SEQ ID NO: 257802 - RNA, 22 nt, Human
auuacacuaaugugacaacaau

SEQ ID NO: 257803 - RNA, 22 nt, Human
aggaugaggcuggacacuucuu

SEQ ID NO: 257804 - RNA, 22 nt, Human
ggagaagggaacugaguuuuug

SEQ ID NO: 257805 - RNA, 23 nt, Human
cugcagagaacugagggacagcc

SEQ ID NO: 257806 - RNA, 22 nt, Human
cuuccucaggcauuagcuggac

SEQ ID NO: 257807 - RNA, 22 nt, Human
cucucugggggccaugccaaga

SEQ ID NO: 257808 - RNA, 22 nt, Human
ccucuguaagccuuagucuaga

SEQ ID NO: 257809 - RNA, 22 nt, Human
aggagcuggccacuaggaugca

SEQ ID NO: 257810 - RNA, 22 nt, Human
cuggaggcugaguugggucucc

SEQ ID NO: 257811 - RNA, 22 nt, Human
gcccuucacgaugguaucuuag

SEQ ID NO: 257812 - RNA, 22 nt, Human
ucaggaaguauaaucagauuca

SEQ ID NO: 257813 - RNA, 22 nt, Human
uuuauuagugcuuguaucacug

SEQ ID NO: 257814 - RNA, 22 nt, Human
uaaagguaugucuuaaucaaac

SEQ ID NO: 257815 - RNA, 22 nt, Human
uagauucucccaucaugagaug

SEQ ID NO: 257816 - RNA, 22 nt, Human
uuccaggaagcucucggccucu

SEQ ID NO: 257817 - RNA, 22 nt, Human
uuuacuucauuuccagugagga

SEQ ID NO: 257818 - RNA, 22 nt, Human
ucuuuguuugccuuuaucaaga

SEQ ID NO: 257819 - RNA, 22 nt, Human
ugaaggcauuugaguuggugag

SEQ ID NO: 257820 - RNA, 22 nt, Human
aagcaggaagcucagguccuug

SEQ ID NO: 257821 - RNA, 22 nt, Human
ucccagcauuaaugccugucag

SEQ ID NO: 257822 - RNA, 22 nt, Human
uccuucaaaaguugagagagcc

SEQ ID NO: 257823 - RNA, 22 nt, Human
ucagagcucaugagcagagcca

SEQ ID NO: 257824 - RNA, 21 nt, Human
gccuggcucucacuggccugg

SEQ ID NO: 257825 - RNA, 22 nt, Human
ugaacuuuguaguaauggagau

SEQ ID NO: 257826 - RNA, 20 nt, Human
ucuuuagauuuaucuuaugu

SEQ ID NO: 257827 - RNA, 22 nt, Human
gaaauauucuugucuuguuuuc

SEQ ID NO: 257828 - RNA, 22 nt, Human
cagaggccauauuucuucacuc

SEQ ID NO: 257829 - RNA, 21 nt, Human
uuucuucacuuugccccaugu

SEQ ID NO: 257830 - RNA, 22 nt, Human
ugcuccagccuaugcucuccgg

SEQ ID NO: 257831 - RNA, 22 nt, Human
ugggcugaguggcagccagagu

SEQ ID NO: 257832 - RNA, 22 nt, Human
ggccuuccuguuguguccaccg

SEQ ID NO: 257833 - RNA, 22 nt, Human
uauuugaaggcauacauuuuga

SEQ ID NO: 257834 - RNA, 22 nt, Human
ccucugggcugccugcacgggu

SEQ ID NO: 257835 - RNA, 22 nt, Human
ccagguguguacagaacagcac

SEQ ID NO: 257836 - RNA, 22 nt, Human
ggggaggaagcuggaacacggg

SEQ ID NO: 257837 - RNA, 22 nt, Human
ucugccagcccugugagucuug

SEQ ID NO: 257838 - RNA, 22 nt, Human
aagaacagauucagccugaacu

SEQ ID NO: 257839 - RNA, 22 nt, Human
uuuauuguguugaaacugaauu

SEQ ID NO: 257840 - RNA, 22 nt, Human
ugcuggaauaauuucauguuaa

SEQ ID NO: 257841 - RNA, 22 nt, Human
uauguguccuguuaccggcagc

SEQ ID NO: 257842 - RNA, 22 nt, Human
acuucccaacgugggccuccca

SEQ ID NO: 257843 - RNA, 18 nt, Human
acccugggcaauucacuc

SEQ ID NO: 257844 - RNA, 22 nt, Human
ucucaggacuccucuggccaua

SEQ ID NO: 257845 - RNA, 22 nt, Human
uacuguacucaacaugugaguu

SEQ ID NO: 257846 - RNA, 22 nt, Human
gagaccuuaagagaugucagcu

SEQ ID NO: 257847 - RNA, 22 nt, Human
gauguguccccagaggauugaa

SEQ ID NO: 257848 - RNA, 22 nt, Human
ugagcaggcucccacuucagug

SEQ ID NO: 257849 - RNA, 22 nt, Human
aucuuugguacuauucuuauca

SEQ ID NO: 257850 - RNA, 22 nt, Human
gcucacugcaaccucugcuucc

SEQ ID NO: 257851 - RNA, 22 nt, Human
guuguacauaugaggauaaguu

SEQ ID NO: 257852 - RNA, 22 nt, Human
gcacugcaucuacuggcaagua

SEQ ID NO: 257853 - RNA, 22 nt, Human
cuccaggacacuaacccaggcu

SEQ ID NO: 257854 - RNA, 22 nt, Human
ccacagcugaccgcaggugagc

SEQ ID NO: 257855 - RNA, 22 nt, Human
ugucauuuucauccuaaggagc

SEQ ID NO: 257856 - RNA, 22 nt, Human
cccuggcuuggcacucuccacu

SEQ ID NO: 257857 - RNA, 22 nt, Human
ggccucucaugcccagagccaa

SEQ ID NO: 257858 - RNA, 22 nt, Human
aacugaggucuccagugcagaa

SEQ ID NO: 257859 - RNA, 22 nt, Human
cugcuuuaaguauucaacaaag

SEQ ID NO: 257860 - RNA, 22 nt, Human
uuuaucuucugcaguucuggcu

SEQ ID NO: 257861 - RNA, 20 nt, Human
uggagcuguaaucuugucug

SEQ ID NO: 257862 - RNA, 22 nt, Human
aaaugcagcagcuaauugaaaa

SEQ ID NO: 257863 - RNA, 20 nt, Human
ugggcacagcuuuggagggc

SEQ ID NO: 257864 - RNA, 22 nt, Human
uguuaaaaaugcagauuccuau

SEQ ID NO: 257865 - RNA, 22 nt, Human
auguauguuaguguauuaucua

SEQ ID NO: 257866 - RNA, 22 nt, Human
acaugagauuagcucacccacu

SEQ ID NO: 257867 - RNA, 22 nt, Human
agggccagggaaacgaucagca

SEQ ID NO: 257868 - RNA, 22 nt, Human
auaugcacauacauacauaggu

SEQ ID NO: 257869 - RNA, 22 nt, Human
uuugcagagugcagaagcaucu

SEQ ID NO: 257870 - RNA, 22 nt, Human
gcacacaugcguguauaugggu

SEQ ID NO: 257871 - RNA, 22 nt, Human
uucuuacagcccuauuacuaaa

SEQ ID NO: 257872 - RNA, 22 nt, Human
cugagcugcuuugcuuuugggg

SEQ ID NO: 257873 - RNA, 22 nt, Human
gcacauccaaugauuguuuuga

SEQ ID NO: 257874 - RNA, 22 nt, Human
cuggcuccugaggcuuggcccc

SEQ ID NO: 257875 - RNA, 20 nt, Human
agugcuguggcugaauaaga

SEQ ID NO: 257876 - RNA, 17 nt, Human
agcacuaaaaugcuucc

SEQ ID NO: 257877 - RNA, 19 nt, Human
agccaguccaaguucuguc

SEQ ID NO: 257878 - RNA, 23 nt, Human
aggcugcuuacugguaucagagc

SEQ ID NO: 257879 - RNA, 20 nt, Human
acaguagaagggauuucaaa

SEQ ID NO: 257880 - RNA, 22 nt, Human
gaguguggaucccagaagcaga

SEQ ID NO: 257881 - RNA, 22 nt, Human
gauccugugguuuuccugugca

SEQ ID NO: 257882 - RNA, 22 nt, Human
uauuagguuggugcaaaauuaa

SEQ ID NO: 257883 - RNA, 22 nt, Human
uuuaaaggccuugcugagccac

SEQ ID NO: 257884 - RNA, 22 nt, Human
cagccugagccuucuguagcaa

SEQ ID NO: 257885 - RNA, 22 nt, Human
acagugcugaacgacauggaag

SEQ ID NO: 257886 - RNA, 22 nt, Human
ugucauuuucuaaucuguuguc

SEQ ID NO: 257887 - RNA, 22 nt, Human
auuuacauaauagacuuuaggu

SEQ ID NO: 257888 - RNA, 22 nt, Human
augguggacucuugauucaggc

SEQ ID NO: 257889 - RNA, 23 nt, Human
gcucagccucagcaggcccagga

SEQ ID NO: 257890 - RNA, 22 nt, Human
uacuuucuguccuucuguuaaa

SEQ ID NO: 257891 - RNA, 22 nt, Human
aggcagacaaguccagaacugg

SEQ ID NO: 257892 - RNA, 22 nt, Human
gagcugugauuggugucucacu

SEQ ID NO: 257893 - RNA, 22 nt, Human
cagucuucuaaccuagcagccu

SEQ ID NO: 257894 - RNA, 22 nt, Human
gaagcuccguacuaugacuuuu

SEQ ID NO: 257895 - RNA, 22 nt, Human
cuugagaaugugagccacagau

SEQ ID NO: 257896 - RNA, 22 nt, Human
agagccagcauuugacacuggc

SEQ ID NO: 257897 - RNA, 22 nt, Human
agccuggggcacuucuccaaac

SEQ ID NO: 257898 - RNA, 22 nt, Human
cuuauucauauauucucgguag

SEQ ID NO: 257899 - RNA, 22 nt, Human
ucacaggcaaagaagauuggug

SEQ ID NO: 257900 - RNA, 22 nt, Human
agcaaagcaguggcuaagcuga

SEQ ID NO: 257901 - RNA, 23 nt, Human
uuggagagggugaguagugucag

SEQ ID NO: 257902 - RNA, 22 nt, Human
cagaguggagauguguguggaa

SEQ ID NO: 257903 - RNA, 22 nt, Human
uugcaaaugugaauaauuacac

SEQ ID NO: 257904 - RNA, 22 nt, Human
ugaaacagaguggauacaguga

SEQ ID NO: 257905 - RNA, 22 nt, Human
augccagggucccuucagagau

SEQ ID NO: 257906 - RNA, 22 nt, Human
aaacuugauuuagaacuaaggc

SEQ ID NO: 257907 - RNA, 22 nt, Human
caggccugguugagcccugaga

SEQ ID NO: 257908 - RNA, 22 nt, Human
aaccuaugaacucuuggugugc

SEQ ID NO: 257909 - RNA, 22 nt, Human
caggcagcaggagcccugcucg

SEQ ID NO: 257910 - RNA, 22 nt, Human
cuugccugggacugaggcauuu

SEQ ID NO: 257911 - RNA, 22 nt, Human
aacagaggcucccugcacuugu

SEQ ID NO: 257912 - RNA, 22 nt, Human
gcugagggggaaggaaagcuga

SEQ ID NO: 257913 - RNA, 22 nt, Human
agucauuguaugaaguguacuc

SEQ ID NO: 257914 - RNA, 22 nt, Human
caaauccagaucccagucguag

SEQ ID NO: 257915 - RNA, 22 nt, Human
cagccagaaccuaggaugagcu

SEQ ID NO: 257916 - RNA, 22 nt, Human
aggcagcugaggucuggcgccc

SEQ ID NO: 257917 - RNA, 22 nt, Human
uucuaucauacuugaauacauu

SEQ ID NO: 257918 - RNA, 22 nt, Human
gcaucccucugaggggccaggc

SEQ ID NO: 257919 - RNA, 22 nt, Human
ugucccuggagcuucugucccc

SEQ ID NO: 257920 - RNA, 22 nt, Human
cacagggccuugugugacugca

SEQ ID NO: 257921 - RNA, 22 nt, Human
ucucuuccucagccuggggccu

SEQ ID NO: 257922 - RNA, 22 nt, Human
cugccuggaaugccagcuucuc

SEQ ID NO: 257923 - RNA, 22 nt, Human
guccagaaggaggucaaguugg

SEQ ID NO: 257924 - RNA, 22 nt, Human
cuggaagguucuuugugugccu

SEQ ID NO: 257925 - RNA, 22 nt, Human
cugggaaauauaauaaaguggu

SEQ ID NO: 257926 - RNA, 22 nt, Human
uuacaacauauuuagcuugauu

SEQ ID NO: 257927 - RNA, 22 nt, Human
acauguguaaaaguggauaaaa

SEQ ID NO: 257928 - RNA, 22 nt, Human
agggcacaagacucugagcccc

SEQ ID NO: 257929 - RNA, 22 nt, Human
auuggucucuagagucuauugu

SEQ ID NO: 257930 - RNA, 22 nt, Human
guuggugaguuucugaucacaa

SEQ ID NO: 257931 - RNA, 22 nt, Human
agcuagaacuacaggcaugugc

SEQ ID NO: 257932 - RNA, 22 nt, Human
gcagcccagguggaguaaucua

SEQ ID NO: 257933 - RNA, 22 nt, Human
gugcagugacccuggagagcug

SEQ ID NO: 257934 - RNA, 22 nt, Human
acccagccauguucaguucucu

SEQ ID NO: 257935 - RNA, 22 nt, Human
gggcuccaaaaucuaugucuuc

SEQ ID NO: 257936 - RNA, 22 nt, Human
ccuguggccgcgucgggcggcg

SEQ ID NO: 257937 - RNA, 22 nt, Human
cucuccagaauaugccgccgug

SEQ ID NO: 257938 - RNA, 22 nt, Human
auugauuuagcucaagacacau

SEQ ID NO: 257939 - RNA, 22 nt, Human
uccagcuggccuaacuucaggg

SEQ ID NO: 257940 - RNA, 23 nt, Human
uuucucauccagagagucagucc

SEQ ID NO: 257941 - RNA, 22 nt, Human
agaaguauaacuauuugcuuuc

SEQ ID NO: 257942 - RNA, 22 nt, Human
augaaaugauugaaaucuuuac

SEQ ID NO: 257943 - RNA, 22 nt, Human
acccagaggugucuagcaagcu

SEQ ID NO: 257944 - RNA, 22 nt, Human
ucccagcauaacaaacugcccg

SEQ ID NO: 257945 - RNA, 22 nt, Human
agaaacaagguguagguugacc

SEQ ID NO: 257946 - RNA, 22 nt, Human
cacaauuauuaucucuuucuac

SEQ ID NO: 257947 - RNA, 22 nt, Human
ggagugauggaaagugcuuggc

SEQ ID NO: 257948 - RNA, 22 nt, Human
ccagaggaguugaggcuuuggg

SEQ ID NO: 257949 - RNA, 22 nt, Human
ucugcccacagccuccugucca

SEQ ID NO: 257950 - RNA, 19 nt, Human
agggauauuuaaaaagcuc

SEQ ID NO: 257951 - RNA, 22 nt, Human
gccuguuuggcugcugacauug

SEQ ID NO: 257952 - RNA, 22 nt, Human
ugcuguggcaguuuauguauag

SEQ ID NO: 257953 - RNA, 22 nt, Human
uugcuuauagagaguuucauac

SEQ ID NO: 257954 - RNA, 22 nt, Human
cugaggagacagaagccaaaua

SEQ ID NO: 257955 - RNA, 22 nt, Human
ugcugagcgcauccggcggccg

SEQ ID NO: 257956 - RNA, 22 nt, Human
ucccugggucauucucuggcac

SEQ ID NO: 257957 - RNA, 22 nt, Human
uggacaugagcugagugggugu

SEQ ID NO: 257958 - RNA, 22 nt, Human
uugagaaugaugagauucuucc

SEQ ID NO: 257959 - RNA, 22 nt, Human
cagggcaggaugcugugauuau

SEQ ID NO: 257960 - RNA, 22 nt, Human
uugaaauuggguguggcuguca

SEQ ID NO: 257961 - RNA, 22 nt, Human
ugcucagcagaucucaggagau

SEQ ID NO: 257962 - RNA, 22 nt, Human
gaauacaaauaauaccaaggug

SEQ ID NO: 257963 - RNA, 22 nt, Human
acaggcauauuucuagauuaca

SEQ ID NO: 257964 - RNA, 22 nt, Human
cuguccugaggcagguggccug

SEQ ID NO: 257965 - RNA, 22 nt, Human
aggaaugucaaguagaugugcg

SEQ ID NO: 257966 - RNA, 22 nt, Human
uccugagagcagaguccaggug

SEQ ID NO: 257967 - RNA, 22 nt, Human
cugcucuggucucuucauguuu

SEQ ID NO: 257968 - RNA, 22 nt, Human
agaccuggauuccaauccuacc

SEQ ID NO: 257969 - RNA, 22 nt, Human
uuggaauucaaguuguagcuua

SEQ ID NO: 257970 - RNA, 23 nt, Human
cugggccuauggucugaauccaa

SEQ ID NO: 257971 - RNA, 22 nt, Human
cuggauguuuugcuaaggacuc

SEQ ID NO: 257972 - RNA, 19 nt, Human
ccuccccuuggaccagcaa

SEQ ID NO: 257973 - RNA, 22 nt, Human
acaaaagcacugcagaguaagc

SEQ ID NO: 257974 - RNA, 22 nt, Human
acacauuauagagaguauaaua

SEQ ID NO: 257975 - RNA, 22 nt, Human
accagcccucaggucagauacu

SEQ ID NO: 257976 - RNA, 22 nt, Human
ugcccacauucaaaaggugaug

SEQ ID NO: 257977 - RNA, 22 nt, Human
gaaggcaguaaauggcuguuuu

SEQ ID NO: 257978 - RNA, 22 nt, Human
uuagugaucaaaaucaaaauug

SEQ ID NO: 257979 - RNA, 22 nt, Human
agguauuauuagcaucucuauu

SEQ ID NO: 257980 - RNA, 22 nt, Human
ugugcagggaagggcaugcuau

SEQ ID NO: 257981 - RNA, 21 nt, Human
cccugcaggccagggcugagc

SEQ ID NO: 257982 - RNA, 22 nt, Human
ucaggcuguggcuuugaccgca

SEQ ID NO: 257983 - RNA, 22 nt, Human
cagggcccaggccacuggguug

SEQ ID NO: 257984 - RNA, 22 nt, Human
uuacagcauuuaaugagaucug

SEQ ID NO: 257985 - RNA, 22 nt, Human
aauguuucguaaauugucuaug

SEQ ID NO: 257986 - RNA, 22 nt, Human
aacaggcaauuuaggacucuuu

SEQ ID NO: 257987 - RNA, 22 nt, Human
auauuucucucagacauggaag

SEQ ID NO: 257988 - RNA, 22 nt, Human
auacacauauguguguauaugu

SEQ ID NO: 257989 - RNA, 22 nt, Human
cacaggacucgacugcagacag

SEQ ID NO: 257990 - RNA, 22 nt, Human
gugccuggcacacagaaggcaa

SEQ ID NO: 257991 - RNA, 22 nt, Human
gccuagugcacuggcagggcuc

SEQ ID NO: 257992 - RNA, 22 nt, Human
uuuuccuucugauacuccauuu

SEQ ID NO: 257993 - RNA, 22 nt, Human
ggcagcugucucugaguuagca

SEQ ID NO: 257994 - RNA, 22 nt, Human
ucucugggucucaguuuguaca

SEQ ID NO: 257995 - RNA, 22 nt, Human
cagaggaaggcucugggaaugu

SEQ ID NO: 257996 - RNA, 22 nt, Human
gcacaugucuuauucacuguua

SEQ ID NO: 257997 - RNA, 22 nt, Human
uaaguuuaaauguacaugaagc

SEQ ID NO: 257998 - RNA, 22 nt, Human
uggagcuguagccaccacccug

SEQ ID NO: 257999 - RNA, 22 nt, Human
aacauucaccucuaccuccuuc

SEQ ID NO: 258000 - RNA, 22 nt, Human
acuggcuuugagggaauagcua

SEQ ID NO: 258001 - RNA, 22 nt, Human
ugcuuuauguggcugauacuca

SEQ ID NO: 258002 - RNA, 22 nt, Human
ggagagguguauucaguggguc

SEQ ID NO: 258003 - RNA, 22 nt, Human
caauaacuuugauauuuugcgg

SEQ ID NO: 258004 - RNA, 22 nt, Human
acaagugcauggaaucagcugu

SEQ ID NO: 258005 - RNA, 22 nt, Human
uuccugguuuauaccuguauca

SEQ ID NO: 258006 - RNA, 22 nt, Human
ucucuggcagggauaucuggcu

SEQ ID NO: 258007 - RNA, 22 nt, Human
gaucccugcccucagccuggac

SEQ ID NO: 258008 - RNA, 22 nt, Human
ucagaaggaaacgaugccagcu

SEQ ID NO: 258009 - RNA, 22 nt, Human
augcauguuuauagggugcuuc

SEQ ID NO: 258010 - RNA, 22 nt, Human
gagugaguuggaaaacagacac

SEQ ID NO: 258011 - RNA, 22 nt, Human
ucuaggguguauaaggaagccu

SEQ ID NO: 258012 - RNA, 22 nt, Human
cuggcuccauuacucagcaucu

SEQ ID NO: 258013 - RNA, 22 nt, Human
gauccacaguuugaugaucaua

SEQ ID NO: 258014 - RNA, 22 nt, Human
ggcuggcuuucucuccgcaccu

SEQ ID NO: 258015 - RNA, 22 nt, Human
uagguucacacaucuuccagau

SEQ ID NO: 258016 - RNA, 19 nt, Human
auguuuacacucaggggcu

SEQ ID NO: 258017 - RNA, 21 nt, Human
guuauuuuaagugagcuuugc

SEQ ID NO: 258018 - RNA, 23 nt, Human
ccagggagguugauugguuaccc

SEQ ID NO: 258019 - RNA, 22 nt, Human
caaggccauauugccuguaugu

SEQ ID NO: 258020 - RNA, 22 nt, Human
uuaugcaaaggggccucuuccu

SEQ ID NO: 258021 - RNA, 22 nt, Human
uuuaguguagccuaagcagaau

SEQ ID NO: 258022 - RNA, 22 nt, Human
ggcaccaggaucagucugucau

SEQ ID NO: 258023 - RNA, 22 nt, Human
acauuccucagugccaguugag

SEQ ID NO: 258024 - RNA, 20 nt, Human
acucuguacugucaauguug

SEQ ID NO: 258025 - RNA, 22 nt, Human
uggacacacauguaugucagag

SEQ ID NO: 258026 - RNA, 22 nt, Human
aacagcagggaaauuccaaguc

SEQ ID NO: 258027 - RNA, 22 nt, Human
ugucaauauguaauaacugaau

SEQ ID NO: 258028 - RNA, 20 nt, Human
acaugaaaggaaacaggaaa

SEQ ID NO: 258029 - RNA, 22 nt, Human
agggcccuaaggaaggcacaca

SEQ ID NO: 258030 - RNA, 22 nt, Human
uugcuuuaucuaagcauggcca

SEQ ID NO: 258031 - RNA, 22 nt, Human
ugaaacauuugaugaucuuugg

SEQ ID NO: 258032 - RNA, 23 nt, Human
aaauaggaguaucuggaucauga

SEQ ID NO: 258033 - RNA, 22 nt, Human
gguaaaaaucacaaauacuuua

SEQ ID NO: 258034 - RNA, 22 nt, Human
ugccuacauuccuugcuuaugg

SEQ ID NO: 258035 - RNA, 22 nt, Human
acuguagucuaaauauagucuu

SEQ ID NO: 258036 - RNA, 22 nt, Human
aaaauccacaacgcucauuuca

SEQ ID NO: 258037 - RNA, 22 nt, Human
aggacuuagaacauuauguacu

SEQ ID NO: 258038 - RNA, 21 nt, Human
guucuacaguuuuagaauucc

SEQ ID NO: 258039 - RNA, 22 nt, Human
cuccaaucugggcaacagagca

SEQ ID NO: 258040 - RNA, 22 nt, Human
gcacccaggccggcgacugcag

SEQ ID NO: 258041 - RNA, 22 nt, Human
acagcagggggagcuguuggac

SEQ ID NO: 258042 - RNA, 22 nt, Human
ggaggggucucuagcgaggaga

SEQ ID NO: 258043 - RNA, 22 nt, Human
aagcaaagugcuuugccuccag

SEQ ID NO: 258044 - RNA, 22 nt, Human
gccagagcaugcacugccugca

SEQ ID NO: 258045 - RNA, 22 nt, Human
aauuaugauuggucuaaaccag

SEQ ID NO: 258046 - RNA, 22 nt, Human
acaugcauaggagaagucuuua

SEQ ID NO: 258047 - RNA, 22 nt, Human
acagagcuguacuacuuacuga

SEQ ID NO: 258048 - RNA, 22 nt, Human
ugcaauuuuaauacauuagagg

SEQ ID NO: 258049 - RNA, 18 nt, Human
gaaaauacucugggcuca

SEQ ID NO: 258050 - RNA, 22 nt, Human
ggagagaaauugagguagcaag

SEQ ID NO: 258051 - RNA, 22 nt, Human
gaguguuuuacucaaagaaaga

SEQ ID NO: 258052 - RNA, 22 nt, Human
uccaggcauguggccaguacuc

SEQ ID NO: 258053 - RNA, 22 nt, Human
uuugcaaagugacuauuauaug

SEQ ID NO: 258054 - RNA, 22 nt, Human
ugcacacauguuuacaagcauc

SEQ ID NO: 258055 - RNA, 23 nt, Human
acacugucucauggauagacugc

SEQ ID NO: 258056 - RNA, 22 nt, Human
ugugcuauuuuugcauaugugu

SEQ ID NO: 258057 - RNA, 23 nt, Human
uuguacagcccagauuccucuuc

SEQ ID NO: 258058 - RNA, 22 nt, Human
uucucucccaugaagcuucuau

SEQ ID NO: 258059 - RNA, 22 nt, Human
gaaagugcuaggaaguguuaga

SEQ ID NO: 258060 - RNA, 22 nt, Human
acagcaggcaugaaugacacug

SEQ ID NO: 258061 - RNA, 22 nt, Human
gcucuguaccugcggagaugag

SEQ ID NO: 258062 - RNA, 22 nt, Human
uggagagaagaggcagugugcu

SEQ ID NO: 258063 - RNA, 20 nt, Human
aaugaguuauuuuguauaug

SEQ ID NO: 258064 - RNA, 18 nt, Human
augcugcccucugagggu

SEQ ID NO: 258065 - RNA, 22 nt, Human
gcugguuucacccaaccgaugu

SEQ ID NO: 258066 - RNA, 22 nt, Human
agcaggagcauuuccaugauuc

SEQ ID NO: 258067 - RNA, 22 nt, Human
uucaugaaaguguaucuugugg

SEQ ID NO: 258068 - RNA, 22 nt, Human
uauuaaagagagaaucaucauc

SEQ ID NO: 258069 - RNA, 22 nt, Human
aaaucccacucacgaguuuugc

SEQ ID NO: 258070 - RNA, 22 nt, Human
uucugauucaugauccaguucu

SEQ ID NO: 258071 - RNA, 22 nt, Human
aaagagaaaaagaucccggcuc

SEQ ID NO: 258072 - RNA, 22 nt, Human
aauaagaauuuacuugucaaga

SEQ ID NO: 258073 - RNA, 22 nt, Human
aggaaugugaaacagguggcug

SEQ ID NO: 258074 - RNA, 23 nt, Human
ccagggagugcuacuaucaagcc

SEQ ID NO: 258075 - RNA, 22 nt, Human
ugacagacuacugccucuauug

SEQ ID NO: 258076 - RNA, 19 nt, Human
ccucuuccucugacacuau

SEQ ID NO: 258077 - RNA, 22 nt, Human
cugggucuggcuacugcuuccu

SEQ ID NO: 258078 - RNA, 22 nt, Human
acugaggauggauaggucauau

SEQ ID NO: 258079 - RNA, 20 nt, Human
acagguucauucugugugac

SEQ ID NO: 258080 - RNA, 20 nt, Human
aauuagcuuaagucaaucag

SEQ ID NO: 258081 - RNA, 22 nt, Human
agagggcaugcuugguggccug

SEQ ID NO: 258082 - RNA, 22 nt, Human
uguagaggaggaaacugaggcu

SEQ ID NO: 258083 - RNA, 22 nt, Human
ugcaagcaaguuuuugaagugg

SEQ ID NO: 258084 - RNA, 22 nt, Human
gccagugugucuugcaggcucc

SEQ ID NO: 258085 - RNA, 22 nt, Human
ugcagaggugaaagacuagcaa

SEQ ID NO: 258086 - RNA, 23 nt, Human
uugcuuagagaccuccucaucag

SEQ ID NO: 258087 - RNA, 22 nt, Human
uggguccuugcugauugcugag

SEQ ID NO: 258088 - RNA, 22 nt, Human
ccagguggaggugugagguccu

SEQ ID NO: 258089 - RNA, 22 nt, Human
ugagcuuacgugggaacagacu

SEQ ID NO: 258090 - RNA, 22 nt, Human
aguaucauguuggaauuaauca

SEQ ID NO: 258091 - RNA, 22 nt, Human
aaaaguauggugguccuuuuua

SEQ ID NO: 258092 - RNA, 22 nt, Human
uucuccaggcuugggccagguc

SEQ ID NO: 258093 - RNA, 18 nt, Human
uagauuaaaauugaauuc

SEQ ID NO: 258094 - RNA, 22 nt, Human
augagguuuuacugccauuuuc

SEQ ID NO: 258095 - RNA, 22 nt, Human
ucauguuuguuggaaauguggc

SEQ ID NO: 258096 - RNA, 22 nt, Human
agcuggaauccuacuucuaaca

SEQ ID NO: 258097 - RNA, 18 nt, Human
uuauucagacgcauauga

SEQ ID NO: 258098 - RNA, 22 nt, Human
auguuuuacccuuugcacaaac

SEQ ID NO: 258099 - RNA, 22 nt, Human
agauguguuucuaguuccugca

SEQ ID NO: 258100 - RNA, 22 nt, Human
agcaugcaggaaccacauggca

SEQ ID NO: 258101 - RNA, 22 nt, Human
cuuuccuccacucccuaggcuu

SEQ ID NO: 258102 - RNA, 22 nt, Human
auucuaaauguaauuuagaauu

SEQ ID NO: 258103 - RNA, 22 nt, Human
acaggcugggcgcuuccugcgg

SEQ ID NO: 258104 - RNA, 22 nt, Human
aggcagaugugauuaauuuccu

SEQ ID NO: 258105 - RNA, 22 nt, Human
ccuguaggaacgccuucauuug

SEQ ID NO: 258106 - RNA, 23 nt, Human
aguaacaugcaaauaacagucug

SEQ ID NO: 258107 - RNA, 22 nt, Human
uaguccugaccuugccaccagc

SEQ ID NO: 258108 - RNA, 22 nt, Human
ucuuggaggagaguaaguaccu

SEQ ID NO: 258109 - RNA, 22 nt, Human
ucuuccuugccuugcuucauca

SEQ ID NO: 258110 - RNA, 22 nt, Human
cuggguuccauguagccaagag

SEQ ID NO: 258111 - RNA, 22 nt, Human
uuuggaauaaucagauccuagu

SEQ ID NO: 258112 - RNA, 22 nt, Human
cuagggccaaaggcugugaugc

SEQ ID NO: 258113 - RNA, 22 nt, Human
aggccaggccuuucuccauucc

SEQ ID NO: 258114 - RNA, 22 nt, Human
ggcuauuucauuuaguacuagg

SEQ ID NO: 258115 - RNA, 22 nt, Human
gaaggagccgagcucuucccca

SEQ ID NO: 258116 - RNA, 22 nt, Human
caucuuuguuucaucuguccag

SEQ ID NO: 258117 - RNA, 22 nt, Human
uuuccaaguuguuaccuucuac

SEQ ID NO: 258118 - RNA, 22 nt, Human
gaguggggaaagccaggacaga

SEQ ID NO: 258119 - RNA, 22 nt, Human
uuauugaguuguaagagcucuu

SEQ ID NO: 258120 - RNA, 22 nt, Human
uuccaggagacuuccagaaaua

SEQ ID NO: 258121 - RNA, 19 nt, Human
cugggaguucacugcugcc

SEQ ID NO: 258122 - RNA, 22 nt, Human
gcagugggagcuuaggcagugc

SEQ ID NO: 258123 - RNA, 22 nt, Human
gaauuuuagaauaugugggcuu

SEQ ID NO: 258124 - RNA, 23 nt, Human
aguuuuucugcaugguucuguau

SEQ ID NO: 258125 - RNA, 22 nt, Human
agaagcaggccucacagaucug

SEQ ID NO: 258126 - RNA, 22 nt, Human
ggcacagcugaugcagacacac

SEQ ID NO: 258127 - RNA, 22 nt, Human
uggagcucugauuaaauuggaa

SEQ ID NO: 258128 - RNA, 22 nt, Human
cugcuuuaaaacugauacauga

SEQ ID NO: 258129 - RNA, 22 nt, Human
uccagaccauggauggcugcaa

SEQ ID NO: 258130 - RNA, 22 nt, Human
gaauuacauaguuucuagguuc

SEQ ID NO: 258131 - RNA, 22 nt, Human
ucccugggccuaucuuagcucc

SEQ ID NO: 258132 - RNA, 22 nt, Human
uuuaagaaguuauguuauaaau

SEQ ID NO: 258133 - RNA, 23 nt, Human
ccaggcaguagcuauugaaguga

SEQ ID NO: 258134 - RNA, 20 nt, Human
agauuaggggcuuucuucuu

SEQ ID NO: 258135 - RNA, 22 nt, Human
agagcugagaauguggcuuccu

SEQ ID NO: 258136 - RNA, 22 nt, Human
gcuccaggugucccagguaaaa

SEQ ID NO: 258137 - RNA, 22 nt, Human
uuaaagaugcagcuuuagagaa

SEQ ID NO: 258138 - RNA, 23 nt, Human
ucugcaagauaaugaagaugaua

SEQ ID NO: 258139 - RNA, 19 nt, Human
ucacauucagccuugcuga

SEQ ID NO: 258140 - RNA, 22 nt, Human
cagcuucugagcaagccagggg

SEQ ID NO: 258141 - RNA, 22 nt, Human
ggcagguguggaguguuauuuu

SEQ ID NO: 258142 - RNA, 22 nt, Human
gcccagcccugaggucacagcu

SEQ ID NO: 258143 - RNA, 22 nt, Human
uagaaacugauagucuugugcu

SEQ ID NO: 258144 - RNA, 22 nt, Human
uuguagcuuuuuaaugugcugc

SEQ ID NO: 258145 - RNA, 22 nt, Human
gcagauuacuggacugauucca

SEQ ID NO: 258146 - RNA, 22 nt, Human
uuugcaaauuucgucuccucag

SEQ ID NO: 258147 - RNA, 23 nt, Human
gggugggccaaauuagguagccu

SEQ ID NO: 258148 - RNA, 22 nt, Human
cagcuuuuuagaaucuagggca

SEQ ID NO: 258149 - RNA, 22 nt, Human
gagaaagauuguccuucagggg

SEQ ID NO: 258150 - RNA, 22 nt, Human
cagcauucuacuuugugaacug

SEQ ID NO: 258151 - RNA, 22 nt, Human
uacacaucacuguaucuuucag

SEQ ID NO: 258152 - RNA, 22 nt, Human
acccacgaagaugagcggcaug

SEQ ID NO: 258153 - RNA, 19 nt, Human
agcuuuuacuaacagcaga

SEQ ID NO: 258154 - RNA, 22 nt, Human
uuuacaagucagggacuguucu

SEQ ID NO: 258155 - RNA, 21 nt, Human
ugggccaguagaaaggaaggc

SEQ ID NO: 258156 - RNA, 22 nt, Human
uacaagaaggauggagcccacu

SEQ ID NO: 258157 - RNA, 22 nt, Human
uggcuuccuaggagcccgugcu

SEQ ID NO: 258158 - RNA, 21 nt, Human
uggggaggggaccugauuaug

SEQ ID NO: 258159 - RNA, 22 nt, Human
ugagcagggacuuuggagucug

SEQ ID NO: 258160 - RNA, 22 nt, Human
uguaggauuuucaccagaccuu

SEQ ID NO: 258161 - RNA, 22 nt, Human
ucugguccucucugugaugcua

SEQ ID NO: 258162 - RNA, 21 nt, Human
cagcuucuucugugaccuggu

SEQ ID NO: 258163 - RNA, 22 nt, Human
uccagagcagguggucagaagg

SEQ ID NO: 258164 - RNA, 22 nt, Human
aacucuuuggucucaggaaagg

SEQ ID NO: 258165 - RNA, 22 nt, Human
ugaggacauuuaucuuggcgca

SEQ ID NO: 258166 - RNA, 22 nt, Human
auuggaaaugcuacaaguuaga

SEQ ID NO: 258167 - RNA, 22 nt, Human
aagucucucugugugggauaag

SEQ ID NO: 258168 - RNA, 22 nt, Human
ggcagugccugaugcugcagga

SEQ ID NO: 258169 - RNA, 22 nt, Human
ccaaggagaaugacaccaugga

SEQ ID NO: 258170 - RNA, 22 nt, Human
acagcuggaguguuggugaggu

SEQ ID NO: 258171 - RNA, 22 nt, Human
auugcuuaucuaucuuuaaguc

SEQ ID NO: 258172 - RNA, 22 nt, Human
ggagcugaggaauagcuuugau

SEQ ID NO: 258173 - RNA, 22 nt, Human
aagcuguugaaguaauucagcc

SEQ ID NO: 258174 - RNA, 22 nt, Human
augaugucaugaauauauuagu

SEQ ID NO: 258175 - RNA, 22 nt, Human
ucaggucaggaaaauaagauug

SEQ ID NO: 258176 - RNA, 22 nt, Human
uuuccuugcacauugguuucca

SEQ ID NO: 258177 - RNA, 22 nt, Human
gccuggcaggccucaugagggg

SEQ ID NO: 258178 - RNA, 22 nt, Human
ccugggcuuacgaccucugacu

SEQ ID NO: 258179 - RNA, 22 nt, Human
cagaaguuugacauguuuagcu

SEQ ID NO: 258180 - RNA, 22 nt, Human
aaaguguaaggaauuuaaguaa

SEQ ID NO: 258181 - RNA, 22 nt, Human
gggugggagucuggcccucaaa

SEQ ID NO: 258182 - RNA, 21 nt, Human
guccuucagcaaguuaguggc

SEQ ID NO: 258183 - RNA, 22 nt, Human
auuaagggccaauccuccagcc

SEQ ID NO: 258184 - RNA, 22 nt, Human
cugggucaaggaaugcuggugg

SEQ ID NO: 258185 - RNA, 22 nt, Human
uaaaguucagugcaugaaugug

SEQ ID NO: 258186 - RNA, 22 nt, Human
augaggcaucugcagucacuag

SEQ ID NO: 258187 - RNA, 22 nt, Human
aaaugcaaggccaugugaagga

SEQ ID NO: 258188 - RNA, 20 nt, Human
aggacagcagcugccacuug

SEQ ID NO: 258189 - RNA, 22 nt, Human
gcagugcuaaggauucugccuu

SEQ ID NO: 258190 - RNA, 22 nt, Human
ugcuggaggaguuuacuguggc

SEQ ID NO: 258191 - RNA, 20 nt, Human
uuuacauuuugaaacaguga

SEQ ID NO: 258192 - RNA, 22 nt, Human
agaguuuggugaagcaauuuga

SEQ ID NO: 258193 - RNA, 22 nt, Human
agcagguguaucggucaccuac

SEQ ID NO: 258194 - RNA, 22 nt, Human
cuuaaauuggaugaguuaaguu

SEQ ID NO: 258195 - RNA, 22 nt, Human
gguggcaggcuggcauuggcaa

SEQ ID NO: 258196 - RNA, 22 nt, Human
ccuggcugguugucugauucua

SEQ ID NO: 258197 - RNA, 22 nt, Human
ggucaacagagguaaugguaac

SEQ ID NO: 258198 - RNA, 22 nt, Human
agcccugcgcucacguucugca

SEQ ID NO: 258199 - RNA, 22 nt, Human
gacagaaggcaucuagggcacg

SEQ ID NO: 258200 - RNA, 22 nt, Human
ucauaaagcauuucagcuuuug

SEQ ID NO: 258201 - RNA, 22 nt, Human
cuuuggcuugcacuauuacacu

SEQ ID NO: 258202 - RNA, 22 nt, Human
auuucaguagaaaaucuugauu

SEQ ID NO: 258203 - RNA, 22 nt, Human
gcuuucugggcuauagaacggg

SEQ ID NO: 258204 - RNA, 22 nt, Human
ccuguucaugaaacugcuuucc

SEQ ID NO: 258205 - RNA, 22 nt, Human
gcauucuuccugggcugggggc

SEQ ID NO: 258206 - RNA, 23 nt, Human
uuaggcacuuaguagggccagag

SEQ ID NO: 258207 - RNA, 22 nt, Human
gcaccucauuuugcagguagaa

SEQ ID NO: 258208 - RNA, 22 nt, Human
uagaaccuauuagaaauguauu

SEQ ID NO: 258209 - RNA, 22 nt, Human
cuggcugggaaguagaguaggu

SEQ ID NO: 258210 - RNA, 22 nt, Human
gucugcccugagcucccagugc

SEQ ID NO: 258211 - RNA, 22 nt, Human
uuaccuguguguuugauacaua

SEQ ID NO: 258212 - RNA, 22 nt, Human
agaggaauaugggugcacuaga

SEQ ID NO: 258213 - RNA, 18 nt, Human
uggaggaaucacaauggc

SEQ ID NO: 258214 - RNA, 22 nt, Human
agacagacacaugguaacagau

SEQ ID NO: 258215 - RNA, 22 nt, Human
uuguuugucauaauaucauuac

SEQ ID NO: 258216 - RNA, 22 nt, Human
aaacugcaauuauguuugcaga

SEQ ID NO: 258217 - RNA, 22 nt, Human
uacuucaugaguuaauaugcag

SEQ ID NO: 258218 - RNA, 22 nt, Human
ccugguggccuucagcccacaa

SEQ ID NO: 258219 - RNA, 22 nt, Human
caugcagucaauaaacaugugu

SEQ ID NO: 258220 - RNA, 22 nt, Human
gcuggcaggagccuuucccuuu

SEQ ID NO: 258221 - RNA, 22 nt, Human
agaggucagaacaggaaagugu

SEQ ID NO: 258222 - RNA, 22 nt, Human
ccuguucaaguugcagggcugg

SEQ ID NO: 258223 - RNA, 22 nt, Human
agucuucacucuucacuacuau

SEQ ID NO: 258224 - RNA, 23 nt, Human
aagcugaacuuguuugcugggag

SEQ ID NO: 258225 - RNA, 22 nt, Human
agcaggccacugcagcuggagc

SEQ ID NO: 258226 - RNA, 22 nt, Human
cccugagcucaggcccuugggg

SEQ ID NO: 258227 - RNA, 22 nt, Human
ggagccuggcccggcccuuggc

SEQ ID NO: 258228 - RNA, 22 nt, Human
cuggguguuggguacugaccgu

SEQ ID NO: 258229 - RNA, 22 nt, Human
guccaggccaugguggacacag

SEQ ID NO: 258230 - RNA, 22 nt, Human
gaaaugcaggcuuggauucagc

SEQ ID NO: 258231 - RNA, 22 nt, Human
cccugcagugugaccucaccua

SEQ ID NO: 258232 - RNA, 22 nt, Human
ccuuguuuuggaaccaaaggau

SEQ ID NO: 258233 - RNA, 22 nt, Human
ggagcccuccaucccuugcggc

SEQ ID NO: 258234 - RNA, 21 nt, Human
cagugagguccccagccuagg

SEQ ID NO: 258235 - RNA, 22 nt, Human
uuccuucuggaggcuccagggg

SEQ ID NO: 258236 - RNA, 21 nt, Human
agccagucucaguacuguacu

SEQ ID NO: 258237 - RNA, 22 nt, Human
aaaguuucaauagaggaagugg

SEQ ID NO: 258238 - RNA, 22 nt, Human
auguaacaggugaagcucugag

SEQ ID NO: 258239 - RNA, 21 nt, Human
uggagagcccuugccugaguc

SEQ ID NO: 258240 - RNA, 22 nt, Human
uuguauuagcuguaaauuuucu

SEQ ID NO: 258241 - RNA, 22 nt, Human
uggcuacauuuauacucucauu

SEQ ID NO: 258242 - RNA, 22 nt, Human
uuggccuaccugggaaugcugg

SEQ ID NO: 258243 - RNA, 22 nt, Human
ggccuggagucagggaaagcaa

SEQ ID NO: 258244 - RNA, 22 nt, Human
agcuagagcugagaagcacuug

SEQ ID NO: 258245 - RNA, 22 nt, Human
uccucccugggagcuucugagu

SEQ ID NO: 258246 - RNA, 22 nt, Human
auaaaggcagauuuuggaccuc

SEQ ID NO: 258247 - RNA, 22 nt, Human
caguccugggcacagcccuggg

SEQ ID NO: 258248 - RNA, 22 nt, Human
uagcaagaaguagcucuggauu

SEQ ID NO: 258249 - RNA, 22 nt, Human
uggcccuguguccugcugccag

SEQ ID NO: 258250 - RNA, 22 nt, Human
uguaagaagggccagagcucca

SEQ ID NO: 258251 - RNA, 21 nt, Human
ucccacugccacagcuucagg

SEQ ID NO: 258252 - RNA, 22 nt, Human
aaacaagcugcagacaagccau

SEQ ID NO: 258253 - RNA, 23 nt, Human
aaauagagauaggccagcuuugc

SEQ ID NO: 258254 - RNA, 23 nt, Human
cacacccaucacuaagagcuccu

SEQ ID NO: 258255 - RNA, 22 nt, Human
aaguacauuuuuaacuuacagc

SEQ ID NO: 258256 - RNA, 22 nt, Human
auagauguacguauguaaauca

SEQ ID NO: 258257 - RNA, 22 nt, Human
gggagaaaugucuggccugcug

SEQ ID NO: 258258 - RNA, 22 nt, Human
cagagccugcugccuucugaag

SEQ ID NO: 258259 - RNA, 22 nt, Human
agccccacacucucucugagaa

SEQ ID NO: 258260 - RNA, 19 nt, Human
gcugggugaggucguugga

SEQ ID NO: 258261 - RNA, 19 nt, Human
uacaagcuuaaaguaaugu

SEQ ID NO: 258262 - RNA, 22 nt, Human
aggaggaggcuggaguacaccc

SEQ ID NO: 258263 - RNA, 22 nt, Human
agauacaguguuacauuuuuau

SEQ ID NO: 258264 - RNA, 22 nt, Human
uguaauaaugaggcauccagcc

SEQ ID NO: 258265 - RNA, 22 nt, Human
cucuuccuuaagacuauaaaga

SEQ ID NO: 258266 - RNA, 22 nt, Human
aggcugagcugaccugguuugg

SEQ ID NO: 258267 - RNA, 22 nt, Human
uagaaacucucacgagugaaac

SEQ ID NO: 258268 - RNA, 22 nt, Human
uaggcagauuccauauuuuggc

SEQ ID NO: 258269 - RNA, 21 nt, Human
gaggcugucugcugcuggccu

SEQ ID NO: 258270 - RNA, 22 nt, Human
gccuuccuuacaccugcucagc

SEQ ID NO: 258271 - RNA, 22 nt, Human
agggccugagaccguggcuuga

SEQ ID NO: 258272 - RNA, 21 nt, Human
agcaggcagugggcuggauuu

SEQ ID NO: 258273 - RNA, 22 nt, Human
gcuguacaucacaauuugcugu

SEQ ID NO: 258274 - RNA, 22 nt, Human
ugaugaaaguucaguagugaau

SEQ ID NO: 258275 - RNA, 22 nt, Human
agcuuaaacucuuugaaguuau

SEQ ID NO: 258276 - RNA, 22 nt, Human
aaacagauaagggacaauuuca

SEQ ID NO: 258277 - RNA, 22 nt, Human
ggagggccaucuugggugugau

SEQ ID NO: 258278 - RNA, 22 nt, Human
uuaguguguccaguucugaaaa

SEQ ID NO: 258279 - RNA, 22 nt, Human
ucucuggcccuguuuucuaucu

SEQ ID NO: 258280 - RNA, 22 nt, Human
ggcaccagcaggcaccgaugcc

SEQ ID NO: 258281 - RNA, 22 nt, Human
gucuuucugccaugugaagaga

SEQ ID NO: 258282 - RNA, 22 nt, Human
ucucuguaaggaagaauuagau

SEQ ID NO: 258283 - RNA, 20 nt, Human
uacaucucucagaugucuaa

SEQ ID NO: 258284 - RNA, 22 nt, Human
agaggaagcugagaugccucuu

SEQ ID NO: 258285 - RNA, 22 nt, Human
aaauaauguuaggccuuugcuc

SEQ ID NO: 258286 - RNA, 22 nt, Human
acacaaugcauauuuuuccaga

SEQ ID NO: 258287 - RNA, 22 nt, Human
gagagggcaaacuuguagcuaa

SEQ ID NO: 258288 - RNA, 22 nt, Human
ugguuagaggcuucuugcuugg

SEQ ID NO: 258289 - RNA, 22 nt, Human
uuccaagagcuuuaauuguuga

SEQ ID NO: 258290 - RNA, 22 nt, Human
ccugagcuccaguagcagccag

SEQ ID NO: 258291 - RNA, 20 nt, Human
ugagccaggcuaggaagggc

SEQ ID NO: 258292 - RNA, 20 nt, Human
agugccagggcaggugagag

SEQ ID NO: 258293 - RNA, 22 nt, Human
acuggcuuggcaggaggaagau

SEQ ID NO: 258294 - RNA, 22 nt, Human
cuuugaaaccugcucugcagaa

SEQ ID NO: 258295 - RNA, 22 nt, Human
gcuucucuggccugcagggcau

SEQ ID NO: 258296 - RNA, 22 nt, Human
aggcccuguccauggugcugaa

SEQ ID NO: 258297 - RNA, 22 nt, Human
agaguuggcccacguguaggcg

SEQ ID NO: 258298 - RNA, 22 nt, Human
acugagacugaaucugaaugau

SEQ ID NO: 258299 - RNA, 22 nt, Human
cagugcaggcuuguggccgcag

SEQ ID NO: 258300 - RNA, 22 nt, Human
uaaaagaccacaaggugguaau

SEQ ID NO: 258301 - RNA, 22 nt, Human
aacaauaggaccuuuauguucu

SEQ ID NO: 258302 - RNA, 22 nt, Human
cuggccucauagccaagcugug

SEQ ID NO: 258303 - RNA, 20 nt, Human
uguccccuagaucccagcuc

SEQ ID NO: 258304 - RNA, 22 nt, Human
uugaccuuggcuuuuaaaauau

SEQ ID NO: 258305 - RNA, 22 nt, Human
cagaaguuccuauuuaccuccu

SEQ ID NO: 258306 - RNA, 22 nt, Human
aucugauucauugaaaugggug

SEQ ID NO: 258307 - RNA, 22 nt, Human
cuggcucccggggaucgagcac

SEQ ID NO: 258308 - RNA, 22 nt, Human
ucuguauucuauggcaguuggu

SEQ ID NO: 258309 - RNA, 22 nt, Human
auuauaugugggauagaauuua

SEQ ID NO: 258310 - RNA, 17 nt, Human
ucuuucccugggagaug

SEQ ID NO: 258311 - RNA, 22 nt, Human
uuuccuuuccaaaauucugccu

SEQ ID NO: 258312 - RNA, 22 nt, Human
gccccaccuugagagcagaaac

SEQ ID NO: 258313 - RNA, 22 nt, Human
uguuuugguuuaaguauaugaa

SEQ ID NO: 258314 - RNA, 22 nt, Human
uacauguauguguacgugcaug

SEQ ID NO: 258315 - RNA, 22 nt, Human
cggacccacucggaucccagcc

SEQ ID NO: 258316 - RNA, 22 nt, Human
aagaguuugucagaucugcacg

SEQ ID NO: 258317 - RNA, 22 nt, Human
gagcccucucuguaggcaagua

SEQ ID NO: 258318 - RNA, 22 nt, Human
gcuugguuucuaacuuuucaua

SEQ ID NO: 258319 - RNA, 22 nt, Human
gagcccagcuugcacauggagc

SEQ ID NO: 258320 - RNA, 21 nt, Human
ugguuucuaagcugucagucu

SEQ ID NO: 258321 - RNA, 22 nt, Human
ccuguucaccauggucacgugc

SEQ ID NO: 258322 - RNA, 22 nt, Human
ccugagucuuggcuucuuggcu

SEQ ID NO: 258323 - RNA, 22 nt, Human
guuccucagcccuuacuuagcc

SEQ ID NO: 258324 - RNA, 22 nt, Human
cauucaaacauuaauuuauuca

SEQ ID NO: 258325 - RNA, 22 nt, Human
agaacguggaauguggcuccuu

SEQ ID NO: 258326 - RNA, 22 nt, Human
uagcuccuggcugcagggccuc

SEQ ID NO: 258327 - RNA, 22 nt, Human
uggaugucauaguuggauauac

SEQ ID NO: 258328 - RNA, 21 nt, Human
uucuaaguguuaccuuuucuu

SEQ ID NO: 258329 - RNA, 22 nt, Human
gguuucaaugagaagugcuugu

SEQ ID NO: 258330 - RNA, 22 nt, Human
aggucuggaggcggagucagga

SEQ ID NO: 258331 - RNA, 22 nt, Human
uaacugguuucauaucauuucc

SEQ ID NO: 258332 - RNA, 22 nt, Human
gcccuccaugagacacagugua

SEQ ID NO: 258333 - RNA, 22 nt, Human
uuuauguacauauccacaagga

SEQ ID NO: 258334 - RNA, 22 nt, Human
cauggcagaaaccugagcugcu

SEQ ID NO: 258335 - RNA, 20 nt, Human
gcagccguggagacuaggag

SEQ ID NO: 258336 - RNA, 22 nt, Human
aaauaguuagcccugcauauau

SEQ ID NO: 258337 - RNA, 22 nt, Human
aaacaggcuuauauuuugcucu

SEQ ID NO: 258338 - RNA, 22 nt, Human
ugcacagaugggcuuguucaua

SEQ ID NO: 258339 - RNA, 22 nt, Human
acccauuuuuaaauauaacuug

SEQ ID NO: 258340 - RNA, 22 nt, Human
uacugaaagaauacauaauuuc

SEQ ID NO: 258341 - RNA, 22 nt, Human
gcugccuucccggaaugucauc

SEQ ID NO: 258342 - RNA, 22 nt, Human
aguguccuacagcuccugccug

SEQ ID NO: 258343 - RNA, 22 nt, Human
gcagugcuaaguagcuggccca

SEQ ID NO: 258344 - RNA, 22 nt, Human
agaggccaugcuagaggccugg

SEQ ID NO: 258345 - RNA, 22 nt, Human
gggcagcuguaucugagcuuau

SEQ ID NO: 258346 - RNA, 22 nt, Human
ggccuccaucuuaucuuacucu

SEQ ID NO: 258347 - RNA, 22 nt, Human
ggagaaaggcauagcagaaccu

SEQ ID NO: 258348 - RNA, 22 nt, Human
cccagcaggugccaucacucug

SEQ ID NO: 258349 - RNA, 22 nt, Human
uuccaggagaggaaaccugauu

SEQ ID NO: 258350 - RNA, 22 nt, Human
cuccuggaagcccgcccugcug

SEQ ID NO: 258351 - RNA, 22 nt, Human
aauaucuuggcccaacuccaga

SEQ ID NO: 258352 - RNA, 22 nt, Human
auaugcauuuaccuggcauaua

SEQ ID NO: 258353 - RNA, 22 nt, Human
gaaguauuacucugaauguauu

SEQ ID NO: 258354 - RNA, 22 nt, Human
ggggacugaggcacugaaggug

SEQ ID NO: 258355 - RNA, 22 nt, Human
uaggaagaugaguaucaacuug

SEQ ID NO: 258356 - RNA, 22 nt, Human
uuccaaacugccaauucagaag

SEQ ID NO: 258357 - RNA, 22 nt, Human
gcucaguguuucugguagaaaa

SEQ ID NO: 258358 - RNA, 22 nt, Human
aggcugaggugugcugugaucg

SEQ ID NO: 258359 - RNA, 21 nt, Human
auggcugguggcucagccucc

SEQ ID NO: 258360 - RNA, 22 nt, Human
ugugugaggugguucugagaag

SEQ ID NO: 258361 - RNA, 21 nt, Human
uccugggagucugagauccug

SEQ ID NO: 258362 - RNA, 22 nt, Human
ggcuucuuuguaacgugccagc

SEQ ID NO: 258363 - RNA, 22 nt, Human
auucugggaguguaggaugguu

SEQ ID NO: 258364 - RNA, 22 nt, Human
cugggagcgcagcaggcacaac

SEQ ID NO: 258365 - RNA, 22 nt, Human
uuggugaacacauacacauuuu

SEQ ID NO: 258366 - RNA, 22 nt, Human
aagcuuuaugacuuggagacag

SEQ ID NO: 258367 - RNA, 22 nt, Human
uacugucuggguucccaagcaa

SEQ ID NO: 258368 - RNA, 21 nt, Human
cacacagcugcccuuagguag

SEQ ID NO: 258369 - RNA, 19 nt, Human
uggcagggagugauauuag

SEQ ID NO: 258370 - RNA, 22 nt, Human
uguugcaguaaaaauggagagg

SEQ ID NO: 258371 - RNA, 22 nt, Human
ccauguguucaauaagggaguu

SEQ ID NO: 258372 - RNA, 23 nt, Human
uucauuuaggaguucauaagagc

SEQ ID NO: 258373 - RNA, 23 nt, Human
acucaaauuucgcuuggaguuca

SEQ ID NO: 258374 - RNA, 22 nt, Human
gggcugcuguguuccugaggca

SEQ ID NO: 258375 - RNA, 22 nt, Human
ucuucagauaaagggagaguau

SEQ ID NO: 258376 - RNA, 22 nt, Human
cagacagggguaaccuuccuca

SEQ ID NO: 258377 - RNA, 22 nt, Human
gggcuucuauucuggcacaaga

SEQ ID NO: 258378 - RNA, 22 nt, Human
ugcuugaacaaggauaaauuug

SEQ ID NO: 258379 - RNA, 22 nt, Human
cagcuuuggcccagucgggagg

SEQ ID NO: 258380 - RNA, 22 nt, Human
agaaaggcaauauuaacuacac

SEQ ID NO: 258381 - RNA, 22 nt, Human
uaagaugguuguagauggacug

SEQ ID NO: 258382 - RNA, 22 nt, Human
auaacaugaccugugcuucaca

SEQ ID NO: 258383 - RNA, 22 nt, Human
cucaguuucugacauuaaaauc

SEQ ID NO: 258384 - RNA, 22 nt, Human
gcacuggagaauggcuguauuc

SEQ ID NO: 258385 - RNA, 22 nt, Human
uggcuuccaguaaucaggauuu

SEQ ID NO: 258386 - RNA, 22 nt, Human
gagagagaaggccugugggugu

SEQ ID NO: 258387 - RNA, 20 nt, Human
ucaagcuaguuuccaaaguu

SEQ ID NO: 258388 - RNA, 22 nt, Human
cuggacagugcugcuugagaug

SEQ ID NO: 258389 - RNA, 22 nt, Human
ccugugcagcccuugccaguuu

SEQ ID NO: 258390 - RNA, 22 nt, Human
gccuugccgcucagcagugggg

SEQ ID NO: 258391 - RNA, 22 nt, Human
ugaggcagcaauuguauuguau

SEQ ID NO: 258392 - RNA, 22 nt, Human
cucugcaggggaggcaugcacu

SEQ ID NO: 258393 - RNA, 22 nt, Human
ucagugcacaaugacgguggcu

SEQ ID NO: 258394 - RNA, 22 nt, Human
caguccugucuuuaugacuuca

SEQ ID NO: 258395 - RNA, 22 nt, Human
ugaaucaaagcugaaguuuuca

SEQ ID NO: 258396 - RNA, 22 nt, Human
augucgauaggagugccaucgg

SEQ ID NO: 258397 - RNA, 22 nt, Human
agagcccucucauuggcuuauu

SEQ ID NO: 258398 - RNA, 22 nt, Human
ccuggggagccgccugagcccc

SEQ ID NO: 258399 - RNA, 22 nt, Human
aggaggggcauagaaauguaau

SEQ ID NO: 258400 - RNA, 22 nt, Human
ugaauacuauuucauaaugugg

SEQ ID NO: 258401 - RNA, 22 nt, Human
gguuccccaggcggcccuugga

SEQ ID NO: 258402 - RNA, 21 nt, Human
accucaagcaacaaccaaggu

SEQ ID NO: 258403 - RNA, 19 nt, Human
cugucugugcagagaugug

SEQ ID NO: 258404 - RNA, 22 nt, Human
caaacauugcuaccagagguuu

SEQ ID NO: 258405 - RNA, 22 nt, Human
gcugccuugaacauccuaagua

SEQ ID NO: 258406 - RNA, 21 nt, Human
uucugggaaaugagcuggggc

SEQ ID NO: 258407 - RNA, 22 nt, Human
agcagcagaagguuugcaccca

SEQ ID NO: 258408 - RNA, 22 nt, Human
cagcacuguucccagaccacug

SEQ ID NO: 258409 - RNA, 22 nt, Human
uuggcugagagcugcucugcag

SEQ ID NO: 258410 - RNA, 22 nt, Human
aggcuggcccuacuggcugccu

SEQ ID NO: 258411 - RNA, 22 nt, Human
ucaccaggauuccuaucaguag

SEQ ID NO: 258412 - RNA, 22 nt, Human
cucaggcacgggucagugagcg

SEQ ID NO: 258413 - RNA, 22 nt, Human
agugacagggaaaaugacacug

SEQ ID NO: 258414 - RNA, 22 nt, Human
ugaggaugguuaaagaacauug

SEQ ID NO: 258415 - RNA, 22 nt, Human
aauacuugucagaugaauaaga

SEQ ID NO: 258416 - RNA, 22 nt, Human
ucagggcauucaagaggccugg

SEQ ID NO: 258417 - RNA, 22 nt, Human
uucaugaauguuccaugugagu

SEQ ID NO: 258418 - RNA, 22 nt, Human
gucuggaggcacuuucucauga

SEQ ID NO: 258419 - RNA, 22 nt, Human
gcggggcacagugauggagcac

SEQ ID NO: 258420 - RNA, 22 nt, Human
agacaucaaugaucagagguag

SEQ ID NO: 258421 - RNA, 22 nt, Human
auucaaacuguguuaggcagca

SEQ ID NO: 258422 - RNA, 22 nt, Human
uuuaguuauuguuacaguauga

SEQ ID NO: 258423 - RNA, 22 nt, Human
gagagucuagugcaccuaguuu

SEQ ID NO: 258424 - RNA, 22 nt, Human
cagcuuggcuuccgcuuuacug

SEQ ID NO: 258425 - RNA, 22 nt, Human
gcagggccuuagcagcggcugc

SEQ ID NO: 258426 - RNA, 22 nt, Human
gcugggcagccuggccgcugcc

SEQ ID NO: 258427 - RNA, 22 nt, Human
gagcacugauuuauuuuugucu

SEQ ID NO: 258428 - RNA, 22 nt, Human
ccagcuccccucagcagguaau

SEQ ID NO: 258429 - RNA, 22 nt, Human
cuuuuacugugaaaagaaacug

SEQ ID NO: 258430 - RNA, 22 nt, Human
cuguacaggagacgucugugca

SEQ ID NO: 258431 - RNA, 22 nt, Human
cucucuccuuagcugcagacca

SEQ ID NO: 258432 - RNA, 19 nt, Human
ugugccucuauagcaugug

SEQ ID NO: 258433 - RNA, 22 nt, Human
gguccugaggggagcugaaggu

SEQ ID NO: 258434 - RNA, 22 nt, Human
ucuguuucuucuucuguuauau

SEQ ID NO: 258435 - RNA, 23 nt, Human
gcacagagcaguuaggggaagau

SEQ ID NO: 258436 - RNA, 22 nt, Human
augcugaauugaugcgagggag

SEQ ID NO: 258437 - RNA, 22 nt, Human
uacaggaaggcucuggaggugc

SEQ ID NO: 258438 - RNA, 22 nt, Human
uuucuagucuucccuaccuccc

SEQ ID NO: 258439 - RNA, 22 nt, Human
cuuugaauuaacgacacaagug

SEQ ID NO: 258440 - RNA, 22 nt, Human
aaaguucagauuagacucaaga

SEQ ID NO: 258441 - RNA, 22 nt, Human
ucugggaagauguuucaaaggu

SEQ ID NO: 258442 - RNA, 22 nt, Human
ccacagcuucuuauaucacugg

SEQ ID NO: 258443 - RNA, 22 nt, Human
ugccucugcugcuguggcauca

SEQ ID NO: 258444 - RNA, 22 nt, Human
aagcuguuaauggcuugcagcu

SEQ ID NO: 258445 - RNA, 22 nt, Human
cugagcccuugaacccaagucc

SEQ ID NO: 258446 - RNA, 22 nt, Human
cccugcaguccuuucuuggcuc

SEQ ID NO: 258447 - RNA, 22 nt, Human
ucuacauuuucuuuauguacau

SEQ ID NO: 258448 - RNA, 22 nt, Human
gccuuggcugccaagcugcuga

SEQ ID NO: 258449 - RNA, 22 nt, Human
cuccuggcagcaacauuuauau

SEQ ID NO: 258450 - RNA, 22 nt, Human
augucccucacuccucauucag

SEQ ID NO: 258451 - RNA, 19 nt, Human
acugugcucgggaaccacu

SEQ ID NO: 258452 - RNA, 20 nt, Human
uguguccaucaucugggcac

SEQ ID NO: 258453 - RNA, 22 nt, Human
auuuggaacaaauauuaguaaa

SEQ ID NO: 258454 - RNA, 22 nt, Human
gcagagugguuucagaguugag

SEQ ID NO: 258455 - RNA, 23 nt, Human
gccagccuugcucuccugcagcc

SEQ ID NO: 258456 - RNA, 22 nt, Human
ugagcugaguggcaggucucag

SEQ ID NO: 258457 - RNA, 22 nt, Human
ugacccuuucauuauucucauu

SEQ ID NO: 258458 - RNA, 23 nt, Human
agcagggccagaauacuugcugu

SEQ ID NO: 258459 - RNA, 22 nt, Human
gugcccaguugaggccaggacu

SEQ ID NO: 258460 - RNA, 22 nt, Human
agaugcugauugaauagauuuc

SEQ ID NO: 258461 - RNA, 22 nt, Human
uggaucucggcaaugcgggacu

SEQ ID NO: 258462 - RNA, 23 nt, Human
uugaggagcagcgcuuuuuaccg

SEQ ID NO: 258463 - RNA, 22 nt, Human
ucaguuaagacugcacuggacu

SEQ ID NO: 258464 - RNA, 22 nt, Human
aagugcauacacuaguuaauug

SEQ ID NO: 258465 - RNA, 22 nt, Human
cagcuguuaccaaucuuagggc

SEQ ID NO: 258466 - RNA, 22 nt, Human
cuggcugguucccugcuccagg

SEQ ID NO: 258467 - RNA, 22 nt, Human
ucuaaagacacuuuuuacaggg

SEQ ID NO: 258468 - RNA, 22 nt, Human
agugcuuggcaaccuucugacc

SEQ ID NO: 258469 - RNA, 22 nt, Human
uuucacagauguuuuggagucu

SEQ ID NO: 258470 - RNA, 17 nt, Human
ugccagccugucccagg

SEQ ID NO: 258471 - RNA, 22 nt, Human
agaaacaucauuggaacacaag

SEQ ID NO: 258472 - RNA, 22 nt, Human
agauuuguaugucuaaauguaa

SEQ ID NO: 258473 - RNA, 22 nt, Human
cagucccaguuugagacucugg

SEQ ID NO: 258474 - RNA, 22 nt, Human
ugacucaccaucggaguuugaa

SEQ ID NO: 258475 - RNA, 22 nt, Human
gccuguguuuuuaacucuagga

SEQ ID NO: 258476 - RNA, 22 nt, Human
cagucccacuagugccaauacc

SEQ ID NO: 258477 - RNA, 22 nt, Human
gccuccugcccagaugagugau

SEQ ID NO: 258478 - RNA, 22 nt, Human
cuguccuguggugacagguaca

SEQ ID NO: 258479 - RNA, 20 nt, Human
ugugugcacacaugacauuc

SEQ ID NO: 258480 - RNA, 22 nt, Human
cccagcucccauguucuccaau

SEQ ID NO: 258481 - RNA, 22 nt, Human
uuacacuuaccuguccauugaa

SEQ ID NO: 258482 - RNA, 22 nt, Human
aauagcuugccuaauccucaug

SEQ ID NO: 258483 - RNA, 22 nt, Human
aagauuuagggccaguuuacau

SEQ ID NO: 258484 - RNA, 22 nt, Human
auuuacauuccauggugguuac

SEQ ID NO: 258485 - RNA, 23 nt, Human
acagccaguucaccucuccuugg

SEQ ID NO: 258486 - RNA, 22 nt, Human
aucauucaagugcucuaaaaug

SEQ ID NO: 258487 - RNA, 22 nt, Human
ucuccugguauguaugcaccug

SEQ ID NO: 258488 - RNA, 22 nt, Human
cccagccucuggguucugccgg

SEQ ID NO: 258489 - RNA, 22 nt, Human
uccuagaauaaguaacaggaca

SEQ ID NO: 258490 - RNA, 22 nt, Human
uucacauguuggacauagagga

SEQ ID NO: 258491 - RNA, 22 nt, Human
gcugcugucagcaggccuuguu

SEQ ID NO: 258492 - RNA, 22 nt, Human
aaauuucuaagucaagaagaac

SEQ ID NO: 258493 - RNA, 22 nt, Human
aagcacagaaaaggagcaugga

SEQ ID NO: 258494 - RNA, 22 nt, Human
gugcuggcaccccucuccaguu

SEQ ID NO: 258495 - RNA, 22 nt, Human
gucaggcagccuggagauucag

SEQ ID NO: 258496 - RNA, 22 nt, Human
cagggcugaaaucaagguguag

SEQ ID NO: 258497 - RNA, 22 nt, Human
aacaugcagguuuuaggguugc

SEQ ID NO: 258498 - RNA, 22 nt, Human
ucucuaaagauauuuauggcaa

SEQ ID NO: 258499 - RNA, 22 nt, Human
gugcacagauuuaauuuuauuc

SEQ ID NO: 258500 - RNA, 22 nt, Human
gccaggcauuuguuaggugcug

SEQ ID NO: 258501 - RNA, 22 nt, Human
auggaauuugcaauaacaggau

SEQ ID NO: 258502 - RNA, 22 nt, Human
uuccuacagcccugaaucucua

SEQ ID NO: 258503 - RNA, 22 nt, Human
ucucugcauccccagggcucuc

SEQ ID NO: 258504 - RNA, 23 nt, Human
uaugagucaucugcuacaaccca

SEQ ID NO: 258505 - RNA, 19 nt, Human
acaugcaaggcaccugcag

SEQ ID NO: 258506 - RNA, 22 nt, Human
gcagaauacauuugggauuacu

SEQ ID NO: 258507 - RNA, 22 nt, Human
ugacucacuuaauuuacaaguc

SEQ ID NO: 258508 - RNA, 22 nt, Human
auucuucauuuacuguuacuug

SEQ ID NO: 258509 - RNA, 22 nt, Human
aagagaauaucgauagcacucu

SEQ ID NO: 258510 - RNA, 22 nt, Human
uuuuacaccucagaugagcaga

SEQ ID NO: 258511 - RNA, 22 nt, Human
ccugugcauugaccacacucuc

SEQ ID NO: 258512 - RNA, 22 nt, Human
agccacagucuguagccagcuu

SEQ ID NO: 258513 - RNA, 22 nt, Human
cccagccugaucucggccagcu

SEQ ID NO: 258514 - RNA, 22 nt, Human
ugcccaggguggagugcagcgg

SEQ ID NO: 258515 - RNA, 16 nt, Human
cuguuacuugacuguu

SEQ ID NO: 258516 - RNA, 22 nt, Human
ucuacaagucaagucuaucaag

SEQ ID NO: 258517 - RNA, 22 nt, Human
cucugggcugccuuuuagcucu

SEQ ID NO: 258518 - RNA, 22 nt, Human
cacaagaaauaagcugccuuuc

SEQ ID NO: 258519 - RNA, 22 nt, Human
aacaugcccgcuguaugccauu

SEQ ID NO: 258520 - RNA, 22 nt, Human
uagaugaagggguucagcaugg

SEQ ID NO: 258521 - RNA, 22 nt, Human
gcuggaaaaggaggcaaaauau

SEQ ID NO: 258522 - RNA, 22 nt, Human
aaacucugccauuuuuggccug

SEQ ID NO: 258523 - RNA, 22 nt, Human
gcauguaaucacucuaggaagg

SEQ ID NO: 258524 - RNA, 22 nt, Human
auuuccaugaaggcagauuuua

SEQ ID NO: 258525 - RNA, 22 nt, Human
uggcuucuagagcccauccuuc

SEQ ID NO: 258526 - RNA, 22 nt, Human
auuuggugagguagccauuguu

SEQ ID NO: 258527 - RNA, 20 nt, Human
uggccuuuuggcuuggagcu

SEQ ID NO: 258528 - RNA, 22 nt, Human
gagccauacaaccuauaaagug

SEQ ID NO: 258529 - RNA, 22 nt, Human
cucagaggguacaggugaaccc

SEQ ID NO: 258530 - RNA, 22 nt, Human
aaguguuuauuuauaacgaucu

SEQ ID NO: 258531 - RNA, 22 nt, Human
gugagucuuaagcaccaccuuu

SEQ ID NO: 258532 - RNA, 22 nt, Human
aggcuccauucaugugaaggca

SEQ ID NO: 258533 - RNA, 22 nt, Human
uaugaucucugggucuggagcu

SEQ ID NO: 258534 - RNA, 22 nt, Human
cucccuucaggagaggcucaca

SEQ ID NO: 258535 - RNA, 22 nt, Human
ccuccagggcagacggggagca

SEQ ID NO: 258536 - RNA, 18 nt, Human
gccuggcugccaacccag

SEQ ID NO: 258537 - RNA, 22 nt, Human
uuauugagaccguaagucaggu

SEQ ID NO: 258538 - RNA, 22 nt, Human
ggcugcagagcugggugggccu

SEQ ID NO: 258539 - RNA, 22 nt, Human
cacagcccccuugacacucugg

SEQ ID NO: 258540 - RNA, 22 nt, Human
agagucuuagccucauuaguca

SEQ ID NO: 258541 - RNA, 22 nt, Human
uggggcagcagaccuuucuugg

SEQ ID NO: 258542 - RNA, 22 nt, Human
uucuucugauugccuucugcaa

SEQ ID NO: 258543 - RNA, 22 nt, Human
aggcaacugacagcauauccug

SEQ ID NO: 258544 - RNA, 22 nt, Human
ucagacccugcgguguuuggau

SEQ ID NO: 258545 - RNA, 22 nt, Human
cuggauccuucucuguguauuu

SEQ ID NO: 258546 - RNA, 22 nt, Human
aucuuucuaugguacuuucucc

SEQ ID NO: 258547 - RNA, 22 nt, Human
ggggaguguuuucaugggcuug

SEQ ID NO: 258548 - RNA, 22 nt, Human
uuucagaaauuguuauuauucu

SEQ ID NO: 258549 - RNA, 22 nt, Human
aguucucaagacaauuaccugu

SEQ ID NO: 258550 - RNA, 21 nt, Human
agugcugaaaaagcaugucuc

SEQ ID NO: 258551 - RNA, 22 nt, Human
cucacaggucaugugguggcuu

SEQ ID NO: 258552 - RNA, 22 nt, Human
ugccuggaaggcccaugggaag

SEQ ID NO: 258553 - RNA, 22 nt, Human
agcuccugcucuuugucccuaa

SEQ ID NO: 258554 - RNA, 22 nt, Human
gccagcuggagugagagugggc

SEQ ID NO: 258555 - RNA, 18 nt, Human
ucccuucucccuugccuc

SEQ ID NO: 258556 - RNA, 22 nt, Human
cagaaauggaauuuuccaucac

SEQ ID NO: 258557 - RNA, 22 nt, Human
aagucagaccuuguugauagcu

SEQ ID NO: 258558 - RNA, 22 nt, Human
ccagggugggaggcugaaggcg

SEQ ID NO: 258559 - RNA, 19 nt, Human
uugagaacaccaaguacug

SEQ ID NO: 258560 - RNA, 22 nt, Human
ucuuuagauguuuagaggaaga

SEQ ID NO: 258561 - RNA, 22 nt, Human
uugcagcuguugcaaagucucu

SEQ ID NO: 258562 - RNA, 20 nt, Human
uccugaauuuccuuucugcu

SEQ ID NO: 258563 - RNA, 22 nt, Human
aucucagggcuggagcccugga

SEQ ID NO: 258564 - RNA, 22 nt, Human
ggccucuguuuggagccaggau

SEQ ID NO: 258565 - RNA, 22 nt, Human
cauuuguuuagaagucuuuaua

SEQ ID NO: 258566 - RNA, 22 nt, Human
uuccuggccucucucugagcag

SEQ ID NO: 258567 - RNA, 22 nt, Human
ggcaggcaggagcucugucucc

SEQ ID NO: 258568 - RNA, 20 nt, Human
uugauucccucuaaacucgc

SEQ ID NO: 258569 - RNA, 22 nt, Human
uggggaagcacuuugaacuuaa

SEQ ID NO: 258570 - RNA, 22 nt, Human
ugcaggucucugcaaggccuau

SEQ ID NO: 258571 - RNA, 22 nt, Human
agaauccucuucaguaaauucu

SEQ ID NO: 258572 - RNA, 22 nt, Human
aggccucucugcuuagcuugua

SEQ ID NO: 258573 - RNA, 22 nt, Human
cugggagaugacucagagcagg

SEQ ID NO: 258574 - RNA, 22 nt, Human
acauuuaaugauccuacuguga

SEQ ID NO: 258575 - RNA, 22 nt, Human
uaucauuuaacagaaucauugc

SEQ ID NO: 258576 - RNA, 22 nt, Human
aggggcugacuggaaagugcca

SEQ ID NO: 258577 - RNA, 15 nt, Human
gcauguguaauaggc

SEQ ID NO: 258578 - RNA, 22 nt, Human
ugcuuggcuuucugagcuucug

SEQ ID NO: 258579 - RNA, 22 nt, Human
cugggccucaugcacagagaug

SEQ ID NO: 258580 - RNA, 22 nt, Human
acaggcaacuucaaaucucacu

SEQ ID NO: 258581 - RNA, 18 nt, Human
gcuuccugaaagcugccc

SEQ ID NO: 258582 - RNA, 22 nt, Human
ccagcacucgcugauuuuagga

SEQ ID NO: 258583 - RNA, 22 nt, Human
ucaggcccuucucccaggacuc

SEQ ID NO: 258584 - RNA, 22 nt, Human
gcuuagcaucuuacaaugcuga

SEQ ID NO: 258585 - RNA, 22 nt, Human
uguccaaugcccuuuccacaug

SEQ ID NO: 258586 - RNA, 22 nt, Human
uaauucaugggcccagugauau

SEQ ID NO: 258587 - RNA, 22 nt, Human
uagggcuauaagagaauaagac

SEQ ID NO: 258588 - RNA, 21 nt, Human
ccagcccagccuccuucucuu

SEQ ID NO: 258589 - RNA, 22 nt, Human
guagccauuggcaaugaagccu

SEQ ID NO: 258590 - RNA, 22 nt, Human
gagcuuccacucuagaaggagu

SEQ ID NO: 258591 - RNA, 22 nt, Human
uuucuuuaaaggaacucuguuu

SEQ ID NO: 258592 - RNA, 22 nt, Human
agggagcccugaaccagagggu

SEQ ID NO: 258593 - RNA, 22 nt, Human
aagauagaugucaucagcauau

SEQ ID NO: 258594 - RNA, 22 nt, Human
acagggauuaugacugacagcc

SEQ ID NO: 258595 - RNA, 22 nt, Human
cucugagguuuccucacaagcu

SEQ ID NO: 258596 - RNA, 22 nt, Human
aauauagauuuacucaagagaa

SEQ ID NO: 258597 - RNA, 22 nt, Human
uuccuggcaccaccacuucuag

SEQ ID NO: 258598 - RNA, 22 nt, Human
cagagcugucauuugccaguga

SEQ ID NO: 258599 - RNA, 22 nt, Human
ugcagagaaaacuccuggguac

SEQ ID NO: 258600 - RNA, 22 nt, Human
aaguuacaguuaugaaacucac

SEQ ID NO: 258601 - RNA, 22 nt, Human
aaaguuacuaucacaaugaaau

SEQ ID NO: 258602 - RNA, 22 nt, Human
agauggcugggagcucuguuug

SEQ ID NO: 258603 - RNA, 22 nt, Human
gaaauguuugggaggagucaac

SEQ ID NO: 258604 - RNA, 22 nt, Human
agcugcagaaaggacaacuaau

SEQ ID NO: 258605 - RNA, 22 nt, Human
ucaaaagaaacaccauguuccu

SEQ ID NO: 258606 - RNA, 22 nt, Human
cuggcccaggaagacguguccc

SEQ ID NO: 258607 - RNA, 22 nt, Human
cuuguucugugcuucuuacauu

SEQ ID NO: 258608 - RNA, 22 nt, Human
gucacacucuucccuccacaug

SEQ ID NO: 258609 - RNA, 22 nt, Human
uucaacaaaauauauuuuucca

SEQ ID NO: 258610 - RNA, 22 nt, Human
cugugcaaauaaagagcaacau

SEQ ID NO: 258611 - RNA, 22 nt, Human
ugcaaacagaaaguuuauugug

SEQ ID NO: 258612 - RNA, 22 nt, Human
ugaggggcgcuggcagguuccu

SEQ ID NO: 258613 - RNA, 22 nt, Human
ggacaacauguuuuaauuaagg

SEQ ID NO: 258614 - RNA, 22 nt, Human
ggacccagguagggaggaagau

SEQ ID NO: 258615 - RNA, 19 nt, Human
agucacagaccuugucucc

SEQ ID NO: 258616 - RNA, 18 nt, Human
gacaccagccucugcccc

SEQ ID NO: 258617 - RNA, 22 nt, Human
gguccuggaugagacagguagu

SEQ ID NO: 258618 - RNA, 21 nt, Human
agcaggucuacagguucauag

SEQ ID NO: 258619 - RNA, 22 nt, Human
agcuggaggaguuucuccuagc

SEQ ID NO: 258620 - RNA, 19 nt, Human
aggcagcauucuggggcuu

SEQ ID NO: 258621 - RNA, 22 nt, Human
agggggcaucagguccuggcuc

SEQ ID NO: 258622 - RNA, 22 nt, Human
gaggccagcuacccaaggguca

SEQ ID NO: 258623 - RNA, 21 nt, Human
gaaauacugccuuaggagcug

SEQ ID NO: 258624 - RNA, 22 nt, Human
gacagacaaauguuuuuaacuu

SEQ ID NO: 258625 - RNA, 22 nt, Human
aggcugugagagguggcuccca

SEQ ID NO: 258626 - RNA, 22 nt, Human
ggugcauguagccaucaagaua

SEQ ID NO: 258627 - RNA, 22 nt, Human
uuugggaauuguagcugucuug

SEQ ID NO: 258628 - RNA, 22 nt, Human
aggccuggccccaguugcuagg

SEQ ID NO: 258629 - RNA, 22 nt, Human
cagcaugguggagcugcucuuu

SEQ ID NO: 258630 - RNA, 22 nt, Human
acccaggcgggagugcaguguc

SEQ ID NO: 258631 - RNA, 22 nt, Human
gagcacccuuugcacaucaguc

SEQ ID NO: 258632 - RNA, 22 nt, Human
aauucugagaacaaaagguacu

SEQ ID NO: 258633 - RNA, 22 nt, Human
ucuauauaaccuccacuucuac

SEQ ID NO: 258634 - RNA, 22 nt, Human
gguccuggcagcucugugucca

SEQ ID NO: 258635 - RNA, 22 nt, Human
ccuggcagacugugagggcagg

SEQ ID NO: 258636 - RNA, 22 nt, Human
uaagugaugauaguaccuagaa

SEQ ID NO: 258637 - RNA, 22 nt, Human
agcugcaguaaagcucuccagg

SEQ ID NO: 258638 - RNA, 22 nt, Human
uucauucccaagaguaaacaua

SEQ ID NO: 258639 - RNA, 22 nt, Human
cccugcagccggccagcucauu

SEQ ID NO: 258640 - RNA, 22 nt, Human
ugccugcccacgacuacagcag

SEQ ID NO: 258641 - RNA, 21 nt, Human
uggcagggguaguaguacagc

SEQ ID NO: 258642 - RNA, 22 nt, Human
cugccaggccuccgcugucccc

SEQ ID NO: 258643 - RNA, 22 nt, Human
uugggaaagggauuaugaguag

SEQ ID NO: 258644 - RNA, 22 nt, Human
ugaauaauuccuuuuugucaag

SEQ ID NO: 258645 - RNA, 22 nt, Human
agaggccucuuugcaaguaggu

SEQ ID NO: 258646 - RNA, 22 nt, Human
auagcaaagaucacuuccuuga

SEQ ID NO: 258647 - RNA, 22 nt, Human
acacagcaacuugcaguaugga

SEQ ID NO: 258648 - RNA, 22 nt, Human
acagagguaggacaugagauau

SEQ ID NO: 258649 - RNA, 22 nt, Human
gcagcauggaguuguggaauga

SEQ ID NO: 258650 - RNA, 22 nt, Human
uuuuuauaacucuuuugugaca

SEQ ID NO: 258651 - RNA, 22 nt, Human
aaacccugcccuucccaagaug

SEQ ID NO: 258652 - RNA, 22 nt, Human
augaauuaaggauaacuggucu

SEQ ID NO: 258653 - RNA, 22 nt, Human
aaaauggucucagcuggcacca

SEQ ID NO: 258654 - RNA, 22 nt, Human
gcagccacccucaaggcugaau

SEQ ID NO: 258655 - RNA, 22 nt, Human
cagagcuggccugugauuuuug

SEQ ID NO: 258656 - RNA, 22 nt, Human
uccugcaggccagaggggugag

SEQ ID NO: 258657 - RNA, 17 nt, Human
caguggcagaucuucuc

SEQ ID NO: 258658 - RNA, 22 nt, Human
caggaugggauguagugggccc

SEQ ID NO: 258659 - RNA, 22 nt, Human
gggagacaaaggugagguucuu

SEQ ID NO: 258660 - RNA, 22 nt, Human
cacuggaauucaagauacugag

SEQ ID NO: 258661 - RNA, 22 nt, Human
ugggcaguggcugggccucucu

SEQ ID NO: 258662 - RNA, 22 nt, Human
gacaucuggaggagaugaaugg

SEQ ID NO: 258663 - RNA, 22 nt, Human
uucucuuuuugcaucucaaccu

SEQ ID NO: 258664 - RNA, 22 nt, Human
uagcaagaggugaagguuucau

SEQ ID NO: 258665 - RNA, 22 nt, Human
gccugcagauauauaggauggu

SEQ ID NO: 258666 - RNA, 22 nt, Human
gcugccuuccaaagaguuuuau

SEQ ID NO: 258667 - RNA, 22 nt, Human
gucugcuggcacgucacagaua

SEQ ID NO: 258668 - RNA, 22 nt, Human
accagcaguuaugaggccagga

SEQ ID NO: 258669 - RNA, 22 nt, Human
gcagcaggcacggucucgacau

SEQ ID NO: 258670 - RNA, 22 nt, Human
gccaacaggccuugcucugcuc

SEQ ID NO: 258671 - RNA, 22 nt, Human
ggcugcucugagaguggguuuu

SEQ ID NO: 258672 - RNA, 22 nt, Human
ggguccagggacguuucugcag

SEQ ID NO: 258673 - RNA, 22 nt, Human
cccagcagggucucugugucua

SEQ ID NO: 258674 - RNA, 22 nt, Human
aggccagcuguuacuagagcca

SEQ ID NO: 258675 - RNA, 22 nt, Human
augaacagaggaauagaauucu

SEQ ID NO: 258676 - RNA, 19 nt, Human
gcucugccagugguaacau

SEQ ID NO: 258677 - RNA, 22 nt, Human
augauuacucccauuugauaga

SEQ ID NO: 258678 - RNA, 22 nt, Human
aacaguuuaucaaguuuuuaca

SEQ ID NO: 258679 - RNA, 22 nt, Human
guccaguggucaauuaucugga

SEQ ID NO: 258680 - RNA, 22 nt, Human
augagucacucagcagaaaagg

SEQ ID NO: 258681 - RNA, 22 nt, Human
uuuaguguaauucugccuuuug

SEQ ID NO: 258682 - RNA, 22 nt, Human
cagcucaguuucaauaccaggu

SEQ ID NO: 258683 - RNA, 22 nt, Human
ggagaagggcaugguaguuuua

SEQ ID NO: 258684 - RNA, 22 nt, Human
acgggccuucucuucaggcgag

SEQ ID NO: 258685 - RNA, 22 nt, Human
guugccaggggcugcugucacc

SEQ ID NO: 258686 - RNA, 22 nt, Human
cuagccugggauuugaacuuau

SEQ ID NO: 258687 - RNA, 22 nt, Human
auucuggggcugguuauuuuga

SEQ ID NO: 258688 - RNA, 20 nt, Human
uggcaggaauagggccagag

SEQ ID NO: 258689 - RNA, 22 nt, Human
gggcugagcuaagcuggguuga

SEQ ID NO: 258690 - RNA, 22 nt, Human
ugguauuuccaggcuuauggua

SEQ ID NO: 258691 - RNA, 20 nt, Human
ucacuggccagaguagcccu

SEQ ID NO: 258692 - RNA, 22 nt, Human
ugagccagguuaagacaggagc

SEQ ID NO: 258693 - RNA, 22 nt, Human
uuggaugagguugagaaucauu

SEQ ID NO: 258694 - RNA, 22 nt, Human
uccgccaggacugagggcccau

SEQ ID NO: 258695 - RNA, 22 nt, Human
uacuuacagaaggaagcaauug

SEQ ID NO: 258696 - RNA, 19 nt, Human
ucccaguggggagaggugu

SEQ ID NO: 258697 - RNA, 22 nt, Human
gccucagguaaaacuugaguuu

SEQ ID NO: 258698 - RNA, 22 nt, Human
cacugggaccuaggacugagcu

SEQ ID NO: 258699 - RNA, 22 nt, Human
ccacaugcucuuguuacagugu

SEQ ID NO: 258700 - RNA, 22 nt, Human
ugugccaugaggcucugauaug

SEQ ID NO: 258701 - RNA, 22 nt, Human
uguuucuugagaguauuacccu

SEQ ID NO: 258702 - RNA, 22 nt, Human
ugcucaguauagaaaaugauau

SEQ ID NO: 258703 - RNA, 22 nt, Human
aaauccuaaggagaauaugauu

SEQ ID NO: 258704 - RNA, 22 nt, Human
uaaggcuuucuaaauaugcaga

SEQ ID NO: 258705 - RNA, 22 nt, Human
aaaaagcuuaaaugagcaguuc

SEQ ID NO: 258706 - RNA, 19 nt, Human
gggucccacugcccgucug

SEQ ID NO: 258707 - RNA, 19 nt, Human
cuugguuaugguaugaugc

SEQ ID NO: 258708 - RNA, 22 nt, Human
gccuggaguagcauggcaagcc

SEQ ID NO: 258709 - RNA, 22 nt, Human
acagauuuggaggccucacccc

SEQ ID NO: 258710 - RNA, 22 nt, Human
acagacuguuugguucaugucu

SEQ ID NO: 258711 - RNA, 22 nt, Human
acagaaaaaugagggagcugga

SEQ ID NO: 258712 - RNA, 22 nt, Human
ccucaggcuagcuacugucccu

SEQ ID NO: 258713 - RNA, 22 nt, Human
uguguggauucaucucaaagag

SEQ ID NO: 258714 - RNA, 22 nt, Human
uacugucuggcaauuaagaauc

SEQ ID NO: 258715 - RNA, 22 nt, Human
auuagaaugaaguauaggauuu

SEQ ID NO: 258716 - RNA, 21 nt, Human
gccugggauaguggccuccgg

SEQ ID NO: 258717 - RNA, 22 nt, Human
cagcacuaauccugcaauuucu

SEQ ID NO: 258718 - RNA, 22 nt, Human
gggcuccagcccgggaccaggu

SEQ ID NO: 258719 - RNA, 22 nt, Human
uguggagaagaaggccacugca

SEQ ID NO: 258720 - RNA, 22 nt, Human
gcuggggagcuagaccucagca

SEQ ID NO: 258721 - RNA, 22 nt, Human
ugggcaaaggcuguaacccauc

SEQ ID NO: 258722 - RNA, 22 nt, Human
gauguggaugaucuuagauggu

SEQ ID NO: 258723 - RNA, 22 nt, Human
uuucuuucucguaaacuuaguu

SEQ ID NO: 258724 - RNA, 22 nt, Human
ugcucaggugccuuggcugcug

SEQ ID NO: 258725 - RNA, 22 nt, Human
ccagccagaaguccgggcuucu

SEQ ID NO: 258726 - RNA, 22 nt, Human
agcagguguuagggauccaaug

SEQ ID NO: 258727 - RNA, 22 nt, Human
aaggcaauauugaguuucccuu

SEQ ID NO: 258728 - RNA, 22 nt, Human
ucugcuuucuuacuaaaaauga

SEQ ID NO: 258729 - RNA, 22 nt, Human
gcaguuccuacaguggaaagcg

SEQ ID NO: 258730 - RNA, 16 nt, Human
ugggaccuguggccaa

SEQ ID NO: 258731 - RNA, 22 nt, Human
aaacaguuuauaacaugauacu

SEQ ID NO: 258732 - RNA, 22 nt, Human
aaacucuguauuugcugugggu

SEQ ID NO: 258733 - RNA, 22 nt, Human
acacgcauaaauacacagucua

SEQ ID NO: 258734 - RNA, 22 nt, Human
aaucuucacagaaaaaugucug

SEQ ID NO: 258735 - RNA, 22 nt, Human
uuggugaauugagaccauuugu

SEQ ID NO: 258736 - RNA, 21 nt, Human
ucgugcagcagcugaggcuug

SEQ ID NO: 258737 - RNA, 22 nt, Human
aacaggcagcagacugaaucug

SEQ ID NO: 258738 - RNA, 22 nt, Human
cagaaauauuuauugagugaca

SEQ ID NO: 258739 - RNA, 22 nt, Human
uugcagggauuaccuuauuuuu

SEQ ID NO: 258740 - RNA, 22 nt, Human
gcuacaggugacagccucugca

SEQ ID NO: 258741 - RNA, 22 nt, Human
gugaggccgcacgccccggagu

SEQ ID NO: 258742 - RNA, 22 nt, Human
gcaguggcuaggagucuggcgu

SEQ ID NO: 258743 - RNA, 22 nt, Human
uagauacauuuuucuuuccugu

SEQ ID NO: 258744 - RNA, 22 nt, Human
ccagugcaccaagaggccuaga

SEQ ID NO: 258745 - RNA, 18 nt, Human
agggagcaucugguugcc

SEQ ID NO: 258746 - RNA, 22 nt, Human
augccucugcucuugguccuca

SEQ ID NO: 258747 - RNA, 22 nt, Human
guggaacauguccauauacauu

SEQ ID NO: 258748 - RNA, 22 nt, Human
uaggagagcugaacuauugucu

SEQ ID NO: 258749 - RNA, 22 nt, Human
cagccaggagcucccccugcuc

SEQ ID NO: 258750 - RNA, 22 nt, Human
cccagagaugggaggugaucgg

SEQ ID NO: 258751 - RNA, 22 nt, Human
acaugugucuaagaaugaaaga

SEQ ID NO: 258752 - RNA, 22 nt, Human
uuguccagcgaccaggcucugu

SEQ ID NO: 258753 - RNA, 22 nt, Human
cuggggccagugaggaggcuuu

SEQ ID NO: 258754 - RNA, 22 nt, Human
ucaaauaaugccauucaucauc

SEQ ID NO: 258755 - RNA, 22 nt, Human
uacccucacgagacuucaaguc

SEQ ID NO: 258756 - RNA, 22 nt, Human
ucaugcauauuuguaguaguuc

SEQ ID NO: 258757 - RNA, 20 nt, Human
uuuagcaaaagggacugcuc

SEQ ID NO: 258758 - RNA, 22 nt, Human
uggccuguugcuccuagggguc

SEQ ID NO: 258759 - RNA, 22 nt, Human
acagugcuucugauaugaugcc

SEQ ID NO: 258760 - RNA, 22 nt, Human
ucugagcugcagaguggggugg

SEQ ID NO: 258761 - RNA, 22 nt, Human
gggaagaagacauggugaaggc

SEQ ID NO: 258762 - RNA, 22 nt, Human
aggucucaauuccugcuccugu

SEQ ID NO: 258763 - RNA, 22 nt, Human
uuguguacuguugguugauauu

SEQ ID NO: 258764 - RNA, 17 nt, Human
agcaaggcuuaaguaaa

SEQ ID NO: 258765 - RNA, 21 nt, Human
ucucugggcccuccugugggg

SEQ ID NO: 258766 - RNA, 20 nt, Human
ccucaguguccuggacuggg

SEQ ID NO: 258767 - RNA, 22 nt, Human
guuuucuuugaaugcuucuaga

SEQ ID NO: 258768 - RNA, 22 nt, Human
cauuagagcagauaauaugugu

SEQ ID NO: 258769 - RNA, 22 nt, Human
gcagugcuuuagucuguccuuu

SEQ ID NO: 258770 - RNA, 22 nt, Human
uauucacaguugauuuacaguu

SEQ ID NO: 258771 - RNA, 22 nt, Human
uuggaaauacagcaguuacuuu

SEQ ID NO: 258772 - RNA, 18 nt, Human
gucuggaggucaggagcu

SEQ ID NO: 258773 - RNA, 21 nt, Human
uccugcaggaggccugagagg

SEQ ID NO: 258774 - RNA, 22 nt, Human
ggcaggguggcagaggcucaga

SEQ ID NO: 258775 - RNA, 22 nt, Human
uagaacucuggucuucucaucc

SEQ ID NO: 258776 - RNA, 22 nt, Human
acaugauauuaaugucuuauuu

SEQ ID NO: 258777 - RNA, 22 nt, Human
aagagcuggaguuugcagcccu

SEQ ID NO: 258778 - RNA, 20 nt, Human
accaggcccggugucuccuc

SEQ ID NO: 258779 - RNA, 22 nt, Human
cacugagcaagucaguacagca

SEQ ID NO: 258780 - RNA, 22 nt, Human
aacaguuuguggauagcuugua

SEQ ID NO: 258781 - RNA, 22 nt, Human
augcugaauaguucacucuucu

SEQ ID NO: 258782 - RNA, 22 nt, Human
gccugccuucggugcgcagcgg

SEQ ID NO: 258783 - RNA, 23 nt, Human
gcucagagguuuuucucuggaug

SEQ ID NO: 258784 - RNA, 22 nt, Human
aacuugaaccacagaagcugcc

SEQ ID NO: 258785 - RNA, 22 nt, Human
uccaggcuucacgucugcccuc

SEQ ID NO: 258786 - RNA, 22 nt, Human
uuaaaggcuauggcugccuggg

SEQ ID NO: 258787 - RNA, 22 nt, Human
gacaagaugacaucauggcuuc

SEQ ID NO: 258788 - RNA, 22 nt, Human
ucuuugaaguaucuuaaauggu

SEQ ID NO: 258789 - RNA, 22 nt, Human
gccauguccugggcaucugcca

SEQ ID NO: 258790 - RNA, 22 nt, Human
ucuaacauugaauggcugauua

SEQ ID NO: 258791 - RNA, 22 nt, Human
agaccagggucccacagagucu

SEQ ID NO: 258792 - RNA, 22 nt, Human
uucuucagacuacugaugauug

SEQ ID NO: 258793 - RNA, 22 nt, Human
gaaauacaaagccagccauuuu

SEQ ID NO: 258794 - RNA, 22 nt, Human
uuagacaaucuguugguaaggu

SEQ ID NO: 258795 - RNA, 22 nt, Human
ggugcaggagcggggugcucgg

SEQ ID NO: 258796 - RNA, 22 nt, Human
caugcaaaggucaagaucagga

SEQ ID NO: 258797 - RNA, 23 nt, Human
uggcuccaggagaagccagaagc

SEQ ID NO: 258798 - RNA, 22 nt, Human
ccucaaauagcccccagucuag

SEQ ID NO: 258799 - RNA, 22 nt, Human
aggcgcagaaggccaggggccu

SEQ ID NO: 258800 - RNA, 22 nt, Human
uuaugaaguuccuguuacagug

SEQ ID NO: 258801 - RNA, 22 nt, Human
uggcuucuuguuugguuuaaga

SEQ ID NO: 258802 - RNA, 22 nt, Human
uccagcuggcccggccaugaau

SEQ ID NO: 258803 - RNA, 22 nt, Human
ggcccaugacccuagccaacug

SEQ ID NO: 258804 - RNA, 22 nt, Human
cagcaaggacugggcaugugaa

SEQ ID NO: 258805 - RNA, 22 nt, Human
gguaacaguuacaguaacagua

SEQ ID NO: 258806 - RNA, 22 nt, Human
agaggcggagcuugcagugagc

SEQ ID NO: 258807 - RNA, 22 nt, Human
ucccuagucgcaucuguggaga

SEQ ID NO: 258808 - RNA, 22 nt, Human
uagaaagcuugggguguuuaaa

SEQ ID NO: 258809 - RNA, 19 nt, Human
guguggcagagagugacca

SEQ ID NO: 258810 - RNA, 22 nt, Human
uaugaaaagguggccaauguag

SEQ ID NO: 258811 - RNA, 17 nt, Human
uucauuaauaaaagcaa

SEQ ID NO: 258812 - RNA, 19 nt, Human
guccaugcuuagaggggcc

SEQ ID NO: 258813 - RNA, 22 nt, Human
uugcaauagccuuauuuccaaa

SEQ ID NO: 258814 - RNA, 22 nt, Human
uucaguuucaaauccugugaag

SEQ ID NO: 258815 - RNA, 22 nt, Human
ugcaucuguucagagcugucga

SEQ ID NO: 258816 - RNA, 21 nt, Human
agguacaggucuugugagucu

SEQ ID NO: 258817 - RNA, 22 nt, Human
cagggcucccugcagccucugu

SEQ ID NO: 258818 - RNA, 22 nt, Human
cagccugucggcuccuucauuc

SEQ ID NO: 258819 - RNA, 19 nt, Human
agcagcucagggaggcacc

SEQ ID NO: 258820 - RNA, 22 nt, Human
ucagacagauuuugacacuugc

SEQ ID NO: 258821 - RNA, 22 nt, Human
ggcaggugagagcucuuugaaa

SEQ ID NO: 258822 - RNA, 20 nt, Human
guauauaaccauagugacua

SEQ ID NO: 258823 - RNA, 19 nt, Human
ugcuuucuaaacacaugca

SEQ ID NO: 258824 - RNA, 22 nt, Human
aauuuguuauaacuugggcuga

SEQ ID NO: 258825 - RNA, 22 nt, Human
ugugugggcgaagacagccuuu

SEQ ID NO: 258826 - RNA, 22 nt, Human
ugaggaguguggauggagcuug

SEQ ID NO: 258827 - RNA, 22 nt, Human
agucuucugaauaagaaucacu

SEQ ID NO: 258828 - RNA, 22 nt, Human
gcaagcagcccagaacagcucu

SEQ ID NO: 258829 - RNA, 22 nt, Human
aauauauagaaguacccguugu

SEQ ID NO: 258830 - RNA, 22 nt, Human
gugggcaggccccaaagcaggg

SEQ ID NO: 258831 - RNA, 22 nt, Human
aagggccaucccagaacagaaa

SEQ ID NO: 258832 - RNA, 22 nt, Human
acucugggccccagguggagcu

SEQ ID NO: 258833 - RNA, 22 nt, Human
ggcuccuucaagccugucacug

SEQ ID NO: 258834 - RNA, 22 nt, Human
gugcuggcuggacauggagcac

SEQ ID NO: 258835 - RNA, 22 nt, Human
aggacagguguagugggcucug

SEQ ID NO: 258836 - RNA, 22 nt, Human
aaacaucuaucagcauuuuuua

SEQ ID NO: 258837 - RNA, 22 nt, Human
uccaggagguaugaguggcccc

SEQ ID NO: 258838 - RNA, 21 nt, Human
uauacaugugcacacacaugc

SEQ ID NO: 258839 - RNA, 20 nt, Human
cccagccccuaccuguugcc

SEQ ID NO: 258840 - RNA, 22 nt, Human
caggcugggaacgccacccgcu

SEQ ID NO: 258841 - RNA, 22 nt, Human
gcucagggaacuuuuugcaggc

SEQ ID NO: 258842 - RNA, 23 nt, Human
cagaaaacccagagcucaguccc

SEQ ID NO: 258843 - RNA, 20 nt, Human
uggcacagaacccuugccua

SEQ ID NO: 258844 - RNA, 22 nt, Human
uagugucauuucaguggaguuu

SEQ ID NO: 258845 - RNA, 22 nt, Human
guggaauuuuuaccuaugaaug

SEQ ID NO: 258846 - RNA, 19 nt, Human
agacagagcucaguggguu

SEQ ID NO: 258847 - RNA, 22 nt, Human
aaagacuuuagguuagaggcau

SEQ ID NO: 258848 - RNA, 22 nt, Human
ccucuggaucuuucuccacacu

SEQ ID NO: 258849 - RNA, 22 nt, Human
cuuugaaauucuucagcugaag

SEQ ID NO: 258850 - RNA, 22 nt, Human
uggaagcaucacuucuugccug

SEQ ID NO: 258851 - RNA, 22 nt, Human
gaccacagaggugugggagaga

SEQ ID NO: 258852 - RNA, 22 nt, Human
gcugaggccaggccccaccgga

SEQ ID NO: 258853 - RNA, 22 nt, Human
uuaacagauguuuauggagcau

SEQ ID NO: 258854 - RNA, 22 nt, Human
uauacuuuccugcaacuuugau

SEQ ID NO: 258855 - RNA, 22 nt, Human
uggggaaaggagagcauuauuu

SEQ ID NO: 258856 - RNA, 23 nt, Human
ggacaugucucuggguauuuuga

SEQ ID NO: 258857 - RNA, 22 nt, Human
uuaaaaugcagauucugauuca

SEQ ID NO: 258858 - RNA, 16 nt, Human
cacauauauuuauaug

SEQ ID NO: 258859 - RNA, 22 nt, Human
uagaaagugaagguuaauuaau

SEQ ID NO: 258860 - RNA, 22 nt, Human
aagcaggcauuccagagacaau

SEQ ID NO: 258861 - RNA, 22 nt, Human
ccuuagcaacacuuagcaacug

SEQ ID NO: 258862 - RNA, 22 nt, Human
gaggaggguuggccuuagguag

SEQ ID NO: 258863 - RNA, 22 nt, Human
ugcccugguagacacagacugu

SEQ ID NO: 258864 - RNA, 22 nt, Human
aggaaauaagggacaagacaaa

SEQ ID NO: 258865 - RNA, 22 nt, Human
augccaaauucuacuuucagca

SEQ ID NO: 258866 - RNA, 22 nt, Human
cuggcuccauccuugagcucug

SEQ ID NO: 258867 - RNA, 22 nt, Human
ugccauuugccccagcacuguc

SEQ ID NO: 258868 - RNA, 22 nt, Human
cacccacauuccaucacucugc

SEQ ID NO: 258869 - RNA, 22 nt, Human
guuagagcacauacuuugcaug

SEQ ID NO: 258870 - RNA, 22 nt, Human
uuuaagaucuaucccauuuugu

SEQ ID NO: 258871 - RNA, 22 nt, Human
aacaguuuauguaaauguccag

SEQ ID NO: 258872 - RNA, 22 nt, Human
acacacgugcucaacacgcucc

SEQ ID NO: 258873 - RNA, 22 nt, Human
uuucuagaugcggggcuugugc

SEQ ID NO: 258874 - RNA, 22 nt, Human
uucuaacuggugcagugcugca

SEQ ID NO: 258875 - RNA, 22 nt, Human
cucagacccccagagcugcuaa

SEQ ID NO: 258876 - RNA, 22 nt, Human
agcaagauuuuucagguuagua

SEQ ID NO: 258877 - RNA, 22 nt, Human
ccagcagaagcucccgcugggu

SEQ ID NO: 258878 - RNA, 22 nt, Human
augaaaagggagugauauuugu

SEQ ID NO: 258879 - RNA, 22 nt, Human
uaaaaccauuccugcuuucaug

SEQ ID NO: 258880 - RNA, 22 nt, Human
cugccuccaggcucaccuugac

SEQ ID NO: 258881 - RNA, 22 nt, Human
gcagcagcucccuauccaggcu

SEQ ID NO: 258882 - RNA, 22 nt, Human
ugcugagggcagaugaauuaga

SEQ ID NO: 258883 - RNA, 22 nt, Human
accaaaaauuguggggcugaau

SEQ ID NO: 258884 - RNA, 22 nt, Human
ccagcagagcucaaacuuccug

SEQ ID NO: 258885 - RNA, 18 nt, Human
uuccuucugauguauaug

SEQ ID NO: 258886 - RNA, 22 nt, Human
uccagcauuuuucaauagaauu

SEQ ID NO: 258887 - RNA, 22 nt, Human
ugcaggugguuuggacacugcu

SEQ ID NO: 258888 - RNA, 22 nt, Human
ggcuucucugucuaguuucuac

SEQ ID NO: 258889 - RNA, 22 nt, Human
uacacaucuggagaagcccugu

SEQ ID NO: 258890 - RNA, 22 nt, Human
cucagagccaguuagcaggugc

SEQ ID NO: 258891 - RNA, 22 nt, Human
aaaguucuaaaacucuuuguga

SEQ ID NO: 258892 - RNA, 22 nt, Human
uauguacucaucaacuauugaa

SEQ ID NO: 258893 - RNA, 22 nt, Human
ugccugaugcaggaguaucaga

SEQ ID NO: 258894 - RNA, 22 nt, Human
acauuaaauuucauagugauua

SEQ ID NO: 258895 - RNA, 22 nt, Human
aagcaggcaugggaggccaucc

SEQ ID NO: 258896 - RNA, 22 nt, Human
agucaacagaguggccgcagcg

SEQ ID NO: 258897 - RNA, 22 nt, Human
uuuucagugggcaaugauguga

SEQ ID NO: 258898 - RNA, 22 nt, Human
agagcagauggccagggggccu

SEQ ID NO: 258899 - RNA, 21 nt, Human
ugaaugaugccccagaguugu

SEQ ID NO: 258900 - RNA, 22 nt, Human
aacuccagggggucaauauuua

SEQ ID NO: 258901 - RNA, 22 nt, Human
uguuuucacaaugaugucagau

SEQ ID NO: 258902 - RNA, 22 nt, Human
guuuauaaugucugugccaaaa

SEQ ID NO: 258903 - RNA, 22 nt, Human
gcuucagcuuugucuccuuggg

SEQ ID NO: 258904 - RNA, 22 nt, Human
gcaggagugacauggaugugga

SEQ ID NO: 258905 - RNA, 22 nt, Human
uugauuaaaaugagacaucauu

SEQ ID NO: 258906 - RNA, 22 nt, Human
augugaaugcaguuaucuauaa

SEQ ID NO: 258907 - RNA, 22 nt, Human
cugccacuuucacccagugcuc

SEQ ID NO: 258908 - RNA, 22 nt, Human
cucugcugcuuugccaguggaa

SEQ ID NO: 258909 - RNA, 22 nt, Human
cagcccaggcucagauguuggg

SEQ ID NO: 258910 - RNA, 22 nt, Human
ugggccaguccagccccaggga

SEQ ID NO: 258911 - RNA, 18 nt, Human
aguaggcacugugggguu

SEQ ID NO: 258912 - RNA, 22 nt, Human
uacacuuuuuacuacagauucu

SEQ ID NO: 258913 - RNA, 22 nt, Human
cuguuuccccaugcccugacuc

SEQ ID NO: 258914 - RNA, 22 nt, Human
caggagucccucuggccagcau

SEQ ID NO: 258915 - RNA, 22 nt, Human
aagccaguggugagaagauagc

SEQ ID NO: 258916 - RNA, 22 nt, Human
uccucagucacgguagcacauu

SEQ ID NO: 258917 - RNA, 22 nt, Human
gaggcuggacgugcauuucuac

SEQ ID NO: 258918 - RNA, 22 nt, Human
uucugggugacucacgcucccc

SEQ ID NO: 258919 - RNA, 22 nt, Human
agacauguccacaaagcauuca

SEQ ID NO: 258920 - RNA, 22 nt, Human
ucccagcagagccagcaagccg

SEQ ID NO: 258921 - RNA, 22 nt, Human
ugucuuuacuuaauaaauauac

SEQ ID NO: 258922 - RNA, 22 nt, Human
ugcagcugaaccuagagucugu

SEQ ID NO: 258923 - RNA, 22 nt, Human
ucugagggcuugaggggaagua

SEQ ID NO: 258924 - RNA, 22 nt, Human
uuugcaaauacagaggucuugc

SEQ ID NO: 258925 - RNA, 22 nt, Human
aagcccuuggcgcacaccgggc

SEQ ID NO: 258926 - RNA, 22 nt, Human
aggcuccugagaggcagaggcu

SEQ ID NO: 258927 - RNA, 21 nt, Human
acagcagacaggcuuaggacc

SEQ ID NO: 258928 - RNA, 18 nt, Human
caguauaaccagcaacuc

SEQ ID NO: 258929 - RNA, 22 nt, Human
cucuucuuggcccccaugaggg

SEQ ID NO: 258930 - RNA, 22 nt, Human
uacauucauggugacuuguaug

SEQ ID NO: 258931 - RNA, 22 nt, Human
ggcagaggagcuggaaacaugg

SEQ ID NO: 258932 - RNA, 22 nt, Human
agguaaggcuguaagcuaagcc

SEQ ID NO: 258933 - RNA, 22 nt, Human
ucucagaagugaucaggauguu

SEQ ID NO: 258934 - RNA, 22 nt, Human
augccuggacuguaucccagau

SEQ ID NO: 258935 - RNA, 22 nt, Human
gagcaggcaaagaugaaaggag

SEQ ID NO: 258936 - RNA, 22 nt, Human
acagccaggaauucuggagaag

SEQ ID NO: 258937 - RNA, 22 nt, Human
uugcuuuaagguaucuggagaa

SEQ ID NO: 258938 - RNA, 22 nt, Human
ccugcaccuaacacaacgcucu

SEQ ID NO: 258939 - RNA, 22 nt, Human
gcccaggugcccucugccuuac

SEQ ID NO: 258940 - RNA, 22 nt, Human
ucaagggaggagacacagcccu

SEQ ID NO: 258941 - RNA, 22 nt, Human
augacaaccugugagcugguau

SEQ ID NO: 258942 - RNA, 21 nt, Human
gcagcagaggcuugacagaca

SEQ ID NO: 258943 - RNA, 20 nt, Human
ucuggcaggugaacgagcug

SEQ ID NO: 258944 - RNA, 22 nt, Human
cagacagcaggccuggaugugu

SEQ ID NO: 258945 - RNA, 22 nt, Human
uccuagaaucuuuguaagauug

SEQ ID NO: 258946 - RNA, 22 nt, Human
acuccagguuuucucucaaguu

SEQ ID NO: 258947 - RNA, 22 nt, Human
aucuccagauugugaucaucag

SEQ ID NO: 258948 - RNA, 22 nt, Human
gcugccagggaggugguggagg

SEQ ID NO: 258949 - RNA, 22 nt, Human
auucuucauaccuacugagguu

SEQ ID NO: 258950 - RNA, 22 nt, Human
uccaggcucccucaggaugcac

SEQ ID NO: 258951 - RNA, 22 nt, Human
gaauaauuuugaucagaaggga

SEQ ID NO: 258952 - RNA, 22 nt, Human
aaugugucauuucccacaggug

SEQ ID NO: 258953 - RNA, 22 nt, Human
ccaaaguauuaaaucuuagcaa

SEQ ID NO: 258954 - RNA, 22 nt, Human
uuacuacagagagagcuccagu

SEQ ID NO: 258955 - RNA, 22 nt, Human
ggcugagguguggggaacuaua

SEQ ID NO: 258956 - RNA, 22 nt, Human
gaacaaaucccuuccugucucc

SEQ ID NO: 258957 - RNA, 18 nt, Human
cagucccaaaccuuagga

SEQ ID NO: 258958 - RNA, 22 nt, Human
ucaggcaggaagggaggacuug

SEQ ID NO: 258959 - RNA, 22 nt, Human
auguuaaaagucugagugggag

SEQ ID NO: 258960 - RNA, 22 nt, Human
aguccagugucaaggugccauu

SEQ ID NO: 258961 - RNA, 17 nt, Human
gaagguuucucuuaggu

SEQ ID NO: 258962 - RNA, 22 nt, Human
cggcugcugccugagucgcugu

SEQ ID NO: 258963 - RNA, 22 nt, Human
uucacacuuuggaauuccaccu

SEQ ID NO: 258964 - RNA, 17 nt, Human
ucugcagaggcaaaccu

SEQ ID NO: 258965 - RNA, 22 nt, Human
agaauacuaggcuucagaaagg

SEQ ID NO: 258966 - RNA, 22 nt, Human
uggagagaacagugucugaaag

SEQ ID NO: 258967 - RNA, 22 nt, Human
agcagaagaaagccacaugacu

SEQ ID NO: 258968 - RNA, 22 nt, Human
uacagagaugugaaaagcucua

SEQ ID NO: 258969 - RNA, 22 nt, Human
cuguuagugaucaaagggagag

SEQ ID NO: 258970 - RNA, 22 nt, Human
acccagaguaacagauggauuc

SEQ ID NO: 258971 - RNA, 22 nt, Human
gcagccaggaaagcuggacccu

SEQ ID NO: 258972 - RNA, 22 nt, Human
ucagaaaagagaaaaucuuaua

SEQ ID NO: 258973 - RNA, 22 nt, Human
uuccacuggcuuucagugaucu

SEQ ID NO: 258974 - RNA, 22 nt, Human
cagcagcaguggcugcagaaca

SEQ ID NO: 258975 - RNA, 22 nt, Human
uguguauuucuggaacagacua

SEQ ID NO: 258976 - RNA, 22 nt, Human
ucagccugcgucauggugacac

SEQ ID NO: 258977 - RNA, 22 nt, Human
uuggaaaagugaaacuagaugc

SEQ ID NO: 258978 - RNA, 22 nt, Human
gaauacauuugccgugguucuc

SEQ ID NO: 258979 - RNA, 22 nt, Human
uaguacaguggagagcaaagaa

SEQ ID NO: 258980 - RNA, 22 nt, Human
agggccccauagucacugcccg

SEQ ID NO: 258981 - RNA, 22 nt, Human
acucagaggcagcugcucaccc

SEQ ID NO: 258982 - RNA, 22 nt, Human
gcugaaaugucuuuagcagugu

SEQ ID NO: 258983 - RNA, 21 nt, Human
ccuuggcuggcaucuagcacc

SEQ ID NO: 258984 - RNA, 22 nt, Human
acuuugcagguacaugagcauc

SEQ ID NO: 258985 - RNA, 20 nt, Human
auuuggcaugaaguauugau

SEQ ID NO: 258986 - RNA, 22 nt, Human
gagucagauugcagacagggcu

SEQ ID NO: 258987 - RNA, 22 nt, Human
aggguccaacugaggcugaacu

SEQ ID NO: 258988 - RNA, 22 nt, Human
agcuggaacgucacaggagcag

SEQ ID NO: 258989 - RNA, 22 nt, Human
ugcuuuuaagaacaaugcugcu

SEQ ID NO: 258990 - RNA, 22 nt, Human
ggcuucccuuuccgagaggaga

SEQ ID NO: 258991 - RNA, 22 nt, Human
cucaucugucugggcugguuuu

SEQ ID NO: 258992 - RNA, 22 nt, Human
gcagguggggcugcuaccagaa

SEQ ID NO: 258993 - RNA, 20 nt, Human
gaaucuuuccccaugcaaug

SEQ ID NO: 258994 - RNA, 22 nt, Human
aggcccagugccauuaguuuug

SEQ ID NO: 258995 - RNA, 22 nt, Human
auugcuuucuuuggggaacugu

SEQ ID NO: 258996 - RNA, 22 nt, Human
guugcaggaagcacacacaugu

SEQ ID NO: 258997 - RNA, 22 nt, Human
cuuuccucuggcacugucuggu

SEQ ID NO: 258998 - RNA, 22 nt, Human
uaauacauuaccuaaccucucu

SEQ ID NO: 258999 - RNA, 22 nt, Human
cuuauuucagcccugggcaccc

SEQ ID NO: 259000 - RNA, 22 nt, Human
ugagaaauuacuucagugaugg

SEQ ID NO: 259001 - RNA, 22 nt, Human
agacaucagcuugugugcaggg

SEQ ID NO: 259002 - RNA, 22 nt, Human
uugcaccccuugauugagccuu

SEQ ID NO: 259003 - RNA, 22 nt, Human
uugcagggcaucgcguacuucu

SEQ ID NO: 259004 - RNA, 22 nt, Human
ucacagaaguguguuucaggag

SEQ ID NO: 259005 - RNA, 23 nt, Human
uauuacaauuggucuuauuaaga

SEQ ID NO: 259006 - RNA, 22 nt, Human
ccaggugugucuggccccgaag

SEQ ID NO: 259007 - RNA, 22 nt, Human
caaacuauuguucacaagacaa

SEQ ID NO: 259008 - RNA, 22 nt, Human
gaggcugcggggaggagccugc

SEQ ID NO: 259009 - RNA, 17 nt, Human
uccugugggugcagcag

SEQ ID NO: 259010 - RNA, 22 nt, Human
uuauuguuuggguauaauuuga

SEQ ID NO: 259011 - RNA, 22 nt, Human
guggauggcccugcacacaggu

SEQ ID NO: 259012 - RNA, 22 nt, Human
gaaggccaagaggcuccaagau

SEQ ID NO: 259013 - RNA, 22 nt, Human
caaugucaaggagaccaaaacg

SEQ ID NO: 259014 - RNA, 22 nt, Human
ccagccaugggccaccuagcug

SEQ ID NO: 259015 - RNA, 20 nt, Human
uccaggcagacagcuauggg

SEQ ID NO: 259016 - RNA, 22 nt, Human
ggcaggcauugcaacauguaca

SEQ ID NO: 259017 - RNA, 22 nt, Human
ccaggcuuccuaaugugugcag

SEQ ID NO: 259018 - RNA, 22 nt, Human
agaaugcuuguaccuuuguuuu

SEQ ID NO: 259019 - RNA, 22 nt, Human
cauuucuaagaaggcugcacau

SEQ ID NO: 259020 - RNA, 22 nt, Human
ucagauggaaagguuacugucc

SEQ ID NO: 259021 - RNA, 22 nt, Human
cagggugggcacccagccucca

SEQ ID NO: 259022 - RNA, 22 nt, Human
caggacucuugucaucaucagu

SEQ ID NO: 259023 - RNA, 22 nt, Human
ucacauuuucuacuacuguacg

SEQ ID NO: 259024 - RNA, 22 nt, Human
ugguguuggagaugguugcauu

SEQ ID NO: 259025 - RNA, 22 nt, Human
gcacuggauuuugaucugcaag

SEQ ID NO: 259026 - RNA, 22 nt, Human
ucuaggagcuuaaaggaggcca

SEQ ID NO: 259027 - RNA, 22 nt, Human
aggccucuggagguggcagugu

SEQ ID NO: 259028 - RNA, 22 nt, Human
uauuuugcguugagucagauuu

SEQ ID NO: 259029 - RNA, 22 nt, Human
uagaggcacccuggaggagacu

SEQ ID NO: 259030 - RNA, 22 nt, Human
cucagagccccaggagggugug

SEQ ID NO: 259031 - RNA, 22 nt, Human
aacuggaucaguugagggaggc

SEQ ID NO: 259032 - RNA, 22 nt, Human
ccaggaggcuucguccguggag

SEQ ID NO: 259033 - RNA, 22 nt, Human
ggccuuccauugcucuuuucua

SEQ ID NO: 259034 - RNA, 23 nt, Human
uggaggaaacacaucagaagacc

SEQ ID NO: 259035 - RNA, 22 nt, Human
uuccugggcucuggcuggccua

SEQ ID NO: 259036 - RNA, 23 nt, Human
acagacauuguacaucuuguuuu

SEQ ID NO: 259037 - RNA, 22 nt, Human
ccugggccaggcuugggaaugc

SEQ ID NO: 259038 - RNA, 22 nt, Human
ucuucaauuagauuuaccaauu

SEQ ID NO: 259039 - RNA, 22 nt, Human
aggaauguguuucuaggcuguu

SEQ ID NO: 259040 - RNA, 22 nt, Human
aguuguaagagacagauauaaa

SEQ ID NO: 259041 - RNA, 21 nt, Human
cuggcauuaugauagcguccu

SEQ ID NO: 259042 - RNA, 18 nt, Human
ggcacugcuguuccccuu

SEQ ID NO: 259043 - RNA, 22 nt, Human
ucaucauccuuuuuugaagagu

SEQ ID NO: 259044 - RNA, 22 nt, Human
cucccuccucaaauaucuuugu

SEQ ID NO: 259045 - RNA, 22 nt, Human
uggcuggcguuggggccaguga

SEQ ID NO: 259046 - RNA, 22 nt, Human
aagcuuuaaggaauuuuaugga

SEQ ID NO: 259047 - RNA, 22 nt, Human
ggcgccagcgguaaguaagaca

SEQ ID NO: 259048 - RNA, 22 nt, Human
aggaaugucugagaaagaggca

SEQ ID NO: 259049 - RNA, 22 nt, Human
uaccuguugucacgauaacacu

SEQ ID NO: 259050 - RNA, 22 nt, Human
ucugccuggaugauggcagggc

SEQ ID NO: 259051 - RNA, 22 nt, Human
cuguagaggaacaagagcucuu

SEQ ID NO: 259052 - RNA, 18 nt, Human
uaucuuuuccagugguau

SEQ ID NO: 259053 - RNA, 21 nt, Human
caugugucauuggagagcaau

SEQ ID NO: 259054 - RNA, 22 nt, Human
gaauaacauuggaacccugaag

SEQ ID NO: 259055 - RNA, 22 nt, Human
ccucugugccucguguccucug

SEQ ID NO: 259056 - RNA, 22 nt, Human
cccaugagguggagguugcagu

SEQ ID NO: 259057 - RNA, 22 nt, Human
aaguucugggguaaugagaauu

SEQ ID NO: 259058 - RNA, 22 nt, Human
uggccugggccugccggugcaa

SEQ ID NO: 259059 - RNA, 22 nt, Human
uccuagaaggaucauucuagug

SEQ ID NO: 259060 - RNA, 22 nt, Human
aauuccuaguuguacuuaguga

SEQ ID NO: 259061 - RNA, 22 nt, Human
caacaguucucauagcagauuc

SEQ ID NO: 259062 - RNA, 19 nt, Human
ccagcccauaguccaucac

SEQ ID NO: 259063 - RNA, 22 nt, Human
aggggaggagcuuuucuugccu

SEQ ID NO: 259064 - RNA, 22 nt, Human
caaaugauccuugcaagcugug

SEQ ID NO: 259065 - RNA, 17 nt, Human
uuccaguuuaguauugu

SEQ ID NO: 259066 - RNA, 22 nt, Human
uaugugucccugcuacucaaca

SEQ ID NO: 259067 - RNA, 22 nt, Human
cacaggagggagcgggcagcca

SEQ ID NO: 259068 - RNA, 22 nt, Human
gaggguggggaauagacugcua

SEQ ID NO: 259069 - RNA, 22 nt, Human
ugucaggacacagcuuucugug

SEQ ID NO: 259070 - RNA, 22 nt, Human
gggagccacagugaggugcaug

SEQ ID NO: 259071 - RNA, 22 nt, Human
cagaagugaaugugauaaacca

SEQ ID NO: 259072 - RNA, 22 nt, Human
acucaggccccaucgcccaucu

SEQ ID NO: 259073 - RNA, 22 nt, Human
caggcuggagugaguguagugg

SEQ ID NO: 259074 - RNA, 22 nt, Human
gcacaauuauuuaugcaguaug

SEQ ID NO: 259075 - RNA, 22 nt, Human
ggcacugauuccauucaugaag

SEQ ID NO: 259076 - RNA, 22 nt, Human
uuucucaaguacugcacaugaa

SEQ ID NO: 259077 - RNA, 22 nt, Human
uguccuuuacugauugcuucug

SEQ ID NO: 259078 - RNA, 22 nt, Human
gcaccagggugcuguguucugg

SEQ ID NO: 259079 - RNA, 22 nt, Human
ucuggguccgggggugaauuga

SEQ ID NO: 259080 - RNA, 22 nt, Human
agugucuuugucucucaagcac

SEQ ID NO: 259081 - RNA, 22 nt, Human
aucucuucucccaacaccuggc

SEQ ID NO: 259082 - RNA, 22 nt, Human
uucuucaguguagcaacuguau

SEQ ID NO: 259083 - RNA, 22 nt, Human
gugcaaaaggcauugugguuuu

SEQ ID NO: 259084 - RNA, 19 nt, Human
gaggagcuaucggagacag

SEQ ID NO: 259085 - RNA, 23 nt, Human
agaccugcaucugauaggcccug

SEQ ID NO: 259086 - RNA, 20 nt, Human
guuuccuauuuaccuccuca

SEQ ID NO: 259087 - RNA, 22 nt, Human
gcugcagcccggcgcgccugag

SEQ ID NO: 259088 - RNA, 22 nt, Human
uaguuaugucugcaugcauauu

SEQ ID NO: 259089 - RNA, 22 nt, Human
aaagccagaguguguuagagac

SEQ ID NO: 259090 - RNA, 22 nt, Human
cagcugaggucuuuuuuaugug

SEQ ID NO: 259091 - RNA, 22 nt, Human
uuauuuaauuuucucacucaga

SEQ ID NO: 259092 - RNA, 22 nt, Human
gcagcauccccaggcagcaggg

SEQ ID NO: 259093 - RNA, 22 nt, Human
cuccaggcuggggugcagguug

SEQ ID NO: 259094 - RNA, 22 nt, Human
gcucagggugcaguguccauga

SEQ ID NO: 259095 - RNA, 20 nt, Human
gcagggcaagggauaugaaa

SEQ ID NO: 259096 - RNA, 22 nt, Human
aaagguuuugguaaggcuuuaa

SEQ ID NO: 259097 - RNA, 22 nt, Human
uagggaggcuacuucuuguagg

SEQ ID NO: 259098 - RNA, 22 nt, Human
aggcuucuugagccccacaggc

SEQ ID NO: 259099 - RNA, 22 nt, Human
cugccagcucaaagcgcagcua

SEQ ID NO: 259100 - RNA, 22 nt, Human
acacagaggcaugacaguggcu

SEQ ID NO: 259101 - RNA, 22 nt, Human
ggcagcugaccuagcaccaucc

SEQ ID NO: 259102 - RNA, 22 nt, Human
aagcaaagacaguuugagugga

SEQ ID NO: 259103 - RNA, 22 nt, Human
augaaucaagugagaacagcau

SEQ ID NO: 259104 - RNA, 17 nt, Human
caggcagacauguaagc

SEQ ID NO: 259105 - RNA, 22 nt, Human
acaaggcucuaauuucauugaa

SEQ ID NO: 259106 - RNA, 21 nt, Human
acagugugcuucucucccucc

SEQ ID NO: 259107 - RNA, 22 nt, Human
aucauaaagugcuaucugauug

SEQ ID NO: 259108 - RNA, 22 nt, Human
aaacccagagacuagaaagacc

SEQ ID NO: 259109 - RNA, 22 nt, Human
guguuuauaggagugaaugcug

SEQ ID NO: 259110 - RNA, 22 nt, Human
ggcacagggagccgcaguugca

SEQ ID NO: 259111 - RNA, 22 nt, Human
uauggaaacuaauucauuuuuc

SEQ ID NO: 259112 - RNA, 22 nt, Human
uuaugaaaacaaucaguaggca

SEQ ID NO: 259113 - RNA, 22 nt, Human
ccugggucacucaggcaggcgg

SEQ ID NO: 259114 - RNA, 21 nt, Human
ugcacuuugggggacaggcug

SEQ ID NO: 259115 - RNA, 18 nt, Human
cuucaguggcugcucugc

SEQ ID NO: 259116 - RNA, 22 nt, Human
ucauaaauaguugugccugaau

SEQ ID NO: 259117 - RNA, 22 nt, Human
gcccucaggcagggagucuuuc

SEQ ID NO: 259118 - RNA, 22 nt, Human
aaagaugugccuguuucauagu

SEQ ID NO: 259119 - RNA, 22 nt, Human
gagaagggauaugccacucucg

SEQ ID NO: 259120 - RNA, 22 nt, Human
gucaaguuuauccgcucauuca

SEQ ID NO: 259121 - RNA, 22 nt, Human
uccuggccaggaugaccuaaca

SEQ ID NO: 259122 - RNA, 22 nt, Human
gcucugagacaguagagauggc

SEQ ID NO: 259123 - RNA, 22 nt, Human
aaaaguuugugcaaacacucag

SEQ ID NO: 259124 - RNA, 22 nt, Human
caggaaacugugggcuuaaauc

SEQ ID NO: 259125 - RNA, 22 nt, Human
aagcacaguucuuagaguuaca

SEQ ID NO: 259126 - RNA, 21 nt, Human
uucauugaacuauuuguggag

SEQ ID NO: 259127 - RNA, 19 nt, Human
agcuggcucuucuuugucu

SEQ ID NO: 259128 - RNA, 22 nt, Human
gaggggcacaguaaaggguccc

SEQ ID NO: 259129 - RNA, 22 nt, Human
acaugaaaccugagucuaacuc

SEQ ID NO: 259130 - RNA, 22 nt, Human
gggaaaggauuuacaguuugau

SEQ ID NO: 259131 - RNA, 22 nt, Human
cuccuggaggcuccaagggaga

SEQ ID NO: 259132 - RNA, 22 nt, Human
ucacucuguuagaggaaagugc

SEQ ID NO: 259133 - RNA, 22 nt, Human
ugaaugcuuggagucauaaaau

SEQ ID NO: 259134 - RNA, 22 nt, Human
gggagggaaggaccuuaugaau

SEQ ID NO: 259135 - RNA, 22 nt, Human
uggaaacugcaguucccgggga

SEQ ID NO: 259136 - RNA, 22 nt, Human
cacuagaaccaaugacauuucu

SEQ ID NO: 259137 - RNA, 23 nt, Human
auaaacugucaaaagccagcccu

SEQ ID NO: 259138 - RNA, 22 nt, Human
acagacaugggccgcucuugag

SEQ ID NO: 259139 - RNA, 22 nt, Human
cagucccaugagcccagaacau

SEQ ID NO: 259140 - RNA, 23 nt, Human
aagaauaaaugacauuaaaggug

SEQ ID NO: 259141 - RNA, 22 nt, Human
ccaccaggcucuguccgagcgg

SEQ ID NO: 259142 - RNA, 22 nt, Human
gguggggccagggcuccaaccu

SEQ ID NO: 259143 - RNA, 22 nt, Human
gcaguagugucaguacagcaaa

SEQ ID NO: 259144 - RNA, 21 nt, Human
aggacacagagacaccuauug

SEQ ID NO: 259145 - RNA, 15 nt, Human
uaccagcugauccgu

SEQ ID NO: 259146 - RNA, 22 nt, Human
acaggcugcugagccauuugcu

SEQ ID NO: 259147 - RNA, 22 nt, Human
acaggaacccagaaacauuucu

SEQ ID NO: 259148 - RNA, 22 nt, Human
aaaugugucauauucaaaguca

SEQ ID NO: 259149 - RNA, 21 nt, Human
acagcaagccuucacaugagu

SEQ ID NO: 259150 - RNA, 21 nt, Human
uuuuacagaugaggggaaggg

SEQ ID NO: 259151 - RNA, 22 nt, Human
gggcggggggagcuggaaugaa

SEQ ID NO: 259152 - RNA, 22 nt, Human
agccccucuguggcucugccuc

SEQ ID NO: 259153 - RNA, 17 nt, Human
ggcaccagacggagagu

SEQ ID NO: 259154 - RNA, 19 nt, Human
aggugacaugugacagccu

SEQ ID NO: 259155 - RNA, 22 nt, Human
cagcccuuaagagucaucccuc

SEQ ID NO: 259156 - RNA, 22 nt, Human
ggaagaggcugguagugcccgu

SEQ ID NO: 259157 - RNA, 22 nt, Human
uuucuuagcgaugcuugauaaa

SEQ ID NO: 259158 - RNA, 22 nt, Human
agggccugcaucaggagcuugg

SEQ ID NO: 259159 - RNA, 21 nt, Human
uagcacuucgcuguaauuggg

SEQ ID NO: 259160 - RNA, 22 nt, Human
uuuuguguuguaaugucagcua

SEQ ID NO: 259161 - RNA, 22 nt, Human
ggcuucuuaaucaugagaguga

SEQ ID NO: 259162 - RNA, 22 nt, Human
aucauacacucacauaaacaga

SEQ ID NO: 259163 - RNA, 22 nt, Human
ggacagcugcuuucaggccaca

SEQ ID NO: 259164 - RNA, 22 nt, Human
aaggcuucuuugcaggcuuuag

SEQ ID NO: 259165 - RNA, 19 nt, Human
ucugaagaauuagagagca

SEQ ID NO: 259166 - RNA, 22 nt, Human
acauggggcccaaagagagguc

SEQ ID NO: 259167 - RNA, 22 nt, Human
cuacauaaauuuaucacagacu

SEQ ID NO: 259168 - RNA, 22 nt, Human
uacagcugcaaggguuucuggg

SEQ ID NO: 259169 - RNA, 22 nt, Human
gccucagagggcagggugguga

SEQ ID NO: 259170 - RNA, 22 nt, Human
agucagcauuuucacugagcua

SEQ ID NO: 259171 - RNA, 17 nt, Human
uucugugcuuccuggcu

SEQ ID NO: 259172 - RNA, 22 nt, Human
aggccuggguguucaccagaag

SEQ ID NO: 259173 - RNA, 22 nt, Human
agguccuguguccaggggccug

SEQ ID NO: 259174 - RNA, 22 nt, Human
ucucuggcacucccuuauggcu

SEQ ID NO: 259175 - RNA, 22 nt, Human
uuucuucucaucccugaaauca

SEQ ID NO: 259176 - RNA, 22 nt, Human
gugcagcugugugagagcucca

SEQ ID NO: 259177 - RNA, 22 nt, Human
uuacagaauguucuuccaacag

SEQ ID NO: 259178 - RNA, 22 nt, Human
caugagauuugggaggggccag

SEQ ID NO: 259179 - RNA, 22 nt, Human
aaggauaaaaaccacuucuaau

SEQ ID NO: 259180 - RNA, 22 nt, Human
ucagguguuagaagaaauuuca

SEQ ID NO: 259181 - RNA, 22 nt, Human
ggaggggcauaguucaccauca

SEQ ID NO: 259182 - RNA, 22 nt, Human
gcaacuuucaagcaccaugggg

SEQ ID NO: 259183 - RNA, 18 nt, Human
ccuguguguguugcaggc

SEQ ID NO: 259184 - RNA, 22 nt, Human
accaggcagcaccaaagccggu

SEQ ID NO: 259185 - RNA, 22 nt, Human
gaacuuggaccugguccuuugg

SEQ ID NO: 259186 - RNA, 22 nt, Human
ucuuuucuguaacucagugucu

SEQ ID NO: 259187 - RNA, 19 nt, Human
cugcuccaggagcugggga

SEQ ID NO: 259188 - RNA, 21 nt, Human
ugggcgcuugaccucugcacu

SEQ ID NO: 259189 - RNA, 22 nt, Human
cuagaacagucaaagugagcuc

SEQ ID NO: 259190 - RNA, 22 nt, Human
uuacaaguauuuaagaugcugu

SEQ ID NO: 259191 - RNA, 22 nt, Human
caggggcuguggcacauggugu

SEQ ID NO: 259192 - RNA, 22 nt, Human
aagacucuaucuuuagagauca

SEQ ID NO: 259193 - RNA, 22 nt, Human
auuuagcaagcaggcaaauuca

SEQ ID NO: 259194 - RNA, 22 nt, Human
gaggcaguuugccaugccagga

SEQ ID NO: 259195 - RNA, 22 nt, Human
ccucugggagacugcuacugag

SEQ ID NO: 259196 - RNA, 22 nt, Human
agguacagaugaaagucuaguu

SEQ ID NO: 259197 - RNA, 22 nt, Human
cugggcucaaauccuaucucca

SEQ ID NO: 259198 - RNA, 22 nt, Human
agguccuggacugcucuuguua

SEQ ID NO: 259199 - RNA, 22 nt, Human
aguguggacuuuuccuaggagg

SEQ ID NO: 259200 - RNA, 22 nt, Human
cuggcugugcagucuuccagaa

SEQ ID NO: 259201 - RNA, 22 nt, Human
gcagaauagugacuuuccuuaa

SEQ ID NO: 259202 - RNA, 22 nt, Human
caaagauuuuagaauuugcaau

SEQ ID NO: 259203 - RNA, 22 nt, Human
aaguuggaaucuggaacugauc

SEQ ID NO: 259204 - RNA, 22 nt, Human
ucuccuggcucuaaaaggcugu

SEQ ID NO: 259205 - RNA, 22 nt, Human
auaaucugagcuauuucaugag

SEQ ID NO: 259206 - RNA, 22 nt, Human
ucucaguguggugcuuaggaua

SEQ ID NO: 259207 - RNA, 22 nt, Human
agucacacugguuguuuacagu

SEQ ID NO: 259208 - RNA, 22 nt, Human
ccacguguagguggacaggauc

SEQ ID NO: 259209 - RNA, 22 nt, Human
cuagggaccucagcuccuggag

SEQ ID NO: 259210 - RNA, 22 nt, Human
ucaaauaggcuuguagugacug

SEQ ID NO: 259211 - RNA, 22 nt, Human
gugcugugcgcuuuuucuguau

SEQ ID NO: 259212 - RNA, 22 nt, Human
gucuggaguaccauaaaaagga

SEQ ID NO: 259213 - RNA, 22 nt, Human
gggucuggagauccgggugaag

SEQ ID NO: 259214 - RNA, 22 nt, Human
auuuggaaauguaagaaugcaa

SEQ ID NO: 259215 - RNA, 22 nt, Human
aaccccgcucaggcugggugag

SEQ ID NO: 259216 - RNA, 22 nt, Human
caaugcauuauucucccacuuc

SEQ ID NO: 259217 - RNA, 22 nt, Human
cucuggcugucccgaugagcag

SEQ ID NO: 259218 - RNA, 22 nt, Human
ucuggcuucaguaggguucacu

SEQ ID NO: 259219 - RNA, 22 nt, Human
cagcuauugguccacagguaug

SEQ ID NO: 259220 - RNA, 22 nt, Human
cuguggcuuuuccggggagccu

SEQ ID NO: 259221 - RNA, 22 nt, Human
gcccugcccugagccguagacc

SEQ ID NO: 259222 - RNA, 19 nt, Human
cuggaccuggaggcccgga

SEQ ID NO: 259223 - RNA, 22 nt, Human
guuccuuccuaucccgagagcc

SEQ ID NO: 259224 - RNA, 22 nt, Human
auggcaggauacccaguccggc

SEQ ID NO: 259225 - RNA, 22 nt, Human
uucuuucucuccacaaggcuug

SEQ ID NO: 259226 - RNA, 22 nt, Human
uacaguuuaacacuuuggagaa

SEQ ID NO: 259227 - RNA, 22 nt, Human
agcuaggauaagcagagacugg

SEQ ID NO: 259228 - RNA, 19 nt, Human
uucuccagggacuuaggga

SEQ ID NO: 259229 - RNA, 22 nt, Human
caggcuggcaaugcgucaagca

SEQ ID NO: 259230 - RNA, 22 nt, Human
ugagguaaauucuggcccaaac

SEQ ID NO: 259231 - RNA, 22 nt, Human
cugagggagaagugaucucuac

SEQ ID NO: 259232 - RNA, 23 nt, Human
ccuccugggcacaggccugaugg

SEQ ID NO: 259233 - RNA, 19 nt, Human
acauuuaaauucagaucuc

SEQ ID NO: 259234 - RNA, 22 nt, Human
ugacauguggcuuugacccagg

SEQ ID NO: 259235 - RNA, 22 nt, Human
acacaguucuuagcaggugucu

SEQ ID NO: 259236 - RNA, 22 nt, Human
ugguuuauuucucugaaagguu

SEQ ID NO: 259237 - RNA, 22 nt, Human
ggcauccaaauaccaagaugua

SEQ ID NO: 259238 - RNA, 22 nt, Human
agccuucacugggaccuuggau

SEQ ID NO: 259239 - RNA, 22 nt, Human
ucugcaggcauuuuugguuguc

SEQ ID NO: 259240 - RNA, 22 nt, Human
uggaaugaaaaguacuucagaa

SEQ ID NO: 259241 - RNA, 22 nt, Human
uugcagcugugagcuuuacacg

SEQ ID NO: 259242 - RNA, 22 nt, Human
uucuggaauccucaaaacauga

SEQ ID NO: 259243 - RNA, 22 nt, Human
cugggaggcccacguugggaag

SEQ ID NO: 259244 - RNA, 18 nt, Human
gagaggcccggcugugcc

SEQ ID NO: 259245 - RNA, 22 nt, Human
cagauggccagaggcagcugca

SEQ ID NO: 259246 - RNA, 19 nt, Human
uggcagggagaguuugaag

SEQ ID NO: 259247 - RNA, 22 nt, Human
ugaccuuucuuugagauuccug

SEQ ID NO: 259248 - RNA, 22 nt, Human
cagaugcuuguuggcuggucuc

SEQ ID NO: 259249 - RNA, 20 nt, Human
ccuggcugguggaggaaagg

SEQ ID NO: 259250 - RNA, 22 nt, Human
gugaggggccaagaguagggca

SEQ ID NO: 259251 - RNA, 22 nt, Human
agacaacaucacuaaagcugag

SEQ ID NO: 259252 - RNA, 22 nt, Human
aaggaacucuagagccuugaac

SEQ ID NO: 259253 - RNA, 22 nt, Human
gugugcagaggcaggaggugcu

SEQ ID NO: 259254 - RNA, 22 nt, Human
aucucauuuugguuucuacuua

SEQ ID NO: 259255 - RNA, 22 nt, Human
auauaauaguuucauaaaggcu

SEQ ID NO: 259256 - RNA, 22 nt, Human
uuauacacguuuauggagcuac

SEQ ID NO: 259257 - RNA, 22 nt, Human
acacuucuauucccugcacaaa

SEQ ID NO: 259258 - RNA, 21 nt, Human
uacaaguugcuuuugaagucc

SEQ ID NO: 259259 - RNA, 22 nt, Human
uccucagauauaaaugagggug

SEQ ID NO: 259260 - RNA, 22 nt, Human
cugggcucagaugagaggaagg

SEQ ID NO: 259261 - RNA, 22 nt, Human
aaaaaugugaccacaggguguu

SEQ ID NO: 259262 - RNA, 22 nt, Human
uuuuaaacuccccuaguuggug

SEQ ID NO: 259263 - RNA, 22 nt, Human
gggugggguguaucggauccua

SEQ ID NO: 259264 - RNA, 22 nt, Human
agggauggaagacuugaagacc

SEQ ID NO: 259265 - RNA, 20 nt, Human
gagucacagaagaagcugaa

SEQ ID NO: 259266 - RNA, 22 nt, Human
acauuucuaauuuaauguaaca

SEQ ID NO: 259267 - RNA, 22 nt, Human
ucugggcuuggauuggcucugc

SEQ ID NO: 259268 - RNA, 22 nt, Human
auucacaauagcagcuugcaug

SEQ ID NO: 259269 - RNA, 22 nt, Human
ggcacagagcccagcuuccuag

SEQ ID NO: 259270 - RNA, 22 nt, Human
auggagggugguaagacagaga

SEQ ID NO: 259271 - RNA, 22 nt, Human
ccaaaguccacaguuuacauua

SEQ ID NO: 259272 - RNA, 22 nt, Human
ugaugagggggaacagagauuu

SEQ ID NO: 259273 - RNA, 22 nt, Human
aucuuuguugcucucauuucug

SEQ ID NO: 259274 - RNA, 22 nt, Human
acaugauuuuuaaagagauaau

SEQ ID NO: 259275 - RNA, 22 nt, Human
ucaggcaguagaauugcuugaa

SEQ ID NO: 259276 - RNA, 23 nt, Human
uucagggccucagaggugaagcu

SEQ ID NO: 259277 - RNA, 18 nt, Human
agagaagagguguuaguc

SEQ ID NO: 259278 - RNA, 22 nt, Human
caugaguucaucugcuucucuu

SEQ ID NO: 259279 - RNA, 22 nt, Human
agacuguagcuucugucuugag

SEQ ID NO: 259280 - RNA, 22 nt, Human
ugaaagaagccuucgaggcucg

SEQ ID NO: 259281 - RNA, 22 nt, Human
gagaucuucaagguuuuagaua

SEQ ID NO: 259282 - RNA, 22 nt, Human
uuccugagucgccgagucuaug

SEQ ID NO: 259283 - RNA, 22 nt, Human
cucaugucuucacccauucuaa

SEQ ID NO: 259284 - RNA, 22 nt, Human
aggccucuguuccccauguuuu

SEQ ID NO: 259285 - RNA, 22 nt, Human
uacuuagacucuaucuagagau

SEQ ID NO: 259286 - RNA, 19 nt, Human
gagguggguccccgcagcc

SEQ ID NO: 259287 - RNA, 22 nt, Human
gccugggagugcacagugaggu

SEQ ID NO: 259288 - RNA, 22 nt, Human
uagguucacugucuugaggagc

SEQ ID NO: 259289 - RNA, 22 nt, Human
cccagcucaucaggagccgccc

SEQ ID NO: 259290 - RNA, 22 nt, Human
acagaugaugugcacagauaga

SEQ ID NO: 259291 - RNA, 22 nt, Human
cagaagaauggugucugagcuc

SEQ ID NO: 259292 - RNA, 21 nt, Human
cuguggaagggaacuagaggg

SEQ ID NO: 259293 - RNA, 22 nt, Human
uggcugagaccaucagggugua

SEQ ID NO: 259294 - RNA, 22 nt, Human
cacaugcaggagccaauguaca

SEQ ID NO: 259295 - RNA, 22 nt, Human
uggcuucucccucugccugauu

SEQ ID NO: 259296 - RNA, 22 nt, Human
uggcgcaguuucucugcugccu

SEQ ID NO: 259297 - RNA, 22 nt, Human
aggcuccagucuccucuggcag

SEQ ID NO: 259298 - RNA, 22 nt, Human
agcucccagcagagcuggccac

SEQ ID NO: 259299 - RNA, 22 nt, Human
agaaagccucaaucuucaggcc

SEQ ID NO: 259300 - RNA, 22 nt, Human
ccacagaauucugucuccagga

SEQ ID NO: 259301 - RNA, 22 nt, Human
uagcaccuagaguauuuuauca

SEQ ID NO: 259302 - RNA, 22 nt, Human
uccaugaggcagggaggcuggc

SEQ ID NO: 259303 - RNA, 22 nt, Human
uagcugaauaaugcgucugcag

SEQ ID NO: 259304 - RNA, 22 nt, Human
cagggacccuacuagcucacac

SEQ ID NO: 259305 - RNA, 22 nt, Human
ccugggucccugagagaugauu

SEQ ID NO: 259306 - RNA, 22 nt, Human
ucagucuauccagcucagaucc

SEQ ID NO: 259307 - RNA, 22 nt, Human
ccuguggaggcugcucagcugg

SEQ ID NO: 259308 - RNA, 19 nt, Human
uaaugcacuuaacacaugg

SEQ ID NO: 259309 - RNA, 22 nt, Human
uguuaacagaggucauuuuggg

SEQ ID NO: 259310 - RNA, 22 nt, Human
acuuggaaaauucaaaauggca

SEQ ID NO: 259311 - RNA, 22 nt, Human
ggaggagauuccccucucacuu

SEQ ID NO: 259312 - RNA, 22 nt, Human
caauuacauuuauugagcauuc

SEQ ID NO: 259313 - RNA, 22 nt, Human
uaggaaauuagaacuuggaaac

SEQ ID NO: 259314 - RNA, 22 nt, Human
gggcucucuuuuuggccugccc

SEQ ID NO: 259315 - RNA, 22 nt, Human
ccucuguacaggucagcaucua

SEQ ID NO: 259316 - RNA, 22 nt, Human
gccacagcggggccgcuagagc

SEQ ID NO: 259317 - RNA, 22 nt, Human
uagaauuuucugcuuugauagu

SEQ ID NO: 259318 - RNA, 22 nt, Human
gaaagccaucuggcugcuggga

SEQ ID NO: 259319 - RNA, 22 nt, Human
ggaaaaacagucuuuauuauuu

SEQ ID NO: 259320 - RNA, 22 nt, Human
cagcugaguaugcauucaagca

SEQ ID NO: 259321 - RNA, 22 nt, Human
cuacaugaauggguguauuacu

SEQ ID NO: 259322 - RNA, 22 nt, Human
gaaggcuggggcaucagugaaa

SEQ ID NO: 259323 - RNA, 22 nt, Human
gccaucugcugcucuccagugu

SEQ ID NO: 259324 - RNA, 22 nt, Human
auuuacaggacagcuuggcauu

SEQ ID NO: 259325 - RNA, 22 nt, Human
uaauuauaacaguuacaucuua

SEQ ID NO: 259326 - RNA, 20 nt, Human
auuccacuuguuugagguac

SEQ ID NO: 259327 - RNA, 22 nt, Human
uuggaaauugcaagugauuugc

SEQ ID NO: 259328 - RNA, 22 nt, Human
ucaggcuggaaugcaguggggc

SEQ ID NO: 259329 - RNA, 22 nt, Human
auuuccagcagcauauuugucu

SEQ ID NO: 259330 - RNA, 22 nt, Human
auaccuuuuagacauguaguug

SEQ ID NO: 259331 - RNA, 22 nt, Human
aaagugcuuuaggauauuugga

SEQ ID NO: 259332 - RNA, 22 nt, Human
cuuaaagaugucaaggcuguuu

SEQ ID NO: 259333 - RNA, 22 nt, Human
ggcuggcuccaccuagguagcu

SEQ ID NO: 259334 - RNA, 22 nt, Human
cuuaaugaaagguugcacaugg

SEQ ID NO: 259335 - RNA, 22 nt, Human
uuagugcuucuguccaaauaua

SEQ ID NO: 259336 - RNA, 17 nt, Human
cugaagaguccuggcua

SEQ ID NO: 259337 - RNA, 22 nt, Human
gugcaggagcuucuggccugac

SEQ ID NO: 259338 - RNA, 22 nt, Human
agagcuggcugcugcggugcuu

SEQ ID NO: 259339 - RNA, 22 nt, Human
cagcaggcggcccgcgggcccg

SEQ ID NO: 259340 - RNA, 22 nt, Human
gcaagcaagcagguagagcuga

SEQ ID NO: 259341 - RNA, 22 nt, Human
gucccccugaaagcagccgcag

SEQ ID NO: 259342 - RNA, 22 nt, Human
aguuuccuuggauucaauuugg

SEQ ID NO: 259343 - RNA, 22 nt, Human
cugcuguuugccgucauugccu

SEQ ID NO: 259344 - RNA, 21 nt, Human
ugggagagggcucagcuaccc

SEQ ID NO: 259345 - RNA, 19 nt, Human
gcacugaagaguuggucac

SEQ ID NO: 259346 - RNA, 22 nt, Human
aaaaccaggcuugcugugcucg

SEQ ID NO: 259347 - RNA, 22 nt, Human
uggcccaggucucucugagccc

SEQ ID NO: 259348 - RNA, 22 nt, Human
uugccugguccugugggugcug

SEQ ID NO: 259349 - RNA, 22 nt, Human
agucaguuuuaccaaucucagu

SEQ ID NO: 259350 - RNA, 22 nt, Human
gcucuggcacuggcgcgggaug

SEQ ID NO: 259351 - RNA, 19 nt, Human
cuguggacucuagaucaug

SEQ ID NO: 259352 - RNA, 22 nt, Human
acugaaauauuuagaagugaag

SEQ ID NO: 259353 - RNA, 22 nt, Human
aggugcuggagucugggcagga

SEQ ID NO: 259354 - RNA, 22 nt, Human
aucugcugucacauguuugaag

SEQ ID NO: 259355 - RNA, 22 nt, Human
aguaaucugauuuuauagcuau

SEQ ID NO: 259356 - RNA, 22 nt, Human
agucacauagaaguggguuuaa

SEQ ID NO: 259357 - RNA, 22 nt, Human
guugggaaggcaagaaguagaa

SEQ ID NO: 259358 - RNA, 22 nt, Human
gugucccaauguucaggacggc

SEQ ID NO: 259359 - RNA, 22 nt, Human
uuuagcuucaguucuagcuucu

SEQ ID NO: 259360 - RNA, 22 nt, Human
gacagcagaauccauucccagu

SEQ ID NO: 259361 - RNA, 23 nt, Human
uguccuuuuugaggccuccuccu

SEQ ID NO: 259362 - RNA, 21 nt, Human
augugaaauaucaucagagca

SEQ ID NO: 259363 - RNA, 22 nt, Human
acucuguagaucucccgggagc

SEQ ID NO: 259364 - RNA, 22 nt, Human
gaacuugggagaagggagugug

SEQ ID NO: 259365 - RNA, 21 nt, Human
aucuuuauuacgcagagaaga

SEQ ID NO: 259366 - RNA, 22 nt, Human
caggacuauguucaacagauag

SEQ ID NO: 259367 - RNA, 22 nt, Human
gaauuagacaugcuuugcuuuu

SEQ ID NO: 259368 - RNA, 22 nt, Human
ucugccuggccuggagggcaca

SEQ ID NO: 259369 - RNA, 22 nt, Human
ggaagccccagcugugggaucc

SEQ ID NO: 259370 - RNA, 22 nt, Human
caggccuggcccccggcacacc

SEQ ID NO: 259371 - RNA, 22 nt, Human
gggaaggcauaccugagggaga

SEQ ID NO: 259372 - RNA, 22 nt, Human
uucugcuuauucaaaugaucuu

SEQ ID NO: 259373 - RNA, 22 nt, Human
cuucuagagcuggagcaaaugu

SEQ ID NO: 259374 - RNA, 22 nt, Human
aggcccagggcugcucucugaa

SEQ ID NO: 259375 - RNA, 22 nt, Human
ucuuuauuuuaugcuugugcaa

SEQ ID NO: 259376 - RNA, 22 nt, Human
aggcaacuuuuggggaugaugg

SEQ ID NO: 259377 - RNA, 22 nt, Human
cucuaggcugcccaggagcuga

SEQ ID NO: 259378 - RNA, 22 nt, Human
accacaggggaggaaugaugcc

SEQ ID NO: 259379 - RNA, 22 nt, Human
uguaauauuguagugacaguac

SEQ ID NO: 259380 - RNA, 22 nt, Human
uguuacucugggguugugguga

SEQ ID NO: 259381 - RNA, 22 nt, Human
ugggacaggaggccucuggaga

SEQ ID NO: 259382 - RNA, 22 nt, Human
ggcuccuggaaagcccucgcuc

SEQ ID NO: 259383 - RNA, 22 nt, Human
acucuggcuugaggaccagguc

SEQ ID NO: 259384 - RNA, 22 nt, Human
agcaaugauguuuucaaguagg

SEQ ID NO: 259385 - RNA, 22 nt, Human
gaggcaguggucugaugcaagg

SEQ ID NO: 259386 - RNA, 22 nt, Human
gaagagcauaugaagagcauau

SEQ ID NO: 259387 - RNA, 22 nt, Human
uuccuggcaaagugagcaucac

SEQ ID NO: 259388 - RNA, 22 nt, Human
uguccucacacguagggaguaa

SEQ ID NO: 259389 - RNA, 22 nt, Human
uucuuuucaagaggggcaagga

SEQ ID NO: 259390 - RNA, 22 nt, Human
ucaagcuggcuguugcuauuuc

SEQ ID NO: 259391 - RNA, 22 nt, Human
acacagugguguuuacaaaauu

SEQ ID NO: 259392 - RNA, 22 nt, Human
gaguuacauucauuguuacgcu

SEQ ID NO: 259393 - RNA, 20 nt, Human
gagugcuuuggcuugcucuc

SEQ ID NO: 259394 - RNA, 22 nt, Human
uugugcuccugugagaaucuag

SEQ ID NO: 259395 - RNA, 22 nt, Human
uccuguagcugucacugggggc

SEQ ID NO: 259396 - RNA, 22 nt, Human
ggcucacgcaauuaucccggcc

SEQ ID NO: 259397 - RNA, 22 nt, Human
cccugcugaaucccauggaguc

SEQ ID NO: 259398 - RNA, 22 nt, Human
uuuggaauuccauuucugcauu

SEQ ID NO: 259399 - RNA, 22 nt, Human
acaggcugauagaccauaaaua

SEQ ID NO: 259400 - RNA, 22 nt, Human
gguagaaauaaucuucaggcug

SEQ ID NO: 259401 - RNA, 22 nt, Human
cuucugugaagagcagaaccau

SEQ ID NO: 259402 - RNA, 22 nt, Human
uugagggucuggaucugcugcu

SEQ ID NO: 259403 - RNA, 22 nt, Human
caggauggucagaugcauuguc

SEQ ID NO: 259404 - RNA, 22 nt, Human
gcacagagagcagugggggaca

SEQ ID NO: 259405 - RNA, 21 nt, Human
gucuuuuaagugaagagaggc

SEQ ID NO: 259406 - RNA, 22 nt, Human
uaaaagcugagauauccuguac

SEQ ID NO: 259407 - RNA, 20 nt, Human
gccugagcuauugccaggau

SEQ ID NO: 259408 - RNA, 22 nt, Human
gugguccugcacccgcuuggcc

SEQ ID NO: 259409 - RNA, 22 nt, Human
cugaggcaugggaaguugggug

SEQ ID NO: 259410 - RNA, 18 nt, Human
ucugucuguacaaguauc

SEQ ID NO: 259411 - RNA, 22 nt, Human
acauguauugacauuauauucu

SEQ ID NO: 259412 - RNA, 22 nt, Human
cuggcagcgguuugcagccugg

SEQ ID NO: 259413 - RNA, 22 nt, Human
gaugaagucauuauccuuuugg

SEQ ID NO: 259414 - RNA, 22 nt, Human
uguuuugcuucucuguuuccca

SEQ ID NO: 259415 - RNA, 22 nt, Human
ccaggacaagccagagggacag

SEQ ID NO: 259416 - RNA, 22 nt, Human
uaacugccagcagcgaugaaca

SEQ ID NO: 259417 - RNA, 22 nt, Human
uaacaguaaaguaaguuagcuu

SEQ ID NO: 259418 - RNA, 22 nt, Human
aggaaagcaauggcugagaaca

SEQ ID NO: 259419 - RNA, 22 nt, Human
ccagagucaggagcucauguga

SEQ ID NO: 259420 - RNA, 22 nt, Human
agacagugcuaucccaucugug

SEQ ID NO: 259421 - RNA, 22 nt, Human
cccccucugccgggguccuuca

SEQ ID NO: 259422 - RNA, 22 nt, Human
ggagcuguugauuguuugagga

SEQ ID NO: 259423 - RNA, 22 nt, Human
caggcccucgcccgcagcgacc

SEQ ID NO: 259424 - RNA, 22 nt, Human
gaggcuuuauaacuauuuguuc

SEQ ID NO: 259425 - RNA, 22 nt, Human
uucugauugcugaugaggccca

SEQ ID NO: 259426 - RNA, 22 nt, Human
gaaaguaugccaucuaccucuu

SEQ ID NO: 259427 - RNA, 22 nt, Human
aaacugcaauuacuuuugcagc

SEQ ID NO: 259428 - RNA, 22 nt, Human
guccuucagcaccucccucggc

SEQ ID NO: 259429 - RNA, 22 nt, Human
ccugccugucccucaguccaca

SEQ ID NO: 259430 - RNA, 22 nt, Human
acagacagaggcuccaugagga

SEQ ID NO: 259431 - RNA, 22 nt, Human
cuccugagcucugaggaagcuu

SEQ ID NO: 259432 - RNA, 22 nt, Human
caccagcuucccaucgcggguc

SEQ ID NO: 259433 - RNA, 22 nt, Human
augguuuaagggagaauauuga

SEQ ID NO: 259434 - RNA, 22 nt, Human
ugcaauauuuuauauccaacaa

SEQ ID NO: 259435 - RNA, 19 nt, Human
aguagcagaaagugcagug

SEQ ID NO: 259436 - RNA, 22 nt, Human
aagaaucugacauaauuuccug

SEQ ID NO: 259437 - RNA, 22 nt, Human
uggaggcagucaaaugacugac

SEQ ID NO: 259438 - RNA, 22 nt, Human
uagaacuggcggcuagaccacu

SEQ ID NO: 259439 - RNA, 22 nt, Human
agguccaguuuucaguucucau

SEQ ID NO: 259440 - RNA, 22 nt, Human
uggcuuccccuaccuuccaauu

SEQ ID NO: 259441 - RNA, 22 nt, Human
caaagugcuggaauuacaggug

SEQ ID NO: 259442 - RNA, 19 nt, Human
uggcuucuggcaacagaug

SEQ ID NO: 259443 - RNA, 22 nt, Human
ucacagaaauaagauaguuauu

SEQ ID NO: 259444 - RNA, 22 nt, Human
gggcugagacgauggggucuuc

SEQ ID NO: 259445 - RNA, 22 nt, Human
gauacaguauuuaaagagcaac

SEQ ID NO: 259446 - RNA, 22 nt, Human
acagugugugcuuucccuuacg

SEQ ID NO: 259447 - RNA, 22 nt, Human
agguccagaggcuccuuauuac

SEQ ID NO: 259448 - RNA, 22 nt, Human
caggccagggagaauaugaagc

SEQ ID NO: 259449 - RNA, 22 nt, Human
acucugggcuuugauuuguuac

SEQ ID NO: 259450 - RNA, 22 nt, Human
cagcaggaagguuuccccugca

SEQ ID NO: 259451 - RNA, 22 nt, Human
ggcucugguggcaauugacugg

SEQ ID NO: 259452 - RNA, 22 nt, Human
gcugucuuccuugcuccaaggg

SEQ ID NO: 259453 - RNA, 22 nt, Human
cagaccagccauuugccucuuc

SEQ ID NO: 259454 - RNA, 22 nt, Human
cagaggcucaccagccuuucac

SEQ ID NO: 259455 - RNA, 20 nt, Human
guaaugaauguaaacaguaa

SEQ ID NO: 259456 - RNA, 22 nt, Human
gggcagguuauuggaguaggga

SEQ ID NO: 259457 - RNA, 22 nt, Human
cagggugugaacaguguaaaac

SEQ ID NO: 259458 - RNA, 22 nt, Human
acuuucuccagaaaaccaagga

SEQ ID NO: 259459 - RNA, 22 nt, Human
aaaaaugaauucuucaguggca

SEQ ID NO: 259460 - RNA, 22 nt, Human
ccugggcucaagcgaucuuguc

SEQ ID NO: 259461 - RNA, 22 nt, Human
agccauuuuccugaaauauaac

SEQ ID NO: 259462 - RNA, 22 nt, Human
gccuguuucuccuccuuggccc

SEQ ID NO: 259463 - RNA, 22 nt, Human
uuggcuucuggcagucuggacg

SEQ ID NO: 259464 - RNA, 22 nt, Human
cccaagccagacccugacccug

SEQ ID NO: 259465 - RNA, 22 nt, Human
uguaaaauaauucuccauguuu

SEQ ID NO: 259466 - RNA, 22 nt, Human
caacauaugauuuuguauauaa

SEQ ID NO: 259467 - RNA, 22 nt, Human
agauugaauauagagauucuug

SEQ ID NO: 259468 - RNA, 18 nt, Human
uuccauaauguauguaac

SEQ ID NO: 259469 - RNA, 22 nt, Human
cacugguagagagaagacaagg

SEQ ID NO: 259470 - RNA, 22 nt, Human
cuuucucuucgaaaaccugccc

SEQ ID NO: 259471 - RNA, 22 nt, Human
gacuuucucuccucccaggugu

SEQ ID NO: 259472 - RNA, 22 nt, Human
ugguggcaucacucagccuccc

SEQ ID NO: 259473 - RNA, 22 nt, Human
uaggacagaguucccugauggc

SEQ ID NO: 259474 - RNA, 22 nt, Human
auuagucuucucauuuggaucc

SEQ ID NO: 259475 - RNA, 22 nt, Human
aacuagaacgagaaagcugaac

SEQ ID NO: 259476 - RNA, 22 nt, Human
gaggacucugggcguguauggg

SEQ ID NO: 259477 - RNA, 22 nt, Human
aggacacagacugauugcagca

SEQ ID NO: 259478 - RNA, 22 nt, Human
ccugguuucaggaacauaaucu

SEQ ID NO: 259479 - RNA, 22 nt, Human
gaaggagaggauugugaggcug

SEQ ID NO: 259480 - RNA, 22 nt, Human
cugagaggcggagcuugcagug

SEQ ID NO: 259481 - RNA, 23 nt, Human
cucagcagccugcugcagauaag

SEQ ID NO: 259482 - RNA, 22 nt, Human
ccuggaagucauuccucguucc

SEQ ID NO: 259483 - RNA, 22 nt, Human
ucugcuucuccuacuucauggg

SEQ ID NO: 259484 - RNA, 22 nt, Human
uggaggcacuaaauggccacaa

SEQ ID NO: 259485 - RNA, 22 nt, Human
aaggccaggcagggagcuguga

SEQ ID NO: 259486 - RNA, 22 nt, Human
gugcauuuauauuugccuuugg

SEQ ID NO: 259487 - RNA, 19 nt, Human
aaggcugguaccauagguu

SEQ ID NO: 259488 - RNA, 22 nt, Human
ucaagaaggagacuccacugug

SEQ ID NO: 259489 - RNA, 22 nt, Human
gcuucaggcugaauuccuccua

SEQ ID NO: 259490 - RNA, 22 nt, Human
auuauuggacacuucuucugca

SEQ ID NO: 259491 - RNA, 19 nt, Human
ugcacacagauaaguaucu

SEQ ID NO: 259492 - RNA, 22 nt, Human
gcccuggaaucucuccauggga

SEQ ID NO: 259493 - RNA, 22 nt, Human
aaauucagcagugaaaugcccc

SEQ ID NO: 259494 - RNA, 22 nt, Human
cauggcagugauucagccuuug

SEQ ID NO: 259495 - RNA, 22 nt, Human
accucuggacacugcauccuuc

SEQ ID NO: 259496 - RNA, 22 nt, Human
cagagcauugagggucugccaa

SEQ ID NO: 259497 - RNA, 22 nt, Human
gugccagcucuccccacaucug

SEQ ID NO: 259498 - RNA, 22 nt, Human
cuugccaaugguacaaacgauu

SEQ ID NO: 259499 - RNA, 21 nt, Human
guauucuuuaugaagugaaaa

SEQ ID NO: 259500 - RNA, 22 nt, Human
uccaggaaugugugugggcuag

SEQ ID NO: 259501 - RNA, 22 nt, Human
gcccacauuuuuggcuuagagg

SEQ ID NO: 259502 - RNA, 22 nt, Human
uuuucaagagaguguucuaugu

SEQ ID NO: 259503 - RNA, 22 nt, Human
aaacugcaugaagcugauuuua

SEQ ID NO: 259504 - RNA, 22 nt, Human
uacacaugaucauuuaguagca

SEQ ID NO: 259505 - RNA, 22 nt, Human
cagcuccuaugaguaugauucc

SEQ ID NO: 259506 - RNA, 22 nt, Human
ugagucuuuagaauucuaacuu

SEQ ID NO: 259507 - RNA, 22 nt, Human
ggagacagugguagggccuaag

SEQ ID NO: 259508 - RNA, 21 nt, Human
uccuucucuaugauugucuga

SEQ ID NO: 259509 - RNA, 22 nt, Human
augacaagaguguucagggaga

SEQ ID NO: 259510 - RNA, 22 nt, Human
cagcagugcuucagugugagau

SEQ ID NO: 259511 - RNA, 22 nt, Human
acagggagugcaauucauauug

SEQ ID NO: 259512 - RNA, 22 nt, Human
uugcauuuuugagcacgaaguu

SEQ ID NO: 259513 - RNA, 22 nt, Human
aacagugcuguuauaaauguac

SEQ ID NO: 259514 - RNA, 22 nt, Human
cugagccacugcuuguucagug

SEQ ID NO: 259515 - RNA, 22 nt, Human
uucucuggauguuucucaguca

SEQ ID NO: 259516 - RNA, 22 nt, Human
acaacauucuuaaauacacuga

SEQ ID NO: 259517 - RNA, 22 nt, Human
ugacauuauuaucaugucacca

SEQ ID NO: 259518 - RNA, 22 nt, Human
ugcaggcaggggaugagcagcc

SEQ ID NO: 259519 - RNA, 22 nt, Human
ugggagcuccuggagggcagga

SEQ ID NO: 259520 - RNA, 22 nt, Human
uaguuaggaauagcagcgacuc

SEQ ID NO: 259521 - RNA, 22 nt, Human
gcaaguuuagcuaacuggccca

SEQ ID NO: 259522 - RNA, 18 nt, Human
gccugcaggcacgggggu

SEQ ID NO: 259523 - RNA, 22 nt, Human
uccugggaguaauugagucaug

SEQ ID NO: 259524 - RNA, 22 nt, Human
uuucaacaggaugauaauaggc

SEQ ID NO: 259525 - RNA, 22 nt, Human
cuggguuuagggucuccccuug

SEQ ID NO: 259526 - RNA, 22 nt, Human
ucacagaagguggccauagcug

SEQ ID NO: 259527 - RNA, 20 nt, Human
gggcagccucgggagugggu

SEQ ID NO: 259528 - RNA, 22 nt, Human
accagccugucugagucguggg

SEQ ID NO: 259529 - RNA, 22 nt, Human
cuacuucuaaguacauggugau

SEQ ID NO: 259530 - RNA, 22 nt, Human
uuucuuuguuguuaucacauca

SEQ ID NO: 259531 - RNA, 22 nt, Human
ggagcugaugacgucaccaugg

SEQ ID NO: 259532 - RNA, 22 nt, Human
uuguguccauuugagucaugug

SEQ ID NO: 259533 - RNA, 22 nt, Human
cagugacguaaacugcaugugc

SEQ ID NO: 259534 - RNA, 22 nt, Human
cccuccaggccugucauguucc

SEQ ID NO: 259535 - RNA, 22 nt, Human
uuccauauuguacucuuuggag

SEQ ID NO: 259536 - RNA, 22 nt, Human
uucagugucccuaguagaaguu

SEQ ID NO: 259537 - RNA, 22 nt, Human
uacuuaaaacugauagaaucuc

SEQ ID NO: 259538 - RNA, 22 nt, Human
gugugcucagcucauuuggaua

SEQ ID NO: 259539 - RNA, 19 nt, Human
auaaauaaaaagugggaga

SEQ ID NO: 259540 - RNA, 22 nt, Human
caagaaaugggauuugacugcc

SEQ ID NO: 259541 - RNA, 20 nt, Human
gcacugaaauucaauguuug

SEQ ID NO: 259542 - RNA, 22 nt, Human
gaaagcugaaccaggaaccaug

SEQ ID NO: 259543 - RNA, 22 nt, Human
aggagcagaccguaguccugca

SEQ ID NO: 259544 - RNA, 22 nt, Human
ccagcucugcagggccuggggu

SEQ ID NO: 259545 - RNA, 23 nt, Human
ugaauguuuauucucggugcaga

SEQ ID NO: 259546 - RNA, 22 nt, Human
augguuuauccuuuaccagucg

SEQ ID NO: 259547 - RNA, 22 nt, Human
agacagcugggaguguccuucu

SEQ ID NO: 259548 - RNA, 22 nt, Human
agguccuguccuuggucucuga

SEQ ID NO: 259549 - RNA, 22 nt, Human
aaggcugagacagcacaggucc

SEQ ID NO: 259550 - RNA, 22 nt, Human
guuuacaugcagaaaaucaaug

SEQ ID NO: 259551 - RNA, 22 nt, Human
ggagcccugcccuaggcagcuc

SEQ ID NO: 259552 - RNA, 22 nt, Human
ucacuuagauggggaucaucac

SEQ ID NO: 259553 - RNA, 22 nt, Human
ccugugggucacaugggugacu

SEQ ID NO: 259554 - RNA, 23 nt, Human
cuagaauuuugcuaaaagacuag

SEQ ID NO: 259555 - RNA, 22 nt, Human
auagaaccuguugugaaauuca

SEQ ID NO: 259556 - RNA, 22 nt, Human
gggcuucuggucauuccucauc

SEQ ID NO: 259557 - RNA, 22 nt, Human
acuuucaagcaagaacacuuug

SEQ ID NO: 259558 - RNA, 22 nt, Human
agauauauuuaagguaauaagu

SEQ ID NO: 259559 - RNA, 22 nt, Human
gagaggaagccuucuguacuug

SEQ ID NO: 259560 - RNA, 22 nt, Human
uggcugaggagagggcggaagu

SEQ ID NO: 259561 - RNA, 22 nt, Human
auaaggcagucccuuaacaagg

SEQ ID NO: 259562 - RNA, 22 nt, Human
aaguaguuaguccgccugcucu

SEQ ID NO: 259563 - RNA, 22 nt, Human
ugucucuggcugcagccuguuc

SEQ ID NO: 259564 - RNA, 22 nt, Human
uuuagggaagaagcccauggcc

SEQ ID NO: 259565 - RNA, 22 nt, Human
gucuccagccauucucugauca

SEQ ID NO: 259566 - RNA, 21 nt, Human
gcagcgcccucugaccuugau

SEQ ID NO: 259567 - RNA, 22 nt, Human
uccuggugaggcuagaaguguc

SEQ ID NO: 259568 - RNA, 22 nt, Human
gccucaugagggaucugcccuc

SEQ ID NO: 259569 - RNA, 19 nt, Human
ugcuuugccuugauuagcu

SEQ ID NO: 259570 - RNA, 22 nt, Human
gggaccugaggcccugcuccac

SEQ ID NO: 259571 - RNA, 22 nt, Human
gcagcaucaauccaugcuucuc

SEQ ID NO: 259572 - RNA, 22 nt, Human
ugcucuucaccauuacaucaug

SEQ ID NO: 259573 - RNA, 22 nt, Human
aaguccaugaucaagauguggc

SEQ ID NO: 259574 - RNA, 22 nt, Human
guuuauauucaacggaguaucu

SEQ ID NO: 259575 - RNA, 22 nt, Human
uaauaauuaguuauugaucgug

SEQ ID NO: 259576 - RNA, 22 nt, Human
ugcugggucaggcaucugcaga

SEQ ID NO: 259577 - RNA, 22 nt, Human
uaugaaggauacaccucugauu

SEQ ID NO: 259578 - RNA, 19 nt, Human
ccugggucugcagcauuca

SEQ ID NO: 259579 - RNA, 22 nt, Human
ggggaagaggcgugauggaucc

SEQ ID NO: 259580 - RNA, 22 nt, Human
ugaaguucaagggcuacauuug

SEQ ID NO: 259581 - RNA, 22 nt, Human
cuuaagaaauugcauucuaauc

SEQ ID NO: 259582 - RNA, 21 nt, Human
uaagcauaucagauagacucu

SEQ ID NO: 259583 - RNA, 22 nt, Human
guaaaauagaauaacguggcua

SEQ ID NO: 259584 - RNA, 22 nt, Human
ggcugcagguugguuggcagcu

SEQ ID NO: 259585 - RNA, 22 nt, Human
gauuuauaaagguugcacugga

SEQ ID NO: 259586 - RNA, 22 nt, Human
gaagagcuguagccugcucuuu

SEQ ID NO: 259587 - RNA, 22 nt, Human
aaaugucuguaggggcugcagg

SEQ ID NO: 259588 - RNA, 22 nt, Human
agcaccugcacaguggaggaaa

SEQ ID NO: 259589 - RNA, 23 nt, Human
aaaugacuaaauguucuuauaga

SEQ ID NO: 259590 - RNA, 22 nt, Human
ugcaguggaaagacucagacuu

SEQ ID NO: 259591 - RNA, 22 nt, Human
uuagagcuacggccuuuaaaaa

SEQ ID NO: 259592 - RNA, 18 nt, Human
agcugaggggacugaaga

SEQ ID NO: 259593 - RNA, 22 nt, Human
cagagaaagaagcccauucauu

SEQ ID NO: 259594 - RNA, 22 nt, Human
caguauacgacuaacgcaugac

SEQ ID NO: 259595 - RNA, 22 nt, Human
agcuaaugauacaugcuccaca

SEQ ID NO: 259596 - RNA, 17 nt, Human
accagccucuccugggg

SEQ ID NO: 259597 - RNA, 22 nt, Human
uugcagcuucgagucuaucugu

SEQ ID NO: 259598 - RNA, 22 nt, Human
uauauucaacaggcuaauguca

SEQ ID NO: 259599 - RNA, 22 nt, Human
cuuggccugggccgcagccacu

SEQ ID NO: 259600 - RNA, 22 nt, Human
guggcuucuggcugggccucag

SEQ ID NO: 259601 - RNA, 22 nt, Human
uugagaaaggggucaauaucuc

SEQ ID NO: 259602 - RNA, 22 nt, Human
guguguccaaggccacaauagc

SEQ ID NO: 259603 - RNA, 22 nt, Human
uaaugcaguacugauauaaaca

SEQ ID NO: 259604 - RNA, 22 nt, Human
aaaugugucaguuucauucucu

SEQ ID NO: 259605 - RNA, 22 nt, Human
agcagguuguuuuguggccagg

SEQ ID NO: 259606 - RNA, 22 nt, Human
auuugucucugcacuuuacuca

SEQ ID NO: 259607 - RNA, 22 nt, Human
aaaggagaaaacauacaggacu

SEQ ID NO: 259608 - RNA, 22 nt, Human
gaucaguaagugaauaaugagu

SEQ ID NO: 259609 - RNA, 22 nt, Human
uuccucagcuuuagacuaugaa

SEQ ID NO: 259610 - RNA, 22 nt, Human
aauuauauguuaaucuucaauu

SEQ ID NO: 259611 - RNA, 22 nt, Human
cuggcagguccagcuggacuca

SEQ ID NO: 259612 - RNA, 22 nt, Human
uauuggauagcuugugcagaau

SEQ ID NO: 259613 - RNA, 18 nt, Human
gcaggcuuuuccuggguc

SEQ ID NO: 259614 - RNA, 23 nt, Human
aaaaaaccauguaggcacucagu

SEQ ID NO: 259615 - RNA, 23 nt, Human
cacuccuguuucuaagccagcau

SEQ ID NO: 259616 - RNA, 22 nt, Human
agaggggcccgguucuccgucu

SEQ ID NO: 259617 - RNA, 22 nt, Human
aaacuaaggugcuguggacuga

SEQ ID NO: 259618 - RNA, 22 nt, Human
uuuccauguuggugaaaugagg

SEQ ID NO: 259619 - RNA, 22 nt, Human
cuccccuccuuaggucuucuag

SEQ ID NO: 259620 - RNA, 22 nt, Human
cucagccaugcaacaugcuggg

SEQ ID NO: 259621 - RNA, 22 nt, Human
uuaccuuuuaggcaagcaucuu

SEQ ID NO: 259622 - RNA, 22 nt, Human
ucaggagggcuaagacuguagc

SEQ ID NO: 259623 - RNA, 22 nt, Human
aguaggguguugcuauaacaag

SEQ ID NO: 259624 - RNA, 21 nt, Human
uauuuauuaauuuguaaggcu

SEQ ID NO: 259625 - RNA, 22 nt, Human
gagaugaugagauuuggaacuu

SEQ ID NO: 259626 - RNA, 22 nt, Human
uuacuugaaaaccaccaguauu

SEQ ID NO: 259627 - RNA, 22 nt, Human
uuaauaacauuguguaucaccc

SEQ ID NO: 259628 - RNA, 22 nt, Human
uaugcaaaucauuagauuuccu

SEQ ID NO: 259629 - RNA, 22 nt, Human
cuucacagccaacaugggcaca

SEQ ID NO: 259630 - RNA, 22 nt, Human
ucacauuuuuuacuggacuuaa

SEQ ID NO: 259631 - RNA, 22 nt, Human
aaacaagucacuuuaucuugaa

SEQ ID NO: 259632 - RNA, 22 nt, Human
cacauuccuuacauucauagag

SEQ ID NO: 259633 - RNA, 22 nt, Human
ucaggucuauacuaugagaggc

SEQ ID NO: 259634 - RNA, 22 nt, Human
aguuuacaaaguuucacuguuc

SEQ ID NO: 259635 - RNA, 23 nt, Human
acucagagaccccgggaagugac

SEQ ID NO: 259636 - RNA, 22 nt, Human
cugccagcucaccggcucagac

SEQ ID NO: 259637 - RNA, 22 nt, Human
ucccagcacuguaauucuuugg

SEQ ID NO: 259638 - RNA, 22 nt, Human
ugaggugguuacuguggugcuc

SEQ ID NO: 259639 - RNA, 22 nt, Human
aaggcagccagauccuuugggu

SEQ ID NO: 259640 - RNA, 22 nt, Human
uuccuucuucauuguguuacag

SEQ ID NO: 259641 - RNA, 22 nt, Human
cuguucaguaaccuauaaaaca

SEQ ID NO: 259642 - RNA, 22 nt, Human
ucuugacauuguuguuagcagg

SEQ ID NO: 259643 - RNA, 22 nt, Human
gcccagccccuggguggacgug

SEQ ID NO: 259644 - RNA, 22 nt, Human
ucuaucuggccccuuuuauaua

SEQ ID NO: 259645 - RNA, 22 nt, Human
uggcagcuacagacagagguga

SEQ ID NO: 259646 - RNA, 22 nt, Human
gggcugagcacauacugacagc

SEQ ID NO: 259647 - RNA, 21 nt, Human
gccugcagaccccaccaggcu

SEQ ID NO: 259648 - RNA, 20 nt, Human
uucagaaauaaggaaugagg

SEQ ID NO: 259649 - RNA, 22 nt, Human
uuuauaucuggaguugcuagga

SEQ ID NO: 259650 - RNA, 22 nt, Human
uucuucuuuaucucaguauccu

SEQ ID NO: 259651 - RNA, 22 nt, Human
caugaaauguuagaauuagaca

SEQ ID NO: 259652 - RNA, 22 nt, Human
auuuagcaccuccaucucaaca

SEQ ID NO: 259653 - RNA, 22 nt, Human
gacucugggcugagccagggcc

SEQ ID NO: 259654 - RNA, 22 nt, Human
uacagaccaguaguucucagcg

SEQ ID NO: 259655 - RNA, 22 nt, Human
uaagauguacuuuuguccucac

SEQ ID NO: 259656 - RNA, 22 nt, Human
ugaggccaggaucccaggcucu

SEQ ID NO: 259657 - RNA, 22 nt, Human
gggagguagcaagccugcagcu

SEQ ID NO: 259658 - RNA, 22 nt, Human
ccaacagguugagagucugaau

SEQ ID NO: 259659 - RNA, 22 nt, Human
uacuuuaaaaacugauaauuca

SEQ ID NO: 259660 - RNA, 22 nt, Human
gaaguauaugucuuuaaucuau

SEQ ID NO: 259661 - RNA, 22 nt, Human
cuuggcagagggcugggcucag

SEQ ID NO: 259662 - RNA, 22 nt, Human
uucagcaaaauaucucagauag

SEQ ID NO: 259663 - RNA, 22 nt, Human
uccuggcaggguggcagcgggu

SEQ ID NO: 259664 - RNA, 23 nt, Human
gcucaggcaucauucuuccuggc

SEQ ID NO: 259665 - RNA, 22 nt, Human
acuuccagcuagguucugcuaa

SEQ ID NO: 259666 - RNA, 22 nt, Human
ccuggccacagggcucugcauu

SEQ ID NO: 259667 - RNA, 20 nt, Human
uccugggguaagccaugguc

SEQ ID NO: 259668 - RNA, 22 nt, Human
caggagcucacugucuaauggg

SEQ ID NO: 259669 - RNA, 22 nt, Human
guuagugugacugaggaaugca

SEQ ID NO: 259670 - RNA, 22 nt, Human
aaacugguaauaaaauggauua

SEQ ID NO: 259671 - RNA, 22 nt, Human
gggaacuucagaaagucgcugc

SEQ ID NO: 259672 - RNA, 22 nt, Human
augaugaaacuaggaacuagag

SEQ ID NO: 259673 - RNA, 22 nt, Human
uacaagacgagggaaguucuuu

SEQ ID NO: 259674 - RNA, 22 nt, Human
ccugggaacagcagaguccugg

SEQ ID NO: 259675 - RNA, 22 nt, Human
ucacaucuugugauguuuucau

SEQ ID NO: 259676 - RNA, 22 nt, Human
uggcuggagucuggugcuagcc

SEQ ID NO: 259677 - RNA, 22 nt, Human
aggcagggcucauuucuuaggc

SEQ ID NO: 259678 - RNA, 22 nt, Human
ugaccaggauacugcagggaug

SEQ ID NO: 259679 - RNA, 22 nt, Human
gcuuuagagaagaaagguugcu

SEQ ID NO: 259680 - RNA, 22 nt, Human
gcuuuaaauggcuugcccaagu

SEQ ID NO: 259681 - RNA, 22 nt, Human
ccugggcaucucaugcaccugc

SEQ ID NO: 259682 - RNA, 22 nt, Human
uaacagaauuugcuaaacuccg

SEQ ID NO: 259683 - RNA, 22 nt, Human
uuggcuuccugcacuugaguuu

SEQ ID NO: 259684 - RNA, 22 nt, Human
ccuggcaggcaagaggaaggga

SEQ ID NO: 259685 - RNA, 22 nt, Human
caggaagauuagaccaagagcu

SEQ ID NO: 259686 - RNA, 22 nt, Human
cugccagggaggcugggaaguu

SEQ ID NO: 259687 - RNA, 22 nt, Human
aaauucuuucauggcuaauaag

SEQ ID NO: 259688 - RNA, 22 nt, Human
gcagggugugucucauacaguu

SEQ ID NO: 259689 - RNA, 21 nt, Human
agagaagggauuccaggcccu

SEQ ID NO: 259690 - RNA, 22 nt, Human
guuucuuuugugaucaccaacc

SEQ ID NO: 259691 - RNA, 22 nt, Human
caaauuaaugugucucaaaaua

SEQ ID NO: 259692 - RNA, 22 nt, Human
gaggagaagcuauuggaaggac

SEQ ID NO: 259693 - RNA, 22 nt, Human
acacaugaaucacugguggaag

SEQ ID NO: 259694 - RNA, 22 nt, Human
cagagacagaaaauggaucuag

SEQ ID NO: 259695 - RNA, 22 nt, Human
uugagaacuagcauggucuauc

SEQ ID NO: 259696 - RNA, 22 nt, Human
aaaauugguuccuuucugaggc

SEQ ID NO: 259697 - RNA, 22 nt, Human
agucuggugguauuuuguagug

SEQ ID NO: 259698 - RNA, 22 nt, Human
gcugugcagguccccacugccu

SEQ ID NO: 259699 - RNA, 23 nt, Human
guggccuccccggaaugccucgc

SEQ ID NO: 259700 - RNA, 22 nt, Human
aucuuuacaguguaagugcaga

SEQ ID NO: 259701 - RNA, 22 nt, Human
aaagcaaugggucuaagguaaa

SEQ ID NO: 259702 - RNA, 22 nt, Human
uccuggcucuaaguccugagug

SEQ ID NO: 259703 - RNA, 22 nt, Human
augcaacacauuugaugagcga

SEQ ID NO: 259704 - RNA, 22 nt, Human
acacaugaggaaggccucaccc

SEQ ID NO: 259705 - RNA, 22 nt, Human
uuacaguuacugguacuguuaa

SEQ ID NO: 259706 - RNA, 20 nt, Human
cagagccaggguuuuguuuu

SEQ ID NO: 259707 - RNA, 22 nt, Human
gcugcccuguuuagccaggguu

SEQ ID NO: 259708 - RNA, 22 nt, Human
cuuggccugcaggcagcagcgc

SEQ ID NO: 259709 - RNA, 22 nt, Human
gaugauuuuugccagugugaug

SEQ ID NO: 259710 - RNA, 22 nt, Human
acauggcaaaagggacuuuaca

SEQ ID NO: 259711 - RNA, 22 nt, Human
uacaguaaucuggacaugauuu

SEQ ID NO: 259712 - RNA, 22 nt, Human
guccugggagaugggacccuga

SEQ ID NO: 259713 - RNA, 22 nt, Human
ucugucuuuagaggccugugcu

SEQ ID NO: 259714 - RNA, 22 nt, Human
ucuggcagggguucugcacuug

SEQ ID NO: 259715 - RNA, 22 nt, Human
aacaaaguguacuuccauacug

SEQ ID NO: 259716 - RNA, 22 nt, Human
acccuggacuggggcugaggcu

SEQ ID NO: 259717 - RNA, 22 nt, Human
ugcaggagcagagauggcugga

SEQ ID NO: 259718 - RNA, 22 nt, Human
gcagggaaggggcaugcuggag

SEQ ID NO: 259719 - RNA, 22 nt, Human
caaaaugaugugauuuuauugu

SEQ ID NO: 259720 - RNA, 22 nt, Human
uuaauuagagcugauguucaua

SEQ ID NO: 259721 - RNA, 22 nt, Human
cuggagggcuggacuaaggaaa

SEQ ID NO: 259722 - RNA, 22 nt, Human
ugggaggaucgcuugagcccag

SEQ ID NO: 259723 - RNA, 22 nt, Human
cacaggaagcugacugcuggca

SEQ ID NO: 259724 - RNA, 22 nt, Human
uggcugccaauggcuuggaaag

SEQ ID NO: 259725 - RNA, 22 nt, Human
cuucaaguugggcggcgggcag

SEQ ID NO: 259726 - RNA, 22 nt, Human
cucaggcagugcccucuggccg

SEQ ID NO: 259727 - RNA, 22 nt, Human
caugcuaaaccagaacauagga

SEQ ID NO: 259728 - RNA, 22 nt, Human
uucagagauggaaggcagaaug

SEQ ID NO: 259729 - RNA, 22 nt, Human
guccagggaaauagcgacaggg

SEQ ID NO: 259730 - RNA, 22 nt, Human
gagauggagucuuuuucuguca

SEQ ID NO: 259731 - RNA, 22 nt, Human
aaggugaacugguaaugacaga

SEQ ID NO: 259732 - RNA, 22 nt, Human
uggcucuggagcuccugggccc

SEQ ID NO: 259733 - RNA, 22 nt, Human
cagagcccugcaugcuccaucu

SEQ ID NO: 259734 - RNA, 22 nt, Human
agcugcagcuacaguguugguu

SEQ ID NO: 259735 - RNA, 22 nt, Human
auugcuuuuccuuaacacaugc

SEQ ID NO: 259736 - RNA, 22 nt, Human
ccugaccuauuuuucucagcug

SEQ ID NO: 259737 - RNA, 22 nt, Human
ccauucugccaugcuucaucua

SEQ ID NO: 259738 - RNA, 22 nt, Human
cacaguuugguuuugcuguaau

SEQ ID NO: 259739 - RNA, 22 nt, Human
cccaaggcugcagugagcauga

SEQ ID NO: 259740 - RNA, 22 nt, Human
agcugagguugaagagugaacg

SEQ ID NO: 259741 - RNA, 22 nt, Human
auguaauuugcccucaaguuaa

SEQ ID NO: 259742 - RNA, 22 nt, Human
gcaggcagagguggaggagaca

SEQ ID NO: 259743 - RNA, 22 nt, Human
ccaggaagguguuuaacuagag

SEQ ID NO: 259744 - RNA, 22 nt, Human
cacugggagucguaagacacgg

SEQ ID NO: 259745 - RNA, 22 nt, Human
uuacuucuuuggccuucagcca

SEQ ID NO: 259746 - RNA, 22 nt, Human
uaguuuuauaauguuaacaucu

SEQ ID NO: 259747 - RNA, 22 nt, Human
cagcacccucggaggcugccgu

SEQ ID NO: 259748 - RNA, 22 nt, Human
uuagguaaguaggaucaaaaaa

SEQ ID NO: 259749 - RNA, 22 nt, Human
cugcacagcccucaagagccug

SEQ ID NO: 259750 - RNA, 22 nt, Human
guuguaaauacagcagauaauu

SEQ ID NO: 259751 - RNA, 22 nt, Human
agugauuagaaaguacacuugg

SEQ ID NO: 259752 - RNA, 22 nt, Human
uaguuacagagaaaugauuuga

SEQ ID NO: 259753 - RNA, 22 nt, Human
ucauuuaauugguuuugcucgu

SEQ ID NO: 259754 - RNA, 22 nt, Human
agagugggacacgggcgcuguc

SEQ ID NO: 259755 - RNA, 22 nt, Human
agaaaugaauauguagugguua

SEQ ID NO: 259756 - RNA, 22 nt, Human
ggugggaguggaacguggaaga

SEQ ID NO: 259757 - RNA, 22 nt, Human
acagaaauugggcaaauggaag

SEQ ID NO: 259758 - RNA, 17 nt, Human
uggcucugaggcugaau

SEQ ID NO: 259759 - RNA, 22 nt, Human
ugcaaggcccagacaagagcuc

SEQ ID NO: 259760 - RNA, 22 nt, Human
ggcccagcccgagucagccuuc

SEQ ID NO: 259761 - RNA, 22 nt, Human
cagcccagccgagggccuggcu

SEQ ID NO: 259762 - RNA, 23 nt, Human
auugccagacggccccugcucgc

SEQ ID NO: 259763 - RNA, 22 nt, Human
uccuucaaucacccagugggga

SEQ ID NO: 259764 - RNA, 22 nt, Human
gggcagcagagcccugccgagu

SEQ ID NO: 259765 - RNA, 22 nt, Human
uagcccucagcuuggagcgugg

SEQ ID NO: 259766 - RNA, 21 nt, Human
aaccagagccaggcucucagc

SEQ ID NO: 259767 - RNA, 22 nt, Human
ggcacacagcuuggcaggagau

SEQ ID NO: 259768 - RNA, 22 nt, Human
cacauuucugugagucaauauu

SEQ ID NO: 259769 - RNA, 22 nt, Human
ccccacccaccuaagagaaacu

SEQ ID NO: 259770 - RNA, 22 nt, Human
uguacacaauucuuaacauaca

SEQ ID NO: 259771 - RNA, 22 nt, Human
uggagcagcucuagcgggcgcc

SEQ ID NO: 259772 - RNA, 22 nt, Human
gggcuguguuaggugcgguuac

SEQ ID NO: 259773 - RNA, 22 nt, Human
ucuagaaaaacaaaguaucuga

SEQ ID NO: 259774 - RNA, 18 nt, Human
uaaaucucucuuuaguca

SEQ ID NO: 259775 - RNA, 22 nt, Human
acaggucugcaguaacugggaa

SEQ ID NO: 259776 - RNA, 22 nt, Human
cauguguguccaugugacuaag

SEQ ID NO: 259777 - RNA, 22 nt, Human
aucagcaggugcugguggagac

SEQ ID NO: 259778 - RNA, 16 nt, Human
uggcuucuuauuucua

SEQ ID NO: 259779 - RNA, 22 nt, Human
cugugaugacaggcagggccaa

SEQ ID NO: 259780 - RNA, 17 nt, Human
ucaggcugugccuggua

SEQ ID NO: 259781 - RNA, 22 nt, Human
uguggccuccuguuccugggua

SEQ ID NO: 259782 - RNA, 22 nt, Human
cuguggcacucaagaagccucc

SEQ ID NO: 259783 - RNA, 20 nt, Human
ucaagaugaggucauacugg

SEQ ID NO: 259784 - RNA, 22 nt, Human
aagugaaauugccauucuuaua

SEQ ID NO: 259785 - RNA, 20 nt, Human
gaggcugaaguguuuuugcu

SEQ ID NO: 259786 - RNA, 22 nt, Human
ucuauuuaccaaauguaguucc

SEQ ID NO: 259787 - RNA, 22 nt, Human
agaagccaccagcugaggaaga

SEQ ID NO: 259788 - RNA, 21 nt, Human
aagcuacagaaaauaauuuga

SEQ ID NO: 259789 - RNA, 22 nt, Human
gcugcaggaugaggcucugcuc

SEQ ID NO: 259790 - RNA, 22 nt, Human
agaaaguuaaacagugauaaga

SEQ ID NO: 259791 - RNA, 22 nt, Human
ccaggagcaggagcuggacaga

SEQ ID NO: 259792 - RNA, 22 nt, Human
ggaggcacuucaugcugacccg

SEQ ID NO: 259793 - RNA, 22 nt, Human
cuuagaacauucugccugggaa

SEQ ID NO: 259794 - RNA, 22 nt, Human
aggcccagagcaggaaaggguu

SEQ ID NO: 259795 - RNA, 22 nt, Human
uagaguguuuuguuaggcagca

SEQ ID NO: 259796 - RNA, 22 nt, Human
uugagacagugggguguugccg

SEQ ID NO: 259797 - RNA, 22 nt, Human
uugcuuuaccauuugaucucua

SEQ ID NO: 259798 - RNA, 17 nt, Human
uggcaagaauggaaaug

SEQ ID NO: 259799 - RNA, 23 nt, Human
guaaaauacgcagugcaguguga

SEQ ID NO: 259800 - RNA, 22 nt, Human
uuagaagcacuaauuacucaca

SEQ ID NO: 259801 - RNA, 20 nt, Human
gagcccaaguagggagaaau

SEQ ID NO: 259802 - RNA, 22 nt, Human
ugucaccucuuuggcugcagcu

SEQ ID NO: 259803 - RNA, 22 nt, Human
agcuccuccugugccaggccag

SEQ ID NO: 259804 - RNA, 22 nt, Human
cugcagagcaaguucucuguug

SEQ ID NO: 259805 - RNA, 22 nt, Human
ggugcauggaaagaguaaguaa

SEQ ID NO: 259806 - RNA, 22 nt, Human
agaugguguuuccccaggugga

SEQ ID NO: 259807 - RNA, 22 nt, Human
aauguauucuucaaccuugcua

SEQ ID NO: 259808 - RNA, 22 nt, Human
aacaacugaaaagcuuuuucug

SEQ ID NO: 259809 - RNA, 22 nt, Human
gcagggcucauucuaguacaau

SEQ ID NO: 259810 - RNA, 22 nt, Human
cuucucagaucucagcuuugag

SEQ ID NO: 259811 - RNA, 22 nt, Human
caucaagagucuuacuaucagu

SEQ ID NO: 259812 - RNA, 22 nt, Human
uucuagaagaacuagccaggaa

SEQ ID NO: 259813 - RNA, 22 nt, Human
gugugcagucugcuaggcaggg

SEQ ID NO: 259814 - RNA, 22 nt, Human
gggcugagcuguucugaguuua

SEQ ID NO: 259815 - RNA, 22 nt, Human
agccagggucucucgcucuguu

SEQ ID NO: 259816 - RNA, 22 nt, Human
cugagccagcgggcucacuuuu

SEQ ID NO: 259817 - RNA, 22 nt, Human
ugacaaaccaguagcaauaaag

SEQ ID NO: 259818 - RNA, 22 nt, Human
ugagcccugaccuagccuggcc

SEQ ID NO: 259819 - RNA, 22 nt, Human
augcacagacccaaaggccauc

SEQ ID NO: 259820 - RNA, 22 nt, Human
aggcucccaugguguggcagga

SEQ ID NO: 259821 - RNA, 19 nt, Human
agguccugaucagcaagga

SEQ ID NO: 259822 - RNA, 22 nt, Human
ugcaaauagccuauauuuauag

SEQ ID NO: 259823 - RNA, 22 nt, Human
uagcuuuaggaugguucucuug

SEQ ID NO: 259824 - RNA, 22 nt, Human
ugggcugcccugaugguccuca

SEQ ID NO: 259825 - RNA, 22 nt, Human
cagugucugggacagaaaguca

SEQ ID NO: 259826 - RNA, 22 nt, Human
uuuauguaaguggaaugaugcc

SEQ ID NO: 259827 - RNA, 18 nt, Human
ugagaggcuauuuuuugc

SEQ ID NO: 259828 - RNA, 22 nt, Human
agcugguccuuggcaguucuca

SEQ ID NO: 259829 - RNA, 22 nt, Human
gaaugugugacucuauugagca

SEQ ID NO: 259830 - RNA, 22 nt, Human
gcagcaggagaguuuguccugc

SEQ ID NO: 259831 - RNA, 22 nt, Human
cacuggucagcaugguagacca

SEQ ID NO: 259832 - RNA, 22 nt, Human
uaguaacagauuuauacagucu

SEQ ID NO: 259833 - RNA, 23 nt, Human
auugaugacuugauuacacuuuu

SEQ ID NO: 259834 - RNA, 22 nt, Human
auucucugucuuuuugaaaaca

SEQ ID NO: 259835 - RNA, 22 nt, Human
ucacaugucaagaagauaauuu

SEQ ID NO: 259836 - RNA, 22 nt, Human
caggcagugugacgcuaggguu

SEQ ID NO: 259837 - RNA, 22 nt, Human
aagcaacuaaggcaaggaaaug

SEQ ID NO: 259838 - RNA, 20 nt, Human
cagggccacgcuccaaggca

SEQ ID NO: 259839 - RNA, 22 nt, Human
gcucuuugcacagcucugcccu

SEQ ID NO: 259840 - RNA, 22 nt, Human
ugagguuauuuauuaugcauga

SEQ ID NO: 259841 - RNA, 22 nt, Human
uccugugacggagcgccagagg

SEQ ID NO: 259842 - RNA, 22 nt, Human
ccaggcagccaagugugugugu

SEQ ID NO: 259843 - RNA, 22 nt, Human
agaaguggucugucuuccagau

SEQ ID NO: 259844 - RNA, 22 nt, Human
cuacugaugcuauacuucucag

SEQ ID NO: 259845 - RNA, 22 nt, Human
uguuuucauuugauguaacaaa

SEQ ID NO: 259846 - RNA, 22 nt, Human
cauuuccugucuggaggucaaa

SEQ ID NO: 259847 - RNA, 17 nt, Human
ucucaggcacguguggc

SEQ ID NO: 259848 - RNA, 22 nt, Human
ugacaagaagaccugguaauga

SEQ ID NO: 259849 - RNA, 22 nt, Human
ccuccugggcuccugucugcac

SEQ ID NO: 259850 - RNA, 22 nt, Human
ugaggccagggauuccaucauu

SEQ ID NO: 259851 - RNA, 19 nt, Human
guggagcuaagaaaaggaa

SEQ ID NO: 259852 - RNA, 23 nt, Human
aucuccugagaacccacaguggu

SEQ ID NO: 259853 - RNA, 22 nt, Human
uuuuagauugggaaauguaaag

SEQ ID NO: 259854 - RNA, 22 nt, Human
cuguaacucugccaagaaggcu

SEQ ID NO: 259855 - RNA, 22 nt, Human
ugggccaccugcucuguuucua

SEQ ID NO: 259856 - RNA, 22 nt, Human
acagucuuugcaggagaaagga

SEQ ID NO: 259857 - RNA, 22 nt, Human
agaugaguacagagcuguacuc

SEQ ID NO: 259858 - RNA, 22 nt, Human
agcaggcagcaugggacccucc

SEQ ID NO: 259859 - RNA, 22 nt, Human
uauugcuguucuuuaaaugaag

SEQ ID NO: 259860 - RNA, 22 nt, Human
cccaggcuucccaaucagaagg

SEQ ID NO: 259861 - RNA, 22 nt, Human
auaaaagucugcuuauuugggc

SEQ ID NO: 259862 - RNA, 22 nt, Human
acuccaguucucuuguuuauaa

SEQ ID NO: 259863 - RNA, 22 nt, Human
aaaugguaagacaacacauuau

SEQ ID NO: 259864 - RNA, 22 nt, Human
gcugcccaggguggagccggcu

SEQ ID NO: 259865 - RNA, 22 nt, Human
ucagaaguaggagacauucuug

SEQ ID NO: 259866 - RNA, 22 nt, Human
ugcccucagccaccuccaaguu

SEQ ID NO: 259867 - RNA, 22 nt, Human
uugcuuuacggcaaggccccag

SEQ ID NO: 259868 - RNA, 22 nt, Human
ccaggcccaggguacugaccaa

SEQ ID NO: 259869 - RNA, 22 nt, Human
agacacaguacuugcccucaug

SEQ ID NO: 259870 - RNA, 22 nt, Human
cuggcucugggcuaagcuccca

SEQ ID NO: 259871 - RNA, 22 nt, Human
uuagaacaucucucuucugcca

SEQ ID NO: 259872 - RNA, 22 nt, Human
ugcagggacaggcucuggggau

SEQ ID NO: 259873 - RNA, 22 nt, Human
uccagcccagcuccucucagaa

SEQ ID NO: 259874 - RNA, 22 nt, Human
uaaauacuuaguuuugugucua

SEQ ID NO: 259875 - RNA, 22 nt, Human
agcagggcugugcuccuuccga

SEQ ID NO: 259876 - RNA, 22 nt, Human
ucuggcccugcugcugugagca

SEQ ID NO: 259877 - RNA, 22 nt, Human
caggggcugagaaggaacgucc

SEQ ID NO: 259878 - RNA, 22 nt, Human
uuggaggauugcucucagccca

SEQ ID NO: 259879 - RNA, 19 nt, Human
uauauuuguugaauaaaaa

SEQ ID NO: 259880 - RNA, 22 nt, Human
ucaguucugcuagaaaaacagu

SEQ ID NO: 259881 - RNA, 22 nt, Human
ugucaguuaaaugagguacaag

SEQ ID NO: 259882 - RNA, 17 nt, Human
cuaaauacuugcguuuc

SEQ ID NO: 259883 - RNA, 22 nt, Human
ugaggcuuggaggcuccagugg

SEQ ID NO: 259884 - RNA, 22 nt, Human
uuuugcugggguggcuagcuua

SEQ ID NO: 259885 - RNA, 22 nt, Human
aggcuccacggcaggaugcugu

SEQ ID NO: 259886 - RNA, 22 nt, Human
gaaaauacaaauagccuugaaa

SEQ ID NO: 259887 - RNA, 23 nt, Human
agccaucauccugcugcuggggc

SEQ ID NO: 259888 - RNA, 22 nt, Human
agcaacaggguggucuucagaa

SEQ ID NO: 259889 - RNA, 22 nt, Human
ucagcagggagaggagaaugca

SEQ ID NO: 259890 - RNA, 22 nt, Human
uguuagcagagcagcugacaga

SEQ ID NO: 259891 - RNA, 22 nt, Human
ggcaggugaggcaugugccugg

SEQ ID NO: 259892 - RNA, 22 nt, Human
caggcucuuuugguggcaagga

SEQ ID NO: 259893 - RNA, 22 nt, Human
guaacauuauucaugagauaca

SEQ ID NO: 259894 - RNA, 22 nt, Human
ggccaguccccuaauccagggc

SEQ ID NO: 259895 - RNA, 22 nt, Human
cagccaggacucccauuuagga

SEQ ID NO: 259896 - RNA, 22 nt, Human
gccuggagcucaugugggcauu

SEQ ID NO: 259897 - RNA, 22 nt, Human
cagcaacuggucauugcucucc

SEQ ID NO: 259898 - RNA, 22 nt, Human
ugccuacuaguacuauuuugug

SEQ ID NO: 259899 - RNA, 22 nt, Human
guacaugugcacaacaugcaug

SEQ ID NO: 259900 - RNA, 22 nt, Human
aaauauuauugcuuaaggggag

SEQ ID NO: 259901 - RNA, 22 nt, Human
ccagugucuagcagaugacagg

SEQ ID NO: 259902 - RNA, 22 nt, Human
caugaagcuugaagcaguccac

SEQ ID NO: 259903 - RNA, 22 nt, Human
uuccaggacuucauggcucuga

SEQ ID NO: 259904 - RNA, 22 nt, Human
aaaagacaucuauuucaggcag

SEQ ID NO: 259905 - RNA, 22 nt, Human
acucucugggcaugccccacca

SEQ ID NO: 259906 - RNA, 22 nt, Human
ucacaacucuuuccauuuaaua

SEQ ID NO: 259907 - RNA, 22 nt, Human
gucugggcuucagaguuagaga

SEQ ID NO: 259908 - RNA, 22 nt, Human
cacagguguucuugcagugaaa

SEQ ID NO: 259909 - RNA, 22 nt, Human
gaggcagcuuaggguacugacu

SEQ ID NO: 259910 - RNA, 22 nt, Human
ccucaguuuucucaucuguaaa

SEQ ID NO: 259911 - RNA, 22 nt, Human
aguaggcauuuaauaaacauga

SEQ ID NO: 259912 - RNA, 22 nt, Human
agaccuggguucgaguccuaac

SEQ ID NO: 259913 - RNA, 22 nt, Human
uuucaugugcaauuagcaauau

SEQ ID NO: 259914 - RNA, 22 nt, Human
cagagccagcuguccuuggcau

SEQ ID NO: 259915 - RNA, 22 nt, Human
aacaagaagagagggacguaau

SEQ ID NO: 259916 - RNA, 22 nt, Human
aaauacagauucugacucagag

SEQ ID NO: 259917 - RNA, 22 nt, Human
ugggcagggaucucuuuugcaa

SEQ ID NO: 259918 - RNA, 22 nt, Human
ugcugccaaaugcgagcucugu

SEQ ID NO: 259919 - RNA, 22 nt, Human
cagggugacugcccuggccacu

SEQ ID NO: 259920 - RNA, 22 nt, Human
gccaggcccugggcacuucgug

SEQ ID NO: 259921 - RNA, 22 nt, Human
guccaugauucugugacacccu

SEQ ID NO: 259922 - RNA, 22 nt, Human
agagggaucacccuguuucugg

SEQ ID NO: 259923 - RNA, 22 nt, Human
uuccugagggccccagaggagg

SEQ ID NO: 259924 - RNA, 22 nt, Human
agggaauggaugauggcagguu

SEQ ID NO: 259925 - RNA, 22 nt, Human
ucaucagagcucccccaaacgu

SEQ ID NO: 259926 - RNA, 22 nt, Human
uaugugucucaguugugauuga

SEQ ID NO: 259927 - RNA, 22 nt, Human
gcagcagaguuugggagauggu

SEQ ID NO: 259928 - RNA, 22 nt, Human
caagcugggugcgggcaguaua

SEQ ID NO: 259929 - RNA, 22 nt, Human
guucucugccacuuaccagcua

SEQ ID NO: 259930 - RNA, 22 nt, Human
uuguagaacaugcagcacaaug

SEQ ID NO: 259931 - RNA, 22 nt, Human
ucuccaggaaccaucaugguaa

SEQ ID NO: 259932 - RNA, 22 nt, Human
ucaggcugcagcugucagcagc

SEQ ID NO: 259933 - RNA, 22 nt, Human
cuggcaggaucuaaccagggaa

SEQ ID NO: 259934 - RNA, 22 nt, Human
uuggaauuuuccagguacagug

SEQ ID NO: 259935 - RNA, 22 nt, Human
caccucuuugauuugaggcaag

SEQ ID NO: 259936 - RNA, 22 nt, Human
gcaagcagacauucagguaggu

SEQ ID NO: 259937 - RNA, 22 nt, Human
ucaggacacccugugcuuccuu

SEQ ID NO: 259938 - RNA, 22 nt, Human
gagcaacacgcaguaguauacg

SEQ ID NO: 259939 - RNA, 22 nt, Human
ugccucugugggcagagcugcc

SEQ ID NO: 259940 - RNA, 22 nt, Human
auuaucuauguagaaugauuuu

SEQ ID NO: 259941 - RNA, 22 nt, Human
gucaauauagguuucaaacaug

SEQ ID NO: 259942 - RNA, 22 nt, Human
uuuaagaucauuuguauuaucc

SEQ ID NO: 259943 - RNA, 22 nt, Human
ugcaaacagccuugaaagaggg

SEQ ID NO: 259944 - RNA, 22 nt, Human
uagggauggaaacuaggaaucu

SEQ ID NO: 259945 - RNA, 22 nt, Human
aauugcuuagagaauccaggua

SEQ ID NO: 259946 - RNA, 22 nt, Human
ugaggcacauccaggccagcuc

SEQ ID NO: 259947 - RNA, 22 nt, Human
acuucaaauuuucagaagaaau

SEQ ID NO: 259948 - RNA, 22 nt, Human
aggaagaaaccuacuagaguuu

SEQ ID NO: 259949 - RNA, 22 nt, Human
caggaagccuuccuugucugcu

SEQ ID NO: 259950 - RNA, 22 nt, Human
ugaacaaauggaaauaaccagu

SEQ ID NO: 259951 - RNA, 22 nt, Human
ucagugcauucuaccaaaaggc

SEQ ID NO: 259952 - RNA, 22 nt, Human
cugugggagaaguugcuggagu

SEQ ID NO: 259953 - RNA, 22 nt, Human
gaagcuuugucuugucuccugg

SEQ ID NO: 259954 - RNA, 22 nt, Human
gcuggagaccucagagaaccca

SEQ ID NO: 259955 - RNA, 22 nt, Human
acagggcaaccucugggagacu

SEQ ID NO: 259956 - RNA, 22 nt, Human
gucugugguagacaggaaggca

SEQ ID NO: 259957 - RNA, 22 nt, Human
ucugggucacugugggagggca

SEQ ID NO: 259958 - RNA, 22 nt, Human
agcugcagagaaaagaggcugg

SEQ ID NO: 259959 - RNA, 22 nt, Human
ggccuuaggcucaacaggcaga

SEQ ID NO: 259960 - RNA, 22 nt, Human
gcagggcuuagaaaugguggcu

SEQ ID NO: 259961 - RNA, 22 nt, Human
ucccagaguucaaugggaaggu

SEQ ID NO: 259962 - RNA, 22 nt, Human
ucagagaguuuucacuagggug

SEQ ID NO: 259963 - RNA, 22 nt, Human
ggcaugcucuuuguccacagua

SEQ ID NO: 259964 - RNA, 22 nt, Human
auucuacaaucauguagauccu

SEQ ID NO: 259965 - RNA, 23 nt, Human
acccugggcaagucaccuaaccu

SEQ ID NO: 259966 - RNA, 22 nt, Human
ccaggaggaugguuguuaggug

SEQ ID NO: 259967 - RNA, 22 nt, Human
acucuugucucaacuuuuguau

SEQ ID NO: 259968 - RNA, 22 nt, Human
cuguuuacuuauugguaaagag

SEQ ID NO: 259969 - RNA, 22 nt, Human
cucuuauuuuauggcauuugug

SEQ ID NO: 259970 - RNA, 22 nt, Human
acugggcuuauuucuugugaac

SEQ ID NO: 259971 - RNA, 22 nt, Human
gagcucagcacuaaaaucaugu

SEQ ID NO: 259972 - RNA, 22 nt, Human
gcugggcuccaggccaggguga

SEQ ID NO: 259973 - RNA, 22 nt, Human
uacaggcauguagcauggugau

SEQ ID NO: 259974 - RNA, 22 nt, Human
acaugagaagcugcaacaugac

SEQ ID NO: 259975 - RNA, 22 nt, Human
uuguuacagcacuuaaccuuuu

SEQ ID NO: 259976 - RNA, 22 nt, Human
auguccagggggcuugacuggu

SEQ ID NO: 259977 - RNA, 22 nt, Human
ucagaagaaagauguuauuacu

SEQ ID NO: 259978 - RNA, 22 nt, Human
cuuucuagaguauggagucugu

SEQ ID NO: 259979 - RNA, 22 nt, Human
aggcaguuuauccccagagccu

SEQ ID NO: 259980 - RNA, 23 nt, Human
cagcucagaguguguccuguuuc

SEQ ID NO: 259981 - RNA, 22 nt, Human
ccagagagaaauggauuugagu

SEQ ID NO: 259982 - RNA, 22 nt, Human
ucacauucuagaauguuaucgu

SEQ ID NO: 259983 - RNA, 22 nt, Human
uggaaugaauuuggcuuccucc

SEQ ID NO: 259984 - RNA, 22 nt, Human
agggcacagccuaaagccuaug

SEQ ID NO: 259985 - RNA, 22 nt, Human
agaaaucauucccaaacccaua

SEQ ID NO: 259986 - RNA, 22 nt, Human
agccuugagcaguucacuuggu

SEQ ID NO: 259987 - RNA, 22 nt, Human
uggaaaauuaguagugaaaggc

SEQ ID NO: 259988 - RNA, 22 nt, Human
uuaaacagacaguaaaugaaac

SEQ ID NO: 259989 - RNA, 22 nt, Human
aaauucaaugaucacuggcuca

SEQ ID NO: 259990 - RNA, 22 nt, Human
uaagaaacuuaacugggaacua

SEQ ID NO: 259991 - RNA, 20 nt, Human
acacaaagcaauggaguaca

SEQ ID NO: 259992 - RNA, 22 nt, Human
uuggagaauguuuuccugcagu

SEQ ID NO: 259993 - RNA, 22 nt, Human
ucagagagcagaacuuuuuuac

SEQ ID NO: 259994 - RNA, 22 nt, Human
ugaguugcuaucuagauccaga

SEQ ID NO: 259995 - RNA, 22 nt, Human
uuggcugaccagaaccugcccc

SEQ ID NO: 259996 - RNA, 22 nt, Human
caugcaggugaccagguguggg

SEQ ID NO: 259997 - RNA, 22 nt, Human
accagaggcaguuucggcuggu

SEQ ID NO: 259998 - RNA, 22 nt, Human
ucccugcagacguccugcgggu

SEQ ID NO: 259999 - RNA, 19 nt, Human
ugcagccacgugagagacu

SEQ ID NO: 260000 - RNA, 22 nt, Human
gucugagggguuucccaggaca

SEQ ID NO: 260001 - RNA, 22 nt, Human
gggaggcacgaggcgcgcagug

SEQ ID NO: 260002 - RNA, 22 nt, Human
gcccuccauggugauccaggcc

SEQ ID NO: 260003 - RNA, 22 nt, Human
ucagcuuucucagaggccuaac

SEQ ID NO: 260004 - RNA, 21 nt, Human
acagacaguccagagaaaaga

SEQ ID NO: 260005 - RNA, 22 nt, Human
caguaaaagauggaaauagaau

SEQ ID NO: 260006 - RNA, 22 nt, Human
uaaugcacauagaaguacuuag

SEQ ID NO: 260007 - RNA, 22 nt, Human
cagagaggauggauuccauagc

SEQ ID NO: 260008 - RNA, 22 nt, Human
cucaaggacuuauucaugccug

SEQ ID NO: 260009 - RNA, 22 nt, Human
cagcaucucugggagaagcauc

SEQ ID NO: 260010 - RNA, 22 nt, Human
ugcaggagacauaauagggacu

SEQ ID NO: 260011 - RNA, 22 nt, Human
uauagaagagacaugugcauag

SEQ ID NO: 260012 - RNA, 22 nt, Human
gcacagacucaccuuaauuuga

SEQ ID NO: 260013 - RNA, 22 nt, Human
agcuuucucucagccaggcugc

SEQ ID NO: 260014 - RNA, 22 nt, Human
gccuguggguuggagcuuggcc

SEQ ID NO: 260015 - RNA, 22 nt, Human
auugcuggaugagcucuuggau

SEQ ID NO: 260016 - RNA, 22 nt, Human
ccaggccuucugaggacacucu

SEQ ID NO: 260017 - RNA, 22 nt, Human
ccaggcuuuucucauggaguca

SEQ ID NO: 260018 - RNA, 20 nt, Human
aggugcaaggcauggcaugu

SEQ ID NO: 260019 - RNA, 22 nt, Human
uuaguguguuauauaccaagcu

SEQ ID NO: 260020 - RNA, 22 nt, Human
uuuuggaaucugggaaaacagu

SEQ ID NO: 260021 - RNA, 22 nt, Human
ugaagcaaacgcuucuguuccu

SEQ ID NO: 260022 - RNA, 22 nt, Human
gagcaacaggugauggggcugu

SEQ ID NO: 260023 - RNA, 22 nt, Human
aucagcagugaguggcuuucau

SEQ ID NO: 260024 - RNA, 22 nt, Human
uauggcuucugcuuucuugacu

SEQ ID NO: 260025 - RNA, 22 nt, Human
ggcugguguugagugccuguag

SEQ ID NO: 260026 - RNA, 22 nt, Human
uccugggagaguuugauucauu

SEQ ID NO: 260027 - RNA, 22 nt, Human
cugaggucuauuuugaaacugc

SEQ ID NO: 260028 - RNA, 22 nt, Human
ugcacagagggaggcauaaaau

SEQ ID NO: 260029 - RNA, 22 nt, Human
caggcuccauuaaucauccugc

SEQ ID NO: 260030 - RNA, 22 nt, Human
gaaggcugccaguggcccucuu

SEQ ID NO: 260031 - RNA, 22 nt, Human
ccuggggaccugccucagcccu

SEQ ID NO: 260032 - RNA, 22 nt, Human
uggcuacaaguguguuuaguuu

SEQ ID NO: 260033 - RNA, 22 nt, Human
augcaggguucugggcuagaga

SEQ ID NO: 260034 - RNA, 21 nt, Human
acaggagaccgccuggcaguc

SEQ ID NO: 260035 - RNA, 22 nt, Human
cagcugcucuucuggccuguca

SEQ ID NO: 260036 - RNA, 22 nt, Human
cagguucccuugcagcuaagug

SEQ ID NO: 260037 - RNA, 22 nt, Human
uuaugaaagacauuucuguugg

SEQ ID NO: 260038 - RNA, 20 nt, Human
accauaauguuaauuacaaa

SEQ ID NO: 260039 - RNA, 22 nt, Human
accuacaucaagggagugguag

SEQ ID NO: 260040 - RNA, 22 nt, Human
caccagcugcaacaccaucucc

SEQ ID NO: 260041 - RNA, 22 nt, Human
caggguggcacucagcgcaucu

SEQ ID NO: 260042 - RNA, 22 nt, Human
ugguccagugacagauaggcac

SEQ ID NO: 260043 - RNA, 22 nt, Human
gaguuacacagaagucaguuug

SEQ ID NO: 260044 - RNA, 22 nt, Human
acucuguagccuguaagagagc

SEQ ID NO: 260045 - RNA, 22 nt, Human
uuuguuacauuaaaaaguaggu

SEQ ID NO: 260046 - RNA, 22 nt, Human
cagguucuggggcuccacugug

SEQ ID NO: 260047 - RNA, 22 nt, Human
gucuagaauggaugagcauuuu

SEQ ID NO: 260048 - RNA, 22 nt, Human
augcagggaccuuugcuuuggu

SEQ ID NO: 260049 - RNA, 22 nt, Human
agauuuacaaaggauuugcuuu

SEQ ID NO: 260050 - RNA, 22 nt, Human
uccugcagacauuuacaccuuu

SEQ ID NO: 260051 - RNA, 22 nt, Human
gccuccccaaagugcugacagc

SEQ ID NO: 260052 - RNA, 22 nt, Human
uuuacaugaguagcagauguuc

SEQ ID NO: 260053 - RNA, 22 nt, Human
agaguggcagcaaaaagugugc

SEQ ID NO: 260054 - RNA, 22 nt, Human
cugcagggaccacaagcagguu

SEQ ID NO: 260055 - RNA, 23 nt, Human
aguuccagaaaaaugcucaagca

SEQ ID NO: 260056 - RNA, 22 nt, Human
guuauaaaugacugcaaaaguu

SEQ ID NO: 260057 - RNA, 22 nt, Human
auguaguguagagauuagucuc

SEQ ID NO: 260058 - RNA, 22 nt, Human
uuagcacuggauuaaucaaagu

SEQ ID NO: 260059 - RNA, 19 nt, Human
auacacuaauauaaaccac

SEQ ID NO: 260060 - RNA, 22 nt, Human
gaggccaggaagcccaagauca

SEQ ID NO: 260061 - RNA, 22 nt, Human
cccagaggaggaucucggcccg

SEQ ID NO: 260062 - RNA, 21 nt, Human
uguuucaugcuauuuucuugu

SEQ ID NO: 260063 - RNA, 19 nt, Human
agaaguuagacauugcaau

SEQ ID NO: 260064 - RNA, 22 nt, Human
caaugacauggauaaucauauu

SEQ ID NO: 260065 - RNA, 22 nt, Human
cugucagguuucccggcucacg

SEQ ID NO: 260066 - RNA, 22 nt, Human
agacuucuuugugagcauuuuc

SEQ ID NO: 260067 - RNA, 22 nt, Human
cucugggucuaccuguggccag

SEQ ID NO: 260068 - RNA, 22 nt, Human
uugugugguagcuucauugaac

SEQ ID NO: 260069 - RNA, 22 nt, Human
uucaucuggaauuuauguuaua

SEQ ID NO: 260070 - RNA, 22 nt, Human
caauguguguguuuuucucaac

SEQ ID NO: 260071 - RNA, 22 nt, Human
uuugguaaaugcagguucuucu

SEQ ID NO: 260072 - RNA, 22 nt, Human
acaacaaggcuuuucauucaua

SEQ ID NO: 260073 - RNA, 22 nt, Human
aauggcaaaaggauaacaagga

SEQ ID NO: 260074 - RNA, 22 nt, Human
gcuccugugaaggcauuaggug

SEQ ID NO: 260075 - RNA, 22 nt, Human
uguggagguuuaaguaauggga

SEQ ID NO: 260076 - RNA, 20 nt, Human
uucucuggauagccagaugu

SEQ ID NO: 260077 - RNA, 22 nt, Human
cauucauuuaugaaauaucuau

SEQ ID NO: 260078 - RNA, 22 nt, Human
cugaggagaaaugggaugguuc

SEQ ID NO: 260079 - RNA, 22 nt, Human
cauuuguugguugcugucuuau

SEQ ID NO: 260080 - RNA, 22 nt, Human
augcaaauuaacauauaguaga

SEQ ID NO: 260081 - RNA, 22 nt, Human
auucagagcacuggguagaauu

SEQ ID NO: 260082 - RNA, 22 nt, Human
ugccuguccugaggaugagggu

SEQ ID NO: 260083 - RNA, 22 nt, Human
gcaggcaggagcccaacugccu

SEQ ID NO: 260084 - RNA, 22 nt, Human
uggcccaagucugcuagaagag

SEQ ID NO: 260085 - RNA, 19 nt, Human
uuuuguguagcugcugguu

SEQ ID NO: 260086 - RNA, 22 nt, Human
cccaaguuaaaauucagugcuc

SEQ ID NO: 260087 - RNA, 22 nt, Human
cagauagaaugcaagaccucuc

SEQ ID NO: 260088 - RNA, 22 nt, Human
gagaacuucaggauuauucaag

SEQ ID NO: 260089 - RNA, 22 nt, Human
auacacauauauacacguuuaa

SEQ ID NO: 260090 - RNA, 22 nt, Human
cugugucccacacgagguguau

SEQ ID NO: 260091 - RNA, 22 nt, Human
acagggcucugacaccaaggua

SEQ ID NO: 260092 - RNA, 22 nt, Human
auuuuacuuugugaauauugac

SEQ ID NO: 260093 - RNA, 22 nt, Human
cuaaauaaucccucuggucuua

SEQ ID NO: 260094 - RNA, 22 nt, Human
agccuucauaaucuugggcuuu

SEQ ID NO: 260095 - RNA, 22 nt, Human
uuucaugccucuugagaaagau

SEQ ID NO: 260096 - RNA, 22 nt, Human
gacacuuuauuaagcuguuguu

SEQ ID NO: 260097 - RNA, 22 nt, Human
caaauaucuuuggcaaagagaa

SEQ ID NO: 260098 - RNA, 22 nt, Human
uagcuuuaggcacguuugaauu

SEQ ID NO: 260099 - RNA, 22 nt, Human
uauuaggguaaauuugacaugc

SEQ ID NO: 260100 - RNA, 22 nt, Human
agcccagggaaccaggaagugg

SEQ ID NO: 260101 - RNA, 22 nt, Human
cugccugugauuuuucucuagu

SEQ ID NO: 260102 - RNA, 22 nt, Human
ugacagaacagguugggagcaa

SEQ ID NO: 260103 - RNA, 22 nt, Human
acccaggcugcuucucaguggc

SEQ ID NO: 260104 - RNA, 22 nt, Human
gaagccaguacugugcucugca

SEQ ID NO: 260105 - RNA, 22 nt, Human
uuccagaauugggagccuugag

SEQ ID NO: 260106 - RNA, 22 nt, Human
auuucaggguaaaaaguguuca

SEQ ID NO: 260107 - RNA, 22 nt, Human
caaggaaguuuuaggagaggaa

SEQ ID NO: 260108 - RNA, 22 nt, Human
agagucuuggcauucaugcguu

SEQ ID NO: 260109 - RNA, 22 nt, Human
uccagcccgacugggccugccg

SEQ ID NO: 260110 - RNA, 22 nt, Human
cugaucuuaaguaacauuauuu

SEQ ID NO: 260111 - RNA, 22 nt, Human
uauuggucuuggaagguuuugu

SEQ ID NO: 260112 - RNA, 22 nt, Human
gagcugaacaaauugcgagugg

SEQ ID NO: 260113 - RNA, 22 nt, Human
guccugugggcccaccaugagc

SEQ ID NO: 260114 - RNA, 22 nt, Human
uaaauuauguuccauguccuuu

SEQ ID NO: 260115 - RNA, 22 nt, Human
aguguauuaaugcuccaggagu

SEQ ID NO: 260116 - RNA, 22 nt, Human
aguggcagccgagcaggagaug

SEQ ID NO: 260117 - RNA, 22 nt, Human
auuguuuacacuaacuucauaa

SEQ ID NO: 260118 - RNA, 22 nt, Human
cagacacagauaugcauauggc

SEQ ID NO: 260119 - RNA, 22 nt, Human
acaggaagugggaagaaacagg

SEQ ID NO: 260120 - RNA, 22 nt, Human
uaauuauagcauuggaguggcc

SEQ ID NO: 260121 - RNA, 21 nt, Human
ugagcaggugcagggaagugg

SEQ ID NO: 260122 - RNA, 22 nt, Human
ccuacaggaaauuguaucaaaa

SEQ ID NO: 260123 - RNA, 19 nt, Human
acaaagugcgugcucuuuu

SEQ ID NO: 260124 - RNA, 22 nt, Human
caauaagccagguguuuguguu

SEQ ID NO: 260125 - RNA, 22 nt, Human
gaggcugcaggcaaugcugccc

SEQ ID NO: 260126 - RNA, 22 nt, Human
uauucacaugaaaacaaauuuu

SEQ ID NO: 260127 - RNA, 22 nt, Human
acuuuagaaaagcauccauaga

SEQ ID NO: 260128 - RNA, 22 nt, Human
aggccucugagcagcacucaug

SEQ ID NO: 260129 - RNA, 22 nt, Human
gcuggaaggcuaggcucaguug

SEQ ID NO: 260130 - RNA, 22 nt, Human
gcaggcagaucaccugucagga

SEQ ID NO: 260131 - RNA, 21 nt, Human
uucuucaggccaaugcucauu

SEQ ID NO: 260132 - RNA, 22 nt, Human
caaagguaguauauauauuguu

SEQ ID NO: 260133 - RNA, 22 nt, Human
uacacauaggucugaauaaaaa

SEQ ID NO: 260134 - RNA, 22 nt, Human
guaaaacugucuaaugguauau

SEQ ID NO: 260135 - RNA, 22 nt, Human
auuuuccuucuaagaggaaggu

SEQ ID NO: 260136 - RNA, 22 nt, Human
agaggggaaguaaugaaugaua

SEQ ID NO: 260137 - RNA, 22 nt, Human
cuuggcuguugggcauugagaa

SEQ ID NO: 260138 - RNA, 22 nt, Human
cagagcauuaaaaccagcucug

SEQ ID NO: 260139 - RNA, 22 nt, Human
accaggcacuccugaggucuga

SEQ ID NO: 260140 - RNA, 19 nt, Human
ucuaacagaagugucgucc

SEQ ID NO: 260141 - RNA, 20 nt, Human
caggaugauuggacacgaug

SEQ ID NO: 260142 - RNA, 22 nt, Human
auagauguuuuaguaauacugu

SEQ ID NO: 260143 - RNA, 22 nt, Human
uucugugacuccucagagauuu

SEQ ID NO: 260144 - RNA, 22 nt, Human
cagcucugguuccugggcccag

SEQ ID NO: 260145 - RNA, 22 nt, Human
ucagagaggauuuuaauaagug

SEQ ID NO: 260146 - RNA, 22 nt, Human
agaagaaaugaggccguucugc

SEQ ID NO: 260147 - RNA, 22 nt, Human
uccaggccucuagccccuaucu

SEQ ID NO: 260148 - RNA, 22 nt, Human
uggaagcagagagcuaucacca

SEQ ID NO: 260149 - RNA, 22 nt, Human
ugcucauuggcgaucugaggga

SEQ ID NO: 260150 - RNA, 22 nt, Human
ugagggaguguggauacaguag

SEQ ID NO: 260151 - RNA, 22 nt, Human
uaguccagccuuggguguagcc

SEQ ID NO: 260152 - RNA, 22 nt, Human
ucaggagcauauauugaugucu

SEQ ID NO: 260153 - RNA, 23 nt, Human
gccuccaaaccucuaggcuggug

SEQ ID NO: 260154 - RNA, 22 nt, Human
cucaggaggaggaaguucauug

SEQ ID NO: 260155 - RNA, 22 nt, Human
ggcaugggccgaggugccuccu

SEQ ID NO: 260156 - RNA, 22 nt, Human
acagaauagguacagucaguca

SEQ ID NO: 260157 - RNA, 22 nt, Human
uuacugauuuuugggcccuacc

SEQ ID NO: 260158 - RNA, 22 nt, Human
cacacuugugaccgauauaaug

SEQ ID NO: 260159 - RNA, 22 nt, Human
auccuggacaguuuccccuauu

SEQ ID NO: 260160 - RNA, 22 nt, Human
guggcaggagacuggaagaugg

SEQ ID NO: 260161 - RNA, 22 nt, Human
ggcuccuggaggcaccacuggu

SEQ ID NO: 260162 - RNA, 22 nt, Human
ggcccagagggucaggagcuga

SEQ ID NO: 260163 - RNA, 22 nt, Human
gugcuccauugucuagaacugg

SEQ ID NO: 260164 - RNA, 22 nt, Human
uauaagugugucagcuuccaac

SEQ ID NO: 260165 - RNA, 22 nt, Human
cugccucugguuuuggucccug

SEQ ID NO: 260166 - RNA, 22 nt, Human
cagggugguaccagcaucuagu

SEQ ID NO: 260167 - RNA, 23 nt, Human
aucuaauuucuccaaaucucuac

SEQ ID NO: 260168 - RNA, 22 nt, Human
gagcucuuugaaccugggcagu

SEQ ID NO: 260169 - RNA, 22 nt, Human
cgcaggggaggaagguacaccu

SEQ ID NO: 260170 - RNA, 22 nt, Human
ucaggugucugccucuuugagu

SEQ ID NO: 260171 - RNA, 20 nt, Human
ucccucaguuuccagcccug

SEQ ID NO: 260172 - RNA, 22 nt, Human
uaucacaggugugauuuacauu

SEQ ID NO: 260173 - RNA, 22 nt, Human
ucucuggcagacuggcugggcu

SEQ ID NO: 260174 - RNA, 22 nt, Human
aauuucuccaagaaugcuuaga

SEQ ID NO: 260175 - RNA, 22 nt, Human
gacccugaggauucccugcuga

SEQ ID NO: 260176 - RNA, 22 nt, Human
uauuacaagaaagggcaugaau

SEQ ID NO: 260177 - RNA, 22 nt, Human
aaacaacaugguggguguguag

SEQ ID NO: 260178 - RNA, 22 nt, Human
gcuguccagguuguggagcaac

SEQ ID NO: 260179 - RNA, 22 nt, Human
aacaugauuuaguauaaugcag

SEQ ID NO: 260180 - RNA, 22 nt, Human
uaagaacauuuucggaaagaua

SEQ ID NO: 260181 - RNA, 22 nt, Human
gugugcagaagacacaagacau

SEQ ID NO: 260182 - RNA, 22 nt, Human
ucuggcaggcaaucggcucugg

SEQ ID NO: 260183 - RNA, 22 nt, Human
ggccagcugcucagugucucug

SEQ ID NO: 260184 - RNA, 22 nt, Human
cucuguagacuccaccuuugag

SEQ ID NO: 260185 - RNA, 22 nt, Human
gccaagcucaccuucugaugga

SEQ ID NO: 260186 - RNA, 22 nt, Human
gcauggcucuggccucagugug

SEQ ID NO: 260187 - RNA, 22 nt, Human
cagcugggccuccugagcccug

SEQ ID NO: 260188 - RNA, 22 nt, Human
gggaaaaauaaugcacagauau

SEQ ID NO: 260189 - RNA, 19 nt, Human
uucugggcauucauauuua

SEQ ID NO: 260190 - RNA, 22 nt, Human
gagcacagauccuggagccaca

SEQ ID NO: 260191 - RNA, 22 nt, Human
gagguucacuuccuggauccuu

SEQ ID NO: 260192 - RNA, 20 nt, Human
aggcagcugggaaaugaggg

SEQ ID NO: 260193 - RNA, 22 nt, Human
aacuagaaccacuuguauuucc

SEQ ID NO: 260194 - RNA, 22 nt, Human
aacuggaauagcacaggaaaag

SEQ ID NO: 260195 - RNA, 22 nt, Human
caggaagcuagauuuuguugcu

SEQ ID NO: 260196 - RNA, 22 nt, Human
ccaggguggcguagaugcuggg

SEQ ID NO: 260197 - RNA, 22 nt, Human
ugucacauguuuaauguggacu

SEQ ID NO: 260198 - RNA, 23 nt, Human
ugguccugccaacggugccccuc

SEQ ID NO: 260199 - RNA, 22 nt, Human
gcugggcuccacccucaacugu

SEQ ID NO: 260200 - RNA, 21 nt, Human
uuacauucagaggaguggaag

SEQ ID NO: 260201 - RNA, 22 nt, Human
ggugcccagagccaggaaugag

SEQ ID NO: 260202 - RNA, 22 nt, Human
gcuugcucuuuagccauggcca

SEQ ID NO: 260203 - RNA, 21 nt, Human
agguggggcugcaccucugcu

SEQ ID NO: 260204 - RNA, 22 nt, Human
gaagaaggaagaucaugcuuga

SEQ ID NO: 260205 - RNA, 22 nt, Human
uaguaacagcagcuucccugug

SEQ ID NO: 260206 - RNA, 22 nt, Human
gaggcucacugggcaaagacuc

SEQ ID NO: 260207 - RNA, 22 nt, Human
agcuaguucacugaagccuaug

SEQ ID NO: 260208 - RNA, 22 nt, Human
ucucaguguuaucuaucugccu

SEQ ID NO: 260209 - RNA, 19 nt, Human
gcucagcagacccagugcu

SEQ ID NO: 260210 - RNA, 22 nt, Human
acagguggagugguuagcaggc

SEQ ID NO: 260211 - RNA, 20 nt, Human
ggguccaggacucugaauuu

SEQ ID NO: 260212 - RNA, 18 nt, Human
aggggcagcuugugugga

SEQ ID NO: 260213 - RNA, 22 nt, Human
cuuuuaaugggagcaguauuug

SEQ ID NO: 260214 - RNA, 19 nt, Human
guauuucaggacaagacgu

SEQ ID NO: 260215 - RNA, 22 nt, Human
agggagcuucuggccucagccu

SEQ ID NO: 260216 - RNA, 22 nt, Human
cauucggagguaguugagguua

SEQ ID NO: 260217 - RNA, 22 nt, Human
caggucucucccaagcuacaau

SEQ ID NO: 260218 - RNA, 22 nt, Human
uucuuucugggguccuucggcu

SEQ ID NO: 260219 - RNA, 22 nt, Human
cagaagguuugaaagaugucuu

SEQ ID NO: 260220 - RNA, 22 nt, Human
cagggagcuuugucuucucauu

SEQ ID NO: 260221 - RNA, 22 nt, Human
gaggcucaguuaugucaucagg

SEQ ID NO: 260222 - RNA, 22 nt, Human
acaaacagaguugaaaaauagg

SEQ ID NO: 260223 - RNA, 18 nt, Human
uggacaggguggagaaaa

SEQ ID NO: 260224 - RNA, 22 nt, Human
ucucuuaauaaguaaauacuga

SEQ ID NO: 260225 - RNA, 22 nt, Human
ucuuucccgccagagcaugagu

SEQ ID NO: 260226 - RNA, 21 nt, Human
ugcagaggcacaaacaagccc

SEQ ID NO: 260227 - RNA, 22 nt, Human
ucucagcucuuuuuucacagaa

SEQ ID NO: 260228 - RNA, 22 nt, Human
acuguacaacugcugagcagaa

SEQ ID NO: 260229 - RNA, 22 nt, Human
aaggugucucucugcuucuugg

SEQ ID NO: 260230 - RNA, 22 nt, Human
ugagaugcaggagaugggacug

SEQ ID NO: 260231 - RNA, 22 nt, Human
uaggaaacaaaguaaugcaacu

SEQ ID NO: 260232 - RNA, 20 nt, Human
uacaagaauccccaguuguc

SEQ ID NO: 260233 - RNA, 22 nt, Human
ucagcagaaaggcacuagauga

SEQ ID NO: 260234 - RNA, 22 nt, Human
cauuucugcagaauugcucuuc

SEQ ID NO: 260235 - RNA, 22 nt, Human
ucugguacuagaggagugcugg

SEQ ID NO: 260236 - RNA, 22 nt, Human
auugcuuuagaaagaaaaauau

SEQ ID NO: 260237 - RNA, 22 nt, Human
guguccauucacugcaacacuu

SEQ ID NO: 260238 - RNA, 22 nt, Human
caggccagguggcaggcaaaac

SEQ ID NO: 260239 - RNA, 22 nt, Human
cagcuggcaaguggagcagggu

SEQ ID NO: 260240 - RNA, 22 nt, Human
gaagcuggcugaaguucagcua

SEQ ID NO: 260241 - RNA, 22 nt, Human
uuaagcauuuauuaugugccag

SEQ ID NO: 260242 - RNA, 22 nt, Human
aaaaagacuagucgagugcagu

SEQ ID NO: 260243 - RNA, 22 nt, Human
aauguuaauuuacugucuucau

SEQ ID NO: 260244 - RNA, 22 nt, Human
ucagugcauggacagauuuaga

SEQ ID NO: 260245 - RNA, 19 nt, Human
cagcaagaaugaaggcaua

SEQ ID NO: 260246 - RNA, 22 nt, Human
aaggccagccuuggaacccuga

SEQ ID NO: 260247 - RNA, 22 nt, Human
uguagauguagacacaggucua

SEQ ID NO: 260248 - RNA, 19 nt, Human
acacaaugacacauauaua

SEQ ID NO: 260249 - RNA, 23 nt, Human
cuagggcaguauuucacagacac

SEQ ID NO: 260250 - RNA, 22 nt, Human
ccauggcuucuuucucugccag

SEQ ID NO: 260251 - RNA, 23 nt, Human
aguccuuuuuauaaaauugagga

SEQ ID NO: 260252 - RNA, 22 nt, Human
ucuuguguggaacugcuuuucu

SEQ ID NO: 260253 - RNA, 22 nt, Human
uggcugccuagugucugagcag

SEQ ID NO: 260254 - RNA, 22 nt, Human
aacacuggaagggacaucaagu

SEQ ID NO: 260255 - RNA, 22 nt, Human
cuucaggauuaauuuggggccu

SEQ ID NO: 260256 - RNA, 22 nt, Human
aauguuaauguguuugcuuaug

SEQ ID NO: 260257 - RNA, 22 nt, Human
auaaucuggucuuuguaugagu

SEQ ID NO: 260258 - RNA, 22 nt, Human
cauucaaagcaggaaaggccuu

SEQ ID NO: 260259 - RNA, 22 nt, Human
acacaucugcaagagccagacc

SEQ ID NO: 260260 - RNA, 22 nt, Human
uaacacuauccagauaugauaa

SEQ ID NO: 260261 - RNA, 22 nt, Human
gcucuguaguauuuaguaaaua

SEQ ID NO: 260262 - RNA, 22 nt, Human
ggcuucucagcacacuguccac

SEQ ID NO: 260263 - RNA, 22 nt, Human
ccaggguuggucucucugaggu

SEQ ID NO: 260264 - RNA, 22 nt, Human
gaggcagagucacaaagagucu

SEQ ID NO: 260265 - RNA, 22 nt, Human
gcuggcuguguuccuucugcca

SEQ ID NO: 260266 - RNA, 22 nt, Human
ccugggaaggggaagagaauuc

SEQ ID NO: 260267 - RNA, 22 nt, Human
cacagaaauauugugucccuug

SEQ ID NO: 260268 - RNA, 22 nt, Human
gcugggaguuacugucuccuuu

SEQ ID NO: 260269 - RNA, 22 nt, Human
cuuaaauucuuaaugcccucau

SEQ ID NO: 260270 - RNA, 22 nt, Human
auguguccuuguucccauucca

SEQ ID NO: 260271 - RNA, 22 nt, Human
acacucaguaaacgacaauggg

SEQ ID NO: 260272 - RNA, 22 nt, Human
uaaauacuuuuacuccacugau

SEQ ID NO: 260273 - RNA, 22 nt, Human
aauagaauuuguacuguguuuu

SEQ ID NO: 260274 - RNA, 22 nt, Human
aaacacagguacugcagaagug

SEQ ID NO: 260275 - RNA, 22 nt, Human
caugccaagcauguucagaagu

SEQ ID NO: 260276 - RNA, 22 nt, Human
cagacaggcuagccagacucac

SEQ ID NO: 260277 - RNA, 22 nt, Human
uuccagaacucaagaaaugccc

SEQ ID NO: 260278 - RNA, 22 nt, Human
accuagaguagucaaauucaua

SEQ ID NO: 260279 - RNA, 22 nt, Human
cuagaaauauuuuacagucaag

SEQ ID NO: 260280 - RNA, 22 nt, Human
gcuuggcuugggcucagaggcc

SEQ ID NO: 260281 - RNA, 22 nt, Human
gccaggcagccacccucugcga

SEQ ID NO: 260282 - RNA, 22 nt, Human
cuaaauacuagccuucagauuu

SEQ ID NO: 260283 - RNA, 22 nt, Human
aauuggcagaacuuuauauauu

SEQ ID NO: 260284 - RNA, 22 nt, Human
acaaaguagucaaaguagauga

SEQ ID NO: 260285 - RNA, 22 nt, Human
uccaggagucagacagauggug

SEQ ID NO: 260286 - RNA, 22 nt, Human
uuacauuucccccuuggaggcu

SEQ ID NO: 260287 - RNA, 22 nt, Human
augguaaugauuuauguaaauu

SEQ ID NO: 260288 - RNA, 22 nt, Human
acccaggguuugagcucugcag

SEQ ID NO: 260289 - RNA, 22 nt, Human
agccacaggaaacagagacagc

SEQ ID NO: 260290 - RNA, 22 nt, Human
aggguggcaccacauaucauag

SEQ ID NO: 260291 - RNA, 22 nt, Human
gcauuagaagggaccucugggg

SEQ ID NO: 260292 - RNA, 23 nt, Human
acuuucccauagcauggcuuccu

SEQ ID NO: 260293 - RNA, 22 nt, Human
gagagcugcaagguagggcggg

SEQ ID NO: 260294 - RNA, 22 nt, Human
gcucuguacgcaggaugagggg

SEQ ID NO: 260295 - RNA, 22 nt, Human
gaggcugagaguuuguucuacu

SEQ ID NO: 260296 - RNA, 22 nt, Human
agucacaugcauuuucuucaau

SEQ ID NO: 260297 - RNA, 20 nt, Human
ccugucuccucuuaccuggc

SEQ ID NO: 260298 - RNA, 22 nt, Human
ggucacugcccucccuuuugca

SEQ ID NO: 260299 - RNA, 22 nt, Human
cacaguuugggucuccggggca

SEQ ID NO: 260300 - RNA, 22 nt, Human
ucuccauaggcaguucauaaca

SEQ ID NO: 260301 - RNA, 22 nt, Human
agaggagcugggaggcccucgu

SEQ ID NO: 260302 - RNA, 22 nt, Human
auguauacgugcaggucacagg

SEQ ID NO: 260303 - RNA, 22 nt, Human
acaccaccgucccagccuccug

SEQ ID NO: 260304 - RNA, 19 nt, Human
ggagaagcaucuagaaaua

SEQ ID NO: 260305 - RNA, 22 nt, Human
gggaaguuugugggaggaauau

SEQ ID NO: 260306 - RNA, 22 nt, Human
caguagcaugcuuaucuuuuga

SEQ ID NO: 260307 - RNA, 22 nt, Human
ccugggucuucagucugcuggu

SEQ ID NO: 260308 - RNA, 22 nt, Human
gcucccagucugauggaggaga

SEQ ID NO: 260309 - RNA, 22 nt, Human
aaauuccaguucuuuuaccugc

SEQ ID NO: 260310 - RNA, 22 nt, Human
aaguaaaagcuuuaccaugcgc

SEQ ID NO: 260311 - RNA, 22 nt, Human
ucagccacuucccucuggucag

SEQ ID NO: 260312 - RNA, 22 nt, Human
aaugcacauauauuuccuuauu

SEQ ID NO: 260313 - RNA, 22 nt, Human
uagucuaagaaaucuuuacuuu

SEQ ID NO: 260314 - RNA, 22 nt, Human
ccuggcucccugcacagggcuc

SEQ ID NO: 260315 - RNA, 22 nt, Human
uaauguuaguauguaaucuuau

SEQ ID NO: 260316 - RNA, 22 nt, Human
uuaaucacagcucugccaugag

SEQ ID NO: 260317 - RNA, 22 nt, Human
aaauucuuuugugcggugaagu

SEQ ID NO: 260318 - RNA, 22 nt, Human
uuaguuagucccugguaccuuu

SEQ ID NO: 260319 - RNA, 17 nt, Human
gcugagaaggggaagag

SEQ ID NO: 260320 - RNA, 22 nt, Human
acugggcuccagaugugauacg

SEQ ID NO: 260321 - RNA, 22 nt, Human
ggagucuguuuuacaugcagga

SEQ ID NO: 260322 - RNA, 22 nt, Human
aaaugcuuagagguguucaaau

SEQ ID NO: 260323 - RNA, 22 nt, Human
ucagcagaggggaaggcaucug

SEQ ID NO: 260324 - RNA, 22 nt, Human
accagucuuguugccaugucug

SEQ ID NO: 260325 - RNA, 22 nt, Human
cauaucuccuccagcacaggcc

SEQ ID NO: 260326 - RNA, 22 nt, Human
caggacugauguuccuccagcc

SEQ ID NO: 260327 - RNA, 21 nt, Human
gcccuaggcuaccuggagcgc

SEQ ID NO: 260328 - RNA, 18 nt, Human
agaauuaccaaagugcuu

SEQ ID NO: 260329 - RNA, 22 nt, Human
gaaaaggaaauuuauagagauc

SEQ ID NO: 260330 - RNA, 22 nt, Human
aagguuagugcaucuuuuguuu

SEQ ID NO: 260331 - RNA, 22 nt, Human
aaaugcacaaaguaaguguaau

SEQ ID NO: 260332 - RNA, 22 nt, Human
acaugcuaugagagauuacuuc

SEQ ID NO: 260333 - RNA, 22 nt, Human
cagcuccagccgacuguaagaa

SEQ ID NO: 260334 - RNA, 22 nt, Human
ugaucccuggacuugaguaagu

SEQ ID NO: 260335 - RNA, 22 nt, Human
gcaggcguguuucacgugccag

SEQ ID NO: 260336 - RNA, 22 nt, Human
uauagcaaaauaguuuccacac

SEQ ID NO: 260337 - RNA, 22 nt, Human
aggcucaguucacgucaacuuu

SEQ ID NO: 260338 - RNA, 22 nt, Human
aaagauguuaugaaauaacuau

SEQ ID NO: 260339 - RNA, 22 nt, Human
uaagacacgggcugaucuaaag

SEQ ID NO: 260340 - RNA, 22 nt, Human
ucccugggaaaugucaguuuca

SEQ ID NO: 260341 - RNA, 22 nt, Human
uuucaaguucuguuccuaaacu

SEQ ID NO: 260342 - RNA, 18 nt, Human
aguuugaacaaggaagaa

SEQ ID NO: 260343 - RNA, 21 nt, Human
gggugggaggacacagcaggc

SEQ ID NO: 260344 - RNA, 22 nt, Human
cacaguuuaugaucucagugaa

SEQ ID NO: 260345 - RNA, 21 nt, Human
aguggcugucaagggggccuu

SEQ ID NO: 260346 - RNA, 22 nt, Human
aaaugcagauugucauucagga

SEQ ID NO: 260347 - RNA, 22 nt, Human
uaaauacugaguuggaguuggc

SEQ ID NO: 260348 - RNA, 22 nt, Human
cagaaauguucuaaugauucag

SEQ ID NO: 260349 - RNA, 17 nt, Human
gugcagggaugaaggau

SEQ ID NO: 260350 - RNA, 22 nt, Human
acagaguccuagcugcaaagaa

SEQ ID NO: 260351 - RNA, 22 nt, Human
uggaaggcugugauuacugugc

SEQ ID NO: 260352 - RNA, 22 nt, Human
cugccccuggugauggacgcca

SEQ ID NO: 260353 - RNA, 23 nt, Human
cauggcagcaagagcucauggcc

SEQ ID NO: 260354 - RNA, 22 nt, Human
aagggagguaaagcuauuuaaa

SEQ ID NO: 260355 - RNA, 22 nt, Human
cacuuagagccagaugcauagu

SEQ ID NO: 260356 - RNA, 16 nt, Human
cuggacagaaaaaccu

SEQ ID NO: 260357 - RNA, 22 nt, Human
agucuucucauuucacaugcuu

SEQ ID NO: 260358 - RNA, 22 nt, Human
agccagacuuuaaaauagauga

SEQ ID NO: 260359 - RNA, 22 nt, Human
cacaggcuugucagcaugaggc

SEQ ID NO: 260360 - RNA, 22 nt, Human
agguucuuuuggccaaccucau

SEQ ID NO: 260361 - RNA, 22 nt, Human
aacaaaugaccugauuucuucc

SEQ ID NO: 260362 - RNA, 22 nt, Human
uggagcugaacuuugaggccag

SEQ ID NO: 260363 - RNA, 23 nt, Human
cucugcaggagagugggcagggc

SEQ ID NO: 260364 - RNA, 22 nt, Human
uggcagaaguucacuaguagcu

SEQ ID NO: 260365 - RNA, 22 nt, Human
acagcaugagagaugaacauuc

SEQ ID NO: 260366 - RNA, 22 nt, Human
uuacaucagcaagaguguaugu

SEQ ID NO: 260367 - RNA, 21 nt, Human
aguuuuauauuauaagcuaaa

SEQ ID NO: 260368 - RNA, 22 nt, Human
uuagaaagcuuuccauagucaa

SEQ ID NO: 260369 - RNA, 22 nt, Human
cagggauggcugucaggaugua

SEQ ID NO: 260370 - RNA, 23 nt, Human
aagaaucucagaauuagaaauac

SEQ ID NO: 260371 - RNA, 22 nt, Human
uauguacuacacuagaacauuu

SEQ ID NO: 260372 - RNA, 22 nt, Human
aagcacuggguauagcaaugau

SEQ ID NO: 260373 - RNA, 17 nt, Human
acagcagggaaguguug

SEQ ID NO: 260374 - RNA, 22 nt, Human
ugaaagauaaguuauuauguac

SEQ ID NO: 260375 - RNA, 22 nt, Human
uccagagcuaauucagcagcug

SEQ ID NO: 260376 - RNA, 22 nt, Human
agcagggcuggauuuggcaaga

SEQ ID NO: 260377 - RNA, 18 nt, Human
acuccccacaggcucugu

SEQ ID NO: 260378 - RNA, 22 nt, Human
cgagagccggaaggggcggugc

SEQ ID NO: 260379 - RNA, 22 nt, Human
ugccaggcugcccuccagucug

SEQ ID NO: 260380 - RNA, 22 nt, Human
ugcucuucggggccacugcuug

SEQ ID NO: 260381 - RNA, 22 nt, Human
aggcaggcuagucgcuugagcc

SEQ ID NO: 260382 - RNA, 22 nt, Human
cguuaguggaguuugaagcugu

SEQ ID NO: 260383 - RNA, 22 nt, Human
gcacagcuccugguaagcuggg

SEQ ID NO: 260384 - RNA, 22 nt, Human
uuugaaauaugaggcauuauga

SEQ ID NO: 260385 - RNA, 22 nt, Human
agggaugguggaggaauuucaa

SEQ ID NO: 260386 - RNA, 22 nt, Human
cuccaggacucaggccccuggg

SEQ ID NO: 260387 - RNA, 21 nt, Human
ugaaacauuugaucaaagcac

SEQ ID NO: 260388 - RNA, 22 nt, Human
ucauuauaaacauaugcuaaag

SEQ ID NO: 260389 - RNA, 22 nt, Human
ggguucuuauaguaucagagcu

SEQ ID NO: 260390 - RNA, 22 nt, Human
gguccucuccagcgccacagug

SEQ ID NO: 260391 - RNA, 22 nt, Human
ucuuaaacuuugcuguaauucu

SEQ ID NO: 260392 - RNA, 22 nt, Human
uaucagaaaugccuuaaauugg

SEQ ID NO: 260393 - RNA, 22 nt, Human
aucuuugaagaggacuugaagu

SEQ ID NO: 260394 - RNA, 22 nt, Human
uuuaauuuucugggcccagcag

SEQ ID NO: 260395 - RNA, 22 nt, Human
uguccauggagaagcucagggc

SEQ ID NO: 260396 - RNA, 22 nt, Human
uuuguaaaagcccaagcuguag

SEQ ID NO: 260397 - RNA, 21 nt, Human
cagagccuguguugacaguug

SEQ ID NO: 260398 - RNA, 22 nt, Human
caaugcuucucauuagccaaug

SEQ ID NO: 260399 - RNA, 22 nt, Human
ugggcuggcguggagaguuuag

SEQ ID NO: 260400 - RNA, 22 nt, Human
ucuccaggggcugcugugccac

SEQ ID NO: 260401 - RNA, 22 nt, Human
aaacacagggauauauauucca

SEQ ID NO: 260402 - RNA, 22 nt, Human
uuucagacaggacuucauaugu

SEQ ID NO: 260403 - RNA, 22 nt, Human
uucuuuuccuacacagcgauuu

SEQ ID NO: 260404 - RNA, 22 nt, Human
uagagcaguggguaccauggca

SEQ ID NO: 260405 - RNA, 22 nt, Human
agcagggcugcggccccaccac

SEQ ID NO: 260406 - RNA, 19 nt, Human
agacaaguuuccagaagcc

SEQ ID NO: 260407 - RNA, 22 nt, Human
gcauuuacauggagcuaucuaa

SEQ ID NO: 260408 - RNA, 22 nt, Human
cagaguguuucuuugggugggu

SEQ ID NO: 260409 - RNA, 23 nt, Human
ugggccuggccucccaguccagc

SEQ ID NO: 260410 - RNA, 22 nt, Human
aggcuaggggcagugccagcau

SEQ ID NO: 260411 - RNA, 22 nt, Human
agucuuaggcuccauuaguaga

SEQ ID NO: 260412 - RNA, 19 nt, Human
ucucucuguacauuagaua

SEQ ID NO: 260413 - RNA, 22 nt, Human
aaagaguucacggaggccaaag

SEQ ID NO: 260414 - RNA, 22 nt, Human
aagggcuggaauaucucuuaga

SEQ ID NO: 260415 - RNA, 19 nt, Human
gcuggggccugaccagaca

SEQ ID NO: 260416 - RNA, 22 nt, Human
uugagcuugaggaguuauuuga

SEQ ID NO: 260417 - RNA, 22 nt, Human
caaguauuuccugauggccugu

SEQ ID NO: 260418 - RNA, 22 nt, Human
ccuccugguaauuagcgaaagg

SEQ ID NO: 260419 - RNA, 22 nt, Human
gaguccuggcguccaauuuccu

SEQ ID NO: 260420 - RNA, 22 nt, Human
agacaauuucaaaguaauauua

SEQ ID NO: 260421 - RNA, 22 nt, Human
uuagccauucugauagguaugu

SEQ ID NO: 260422 - RNA, 22 nt, Human
acauucccaccaacaguguaaa

SEQ ID NO: 260423 - RNA, 22 nt, Human
cugcaucuguuagauuaucacc

SEQ ID NO: 260424 - RNA, 22 nt, Human
acagagacuaagcuuuucauca

SEQ ID NO: 260425 - RNA, 22 nt, Human
cccugggagcugccuggcugac

SEQ ID NO: 260426 - RNA, 22 nt, Human
acacuguagacuguugaaguac

SEQ ID NO: 260427 - RNA, 22 nt, Human
gcaguuauguauguguuugaga

SEQ ID NO: 260428 - RNA, 18 nt, Human
aggccacacuccagaaca

SEQ ID NO: 260429 - RNA, 22 nt, Human
aucuguaaagauaaucauaugu

SEQ ID NO: 260430 - RNA, 22 nt, Human
aauuuacacuucauuuggaggg

SEQ ID NO: 260431 - RNA, 22 nt, Human
agccuggaauuaaggaaaugca

SEQ ID NO: 260432 - RNA, 22 nt, Human
cuguuacuucaaucuucucccg

SEQ ID NO: 260433 - RNA, 19 nt, Human
aucugccuguuaucacaua

SEQ ID NO: 260434 - RNA, 22 nt, Human
uccagcauauauagagaaugag

SEQ ID NO: 260435 - RNA, 22 nt, Human
ggaauugguuucaagggaaagu

SEQ ID NO: 260436 - RNA, 22 nt, Human
agcuucugaaagucuguuuucc

SEQ ID NO: 260437 - RNA, 22 nt, Human
ggcuuuauuaacucauccguaa

SEQ ID NO: 260438 - RNA, 22 nt, Human
gugaccaucaucucagcuaguu

SEQ ID NO: 260439 - RNA, 22 nt, Human
cuuuauguccuugaagaguugu

SEQ ID NO: 260440 - RNA, 22 nt, Human
acaguguagcaugguagcaaug

SEQ ID NO: 260441 - RNA, 22 nt, Human
uuuugauaucaugaugaacaga

SEQ ID NO: 260442 - RNA, 22 nt, Human
uccugcagagacagaggccuca

SEQ ID NO: 260443 - RNA, 22 nt, Human
uacuuuauauuguggcuggcca

SEQ ID NO: 260444 - RNA, 22 nt, Human
gagggaauggugugcaagaggu

SEQ ID NO: 260445 - RNA, 22 nt, Human
cugguacaaaaugcugauauca

SEQ ID NO: 260446 - RNA, 22 nt, Human
uggcuucugguuuauccuuaua

SEQ ID NO: 260447 - RNA, 22 nt, Human
aauuaaaagauaacccaugagu

SEQ ID NO: 260448 - RNA, 22 nt, Human
gagugagggccaacauccagcu

SEQ ID NO: 260449 - RNA, 22 nt, Human
uguguguggggaggcagcagau

SEQ ID NO: 260450 - RNA, 22 nt, Human
agcagcaccuguccucgcugcu

SEQ ID NO: 260451 - RNA, 22 nt, Human
ugcugcacucaccaacagauaa

SEQ ID NO: 260452 - RNA, 22 nt, Human
gaggccaggggccuggagauga

SEQ ID NO: 260453 - RNA, 22 nt, Human
aauguguguucggggcccagag

SEQ ID NO: 260454 - RNA, 20 nt, Human
ucagggcaugggacagcccc

SEQ ID NO: 260455 - RNA, 22 nt, Human
ugcucccuugccagaggggaag

SEQ ID NO: 260456 - RNA, 22 nt, Human
agcugaggguucgguguccaca

SEQ ID NO: 260457 - RNA, 22 nt, Human
aucugggccuguucccucaccu

SEQ ID NO: 260458 - RNA, 22 nt, Human
ccccuggggaucagcuggaauu

SEQ ID NO: 260459 - RNA, 22 nt, Human
cucagcagugacaagagaguau

SEQ ID NO: 260460 - RNA, 22 nt, Human
gcagcuuucuuuuugcaugucu

SEQ ID NO: 260461 - RNA, 22 nt, Human
agaaacuucagcuauucuuuug

SEQ ID NO: 260462 - RNA, 22 nt, Human
uuauauaucuugauuuguucca

SEQ ID NO: 260463 - RNA, 22 nt, Human
cagggccugccugguuccugga

SEQ ID NO: 260464 - RNA, 22 nt, Human
uucccagugauuaaggcagugg

SEQ ID NO: 260465 - RNA, 22 nt, Human
gccaggagagcuccuucagguu

SEQ ID NO: 260466 - RNA, 22 nt, Human
guuuaaauaauuaggggccugu

SEQ ID NO: 260467 - RNA, 17 nt, Human
aggaagcgagcuggccu

SEQ ID NO: 260468 - RNA, 17 nt, Human
ugguuccaaccauacgc

SEQ ID NO: 260469 - RNA, 22 nt, Human
gacccaggcucgugggacggcu

SEQ ID NO: 260470 - RNA, 22 nt, Human
acacagaggaaagugugaaggg

SEQ ID NO: 260471 - RNA, 23 nt, Human
ugggccucuccacccuuuucugu

SEQ ID NO: 260472 - RNA, 22 nt, Human
ucucaguggguuaaaagagaag

SEQ ID NO: 260473 - RNA, 22 nt, Human
accacugggcgggcagccugcu

SEQ ID NO: 260474 - RNA, 22 nt, Human
acuggugguuucuccccagaga

SEQ ID NO: 260475 - RNA, 22 nt, Human
cucacagcugcuucaggaucca

SEQ ID NO: 260476 - RNA, 22 nt, Human
auuuuguggcagaugcagaacc

SEQ ID NO: 260477 - RNA, 22 nt, Human
acuuagcaguuuagaauauguc

SEQ ID NO: 260478 - RNA, 19 nt, Human
aaacacagauuucuuacca

SEQ ID NO: 260479 - RNA, 22 nt, Human
uucuauugggaagugugagagu

SEQ ID NO: 260480 - RNA, 22 nt, Human
ucugaagguuacuucugcucag

SEQ ID NO: 260481 - RNA, 22 nt, Human
auaguuacaaagacuuuuuaaa

SEQ ID NO: 260482 - RNA, 22 nt, Human
augcuuuauuguuaggucaugu

SEQ ID NO: 260483 - RNA, 22 nt, Human
cagaacagaaguaaaauuuacc

SEQ ID NO: 260484 - RNA, 22 nt, Human
uagauucuggagagacagcagu

SEQ ID NO: 260485 - RNA, 22 nt, Human
aagaagaugguuaacuuucagu

SEQ ID NO: 260486 - RNA, 22 nt, Human
uucuuuuccuguggcucaucca

SEQ ID NO: 260487 - RNA, 22 nt, Human
uuucaguugauugcuuggguua

SEQ ID NO: 260488 - RNA, 22 nt, Human
gcuuuacauaaacauuuauuau

SEQ ID NO: 260489 - RNA, 22 nt, Human
uggaccugaagaauaggaagua

SEQ ID NO: 260490 - RNA, 22 nt, Human
gggcucuggggugcccuggcau

SEQ ID NO: 260491 - RNA, 22 nt, Human
uaaucuagucccacauggaauu

SEQ ID NO: 260492 - RNA, 22 nt, Human
acauuuaaauaccuauguuucu

SEQ ID NO: 260493 - RNA, 22 nt, Human
uauuucucuucaaaauugaugu

SEQ ID NO: 260494 - RNA, 22 nt, Human
accaggaguugggggugggacc

SEQ ID NO: 260495 - RNA, 22 nt, Human
auauccaccauucugcaccuuc

SEQ ID NO: 260496 - RNA, 19 nt, Human
ucuggcagguaauuaggga

SEQ ID NO: 260497 - RNA, 22 nt, Human
augcagggucuccgugugacga

SEQ ID NO: 260498 - RNA, 22 nt, Human
uucuaaaaccaauucugcuucu

SEQ ID NO: 260499 - RNA, 22 nt, Human
gaauaauauugacuuugcaggc

SEQ ID NO: 260500 - RNA, 22 nt, Human
gagagcaggaggcagcgggacg

SEQ ID NO: 260501 - RNA, 22 nt, Human
cagggccuccccggcagucuuu

SEQ ID NO: 260502 - RNA, 19 nt, Human
gucuagaacauuguaggug

SEQ ID NO: 260503 - RNA, 22 nt, Human
caauacuuuaguaaaauggccc

SEQ ID NO: 260504 - RNA, 22 nt, Human
aguggcuuuuuaguggcagaug

SEQ ID NO: 260505 - RNA, 22 nt, Human
gcaaagcagaacccucucuauc

SEQ ID NO: 260506 - RNA, 22 nt, Human
agaagcugccuacaugaccagc

SEQ ID NO: 260507 - RNA, 22 nt, Human
ccuucaaggcaaggagggcugg

SEQ ID NO: 260508 - RNA, 22 nt, Human
gguaccaccaauucagcugcca

SEQ ID NO: 260509 - RNA, 22 nt, Human
caacauguguuagacaauagac

SEQ ID NO: 260510 - RNA, 19 nt, Human
gaaggcuuuugguauguuu

SEQ ID NO: 260511 - RNA, 22 nt, Human
ggcucccuggcccuggggacac

SEQ ID NO: 260512 - RNA, 22 nt, Human
aucuuuggccacuugugcugca

SEQ ID NO: 260513 - RNA, 22 nt, Human
gugcaaaauuuggccaauaaca

SEQ ID NO: 260514 - RNA, 22 nt, Human
agcugucugucuccugaggaga

SEQ ID NO: 260515 - RNA, 22 nt, Human
uucugagagagccucucauguu

SEQ ID NO: 260516 - RNA, 22 nt, Human
caaaugcuggcccugcuacuua

SEQ ID NO: 260517 - RNA, 22 nt, Human
ggagcugaggacacuacauuuu

SEQ ID NO: 260518 - RNA, 16 nt, Human
gugagggacauagcuu

SEQ ID NO: 260519 - RNA, 17 nt, Human
agaggcagauacuugga

SEQ ID NO: 260520 - RNA, 22 nt, Human
cucuucaauagauuguugaggg

SEQ ID NO: 260521 - RNA, 22 nt, Human
uaaaugugucuuuuuaaggccu

SEQ ID NO: 260522 - RNA, 22 nt, Human
cuuucuuugcagugagccagag

SEQ ID NO: 260523 - RNA, 22 nt, Human
cgggcacacacuugacagguuc

SEQ ID NO: 260524 - RNA, 22 nt, Human
cagaauuuuucacucaaucuuc

SEQ ID NO: 260525 - RNA, 22 nt, Human
cccaggcuuuuaaguuagacag

SEQ ID NO: 260526 - RNA, 22 nt, Human
ugcaaaggaggaugggaaagaa

SEQ ID NO: 260527 - RNA, 20 nt, Human
agcuacaaugcgaagcuggc

SEQ ID NO: 260528 - RNA, 22 nt, Human
gcucaggcaaauuucuggugaa

SEQ ID NO: 260529 - RNA, 22 nt, Human
acagaccucuagauuacauuug

SEQ ID NO: 260530 - RNA, 22 nt, Human
ccuuucuugcuaagaguuuaug

SEQ ID NO: 260531 - RNA, 22 nt, Human
cuguccauggcaaugaugcaga

SEQ ID NO: 260532 - RNA, 22 nt, Human
acaacaggguaaggcaggccau

SEQ ID NO: 260533 - RNA, 22 nt, Human
aggacagaaucuauauucaguu

SEQ ID NO: 260534 - RNA, 22 nt, Human
guguguccacacauacauacau

SEQ ID NO: 260535 - RNA, 20 nt, Human
ucaggagccuaggacaugau

SEQ ID NO: 260536 - RNA, 22 nt, Human
aggcaguguucuucuaagggca

SEQ ID NO: 260537 - RNA, 22 nt, Human
aggguguguucuccuaugagaa

SEQ ID NO: 260538 - RNA, 22 nt, Human
ugugggaaugacgaggaagagg

SEQ ID NO: 260539 - RNA, 20 nt, Human
gugcauuucaccuguacugu

SEQ ID NO: 260540 - RNA, 22 nt, Human
ccauguguaaauuagauaacuc

SEQ ID NO: 260541 - RNA, 16 nt, Human
gaaggcuuacugcagg

SEQ ID NO: 260542 - RNA, 22 nt, Human
ugcagggaaagggcacugggcu

SEQ ID NO: 260543 - RNA, 22 nt, Human
aggaacacaacuuccugagagc

SEQ ID NO: 260544 - RNA, 22 nt, Human
agccacagucaaccuguccaua

SEQ ID NO: 260545 - RNA, 22 nt, Human
aagcacccaauuuacagcaguu

SEQ ID NO: 260546 - RNA, 20 nt, Human
guguggccaggagcugcgcu

SEQ ID NO: 260547 - RNA, 20 nt, Human
caugguggaggagcagggcc

SEQ ID NO: 260548 - RNA, 22 nt, Human
guccaaaagagccagccgggcg

SEQ ID NO: 260549 - RNA, 22 nt, Human
ucccuggguuaccuuucaaggu

SEQ ID NO: 260550 - RNA, 22 nt, Human
guaaguuauauuaaaauuucag

SEQ ID NO: 260551 - RNA, 23 nt, Human
uggaaacuuaagggggagauguc

SEQ ID NO: 260552 - RNA, 22 nt, Human
caucucugagaccucagcuggg

SEQ ID NO: 260553 - RNA, 22 nt, Human
aacacuuucuuccuugcucagg

SEQ ID NO: 260554 - RNA, 22 nt, Human
cagcagcuguuuacggaacacc

SEQ ID NO: 260555 - RNA, 22 nt, Human
ucaagacagauggguaacuugg

SEQ ID NO: 260556 - RNA, 22 nt, Human
uaaaugucuuugucacguuggg

SEQ ID NO: 260557 - RNA, 22 nt, Human
gauggcuuaagaguaaaaggca

SEQ ID NO: 260558 - RNA, 22 nt, Human
uggcaagaauauuggaccagaa

SEQ ID NO: 260559 - RNA, 21 nt, Human
caucucaguggguugguggau

SEQ ID NO: 260560 - RNA, 22 nt, Human
ucuaugaaucaauuuuaacauc

SEQ ID NO: 260561 - RNA, 22 nt, Human
augcacccagugucuggacuau

SEQ ID NO: 260562 - RNA, 16 nt, Human
gcacacagccagccuu

SEQ ID NO: 260563 - RNA, 21 nt, Human
cugcaggaugcugaagccagg

SEQ ID NO: 260564 - RNA, 22 nt, Human
ucuuuaauauaaaggaaugaau

SEQ ID NO: 260565 - RNA, 22 nt, Human
aaagccaggggagggauuccca

SEQ ID NO: 260566 - RNA, 22 nt, Human
uggcagcauguuauguaaggaa

SEQ ID NO: 260567 - RNA, 20 nt, Human
accaauuucagaggugcaga

SEQ ID NO: 260568 - RNA, 22 nt, Human
gcuuagaaagugauugauacau

SEQ ID NO: 260569 - RNA, 22 nt, Human
gcucucugaggugcuggcagag

SEQ ID NO: 260570 - RNA, 22 nt, Human
gauucagugagggugagaagaa

SEQ ID NO: 260571 - RNA, 22 nt, Human
cuguuuguuggcuauugacagu

SEQ ID NO: 260572 - RNA, 22 nt, Human
cagccugacaccagcuuugggc

SEQ ID NO: 260573 - RNA, 22 nt, Human
guguccugaucaauugagcugg

SEQ ID NO: 260574 - RNA, 22 nt, Human
cagcagcagacauuugaucuuc

SEQ ID NO: 260575 - RNA, 22 nt, Human
gcaugcaggagagaaagacggc

SEQ ID NO: 260576 - RNA, 22 nt, Human
agcagcaucugguucugaugug

SEQ ID NO: 260577 - RNA, 22 nt, Human
acacagcaaggucugacuuugg

SEQ ID NO: 260578 - RNA, 22 nt, Human
agaaggcugaagaagauccguu

SEQ ID NO: 260579 - RNA, 22 nt, Human
uagcucaaagguuaagugugga

SEQ ID NO: 260580 - RNA, 22 nt, Human
aggaaauguacaaaugaagaug

SEQ ID NO: 260581 - RNA, 21 nt, Human
ugaaacagauggaaguauuug

SEQ ID NO: 260582 - RNA, 22 nt, Human
aaauguacgggaguagaauuag

SEQ ID NO: 260583 - RNA, 22 nt, Human
caugaaggaauaauuguuuaga

SEQ ID NO: 260584 - RNA, 22 nt, Human
aaggccagcgcagaccauuguc

SEQ ID NO: 260585 - RNA, 22 nt, Human
uucugaauccucgaaacauagc

SEQ ID NO: 260586 - RNA, 22 nt, Human
ccucugagaacaccuggcgucc

SEQ ID NO: 260587 - RNA, 23 nt, Human
ucuggaaugguacucacuggagu

SEQ ID NO: 260588 - RNA, 22 nt, Human
ugugucuguuuugcucaccauu

SEQ ID NO: 260589 - RNA, 22 nt, Human
ucucaucuucauaucugaaaga

SEQ ID NO: 260590 - RNA, 22 nt, Human
aguccugggugugcaaggcaga

SEQ ID NO: 260591 - RNA, 22 nt, Human
cgugggaggaaaaaugggcuuc

SEQ ID NO: 260592 - RNA, 22 nt, Human
aaagacagauggcaaggaugau

SEQ ID NO: 260593 - RNA, 22 nt, Human
ucaguuaacggaaaggggugug

SEQ ID NO: 260594 - RNA, 22 nt, Human
ccacugccagccgcccggaggc

SEQ ID NO: 260595 - RNA, 22 nt, Human
gcuucucuuucuccccuggcgg

SEQ ID NO: 260596 - RNA, 22 nt, Human
gcccugagcacacaguagcaaa

SEQ ID NO: 260597 - RNA, 22 nt, Human
aauaccaccucauucuggaggc

SEQ ID NO: 260598 - RNA, 22 nt, Human
uccacagacuauuaagugaucu

SEQ ID NO: 260599 - RNA, 22 nt, Human
agucacagaaugauggcuccag

SEQ ID NO: 260600 - RNA, 22 nt, Human
auugcuuuguacaugccuagca

SEQ ID NO: 260601 - RNA, 19 nt, Human
gcuucccaccagccagccc

SEQ ID NO: 260602 - RNA, 22 nt, Human
aaaugucuuucuucugcuacgu

SEQ ID NO: 260603 - RNA, 22 nt, Human
uucauuuuuaccgcgugucaaa

SEQ ID NO: 260604 - RNA, 22 nt, Human
uaggcaaguugcccaaucucuc

SEQ ID NO: 260605 - RNA, 21 nt, Human
uuuguucaggcaaguuacagu

SEQ ID NO: 260606 - RNA, 22 nt, Human
uuuacagcaacagugcagaggu

SEQ ID NO: 260607 - RNA, 22 nt, Human
ucaggaaggcacuugguguguu

SEQ ID NO: 260608 - RNA, 22 nt, Human
caggggcucccugggugccagu

SEQ ID NO: 260609 - RNA, 17 nt, Human
uauguguguguuuauac

SEQ ID NO: 260610 - RNA, 22 nt, Human
gucccaggaacauucuggcuag

SEQ ID NO: 260611 - RNA, 23 nt, Human
ggucccaguggagaggccucacc

SEQ ID NO: 260612 - RNA, 22 nt, Human
cucagagcaaugaacaugcaaa

SEQ ID NO: 260613 - RNA, 22 nt, Human
ggcugccuauagaauuauuagu

SEQ ID NO: 260614 - RNA, 22 nt, Human
gcauuuggaacuugguugagau

SEQ ID NO: 260615 - RNA, 22 nt, Human
aggcugagucgggaggaucacu

SEQ ID NO: 260616 - RNA, 22 nt, Human
aggcauggguagaagagaagcc

SEQ ID NO: 260617 - RNA, 22 nt, Human
agugugggggcuuuggugucac

SEQ ID NO: 260618 - RNA, 20 nt, Human
uucuaguuuggaguuauuaa

SEQ ID NO: 260619 - RNA, 22 nt, Human
ucuacaaagaagaauuaauguc

SEQ ID NO: 260620 - RNA, 22 nt, Human
ugugucugcacugaguccucac

SEQ ID NO: 260621 - RNA, 22 nt, Human
ggaugggaacuugguagggcau

SEQ ID NO: 260622 - RNA, 23 nt, Human
agggccuggcguggagugugugc

SEQ ID NO: 260623 - RNA, 22 nt, Human
gggaccuggggacuccuuguuc

SEQ ID NO: 260624 - RNA, 22 nt, Human
ggcuuugcaaaaucggcuucug

SEQ ID NO: 260625 - RNA, 22 nt, Human
cugggcucuaagggagcaccgu

SEQ ID NO: 260626 - RNA, 22 nt, Human
augucagagcuuccacaauagu

SEQ ID NO: 260627 - RNA, 23 nt, Human
acauucuugauucaggccuuagc

SEQ ID NO: 260628 - RNA, 22 nt, Human
agggagcagcagccacaggaug

SEQ ID NO: 260629 - RNA, 22 nt, Human
caaguaacuugauuaagguaag

SEQ ID NO: 260630 - RNA, 22 nt, Human
uuauaagcucugaaaucuccua

SEQ ID NO: 260631 - RNA, 22 nt, Human
aaagaguugaggcaguuaucca

SEQ ID NO: 260632 - RNA, 22 nt, Human
cagcccagcgcaaacaacuggc

SEQ ID NO: 260633 - RNA, 22 nt, Human
ggcuggagaagggugguugaca

SEQ ID NO: 260634 - RNA, 19 nt, Human
cugcucagagcagcuccag

SEQ ID NO: 260635 - RNA, 23 nt, Human
aaguacauauauuuagauaguga

SEQ ID NO: 260636 - RNA, 22 nt, Human
gaggugucuggccuuuguagga

SEQ ID NO: 260637 - RNA, 20 nt, Human
gucaaacuacuggcagugcc

SEQ ID NO: 260638 - RNA, 23 nt, Human
aggauaaacuaaacucauuuugg

SEQ ID NO: 260639 - RNA, 22 nt, Human
accuagaaugaagcaaugcugu

SEQ ID NO: 260640 - RNA, 22 nt, Human
caugcucugcagcagaccugug

SEQ ID NO: 260641 - RNA, 19 nt, Human
ugagacugggugcaguacu

SEQ ID NO: 260642 - RNA, 23 nt, Human
agaguuuucuguuuucuguaggg

SEQ ID NO: 260643 - RNA, 22 nt, Human
uccaugagcuagcuuuccaaag

SEQ ID NO: 260644 - RNA, 22 nt, Human
uucauucaucacaugcagcugg

SEQ ID NO: 260645 - RNA, 22 nt, Human
cauuuguuaagaaggaaaaagg

SEQ ID NO: 260646 - RNA, 19 nt, Human
auuuggaaauaaggucuuc

SEQ ID NO: 260647 - RNA, 22 nt, Human
ugucacaucaggugguggcugu

SEQ ID NO: 260648 - RNA, 22 nt, Human
gcuguacauucugcacaggccc

SEQ ID NO: 260649 - RNA, 22 nt, Human
aagggacauagacuguacaucu

SEQ ID NO: 260650 - RNA, 22 nt, Human
uauuggucugcuuaaguggauu

SEQ ID NO: 260651 - RNA, 22 nt, Human
guggucagagaugacagugggu

SEQ ID NO: 260652 - RNA, 22 nt, Human
aggcaagcugcagagaguccuu

SEQ ID NO: 260653 - RNA, 22 nt, Human
gcuccuggauguucaagucggc

SEQ ID NO: 260654 - RNA, 22 nt, Human
uucagaaaaaacuucaauaagu

SEQ ID NO: 260655 - RNA, 22 nt, Human
uggcagcuccggguaggggcug

SEQ ID NO: 260656 - RNA, 22 nt, Human
agugcaacuucacguagaguac

SEQ ID NO: 260657 - RNA, 22 nt, Human
agggagaaaauuggaugcacaa

SEQ ID NO: 260658 - RNA, 21 nt, Human
uggaaggcugcucugccaggg

SEQ ID NO: 260659 - RNA, 22 nt, Human
cucagggcuugaguguccagga

SEQ ID NO: 260660 - RNA, 23 nt, Human
acagaugaaaguguggcucagag

SEQ ID NO: 260661 - RNA, 22 nt, Human
aaggaccuauauugucagagga

SEQ ID NO: 260662 - RNA, 22 nt, Human
ugaaggcauaaaucuugggaac

SEQ ID NO: 260663 - RNA, 22 nt, Human
cucauaaggagcucacaaccua

SEQ ID NO: 260664 - RNA, 22 nt, Human
uauccacacucaaggggagggg

SEQ ID NO: 260665 - RNA, 22 nt, Human
ccuggagcacucucccuggcug

SEQ ID NO: 260666 - RNA, 22 nt, Human
uguauuuucugaagauaaucaa

SEQ ID NO: 260667 - RNA, 22 nt, Human
gguggauggacucucgggggcc

SEQ ID NO: 260668 - RNA, 22 nt, Human
ucccagagugugggcaucaagg

SEQ ID NO: 260669 - RNA, 22 nt, Human
auggcugcaucauccugguuga

SEQ ID NO: 260670 - RNA, 22 nt, Human
aacuuucuuucacagaaguauc

SEQ ID NO: 260671 - RNA, 22 nt, Human
ccagccucacuggcaucaccua

SEQ ID NO: 260672 - RNA, 23 nt, Human
cuucucagaagucugugccagga

SEQ ID NO: 260673 - RNA, 22 nt, Human
aggcuggguaccugucauaugc

SEQ ID NO: 260674 - RNA, 18 nt, Human
ggagagugacagagucgu

SEQ ID NO: 260675 - RNA, 22 nt, Human
gaauguaauagucaguagaaca

SEQ ID NO: 260676 - RNA, 22 nt, Human
aggucacauggauaaugaucag

SEQ ID NO: 260677 - RNA, 22 nt, Human
augcaacaauguauuuauguau

SEQ ID NO: 260678 - RNA, 22 nt, Human
aucuaagaggaugguuggaaau

SEQ ID NO: 260679 - RNA, 22 nt, Human
gaaaggagaggguuaaggagcu

SEQ ID NO: 260680 - RNA, 20 nt, Human
guacucagaucaagucagcu

SEQ ID NO: 260681 - RNA, 22 nt, Human
ggaauguuuuagcuugacuuuu

SEQ ID NO: 260682 - RNA, 22 nt, Human
agaggccuaaccaagauguccu

SEQ ID NO: 260683 - RNA, 22 nt, Human
ccugcagguugcagaggcggaa

SEQ ID NO: 260684 - RNA, 22 nt, Human
cugcuuccaugcaauggcaguc

SEQ ID NO: 260685 - RNA, 22 nt, Human
uacuacaagggcccuaaaaggu

SEQ ID NO: 260686 - RNA, 22 nt, Human
ugagaacaguuggaagcaguca

SEQ ID NO: 260687 - RNA, 21 nt, Human
uuuauuaacaacuguggacgu

SEQ ID NO: 260688 - RNA, 22 nt, Human
uuuauucacucauucagccagu

SEQ ID NO: 260689 - RNA, 22 nt, Human
ucuucuuccucauuuauacaua

SEQ ID NO: 260690 - RNA, 17 nt, Human
aagacaagacaaaugca

SEQ ID NO: 260691 - RNA, 22 nt, Human
ggcugcugacaaacaugaucau

SEQ ID NO: 260692 - RNA, 22 nt, Human
gcuuuuggaccucugauguuuc

SEQ ID NO: 260693 - RNA, 22 nt, Human
augcauugcugcuuucaaaaca

SEQ ID NO: 260694 - RNA, 22 nt, Human
caaggcagcguuccuuucugga

SEQ ID NO: 260695 - RNA, 20 nt, Human
uggcccaguggggcagggug

SEQ ID NO: 260696 - RNA, 22 nt, Human
auuuacugcuugacacauuggu

SEQ ID NO: 260697 - RNA, 22 nt, Human
aaaugugcuugugaucagcugu

SEQ ID NO: 260698 - RNA, 22 nt, Human
cucaggccugaguggcaguccc

SEQ ID NO: 260699 - RNA, 22 nt, Human
ugagacagcagucagggaaaua

SEQ ID NO: 260700 - RNA, 22 nt, Human
uccucccaacuuuuccaucuca

SEQ ID NO: 260701 - RNA, 22 nt, Human
gccuggcucccucugcagcucc

SEQ ID NO: 260702 - RNA, 22 nt, Human
uuacauauuauccaaaacugcu

SEQ ID NO: 260703 - RNA, 22 nt, Human
ccacgagggaaccagguggggu

SEQ ID NO: 260704 - RNA, 22 nt, Human
caugagcugcugggagccuguc

SEQ ID NO: 260705 - RNA, 22 nt, Human
cagcccugcucuuagugucucc

SEQ ID NO: 260706 - RNA, 22 nt, Human
uagaacacuugaccacugcucc

SEQ ID NO: 260707 - RNA, 22 nt, Human
aguugggaguuauagacucuau

SEQ ID NO: 260708 - RNA, 22 nt, Human
acccugggugagaggcaaacag

SEQ ID NO: 260709 - RNA, 22 nt, Human
caggccuccuaugagcacuagc

SEQ ID NO: 260710 - RNA, 22 nt, Human
caggcucccugggcaguggcag

SEQ ID NO: 260711 - RNA, 22 nt, Human
cagaguccugcaccagcuccag

SEQ ID NO: 260712 - RNA, 22 nt, Human
uugcagggccuuggcuucuucc

SEQ ID NO: 260713 - RNA, 22 nt, Human
ggcagguguggugaccagagau

SEQ ID NO: 260714 - RNA, 23 nt, Human
caugaagguagcacaaagccucu

SEQ ID NO: 260715 - RNA, 18 nt, Human
ccagguggugacagagau

SEQ ID NO: 260716 - RNA, 22 nt, Human
ccuggcugagccuccaggaaga

SEQ ID NO: 260717 - RNA, 22 nt, Human
ccagcagggaaaaacccaccaa

SEQ ID NO: 260718 - RNA, 22 nt, Human
uggagcaggaagucuauggcug

SEQ ID NO: 260719 - RNA, 22 nt, Human
uccaggccuggcuccauucagu

SEQ ID NO: 260720 - RNA, 22 nt, Human
auaugcacacucugcccacaga

SEQ ID NO: 260721 - RNA, 22 nt, Human
gcugcaggcagaaucucccaau

SEQ ID NO: 260722 - RNA, 23 nt, Human
gaaaucuagucauuuuuagucug

SEQ ID NO: 260723 - RNA, 22 nt, Human
ugcagaguccucuggagggacu

SEQ ID NO: 260724 - RNA, 22 nt, Human
agcuccugggccaagcccaugc

SEQ ID NO: 260725 - RNA, 22 nt, Human
uagaaaugcccagauucugcua

SEQ ID NO: 260726 - RNA, 22 nt, Human
gaucaauacuauuaagaucaua

SEQ ID NO: 260727 - RNA, 22 nt, Human
uaugaaaugauggggaaaauag

SEQ ID NO: 260728 - RNA, 22 nt, Human
aaauguaagucuuuguuucuua

SEQ ID NO: 260729 - RNA, 22 nt, Human
uacaacacugguucgacaugug

SEQ ID NO: 260730 - RNA, 22 nt, Human
aaaggccacuugaaggauuuuu

SEQ ID NO: 260731 - RNA, 22 nt, Human
ccaggccugauugggaaucuug

SEQ ID NO: 260732 - RNA, 22 nt, Human
uucuaggaagggaagcauggca

SEQ ID NO: 260733 - RNA, 22 nt, Human
ccuggucagagcagucaggauc

SEQ ID NO: 260734 - RNA, 22 nt, Human
acagauuuugguauuugcaaug

SEQ ID NO: 260735 - RNA, 20 nt, Human
cuacacuuggcaccuggcau

SEQ ID NO: 260736 - RNA, 22 nt, Human
ccauuggagaguuuuaagaagg

SEQ ID NO: 260737 - RNA, 22 nt, Human
ugcaucaaaacuggacuccuuc

SEQ ID NO: 260738 - RNA, 22 nt, Human
aaacugaguaccucugcauuca

SEQ ID NO: 260739 - RNA, 22 nt, Human
gaagucugccugccuucucugu

SEQ ID NO: 260740 - RNA, 22 nt, Human
gcagcuaccacccaggaaggac

SEQ ID NO: 260741 - RNA, 22 nt, Human
ucuggcuuggcuggcaucucug

SEQ ID NO: 260742 - RNA, 22 nt, Human
cuagaaguuggggcuagggaua

SEQ ID NO: 260743 - RNA, 22 nt, Human
ucucuaaagccuggaagaggag

SEQ ID NO: 260744 - RNA, 22 nt, Human
caucuuuaauuugugacaacua

SEQ ID NO: 260745 - RNA, 22 nt, Human
acucagcuaaacucagucuaug

SEQ ID NO: 260746 - RNA, 22 nt, Human
cuuggucuugggagcagggaca

SEQ ID NO: 260747 - RNA, 21 nt, Human
uaugguaaccagacaagaaug

SEQ ID NO: 260748 - RNA, 21 nt, Human
uggcucccuugaauugucugu

SEQ ID NO: 260749 - RNA, 22 nt, Human
guucucauaguggaaaauaggu

SEQ ID NO: 260750 - RNA, 22 nt, Human
uuugcaaaaugaggugaagagu

SEQ ID NO: 260751 - RNA, 17 nt, Human
uggcuucagauguacau

SEQ ID NO: 260752 - RNA, 22 nt, Human
guaacagaggguuugcagauau

SEQ ID NO: 260753 - RNA, 22 nt, Human
cucauuaaaggaaaucaccugc

SEQ ID NO: 260754 - RNA, 22 nt, Human
ucaggcaccccuugaguagggg

SEQ ID NO: 260755 - RNA, 22 nt, Human
aggccagggucccacacucgca

SEQ ID NO: 260756 - RNA, 22 nt, Human
ggccuucacgugaccuggcgug

SEQ ID NO: 260757 - RNA, 22 nt, Human
uucuuucugaauacaguugagu

SEQ ID NO: 260758 - RNA, 23 nt, Human
gugagcagcaccaugaggcuaga

SEQ ID NO: 260759 - RNA, 22 nt, Human
gggggcggagcacgugaccacg

SEQ ID NO: 260760 - RNA, 22 nt, Human
ucagguguauugaugucuguga

SEQ ID NO: 260761 - RNA, 22 nt, Human
aaacugacaaucucaguccuau

SEQ ID NO: 260762 - RNA, 22 nt, Human
ucauugaagcccuugacaagcc

SEQ ID NO: 260763 - RNA, 22 nt, Human
gcucuggcuacuccacccuguu

SEQ ID NO: 260764 - RNA, 22 nt, Human
ccacaucucuugauguaccuac

SEQ ID NO: 260765 - RNA, 22 nt, Human
cucuuuggcuuugacucccauu

SEQ ID NO: 260766 - RNA, 22 nt, Human
ucauguguccuaguucauauaa

SEQ ID NO: 260767 - RNA, 19 nt, Human
ucccaagauuucuguauca

SEQ ID NO: 260768 - RNA, 22 nt, Human
aguaugcauauuucaaaguaag

SEQ ID NO: 260769 - RNA, 22 nt, Human
uaaguaaauuuauaaugugauu

SEQ ID NO: 260770 - RNA, 22 nt, Human
cacacaucuuaucccaguuauu

SEQ ID NO: 260771 - RNA, 22 nt, Human
agcuguuuuugucugcugaucc

SEQ ID NO: 260772 - RNA, 22 nt, Human
cagagagaggggcugccuggcc

SEQ ID NO: 260773 - RNA, 22 nt, Human
ucuuuguaaaugccuagcauaa

SEQ ID NO: 260774 - RNA, 22 nt, Human
gacacaggaaucaccuuggaug

SEQ ID NO: 260775 - RNA, 22 nt, Human
acaaugcauaccuagcagcuca

SEQ ID NO: 260776 - RNA, 22 nt, Human
agcagcugccacuggaauagga

SEQ ID NO: 260777 - RNA, 22 nt, Human
gagcugaauugaagcaaggagc

SEQ ID NO: 260778 - RNA, 22 nt, Human
ccugcuggccaguggagggcug

SEQ ID NO: 260779 - RNA, 22 nt, Human
agagccuggacuuuucugagcc

SEQ ID NO: 260780 - RNA, 22 nt, Human
uggaagggagcuggaauuugga

SEQ ID NO: 260781 - RNA, 22 nt, Human
aggcucuggcaacagcuggugu

SEQ ID NO: 260782 - RNA, 22 nt, Human
cagcuauuaauguuuuugcuga

SEQ ID NO: 260783 - RNA, 22 nt, Human
ccugguugagggagguguggac

SEQ ID NO: 260784 - RNA, 22 nt, Human
gcugagcuagcuaucucagucu

SEQ ID NO: 260785 - RNA, 22 nt, Human
aagcugaaauuccuccugaaau

SEQ ID NO: 260786 - RNA, 22 nt, Human
gucuggcuuugcucagaugcug

SEQ ID NO: 260787 - RNA, 22 nt, Human
agcccagggaguugauuagcau

SEQ ID NO: 260788 - RNA, 19 nt, Human
cagcccucuuaccacugug

SEQ ID NO: 260789 - RNA, 22 nt, Human
augcaacauccaauuccuuuug

SEQ ID NO: 260790 - RNA, 19 nt, Human
uggaagaggaagggaaaua

SEQ ID NO: 260791 - RNA, 22 nt, Human
agcuugaagccuuggcgagauu

SEQ ID NO: 260792 - RNA, 22 nt, Human
agguccugggaguucuagugug

SEQ ID NO: 260793 - RNA, 22 nt, Human
augaggcucucaacaccuugag

SEQ ID NO: 260794 - RNA, 22 nt, Human
uuugaacaugcugcaugauaau

SEQ ID NO: 260795 - RNA, 22 nt, Human
uucucuggccauagcuggcuag

SEQ ID NO: 260796 - RNA, 18 nt, Human
ggagcccacggcguccca

SEQ ID NO: 260797 - RNA, 22 nt, Human
guucaaauuuucuaggugggug

SEQ ID NO: 260798 - RNA, 22 nt, Human
uucugcagcaugaggcuggagc

SEQ ID NO: 260799 - RNA, 19 nt, Human
ggcugucucggcccagcca

SEQ ID NO: 260800 - RNA, 22 nt, Human
gacuacucaaacuuucucuaua

SEQ ID NO: 260801 - RNA, 22 nt, Human
cuggguguagcccaguaugagg

SEQ ID NO: 260802 - RNA, 22 nt, Human
uccaggcugugcgcaccgugug

SEQ ID NO: 260803 - RNA, 22 nt, Human
uggagcucaaaggccuguggga

SEQ ID NO: 260804 - RNA, 22 nt, Human
uucccagaaugaauggauggag

SEQ ID NO: 260805 - RNA, 20 nt, Human
uccaggccuuguucucagau

SEQ ID NO: 260806 - RNA, 22 nt, Human
ccacaguacaggaaaucuuguu

SEQ ID NO: 260807 - RNA, 22 nt, Human
agauguaccagguauuacagga

SEQ ID NO: 260808 - RNA, 19 nt, Human
ucucuggaugacagacacu

SEQ ID NO: 260809 - RNA, 22 nt, Human
ugaggugguuuguaucacuggg

SEQ ID NO: 260810 - RNA, 22 nt, Human
guuuacuguuuucugauaagug

SEQ ID NO: 260811 - RNA, 22 nt, Human
cugggccacaucagaugaagac

SEQ ID NO: 260812 - RNA, 22 nt, Human
gcccucagugaccacugauuca

SEQ ID NO: 260813 - RNA, 22 nt, Human
gcuucucggggagguuagccag

SEQ ID NO: 260814 - RNA, 22 nt, Human
aauaauuuuagcucagaguugu

SEQ ID NO: 260815 - RNA, 22 nt, Human
aagugcaugguauggucuccau

SEQ ID NO: 260816 - RNA, 22 nt, Human
ugcccugggaguuggagcugcu

SEQ ID NO: 260817 - RNA, 22 nt, Human
uuccaggcucccuuggaggugu

SEQ ID NO: 260818 - RNA, 22 nt, Human
gucagaggggacaagacacaga

SEQ ID NO: 260819 - RNA, 22 nt, Human
aagcagaguuagcuugucaccu

SEQ ID NO: 260820 - RNA, 22 nt, Human
ccacagagagugucagccuuug

SEQ ID NO: 260821 - RNA, 22 nt, Human
aaguuccucuucucugcaggga

SEQ ID NO: 260822 - RNA, 22 nt, Human
aggagccaguggaguuccugcc

SEQ ID NO: 260823 - RNA, 22 nt, Human
ccaagcaaauaaucacccacua

SEQ ID NO: 260824 - RNA, 22 nt, Human
uggaaaaaacccagacucuaga

SEQ ID NO: 260825 - RNA, 22 nt, Human
aaggcuccagugaaugcuggca

SEQ ID NO: 260826 - RNA, 22 nt, Human
auauuaaauggauuuugggagc

SEQ ID NO: 260827 - RNA, 20 nt, Human
cacaggccccaagaccugua

SEQ ID NO: 260828 - RNA, 22 nt, Human
auugcuuuuaagcaccaccuaa

SEQ ID NO: 260829 - RNA, 22 nt, Human
ugacaagagaccccuccgcagg

SEQ ID NO: 260830 - RNA, 22 nt, Human
gucucagagagcuacucucuua

SEQ ID NO: 260831 - RNA, 22 nt, Human
auuuauugaagcuuauuacguu

SEQ ID NO: 260832 - RNA, 22 nt, Human
augcuuuauguucuggcauuuu

SEQ ID NO: 260833 - RNA, 22 nt, Human
gaaaucuacgauuagugaaaau

SEQ ID NO: 260834 - RNA, 22 nt, Human
cagcuauuggcaagaaguggug

SEQ ID NO: 260835 - RNA, 22 nt, Human
agcuguggggcaggcagcgagg

SEQ ID NO: 260836 - RNA, 22 nt, Human
auuauucauugguaggcaagcu

SEQ ID NO: 260837 - RNA, 22 nt, Human
acagacuggagcccuuuugccc

SEQ ID NO: 260838 - RNA, 23 nt, Human
cccaggagccugaguccucucug

SEQ ID NO: 260839 - RNA, 22 nt, Human
ucaggaagugcugaggcugcuu

SEQ ID NO: 260840 - RNA, 22 nt, Human
ccagaggcuggcagccagcuga

SEQ ID NO: 260841 - RNA, 22 nt, Human
acaugauuuuaguaucauaaua

SEQ ID NO: 260842 - RNA, 22 nt, Human
cggcuucuucgaggugucugcg

SEQ ID NO: 260843 - RNA, 22 nt, Human
ucacagaaacagaauggcacag

SEQ ID NO: 260844 - RNA, 22 nt, Human
agggagaggcugaacuauccua

SEQ ID NO: 260845 - RNA, 22 nt, Human
acuguuaaaguaauuaauuguc

SEQ ID NO: 260846 - RNA, 19 nt, Human
agcaggcuaggcugccucu

SEQ ID NO: 260847 - RNA, 22 nt, Human
gaccuucuugcuguguccuaac

SEQ ID NO: 260848 - RNA, 22 nt, Human
gcagcccacaccacucugcuca

SEQ ID NO: 260849 - RNA, 22 nt, Human
ucagagaagguaagugaccugc

SEQ ID NO: 260850 - RNA, 22 nt, Human
ugggcugcugcggugcucuugg

SEQ ID NO: 260851 - RNA, 22 nt, Human
agacccucuccaugcccacugc

SEQ ID NO: 260852 - RNA, 22 nt, Human
ucuguucaucucaugggagaau

SEQ ID NO: 260853 - RNA, 22 nt, Human
aacagcgucuuuccagcuguuc

SEQ ID NO: 260854 - RNA, 22 nt, Human
aacauguugaguugaaaguagc

SEQ ID NO: 260855 - RNA, 23 nt, Human
uggccacaguccaugcaugccca

SEQ ID NO: 260856 - RNA, 23 nt, Human
ggagugcaauggcgccaucucgg

SEQ ID NO: 260857 - RNA, 22 nt, Human
uugaaacugcuuauugaauuug

SEQ ID NO: 260858 - RNA, 22 nt, Human
aaagcuuaagguagguacagag

SEQ ID NO: 260859 - RNA, 22 nt, Human
gcaaagcaaucaggaguagcau

SEQ ID NO: 260860 - RNA, 22 nt, Human
agcaggaacucagggaguucuc

SEQ ID NO: 260861 - RNA, 22 nt, Human
aaaguagaggcauugaucaggu

SEQ ID NO: 260862 - RNA, 22 nt, Human
aucauuuuuaagagacucuucu

SEQ ID NO: 260863 - RNA, 22 nt, Human
uucucuuagcuguaaagucaau

SEQ ID NO: 260864 - RNA, 22 nt, Human
cauuuauucucagauccuuguc

SEQ ID NO: 260865 - RNA, 22 nt, Human
uagaggcaaccaguguugagaa

SEQ ID NO: 260866 - RNA, 22 nt, Human
uccaggucuggccugcuaggca

SEQ ID NO: 260867 - RNA, 22 nt, Human
uuaaaugugauccugguaugca

SEQ ID NO: 260868 - RNA, 22 nt, Human
aaagacuuggcuuaugauuugc

SEQ ID NO: 260869 - RNA, 22 nt, Human
ucuguggcuuccuauuucuugg

SEQ ID NO: 260870 - RNA, 22 nt, Human
ucuccuggauggaccuucucuu

SEQ ID NO: 260871 - RNA, 22 nt, Human
ucuuuguggcgggcuuaaauac

SEQ ID NO: 260872 - RNA, 22 nt, Human
cccaggcaguagaaagaagagg

SEQ ID NO: 260873 - RNA, 22 nt, Human
agcaggguccugaggugaguca

SEQ ID NO: 260874 - RNA, 22 nt, Human
agugggcauaugaagucucaag

SEQ ID NO: 260875 - RNA, 22 nt, Human
cagcuugugucauucaucuugu

SEQ ID NO: 260876 - RNA, 22 nt, Human
aacagagaucuuaauuccugua

SEQ ID NO: 260877 - RNA, 22 nt, Human
cuuccaguggcaccaacaugca

SEQ ID NO: 260878 - RNA, 22 nt, Human
caggauggagagugagggguca

SEQ ID NO: 260879 - RNA, 22 nt, Human
cuguccuguggaccugaggacg

SEQ ID NO: 260880 - RNA, 22 nt, Human
accagccaagacugccuggaau

SEQ ID NO: 260881 - RNA, 22 nt, Human
auuuaugauuagccuauuguug

SEQ ID NO: 260882 - RNA, 22 nt, Human
uuguugcucuuguugccacaug

SEQ ID NO: 260883 - RNA, 22 nt, Human
uccuuggggacgcugacaucgu

SEQ ID NO: 260884 - RNA, 22 nt, Human
agcaucugugauauuuuguuau

SEQ ID NO: 260885 - RNA, 22 nt, Human
aaaauuuccaccaucuuugugu

SEQ ID NO: 260886 - RNA, 22 nt, Human
gaguuauaaccuaguuuaacug

SEQ ID NO: 260887 - RNA, 22 nt, Human
cagucccagcugcucagaaggc

SEQ ID NO: 260888 - RNA, 22 nt, Human
ugacauacuuuuagauagaugg

SEQ ID NO: 260889 - RNA, 22 nt, Human
agucagcugcagcagcuuuggu

SEQ ID NO: 260890 - RNA, 22 nt, Human
aggucuggugggcuuuagauug

SEQ ID NO: 260891 - RNA, 22 nt, Human
ccugguuuuucaaacauacaag

SEQ ID NO: 260892 - RNA, 22 nt, Human
aacaaagaugggugggaaagag

SEQ ID NO: 260893 - RNA, 22 nt, Human
ugugaaggagaugaagggagug

SEQ ID NO: 260894 - RNA, 22 nt, Human
uuuccaaagguggcaggaacaa

SEQ ID NO: 260895 - RNA, 22 nt, Human
gcuaguccacagccauccaggc

SEQ ID NO: 260896 - RNA, 23 nt, Human
uugcauguagcccaugaguaacu

SEQ ID NO: 260897 - RNA, 22 nt, Human
cccagccuggugcacugugggg

SEQ ID NO: 260898 - RNA, 23 nt, Human
cuguccugccauccacagcggcc

SEQ ID NO: 260899 - RNA, 22 nt, Human
uggaggagaccauuccacucag

SEQ ID NO: 260900 - RNA, 23 nt, Human
uuucaguuccagaaaaggggagc

SEQ ID NO: 260901 - RNA, 22 nt, Human
ccaggagaugggagcaucuaaa

SEQ ID NO: 260902 - RNA, 22 nt, Human
aagagcccugguugaaaauaac

SEQ ID NO: 260903 - RNA, 22 nt, Human
cagagcugcuucccaguuugug

SEQ ID NO: 260904 - RNA, 19 nt, Human
ucaaagcaagcauguucug

SEQ ID NO: 260905 - RNA, 22 nt, Human
accugcaagcauuacacuucua

SEQ ID NO: 260906 - RNA, 22 nt, Human
aagccagguguugugguaagag

SEQ ID NO: 260907 - RNA, 20 nt, Human
uucaugggagcaaagaggcc

SEQ ID NO: 260908 - RNA, 23 nt, Human
ugcacuucuccauagaugcaucu

SEQ ID NO: 260909 - RNA, 22 nt, Human
gcuccuccaauauggacuccuc

SEQ ID NO: 260910 - RNA, 22 nt, Human
cagcaggaggcauggcuucccu

SEQ ID NO: 260911 - RNA, 22 nt, Human
ugcaggugagugcaggggcuca

SEQ ID NO: 260912 - RNA, 22 nt, Human
cccagagagcauuuggacaaag

SEQ ID NO: 260913 - RNA, 22 nt, Human
cuggccugggagcugcuagcgu

SEQ ID NO: 260914 - RNA, 22 nt, Human
augauucuaggcauugaagaua

SEQ ID NO: 260915 - RNA, 22 nt, Human
gacagguggggaaacuaaggua

SEQ ID NO: 260916 - RNA, 22 nt, Human
uuggaaaacuuacacagagcug

SEQ ID NO: 260917 - RNA, 22 nt, Human
cugcuguccaggagugcccugu

SEQ ID NO: 260918 - RNA, 22 nt, Human
ucuggcagaaggcagaaauuca

SEQ ID NO: 260919 - RNA, 20 nt, Human
ugacuucuucaugcuguacu

SEQ ID NO: 260920 - RNA, 22 nt, Human
agaaugcuuccuuugaaacuga

SEQ ID NO: 260921 - RNA, 22 nt, Human
cugccaggcagggagauggcug

SEQ ID NO: 260922 - RNA, 20 nt, Human
gucagaggacccuagagcga

SEQ ID NO: 260923 - RNA, 22 nt, Human
gcauguguuagagugugcaugc

SEQ ID NO: 260924 - RNA, 22 nt, Human
uguuacuccuucccuacucaug

SEQ ID NO: 260925 - RNA, 22 nt, Human
ucugccuggguguggagcagag

SEQ ID NO: 260926 - RNA, 22 nt, Human
uuuccuucaucaucugagagcu

SEQ ID NO: 260927 - RNA, 20 nt, Human
uccagaggccacauccagug

SEQ ID NO: 260928 - RNA, 22 nt, Human
cagcagaagcaacauucaggcu

SEQ ID NO: 260929 - RNA, 22 nt, Human
ugccagggugucaggagagcua

SEQ ID NO: 260930 - RNA, 22 nt, Human
ugcuggcuguucuagggaggcc

SEQ ID NO: 260931 - RNA, 22 nt, Human
gaggcuucuggaaagccuggca

SEQ ID NO: 260932 - RNA, 22 nt, Human
caagauaucaaugacauaguau

SEQ ID NO: 260933 - RNA, 22 nt, Human
ucagucuuucccucccucaguu

SEQ ID NO: 260934 - RNA, 22 nt, Human
caggagcuggauaggaccacaa

SEQ ID NO: 260935 - RNA, 22 nt, Human
aauaccuuccaacaucaagaca

SEQ ID NO: 260936 - RNA, 22 nt, Human
aagcugcagacccccugucuca

SEQ ID NO: 260937 - RNA, 22 nt, Human
ucucugggccucccuuuccaag

SEQ ID NO: 260938 - RNA, 23 nt, Human
agcaaucuguguuucagcaagcc

SEQ ID NO: 260939 - RNA, 22 nt, Human
ccuggagccccucuggccagcc

SEQ ID NO: 260940 - RNA, 22 nt, Human
ucccuaggaccccaccuuccgc

SEQ ID NO: 260941 - RNA, 22 nt, Human
uacaugcaauuaagagggugaa

SEQ ID NO: 260942 - RNA, 22 nt, Human
gauguagacacuuggaggcuua

SEQ ID NO: 260943 - RNA, 22 nt, Human
aguuuggaaaaugagacaagga

SEQ ID NO: 260944 - RNA, 22 nt, Human
ugcaggagauaauggugcuuag

SEQ ID NO: 260945 - RNA, 22 nt, Human
uagcaaaggccuuggacacgcu

SEQ ID NO: 260946 - RNA, 22 nt, Human
gcuugggacuggagaauagggu

SEQ ID NO: 260947 - RNA, 23 nt, Human
gacaccaggcguggcccucgaca

SEQ ID NO: 260948 - RNA, 22 nt, Human
gccaaagugcugcucuuuacca

SEQ ID NO: 260949 - RNA, 22 nt, Human
cagccaagaaagcagugcucca

SEQ ID NO: 260950 - RNA, 22 nt, Human
auguuuauggagcagguauuag

SEQ ID NO: 260951 - RNA, 22 nt, Human
caggcuugcugcuagagcacuu

SEQ ID NO: 260952 - RNA, 22 nt, Human
cggggcaggagucccuguagag

SEQ ID NO: 260953 - RNA, 23 nt, Human
agcugcaagacucccugucugag

SEQ ID NO: 260954 - RNA, 22 nt, Human
uuuagggaugucagaacaggga

SEQ ID NO: 260955 - RNA, 22 nt, Human
acucuguaucccucucaaauug

SEQ ID NO: 260956 - RNA, 17 nt, Human
uguuuucauucauugcu

SEQ ID NO: 260957 - RNA, 18 nt, Human
uggguggcuagggaguuu

SEQ ID NO: 260958 - RNA, 22 nt, Human
acauuucucuuagaguuggacu

SEQ ID NO: 260959 - RNA, 22 nt, Human
uucaacaaggcugucaaaaguu

SEQ ID NO: 260960 - RNA, 23 nt, Human
cauguuuuucuaucucagcgugu

SEQ ID NO: 260961 - RNA, 22 nt, Human
cugcccuguggcucugagucau

SEQ ID NO: 260962 - RNA, 22 nt, Human
ccccagggacugguuucaugga

SEQ ID NO: 260963 - RNA, 22 nt, Human
gcugucugcugugcacugagca

SEQ ID NO: 260964 - RNA, 22 nt, Human
agacaagaaacugggagucucu

SEQ ID NO: 260965 - RNA, 23 nt, Human
uggaaacauucugaauguccauc

SEQ ID NO: 260966 - RNA, 22 nt, Human
ugauauuugcugacugcauugu

SEQ ID NO: 260967 - RNA, 22 nt, Human
agccuggguuuuuauuaaggag

SEQ ID NO: 260968 - RNA, 20 nt, Human
agguccugggacuggcagag

SEQ ID NO: 260969 - RNA, 22 nt, Human
caaaugcauagaaagaugaaac

SEQ ID NO: 260970 - RNA, 22 nt, Human
gaggaugcugcagugcaggaca

SEQ ID NO: 260971 - RNA, 21 nt, Human
ucaggcugaugucgauguuag

SEQ ID NO: 260972 - RNA, 22 nt, Human
gcuggucuccgccgcucccuga

SEQ ID NO: 260973 - RNA, 22 nt, Human
ucaagaaagggcuucaccagga

SEQ ID NO: 260974 - RNA, 22 nt, Human
ugccaggcccagcuccagagcu

SEQ ID NO: 260975 - RNA, 22 nt, Human
cugaagccacgauagcuuccua

SEQ ID NO: 260976 - RNA, 22 nt, Human
ucauuucccuccuacaaagagg

SEQ ID NO: 260977 - RNA, 22 nt, Human
ggcuacuagguaccauuuagaa

SEQ ID NO: 260978 - RNA, 22 nt, Human
agcagcaggagccgugggguga

SEQ ID NO: 260979 - RNA, 22 nt, Human
agccuugcuuuuucaguagcac

SEQ ID NO: 260980 - RNA, 22 nt, Human
cagagcuuugugucagggcugu

SEQ ID NO: 260981 - RNA, 22 nt, Human
ugaguagagaauucagcuaagg

SEQ ID NO: 260982 - RNA, 22 nt, Human
agaaauaugcugauuagaugaa

SEQ ID NO: 260983 - RNA, 22 nt, Human
ugccaggaggaggugggacaga

SEQ ID NO: 260984 - RNA, 22 nt, Human
cccauuuaucccaagguuacuc

SEQ ID NO: 260985 - RNA, 19 nt, Human
ugguggaggccccauguuc

SEQ ID NO: 260986 - RNA, 22 nt, Human
gggcuuggccccagaagagcua

SEQ ID NO: 260987 - RNA, 22 nt, Human
ucucuucuaacacuagaaauuc

SEQ ID NO: 260988 - RNA, 22 nt, Human
uucucuagcaaaaccagcuagu

SEQ ID NO: 260989 - RNA, 22 nt, Human
uucuaagaggcuaaugaagaau

SEQ ID NO: 260990 - RNA, 22 nt, Human
uuaauagauaugccucuagagu

SEQ ID NO: 260991 - RNA, 22 nt, Human
aaauucauauguugaaaugcua

SEQ ID NO: 260992 - RNA, 22 nt, Human
uaacauaacuuuuccuugaccc

SEQ ID NO: 260993 - RNA, 22 nt, Human
aauguguuacuguguaagagca

SEQ ID NO: 260994 - RNA, 22 nt, Human
ucagcugccccaguggccccag

SEQ ID NO: 260995 - RNA, 18 nt, Human
uagggcucuagggaguga

SEQ ID NO: 260996 - RNA, 19 nt, Human
ucuccaggcaggugagcga

SEQ ID NO: 260997 - RNA, 22 nt, Human
ugcauugaggggcucucuuccu

SEQ ID NO: 260998 - RNA, 22 nt, Human
aagaaucuguugauuccccacu

SEQ ID NO: 260999 - RNA, 22 nt, Human
aaguguggggucucagagcuga

SEQ ID NO: 261000 - RNA, 22 nt, Human
cuggcauuuagacccacagcaa

SEQ ID NO: 261001 - RNA, 22 nt, Human
uggaugagaaacucuggugacu

SEQ ID NO: 261002 - RNA, 23 nt, Human
uggccaggguacuacacccaccc

SEQ ID NO: 261003 - RNA, 22 nt, Human
auggaguaauauuaacauguua

SEQ ID NO: 261004 - RNA, 22 nt, Human
gcccucagcuugauguuguucu

SEQ ID NO: 261005 - RNA, 22 nt, Human
ccagcuguuucugaugcuaggc

SEQ ID NO: 261006 - RNA, 23 nt, Human
ugaguucuaggcuuaaaacuagc

SEQ ID NO: 261007 - RNA, 22 nt, Human
acagcugggugucccacuucug

SEQ ID NO: 261008 - RNA, 22 nt, Human
gacccauaggaaucuguugucc

SEQ ID NO: 261009 - RNA, 22 nt, Human
gccuggcuccuaagagcacaac

SEQ ID NO: 261010 - RNA, 23 nt, Human
cucagugugugacccauggccuc

SEQ ID NO: 261011 - RNA, 22 nt, Human
gccuuacugagggcaauuuuga

SEQ ID NO: 261012 - RNA, 22 nt, Human
cuucuagauuuuuguaauuguu

SEQ ID NO: 261013 - RNA, 22 nt, Human
ucagcacuuuuacucucuuugc

SEQ ID NO: 261014 - RNA, 22 nt, Human
caaauagauuguucaauccuga

SEQ ID NO: 261015 - RNA, 19 nt, Human
gcuguauuaaagauacaug

SEQ ID NO: 261016 - RNA, 22 nt, Human
ucccuccuggccgucaccgcug

SEQ ID NO: 261017 - RNA, 22 nt, Human
caaggcuuaucagccaggagcc

SEQ ID NO: 261018 - RNA, 22 nt, Human
uauuucagcccuacuacuuggc

SEQ ID NO: 261019 - RNA, 22 nt, Human
ucauucuugcguaugccauggu

SEQ ID NO: 261020 - RNA, 20 nt, Human
uccugagccuccaccauguc

SEQ ID NO: 261021 - RNA, 22 nt, Human
aaguuuuccuguguccaagaug

SEQ ID NO: 261022 - RNA, 21 nt, Human
agacaaugcuguaaaauucag

SEQ ID NO: 261023 - RNA, 22 nt, Human
aagggauguaaacaugaauaag

SEQ ID NO: 261024 - RNA, 22 nt, Human
cuucagaggggacucaaaguca

SEQ ID NO: 261025 - RNA, 22 nt, Human
gacaagacagcuugcagacaac

SEQ ID NO: 261026 - RNA, 17 nt, Human
ccucuuccucucagcug

SEQ ID NO: 261027 - RNA, 22 nt, Human
cuggcacugaguggcuuaugac

SEQ ID NO: 261028 - RNA, 22 nt, Human
uguccaugggcgucaggcagga

SEQ ID NO: 261029 - RNA, 22 nt, Human
ugcucuggguucuugcuguuac

SEQ ID NO: 261030 - RNA, 22 nt, Human
ucagugucucauaugagguuuc

SEQ ID NO: 261031 - RNA, 22 nt, Human
uucauucuuugaaucugaggua

SEQ ID NO: 261032 - RNA, 22 nt, Human
auagcugacuccagacauagcu

SEQ ID NO: 261033 - RNA, 22 nt, Human
cccucccuauguagaugauguu

SEQ ID NO: 261034 - RNA, 22 nt, Human
ugacaagaggcagaaucagcug

SEQ ID NO: 261035 - RNA, 22 nt, Human
agccacccauucccgagcccua

SEQ ID NO: 261036 - RNA, 22 nt, Human
gguuccuucugaggucccugua

SEQ ID NO: 261037 - RNA, 22 nt, Human
aucuuugugcuaauguaguucu

SEQ ID NO: 261038 - RNA, 22 nt, Human
agcugggguugcacacauuuug

SEQ ID NO: 261039 - RNA, 22 nt, Human
ugccugugaucagcugaguuca

SEQ ID NO: 261040 - RNA, 22 nt, Human
ggagccugcgggagcucccauu

SEQ ID NO: 261041 - RNA, 22 nt, Human
auaaaugauucagcaggaaaua

SEQ ID NO: 261042 - RNA, 23 nt, Human
augaaugaauaaggcaggaaagc

SEQ ID NO: 261043 - RNA, 22 nt, Human
gccaggcagcugggagggugcc

SEQ ID NO: 261044 - RNA, 22 nt, Human
cagggcugagaauuuagagaca

SEQ ID NO: 261045 - RNA, 22 nt, Human
ucagagaauuguuuaauggaau

SEQ ID NO: 261046 - RNA, 22 nt, Human
uguccugucucuuuccuaauug

SEQ ID NO: 261047 - RNA, 22 nt, Human
aagauguuauugucuuccuugc

SEQ ID NO: 261048 - RNA, 22 nt, Human
ccuggcaugaggagcaugaggu

SEQ ID NO: 261049 - RNA, 22 nt, Human
gccccagguugccugucccagg

SEQ ID NO: 261050 - RNA, 22 nt, Human
acuucugagaaauuuaaggaca

SEQ ID NO: 261051 - RNA, 22 nt, Human
cuuacagugaucaacacaaaga

SEQ ID NO: 261052 - RNA, 22 nt, Human
uaguuuuuacugcgaguuauaa

SEQ ID NO: 261053 - RNA, 22 nt, Human
uaucuagauaguuuagccaucu

SEQ ID NO: 261054 - RNA, 22 nt, Human
ugcuuuaagagauuguuaguac

SEQ ID NO: 261055 - RNA, 22 nt, Human
ccucaagucaauucugucucgc

SEQ ID NO: 261056 - RNA, 22 nt, Human
caguccagcucaucaguggcac

SEQ ID NO: 261057 - RNA, 22 nt, Human
uuucuuuaauucucacagcaau

SEQ ID NO: 261058 - RNA, 22 nt, Human
ugacagggcuagaggcaaugca

SEQ ID NO: 261059 - RNA, 22 nt, Human
aauaagauugacacaaguaccu

SEQ ID NO: 261060 - RNA, 22 nt, Human
ggcuugggagcaggcaugugac

SEQ ID NO: 261061 - RNA, 22 nt, Human
guguguccaaggcacggaugac

SEQ ID NO: 261062 - RNA, 22 nt, Human
ugauucaacuuucauaacaaaa

SEQ ID NO: 261063 - RNA, 22 nt, Human
ucaggcuuugaagucuagcugg

SEQ ID NO: 261064 - RNA, 22 nt, Human
ugggcucagggaagcuuggccu

SEQ ID NO: 261065 - RNA, 22 nt, Human
acugucacuugcaacugugagg

SEQ ID NO: 261066 - RNA, 21 nt, Human
aaaugaaugugguagugcaag

SEQ ID NO: 261067 - RNA, 22 nt, Human
agcaucuuuaggaagagaaaga

SEQ ID NO: 261068 - RNA, 22 nt, Human
agugugaguaauugagucuguc

SEQ ID NO: 261069 - RNA, 22 nt, Human
ugaaacauuaggaaaucauuau

SEQ ID NO: 261070 - RNA, 22 nt, Human
uaagucguggaugauucuucgg

SEQ ID NO: 261071 - RNA, 22 nt, Human
ugggagcagccaacauggccuu

SEQ ID NO: 261072 - RNA, 22 nt, Human
ucagaggaaagggaacauaguc

SEQ ID NO: 261073 - RNA, 22 nt, Human
acugggccugauugggucggag

SEQ ID NO: 261074 - RNA, 22 nt, Human
agugcagagaccuggucaggca

SEQ ID NO: 261075 - RNA, 22 nt, Human
auuccugguggcagaaacauga

SEQ ID NO: 261076 - RNA, 22 nt, Human
uugagggagccugggagccaug

SEQ ID NO: 261077 - RNA, 22 nt, Human
uuccaugagcucugaguucaca

SEQ ID NO: 261078 - RNA, 22 nt, Human
guguucugggaugauuguagug

SEQ ID NO: 261079 - RNA, 22 nt, Human
cuugaaaugacaggagcacauc

SEQ ID NO: 261080 - RNA, 22 nt, Human
agccauccucccaccucagccu

SEQ ID NO: 261081 - RNA, 22 nt, Human
auguuacagagaaaguggaagc

SEQ ID NO: 261082 - RNA, 22 nt, Human
cagcagcuacuuggagcagcag

SEQ ID NO: 261083 - RNA, 19 nt, Human
augaaugagcugugagguu

SEQ ID NO: 261084 - RNA, 16 nt, Human
ggcuccagaauagcga

SEQ ID NO: 261085 - RNA, 22 nt, Human
ggguuucaugguucucacaaug

SEQ ID NO: 261086 - RNA, 22 nt, Human
cuuugcaaacugucacacuuuc

SEQ ID NO: 261087 - RNA, 22 nt, Human
gugcugggcccugagaccaggg

SEQ ID NO: 261088 - RNA, 22 nt, Human
cauuuguuuauaaguuccccag

SEQ ID NO: 261089 - RNA, 22 nt, Human
gagcccuggcagucugggaugg

SEQ ID NO: 261090 - RNA, 22 nt, Human
auuucuuacauaacaaauuguu

SEQ ID NO: 261091 - RNA, 22 nt, Human
cuggggcuggugaggcaggcuc

SEQ ID NO: 261092 - RNA, 22 nt, Human
uccugggaagacugugaggaca

SEQ ID NO: 261093 - RNA, 22 nt, Human
ccucaaauugucaaauaagaau

SEQ ID NO: 261094 - RNA, 22 nt, Human
agggacaguuacaucaucagac

SEQ ID NO: 261095 - RNA, 22 nt, Human
ucugcugucacucauuugcuuc

SEQ ID NO: 261096 - RNA, 22 nt, Human
uugugagcaggcugcacaaacc

SEQ ID NO: 261097 - RNA, 22 nt, Human
agaccuguuggguucauuggcu

SEQ ID NO: 261098 - RNA, 22 nt, Human
ucccaggcaaaggcagcucauu

SEQ ID NO: 261099 - RNA, 22 nt, Human
cuuucucugugugguaaagggc

SEQ ID NO: 261100 - RNA, 22 nt, Human
cacagcuucccaaaguggaccu

SEQ ID NO: 261101 - RNA, 22 nt, Human
gaggcuggaauauuagaaaugu

SEQ ID NO: 261102 - RNA, 22 nt, Human
ggcuucagaggggagguagugc

SEQ ID NO: 261103 - RNA, 20 nt, Human
agcugaggcaccugagguua

SEQ ID NO: 261104 - RNA, 22 nt, Human
acagauuuauugaagcugcugc

SEQ ID NO: 261105 - RNA, 22 nt, Human
aggccuggccuuuauguucaag

SEQ ID NO: 261106 - RNA, 22 nt, Human
gagccuuugaagcccucagaga

SEQ ID NO: 261107 - RNA, 22 nt, Human
aguuugaaagcuuaacaguaca

SEQ ID NO: 261108 - RNA, 21 nt, Human
agauuacaggugugauccacc

SEQ ID NO: 261109 - RNA, 22 nt, Human
ggagagaauuccauggacaugu

SEQ ID NO: 261110 - RNA, 22 nt, Human
caagucugucugcuccugugug

SEQ ID NO: 261111 - RNA, 22 nt, Human
auacagagacacuugagacugg

SEQ ID NO: 261112 - RNA, 19 nt, Human
caugugucaauacuguacc

SEQ ID NO: 261113 - RNA, 20 nt, Human
uuccuggggaaugauagaag

SEQ ID NO: 261114 - RNA, 22 nt, Human
ucaggcucagguuaggggccaa

SEQ ID NO: 261115 - RNA, 22 nt, Human
cuggcccauggugagcucuggg

SEQ ID NO: 261116 - RNA, 22 nt, Human
acagugucucacugcugaaauc

SEQ ID NO: 261117 - RNA, 22 nt, Human
uuuuagcacuaagugauaugcu

SEQ ID NO: 261118 - RNA, 22 nt, Human
ucugggugacccugggcaaggc

SEQ ID NO: 261119 - RNA, 22 nt, Human
ugacuuccagcaacuuccucca

SEQ ID NO: 261120 - RNA, 22 nt, Human
auugugcaauguuuuacaauuu

SEQ ID NO: 261121 - RNA, 20 nt, Human
uuuauucacagagaagaguu

SEQ ID NO: 261122 - RNA, 22 nt, Human
caaacauucaaguacaagucuu

SEQ ID NO: 261123 - RNA, 22 nt, Human
gcuauucaucaauuguucuagc

SEQ ID NO: 261124 - RNA, 22 nt, Human
caucucuccacggcagcucucg

SEQ ID NO: 261125 - RNA, 22 nt, Human
aguggagaagaggauggucucc

SEQ ID NO: 261126 - RNA, 22 nt, Human
cuuugaaagcucccaggacuua

SEQ ID NO: 261127 - RNA, 22 nt, Human
ugcugaggagggcacccggggg

SEQ ID NO: 261128 - RNA, 22 nt, Human
gaugcaaagauaaaacagacgc

SEQ ID NO: 261129 - RNA, 22 nt, Human
cugcaccacagccugaggcagc

SEQ ID NO: 261130 - RNA, 18 nt, Human
cucucugggugaggacaa

SEQ ID NO: 261131 - RNA, 22 nt, Human
cuauuaaacacuacugugcacu

SEQ ID NO: 261132 - RNA, 22 nt, Human
ccugugucaucagcuguggcua

SEQ ID NO: 261133 - RNA, 22 nt, Human
uagcccaggagaauugucuuuc

SEQ ID NO: 261134 - RNA, 22 nt, Human
ucuucaaauacagucauauuga

SEQ ID NO: 261135 - RNA, 22 nt, Human
cugggcucagcccaugcugucc

SEQ ID NO: 261136 - RNA, 18 nt, Human
auauccaauaaugaacac

SEQ ID NO: 261137 - RNA, 22 nt, Human
aggcugccuguuccaaucuccu

SEQ ID NO: 261138 - RNA, 22 nt, Human
uuagaaaugcacccaagaccua

SEQ ID NO: 261139 - RNA, 19 nt, Human
ccucacccugcagaggagg

SEQ ID NO: 261140 - RNA, 22 nt, Human
uaugaaaauuuagcugaagcau

SEQ ID NO: 261141 - RNA, 22 nt, Human
gacacagagcucacagucuccu

SEQ ID NO: 261142 - RNA, 22 nt, Human
caggaagcucuuagcagucacc

SEQ ID NO: 261143 - RNA, 23 nt, Human
aaagauguucccaaaguucacgu

SEQ ID NO: 261144 - RNA, 22 nt, Human
acuuagcacgaacauuuacuuu

SEQ ID NO: 261145 - RNA, 22 nt, Human
cagcuuguuuuauuuggggacc

SEQ ID NO: 261146 - RNA, 22 nt, Human
ccaggcugugcuuuucauaaau

SEQ ID NO: 261147 - RNA, 21 nt, Human
uuucacaaaaguaugugacaa

SEQ ID NO: 261148 - RNA, 21 nt, Human
uggacauuauggagagaguag

SEQ ID NO: 261149 - RNA, 22 nt, Human
uagauaaauuagaaaguuuacu

SEQ ID NO: 261150 - RNA, 22 nt, Human
aggagaccuuuugagugugaga

SEQ ID NO: 261151 - RNA, 22 nt, Human
gcucaggcauguaugugguugc

SEQ ID NO: 261152 - RNA, 22 nt, Human
ugccuggguccaggccaagccu

SEQ ID NO: 261153 - RNA, 22 nt, Human
ucagggcacaggccuguggguu

SEQ ID NO: 261154 - RNA, 22 nt, Human
agugaggggauucaggcaaggu

SEQ ID NO: 261155 - RNA, 22 nt, Human
cuucccuuucuggugacuucuc

SEQ ID NO: 261156 - RNA, 20 nt, Human
uuucaagucagcaauucuca

SEQ ID NO: 261157 - RNA, 22 nt, Human
uuucucuguucucuaacuguaa

SEQ ID NO: 261158 - RNA, 22 nt, Human
acaggcuguacuucuaaucauc

SEQ ID NO: 261159 - RNA, 22 nt, Human
agcaauuaugauaaggccgcug

SEQ ID NO: 261160 - RNA, 22 nt, Human
cugaggcagagaaugaguuugu

SEQ ID NO: 261161 - RNA, 19 nt, Human
gaaggcugaaaugaagcac

SEQ ID NO: 261162 - RNA, 22 nt, Human
ccaagcuacuuaggagucugag

SEQ ID NO: 261163 - RNA, 22 nt, Human
gccggggcuggggagagacaug

SEQ ID NO: 261164 - RNA, 22 nt, Human
ucuuggcuuucuccuagggaug

SEQ ID NO: 261165 - RNA, 22 nt, Human
ucacaaugcaaguguucagugg

SEQ ID NO: 261166 - RNA, 22 nt, Human
uugcccagagucacccagcuca

SEQ ID NO: 261167 - RNA, 22 nt, Human
uccugagugagagcugggaggu

SEQ ID NO: 261168 - RNA, 18 nt, Human
aggcagcagcaucuucuc

SEQ ID NO: 261169 - RNA, 20 nt, Human
acaaaguauugaggacaagu

SEQ ID NO: 261170 - RNA, 22 nt, Human
uuucuguuguacuuaaacuagg

SEQ ID NO: 261171 - RNA, 22 nt, Human
agggccagggaagcuguauuuu

SEQ ID NO: 261172 - RNA, 22 nt, Human
uuuccagguaucaagcuucagg

SEQ ID NO: 261173 - RNA, 22 nt, Human
gcuggcuugacagaggccuggg

SEQ ID NO: 261174 - RNA, 22 nt, Human
auuuucugaguccagaauuuac

SEQ ID NO: 261175 - RNA, 19 nt, Human
uccaggcuccauuggcaga

SEQ ID NO: 261176 - RNA, 22 nt, Human
cugcagagagugccgggcagcc

SEQ ID NO: 261177 - RNA, 23 nt, Human
aucuagaaaccugaugacucugu

SEQ ID NO: 261178 - RNA, 19 nt, Human
gucaggcacgugagagcau

SEQ ID NO: 261179 - RNA, 22 nt, Human
ggaucugggguagagcaguggg

SEQ ID NO: 261180 - RNA, 21 nt, Human
acaguuuauuagaguaagugc

SEQ ID NO: 261181 - RNA, 22 nt, Human
uuauagcagcaugauuuacaau

SEQ ID NO: 261182 - RNA, 20 nt, Human
auguuuuauaaaagaacggg

SEQ ID NO: 261183 - RNA, 22 nt, Human
ggcagcaugggugccuuuguga

SEQ ID NO: 261184 - RNA, 22 nt, Human
ugauuuaccaguuacuaucuug

SEQ ID NO: 261185 - RNA, 21 nt, Human
ucugggugcuaguguuugcuu

SEQ ID NO: 261186 - RNA, 20 nt, Human
aucuuugucucuguaguugu

SEQ ID NO: 261187 - RNA, 22 nt, Human
uucuacauauauuuuucucacu

SEQ ID NO: 261188 - RNA, 22 nt, Human
gaauauuuucaguacagauggu

SEQ ID NO: 261189 - RNA, 23 nt, Human
ccucagcauggcaggagcccagc

SEQ ID NO: 261190 - RNA, 22 nt, Human
ccagcuggcccagcugugcucc

SEQ ID NO: 261191 - RNA, 22 nt, Human
ucuuuaagccaagauauauuua

SEQ ID NO: 261192 - RNA, 17 nt, Human
uucugggucccagggcc

SEQ ID NO: 261193 - RNA, 22 nt, Human
cucagcagcugcugcugguggg

SEQ ID NO: 261194 - RNA, 22 nt, Human
aaugcacaaaggugucuauugc

SEQ ID NO: 261195 - RNA, 22 nt, Human
aagauacauauuuguucuagug

SEQ ID NO: 261196 - RNA, 21 nt, Human
ugggggagaauugguugcuuu

SEQ ID NO: 261197 - RNA, 22 nt, Human
augccaggcuguuuggccucag

SEQ ID NO: 261198 - RNA, 22 nt, Human
uccugugccaucucuagagacu

SEQ ID NO: 261199 - RNA, 22 nt, Human
ugucacauguguggcauuuuuc

SEQ ID NO: 261200 - RNA, 22 nt, Human
cagagguuugaucgaguagguc

SEQ ID NO: 261201 - RNA, 22 nt, Human
uuccuucuccagaacuucuagg

SEQ ID NO: 261202 - RNA, 22 nt, Human
ugagacaguucugcagcugggu

SEQ ID NO: 261203 - RNA, 22 nt, Human
agcucuuacauuuaggucuaug

SEQ ID NO: 261204 - RNA, 23 nt, Human
gccagcuuuggucugucuccuag

SEQ ID NO: 261205 - RNA, 22 nt, Human
cagagaugggucgcagagaugg

SEQ ID NO: 261206 - RNA, 22 nt, Human
uuucuugagcccaggaggugga

SEQ ID NO: 261207 - RNA, 23 nt, Human
aggcauggcauggaugguggcuc

SEQ ID NO: 261208 - RNA, 22 nt, Human
ccagccuucugagcugccugga

SEQ ID NO: 261209 - RNA, 22 nt, Human
ucagcucugcaaggucaccucc

SEQ ID NO: 261210 - RNA, 22 nt, Human
aagccacagaucguucugucac

SEQ ID NO: 261211 - RNA, 22 nt, Human
agacagagauacuauguuguca

SEQ ID NO: 261212 - RNA, 22 nt, Human
uuauaggaaaaguucuagaaaa

SEQ ID NO: 261213 - RNA, 22 nt, Human
cauaaauucaguucugccucuu

SEQ ID NO: 261214 - RNA, 23 nt, Human
uaaagacagccuucaggauucug

SEQ ID NO: 261215 - RNA, 22 nt, Human
uccuuccugcaggccaaguccu

SEQ ID NO: 261216 - RNA, 22 nt, Human
aaguuucuuuauuagcuugucc

SEQ ID NO: 261217 - RNA, 22 nt, Human
uccaguuuauuuuuggcagggu

SEQ ID NO: 261218 - RNA, 22 nt, Human
cauucaaaaugggcugaccugu

SEQ ID NO: 261219 - RNA, 22 nt, Human
ccaggaagccucagaugcugag

SEQ ID NO: 261220 - RNA, 22 nt, Human
uucaggugucaaggauaggcug

SEQ ID NO: 261221 - RNA, 22 nt, Human
agugauuugcaguauuuacuaa

SEQ ID NO: 261222 - RNA, 21 nt, Human
gauccacugaccuggggaucc

SEQ ID NO: 261223 - RNA, 22 nt, Human
ucuguucauguugggcuuuucc

SEQ ID NO: 261224 - RNA, 22 nt, Human
cuuagcuucucugcaucugugu

SEQ ID NO: 261225 - RNA, 22 nt, Human
guggauggauuuugaggaaugg

SEQ ID NO: 261226 - RNA, 22 nt, Human
cugggucuggccacaggaagua

SEQ ID NO: 261227 - RNA, 22 nt, Human
auaguggugagcugcauuuaug

SEQ ID NO: 261228 - RNA, 22 nt, Human
cucuagaagcugaggggcccaa

SEQ ID NO: 261229 - RNA, 22 nt, Human
cagacauaucccugcucccuua

SEQ ID NO: 261230 - RNA, 22 nt, Human
ugaaggcagugaguuuguguuu

SEQ ID NO: 261231 - RNA, 22 nt, Human
ugcagggcccuugggguugaac

SEQ ID NO: 261232 - RNA, 22 nt, Human
gagacacaguuaucaggcauac

SEQ ID NO: 261233 - RNA, 22 nt, Human
caagagcuggguggcaagcuag

SEQ ID NO: 261234 - RNA, 22 nt, Human
cagcagcuucuguugaucagaa

SEQ ID NO: 261235 - RNA, 20 nt, Human
cagauggcacgucagggcau

SEQ ID NO: 261236 - RNA, 19 nt, Human
uuuggacagaguguccagg

SEQ ID NO: 261237 - RNA, 19 nt, Human
ugugugguuggugaaacuc

SEQ ID NO: 261238 - RNA, 22 nt, Human
uagaaaccaucucacugcucag

SEQ ID NO: 261239 - RNA, 22 nt, Human
uucaaaucccugcuccacuauu

SEQ ID NO: 261240 - RNA, 22 nt, Human
cccucaugccagacagcaugca

SEQ ID NO: 261241 - RNA, 22 nt, Human
uccagcaugaaggggcuuuuau

SEQ ID NO: 261242 - RNA, 22 nt, Human
caaucacaaagagacaaguguc

SEQ ID NO: 261243 - RNA, 21 nt, Human
ugacagguuuaggauuaaaau

SEQ ID NO: 261244 - RNA, 19 nt, Human
ugccuguggcgagcaucuu

SEQ ID NO: 261245 - RNA, 22 nt, Human
agggacacacuccaguguuauu

SEQ ID NO: 261246 - RNA, 22 nt, Human
auucugagaaaugcauugucag

SEQ ID NO: 261247 - RNA, 22 nt, Human
caggaauaguggagcaacaaga

SEQ ID NO: 261248 - RNA, 22 nt, Human
cagggcucugccuugagggaug

SEQ ID NO: 261249 - RNA, 22 nt, Human
agcccugggcuguagauaagca

SEQ ID NO: 261250 - RNA, 22 nt, Human
gcucugaguaaaugaaagcauu

SEQ ID NO: 261251 - RNA, 22 nt, Human
auggcagcccacgauggcaaug

SEQ ID NO: 261252 - RNA, 22 nt, Human
gagagcuguuuaucuucuucaa

SEQ ID NO: 261253 - RNA, 22 nt, Human
uccaggcccauagacacuucuc

SEQ ID NO: 261254 - RNA, 22 nt, Human
uaaggcuucagcauucaaaaca

SEQ ID NO: 261255 - RNA, 22 nt, Human
uagaaauccccagucucauagu

SEQ ID NO: 261256 - RNA, 22 nt, Human
ggacacagauaaucacacagau

SEQ ID NO: 261257 - RNA, 22 nt, Human
aggaccaguaugagagcaucug

SEQ ID NO: 261258 - RNA, 22 nt, Human
uuguaacaggcacucugugcca

SEQ ID NO: 261259 - RNA, 19 nt, Human
ucuugaggaaaguaaggca

SEQ ID NO: 261260 - RNA, 22 nt, Human
acagugcagggugggaagaagg

SEQ ID NO: 261261 - RNA, 22 nt, Human
aagaaaagauguuugguuuuca

SEQ ID NO: 261262 - RNA, 22 nt, Human
agugacauuauuuuguguacua

SEQ ID NO: 261263 - RNA, 22 nt, Human
accuugucugugcaccugggcu

SEQ ID NO: 261264 - RNA, 22 nt, Human
gaauauauuggugaaaauaguu

SEQ ID NO: 261265 - RNA, 22 nt, Human
acacugucucauaugaggggac

SEQ ID NO: 261266 - RNA, 22 nt, Human
cagguaguccacagugagggag

SEQ ID NO: 261267 - RNA, 22 nt, Human
uaugugcauuaucuaguucauu

SEQ ID NO: 261268 - RNA, 22 nt, Human
gcagggauugucaaugcugcuc

SEQ ID NO: 261269 - RNA, 22 nt, Human
cacccagcagcacuuaagacua

SEQ ID NO: 261270 - RNA, 22 nt, Human
acugaacauaugcaagaccauu

SEQ ID NO: 261271 - RNA, 22 nt, Human
guuuuacaagguuaaucagcag

SEQ ID NO: 261272 - RNA, 22 nt, Human
uagauuugugcaagaagggauu

SEQ ID NO: 261273 - RNA, 22 nt, Human
uugaaauaucaaguuauuagug

SEQ ID NO: 261274 - RNA, 22 nt, Human
cugcccaguuugggagccuuuc

SEQ ID NO: 261275 - RNA, 22 nt, Human
ccugagcaucagcgccuccuua

SEQ ID NO: 261276 - RNA, 22 nt, Human
gagcccaggaaguggaggcuga

SEQ ID NO: 261277 - RNA, 22 nt, Human
cagggcucaucugugugaccag

SEQ ID NO: 261278 - RNA, 22 nt, Human
cauuuggauuuugaagagagua

SEQ ID NO: 261279 - RNA, 21 nt, Human
uucuguagcuguuagcuuuuc

SEQ ID NO: 261280 - RNA, 22 nt, Human
cagacaggagacuggaucaugg

SEQ ID NO: 261281 - RNA, 22 nt, Human
aaugcaaagcucuuuaauccuu

SEQ ID NO: 261282 - RNA, 22 nt, Human
uggcugggcccccaccugccuc

SEQ ID NO: 261283 - RNA, 22 nt, Human
ucuuuaauuguggaagagcagc

SEQ ID NO: 261284 - RNA, 22 nt, Human
guucucaguggggagcaggguu

SEQ ID NO: 261285 - RNA, 22 nt, Human
aguaaaauuaauggaucagaag

SEQ ID NO: 261286 - RNA, 22 nt, Human
ucugaaauggggcugaagcacu

SEQ ID NO: 261287 - RNA, 22 nt, Human
uccuggguucauguccuggugc

SEQ ID NO: 261288 - RNA, 19 nt, Human
gguaaaagugagcuucagg

SEQ ID NO: 261289 - RNA, 22 nt, Human
ucauucaucaguugguagagau

SEQ ID NO: 261290 - RNA, 22 nt, Human
ucuaaacaguuucacucuuaau

SEQ ID NO: 261291 - RNA, 23 nt, Human
aggaaagcauucauuuuuaccau

SEQ ID NO: 261292 - RNA, 22 nt, Human
ucuaaacacgucucuuugaaua

SEQ ID NO: 261293 - RNA, 22 nt, Human
gagcacagugcaguuucugcua

SEQ ID NO: 261294 - RNA, 22 nt, Human
auuucuagacuuagaacucuua

SEQ ID NO: 261295 - RNA, 22 nt, Human
acugucacugacagaaucaaca

SEQ ID NO: 261296 - RNA, 21 nt, Human
agccaagccuugggagccagg

SEQ ID NO: 261297 - RNA, 22 nt, Human
uucaacuaauguuuauuuuaug

SEQ ID NO: 261298 - RNA, 22 nt, Human
auuuccugggucucacuccaga

SEQ ID NO: 261299 - RNA, 22 nt, Human
auagcaaacuggcagcuugugg

SEQ ID NO: 261300 - RNA, 22 nt, Human
ggcagcuucucccaggcuguuu

SEQ ID NO: 261301 - RNA, 22 nt, Human
cagcacuuugagggcucuuaau

SEQ ID NO: 261302 - RNA, 22 nt, Human
gcacacagaauugauucacugu

SEQ ID NO: 261303 - RNA, 22 nt, Human
cuguggcuccagugaaccaaug

SEQ ID NO: 261304 - RNA, 22 nt, Human
gguccucaaucccaacaaggca

SEQ ID NO: 261305 - RNA, 22 nt, Human
aaaaccauguaucuauuuccuu

SEQ ID NO: 261306 - RNA, 22 nt, Human
uugggagcuggaagcaaggccu

SEQ ID NO: 261307 - RNA, 22 nt, Human
ccuggccagcagccccuuccuc

SEQ ID NO: 261308 - RNA, 22 nt, Human
caacagucagaaugaagcugag

SEQ ID NO: 261309 - RNA, 22 nt, Human
aguucaaacucuauaagaacuu

SEQ ID NO: 261310 - RNA, 22 nt, Human
aggcuucuggggcaccgagcga

SEQ ID NO: 261311 - RNA, 21 nt, Human
uuguaaagguuuagaagaaug

SEQ ID NO: 261312 - RNA, 22 nt, Human
aaagcugggggcccuggucuag

SEQ ID NO: 261313 - RNA, 22 nt, Human
aagccaugguagaaaacucagu

SEQ ID NO: 261314 - RNA, 22 nt, Human
gucucuggcuuuaugcugguuu

SEQ ID NO: 261315 - RNA, 22 nt, Human
ucaaaugcaccucucauuuguu

SEQ ID NO: 261316 - RNA, 21 nt, Human
cacuccacuuagaacaggguu

SEQ ID NO: 261317 - RNA, 22 nt, Human
cucaaauauguggucagaaagc

SEQ ID NO: 261318 - RNA, 22 nt, Human
cuucucucccuggcacucagac

SEQ ID NO: 261319 - RNA, 22 nt, Human
caggggccuguccuggcuucug

SEQ ID NO: 261320 - RNA, 20 nt, Human
uuccagagaucugcauuuua

SEQ ID NO: 261321 - RNA, 21 nt, Human
ggagcuggggagcuggcccca

SEQ ID NO: 261322 - RNA, 20 nt, Human
aaaaucucccagaaacuuau

SEQ ID NO: 261323 - RNA, 22 nt, Human
ggccacgugaccucuggcuccu

SEQ ID NO: 261324 - RNA, 18 nt, Human
guguccuggcugcggcgc

SEQ ID NO: 261325 - RNA, 22 nt, Human
aacaucucauggacuacauucu

SEQ ID NO: 261326 - RNA, 22 nt, Human
uuguaagucacaccagggcagg

SEQ ID NO: 261327 - RNA, 22 nt, Human
gugcagguguuuuggcugccag

SEQ ID NO: 261328 - RNA, 22 nt, Human
guuuuccugagcccagagaugc

SEQ ID NO: 261329 - RNA, 22 nt, Human
acuaaauagccucugguaguug

SEQ ID NO: 261330 - RNA, 19 nt, Human
caggacaguuugccaagaa

SEQ ID NO: 261331 - RNA, 22 nt, Human
cugggaccuccucacuguucua

SEQ ID NO: 261332 - RNA, 19 nt, Human
aguucuuguccugucuguu

SEQ ID NO: 261333 - RNA, 22 nt, Human
cagcugagucugagguucuuug

SEQ ID NO: 261334 - RNA, 22 nt, Human
auuuguuccaugaguaaggcua

SEQ ID NO: 261335 - RNA, 22 nt, Human
gcuuuggucagguguccagccc

SEQ ID NO: 261336 - RNA, 22 nt, Human
uucacauuaucaggauuguuuc

SEQ ID NO: 261337 - RNA, 22 nt, Human
agagccaaggcugagagcuauu

SEQ ID NO: 261338 - RNA, 22 nt, Human
caaacuuucaguuauaacauga

SEQ ID NO: 261339 - RNA, 22 nt, Human
aagccuucagaguuggcugguc

SEQ ID NO: 261340 - RNA, 22 nt, Human
ugaguguuguaaccauaugauu

SEQ ID NO: 261341 - RNA, 22 nt, Human
ccugagccugcagccgagcaga

SEQ ID NO: 261342 - RNA, 22 nt, Human
gcugagggaggcugaacugagu

SEQ ID NO: 261343 - RNA, 22 nt, Human
ggccaugcaggucugguagguc

SEQ ID NO: 261344 - RNA, 22 nt, Human
uaggcugggagccugaggcuag

SEQ ID NO: 261345 - RNA, 22 nt, Human
gccaggcaugggcuucugggcg

SEQ ID NO: 261346 - RNA, 22 nt, Human
aggaccugcuaaugugccaagu

SEQ ID NO: 261347 - RNA, 22 nt, Human
gaggugguucagguagagccca

SEQ ID NO: 261348 - RNA, 22 nt, Human
ucagaggagcugcagaacgcug

SEQ ID NO: 261349 - RNA, 22 nt, Human
cagguggcuaacggccucauag

SEQ ID NO: 261350 - RNA, 22 nt, Human
gcaggccugacuguagggggca

SEQ ID NO: 261351 - RNA, 22 nt, Human
uaacagaauagcagaaacagaa

SEQ ID NO: 261352 - RNA, 22 nt, Human
uggaccugagccuggcccugcc

SEQ ID NO: 261353 - RNA, 22 nt, Human
gcaccugcuggaaucagucugu

SEQ ID NO: 261354 - RNA, 22 nt, Human
gggaagauaguguugagggccc

SEQ ID NO: 261355 - RNA, 22 nt, Human
cuuauguauauuuggaacguac

SEQ ID NO: 261356 - RNA, 22 nt, Human
ccagcuggggaaguggggcaua

SEQ ID NO: 261357 - RNA, 22 nt, Human
ucugaggggcuggaagggcugc

SEQ ID NO: 261358 - RNA, 19 nt, Human
aucagcaagguaggaugug

SEQ ID NO: 261359 - RNA, 22 nt, Human
uauuuuacagacuacuuuagau

SEQ ID NO: 261360 - RNA, 22 nt, Human
uuuuauacacaugaacaugcag

SEQ ID NO: 261361 - RNA, 22 nt, Human
augggacaauuugaacacagug

SEQ ID NO: 261362 - RNA, 23 nt, Human
ccugcagcugcuggggcuccacc

SEQ ID NO: 261363 - RNA, 22 nt, Human
uuagaaacucaacucugggaau

SEQ ID NO: 261364 - RNA, 22 nt, Human
ccaugagcuuccuauauagggu

SEQ ID NO: 261365 - RNA, 22 nt, Human
agcagucaguccugaaugaagg

SEQ ID NO: 261366 - RNA, 22 nt, Human
ggcacugggaaugcagugauga

SEQ ID NO: 261367 - RNA, 19 nt, Human
aguguccuagucauuugcc

SEQ ID NO: 261368 - RNA, 22 nt, Human
guaaacaucgacccaacagggg

SEQ ID NO: 261369 - RNA, 22 nt, Human
gcagcucaaaggccacggacgg

SEQ ID NO: 261370 - RNA, 23 nt, Human
uccaggacccugguagacacaca

SEQ ID NO: 261371 - RNA, 20 nt, Human
auguucuucauuuaauguuc

SEQ ID NO: 261372 - RNA, 22 nt, Human
cagcugccccuccagggcuggg

SEQ ID NO: 261373 - RNA, 20 nt, Human
ggcaggcaggagguuuccag

SEQ ID NO: 261374 - RNA, 22 nt, Human
uuacaaaguguuaugauaaaca

SEQ ID NO: 261375 - RNA, 22 nt, Human
uuacagcaaagugcgcagaccu

SEQ ID NO: 261376 - RNA, 22 nt, Human
aauccuuacugaaugagaaaaa

SEQ ID NO: 261377 - RNA, 22 nt, Human
agacagugagaaugaguugaaa

SEQ ID NO: 261378 - RNA, 22 nt, Human
gagcagggcuuguccuccucau

SEQ ID NO: 261379 - RNA, 15 nt, Human
auacacaugagggag

SEQ ID NO: 261380 - RNA, 22 nt, Human
auggaaauacagccagagcaga

SEQ ID NO: 261381 - RNA, 22 nt, Human
cuggucccagcagagcucugag

SEQ ID NO: 261382 - RNA, 22 nt, Human
caaggcauacuccuuucucagc

SEQ ID NO: 261383 - RNA, 22 nt, Human
gcuucuaucccuccacugcacu

SEQ ID NO: 261384 - RNA, 22 nt, Human
ggcuuuaucaaaugagacccug

SEQ ID NO: 261385 - RNA, 22 nt, Human
auccugaagcaugaaugucaaa

SEQ ID NO: 261386 - RNA, 22 nt, Human
aagcaaagagauaaccuuuugg

SEQ ID NO: 261387 - RNA, 22 nt, Human
caggccacacggcggcucccug

SEQ ID NO: 261388 - RNA, 22 nt, Human
cugagagaucaagccacaggau

SEQ ID NO: 261389 - RNA, 22 nt, Human
cucuuaaagcuuccaguuucaa

SEQ ID NO: 261390 - RNA, 22 nt, Human
ugccaccaggagaaccagugca

SEQ ID NO: 261391 - RNA, 22 nt, Human
uccucuccaugucucacgccac

SEQ ID NO: 261392 - RNA, 22 nt, Human
agcuggagaucaugcugauacu

SEQ ID NO: 261393 - RNA, 22 nt, Human
aaugucuacaccguauguuguu

SEQ ID NO: 261394 - RNA, 22 nt, Human
ccucccugcuccucaacuggca

SEQ ID NO: 261395 - RNA, 22 nt, Human
agcccugcacaguucgggagga

SEQ ID NO: 261396 - RNA, 22 nt, Human
gccaccauguagcccauuagag

SEQ ID NO: 261397 - RNA, 22 nt, Human
caugccauuucuucucuuuaug

SEQ ID NO: 261398 - RNA, 22 nt, Human
ugguaugaccguggugcaagca

SEQ ID NO: 261399 - RNA, 22 nt, Human
ugauaaacagcugaugaagacc

SEQ ID NO: 261400 - RNA, 22 nt, Human
ccuucucugcagguaguuggcu

SEQ ID NO: 261401 - RNA, 22 nt, Human
aggcuccaccagucaggugcau

SEQ ID NO: 261402 - RNA, 22 nt, Human
cuuucagucuuuacaagguugc

SEQ ID NO: 261403 - RNA, 22 nt, Human
aagaguuaagcaacagauacca

SEQ ID NO: 261404 - RNA, 22 nt, Human
aggcaggaggaucauggaugca

SEQ ID NO: 261405 - RNA, 22 nt, Human
auggcauuguuuauagauugca

SEQ ID NO: 261406 - RNA, 22 nt, Human
gugaggcagcaggagccucugu

SEQ ID NO: 261407 - RNA, 21 nt, Human
uccuguaagcuuggguggcuc

SEQ ID NO: 261408 - RNA, 22 nt, Human
cuacaacauuaugcuuucuguc

SEQ ID NO: 261409 - RNA, 20 nt, Human
ugcugagguugacaugccca

SEQ ID NO: 261410 - RNA, 22 nt, Human
ggucacuccaccuucuccaccu

SEQ ID NO: 261411 - RNA, 22 nt, Human
ucuuuauugcuacugguuuguc

SEQ ID NO: 261412 - RNA, 22 nt, Human
acucauguccuaggaguaaagc

SEQ ID NO: 261413 - RNA, 22 nt, Human
cagauaaauagacuuggucaga

SEQ ID NO: 261414 - RNA, 22 nt, Human
gaaacccugagagguggucugg

SEQ ID NO: 261415 - RNA, 22 nt, Human
uccaggaacgagaggcugggca

SEQ ID NO: 261416 - RNA, 22 nt, Human
aggcucagagagcuguguccau

SEQ ID NO: 261417 - RNA, 22 nt, Human
agauuacagaagaauaaguaga

SEQ ID NO: 261418 - RNA, 22 nt, Human
augcagcugacauuuucauguu

SEQ ID NO: 261419 - RNA, 22 nt, Human
cuucuggcaaucccagggucuu

SEQ ID NO: 261420 - RNA, 22 nt, Human
uauuaaauuauggauuuaggag

SEQ ID NO: 261421 - RNA, 22 nt, Human
acguuugcuuucuuuggccugg

SEQ ID NO: 261422 - RNA, 22 nt, Human
caacugggauaaagagcuaaag

SEQ ID NO: 261423 - RNA, 22 nt, Human
uguuagaaguuaaucacuaauu

SEQ ID NO: 261424 - RNA, 22 nt, Human
cagaaagccaacuccaacuguc

SEQ ID NO: 261425 - RNA, 22 nt, Human
aaguguuuccauugugcaggcu

SEQ ID NO: 261426 - RNA, 22 nt, Human
uccugggcuuaguggcuagguc

SEQ ID NO: 261427 - RNA, 22 nt, Human
uggcacagcccauucagagaag

SEQ ID NO: 261428 - RNA, 22 nt, Human
caguguaagcucuagacuagaa

SEQ ID NO: 261429 - RNA, 22 nt, Human
uucagagccacuucaagucuaa

SEQ ID NO: 261430 - RNA, 22 nt, Human
uggagcuggaauuucugggccu

SEQ ID NO: 261431 - RNA, 22 nt, Human
uuaaagacaucacagauuacac

SEQ ID NO: 261432 - RNA, 22 nt, Human
uaggaggcauuugcucccaggg

SEQ ID NO: 261433 - RNA, 23 nt, Human
acugccugcuacuaugcccacgg

SEQ ID NO: 261434 - RNA, 22 nt, Human
caggcagagucagauuagacuu

SEQ ID NO: 261435 - RNA, 23 nt, Human
cagggcugggcuugguguuaggc

SEQ ID NO: 261436 - RNA, 22 nt, Human
gcuuguuugugauuucuccaga

SEQ ID NO: 261437 - RNA, 22 nt, Human
gaauuuuaaguguucgccucuu

SEQ ID NO: 261438 - RNA, 18 nt, Human
caguggcauaguugagua

SEQ ID NO: 261439 - RNA, 22 nt, Human
gucuuugccacacuucuguaca

SEQ ID NO: 261440 - RNA, 22 nt, Human
gaguggggucugggcaucaguc

SEQ ID NO: 261441 - RNA, 22 nt, Human
aauuaggggaggacguaucaua

SEQ ID NO: 261442 - RNA, 22 nt, Human
ggagagagagcucauuagcugc

SEQ ID NO: 261443 - RNA, 22 nt, Human
uacccagcaaucccuagagguu

SEQ ID NO: 261444 - RNA, 22 nt, Human
gaauauuaguaucaguuauacc

SEQ ID NO: 261445 - RNA, 17 nt, Human
cugaggcccagggccca

SEQ ID NO: 261446 - RNA, 22 nt, Human
ccuggcuccugccucugcaggg

SEQ ID NO: 261447 - RNA, 20 nt, Human
cuacuuuaggcacugagaau

SEQ ID NO: 261448 - RNA, 22 nt, Human
agcugugggagaaucucugggu

SEQ ID NO: 261449 - RNA, 22 nt, Human
uuucccaguuagugaagacaug

SEQ ID NO: 261450 - RNA, 22 nt, Human
aguuuuuccugauuuuacagaa

SEQ ID NO: 261451 - RNA, 22 nt, Human
auguuugucaggauuguaauua

SEQ ID NO: 261452 - RNA, 19 nt, Human
caguggccuggaggucucu

SEQ ID NO: 261453 - RNA, 22 nt, Human
gugggcucaggccucugugggg

SEQ ID NO: 261454 - RNA, 17 nt, Human
ugauucaacuagaaacu

SEQ ID NO: 261455 - RNA, 22 nt, Human
caaaugauacuguuuuuagucu

SEQ ID NO: 261456 - RNA, 22 nt, Human
agcuccugauucucagagauag

SEQ ID NO: 261457 - RNA, 22 nt, Human
uuccugugcuuauucuucucug

SEQ ID NO: 261458 - RNA, 21 nt, Human
ugcagcagauuugggggaaga

SEQ ID NO: 261459 - RNA, 21 nt, Human
agcuuacauuaccauuguugc

SEQ ID NO: 261460 - RNA, 22 nt, Human
agggaccacauccccucugugg

SEQ ID NO: 261461 - RNA, 22 nt, Human
cccagccaaaagcaaguuuacc

SEQ ID NO: 261462 - RNA, 22 nt, Human
cuguauuuguccucuauuuauu

SEQ ID NO: 261463 - RNA, 22 nt, Human
cuccuuccugccccagugauaa

SEQ ID NO: 261464 - RNA, 22 nt, Human
uguggccaggccccugauggug

SEQ ID NO: 261465 - RNA, 22 nt, Human
caucucaucagugagagucagc

SEQ ID NO: 261466 - RNA, 22 nt, Human
ccuggcaggcuggggacagugc

SEQ ID NO: 261467 - RNA, 22 nt, Human
gcagaggcugggugucccaguc

SEQ ID NO: 261468 - RNA, 22 nt, Human
guggcuucuucugccagaagga

SEQ ID NO: 261469 - RNA, 22 nt, Human
ugccaaguuucucucagggacu

SEQ ID NO: 261470 - RNA, 22 nt, Human
ccugcccccgucagaggugaug

SEQ ID NO: 261471 - RNA, 22 nt, Human
cuuagcuagaggcaauuauguu

SEQ ID NO: 261472 - RNA, 22 nt, Human
ucucugugugugugacagcauu

SEQ ID NO: 261473 - RNA, 22 nt, Human
gaagcagaacccacuccccaac

SEQ ID NO: 261474 - RNA, 22 nt, Human
aggccucaugucaaagcagcaa

SEQ ID NO: 261475 - RNA, 23 nt, Human
agcacucaugcugcagaagucau

SEQ ID NO: 261476 - RNA, 20 nt, Human
augaguuuaaacauucagag

SEQ ID NO: 261477 - RNA, 22 nt, Human
gccugggaacucugaucuccug

SEQ ID NO: 261478 - RNA, 22 nt, Human
uauucccacuccucagcaauuu

SEQ ID NO: 261479 - RNA, 22 nt, Human
gagguagccacagauagagacu

SEQ ID NO: 261480 - RNA, 22 nt, Human
aauaucuguggccauacaauuu

SEQ ID NO: 261481 - RNA, 22 nt, Human
auugacaagaaagauauuuuua

SEQ ID NO: 261482 - RNA, 22 nt, Human
ucaauuuaagguacuacuuugg

SEQ ID NO: 261483 - RNA, 22 nt, Human
cuccccaacucagccgaggcuu

SEQ ID NO: 261484 - RNA, 23 nt, Human
auuucuaggggauuuucuggugc

SEQ ID NO: 261485 - RNA, 20 nt, Human
uugaagagucagguagggcc

SEQ ID NO: 261486 - RNA, 21 nt, Human
accaucuuccaugcauuauau

SEQ ID NO: 261487 - RNA, 22 nt, Human
aagccagugggcauagcaguug

SEQ ID NO: 261488 - RNA, 22 nt, Human
cugaggccuaagacaugaauga

SEQ ID NO: 261489 - RNA, 22 nt, Human
gcacuuaugcucaccuuguucu

SEQ ID NO: 261490 - RNA, 22 nt, Human
uuugggaagaggaaucucugga

SEQ ID NO: 261491 - RNA, 22 nt, Human
cagggcagcuuccuuuguuagg

SEQ ID NO: 261492 - RNA, 22 nt, Human
gcacaauggaccgugugcucug

SEQ ID NO: 261493 - RNA, 22 nt, Human
aaccacagagcccccucagaug

SEQ ID NO: 261494 - RNA, 22 nt, Human
cagagccccccuucugaucaca

SEQ ID NO: 261495 - RNA, 20 nt, Human
uggaggcagagccagaggga

SEQ ID NO: 261496 - RNA, 22 nt, Human
gugcaagguacauccuugaugu

SEQ ID NO: 261497 - RNA, 18 nt, Human
uccaaagccagagaaguu

SEQ ID NO: 261498 - RNA, 22 nt, Human
caaaaacugcaauuacuuuuac

SEQ ID NO: 261499 - RNA, 22 nt, Human
auucuaagucuuguucacauuc

SEQ ID NO: 261500 - RNA, 22 nt, Human
aaaugcuacacaggaauucuca

SEQ ID NO: 261501 - RNA, 22 nt, Human
agcucugacauugauucucagc

SEQ ID NO: 261502 - RNA, 22 nt, Human
gaaggcuuuagagagauauaaa

SEQ ID NO: 261503 - RNA, 22 nt, Human
agggauguuaguugugagcuca

SEQ ID NO: 261504 - RNA, 22 nt, Human
ucccugagugggcugguaguau

SEQ ID NO: 261505 - RNA, 22 nt, Human
gggcagcugccagaggccaugg

SEQ ID NO: 261506 - RNA, 22 nt, Human
uccugcaguuacaucccagcca

SEQ ID NO: 261507 - RNA, 22 nt, Human
agaaggcagaugggacggagca

SEQ ID NO: 261508 - RNA, 22 nt, Human
cagagggagcccuccaggagca

SEQ ID NO: 261509 - RNA, 22 nt, Human
gagggagcuaugaauagaagaa

SEQ ID NO: 261510 - RNA, 20 nt, Human
aguaggggaaugcaagagca

SEQ ID NO: 261511 - RNA, 22 nt, Human
gcccugugcgcugaguucaggg

SEQ ID NO: 261512 - RNA, 22 nt, Human
uuucaguuacugcuauaucauu

SEQ ID NO: 261513 - RNA, 22 nt, Human
gaugaugaggccaugaggcagg

SEQ ID NO: 261514 - RNA, 22 nt, Human
caagauaagaucauuuacacua

SEQ ID NO: 261515 - RNA, 22 nt, Human
acagccuuauucuuuaguuuac

SEQ ID NO: 261516 - RNA, 22 nt, Human
uaaguucauuagacuacagaua

SEQ ID NO: 261517 - RNA, 18 nt, Human
cuagaugagcuuggcaag

SEQ ID NO: 261518 - RNA, 22 nt, Human
gcagugcauuacucacauguuu

SEQ ID NO: 261519 - RNA, 21 nt, Human
agcagccauuucacagagacu

SEQ ID NO: 261520 - RNA, 22 nt, Human
uuaguuuucccaucuuuauggu

SEQ ID NO: 261521 - RNA, 20 nt, Human
agcacauuaaacauacuccu

SEQ ID NO: 261522 - RNA, 22 nt, Human
aagguuaguaauauuucuauau

SEQ ID NO: 261523 - RNA, 22 nt, Human
ucagagaaucucuccuuaguuu

SEQ ID NO: 261524 - RNA, 22 nt, Human
gcugggcuucaccuccagaguu

SEQ ID NO: 261525 - RNA, 22 nt, Human
gagcaaacaucagugaugucug

SEQ ID NO: 261526 - RNA, 22 nt, Human
uccugggccaagggcugugagg

SEQ ID NO: 261527 - RNA, 22 nt, Human
cuuaggaguucacuugaauagu

SEQ ID NO: 261528 - RNA, 22 nt, Human
uugggaaacaguauagcuaaca

SEQ ID NO: 261529 - RNA, 22 nt, Human
uguauugaauuguguuauaucu

SEQ ID NO: 261530 - RNA, 22 nt, Human
ccucacagcuuuucaaagugga

SEQ ID NO: 261531 - RNA, 21 nt, Human
cucaaaugccaguuuuauuua

SEQ ID NO: 261532 - RNA, 22 nt, Human
ucuguguuuuacuccaauuaua

SEQ ID NO: 261533 - RNA, 22 nt, Human
ccacagaggacaacugccuggc

SEQ ID NO: 261534 - RNA, 22 nt, Human
caggcuggaguuaccuuuaggg

SEQ ID NO: 261535 - RNA, 22 nt, Human
gccugcuuccuuuucauagaug

SEQ ID NO: 261536 - RNA, 22 nt, Human
ggggcagaguagcuggggugug

SEQ ID NO: 261537 - RNA, 22 nt, Human
gcauucauacaucaauaagcuu

SEQ ID NO: 261538 - RNA, 22 nt, Human
ccaggaucuggguccaugggac

SEQ ID NO: 261539 - RNA, 23 nt, Human
gcuucccagacaauacugcuucc

SEQ ID NO: 261540 - RNA, 22 nt, Human
acacugcuucucuggcagagcc

SEQ ID NO: 261541 - RNA, 22 nt, Human
cuggcccaggagagcaggcauu

SEQ ID NO: 261542 - RNA, 22 nt, Human
gugauuuugagaccuauauagu

SEQ ID NO: 261543 - RNA, 22 nt, Human
caggcucccugccagggccggc

SEQ ID NO: 261544 - RNA, 22 nt, Human
uuucuggguuuaugucacagcu

SEQ ID NO: 261545 - RNA, 22 nt, Human
ugcuuuaucaaagcuauaguga

SEQ ID NO: 261546 - RNA, 22 nt, Human
agugcuuuagcauccaacuguc

SEQ ID NO: 261547 - RNA, 22 nt, Human
auuucucacucacaguccaugu

SEQ ID NO: 261548 - RNA, 22 nt, Human
gccaggaguucagaugcauguu

SEQ ID NO: 261549 - RNA, 22 nt, Human
uuuauuuaccuuauguccucca

SEQ ID NO: 261550 - RNA, 22 nt, Human
auagcacugguuuuucuugguu

SEQ ID NO: 261551 - RNA, 22 nt, Human
ugcugagguuucgucugcuugc

SEQ ID NO: 261552 - RNA, 22 nt, Human
uuccagcaggcagacaggagau

SEQ ID NO: 261553 - RNA, 22 nt, Human
guacaaauuaggaagcuuugug

SEQ ID NO: 261554 - RNA, 22 nt, Human
aggucaaguuuagauagaguua

SEQ ID NO: 261555 - RNA, 22 nt, Human
aucucaggugaaacuucuaggu

SEQ ID NO: 261556 - RNA, 22 nt, Human
cugguguggacuccgcgcggag

SEQ ID NO: 261557 - RNA, 22 nt, Human
aacuuuuaaaauacacagacaa

SEQ ID NO: 261558 - RNA, 22 nt, Human
agaggccugugugcuccagugg

SEQ ID NO: 261559 - RNA, 17 nt, Human
aagucccagcuaacaca

SEQ ID NO: 261560 - RNA, 22 nt, Human
aucagagugggucuggcaugag

SEQ ID NO: 261561 - RNA, 22 nt, Human
gugcuuuuucaaucagaaggga

SEQ ID NO: 261562 - RNA, 22 nt, Human
cacacaccaaucaaaugucaga

SEQ ID NO: 261563 - RNA, 21 nt, Human
agaaccuuggaugccauugca

SEQ ID NO: 261564 - RNA, 23 nt, Human
ucuggaggggacacugcagaugc

SEQ ID NO: 261565 - RNA, 22 nt, Human
ugggaggcagaaguugacugga

SEQ ID NO: 261566 - RNA, 22 nt, Human
auccuucuucaaagagggaaaa

SEQ ID NO: 261567 - RNA, 22 nt, Human
ucuggcucucauacucgccagu

SEQ ID NO: 261568 - RNA, 22 nt, Human
auucuacaccucucucauuuag

SEQ ID NO: 261569 - RNA, 22 nt, Human
auuuagaaguuggagggcaaga

SEQ ID NO: 261570 - RNA, 22 nt, Human
aguccaggacuguuucagcuga

SEQ ID NO: 261571 - RNA, 22 nt, Human
aaggcuucuggagcuugcuggc

SEQ ID NO: 261572 - RNA, 21 nt, Human
cuugagaauuaacuguucauu

SEQ ID NO: 261573 - RNA, 22 nt, Human
uuccuguguccuauuucgacuu

SEQ ID NO: 261574 - RNA, 22 nt, Human
ccagaacugagaaaauaaauuu

SEQ ID NO: 261575 - RNA, 22 nt, Human
gcagggcuguucaggagggugg

SEQ ID NO: 261576 - RNA, 22 nt, Human
aauccauuuaccuuugcuugaa

SEQ ID NO: 261577 - RNA, 22 nt, Human
cuguauaucaugguuuugcagu

SEQ ID NO: 261578 - RNA, 22 nt, Human
agaguuuguaguggugaaugua

SEQ ID NO: 261579 - RNA, 22 nt, Human
caguaguuauuaguugccacug

SEQ ID NO: 261580 - RNA, 21 nt, Human
uggcucuggguaggagagugc

SEQ ID NO: 261581 - RNA, 22 nt, Human
uccugagcuacaguaguaugau

SEQ ID NO: 261582 - RNA, 22 nt, Human
gaacaucaugaagaaaacauau

SEQ ID NO: 261583 - RNA, 22 nt, Human
aaugucaaaggcuauacauuca

SEQ ID NO: 261584 - RNA, 22 nt, Human
acacaugcacaacaguucuuuc

SEQ ID NO: 261585 - RNA, 22 nt, Human
uuugggaauagcagggacugag

SEQ ID NO: 261586 - RNA, 22 nt, Human
aguacaaguagaaugcuacaag

SEQ ID NO: 261587 - RNA, 22 nt, Human
agggacccugaugacugaggag

SEQ ID NO: 261588 - RNA, 22 nt, Human
uuggaauugaggauuuacauag

SEQ ID NO: 261589 - RNA, 22 nt, Human
cucugcaaggcccuccaguagc

SEQ ID NO: 261590 - RNA, 22 nt, Human
ccucugugauuucugagccaau

SEQ ID NO: 261591 - RNA, 22 nt, Human
cccagaggugaaggagguggga

SEQ ID NO: 261592 - RNA, 22 nt, Human
aaugauaugcaaauuaucauca

SEQ ID NO: 261593 - RNA, 22 nt, Human
gcugccucugcacagcucacuc

SEQ ID NO: 261594 - RNA, 22 nt, Human
acucugagggguauguuccuau

SEQ ID NO: 261595 - RNA, 22 nt, Human
ggccaugccaggcugccuggga

SEQ ID NO: 261596 - RNA, 22 nt, Human
uaacagaaaggcucaggugcuc

SEQ ID NO: 261597 - RNA, 22 nt, Human
caggaugcagugggacccaggg

SEQ ID NO: 261598 - RNA, 22 nt, Human
uaugcauagguaucuauacuca

SEQ ID NO: 261599 - RNA, 22 nt, Human
aaauccaacgacagguguacuu

SEQ ID NO: 261600 - RNA, 22 nt, Human
caggcagcccugcaccaagugu

SEQ ID NO: 261601 - RNA, 22 nt, Human
acaugcucuccaaggacagagc

SEQ ID NO: 261602 - RNA, 22 nt, Human
ccuugcucaucccccagugccu

SEQ ID NO: 261603 - RNA, 22 nt, Human
gccugccuuugugaggaagcgg

SEQ ID NO: 261604 - RNA, 22 nt, Human
cagcucuuggagaaaccagagc

SEQ ID NO: 261605 - RNA, 22 nt, Human
uuaugacagaaaugaaaagcug

SEQ ID NO: 261606 - RNA, 22 nt, Human
caggcccugccuugagggaccu

SEQ ID NO: 261607 - RNA, 22 nt, Human
ucagaggaucaugucccuacuc

SEQ ID NO: 261608 - RNA, 22 nt, Human
acagacagauuuugucugaugu

SEQ ID NO: 261609 - RNA, 22 nt, Human
aauuaguucaauggaugauaga

SEQ ID NO: 261610 - RNA, 22 nt, Human
cugacuuuuccaaauaauacuu

SEQ ID NO: 261611 - RNA, 22 nt, Human
uccaaauucuauguucuuucca

SEQ ID NO: 261612 - RNA, 22 nt, Human
aaacaacuucugcacuaugggu

SEQ ID NO: 261613 - RNA, 22 nt, Human
gugcagcugggcgcugaccuuc

SEQ ID NO: 261614 - RNA, 22 nt, Human
guuauacauauguguuaacaaa

SEQ ID NO: 261615 - RNA, 21 nt, Human
gccacugcacuccagccuggg

SEQ ID NO: 261616 - RNA, 22 nt, Human
aagaacauugauauugucuaug

SEQ ID NO: 261617 - RNA, 22 nt, Human
uggaaucaguuacaugugguug

SEQ ID NO: 261618 - RNA, 20 nt, Human
ucagagcugcaggagagaaa

SEQ ID NO: 261619 - RNA, 22 nt, Human
aaauggaucuguggaauacauu

SEQ ID NO: 261620 - RNA, 22 nt, Human
caccucauggauaagauaaacu

SEQ ID NO: 261621 - RNA, 22 nt, Human
uuggcaccucccuaggaagaag

SEQ ID NO: 261622 - RNA, 22 nt, Human
uauuucugucagccagauaugg

SEQ ID NO: 261623 - RNA, 21 nt, Human
uucacaguggauaacuuucug

SEQ ID NO: 261624 - RNA, 22 nt, Human
aaaucaaaagacauguguuuua

SEQ ID NO: 261625 - RNA, 22 nt, Human
caaacuuacuguguuuaaagag

SEQ ID NO: 261626 - RNA, 22 nt, Human
agaagcacaccaguagacaggg

SEQ ID NO: 261627 - RNA, 22 nt, Human
uacaggagcugcucugugauac

SEQ ID NO: 261628 - RNA, 22 nt, Human
agcaggcaggcugccagugaau

SEQ ID NO: 261629 - RNA, 22 nt, Human
agugcuggcccauagcugcugg

SEQ ID NO: 261630 - RNA, 22 nt, Human
acaauuacccuggcuugauaaa

SEQ ID NO: 261631 - RNA, 22 nt, Human
aaauggcaauuuaguuuauuua

SEQ ID NO: 261632 - RNA, 22 nt, Human
ucugggaacgaaggcuaauaug

SEQ ID NO: 261633 - RNA, 22 nt, Human
cuguguccuuuaaaaaagacac

SEQ ID NO: 261634 - RNA, 22 nt, Human
cccagcaugcacgcugacacuc

SEQ ID NO: 261635 - RNA, 22 nt, Human
uccaggacuagcauuucugaua

SEQ ID NO: 261636 - RNA, 23 nt, Human
accuuggacuucccagcuuccag

SEQ ID NO: 261637 - RNA, 22 nt, Human
agguccucugugccugcuggcg

SEQ ID NO: 261638 - RNA, 22 nt, Human
uaaaaaucuuaugaauggcaag

SEQ ID NO: 261639 - RNA, 22 nt, Human
uuagugcaaaccucagagacac

SEQ ID NO: 261640 - RNA, 22 nt, Human
agauggugagggcagaaguaac

SEQ ID NO: 261641 - RNA, 22 nt, Human
acugggcugccugguucuucua

SEQ ID NO: 261642 - RNA, 22 nt, Human
ugggcugaguguggaacuaguu

SEQ ID NO: 261643 - RNA, 22 nt, Human
ugauuucauaguauauacauga

SEQ ID NO: 261644 - RNA, 22 nt, Human
ccccagcugcauacuugccaag

SEQ ID NO: 261645 - RNA, 21 nt, Human
ugaaaucugaugggacaaaug

SEQ ID NO: 261646 - RNA, 22 nt, Human
ccuuagaagaaaguuacuuuuu

SEQ ID NO: 261647 - RNA, 22 nt, Human
cugcaggaaucugugcuaggug

SEQ ID NO: 261648 - RNA, 22 nt, Human
aguggcagagcaggugcuggaa

SEQ ID NO: 261649 - RNA, 19 nt, Human
cccagccaggucuugcauc

SEQ ID NO: 261650 - RNA, 22 nt, Human
gccuuggaaagcuggagcaguu

SEQ ID NO: 261651 - RNA, 22 nt, Human
gcucccaggaagagaagggcca

SEQ ID NO: 261652 - RNA, 22 nt, Human
uugcaaauuccaauccaauauu

SEQ ID NO: 261653 - RNA, 22 nt, Human
uggguccuuuuuggacuucuuc

SEQ ID NO: 261654 - RNA, 22 nt, Human
agaaucuuguuucuuguguguu

SEQ ID NO: 261655 - RNA, 22 nt, Human
cuuuggaaggcagagcucugug

SEQ ID NO: 261656 - RNA, 22 nt, Human
caggcccaugagggcagccaca

SEQ ID NO: 261657 - RNA, 22 nt, Human
gagguggucgaggagggguacc

SEQ ID NO: 261658 - RNA, 22 nt, Human
acccaggcuagaagugaauuau

SEQ ID NO: 261659 - RNA, 22 nt, Human
caaggcaggaagccugucuuau

SEQ ID NO: 261660 - RNA, 22 nt, Human
agcaauuauuguauaagaacaa

SEQ ID NO: 261661 - RNA, 22 nt, Human
gcuaauacuuuggaaagaaugu

SEQ ID NO: 261662 - RNA, 22 nt, Human
cuuuuccacugagccucacaaa

SEQ ID NO: 261663 - RNA, 22 nt, Human
uauuacaaauuauaaugggaga

SEQ ID NO: 261664 - RNA, 22 nt, Human
ucacagaagcaucauacccgga

SEQ ID NO: 261665 - RNA, 22 nt, Human
gagcuccugcugcauccugccu

SEQ ID NO: 261666 - RNA, 22 nt, Human
cacaggagcuguggggcagugu

SEQ ID NO: 261667 - RNA, 22 nt, Human
guuuuucuaaguagcgauauuu

SEQ ID NO: 261668 - RNA, 22 nt, Human
aaagcgcuauauaaauguuaac

SEQ ID NO: 261669 - RNA, 22 nt, Human
gacagggaaacauugaaguguc

SEQ ID NO: 261670 - RNA, 22 nt, Human
gcuucccaggcgccugaccuuu

SEQ ID NO: 261671 - RNA, 19 nt, Human
ccaggcuuuaugcaaauac

SEQ ID NO: 261672 - RNA, 22 nt, Human
ccagguguccccgucacugcag

SEQ ID NO: 261673 - RNA, 22 nt, Human
augcagaaugaguucacgaucu

SEQ ID NO: 261674 - RNA, 22 nt, Human
gagaggcucagggacuugcuga

SEQ ID NO: 261675 - RNA, 22 nt, Human
auucagaagcuauucuuaguuc

SEQ ID NO: 261676 - RNA, 22 nt, Human
cauuuagaagucuuagaacuau

SEQ ID NO: 261677 - RNA, 22 nt, Human
ucuuucugguuauguauagaga

SEQ ID NO: 261678 - RNA, 22 nt, Human
aaaguauauuuacuuacuguga

SEQ ID NO: 261679 - RNA, 22 nt, Human
aagcaacuccuaggaggaaagg

SEQ ID NO: 261680 - RNA, 22 nt, Human
cugagaauaaagccagcaggag

SEQ ID NO: 261681 - RNA, 22 nt, Human
gagcacagcugucuugcaagcu

SEQ ID NO: 261682 - RNA, 20 nt, Human
uccuccagaagggcagggug

SEQ ID NO: 261683 - RNA, 22 nt, Human
acugcaggccuuggugccagca

SEQ ID NO: 261684 - RNA, 22 nt, Human
uccagcccaucccuagccuggg

SEQ ID NO: 261685 - RNA, 18 nt, Human
ccagugccaagaguggca

SEQ ID NO: 261686 - RNA, 20 nt, Human
uguggacucaguuucuugcu

SEQ ID NO: 261687 - RNA, 22 nt, Human
cugcugaaguuguuggucuuuu

SEQ ID NO: 261688 - RNA, 22 nt, Human
ugcaggugcguuuucaagccuc

SEQ ID NO: 261689 - RNA, 22 nt, Human
gagagaagaauguuccgaggcc

SEQ ID NO: 261690 - RNA, 17 nt, Human
uugaacugcugagucag

SEQ ID NO: 261691 - RNA, 22 nt, Human
aacuauguuaauaaguuucauu

SEQ ID NO: 261692 - RNA, 20 nt, Human
ucuuccagguacagucugca

SEQ ID NO: 261693 - RNA, 20 nt, Human
gcacacauagaaaugcauau

SEQ ID NO: 261694 - RNA, 20 nt, Human
uagagagaggauauuaaagu

SEQ ID NO: 261695 - RNA, 22 nt, Human
ggggcaggagguguucucuuuu

SEQ ID NO: 261696 - RNA, 22 nt, Human
ucagugcauuguucauuguagg

SEQ ID NO: 261697 - RNA, 22 nt, Human
agccauuguugucuucaucuuc

SEQ ID NO: 261698 - RNA, 22 nt, Human
gcauguguuauuuuauguauga

SEQ ID NO: 261699 - RNA, 22 nt, Human
uucagagcucagaaaagugucu

SEQ ID NO: 261700 - RNA, 22 nt, Human
ugcccugggaggcuuuccuguu

SEQ ID NO: 261701 - RNA, 22 nt, Human
ggaugucuuuacuuugggauuu

SEQ ID NO: 261702 - RNA, 22 nt, Human
gccaugcauccuuggacuuggc

SEQ ID NO: 261703 - RNA, 22 nt, Human
caggccaggcugcauuugcccc

SEQ ID NO: 261704 - RNA, 22 nt, Human
guuuucauuacugcugugauuu

SEQ ID NO: 261705 - RNA, 22 nt, Human
gcuccagggaacagaauguacu

SEQ ID NO: 261706 - RNA, 20 nt, Human
ccagcucugugguuagauac

SEQ ID NO: 261707 - RNA, 22 nt, Human
caggagagcccggguccgggcu

SEQ ID NO: 261708 - RNA, 22 nt, Human
caggcauggugagaacucagcc

SEQ ID NO: 261709 - RNA, 22 nt, Human
ggaaggggugucgcccauggau

SEQ ID NO: 261710 - RNA, 22 nt, Human
agcccaggugacucauacaccc

SEQ ID NO: 261711 - RNA, 22 nt, Human
uuuguacacugucuacuaugaa

SEQ ID NO: 261712 - RNA, 22 nt, Human
acaccagggauaugaggaagga

SEQ ID NO: 261713 - RNA, 22 nt, Human
ccuccucugggaagauucagag

SEQ ID NO: 261714 - RNA, 22 nt, Human
caggacugaagggcacagggaa

SEQ ID NO: 261715 - RNA, 22 nt, Human
ggcagaggaaggaugaauucac

SEQ ID NO: 261716 - RNA, 22 nt, Human
acugcauuaucaccaagaugua

SEQ ID NO: 261717 - RNA, 22 nt, Human
gcucaggaaaacagucuaguaa

SEQ ID NO: 261718 - RNA, 22 nt, Human
uuucucauagucaugccucuua

SEQ ID NO: 261719 - RNA, 22 nt, Human
cugcaauaugaugucugagaaa

SEQ ID NO: 261720 - RNA, 22 nt, Human
caugaaaucugaguauguuucc

SEQ ID NO: 261721 - RNA, 22 nt, Human
agugucugcuuugagucaggug

SEQ ID NO: 261722 - RNA, 22 nt, Human
cuugcuggaaacucucucugcc

SEQ ID NO: 261723 - RNA, 22 nt, Human
ccagagccggcucccucagcuu

SEQ ID NO: 261724 - RNA, 22 nt, Human
uguuaacauaguggcgcaucug

SEQ ID NO: 261725 - RNA, 22 nt, Human
auacauucaaaggaaggauaga

SEQ ID NO: 261726 - RNA, 22 nt, Human
cagagcucagagcagggcacuc

SEQ ID NO: 261727 - RNA, 22 nt, Human
uccuggguuaauuaugauucac

SEQ ID NO: 261728 - RNA, 22 nt, Human
uccugggaccgagggaagagcu

SEQ ID NO: 261729 - RNA, 22 nt, Human
aaaaagacagaggaugaggcag

SEQ ID NO: 261730 - RNA, 22 nt, Human
ggaacuggagaaugcccucuuu

SEQ ID NO: 261731 - RNA, 21 nt, Human
ggaguuuuucuggaagggacu

SEQ ID NO: 261732 - RNA, 22 nt, Human
aaagcaguauaguggaagggcu

SEQ ID NO: 261733 - RNA, 18 nt, Human
uaacauguuuucauuaag

SEQ ID NO: 261734 - RNA, 22 nt, Human
augcaggauuagaaaguugccu

SEQ ID NO: 261735 - RNA, 22 nt, Human
uacaaagcuguauagccugguc

SEQ ID NO: 261736 - RNA, 22 nt, Human
ucaaugauaguacaaucagccu

SEQ ID NO: 261737 - RNA, 22 nt, Human
cauccauucagugcaaaucaca

SEQ ID NO: 261738 - RNA, 22 nt, Human
uuugacaugcaaagcacuuuag

SEQ ID NO: 261739 - RNA, 22 nt, Human
ugggccacucuucccugggucu

SEQ ID NO: 261740 - RNA, 22 nt, Human
ugcaauuucaggcauauauugu

SEQ ID NO: 261741 - RNA, 22 nt, Human
cauucccacguguucuuugcuu

SEQ ID NO: 261742 - RNA, 22 nt, Human
uguggggcuuacaaaggcagau

SEQ ID NO: 261743 - RNA, 22 nt, Human
uuuuuuauaucaacugaagucu

SEQ ID NO: 261744 - RNA, 22 nt, Human
aaggcucccucuucucgagugu

SEQ ID NO: 261745 - RNA, 22 nt, Human
uuggcccagacucggggacuga

SEQ ID NO: 261746 - RNA, 22 nt, Human
accugucugcaugaucuaaaac

SEQ ID NO: 261747 - RNA, 22 nt, Human
gguguagcucugugucccacug

SEQ ID NO: 261748 - RNA, 22 nt, Human
aguauucuggaauucuauguga

SEQ ID NO: 261749 - RNA, 22 nt, Human
aauguacaccguggguuuuuua

SEQ ID NO: 261750 - RNA, 22 nt, Human
gacaagcucuuguuucaugguu

SEQ ID NO: 261751 - RNA, 22 nt, Human
acugccuugaaagauuguugag

SEQ ID NO: 261752 - RNA, 22 nt, Human
cccaggagguuggggcuacagu

SEQ ID NO: 261753 - RNA, 22 nt, Human
aggcugugcauuuuggagggcc

SEQ ID NO: 261754 - RNA, 22 nt, Human
aggagcugucagagugccagag

SEQ ID NO: 261755 - RNA, 22 nt, Human
cuguaaauaugaagaauauaug

SEQ ID NO: 261756 - RNA, 22 nt, Human
gagaggagguggcuaugacagc

SEQ ID NO: 261757 - RNA, 22 nt, Human
aaauuucuguuguuuugagcca

SEQ ID NO: 261758 - RNA, 22 nt, Human
gcagaggagcaagcuggacacc

SEQ ID NO: 261759 - RNA, 22 nt, Human
uucucaggccuuugggauggga

SEQ ID NO: 261760 - RNA, 22 nt, Human
ucacagcuuugagcagagacca

SEQ ID NO: 261761 - RNA, 22 nt, Human
ugggaacauuuugagcugagag

SEQ ID NO: 261762 - RNA, 22 nt, Human
cuccaggcgcuuaccaagcgcu

SEQ ID NO: 261763 - RNA, 21 nt, Human
uuguguuuccccagucacuuu

SEQ ID NO: 261764 - RNA, 22 nt, Human
uguggacuuuauuuuagggagg

SEQ ID NO: 261765 - RNA, 22 nt, Human
ucuggcuguguaagguagcacc

SEQ ID NO: 261766 - RNA, 19 nt, Human
ugcaaauucuaaaaacuga

SEQ ID NO: 261767 - RNA, 22 nt, Human
ggcacacagauggagcacuagc

SEQ ID NO: 261768 - RNA, 22 nt, Human
gagguuggagggcuggccugca

SEQ ID NO: 261769 - RNA, 19 nt, Human
agugagcauccagagaggu

SEQ ID NO: 261770 - RNA, 22 nt, Human
caggggccaggcugucugcugu

SEQ ID NO: 261771 - RNA, 22 nt, Human
gccugcaguucugugcuaggca

SEQ ID NO: 261772 - RNA, 22 nt, Human
aggcucagcccaagguggagag

SEQ ID NO: 261773 - RNA, 23 nt, Human
uucaaaacuggaaaaucagaugc

SEQ ID NO: 261774 - RNA, 16 nt, Human
gagggcagaggcggaa

SEQ ID NO: 261775 - RNA, 22 nt, Human
uccaggcaaagugcugggcugc

SEQ ID NO: 261776 - RNA, 22 nt, Human
ccuuggcuaggcagcggcuguc

SEQ ID NO: 261777 - RNA, 22 nt, Human
uucuguaggacuucugccaacu

SEQ ID NO: 261778 - RNA, 22 nt, Human
aaguucaaguaguguuacaugg

SEQ ID NO: 261779 - RNA, 22 nt, Human
aguuugccccgucacccuggug

SEQ ID NO: 261780 - RNA, 22 nt, Human
aaaaaugcuuggacuuaauaaa

SEQ ID NO: 261781 - RNA, 22 nt, Human
gaacaauacaggcuuuauuccu

SEQ ID NO: 261782 - RNA, 22 nt, Human
uaaggaaaauggacaucaaaca

SEQ ID NO: 261783 - RNA, 20 nt, Human
aggcucagauacccagggaa

SEQ ID NO: 261784 - RNA, 22 nt, Human
uauaaaacagaaagcacuaccu

SEQ ID NO: 261785 - RNA, 22 nt, Human
guuuccugucugcuuuacuaua

SEQ ID NO: 261786 - RNA, 21 nt, Human
uucucuggauaggccaguccu

SEQ ID NO: 261787 - RNA, 22 nt, Human
ugcccagguuugagugcccaag

SEQ ID NO: 261788 - RNA, 22 nt, Human
gguccguuuuugaagacagugg

SEQ ID NO: 261789 - RNA, 22 nt, Human
aacacuuagauuuuuaagguuu

SEQ ID NO: 261790 - RNA, 22 nt, Human
agaagucuggaauuccugcagg

SEQ ID NO: 261791 - RNA, 22 nt, Human
cauacauaugcauguguguaua

SEQ ID NO: 261792 - RNA, 22 nt, Human
uguuaacagccagauuugguga

SEQ ID NO: 261793 - RNA, 22 nt, Human
ugagcuggcaggggcucaggga

SEQ ID NO: 261794 - RNA, 22 nt, Human
ucccagggugcgccugcccucg

SEQ ID NO: 261795 - RNA, 22 nt, Human
uggagcaggacugcugcccuca

SEQ ID NO: 261796 - RNA, 22 nt, Human
ugcaaauugcgauuuuuauuag

SEQ ID NO: 261797 - RNA, 22 nt, Human
cauagaaaucaggugagaaucu

SEQ ID NO: 261798 - RNA, 22 nt, Human
agaggcacaacagucccauugu

SEQ ID NO: 261799 - RNA, 22 nt, Human
ucuugggauagugucucauggc

SEQ ID NO: 261800 - RNA, 22 nt, Human
ucaggaaagaguuagaugauua

SEQ ID NO: 261801 - RNA, 22 nt, Human
cacagacuccccgccauagugg

SEQ ID NO: 261802 - RNA, 22 nt, Human
aacaaaugauuguugguuggag

SEQ ID NO: 261803 - RNA, 18 nt, Human
cucaggccuuucccugug

SEQ ID NO: 261804 - RNA, 22 nt, Human
cauuuacaauguacagguugug

SEQ ID NO: 261805 - RNA, 22 nt, Human
uggcagcagcuaacuuaggcag

SEQ ID NO: 261806 - RNA, 22 nt, Human
guccagaagcucaaguugaacu

SEQ ID NO: 261807 - RNA, 22 nt, Human
aagccuuuuccaccuaauagag

SEQ ID NO: 261808 - RNA, 22 nt, Human
uuaaggaacuugucuuucucuu

SEQ ID NO: 261809 - RNA, 22 nt, Human
uauuucagacacugaucuugca

SEQ ID NO: 261810 - RNA, 22 nt, Human
uccuggccucacaguccugggu

SEQ ID NO: 261811 - RNA, 22 nt, Human
guuuccugacuguggaauuaua

SEQ ID NO: 261812 - RNA, 22 nt, Human
agagccagaccauugccgugca

SEQ ID NO: 261813 - RNA, 22 nt, Human
uucauguuuguaggacugaggc

SEQ ID NO: 261814 - RNA, 21 nt, Human
uccuccuggccaggcggcccc

SEQ ID NO: 261815 - RNA, 22 nt, Human
agguccaguuuucugacaaggg

SEQ ID NO: 261816 - RNA, 19 nt, Human
guccucucaacaacccggg

SEQ ID NO: 261817 - RNA, 22 nt, Human
gagcccugcgugucugggggca

SEQ ID NO: 261818 - RNA, 22 nt, Human
accuguuuaccugcaccuguuu

SEQ ID NO: 261819 - RNA, 22 nt, Human
aagcauuuuucacagcaacagc

SEQ ID NO: 261820 - RNA, 22 nt, Human
ucuucaguagguccucagaauc

SEQ ID NO: 261821 - RNA, 22 nt, Human
ucuccagucucaagacauugag

SEQ ID NO: 261822 - RNA, 22 nt, Human
uggaaccaucaaagagauccug

SEQ ID NO: 261823 - RNA, 22 nt, Human
gccugaggaauugaggggguaa

SEQ ID NO: 261824 - RNA, 22 nt, Human
gacagcagauacuuucauugaa

SEQ ID NO: 261825 - RNA, 22 nt, Human
gcccagcacuccucucugacau

SEQ ID NO: 261826 - RNA, 22 nt, Human
cugagggagggacuuugagacu

SEQ ID NO: 261827 - RNA, 22 nt, Human
agauaaacccaacuuaaugaag

SEQ ID NO: 261828 - RNA, 22 nt, Human
cagagagcaugggaggcccgag

SEQ ID NO: 261829 - RNA, 22 nt, Human
uugaggaggaacugugaggcaa

SEQ ID NO: 261830 - RNA, 22 nt, Human
cagcugaaccuuucccuggagc

SEQ ID NO: 261831 - RNA, 22 nt, Human
uuuccuguugccaucaagaaug

SEQ ID NO: 261832 - RNA, 22 nt, Human
uggauuuuagcauguaacugug

SEQ ID NO: 261833 - RNA, 22 nt, Human
aaauguaguauguugcauguau

SEQ ID NO: 261834 - RNA, 22 nt, Human
ggguaggagaggugucugugug

SEQ ID NO: 261835 - RNA, 17 nt, Human
ugcaggcuguuauagcc

SEQ ID NO: 261836 - RNA, 22 nt, Human
uggccaguuugcucaggcaguc

SEQ ID NO: 261837 - RNA, 22 nt, Human
ugggggcagccaggcugucaag

SEQ ID NO: 261838 - RNA, 22 nt, Human
gcucccagggacacuggccacu

SEQ ID NO: 261839 - RNA, 22 nt, Human
ccauggccugaaggagugcauc

SEQ ID NO: 261840 - RNA, 22 nt, Human
ucucugagccccugccucuuuc

SEQ ID NO: 261841 - RNA, 22 nt, Human
agagucaguaacauauauggua

SEQ ID NO: 261842 - RNA, 22 nt, Human
cacuuuacuaucuauaaaauaa

SEQ ID NO: 261843 - RNA, 22 nt, Human
agugucugccuauuuuucaagc

SEQ ID NO: 261844 - RNA, 22 nt, Human
uacaugugguagggagggcagu

SEQ ID NO: 261845 - RNA, 22 nt, Human
gcagcuguacuggcagcauugu

SEQ ID NO: 261846 - RNA, 22 nt, Human
aaucuuaaagaauauucuacca

SEQ ID NO: 261847 - RNA, 22 nt, Human
gggcagagaaauggacaguugg

SEQ ID NO: 261848 - RNA, 22 nt, Human
cugaggaguuucuuauaugugu

SEQ ID NO: 261849 - RNA, 22 nt, Human
acccucugccuugagcagugcc

SEQ ID NO: 261850 - RNA, 22 nt, Human
uacaagauaagaauuggcaagg

SEQ ID NO: 261851 - RNA, 22 nt, Human
cucagcaacccuagaacauuug

SEQ ID NO: 261852 - RNA, 22 nt, Human
cuuuuccuauugauucuguuac

SEQ ID NO: 261853 - RNA, 22 nt, Human
gccaaaguccacuugcuuucug

SEQ ID NO: 261854 - RNA, 22 nt, Human
cacuuuauuauaaauuugagag

SEQ ID NO: 261855 - RNA, 22 nt, Human
cuagaaaugcucaagagaaagu

SEQ ID NO: 261856 - RNA, 22 nt, Human
cuuuugcagccauuauugcugc

SEQ ID NO: 261857 - RNA, 22 nt, Human
cuggcucccgaagcccucagug

SEQ ID NO: 261858 - RNA, 22 nt, Human
gcacagagucacuagcuaagca

SEQ ID NO: 261859 - RNA, 22 nt, Human
acccuucauagaggagaagcug

SEQ ID NO: 261860 - RNA, 22 nt, Human
uguggcucugccuggcaguauu

SEQ ID NO: 261861 - RNA, 22 nt, Human
cccagugucucuugugccuuuc

SEQ ID NO: 261862 - RNA, 22 nt, Human
gugcauuacauguaauaaaaua

SEQ ID NO: 261863 - RNA, 22 nt, Human
acuuguuucaacuguacucuca

SEQ ID NO: 261864 - RNA, 22 nt, Human
augacaugauugccauuugaua

SEQ ID NO: 261865 - RNA, 22 nt, Human
aauggagacuucaaaauggauu

SEQ ID NO: 261866 - RNA, 22 nt, Human
uuucucugugccauuuccauaa

SEQ ID NO: 261867 - RNA, 21 nt, Human
ugaucauuuguguaaaggaga

SEQ ID NO: 261868 - RNA, 22 nt, Human
cuuuguuaucuguaaaugguua

SEQ ID NO: 261869 - RNA, 19 nt, Human
gggcaguggcacuagggag

SEQ ID NO: 261870 - RNA, 23 nt, Human
ugcagggcaaguuagagacccca

SEQ ID NO: 261871 - RNA, 22 nt, Human
uucaggcauggaaacuggauua

SEQ ID NO: 261872 - RNA, 22 nt, Human
guacauuucucuuguucuuauu

SEQ ID NO: 261873 - RNA, 22 nt, Human
gcucuguaucuguggggcuucc

SEQ ID NO: 261874 - RNA, 22 nt, Human
aggggaccaaaauguccugccu

SEQ ID NO: 261875 - RNA, 18 nt, Human
ucuguugagcagagaggc

SEQ ID NO: 261876 - RNA, 16 nt, Human
caccaguccuuccugc

SEQ ID NO: 261877 - RNA, 21 nt, Human
uuacaacauuuguguucuaug

SEQ ID NO: 261878 - RNA, 22 nt, Human
uauguuauauuuugucaauugu

SEQ ID NO: 261879 - RNA, 22 nt, Human
ggcagcacugcagcuuguuggg

SEQ ID NO: 261880 - RNA, 22 nt, Human
uuccuggcugaucuaccaaagu

SEQ ID NO: 261881 - RNA, 22 nt, Human
acacuugaggaauguggugauu

SEQ ID NO: 261882 - RNA, 22 nt, Human
ugcaauaaggaguaauaguaaa

SEQ ID NO: 261883 - RNA, 17 nt, Human
agcuccuggggucuuua

SEQ ID NO: 261884 - RNA, 22 nt, Human
cuccaugggggcuggccugugu

SEQ ID NO: 261885 - RNA, 22 nt, Human
aaaguuuuguugauuguggaau

SEQ ID NO: 261886 - RNA, 22 nt, Human
gccaggcaguucaaguacacca

SEQ ID NO: 261887 - RNA, 22 nt, Human
gcuccuggugcaaaguuucuuc

SEQ ID NO: 261888 - RNA, 22 nt, Human
gcaagcaguuacccaggauucg

SEQ ID NO: 261889 - RNA, 22 nt, Human
cauugauuauugaagggucuuu

SEQ ID NO: 261890 - RNA, 22 nt, Human
ucccucaucucacaugugugug

SEQ ID NO: 261891 - RNA, 22 nt, Human
auugaaucugcacuaguauuuu

SEQ ID NO: 261892 - RNA, 22 nt, Human
gugcaaaaauaauugugguuuu

SEQ ID NO: 261893 - RNA, 22 nt, Human
aagaggucauaccagauaaggg

SEQ ID NO: 261894 - RNA, 22 nt, Human
gaggcacaguucuuccuccaga

SEQ ID NO: 261895 - RNA, 22 nt, Human
acagcuggacaggggagaguuu

SEQ ID NO: 261896 - RNA, 22 nt, Human
aagcagcagcaggauuaaagag

SEQ ID NO: 261897 - RNA, 22 nt, Human
aaauaacagucagggacaacau

SEQ ID NO: 261898 - RNA, 22 nt, Human
uucauguaguguaaugucuuca

SEQ ID NO: 261899 - RNA, 22 nt, Human
gaaugagggagauguuggugca

SEQ ID NO: 261900 - RNA, 22 nt, Human
gaugugagugguagcugggauu

SEQ ID NO: 261901 - RNA, 22 nt, Human
uguuucuucucacacaaacuca

SEQ ID NO: 261902 - RNA, 22 nt, Human
ggccuaggaaggggauguaacu

SEQ ID NO: 261903 - RNA, 22 nt, Human
aggccuggugaaugaaguaucu

SEQ ID NO: 261904 - RNA, 23 nt, Human
uuguccagcugguuugggccaca

SEQ ID NO: 261905 - RNA, 22 nt, Human
gcagccucugcaguucaggagg

SEQ ID NO: 261906 - RNA, 22 nt, Human
caggcccugcugcugagaccuu

SEQ ID NO: 261907 - RNA, 22 nt, Human
agugcuggauuacaggcgugag

SEQ ID NO: 261908 - RNA, 22 nt, Human
ugcuggagaccugcuugcacca

SEQ ID NO: 261909 - RNA, 22 nt, Human
cuccagccucaucuccuggcug

SEQ ID NO: 261910 - RNA, 22 nt, Human
ccagagaggccaaggucguggu

SEQ ID NO: 261911 - RNA, 19 nt, Human
uccuggcauuuguaggaaa

SEQ ID NO: 261912 - RNA, 22 nt, Human
gaacuggguccuugagucuaga

SEQ ID NO: 261913 - RNA, 22 nt, Human
aaauagcuucuaagccuuuuga

SEQ ID NO: 261914 - RNA, 22 nt, Human
agguguggcuggggcagaggcc

SEQ ID NO: 261915 - RNA, 22 nt, Human
ccuggcugcaguuuuugcagaa

SEQ ID NO: 261916 - RNA, 22 nt, Human
cagacucuugagcugauuguau

SEQ ID NO: 261917 - RNA, 22 nt, Human
uuccaguucccaugaggauuaa

SEQ ID NO: 261918 - RNA, 18 nt, Human
cugaggcuggcaggagcc

SEQ ID NO: 261919 - RNA, 22 nt, Human
cuggaaaaugaagaagcagagg

SEQ ID NO: 261920 - RNA, 22 nt, Human
guccugagcccucagcacagca

SEQ ID NO: 261921 - RNA, 22 nt, Human
uguuccaauaaggaguugaaau

SEQ ID NO: 261922 - RNA, 22 nt, Human
uuuaaagagaaugugaaggagu

SEQ ID NO: 261923 - RNA, 22 nt, Human
ggauguuuggcguuugaauugc

SEQ ID NO: 261924 - RNA, 22 nt, Human
uguaaacuguagaaaauacuuu

SEQ ID NO: 261925 - RNA, 22 nt, Human
gaggggcaaugagggaaagagu

SEQ ID NO: 261926 - RNA, 22 nt, Human
gaauuguagagggaacagaagc

SEQ ID NO: 261927 - RNA, 22 nt, Human
auuucagagaaugaaccuaauc

SEQ ID NO: 261928 - RNA, 22 nt, Human
cagcaggauaugguggagagag

SEQ ID NO: 261929 - RNA, 22 nt, Human
gacacagcuaauggcuuaggac

SEQ ID NO: 261930 - RNA, 22 nt, Human
uuucacauucuucugaaucuac

SEQ ID NO: 261931 - RNA, 22 nt, Human
uagugaauuccuaauaggaaga

SEQ ID NO: 261932 - RNA, 22 nt, Human
ucucugagcccagugucccccu

SEQ ID NO: 261933 - RNA, 22 nt, Human
aauuuagauugauaaacaugga

SEQ ID NO: 261934 - RNA, 22 nt, Human
auccaggcgaaugcagaaggcc

SEQ ID NO: 261935 - RNA, 21 nt, Human
agaguuacugucauccuaggu

SEQ ID NO: 261936 - RNA, 22 nt, Human
cuauacaguaaccacagugauu

SEQ ID NO: 261937 - RNA, 22 nt, Human
uauuucaacguaugaaaagcug

SEQ ID NO: 261938 - RNA, 22 nt, Human
uccuggcagguguauuggcugu

SEQ ID NO: 261939 - RNA, 22 nt, Human
uaggcugagcuuguagaucgua

SEQ ID NO: 261940 - RNA, 22 nt, Human
agcgugaauuaguugguacaca

SEQ ID NO: 261941 - RNA, 22 nt, Human
aauugcuuuuauuuagggccag

SEQ ID NO: 261942 - RNA, 22 nt, Human
uuccaggaacacucuguguccc

SEQ ID NO: 261943 - RNA, 22 nt, Human
uggcucuguggauguucugacc

SEQ ID NO: 261944 - RNA, 22 nt, Human
ccuccuuccugggacagagcug

SEQ ID NO: 261945 - RNA, 22 nt, Human
aguaggacuagggguugaggca

SEQ ID NO: 261946 - RNA, 22 nt, Human
gggcaauuaaggucccguuucc

SEQ ID NO: 261947 - RNA, 22 nt, Human
ucaaugagcuggggacguguac

SEQ ID NO: 261948 - RNA, 22 nt, Human
uugacaaaaaccucauuucacc

SEQ ID NO: 261949 - RNA, 23 nt, Human
aucaaacuggugagaaugucagu

SEQ ID NO: 261950 - RNA, 18 nt, Human
uggcuucuauuuuacuca

SEQ ID NO: 261951 - RNA, 23 nt, Human
aaacuacaacgccaggcacugag

SEQ ID NO: 261952 - RNA, 20 nt, Human
auagaaucacaaguccugaa

SEQ ID NO: 261953 - RNA, 22 nt, Human
cacaauuuguuuuaucaguauu

SEQ ID NO: 261954 - RNA, 22 nt, Human
agcuccuguucugagagcagga

SEQ ID NO: 261955 - RNA, 22 nt, Human
uaauacaauggaguugggcccc

SEQ ID NO: 261956 - RNA, 22 nt, Human
uaaagcauguuucaguaagguu

SEQ ID NO: 261957 - RNA, 22 nt, Human
gaggcagagugcaccccaggag

SEQ ID NO: 261958 - RNA, 19 nt, Human
agcuguggaugugggauuu

SEQ ID NO: 261959 - RNA, 21 nt, Human
agcagaggggacauguuugau

SEQ ID NO: 261960 - RNA, 22 nt, Human
aggcagagagcaguggccgucu

SEQ ID NO: 261961 - RNA, 22 nt, Human
aacuauacucuguaaaugugcu

SEQ ID NO: 261962 - RNA, 22 nt, Human
gcugggaggcagcaccuuuagc

SEQ ID NO: 261963 - RNA, 22 nt, Human
ugucccucauugacgcugugcc

SEQ ID NO: 261964 - RNA, 22 nt, Human
gcccuggccuucaucucagaca

SEQ ID NO: 261965 - RNA, 22 nt, Human
ggaaagggcauggccuuuucac

SEQ ID NO: 261966 - RNA, 22 nt, Human
acuuucaugcucugagcacugg

SEQ ID NO: 261967 - RNA, 22 nt, Human
uggguccuggcuuugucagggu

SEQ ID NO: 261968 - RNA, 22 nt, Human
guauucagggcuagucagagga

SEQ ID NO: 261969 - RNA, 22 nt, Human
agagugauucuaguuagggaau

SEQ ID NO: 261970 - RNA, 22 nt, Human
gugggaagagccaauuggggua

SEQ ID NO: 261971 - RNA, 22 nt, Human
uccaggaaagugggaugugugu

SEQ ID NO: 261972 - RNA, 22 nt, Human
guuuagaauucuaacuuuaagg

SEQ ID NO: 261973 - RNA, 21 nt, Human
uuuaaagaauaggaagggagg

SEQ ID NO: 261974 - RNA, 20 nt, Human
ggcaguuaaggcacagucau

SEQ ID NO: 261975 - RNA, 22 nt, Human
gcagggaccuugcccacccucc

SEQ ID NO: 261976 - RNA, 22 nt, Human
aagcacaguaaaagcagauuuu

SEQ ID NO: 261977 - RNA, 22 nt, Human
acuacaguacuauaucuauagg

SEQ ID NO: 261978 - RNA, 22 nt, Human
gaaggagacccugaagaugcug

SEQ ID NO: 261979 - RNA, 22 nt, Human
uggccagguguggguucucaga

SEQ ID NO: 261980 - RNA, 22 nt, Human
aucuguacuaauuaauuaaugu

SEQ ID NO: 261981 - RNA, 22 nt, Human
ugauuugcauggagaauaacag

SEQ ID NO: 261982 - RNA, 22 nt, Human
augaagcagaauuucccacucu

SEQ ID NO: 261983 - RNA, 22 nt, Human
ucagaggaagcaucaaguucuc

SEQ ID NO: 261984 - RNA, 22 nt, Human
gggcucucgauuagacccuggg

SEQ ID NO: 261985 - RNA, 22 nt, Human
aggcucaggucucaggucuggc

SEQ ID NO: 261986 - RNA, 22 nt, Human
ucugucauguuuccauuacaug

SEQ ID NO: 261987 - RNA, 22 nt, Human
agaauacaguucaguaauggau

SEQ ID NO: 261988 - RNA, 22 nt, Human
gcccagagggaagaggugucau

SEQ ID NO: 261989 - RNA, 22 nt, Human
uucuguuuugcacagacuugaa

SEQ ID NO: 261990 - RNA, 22 nt, Human
gucucagguauugaaugggaac

SEQ ID NO: 261991 - RNA, 22 nt, Human
cugaggagcguuggucacgugu

SEQ ID NO: 261992 - RNA, 22 nt, Human
uccagccaugacucggacagug

SEQ ID NO: 261993 - RNA, 22 nt, Human
uuuagacaagauccuucugaau

SEQ ID NO: 261994 - RNA, 22 nt, Human
ucugaggaaucuugacacauuu

SEQ ID NO: 261995 - RNA, 22 nt, Human
cagugagguggaguaguuccca

SEQ ID NO: 261996 - RNA, 22 nt, Human
uuccuugaaaguuugaacugac

SEQ ID NO: 261997 - RNA, 22 nt, Human
aagucugggccagggcacagcc

SEQ ID NO: 261998 - RNA, 22 nt, Human
gcagaagucagaccaucugaau

SEQ ID NO: 261999 - RNA, 22 nt, Human
uuggaaaugcaaauauauugaa

SEQ ID NO: 262000 - RNA, 22 nt, Human
ucagacaggcuucuuucucccu

SEQ ID NO: 262001 - RNA, 22 nt, Human
ccucugagaccagcucugcacc

SEQ ID NO: 262002 - RNA, 22 nt, Human
augaggcagcugacagcuguuc

SEQ ID NO: 262003 - RNA, 22 nt, Human
uccagggccaguccuugucugu

SEQ ID NO: 262004 - RNA, 19 nt, Human
aggcccagcgcugggggcu

SEQ ID NO: 262005 - RNA, 22 nt, Human
acagcucuuaggcagaaccaac

SEQ ID NO: 262006 - RNA, 22 nt, Human
aagccuggcacauuggagucug

SEQ ID NO: 262007 - RNA, 22 nt, Human
cucuggagaacuccuugugucu

SEQ ID NO: 262008 - RNA, 22 nt, Human
uguuccugaaugccuggcuggc

SEQ ID NO: 262009 - RNA, 22 nt, Human
gcuguacaaggccucugccauc

SEQ ID NO: 262010 - RNA, 21 nt, Human
auuuagaaggaaauuuugcaa

SEQ ID NO: 262011 - RNA, 22 nt, Human
gggcugggcaugguguucccuc

SEQ ID NO: 262012 - RNA, 22 nt, Human
acaugaaaacugguuccuucag

SEQ ID NO: 262013 - RNA, 22 nt, Human
cagcugucuggggagugcucgc

SEQ ID NO: 262014 - RNA, 22 nt, Human
uggccuguguggcuuccuggga

SEQ ID NO: 262015 - RNA, 22 nt, Human
auggugcuccugcaggaagcag

SEQ ID NO: 262016 - RNA, 22 nt, Human
cgaaaucagcaucuugaggcaa

SEQ ID NO: 262017 - RNA, 22 nt, Human
acuuucuguuagaugaauggau

SEQ ID NO: 262018 - RNA, 22 nt, Human
ucuagagacuauaauguguccu

SEQ ID NO: 262019 - RNA, 22 nt, Human
ugacaauacagagagagcaaaa

SEQ ID NO: 262020 - RNA, 22 nt, Human
uuucuguaaguggcaaauaaug

SEQ ID NO: 262021 - RNA, 22 nt, Human
gguucacauauugagaguauuc

SEQ ID NO: 262022 - RNA, 22 nt, Human
ucuaggaaauuguuacuauauu

SEQ ID NO: 262023 - RNA, 22 nt, Human
uccccacucaccacuggccaaa

SEQ ID NO: 262024 - RNA, 22 nt, Human
uuacagacaaacuguguuaagu

SEQ ID NO: 262025 - RNA, 22 nt, Human
aacaucuacuaagugccaggca

SEQ ID NO: 262026 - RNA, 22 nt, Human
acacuguagauauagaguuagu

SEQ ID NO: 262027 - RNA, 22 nt, Human
gucugagggacagaguccuggc

SEQ ID NO: 262028 - RNA, 22 nt, Human
gucugggauugggguaaagaag

SEQ ID NO: 262029 - RNA, 22 nt, Human
ggggaccuucccagagcaguug

SEQ ID NO: 262030 - RNA, 22 nt, Human
agugugagccuacaggccaaag

SEQ ID NO: 262031 - RNA, 22 nt, Human
uuguaauuaauggcagcaauua

SEQ ID NO: 262032 - RNA, 22 nt, Human
gcuucccauaguggaauucggg

SEQ ID NO: 262033 - RNA, 22 nt, Human
aagcugaagccggaucaaaaag

SEQ ID NO: 262034 - RNA, 22 nt, Human
ccuuaaaagaacuaucucuucu

SEQ ID NO: 262035 - RNA, 22 nt, Human
aaguaucugggagauuugcuuu

SEQ ID NO: 262036 - RNA, 22 nt, Human
acucuguacgcaagagauggag

SEQ ID NO: 262037 - RNA, 19 nt, Human
cuggcuucaagcaguccuc

SEQ ID NO: 262038 - RNA, 22 nt, Human
ucccuggcacaagaaggcuguc

SEQ ID NO: 262039 - RNA, 22 nt, Human
gagcccugugauucuguugugu

SEQ ID NO: 262040 - RNA, 22 nt, Human
aucugggcauggaggaaagaga

SEQ ID NO: 262041 - RNA, 22 nt, Human
uccucagcauuagcacagacau

SEQ ID NO: 262042 - RNA, 22 nt, Human
aggacaguggcaaggcaggaca

SEQ ID NO: 262043 - RNA, 22 nt, Human
aucaucuuaucugacucauuuu

SEQ ID NO: 262044 - RNA, 22 nt, Human
uaagacacauucauaucugucu

SEQ ID NO: 262045 - RNA, 20 nt, Human
uacaaguacauuauaguuau

SEQ ID NO: 262046 - RNA, 22 nt, Human
uucucauucugacucaguguag

SEQ ID NO: 262047 - RNA, 22 nt, Human
ucccugagacucuggaguguaa

SEQ ID NO: 262048 - RNA, 22 nt, Human
uaauuuuaacugugcuguuugg

SEQ ID NO: 262049 - RNA, 22 nt, Human
gccagccugugggggcucugug

SEQ ID NO: 262050 - RNA, 22 nt, Human
aggcaggugggagugauuccuu

SEQ ID NO: 262051 - RNA, 22 nt, Human
uacauauacugagugauuugcu

SEQ ID NO: 262052 - RNA, 22 nt, Human
ccugccagcgcuuaucucucgg

SEQ ID NO: 262053 - RNA, 22 nt, Human
acauugaauucaaaauuacuga

SEQ ID NO: 262054 - RNA, 22 nt, Human
ccaggagacccagggaaggagc

SEQ ID NO: 262055 - RNA, 22 nt, Human
uccagccaacugccuagggagc

SEQ ID NO: 262056 - RNA, 22 nt, Human
guuauugacucucuuguggcuu

SEQ ID NO: 262057 - RNA, 22 nt, Human
ucuguaaucaagauauuugaga

SEQ ID NO: 262058 - RNA, 22 nt, Human
aggcucugaugcaagcccaggg

SEQ ID NO: 262059 - RNA, 22 nt, Human
uacaaugauuagcuaacuugcc

SEQ ID NO: 262060 - RNA, 22 nt, Human
gcauguguaugguaggaauauu

SEQ ID NO: 262061 - RNA, 22 nt, Human
aaaugcagaucccugaaucuca

SEQ ID NO: 262062 - RNA, 22 nt, Human
gagcaacaguggcagugguggg

SEQ ID NO: 262063 - RNA, 22 nt, Human
aaagcaagacaggaguuucaga

SEQ ID NO: 262064 - RNA, 22 nt, Human
auccuucuccaaaacuggcucc

SEQ ID NO: 262065 - RNA, 22 nt, Human
uuguuuccauugcagacugugu

SEQ ID NO: 262066 - RNA, 22 nt, Human
uggggagguucgggaaucuugu

SEQ ID NO: 262067 - RNA, 22 nt, Human
cacaauuccauggcauucuuug

SEQ ID NO: 262068 - RNA, 16 nt, Human
ucuuaguuguguggua

SEQ ID NO: 262069 - RNA, 22 nt, Human
acagggaauggagggaucagua

SEQ ID NO: 262070 - RNA, 22 nt, Human
ucagucaugaccauggggugga

SEQ ID NO: 262071 - RNA, 22 nt, Human
cuggacagaaaaggccacugga

SEQ ID NO: 262072 - RNA, 22 nt, Human
cgccugcucuguuuccaugugg

SEQ ID NO: 262073 - RNA, 22 nt, Human
ggcagcucacgggcauggggug

SEQ ID NO: 262074 - RNA, 22 nt, Human
aauguguacuuuuucaugcuca

SEQ ID NO: 262075 - RNA, 22 nt, Human
gacccauauauacguaauuugu

SEQ ID NO: 262076 - RNA, 22 nt, Human
cuugcuucauuagugucuuagu

SEQ ID NO: 262077 - RNA, 17 nt, Human
ccaggcuccaucacugu

SEQ ID NO: 262078 - RNA, 22 nt, Human
gcacaguaggcucagcucuauc

SEQ ID NO: 262079 - RNA, 21 nt, Human
uccaggccaugguggggaggc

SEQ ID NO: 262080 - RNA, 22 nt, Human
ccuugcccugagcaggggucag

SEQ ID NO: 262081 - RNA, 22 nt, Human
agaagccacaggaaagcagcuu

SEQ ID NO: 262082 - RNA, 22 nt, Human
uggcuucuuucuuuccaugugu

SEQ ID NO: 262083 - RNA, 22 nt, Human
gccaggaggcuuaacuggacag

SEQ ID NO: 262084 - RNA, 22 nt, Human
ugucuguauuagucagcauucu

SEQ ID NO: 262085 - RNA, 22 nt, Human
ugaaaaaccucaguccgcuuua

SEQ ID NO: 262086 - RNA, 22 nt, Human
gcuuucuguagguaguuacugu

SEQ ID NO: 262087 - RNA, 22 nt, Human
aaaggcuuuaaaauguacauau

SEQ ID NO: 262088 - RNA, 22 nt, Human
aauuauacaugaaggcauuaua

SEQ ID NO: 262089 - RNA, 22 nt, Human
gcuggaggcaguucagacacca

SEQ ID NO: 262090 - RNA, 22 nt, Human
cuccaggacagauucagggcca

SEQ ID NO: 262091 - RNA, 18 nt, Human
agcagguggcgucugcag

SEQ ID NO: 262092 - RNA, 22 nt, Human
aaauguaccuugauaguuuggu

SEQ ID NO: 262093 - RNA, 22 nt, Human
aacaaugugauugaagcuagaa

SEQ ID NO: 262094 - RNA, 22 nt, Human
uccuaaaggcugcuuuuauauu

SEQ ID NO: 262095 - RNA, 22 nt, Human
agagcucaguguguuaugguua

SEQ ID NO: 262096 - RNA, 22 nt, Human
ccugccuguacuagagacccag

SEQ ID NO: 262097 - RNA, 22 nt, Human
agagaauuaacauuccauggcu

SEQ ID NO: 262098 - RNA, 22 nt, Human
cugaggaguuggugaauaagcc

SEQ ID NO: 262099 - RNA, 22 nt, Human
caggacaguuugcuuugcccug

SEQ ID NO: 262100 - RNA, 21 nt, Human
aguccaggaggaggccagguu

SEQ ID NO: 262101 - RNA, 22 nt, Human
aguccuuagaacacuguaucug

SEQ ID NO: 262102 - RNA, 22 nt, Human
gaggagcucugcuccauccuuc

SEQ ID NO: 262103 - RNA, 22 nt, Human
uguggaagccggugggaagcag

SEQ ID NO: 262104 - RNA, 22 nt, Human
aaucgcuugguaauuuuaaaag

SEQ ID NO: 262105 - RNA, 22 nt, Human
aaauuguaggaucacaugaccu

SEQ ID NO: 262106 - RNA, 22 nt, Human
gggggaagaaagaacauggcau

SEQ ID NO: 262107 - RNA, 22 nt, Human
agucuccagaaauauagcagug

SEQ ID NO: 262108 - RNA, 22 nt, Human
aguggcugucuuccaaaaucug

SEQ ID NO: 262109 - RNA, 23 nt, Human
caggacaugggaggaaguauggc

SEQ ID NO: 262110 - RNA, 22 nt, Human
auccaagucagggauaguuuga

SEQ ID NO: 262111 - RNA, 22 nt, Human
uugaaagauauguuaaucuuuc

SEQ ID NO: 262112 - RNA, 22 nt, Human
uugauacaggccuucuagauga

SEQ ID NO: 262113 - RNA, 22 nt, Human
aacuuucuccagugccaacuau

SEQ ID NO: 262114 - RNA, 22 nt, Human
ugcaauaacccaguaucuguga

SEQ ID NO: 262115 - RNA, 22 nt, Human
uuguggaagcccuaugagagac

SEQ ID NO: 262116 - RNA, 22 nt, Human
aggcaaauugugagaaaaugaa

SEQ ID NO: 262117 - RNA, 22 nt, Human
caaggcugucuccagcuuccaa

SEQ ID NO: 262118 - RNA, 22 nt, Human
gagagggagccagccaggaacc

SEQ ID NO: 262119 - RNA, 23 nt, Human
uguguacacaauagaugagguuu

SEQ ID NO: 262120 - RNA, 22 nt, Human
aggagccaugagugacaucaca

SEQ ID NO: 262121 - RNA, 22 nt, Human
cucucgcgugugccuuuccgcu

SEQ ID NO: 262122 - RNA, 22 nt, Human
gaauuauaggcaaagcagucau

SEQ ID NO: 262123 - RNA, 22 nt, Human
acauucaaggcagcacugagug

SEQ ID NO: 262124 - RNA, 22 nt, Human
agugucuguuacgcuugcagaa

SEQ ID NO: 262125 - RNA, 22 nt, Human
uauaccaaaaaaauucuugucu

SEQ ID NO: 262126 - RNA, 22 nt, Human
ucugccugagggagcugaggaa

SEQ ID NO: 262127 - RNA, 22 nt, Human
acuggcaguuugagaaugcauu

SEQ ID NO: 262128 - RNA, 17 nt, Human
ccaggagagaugcuugu

SEQ ID NO: 262129 - RNA, 22 nt, Human
uuucuaggcacagugucuuccc

SEQ ID NO: 262130 - RNA, 22 nt, Human
gcuucuaaccugcuuccuguag

SEQ ID NO: 262131 - RNA, 22 nt, Human
accaggaacucacccgcagagg

SEQ ID NO: 262132 - RNA, 22 nt, Human
uggagagugguuugggggacau

SEQ ID NO: 262133 - RNA, 22 nt, Human
aagccaguguuuuugagaguug

SEQ ID NO: 262134 - RNA, 22 nt, Human
caggccuccacuccacgcagac

SEQ ID NO: 262135 - RNA, 22 nt, Human
ugccucugccuccauuguuagu

SEQ ID NO: 262136 - RNA, 22 nt, Human
ucaggaaauuaaacacuugaaa

SEQ ID NO: 262137 - RNA, 22 nt, Human
gcuucuuuccuugggcuggaac

SEQ ID NO: 262138 - RNA, 22 nt, Human
gggagcucgugcgcccaggugc

SEQ ID NO: 262139 - RNA, 22 nt, Human
uguuuaauaauucuaugauagu

SEQ ID NO: 262140 - RNA, 22 nt, Human
uuucuaaaauagauuuuauggu

SEQ ID NO: 262141 - RNA, 22 nt, Human
gugccugguauguagguagcgg

SEQ ID NO: 262142 - RNA, 22 nt, Human
gcagccagagggggugugauca

SEQ ID NO: 262143 - RNA, 22 nt, Human
uuaagauagaacccaguagucu

SEQ ID NO: 262144 - RNA, 22 nt, Human
ugcugaggcccaggagcacuuu

SEQ ID NO: 262145 - RNA, 22 nt, Human
uagaaaguaaacacgaagucuc

SEQ ID NO: 262146 - RNA, 22 nt, Human
uaaguacaaauguauacauaag

SEQ ID NO: 262147 - RNA, 22 nt, Human
cugaggccggagcacugaagag

SEQ ID NO: 262148 - RNA, 22 nt, Human
cagcccugccauggagccuccu

SEQ ID NO: 262149 - RNA, 22 nt, Human
gcugucugggaugucacugcug

SEQ ID NO: 262150 - RNA, 22 nt, Human
uggccugacugucaggcuguau

SEQ ID NO: 262151 - RNA, 22 nt, Human
aggcagccuauggggagcucag

SEQ ID NO: 262152 - RNA, 22 nt, Human
aggcccugcuuuccagagcuca

SEQ ID NO: 262153 - RNA, 22 nt, Human
auucaaaagaccaugcagacuc

SEQ ID NO: 262154 - RNA, 22 nt, Human
uccuggcauaauggcuuugcuc

SEQ ID NO: 262155 - RNA, 17 nt, Human
gaacaguguaagacacu

SEQ ID NO: 262156 - RNA, 22 nt, Human
acauuuaggauguuuugagaga

SEQ ID NO: 262157 - RNA, 22 nt, Human
uccagccauucauuaugacacc

SEQ ID NO: 262158 - RNA, 22 nt, Human
gccugccaaaagaagcugcugg

SEQ ID NO: 262159 - RNA, 22 nt, Human
ggcacagccacuuuggagaacu

SEQ ID NO: 262160 - RNA, 22 nt, Human
gaaaggcuugguuuugaauaua

SEQ ID NO: 262161 - RNA, 22 nt, Human
aaacucuauaggcagaagcaau

SEQ ID NO: 262162 - RNA, 22 nt, Human
ugacuccaaacagaaaacgaau

SEQ ID NO: 262163 - RNA, 22 nt, Human
gcaguaggggcuggagggcugu

SEQ ID NO: 262164 - RNA, 22 nt, Human
acuggcaggcugcuggccggcg

SEQ ID NO: 262165 - RNA, 22 nt, Human
uaguccagaaacugagcuuaua

SEQ ID NO: 262166 - RNA, 22 nt, Human
aaaugcauaucaaagacuugaa

SEQ ID NO: 262167 - RNA, 22 nt, Human
ucugcaccccgcagggucaggu

SEQ ID NO: 262168 - RNA, 21 nt, Human
agacuucuagaagugagauag

SEQ ID NO: 262169 - RNA, 21 nt, Human
uucuucaaagaagaaggcaca

SEQ ID NO: 262170 - RNA, 22 nt, Human
aucaaagugaaaagugcugaug

SEQ ID NO: 262171 - RNA, 22 nt, Human
cccaggcugguccugaacuccu

SEQ ID NO: 262172 - RNA, 22 nt, Human
caauguuuucaacugacaagua

SEQ ID NO: 262173 - RNA, 22 nt, Human
uagcagaggcugucugacuuaa

SEQ ID NO: 262174 - RNA, 22 nt, Human
gcucucucgugaacaggugguu

SEQ ID NO: 262175 - RNA, 22 nt, Human
ugcauauuguccuugauauuau

SEQ ID NO: 262176 - RNA, 22 nt, Human
uugauguaaagugauucauggg

SEQ ID NO: 262177 - RNA, 22 nt, Human
gaccuucaguguguuucucaca

SEQ ID NO: 262178 - RNA, 22 nt, Human
auugaaugcuugcuaacacuuu

SEQ ID NO: 262179 - RNA, 22 nt, Human
auuucaaggcuacagaaaccuu

SEQ ID NO: 262180 - RNA, 22 nt, Human
gaggaguggguuagugcuuauu

SEQ ID NO: 262181 - RNA, 22 nt, Human
ucccucagggugcaguugcuuu

SEQ ID NO: 262182 - RNA, 18 nt, Human
cagagcagagguggagcg

SEQ ID NO: 262183 - RNA, 22 nt, Human
gcacacaggggaguucucagaa

SEQ ID NO: 262184 - RNA, 20 nt, Human
aggcucagcugagcucuugg

SEQ ID NO: 262185 - RNA, 22 nt, Human
cuaucucuuguuuuccugaagc

SEQ ID NO: 262186 - RNA, 22 nt, Human
cugccucucagccugaccgcca

SEQ ID NO: 262187 - RNA, 22 nt, Human
acuggguguauuagugguguuu

SEQ ID NO: 262188 - RNA, 22 nt, Human
augcaucuuaucaaaaauuaua

SEQ ID NO: 262189 - RNA, 22 nt, Human
ucugucccugagagcucaggag

SEQ ID NO: 262190 - RNA, 22 nt, Human
uaggagcuuuuggaguccugug

SEQ ID NO: 262191 - RNA, 22 nt, Human
cuggagcugcuguccuugggug

SEQ ID NO: 262192 - RNA, 22 nt, Human
cuguggcucucagaggcugcug

SEQ ID NO: 262193 - RNA, 22 nt, Human
ucugggugccacugucuguaca

SEQ ID NO: 262194 - RNA, 23 nt, Human
aucauucuccaaucuggagcagg

SEQ ID NO: 262195 - RNA, 22 nt, Human
cuuaggaaugucccuucccaca

SEQ ID NO: 262196 - RNA, 22 nt, Human
ucagcugguguuucuucuccuu

SEQ ID NO: 262197 - RNA, 22 nt, Human
gagcaggcaacucugcagugcc

SEQ ID NO: 262198 - RNA, 22 nt, Human
cucccagguuccgacgccucuu

SEQ ID NO: 262199 - RNA, 22 nt, Human
cuauuuucugucucuauagagu

SEQ ID NO: 262200 - RNA, 22 nt, Human
gcucuggcuacuguggcuaccg

SEQ ID NO: 262201 - RNA, 22 nt, Human
aaaugcacugaacacauguugu

SEQ ID NO: 262202 - RNA, 22 nt, Human
augucugcggcccaggccaggg

SEQ ID NO: 262203 - RNA, 22 nt, Human
gugaggucuuugggaggugauu

SEQ ID NO: 262204 - RNA, 23 nt, Human
ucacaucugccguaguguauucu

SEQ ID NO: 262205 - RNA, 22 nt, Human
ggagacacccacauugcugggu

SEQ ID NO: 262206 - RNA, 22 nt, Human
ggcugggcauccauccaugaga

SEQ ID NO: 262207 - RNA, 22 nt, Human
uggcuccugcagaccaucugga

SEQ ID NO: 262208 - RNA, 22 nt, Human
uucuagaaauccguaagugaau

SEQ ID NO: 262209 - RNA, 22 nt, Human
acccugggacuuccgaguugag

SEQ ID NO: 262210 - RNA, 22 nt, Human
uuugacucauuaaagucuccgu

SEQ ID NO: 262211 - RNA, 22 nt, Human
ucuuaugaaaagcacuuagaac

SEQ ID NO: 262212 - RNA, 22 nt, Human
ccuagacuagaggcagggagcc

SEQ ID NO: 262213 - RNA, 22 nt, Human
aguauaaagugguuuucagcac

SEQ ID NO: 262214 - RNA, 20 nt, Human
acauagaucagugauugaca

SEQ ID NO: 262215 - RNA, 22 nt, Human
gcuguucaaaagccacaguuac

SEQ ID NO: 262216 - RNA, 19 nt, Human
cgugaacaugacugcaugg

SEQ ID NO: 262217 - RNA, 22 nt, Human
uuacauucccagugugcagcau

SEQ ID NO: 262218 - RNA, 22 nt, Human
aggucugggcaccacuggcugc

SEQ ID NO: 262219 - RNA, 23 nt, Human
augugcaaagugcuacaguauag

SEQ ID NO: 262220 - RNA, 22 nt, Human
ccccucucccucacuuaucaau

SEQ ID NO: 262221 - RNA, 22 nt, Human
ucccacacuacacgguuguugg

SEQ ID NO: 262222 - RNA, 22 nt, Human
gaggcaagagaagccagcuuuc

SEQ ID NO: 262223 - RNA, 22 nt, Human
uauuagguaaaggacuugcagg

SEQ ID NO: 262224 - RNA, 22 nt, Human
augacucaaaauuauuguuuug

SEQ ID NO: 262225 - RNA, 22 nt, Human
agcaacaggaccauggagccca

SEQ ID NO: 262226 - RNA, 22 nt, Human
cccagaaggcuugccaggaagc

SEQ ID NO: 262227 - RNA, 22 nt, Human
ccucagugcguacugaacagug

SEQ ID NO: 262228 - RNA, 22 nt, Human
ucuuggaauaccccgaagguca

SEQ ID NO: 262229 - RNA, 19 nt, Human
guguuuacugugugcagaa

SEQ ID NO: 262230 - RNA, 22 nt, Human
uuuuuaucuacagauucucagc

SEQ ID NO: 262231 - RNA, 22 nt, Human
uugauaucucugcuguguuagg

SEQ ID NO: 262232 - RNA, 22 nt, Human
agaggcugcacuugcucaugau

SEQ ID NO: 262233 - RNA, 22 nt, Human
agagucugaugucaacaguucu

SEQ ID NO: 262234 - RNA, 22 nt, Human
cagcagaggugguucacauugu

SEQ ID NO: 262235 - RNA, 23 nt, Human
ucucuggccuuugaucagguuga

SEQ ID NO: 262236 - RNA, 22 nt, Human
uucauucacccaggaaacaucu

SEQ ID NO: 262237 - RNA, 22 nt, Human
acaauucaagaagagagaugaa

SEQ ID NO: 262238 - RNA, 22 nt, Human
uaucaauacauguuaucagugu

SEQ ID NO: 262239 - RNA, 22 nt, Human
cuaggguggauuugugcagagu

SEQ ID NO: 262240 - RNA, 22 nt, Human
gcucagaggccacuguuggaaa

SEQ ID NO: 262241 - RNA, 22 nt, Human
uuacugauacacauaagaauuu

SEQ ID NO: 262242 - RNA, 22 nt, Human
uauuugaaaguguacaaaaacu

SEQ ID NO: 262243 - RNA, 22 nt, Human
guggcccucugauagggucagg

SEQ ID NO: 262244 - RNA, 22 nt, Human
gcagugcagugggacagggcgc

SEQ ID NO: 262245 - RNA, 20 nt, Human
cagcccugugaccuggcccu

SEQ ID NO: 262246 - RNA, 22 nt, Human
gcacagccggaccgaggaaaag

SEQ ID NO: 262247 - RNA, 22 nt, Human
uggccugccacugccacgccac

SEQ ID NO: 262248 - RNA, 22 nt, Human
ucagaggaccuuacugagaacc

SEQ ID NO: 262249 - RNA, 22 nt, Human
cagcagaaauggauuuugagau

SEQ ID NO: 262250 - RNA, 22 nt, Human
cagaggcaaaagagguggaggu

SEQ ID NO: 262251 - RNA, 22 nt, Human
aagcuggacucugccauuuacu

SEQ ID NO: 262252 - RNA, 21 nt, Human
acagagaaagagcagccuccu

SEQ ID NO: 262253 - RNA, 22 nt, Human
auggauuggauuuuuauggacc

SEQ ID NO: 262254 - RNA, 17 nt, Human
gacuuuggaguuucaua

SEQ ID NO: 262255 - RNA, 22 nt, Human
ugggccagcugaagugccgccc

SEQ ID NO: 262256 - RNA, 22 nt, Human
gcaggccuguaaugaagggaca

SEQ ID NO: 262257 - RNA, 22 nt, Human
ucuccaggaagcccucccugac

SEQ ID NO: 262258 - RNA, 22 nt, Human
auuaaauguuccuuaaauuaua

SEQ ID NO: 262259 - RNA, 22 nt, Human
aguccugucaccucuacuuucg

SEQ ID NO: 262260 - RNA, 22 nt, Human
auaguacaagggaagagugaag

SEQ ID NO: 262261 - RNA, 22 nt, Human
augcugagugagugaaacccag

SEQ ID NO: 262262 - RNA, 22 nt, Human
aaagaguucuaugaucuuucca

SEQ ID NO: 262263 - RNA, 20 nt, Human
cacccuacggccucaccucc

SEQ ID NO: 262264 - RNA, 22 nt, Human
ucaaauacagaagauccuuucc

SEQ ID NO: 262265 - RNA, 22 nt, Human
gcccuguggacagugagaagug

SEQ ID NO: 262266 - RNA, 22 nt, Human
ucugcaggugggccccuagaau

SEQ ID NO: 262267 - RNA, 22 nt, Human
cuguggaguuuguggcgcugac

SEQ ID NO: 262268 - RNA, 22 nt, Human
aaaagguuuugaguacaaauau

SEQ ID NO: 262269 - RNA, 22 nt, Human
gcucugcccaaugucccuacac

SEQ ID NO: 262270 - RNA, 22 nt, Human
ggucagugccuaucaugugggc

SEQ ID NO: 262271 - RNA, 17 nt, Human
augaggucauuaagaua

SEQ ID NO: 262272 - RNA, 23 nt, Human
uuugaaguugacugccuuccaga

SEQ ID NO: 262273 - RNA, 22 nt, Human
gcugggcuguaguuugcugacc

SEQ ID NO: 262274 - RNA, 23 nt, Human
ugccucaguggaaugugagggug

SEQ ID NO: 262275 - RNA, 22 nt, Human
caggaaagaaaugagaacacca

SEQ ID NO: 262276 - RNA, 22 nt, Human
ccugugaggucuugcaugugaa

SEQ ID NO: 262277 - RNA, 22 nt, Human
uuccccaggugauucucauggc

SEQ ID NO: 262278 - RNA, 22 nt, Human
aggcagauauuucaguucacau

SEQ ID NO: 262279 - RNA, 22 nt, Human
caggaaagggaugggcugccac

SEQ ID NO: 262280 - RNA, 22 nt, Human
uuccagugugcuuuuauguuag

SEQ ID NO: 262281 - RNA, 22 nt, Human
ggcaaaaaucaccccugguuca

SEQ ID NO: 262282 - RNA, 21 nt, Human
ucugaugguagaugagaugug

SEQ ID NO: 262283 - RNA, 19 nt, Human
ccagcccugucacuucuug

SEQ ID NO: 262284 - RNA, 19 nt, Human
augaguacacuuguacauu

SEQ ID NO: 262285 - RNA, 22 nt, Human
agccugggaauuuagaguucgg

SEQ ID NO: 262286 - RNA, 22 nt, Human
acaggccuugguccugaccuaa

SEQ ID NO: 262287 - RNA, 22 nt, Human
ugcagggauuagaggccgggga

SEQ ID NO: 262288 - RNA, 22 nt, Human
ugaaagaaacagguauauuggg

SEQ ID NO: 262289 - RNA, 22 nt, Human
uugcccugucaguagaagugca

SEQ ID NO: 262290 - RNA, 22 nt, Human
uugggaaauuacucugcuagga

SEQ ID NO: 262291 - RNA, 22 nt, Human
ugggacagugaccccagagguc

SEQ ID NO: 262292 - RNA, 22 nt, Human
cucagagaaccuaagcggagga

SEQ ID NO: 262293 - RNA, 20 nt, Human
aggcugccaggucucacauc

SEQ ID NO: 262294 - RNA, 22 nt, Human
uggacaggggcugcuguuguca

SEQ ID NO: 262295 - RNA, 20 nt, Human
aagggcagagggaacagacu

SEQ ID NO: 262296 - RNA, 22 nt, Human
uacaaagaguuuggucucuaga

SEQ ID NO: 262297 - RNA, 22 nt, Human
ggaggaagcacacggcuuguau

SEQ ID NO: 262298 - RNA, 22 nt, Human
agcugaggaauaauaacaaggu

SEQ ID NO: 262299 - RNA, 22 nt, Human
cuugagcuaggaaggcugaggc

SEQ ID NO: 262300 - RNA, 22 nt, Human
ggcuucuccccuuugagucuuc

SEQ ID NO: 262301 - RNA, 22 nt, Human
caucagaagaaagacaaaugau

SEQ ID NO: 262302 - RNA, 22 nt, Human
gcugucaguuuuacccacagac

SEQ ID NO: 262303 - RNA, 21 nt, Human
uugggaucugagaagugaaaa

SEQ ID NO: 262304 - RNA, 22 nt, Human
uuaguacaagagauuaauuacu

SEQ ID NO: 262305 - RNA, 23 nt, Human
ggcugagaagucccaugauaggu

SEQ ID NO: 262306 - RNA, 22 nt, Human
cugugacugggugacaguccuc

SEQ ID NO: 262307 - RNA, 22 nt, Human
uuuagugugacaguccccagua

SEQ ID NO: 262308 - RNA, 22 nt, Human
ucagaacauucucauugacugc

SEQ ID NO: 262309 - RNA, 22 nt, Human
uuguagcuuaucaaggcuguuu

SEQ ID NO: 262310 - RNA, 23 nt, Human
uuugcaaauuggacacaaccaca

SEQ ID NO: 262311 - RNA, 22 nt, Human
agaggcugggcaggacccacag

SEQ ID NO: 262312 - RNA, 22 nt, Human
uggaagaaaauucaaucgaguu

SEQ ID NO: 262313 - RNA, 22 nt, Human
ggcuuggcugucucccagccca

SEQ ID NO: 262314 - RNA, 22 nt, Human
acaguggcucaugccugucauc

SEQ ID NO: 262315 - RNA, 22 nt, Human
uuuguacauccuaauucugagu

SEQ ID NO: 262316 - RNA, 22 nt, Human
uuagcauucucauuugcauaaa

SEQ ID NO: 262317 - RNA, 22 nt, Human
aaagcauguugggucccucuuu

SEQ ID NO: 262318 - RNA, 22 nt, Human
ucucagggcagcaaggaagcau

SEQ ID NO: 262319 - RNA, 22 nt, Human
agccuucaguaaauccacugug

SEQ ID NO: 262320 - RNA, 22 nt, Human
aucagugcuaaagcaaaugccc

SEQ ID NO: 262321 - RNA, 22 nt, Human
agauauacacccauaucacaua

SEQ ID NO: 262322 - RNA, 22 nt, Human
ugcaaucucggcacuuugggag

SEQ ID NO: 262323 - RNA, 22 nt, Human
ugccugcuuguguaccugguga

SEQ ID NO: 262324 - RNA, 22 nt, Human
augaggagaccaaggccugaug

SEQ ID NO: 262325 - RNA, 22 nt, Human
ucuucucccaucggccgcaggg

SEQ ID NO: 262326 - RNA, 22 nt, Human
cuccuacaguguuugaguccag

SEQ ID NO: 262327 - RNA, 22 nt, Human
aggcagcuuaagcccuggccca

SEQ ID NO: 262328 - RNA, 22 nt, Human
uuucaaaggaggcugagaggau

SEQ ID NO: 262329 - RNA, 22 nt, Human
cuuaggaaugcguuuccugggu

SEQ ID NO: 262330 - RNA, 22 nt, Human
ccaggugugguggcauacaccu

SEQ ID NO: 262331 - RNA, 22 nt, Human
ggguccagggccaguggcugag

SEQ ID NO: 262332 - RNA, 22 nt, Human
gccuggguccacugaucaugcu

SEQ ID NO: 262333 - RNA, 22 nt, Human
ugaaucaauugucuuaagacau

SEQ ID NO: 262334 - RNA, 22 nt, Human
uuguguccucuaaucucaccac

SEQ ID NO: 262335 - RNA, 22 nt, Human
ugaaugauacagaauuauguag

SEQ ID NO: 262336 - RNA, 22 nt, Human
agggaggaaggaacuccuucua

SEQ ID NO: 262337 - RNA, 22 nt, Human
agugacuucuccguggcaggau

SEQ ID NO: 262338 - RNA, 20 nt, Human
uuucacaucugucccuuuaa

SEQ ID NO: 262339 - RNA, 22 nt, Human
auugagaauauugugacagugu

SEQ ID NO: 262340 - RNA, 22 nt, Human
gugagauuugaguggggauaca

SEQ ID NO: 262341 - RNA, 22 nt, Human
agggcccucugggcacuguggc

SEQ ID NO: 262342 - RNA, 19 nt, Human
cuggcagccugucuguguc

SEQ ID NO: 262343 - RNA, 22 nt, Human
uggcuucuuagaccaguggccu

SEQ ID NO: 262344 - RNA, 22 nt, Human
aaacuuuuuauucuaaugucua

SEQ ID NO: 262345 - RNA, 22 nt, Human
uuaauaaacaggugcagcugaa

SEQ ID NO: 262346 - RNA, 22 nt, Human
agguuccaagaaaucaucagug

SEQ ID NO: 262347 - RNA, 22 nt, Human
uuagaaucuuuagagucucacu

SEQ ID NO: 262348 - RNA, 22 nt, Human
gccucagacacugccugggugu

SEQ ID NO: 262349 - RNA, 22 nt, Human
gcuuuaaugcuucguggggcca

SEQ ID NO: 262350 - RNA, 22 nt, Human
cugauuccagagucuguguucu

SEQ ID NO: 262351 - RNA, 21 nt, Human
agauggcucccaggucucugg

SEQ ID NO: 262352 - RNA, 18 nt, Human
guaggucaguaccaagca

SEQ ID NO: 262353 - RNA, 22 nt, Human
cuccugucaauaggcuccuggc

SEQ ID NO: 262354 - RNA, 22 nt, Human
cuucacaggcaagucuguuuuu

SEQ ID NO: 262355 - RNA, 22 nt, Human
uacaaagucacauugaaaugaa

SEQ ID NO: 262356 - RNA, 22 nt, Human
uggcugagguaacuaugaauaa

SEQ ID NO: 262357 - RNA, 19 nt, Human
gcuggccacgccccaguug

SEQ ID NO: 262358 - RNA, 22 nt, Human
cuggagcugccagggcugccgc

SEQ ID NO: 262359 - RNA, 22 nt, Human
gcaaaaaaugcuuguugcuuag

SEQ ID NO: 262360 - RNA, 22 nt, Human
caggggcaagaaugcugucagc

SEQ ID NO: 262361 - RNA, 20 nt, Human
cuguaucagguuacaaagua

SEQ ID NO: 262362 - RNA, 22 nt, Human
uccagggcagugacuacagcgg

SEQ ID NO: 262363 - RNA, 22 nt, Human
acacuguucuuugcacugagaa

SEQ ID NO: 262364 - RNA, 22 nt, Human
auuucuuaugaauauugacugu

SEQ ID NO: 262365 - RNA, 22 nt, Human
aggaccugaaauucuugcuuuu

SEQ ID NO: 262366 - RNA, 20 nt, Human
uccuggccucccuggggcuc

SEQ ID NO: 262367 - RNA, 22 nt, Human
cuggagcugguauagggacaaa

SEQ ID NO: 262368 - RNA, 22 nt, Human
agagcuggaaucagaccucagg

SEQ ID NO: 262369 - RNA, 22 nt, Human
acauucuuucgaugucugauuu

SEQ ID NO: 262370 - RNA, 22 nt, Human
ucuaaaugucaguacagaauga

SEQ ID NO: 262371 - RNA, 22 nt, Human
cuacauuuuaauaagcugcuua

SEQ ID NO: 262372 - RNA, 23 nt, Human
agcaauaagaagggauacaugug

SEQ ID NO: 262373 - RNA, 22 nt, Human
uaaagacaaacccacuaggguu

SEQ ID NO: 262374 - RNA, 18 nt, Human
aaggcuucaaagaguaga

SEQ ID NO: 262375 - RNA, 22 nt, Human
aaucaacauuguuuuaagucaa

SEQ ID NO: 262376 - RNA, 22 nt, Human
uugccuggagggacauggagac

SEQ ID NO: 262377 - RNA, 22 nt, Human
ugaggccugucauugucuuguu

SEQ ID NO: 262378 - RNA, 22 nt, Human
uaacagaaauagaaaugagagu

SEQ ID NO: 262379 - RNA, 22 nt, Human
gucugggcaccuggccugggaa

SEQ ID NO: 262380 - RNA, 22 nt, Human
aagcacuggagaugccagagug

SEQ ID NO: 262381 - RNA, 22 nt, Human
aacacugaguaucagaguuggg

SEQ ID NO: 262382 - RNA, 22 nt, Human
uaagcaagugguagaaggacaa

SEQ ID NO: 262383 - RNA, 22 nt, Human
ugagccugggagauggaggcug

SEQ ID NO: 262384 - RNA, 22 nt, Human
uuucuauucuggaucuguggca

SEQ ID NO: 262385 - RNA, 22 nt, Human
acacugaauguuuaagaacuug

SEQ ID NO: 262386 - RNA, 22 nt, Human
guggccugugcugucuccccaa

SEQ ID NO: 262387 - RNA, 21 nt, Human
gugcucugggcagcagagggc

SEQ ID NO: 262388 - RNA, 22 nt, Human
ugcccucccacauuauggcugu

SEQ ID NO: 262389 - RNA, 21 nt, Human
agacaugugaacuaaagguga

SEQ ID NO: 262390 - RNA, 22 nt, Human
uacaagaagaggcagagcugga

SEQ ID NO: 262391 - RNA, 22 nt, Human
ccugagggaacaugcacccaau

SEQ ID NO: 262392 - RNA, 22 nt, Human
aguaaaaucaccaucucuuugu

SEQ ID NO: 262393 - RNA, 22 nt, Human
cuggaucuguccccuuuuuguu

SEQ ID NO: 262394 - RNA, 22 nt, Human
gcccagggucuacaaaaauauu

SEQ ID NO: 262395 - RNA, 22 nt, Human
uacugucuaauaagauugaugg

SEQ ID NO: 262396 - RNA, 22 nt, Human
ggccaaggcucuugagggcuga

SEQ ID NO: 262397 - RNA, 22 nt, Human
gccaggguucgaauccguaugg

SEQ ID NO: 262398 - RNA, 22 nt, Human
gaggaggggcacuugucuccua

SEQ ID NO: 262399 - RNA, 22 nt, Human
aaaucuguuguaauguuuuuua

SEQ ID NO: 262400 - RNA, 22 nt, Human
accccaggucuccaggcucugg

SEQ ID NO: 262401 - RNA, 22 nt, Human
uacauaauaaggggcauggugu

SEQ ID NO: 262402 - RNA, 22 nt, Human
uuggagagauuuaggucucagu

SEQ ID NO: 262403 - RNA, 22 nt, Human
ggggagaugcuuagguccgggg

SEQ ID NO: 262404 - RNA, 22 nt, Human
uuggcuucauugaucucacuuu

SEQ ID NO: 262405 - RNA, 22 nt, Human
acagguguugaaugaugucaca

SEQ ID NO: 262406 - RNA, 22 nt, Human
agcagggcagugaucagaaagg

SEQ ID NO: 262407 - RNA, 22 nt, Human
gccagccugugcuuggccaggc

SEQ ID NO: 262408 - RNA, 22 nt, Human
aaggcauuuguuggauuucuca

SEQ ID NO: 262409 - RNA, 22 nt, Human
cucugggaguggccacuucuca

SEQ ID NO: 262410 - RNA, 22 nt, Human
ggcacagcacaguggacccagg

SEQ ID NO: 262411 - RNA, 22 nt, Human
gugcaaaagucauugugguuuu

SEQ ID NO: 262412 - RNA, 22 nt, Human
gugcuuuuaacuuuugaaagga

SEQ ID NO: 262413 - RNA, 22 nt, Human
cugaaauucugccucugcacaa

SEQ ID NO: 262414 - RNA, 22 nt, Human
gcucaaaucccagcgggcuccu

SEQ ID NO: 262415 - RNA, 22 nt, Human
gcagcaggucugucaaugucau

SEQ ID NO: 262416 - RNA, 22 nt, Human
agaaagagcucgggauuaacag

SEQ ID NO: 262417 - RNA, 22 nt, Human
aucacaaaggcugcuucaugau

SEQ ID NO: 262418 - RNA, 22 nt, Human
agagaugguagaacagucauaa

SEQ ID NO: 262419 - RNA, 22 nt, Human
aaaacugaaccuugagaucuuu

SEQ ID NO: 262420 - RNA, 22 nt, Human
gaagcuuggauaacuguauggg

SEQ ID NO: 262421 - RNA, 17 nt, Human
uguagcuucuccuucuc

SEQ ID NO: 262422 - RNA, 22 nt, Human
ucagagaaguaggcuaauggug

SEQ ID NO: 262423 - RNA, 22 nt, Human
cugggcacugcagcaggcauca

SEQ ID NO: 262424 - RNA, 22 nt, Human
cagagacaguuucacagggucu

SEQ ID NO: 262425 - RNA, 22 nt, Human
cuauuucagcugccuuugacug

SEQ ID NO: 262426 - RNA, 22 nt, Human
ucucagagaacaguuggugcuu

SEQ ID NO: 262427 - RNA, 22 nt, Human
ucccucucuugggcguggcuca

SEQ ID NO: 262428 - RNA, 22 nt, Human
uucagaaaggauaauuggaagg

SEQ ID NO: 262429 - RNA, 22 nt, Human
caagaauauaaauacuuucaaa

SEQ ID NO: 262430 - RNA, 22 nt, Human
ugcaggcugcagucucaggugg

SEQ ID NO: 262431 - RNA, 22 nt, Human
gaggccaggacaugaaagcuga

SEQ ID NO: 262432 - RNA, 22 nt, Human
cacacauugguuuuacuccuuu

SEQ ID NO: 262433 - RNA, 22 nt, Human
ccucuguguccuggucauugaa

SEQ ID NO: 262434 - RNA, 22 nt, Human
ugaaaccccagauuaccacaaa

SEQ ID NO: 262435 - RNA, 22 nt, Human
ccucccaccguaucucaguggc

SEQ ID NO: 262436 - RNA, 22 nt, Human
aaccaguacuuuacacagcucu

SEQ ID NO: 262437 - RNA, 22 nt, Human
gcccagcagaucucagugucuc

SEQ ID NO: 262438 - RNA, 22 nt, Human
auagucuuacuuuucucugcua

SEQ ID NO: 262439 - RNA, 22 nt, Human
gcucagggccuggcugcggacu

SEQ ID NO: 262440 - RNA, 18 nt, Human
cagcugaggaccaaacug

SEQ ID NO: 262441 - RNA, 22 nt, Human
cucacagcagccagucugccuu

SEQ ID NO: 262442 - RNA, 22 nt, Human
uuaggaaauuccaccuguauuc

SEQ ID NO: 262443 - RNA, 22 nt, Human
aaucuagauucggaucaaaggg

SEQ ID NO: 262444 - RNA, 22 nt, Human
aaacaagagcuuacauggcugc

SEQ ID NO: 262445 - RNA, 21 nt, Human
gaucuuuacuuuccuacuuac

SEQ ID NO: 262446 - RNA, 22 nt, Human
gcccuggggaaggugucuccaa

SEQ ID NO: 262447 - RNA, 22 nt, Human
gauuuuauauggcauacugugg

SEQ ID NO: 262448 - RNA, 22 nt, Human
ugugcaaucuugagcaauuuau

SEQ ID NO: 262449 - RNA, 22 nt, Human
aaaugacagaguaagcuguuua

SEQ ID NO: 262450 - RNA, 22 nt, Human
cugcugucccagccuccucaca

SEQ ID NO: 262451 - RNA, 23 nt, Human
gaggccuggcccugccacaucuc

SEQ ID NO: 262452 - RNA, 21 nt, Human
agggcucaaaugugcuugcug

SEQ ID NO: 262453 - RNA, 22 nt, Human
caagaggcaaauugucuagaag

SEQ ID NO: 262454 - RNA, 22 nt, Human
agaagccauggggucaccagag

SEQ ID NO: 262455 - RNA, 22 nt, Human
agcuagaaguccuagauaaagg

SEQ ID NO: 262456 - RNA, 22 nt, Human
uacugucugcuucuuauagcuu

SEQ ID NO: 262457 - RNA, 22 nt, Human
acaaugucaccucucauguuuu

SEQ ID NO: 262458 - RNA, 22 nt, Human
cacaugaacaugcuggaaaagc

SEQ ID NO: 262459 - RNA, 22 nt, Human
gucccagggaagaaggcagcac

SEQ ID NO: 262460 - RNA, 22 nt, Human
uuggcccacucucagaaugugg

SEQ ID NO: 262461 - RNA, 22 nt, Human
accccagaggcggaggcugcag

SEQ ID NO: 262462 - RNA, 22 nt, Human
gggcacagagaagguuuuagug

SEQ ID NO: 262463 - RNA, 22 nt, Human
aaaaguauuuugagcacuuuau

SEQ ID NO: 262464 - RNA, 23 nt, Human
uagaauccucugagauggaauag

SEQ ID NO: 262465 - RNA, 22 nt, Human
guaggagcucauggggccagga

SEQ ID NO: 262466 - RNA, 22 nt, Human
gaacaucugggaucauugcugu

SEQ ID NO: 262467 - RNA, 22 nt, Human
aguccggggucuggacaccugg

SEQ ID NO: 262468 - RNA, 22 nt, Human
uucuaacuggcuugacaguuuc

SEQ ID NO: 262469 - RNA, 22 nt, Human
uggacaaaugauuucuaccuuu

SEQ ID NO: 262470 - RNA, 22 nt, Human
ucaguguuuccugugguacagc

SEQ ID NO: 262471 - RNA, 22 nt, Human
auccacaggguguguuaagaug

SEQ ID NO: 262472 - RNA, 22 nt, Human
gucuccacagcccagcugccac

SEQ ID NO: 262473 - RNA, 22 nt, Human
agggcugacaguaaaaguauga

SEQ ID NO: 262474 - RNA, 22 nt, Human
gggguguggacggcugugccag

SEQ ID NO: 262475 - RNA, 22 nt, Human
auuagucuacugucuaauaaau

SEQ ID NO: 262476 - RNA, 22 nt, Human
uccauuuggcacucuauuucca

SEQ ID NO: 262477 - RNA, 22 nt, Human
gaaauaauucugugucugaaca

SEQ ID NO: 262478 - RNA, 22 nt, Human
gucuggaagaacuagggauguu

SEQ ID NO: 262479 - RNA, 22 nt, Human
cugaagcagauguggcugagau

SEQ ID NO: 262480 - RNA, 22 nt, Human
ugauaucuaccauaaccauucg

SEQ ID NO: 262481 - RNA, 22 nt, Human
acaaauuuguguaguuauggca

SEQ ID NO: 262482 - RNA, 22 nt, Human
ucuguggaagauuccaggcguu

SEQ ID NO: 262483 - RNA, 22 nt, Human
uuacaguagauuuugaaugugg

SEQ ID NO: 262484 - RNA, 23 nt, Human
ucugggcugagcucgaguguaga

SEQ ID NO: 262485 - RNA, 22 nt, Human
caucucaguguacagggagucu

SEQ ID NO: 262486 - RNA, 22 nt, Human
auccugggcugcacccucagcc

SEQ ID NO: 262487 - RNA, 23 nt, Human
gccuuggagaagucacucaggga

SEQ ID NO: 262488 - RNA, 22 nt, Human
aggccaaguagcuagcauugaa

SEQ ID NO: 262489 - RNA, 22 nt, Human
ucaucucuagacaggaggcugg

SEQ ID NO: 262490 - RNA, 22 nt, Human
agcccugcuucaccauuuacuu

SEQ ID NO: 262491 - RNA, 18 nt, Human
aggccucugugugcccag

SEQ ID NO: 262492 - RNA, 22 nt, Human
agguccuggugaccauggaguu

SEQ ID NO: 262493 - RNA, 22 nt, Human
ugucucugcuuuccuugcaggg

SEQ ID NO: 262494 - RNA, 22 nt, Human
uaaaguuuauuugaacaucucu

SEQ ID NO: 262495 - RNA, 22 nt, Human
cuuuacagcuuagugguaugga

SEQ ID NO: 262496 - RNA, 22 nt, Human
augaaggacaacaggggagcag

SEQ ID NO: 262497 - RNA, 22 nt, Human
uggaaagugcucuagacuuucu

SEQ ID NO: 262498 - RNA, 19 nt, Human
agcaggccacagggccagc

SEQ ID NO: 262499 - RNA, 22 nt, Human
agaaaugacaagacugaucagg

SEQ ID NO: 262500 - RNA, 22 nt, Human
ucccuucaucagugagcaagcc

SEQ ID NO: 262501 - RNA, 22 nt, Human
ccccaaaacuuagugacuuaaa

SEQ ID NO: 262502 - RNA, 22 nt, Human
gcaggccuuggcaaugagccug

SEQ ID NO: 262503 - RNA, 22 nt, Human
uaucugagaaagaagcaccaga

SEQ ID NO: 262504 - RNA, 22 nt, Human
cccacccacucugaccagaagc

SEQ ID NO: 262505 - RNA, 22 nt, Human
ugaaagcuuugggacaguguga

SEQ ID NO: 262506 - RNA, 22 nt, Human
uuugcaauaguccuggccugua

SEQ ID NO: 262507 - RNA, 22 nt, Human
caaggccagagccagcgauaag

SEQ ID NO: 262508 - RNA, 22 nt, Human
ggcuucauggaguucuacacca

SEQ ID NO: 262509 - RNA, 22 nt, Human
aacagaaugcaggggaugcugc

SEQ ID NO: 262510 - RNA, 22 nt, Human
aagccauggcaugccaggauca

SEQ ID NO: 262511 - RNA, 22 nt, Human
uggccacccagcugacgccuuc

SEQ ID NO: 262512 - RNA, 19 nt, Human
ugcauacauguuaacaugu

SEQ ID NO: 262513 - RNA, 22 nt, Human
ccuggaagagcugaaucaggca

SEQ ID NO: 262514 - RNA, 22 nt, Human
augcaggaguuggaaaaaauga

SEQ ID NO: 262515 - RNA, 22 nt, Human
gcagggcugggugggagacaga

SEQ ID NO: 262516 - RNA, 22 nt, Human
aauaucuggagaugcuuuuugu

SEQ ID NO: 262517 - RNA, 22 nt, Human
ugcacacagaugguacaugcau

SEQ ID NO: 262518 - RNA, 22 nt, Human
gaauccaggguuguuugagcua

SEQ ID NO: 262519 - RNA, 22 nt, Human
cagcugcaguucaaugcuugcu

SEQ ID NO: 262520 - RNA, 22 nt, Human
gcaggccuaagagaaggcauug

SEQ ID NO: 262521 - RNA, 22 nt, Human
cagaguccuggacacagagaca

SEQ ID NO: 262522 - RNA, 22 nt, Human
guacauuuauuuuugcagcaua

SEQ ID NO: 262523 - RNA, 22 nt, Human
auucucagggaguauuuucuau

SEQ ID NO: 262524 - RNA, 22 nt, Human
ugggcccuuaugaagcucaaga

SEQ ID NO: 262525 - RNA, 22 nt, Human
acuuagcaaaucuuuuggauuc

SEQ ID NO: 262526 - RNA, 22 nt, Human
uaaaggcacugcgucccucaaa

SEQ ID NO: 262527 - RNA, 22 nt, Human
ucugagggcuguacuaugcacg

SEQ ID NO: 262528 - RNA, 22 nt, Human
ccugccuggggacaaaggaggg

SEQ ID NO: 262529 - RNA, 20 nt, Human
agacaggagcccccauucag

SEQ ID NO: 262530 - RNA, 22 nt, Human
aggcccuggguuagggcccacu

SEQ ID NO: 262531 - RNA, 22 nt, Human
gcucucugggugugucuagaua

SEQ ID NO: 262532 - RNA, 22 nt, Human
aggggagcaacauagucacucu

SEQ ID NO: 262533 - RNA, 22 nt, Human
ugaugaauuaguaacaaaugag

SEQ ID NO: 262534 - RNA, 22 nt, Human
cuuaacauccugcauuuuucuu

SEQ ID NO: 262535 - RNA, 22 nt, Human
cugaccaacauggugaaaccuu

SEQ ID NO: 262536 - RNA, 22 nt, Human
cucugugugguccucuguauug

SEQ ID NO: 262537 - RNA, 22 nt, Human
ggcccacacugacagcugagcu

SEQ ID NO: 262538 - RNA, 22 nt, Human
gugcaccccggggcccugcucc

SEQ ID NO: 262539 - RNA, 22 nt, Human
cuguggaaggacuuagcgauac

SEQ ID NO: 262540 - RNA, 22 nt, Human
aagaguuuucucugauggcauu

SEQ ID NO: 262541 - RNA, 22 nt, Human
uuugaagugggcauuagaaccu

SEQ ID NO: 262542 - RNA, 22 nt, Human
ucauggcauuguuaaggguuuu

SEQ ID NO: 262543 - RNA, 22 nt, Human
uucccuggcccuggcacgcucu

SEQ ID NO: 262544 - RNA, 22 nt, Human
ccaggccuggccaggggaugcc

SEQ ID NO: 262545 - RNA, 22 nt, Human
uccuggcagcccgcaggugcug

SEQ ID NO: 262546 - RNA, 22 nt, Human
cccugcugcagagagcuuucca

SEQ ID NO: 262547 - RNA, 22 nt, Human
uuccagauuucuacacaagacc

SEQ ID NO: 262548 - RNA, 23 nt, Human
aaauaugucugagggcaaagaau

SEQ ID NO: 262549 - RNA, 22 nt, Human
agagaguugaggaagcaacacu

SEQ ID NO: 262550 - RNA, 22 nt, Human
uucucagugaaguuuagaacau

SEQ ID NO: 262551 - RNA, 22 nt, Human
aggcgcagacauacagggucug

SEQ ID NO: 262552 - RNA, 22 nt, Human
gcugggcugagcuagacuuggc

SEQ ID NO: 262553 - RNA, 22 nt, Human
ugcagggccuugggaugugucc

SEQ ID NO: 262554 - RNA, 22 nt, Human
uaauuuugucccccugcacaua

SEQ ID NO: 262555 - RNA, 19 nt, Human
cagucccaaauucuuguca

SEQ ID NO: 262556 - RNA, 22 nt, Human
uguuuauucauggcuaaugaaa

SEQ ID NO: 262557 - RNA, 22 nt, Human
cagcacaguacaaggcacggau

SEQ ID NO: 262558 - RNA, 22 nt, Human
aagaacaugaagucacaaaugc

SEQ ID NO: 262559 - RNA, 22 nt, Human
ccagagagaaaauggagggcca

SEQ ID NO: 262560 - RNA, 22 nt, Human
ugaugaaaguguuuacucaccu

SEQ ID NO: 262561 - RNA, 22 nt, Human
agcuugaaccacaugaaauugc

SEQ ID NO: 262562 - RNA, 22 nt, Human
aauugcuucauuaacauuuagg

SEQ ID NO: 262563 - RNA, 22 nt, Human
ugccuuuuccaguuucuagggg

SEQ ID NO: 262564 - RNA, 22 nt, Human
auauuuguugaguucuuaugau

SEQ ID NO: 262565 - RNA, 22 nt, Human
cuggcucccuggacauggggcc

SEQ ID NO: 262566 - RNA, 22 nt, Human
uuucagaaagcaucaucaaagu

SEQ ID NO: 262567 - RNA, 22 nt, Human
agaaggcuuaaaacauggaaua

SEQ ID NO: 262568 - RNA, 22 nt, Human
uacaguuacuguuauaugugcu

SEQ ID NO: 262569 - RNA, 22 nt, Human
cauucaaaagcuccauguuugu

SEQ ID NO: 262570 - RNA, 22 nt, Human
uaggcuccugaguccacagcac

SEQ ID NO: 262571 - RNA, 18 nt, Human
ugaccugcgcuucacggu

SEQ ID NO: 262572 - RNA, 22 nt, Human
cuuuauuagauguagacuuucu

SEQ ID NO: 262573 - RNA, 17 nt, Human
auuuccugcaagccccu

SEQ ID NO: 262574 - RNA, 22 nt, Human
uaggugguugucugcuuuccua

SEQ ID NO: 262575 - RNA, 22 nt, Human
uuguuuuggaagaacuuacucu

SEQ ID NO: 262576 - RNA, 17 nt, Human
acaggcagaucaccuga

SEQ ID NO: 262577 - RNA, 22 nt, Human
auuuuuaugacaaaccauccuc

SEQ ID NO: 262578 - RNA, 22 nt, Human
cagcuggcccuuugguagccuu

SEQ ID NO: 262579 - RNA, 17 nt, Human
gcaauuauugggcauuu

SEQ ID NO: 262580 - RNA, 22 nt, Human
uuccagccuuuauccauccaga

SEQ ID NO: 262581 - RNA, 22 nt, Human
aaagcagaacugagagagcugg

SEQ ID NO: 262582 - RNA, 22 nt, Human
agaaaguuguuuuagccaaacc

SEQ ID NO: 262583 - RNA, 22 nt, Human
auauucacugagcauaaagcca

SEQ ID NO: 262584 - RNA, 23 nt, Human
aggaaacugaaggggcccucuau

SEQ ID NO: 262585 - RNA, 22 nt, Human
aagaggccuuggucugaccuga

SEQ ID NO: 262586 - RNA, 22 nt, Human
cucugcccccagcuggugcuug

SEQ ID NO: 262587 - RNA, 22 nt, Human
caucucaggucugugguucacu

SEQ ID NO: 262588 - RNA, 22 nt, Human
ggaaggaagugcagacuuuaaa

SEQ ID NO: 262589 - RNA, 22 nt, Human
gcagcaugugccuuaaaucauu

SEQ ID NO: 262590 - RNA, 22 nt, Human
acuuucugugguuaccagggag

SEQ ID NO: 262591 - RNA, 22 nt, Human
uuucuaaguguguuucauagga

SEQ ID NO: 262592 - RNA, 22 nt, Human
uauugcugcuauugucaguuca

SEQ ID NO: 262593 - RNA, 22 nt, Human
ugcccuggaaaugagaggugug

SEQ ID NO: 262594 - RNA, 22 nt, Human
uuccuggccaagcagaguggaa

SEQ ID NO: 262595 - RNA, 22 nt, Human
aggugccauugcuugccaguuu

SEQ ID NO: 262596 - RNA, 22 nt, Human
uggcccagucagcaggagaggg

SEQ ID NO: 262597 - RNA, 22 nt, Human
gcacccaguuugucucaggguu

SEQ ID NO: 262598 - RNA, 22 nt, Human
gcaaacaugcugagaaauaaga

SEQ ID NO: 262599 - RNA, 22 nt, Human
agagagcaguggaucaccuagc

SEQ ID NO: 262600 - RNA, 22 nt, Human
ggagcugaugguagaagaauga

SEQ ID NO: 262601 - RNA, 22 nt, Human
uggcuccaucauccaugcaaga

SEQ ID NO: 262602 - RNA, 22 nt, Human
agcucagggccaucggcccuuu

SEQ ID NO: 262603 - RNA, 22 nt, Human
ccuggcugggguagaagugagg

SEQ ID NO: 262604 - RNA, 22 nt, Human
uuccagaacaauguggacguau

SEQ ID NO: 262605 - RNA, 22 nt, Human
ggaaggucgagcugcaucuggc

SEQ ID NO: 262606 - RNA, 22 nt, Human
cacugcacaauguagcaaagaa

SEQ ID NO: 262607 - RNA, 22 nt, Human
uugcuuuagaaucugcuucugg

SEQ ID NO: 262608 - RNA, 22 nt, Human
aauaauguacauacauauuucg

SEQ ID NO: 262609 - RNA, 22 nt, Human
cucucugggcccaguuggcacc

SEQ ID NO: 262610 - RNA, 19 nt, Human
ugcugcagucaggcgaggg

SEQ ID NO: 262611 - RNA, 22 nt, Human
uaggcagauguuaacaggaaaa

SEQ ID NO: 262612 - RNA, 23 nt, Human
ugugaauugaggacaucaaaagc

SEQ ID NO: 262613 - RNA, 22 nt, Human
uccagccuucucaaggcuggcu

SEQ ID NO: 262614 - RNA, 18 nt, Human
agacuuugaguuagaggg

SEQ ID NO: 262615 - RNA, 22 nt, Human
ccagagagauugcuucuaaaga

SEQ ID NO: 262616 - RNA, 22 nt, Human
guaaaaccugcuuuucaacacc

SEQ ID NO: 262617 - RNA, 22 nt, Human
caaagauaugacauggaaaaug

SEQ ID NO: 262618 - RNA, 22 nt, Human
cugucauuuaagacauucugga

SEQ ID NO: 262619 - RNA, 22 nt, Human
uuagaaccaccuggagagcuuu

SEQ ID NO: 262620 - RNA, 22 nt, Human
gucugggcaagggagauggcgc

SEQ ID NO: 262621 - RNA, 22 nt, Human
uggccucuccuggcagcaucca

SEQ ID NO: 262622 - RNA, 19 nt, Human
uuuacaaguucuuuguaug

SEQ ID NO: 262623 - RNA, 22 nt, Human
aacugguaucucuucaguguaa

SEQ ID NO: 262624 - RNA, 20 nt, Human
ugagagcugggcagggauac

SEQ ID NO: 262625 - RNA, 22 nt, Human
ucuaacuuagggaauacuuuag

SEQ ID NO: 262626 - RNA, 22 nt, Human
ugccacagacaggacagaacag

SEQ ID NO: 262627 - RNA, 22 nt, Human
gaacuuuaccauuuagguaacu

SEQ ID NO: 262628 - RNA, 22 nt, Human
ucaaaucagcaagcagcuuccc

SEQ ID NO: 262629 - RNA, 22 nt, Human
cccagagggaagggaaugaggu

SEQ ID NO: 262630 - RNA, 22 nt, Human
gcuuuagagcccagcuuggugg

SEQ ID NO: 262631 - RNA, 22 nt, Human
uauuuuacaugauccagaguug

SEQ ID NO: 262632 - RNA, 22 nt, Human
gaggcagcgggucaggaccgug

SEQ ID NO: 262633 - RNA, 22 nt, Human
acagggcagagugaaaugcuau

SEQ ID NO: 262634 - RNA, 23 nt, Human
uugagcucaguagcucugcuggu

SEQ ID NO: 262635 - RNA, 22 nt, Human
cccaguggcccagcauguggug

SEQ ID NO: 262636 - RNA, 22 nt, Human
uucuggguggccaguauuuaga

SEQ ID NO: 262637 - RNA, 22 nt, Human
agugaauauuuuuagacaccca

SEQ ID NO: 262638 - RNA, 14 nt, Human
gcagguggaucacu

SEQ ID NO: 262639 - RNA, 22 nt, Human
uccuucuguagucccugucccu

SEQ ID NO: 262640 - RNA, 23 nt, Human
aaaguugauuugcaguuuaagag

SEQ ID NO: 262641 - RNA, 22 nt, Human
ucuccuaggcuggagugcagug

SEQ ID NO: 262642 - RNA, 22 nt, Human
acaggacagucuaguaacagua

SEQ ID NO: 262643 - RNA, 22 nt, Human
caaaauucugcauuucuaauaa

SEQ ID NO: 262644 - RNA, 22 nt, Human
cuccauggcuuucgcaucugca

SEQ ID NO: 262645 - RNA, 22 nt, Human
agcugugggccugggagagcug

SEQ ID NO: 262646 - RNA, 22 nt, Human
ucugggauuuuauagacaugcu

SEQ ID NO: 262647 - RNA, 22 nt, Human
aaaucccagauaguaauguauu

SEQ ID NO: 262648 - RNA, 22 nt, Human
uuccugggagcuagccacaucu

SEQ ID NO: 262649 - RNA, 22 nt, Human
aaggugguucgcugguacccag

SEQ ID NO: 262650 - RNA, 22 nt, Human
acaagguucuuguggaggaauu

SEQ ID NO: 262651 - RNA, 22 nt, Human
ugagauuuguuuuauaaaauag

SEQ ID NO: 262652 - RNA, 22 nt, Human
uaacuggugaguugguugagug

SEQ ID NO: 262653 - RNA, 22 nt, Human
cgaggccaugcaugcugaggac

SEQ ID NO: 262654 - RNA, 22 nt, Human
uacacaucuggugugacugcca

SEQ ID NO: 262655 - RNA, 22 nt, Human
aauugcaacagguagacuuuuc

SEQ ID NO: 262656 - RNA, 22 nt, Human
acaguguuuuagaaaagcuuga

SEQ ID NO: 262657 - RNA, 22 nt, Human
guucauuuaugauguaacaugu

SEQ ID NO: 262658 - RNA, 22 nt, Human
aagaugacccugagggcaauug

SEQ ID NO: 262659 - RNA, 23 nt, Human
cagagcuggcucagagcugccug

SEQ ID NO: 262660 - RNA, 22 nt, Human
aaaaagauagcauugugcuccu

SEQ ID NO: 262661 - RNA, 22 nt, Human
ugcuggcuuggaaggaaagcgc

SEQ ID NO: 262662 - RNA, 22 nt, Human
agacacuuucagaaguguuugc

SEQ ID NO: 262663 - RNA, 22 nt, Human
ccucuggccaucccccauuaag

SEQ ID NO: 262664 - RNA, 22 nt, Human
uuuuauucuaaguaugauggga

SEQ ID NO: 262665 - RNA, 22 nt, Human
agaagauuauuagagacuuugu

SEQ ID NO: 262666 - RNA, 22 nt, Human
uuuauguuugcauuuucaaaga

SEQ ID NO: 262667 - RNA, 22 nt, Human
ccacugaggggucaugguggga

SEQ ID NO: 262668 - RNA, 23 nt, Human
uccuccugacacagccugaguga

SEQ ID NO: 262669 - RNA, 22 nt, Human
cucccaagcugugcugaacugu

SEQ ID NO: 262670 - RNA, 22 nt, Human
aguucacauaucuguuuuauuu

SEQ ID NO: 262671 - RNA, 22 nt, Human
uuugauucuguaaaauaacagg

SEQ ID NO: 262672 - RNA, 22 nt, Human
gcagcagcagcaauuuucuguc

SEQ ID NO: 262673 - RNA, 22 nt, Human
uuucaugaggggcaaaaucuca

SEQ ID NO: 262674 - RNA, 22 nt, Human
ucugcugcugaccaacacugug

SEQ ID NO: 262675 - RNA, 23 nt, Human
ggagugugaagaccugauauagc

SEQ ID NO: 262676 - RNA, 23 nt, Human
uagcaaaguuguuugggaaauuu

SEQ ID NO: 262677 - RNA, 22 nt, Human
guacagugugacuuuggaguga

SEQ ID NO: 262678 - RNA, 22 nt, Human
uugcccugucuuaagcuggcaa

SEQ ID NO: 262679 - RNA, 22 nt, Human
uaguuacaauggguucugugac

SEQ ID NO: 262680 - RNA, 22 nt, Human
uccaggaagccacacugggccu

SEQ ID NO: 262681 - RNA, 22 nt, Human
uacauagaauauuucacuuaaa

SEQ ID NO: 262682 - RNA, 22 nt, Human
acucuggcugccuugugagcau

SEQ ID NO: 262683 - RNA, 22 nt, Human
agucccuucucaaagugugcgg

SEQ ID NO: 262684 - RNA, 22 nt, Human
auaugaaaauguuuuagcugua

SEQ ID NO: 262685 - RNA, 22 nt, Human
ucccugcaggugggguggccag

SEQ ID NO: 262686 - RNA, 22 nt, Human
ggacaggccuggcacaguacug

SEQ ID NO: 262687 - RNA, 22 nt, Human
aguauauaugaggaaccacaaa

SEQ ID NO: 262688 - RNA, 22 nt, Human
cuauucaguaagccaaaaccau

SEQ ID NO: 262689 - RNA, 21 nt, Human
uggccucccacacuuccaugg

SEQ ID NO: 262690 - RNA, 22 nt, Human
cugcuuuaucugagacaaguca

SEQ ID NO: 262691 - RNA, 22 nt, Human
cagcuuugccaaguaaggucuu

SEQ ID NO: 262692 - RNA, 22 nt, Human
ucucaaauuugcuggaccagua

SEQ ID NO: 262693 - RNA, 22 nt, Human
gcuggccugagggccgaggcuc

SEQ ID NO: 262694 - RNA, 22 nt, Human
aaaggccaccaacaugaagcau

SEQ ID NO: 262695 - RNA, 22 nt, Human
gccaggcucucagugacugccc

SEQ ID NO: 262696 - RNA, 22 nt, Human
uagggauguccugagacuuggc

SEQ ID NO: 262697 - RNA, 22 nt, Human
uaauuuuguauugccauuguag

SEQ ID NO: 262698 - RNA, 22 nt, Human
uauuaagagauguaugaagaga

SEQ ID NO: 262699 - RNA, 19 nt, Human
uccauacaaacuguugaaa

SEQ ID NO: 262700 - RNA, 22 nt, Human
aaaccacaguucagugcuuuug

SEQ ID NO: 262701 - RNA, 22 nt, Human
uuggaauugugaacuaagugau

SEQ ID NO: 262702 - RNA, 22 nt, Human
uggcucagaaggcugccuucac

SEQ ID NO: 262703 - RNA, 22 nt, Human
uuuagggaaauugaggguuaag

SEQ ID NO: 262704 - RNA, 22 nt, Human
agugaugguuuccagucacuga

SEQ ID NO: 262705 - RNA, 21 nt, Human
cucugcugucuaccagcuguu

SEQ ID NO: 262706 - RNA, 22 nt, Human
cccaggcuagaaaggccaacaa

SEQ ID NO: 262707 - RNA, 22 nt, Human
auacacauaucagguguauaca

SEQ ID NO: 262708 - RNA, 22 nt, Human
cuuuaguuugugauacgaagau

SEQ ID NO: 262709 - RNA, 22 nt, Human
uuucaaagaccauuaacuauca

SEQ ID NO: 262710 - RNA, 22 nt, Human
guggggaggccuaagcaaguug

SEQ ID NO: 262711 - RNA, 17 nt, Human
uuauugcuauaagcuga

SEQ ID NO: 262712 - RNA, 22 nt, Human
uaugcauacaaugagauauucc

SEQ ID NO: 262713 - RNA, 22 nt, Human
cuguauauggcuuacuuuauau

SEQ ID NO: 262714 - RNA, 22 nt, Human
ugggccuguuucccuucagggc

SEQ ID NO: 262715 - RNA, 22 nt, Human
ccaggucuaucaaguugggcuc

SEQ ID NO: 262716 - RNA, 17 nt, Human
uguuuucugcuaccuuu

SEQ ID NO: 262717 - RNA, 22 nt, Human
cugguuuacccaagauuugcug

SEQ ID NO: 262718 - RNA, 22 nt, Human
cugaggagagguggccuguguu

SEQ ID NO: 262719 - RNA, 22 nt, Human
uguucauuuggcccuuuuguau

SEQ ID NO: 262720 - RNA, 22 nt, Human
uaguauuuauaaucaugcuuaa

SEQ ID NO: 262721 - RNA, 22 nt, Human
aaaugcagaaugauuucaucua

SEQ ID NO: 262722 - RNA, 22 nt, Human
augcaacaaaugcuacgaaucg

SEQ ID NO: 262723 - RNA, 23 nt, Human
ugucugguucaugcuuauuuugg

SEQ ID NO: 262724 - RNA, 22 nt, Human
aaaggcuuguccaguaagggga

SEQ ID NO: 262725 - RNA, 22 nt, Human
agcuugggugugccugcgagcu

SEQ ID NO: 262726 - RNA, 22 nt, Human
ucucuaguugaggacugagcag

SEQ ID NO: 262727 - RNA, 22 nt, Human
guccuggugcuggucauugucg

SEQ ID NO: 262728 - RNA, 22 nt, Human
gaggugaguggggucuccaggg

SEQ ID NO: 262729 - RNA, 22 nt, Human
uuuuucuacugcccacauugua

SEQ ID NO: 262730 - RNA, 22 nt, Human
cuguuacuccuuuggcagauua

SEQ ID NO: 262731 - RNA, 22 nt, Human
aaaguguugggaagaaagugca

SEQ ID NO: 262732 - RNA, 22 nt, Human
gaagguccagcguggccaaguc

SEQ ID NO: 262733 - RNA, 22 nt, Human
ucagagccccuccgcuguccca

SEQ ID NO: 262734 - RNA, 18 nt, Human
ugaacuuuuccugcugcu

SEQ ID NO: 262735 - RNA, 22 nt, Human
caggccucagggcuguccguag

SEQ ID NO: 262736 - RNA, 22 nt, Human
uauaagcacauccuugacugau

SEQ ID NO: 262737 - RNA, 22 nt, Human
gaagaacacuucaugauucauu

SEQ ID NO: 262738 - RNA, 22 nt, Human
uugaaugaagucccuuuuuacu

SEQ ID NO: 262739 - RNA, 22 nt, Human
uuggagauaucacaccuucaca

SEQ ID NO: 262740 - RNA, 22 nt, Human
aagccuccuuauuaaaggauau

SEQ ID NO: 262741 - RNA, 22 nt, Human
uccagccugguugcgggcaucc

SEQ ID NO: 262742 - RNA, 22 nt, Human
acaguuaauuguuguugggugu

SEQ ID NO: 262743 - RNA, 22 nt, Human
gagacacacauucuggagagaa

SEQ ID NO: 262744 - RNA, 22 nt, Human
ugaggaguaugguggggucauu

SEQ ID NO: 262745 - RNA, 22 nt, Human
agaggaggcuggguccagauaa

SEQ ID NO: 262746 - RNA, 22 nt, Human
ugcugagguuucugacuaugga

SEQ ID NO: 262747 - RNA, 22 nt, Human
ucuggcagcaagucuguuucuc

SEQ ID NO: 262748 - RNA, 22 nt, Human
aggagguguugauagaagguuu

SEQ ID NO: 262749 - RNA, 22 nt, Human
ucaguuaaugguaagggugaaa

SEQ ID NO: 262750 - RNA, 22 nt, Human
ugccaggcccugugcuggaugc

SEQ ID NO: 262751 - RNA, 22 nt, Human
gccuguuucuaaucucauuucu

SEQ ID NO: 262752 - RNA, 22 nt, Human
ccagcaucgacuuccugccuga

SEQ ID NO: 262753 - RNA, 22 nt, Human
acacccagagcgccagugccga

SEQ ID NO: 262754 - RNA, 22 nt, Human
gcucaaagguugauagcugugc

SEQ ID NO: 262755 - RNA, 17 nt, Human
ucuggaugucauggaag

SEQ ID NO: 262756 - RNA, 22 nt, Human
gggaccuggacaugugugugcu

SEQ ID NO: 262757 - RNA, 22 nt, Human
ucaggccugcaaaugaauggua

SEQ ID NO: 262758 - RNA, 22 nt, Human
auuuacagacguggauuagugc

SEQ ID NO: 262759 - RNA, 22 nt, Human
acagacugucccaccacaugga

SEQ ID NO: 262760 - RNA, 22 nt, Human
ucugaaagcuagaaaaugcucu

SEQ ID NO: 262761 - RNA, 22 nt, Human
uaggaaaugcugucuuauugua

SEQ ID NO: 262762 - RNA, 22 nt, Human
acagcagguuuuaacuuugaag

SEQ ID NO: 262763 - RNA, 22 nt, Human
ccagugcaggugagcaccaggu

SEQ ID NO: 262764 - RNA, 22 nt, Human
ccugggagugucagacuugcuu

SEQ ID NO: 262765 - RNA, 22 nt, Human
auaguguuguauguacagucug

SEQ ID NO: 262766 - RNA, 22 nt, Human
ccuggcucugccguaaccacca

SEQ ID NO: 262767 - RNA, 22 nt, Human
uuuauuuaaagucguguguuaa

SEQ ID NO: 262768 - RNA, 22 nt, Human
aaaucucaaaggcuuagcaucu

SEQ ID NO: 262769 - RNA, 19 nt, Human
cuccucagucccagagguc

SEQ ID NO: 262770 - RNA, 22 nt, Human
gggcuucugcucuuuuggugcu

SEQ ID NO: 262771 - RNA, 22 nt, Human
aggcuucuaggguuggcagcgg

SEQ ID NO: 262772 - RNA, 22 nt, Human
ggaguauuguagcuuccaguuc

SEQ ID NO: 262773 - RNA, 22 nt, Human
ucuuccagcuucugguggcugc

SEQ ID NO: 262774 - RNA, 20 nt, Human
uucaugcuggaggggcuggc

SEQ ID NO: 262775 - RNA, 22 nt, Human
uuuaggaucaaugagaaagucu

SEQ ID NO: 262776 - RNA, 20 nt, Human
ugcagguguguccaagcacu

SEQ ID NO: 262777 - RNA, 22 nt, Human
cugcuuuaacagaugauggugu

SEQ ID NO: 262778 - RNA, 22 nt, Human
uuacacaacaucuguauuauua

SEQ ID NO: 262779 - RNA, 21 nt, Human
ugacagcauagagcagggagg

SEQ ID NO: 262780 - RNA, 22 nt, Human
uccuggugcugacacccauagc

SEQ ID NO: 262781 - RNA, 22 nt, Human
aaagagaaacuuagaagccuga

SEQ ID NO: 262782 - RNA, 22 nt, Human
acauuucucaucuaguagagua

SEQ ID NO: 262783 - RNA, 22 nt, Human
gaggccauaagaaguucuuggg

SEQ ID NO: 262784 - RNA, 22 nt, Human
guugcagauguggaacucgugc

SEQ ID NO: 262785 - RNA, 22 nt, Human
caggacagaccaagaucgugcu

SEQ ID NO: 262786 - RNA, 22 nt, Human
uuuccugagucagagacaccag

SEQ ID NO: 262787 - RNA, 22 nt, Human
aaagugcagcuugugaucccua

SEQ ID NO: 262788 - RNA, 22 nt, Human
ugaguauugaccagaaaauuua

SEQ ID NO: 262789 - RNA, 22 nt, Human
agcuggaggggccagcaggugu

SEQ ID NO: 262790 - RNA, 22 nt, Human
ucagguguuucuggagaaguaa

SEQ ID NO: 262791 - RNA, 22 nt, Human
uccaggagauacacugcaccag

SEQ ID NO: 262792 - RNA, 22 nt, Human
uuucauaaugucacagucaaaa

SEQ ID NO: 262793 - RNA, 22 nt, Human
cugucauuuucuuccaauauaa

SEQ ID NO: 262794 - RNA, 22 nt, Human
cucugugcucccaugcuaguaa

SEQ ID NO: 262795 - RNA, 22 nt, Human
uaaaucucacuggguauauugg

SEQ ID NO: 262796 - RNA, 22 nt, Human
ccucagcagacacgcuucucac

SEQ ID NO: 262797 - RNA, 22 nt, Human
gccaggcuggcaaaaggaaacc

SEQ ID NO: 262798 - RNA, 21 nt, Human
acagauuuuauaucucugcug

SEQ ID NO: 262799 - RNA, 22 nt, Human
gccaggggacgcggagcgacga

SEQ ID NO: 262800 - RNA, 22 nt, Human
aaaccuuuucagcugaauggag

SEQ ID NO: 262801 - RNA, 22 nt, Human
ugaaauaacuuuugggugaguu

SEQ ID NO: 262802 - RNA, 22 nt, Human
uuugcagugucagcuucugugu

SEQ ID NO: 262803 - RNA, 22 nt, Human
gugugccaggaacuggcugcug

SEQ ID NO: 262804 - RNA, 22 nt, Human
ugcauuauuacaagguaagacu

SEQ ID NO: 262805 - RNA, 22 nt, Human
gagcuccuauggucgguggcuc

SEQ ID NO: 262806 - RNA, 22 nt, Human
augccccaggaggugccaucca

SEQ ID NO: 262807 - RNA, 22 nt, Human
aguccuggacuuggagucaggg

SEQ ID NO: 262808 - RNA, 22 nt, Human
gcaggcuugagagaucagaugg

SEQ ID NO: 262809 - RNA, 22 nt, Human
aaacucugcacugcgguaaggu

SEQ ID NO: 262810 - RNA, 22 nt, Human
aguguucauuuauucauucacu

SEQ ID NO: 262811 - RNA, 22 nt, Human
uggcagugggaagcuggaaguc

SEQ ID NO: 262812 - RNA, 22 nt, Human
aaggccaggacaccaggggacu

SEQ ID NO: 262813 - RNA, 22 nt, Human
gguccaguccugcucaccacuu

SEQ ID NO: 262814 - RNA, 22 nt, Human
ucuuuucauugagaacacacug

SEQ ID NO: 262815 - RNA, 22 nt, Human
gagcuggguauauggcuuuaug

SEQ ID NO: 262816 - RNA, 22 nt, Human
caaaauugaugaauguaugauu

SEQ ID NO: 262817 - RNA, 21 nt, Human
cucuccagugguuccugauuc

SEQ ID NO: 262818 - RNA, 22 nt, Human
uuacaaguacugaauaugauuu

SEQ ID NO: 262819 - RNA, 22 nt, Human
guaugaaagcaucauuccugcu

SEQ ID NO: 262820 - RNA, 22 nt, Human
aacccagagcuggaggagagua

SEQ ID NO: 262821 - RNA, 22 nt, Human
uucuagaaugauaugagguacu

SEQ ID NO: 262822 - RNA, 22 nt, Human
cccagcucugcagaccugcccu

SEQ ID NO: 262823 - RNA, 23 nt, Human
uucuuuggaauugggcugcaagg

SEQ ID NO: 262824 - RNA, 22 nt, Human
aaggccaggccuagcacggagg

SEQ ID NO: 262825 - RNA, 22 nt, Human
gccacuguuccaccaucuugau

SEQ ID NO: 262826 - RNA, 22 nt, Human
ucuuucuacaucauuugcuucu

SEQ ID NO: 262827 - RNA, 22 nt, Human
ggaaggcuuuguagaagugcca

SEQ ID NO: 262828 - RNA, 22 nt, Human
caucugaauuugccuuaguuuc

SEQ ID NO: 262829 - RNA, 22 nt, Human
aacaucuacagugagauguuag

SEQ ID NO: 262830 - RNA, 22 nt, Human
ggccugaggccaccagcagccc

SEQ ID NO: 262831 - RNA, 23 nt, Human
auuugagaaaguauuuuuaagac

SEQ ID NO: 262832 - RNA, 22 nt, Human
agguucuccuuaucaaugaaga

SEQ ID NO: 262833 - RNA, 22 nt, Human
cugaggaggggccugagugaga

SEQ ID NO: 262834 - RNA, 22 nt, Human
ucaaaagucugcauucuucaca

SEQ ID NO: 262835 - RNA, 22 nt, Human
uccugcuagagaauaacagcac

SEQ ID NO: 262836 - RNA, 22 nt, Human
ugaaaugcuuaggaccagaagg

SEQ ID NO: 262837 - RNA, 22 nt, Human
cggagcugcgccgggacacggg

SEQ ID NO: 262838 - RNA, 22 nt, Human
guguccugcauuggcucugccc

SEQ ID NO: 262839 - RNA, 22 nt, Human
ggcuugcuucuuguccaggaau

SEQ ID NO: 262840 - RNA, 22 nt, Human
cacagguagaugccaugcagca

SEQ ID NO: 262841 - RNA, 22 nt, Human
ucaaacagaggaacaauuguuu

SEQ ID NO: 262842 - RNA, 18 nt, Human
agacagacagguuugugc

SEQ ID NO: 262843 - RNA, 22 nt, Human
ugcagggcccucauuccugucc

SEQ ID NO: 262844 - RNA, 22 nt, Human
caggcugugggagucaggaccc

SEQ ID NO: 262845 - RNA, 22 nt, Human
auggcuucaucuuuuaguccuu

SEQ ID NO: 262846 - RNA, 22 nt, Human
ggcccagaaaaaggcuuagaau

SEQ ID NO: 262847 - RNA, 22 nt, Human
ucuccaggccuuucccaucuua

SEQ ID NO: 262848 - RNA, 22 nt, Human
cuaaagcaacugagacacauag

SEQ ID NO: 262849 - RNA, 23 nt, Human
uccuccuuuugcuugugcuuccc

SEQ ID NO: 262850 - RNA, 22 nt, Human
cucucugugcucacaagggcag

SEQ ID NO: 262851 - RNA, 21 nt, Human
agugacuaugacauuauuacc

SEQ ID NO: 262852 - RNA, 22 nt, Human
guauuagguuggugcaaaagua

SEQ ID NO: 262853 - RNA, 22 nt, Human
uacuguacugcaguucugcaaa

SEQ ID NO: 262854 - RNA, 22 nt, Human
aacaaaacauuugucuuguuuc

SEQ ID NO: 262855 - RNA, 22 nt, Human
aauggcuuuaaguagucucaca

SEQ ID NO: 262856 - RNA, 22 nt, Human
auacaacuuuaucuguaaugag

SEQ ID NO: 262857 - RNA, 22 nt, Human
agccuaaugcuuuucccaaagu

SEQ ID NO: 262858 - RNA, 22 nt, Human
cuggucccuguagguauuugac

SEQ ID NO: 262859 - RNA, 22 nt, Human
uguucauucgcuauugucuaug

SEQ ID NO: 262860 - RNA, 15 nt, Human
ccaggcugggugagc

SEQ ID NO: 262861 - RNA, 22 nt, Human
aggcugagauagguggaucauu

SEQ ID NO: 262862 - RNA, 22 nt, Human
caacaguauagcuuuugacugc

SEQ ID NO: 262863 - RNA, 20 nt, Human
agaaccuaaguuaaaacaca

SEQ ID NO: 262864 - RNA, 22 nt, Human
guuauugagacauagaguuaug

SEQ ID NO: 262865 - RNA, 22 nt, Human
accucaguucaauucaguuaga

SEQ ID NO: 262866 - RNA, 22 nt, Human
ccaggagcgcgugaacaggcug

SEQ ID NO: 262867 - RNA, 22 nt, Human
uuguacaacguuuuaaauuuga

SEQ ID NO: 262868 - RNA, 22 nt, Human
gguucucuuccuccugacugag

SEQ ID NO: 262869 - RNA, 22 nt, Human
guuuaauuuuagguugucaagc

SEQ ID NO: 262870 - RNA, 22 nt, Human
cguggcuggggcgacuccacgg

SEQ ID NO: 262871 - RNA, 22 nt, Human
ucaggccuggagaaaggaauga

SEQ ID NO: 262872 - RNA, 21 nt, Human
ugggggugaggccuaggaauc

SEQ ID NO: 262873 - RNA, 22 nt, Human
cagagugcauggugcuguucau

SEQ ID NO: 262874 - RNA, 22 nt, Human
gccagcagggaagccuugggcu

SEQ ID NO: 262875 - RNA, 21 nt, Human
gagcugaauauguucuagggg

SEQ ID NO: 262876 - RNA, 22 nt, Human
uucaaacuuaaggagcagcaga

SEQ ID NO: 262877 - RNA, 22 nt, Human
caggcuccucacucaugcuccc

SEQ ID NO: 262878 - RNA, 22 nt, Human
gucugcccugcugaucucaccc

SEQ ID NO: 262879 - RNA, 22 nt, Human
uacaguaaagcugcuaugaauu

SEQ ID NO: 262880 - RNA, 22 nt, Human
uguauuuugugaggaucacucu

SEQ ID NO: 262881 - RNA, 22 nt, Human
gcuguggucccucuguccucau

SEQ ID NO: 262882 - RNA, 22 nt, Human
aaaugucuuuaucucauguaac

SEQ ID NO: 262883 - RNA, 22 nt, Human
ccuggcugaaccaaugaagugg

SEQ ID NO: 262884 - RNA, 22 nt, Human
uacauuccuucguuuagagauu

SEQ ID NO: 262885 - RNA, 22 nt, Human
gcccucuggcagccuuggcugg

SEQ ID NO: 262886 - RNA, 22 nt, Human
cuaauagauaccacauuggaca

SEQ ID NO: 262887 - RNA, 22 nt, Human
acugcacuucacccugggugac

SEQ ID NO: 262888 - RNA, 21 nt, Human
uucccagcaccuagcacaggu

SEQ ID NO: 262889 - RNA, 22 nt, Human
uaauuuaugaugcaaagaaaag

SEQ ID NO: 262890 - RNA, 22 nt, Human
gaaaagagaacaucugaggauc

SEQ ID NO: 262891 - RNA, 22 nt, Human
ucacagaauagcacuguaagcg

SEQ ID NO: 262892 - RNA, 22 nt, Human
acuucucugcuaccugcaaaga

SEQ ID NO: 262893 - RNA, 22 nt, Human
gaaguuacucucguuaaauaug

SEQ ID NO: 262894 - RNA, 22 nt, Human
cccaugccuucugacucacagg

SEQ ID NO: 262895 - RNA, 22 nt, Human
uucucuuaucuggcauuauugg

SEQ ID NO: 262896 - RNA, 22 nt, Human
cccugagagguugagugucugc

SEQ ID NO: 262897 - RNA, 22 nt, Human
cugcaagguauauguuaucaua

SEQ ID NO: 262898 - RNA, 22 nt, Human
gaaauguguuguucauuucuaa

SEQ ID NO: 262899 - RNA, 17 nt, Human
uggcuucaggcugagca

SEQ ID NO: 262900 - RNA, 22 nt, Human
aaaauguguuuaugcauuucgu

SEQ ID NO: 262901 - RNA, 22 nt, Human
cccugucucauugaucacuugu

SEQ ID NO: 262902 - RNA, 22 nt, Human
agagaauuaauuaggagcacug

SEQ ID NO: 262903 - RNA, 22 nt, Human
uaauacagaaguguauuaaaau

SEQ ID NO: 262904 - RNA, 22 nt, Human
gcagagugagccgaggcugcuc

SEQ ID NO: 262905 - RNA, 22 nt, Human
uuucucagggaggagucaagcc

SEQ ID NO: 262906 - RNA, 22 nt, Human
cucugaauggacacuccagugu

SEQ ID NO: 262907 - RNA, 22 nt, Human
agucaggauuuuggauuauucg

SEQ ID NO: 262908 - RNA, 22 nt, Human
gacauuucuagcccauaaaacu

SEQ ID NO: 262909 - RNA, 22 nt, Human
uucuguacccucgcgauucucc

SEQ ID NO: 262910 - RNA, 22 nt, Human
ccuggggcuuucuuuguaucau

SEQ ID NO: 262911 - RNA, 22 nt, Human
ggcuguggucugggugcucccc

SEQ ID NO: 262912 - RNA, 22 nt, Human
uuaaaggcaugguuagacaugg

SEQ ID NO: 262913 - RNA, 22 nt, Human
aucuuuaggcaaguuacuuaac

SEQ ID NO: 262914 - RNA, 22 nt, Human
cugggagagccuuuccugaguc

SEQ ID NO: 262915 - RNA, 22 nt, Human
caugccaguuuugagaugcacc

SEQ ID NO: 262916 - RNA, 22 nt, Human
aagaacuguaucaagauguagu

SEQ ID NO: 262917 - RNA, 22 nt, Human
agcaccugugcccugauggaga

SEQ ID NO: 262918 - RNA, 22 nt, Human
aaaugucaaggugauagaugca

SEQ ID NO: 262919 - RNA, 22 nt, Human
auucuggguucaugagugagcu

SEQ ID NO: 262920 - RNA, 22 nt, Human
aucuaggauuugaaugcacagu

SEQ ID NO: 262921 - RNA, 22 nt, Human
agcucaggccggagcuacaggc

SEQ ID NO: 262922 - RNA, 22 nt, Human
acaggcuuacaggcugcaagua

SEQ ID NO: 262923 - RNA, 22 nt, Human
uauguacacacacaugcaugua

SEQ ID NO: 262924 - RNA, 22 nt, Human
uacaacauguaaagugguuuaa

SEQ ID NO: 262925 - RNA, 22 nt, Human
ugcacgugugagcauucacaug

SEQ ID NO: 262926 - RNA, 20 nt, Human
agagagagguaaauugagca

SEQ ID NO: 262927 - RNA, 22 nt, Human
cugagacacggagaggcugugu

SEQ ID NO: 262928 - RNA, 22 nt, Human
ugcaacaggagaguucagggca

SEQ ID NO: 262929 - RNA, 22 nt, Human
auuucucucauuguuagcuagg

SEQ ID NO: 262930 - RNA, 22 nt, Human
uucuguguggguagcuccuguu

SEQ ID NO: 262931 - RNA, 22 nt, Human
aguuaucaucccuuacacuuug

SEQ ID NO: 262932 - RNA, 22 nt, Human
ggcaaaaguauuaucucuuuaa

SEQ ID NO: 262933 - RNA, 22 nt, Human
uccuggccucgcuguccaccuu

SEQ ID NO: 262934 - RNA, 22 nt, Human
cagcagggcccccgggugcgcc

SEQ ID NO: 262935 - RNA, 22 nt, Human
uuauuggaaaagggcuguaauu

SEQ ID NO: 262936 - RNA, 22 nt, Human
ugucuuuuggagcaucuuucuu

SEQ ID NO: 262937 - RNA, 22 nt, Human
ccuggaggcagaaauaggacuu

SEQ ID NO: 262938 - RNA, 23 nt, Human
gcugggcuuacucuuucagugag

SEQ ID NO: 262939 - RNA, 22 nt, Human
agcuggcaucugaagucagggc

SEQ ID NO: 262940 - RNA, 22 nt, Human
aggcaggcucuggguaugugca

SEQ ID NO: 262941 - RNA, 22 nt, Human
gaccauuugcuaguaaauugca

SEQ ID NO: 262942 - RNA, 22 nt, Human
ucagggcaagauugguuaauaa

SEQ ID NO: 262943 - RNA, 22 nt, Human
augagaaauuuauuacaagcua

SEQ ID NO: 262944 - RNA, 22 nt, Human
uacaggcacugaaaugcuuauu

SEQ ID NO: 262945 - RNA, 22 nt, Human
ugccucuggccuuuggugccca

SEQ ID NO: 262946 - RNA, 22 nt, Human
uccaggacagcggcaggcagau

SEQ ID NO: 262947 - RNA, 22 nt, Human
ccaggcuagcccagaccacagg

SEQ ID NO: 262948 - RNA, 22 nt, Human
agucuuuauacagaaauauaug

SEQ ID NO: 262949 - RNA, 19 nt, Human
ucaggacugacuugaaguc

SEQ ID NO: 262950 - RNA, 22 nt, Human
gcagcuggauuucaagagggag

SEQ ID NO: 262951 - RNA, 22 nt, Human
aaagcaggguccaaggagaugu

SEQ ID NO: 262952 - RNA, 22 nt, Human
augguggaaucggcgugaaugg

SEQ ID NO: 262953 - RNA, 22 nt, Human
agggcugagcccaggcauguag

SEQ ID NO: 262954 - RNA, 22 nt, Human
ucacacagcuccuuuccuuagu

SEQ ID NO: 262955 - RNA, 22 nt, Human
caguuuuagggcaaugugaaga

SEQ ID NO: 262956 - RNA, 22 nt, Human
ucuggguguagggccuggcaac

SEQ ID NO: 262957 - RNA, 22 nt, Human
gucauggaggauugugaguggu

SEQ ID NO: 262958 - RNA, 22 nt, Human
aguuauauuccauagauucaga

SEQ ID NO: 262959 - RNA, 22 nt, Human
uuccaggacucguucuggcuca

SEQ ID NO: 262960 - RNA, 23 nt, Human
ggcagauuugguuuguuuuaaua

SEQ ID NO: 262961 - RNA, 22 nt, Human
ucccuggccuggaaggauauca

SEQ ID NO: 262962 - RNA, 22 nt, Human
cauggccaggcacgcgcauagc

SEQ ID NO: 262963 - RNA, 22 nt, Human
auaggugugugguucauggccc

SEQ ID NO: 262964 - RNA, 22 nt, Human
ccaguguuuccccagaagagag

SEQ ID NO: 262965 - RNA, 22 nt, Human
augcaaaauuaccauucuguuc

SEQ ID NO: 262966 - RNA, 22 nt, Human
auucaguuuuuauuggaccagc

SEQ ID NO: 262967 - RNA, 22 nt, Human
ugccaggcuuuggucaaaggcu

SEQ ID NO: 262968 - RNA, 22 nt, Human
uucucuguggauugggugagag

SEQ ID NO: 262969 - RNA, 22 nt, Human
aacuugaaacuguuccagaaaa

SEQ ID NO: 262970 - RNA, 18 nt, Human
acuguucucuccugcccu

SEQ ID NO: 262971 - RNA, 22 nt, Human
cacgccagccggacacugggcc

SEQ ID NO: 262972 - RNA, 22 nt, Human
uggcaggugccuguaaucucag

SEQ ID NO: 262973 - RNA, 22 nt, Human
gugugccacugccugaggaccc

SEQ ID NO: 262974 - RNA, 22 nt, Human
uggaggaaaaaaccaggcagag

SEQ ID NO: 262975 - RNA, 22 nt, Human
gcugugugcucacguaguggaa

SEQ ID NO: 262976 - RNA, 22 nt, Human
ugguauuacuucuagacacaag

SEQ ID NO: 262977 - RNA, 22 nt, Human
gaggccagccccucuugaaggc

SEQ ID NO: 262978 - RNA, 20 nt, Human
ucacagcuggcuaugacagg

SEQ ID NO: 262979 - RNA, 22 nt, Human
ugcugauuuugccuacugaucc

SEQ ID NO: 262980 - RNA, 23 nt, Human
ucuuugguaaauaaaguggggau

SEQ ID NO: 262981 - RNA, 22 nt, Human
ugaguccugcugagcagagagg

SEQ ID NO: 262982 - RNA, 22 nt, Human
ccugccugcaaaaugggacaag

SEQ ID NO: 262983 - RNA, 22 nt, Human
uucuguauauuguaaagacuca

SEQ ID NO: 262984 - RNA, 22 nt, Human
ggguaggccagaagggccugga

SEQ ID NO: 262985 - RNA, 22 nt, Human
gccugccuagaauugcagcuuu

SEQ ID NO: 262986 - RNA, 22 nt, Human
ucucuuggaaagcuugcccacu

SEQ ID NO: 262987 - RNA, 22 nt, Human
gauauuuaacucucacaggucc

SEQ ID NO: 262988 - RNA, 22 nt, Human
aguucagaguaaauguugaagg

SEQ ID NO: 262989 - RNA, 22 nt, Human
gaggugucugaguggggaccug

SEQ ID NO: 262990 - RNA, 22 nt, Human
ucugccugcaguguggcagggc

SEQ ID NO: 262991 - RNA, 22 nt, Human
caaaucugagucuacaauuuua

SEQ ID NO: 262992 - RNA, 22 nt, Human
uuggaacaugccgggguccagg

SEQ ID NO: 262993 - RNA, 19 nt, Human
gaggcgaggcgugcaggag

SEQ ID NO: 262994 - RNA, 22 nt, Human
uguguuauugccacugaagacc

SEQ ID NO: 262995 - RNA, 22 nt, Human
ugugcccuguuaaaugcacagu

SEQ ID NO: 262996 - RNA, 22 nt, Human
auguuuccagguucuuccuaug

SEQ ID NO: 262997 - RNA, 17 nt, Human
agugugugaaauggugg

SEQ ID NO: 262998 - RNA, 22 nt, Human
uaggcaugcaaauaaaugugca

SEQ ID NO: 262999 - RNA, 22 nt, Human
caaugacagguucaugacuccu

SEQ ID NO: 263000 - RNA, 22 nt, Human
uaaacaucugucauguguuuau

SEQ ID NO: 263001 - RNA, 22 nt, Human
ucagcuccucaugcaggggaua

SEQ ID NO: 263002 - RNA, 22 nt, Human
aagcuuuagagaugaguuccuu

SEQ ID NO: 263003 - RNA, 22 nt, Human
uaaaugauuuauguaugugaaa

SEQ ID NO: 263004 - RNA, 22 nt, Human
ccucuucucaacuccagccaga

SEQ ID NO: 263005 - RNA, 22 nt, Human
acagaaagauaggcacaagguc

SEQ ID NO: 263006 - RNA, 22 nt, Human
cuuuaguuuaagaacaugauga

SEQ ID NO: 263007 - RNA, 22 nt, Human
ggccucugggguccugagccca

SEQ ID NO: 263008 - RNA, 22 nt, Human
auuugcuucugugaaaucaagu

SEQ ID NO: 263009 - RNA, 22 nt, Human
uucacauuugcccuuaugugug

SEQ ID NO: 263010 - RNA, 22 nt, Human
ucugcagaacuuuaugagcaaa

SEQ ID NO: 263011 - RNA, 22 nt, Human
gagaugguguuccacugccagu

SEQ ID NO: 263012 - RNA, 22 nt, Human
uuuaagaugguauuuuauaaag

SEQ ID NO: 263013 - RNA, 22 nt, Human
cauuaauauuguucuucuuuag

SEQ ID NO: 263014 - RNA, 22 nt, Human
gcucagcugcaccuggagagcc

SEQ ID NO: 263015 - RNA, 22 nt, Human
gcugcuguggcagauuggauuc

SEQ ID NO: 263016 - RNA, 22 nt, Human
agacugggccauuuccccagcu

SEQ ID NO: 263017 - RNA, 22 nt, Human
gaaugcuaagcaugugggaguu

SEQ ID NO: 263018 - RNA, 22 nt, Human
guccugaaugccuuuaggcaga

SEQ ID NO: 263019 - RNA, 19 nt, Human
uuuaaagugacugguauuu

SEQ ID NO: 263020 - RNA, 22 nt, Human
gaacagagaagcuuuacuaaag

SEQ ID NO: 263021 - RNA, 22 nt, Human
guuuuauaggcuguugcuauau

SEQ ID NO: 263022 - RNA, 23 nt, Human
uucuccugaggaagcagggacug

SEQ ID NO: 263023 - RNA, 22 nt, Human
uuacaggguugcagcauugacg

SEQ ID NO: 263024 - RNA, 22 nt, Human
acagucuacuaaacaucaucag

SEQ ID NO: 263025 - RNA, 22 nt, Human
aacagacuuagagcaucccaau

SEQ ID NO: 263026 - RNA, 22 nt, Human
gggcuccagaggcucacccugg

SEQ ID NO: 263027 - RNA, 22 nt, Human
aagauuuaccacuuuauucaag

SEQ ID NO: 263028 - RNA, 22 nt, Human
aggugaggauagguggccaagg

SEQ ID NO: 263029 - RNA, 22 nt, Human
ccuggucagguaacugggcuga

SEQ ID NO: 263030 - RNA, 22 nt, Human
ugacacauaccgaaaauauuug

SEQ ID NO: 263031 - RNA, 22 nt, Human
ucuggcagcuauccucuggcca

SEQ ID NO: 263032 - RNA, 22 nt, Human
uacaccaguaucuuaagcauga

SEQ ID NO: 263033 - RNA, 22 nt, Human
ucagggaacaucguuaaacuag

SEQ ID NO: 263034 - RNA, 22 nt, Human
uccugccaggagugcuggcccu

SEQ ID NO: 263035 - RNA, 19 nt, Human
ccaggccaucccaguuccc

SEQ ID NO: 263036 - RNA, 22 nt, Human
uugccuggauucuaccacagaa

SEQ ID NO: 263037 - RNA, 22 nt, Human
uucucugggaucuggcaaaagg

SEQ ID NO: 263038 - RNA, 22 nt, Human
uggcaaaguaucugucccagcu

SEQ ID NO: 263039 - RNA, 22 nt, Human
uggcuggggccacaguuuuccu

SEQ ID NO: 263040 - RNA, 22 nt, Human
gacagcagcauguuuacaggcc

SEQ ID NO: 263041 - RNA, 22 nt, Human
ccugggugucaugggcagcugg

SEQ ID NO: 263042 - RNA, 22 nt, Human
uaauuacagagguuugccaguu

SEQ ID NO: 263043 - RNA, 22 nt, Human
aaucaguuucuuggcaaguuua

SEQ ID NO: 263044 - RNA, 22 nt, Human
auuugccuugugauuuguaagu

SEQ ID NO: 263045 - RNA, 22 nt, Human
acagucaguaucccaggcaaau

SEQ ID NO: 263046 - RNA, 22 nt, Human
ggcaccaggacaugacucccag

SEQ ID NO: 263047 - RNA, 22 nt, Human
gaggugucauuuaguuaaucag

SEQ ID NO: 263048 - RNA, 22 nt, Human
uaacaguauagccuaacauuuc

SEQ ID NO: 263049 - RNA, 22 nt, Human
ggcaggcaagucugcucuguga

SEQ ID NO: 263050 - RNA, 22 nt, Human
agaggggcaaguaaagagucuu

SEQ ID NO: 263051 - RNA, 22 nt, Human
gaggcacaauacaugucucaag

SEQ ID NO: 263052 - RNA, 18 nt, Human
gcacagcuaggagggucc

SEQ ID NO: 263053 - RNA, 22 nt, Human
aguguagaugaaauuaaaccca

SEQ ID NO: 263054 - RNA, 22 nt, Human
acauucaaccaauguuugcuau

SEQ ID NO: 263055 - RNA, 20 nt, Human
ucuguuauugcauguacaua

SEQ ID NO: 263056 - RNA, 22 nt, Human
cuuauguaaaacggaaagggaa

SEQ ID NO: 263057 - RNA, 19 nt, Human
uccuccuuacuuccucuug

SEQ ID NO: 263058 - RNA, 22 nt, Human
agcaguuugaaucaauggccag

SEQ ID NO: 263059 - RNA, 22 nt, Human
cacaaaguauaacuugauggaa

SEQ ID NO: 263060 - RNA, 22 nt, Human
gaaucauuggaaccacauccaa

SEQ ID NO: 263061 - RNA, 22 nt, Human
ucugccuuagcaauugucaagg

SEQ ID NO: 263062 - RNA, 22 nt, Human
cuccugugaggcuuaagcccag

SEQ ID NO: 263063 - RNA, 22 nt, Human
ccaggacaauucgucacuuucu

SEQ ID NO: 263064 - RNA, 22 nt, Human
uuucagaaccgcuaaaauaaau

SEQ ID NO: 263065 - RNA, 20 nt, Human
ucuuugugucagauggacag

SEQ ID NO: 263066 - RNA, 22 nt, Human
cuucugugcuaaaugcaaaacc

SEQ ID NO: 263067 - RNA, 22 nt, Human
ccaggaggggucucugucuccc

SEQ ID NO: 263068 - RNA, 21 nt, Human
agaaauguaucauucuuuucc

SEQ ID NO: 263069 - RNA, 22 nt, Human
uaaugcacaugacugaacuauu

SEQ ID NO: 263070 - RNA, 22 nt, Human
guuugcauaucugugaaaugga

SEQ ID NO: 263071 - RNA, 22 nt, Human
ggagaucuugcuugaaggcaug

SEQ ID NO: 263072 - RNA, 22 nt, Human
gcuucauuuugcccucuggugg

SEQ ID NO: 263073 - RNA, 22 nt, Human
guguccugcacagcaccuugca

SEQ ID NO: 263074 - RNA, 22 nt, Human
ccugggcugcucauggggauga

SEQ ID NO: 263075 - RNA, 22 nt, Human
aaugucaaaauggaaugagacu

SEQ ID NO: 263076 - RNA, 22 nt, Human
ugucugaagcagccagugcugu

SEQ ID NO: 263077 - RNA, 22 nt, Human
ccuguucauuuguauuugucuu

SEQ ID NO: 263078 - RNA, 22 nt, Human
uguaagaauaaugauuucuaag

SEQ ID NO: 263079 - RNA, 22 nt, Human
auggguuuauagguggacuuuu

SEQ ID NO: 263080 - RNA, 22 nt, Human
gucucagguucgagccuccuua

SEQ ID NO: 263081 - RNA, 22 nt, Human
aguagugaacagccacaggauu

SEQ ID NO: 263082 - RNA, 22 nt, Human
aggcaagugcauuagaagagca

SEQ ID NO: 263083 - RNA, 22 nt, Human
aauuuacaggugcacucgccau

SEQ ID NO: 263084 - RNA, 19 nt, Human
ucucagaauuaagagugcu

SEQ ID NO: 263085 - RNA, 22 nt, Human
gcuuggcagcaacaggcauccc

SEQ ID NO: 263086 - RNA, 22 nt, Human
ucuggagggggaugccucaucc

SEQ ID NO: 263087 - RNA, 22 nt, Human
uuugcagugauucuugcaguga

SEQ ID NO: 263088 - RNA, 22 nt, Human
uacagcaauaaugacaccgcuc

SEQ ID NO: 263089 - RNA, 22 nt, Human
aaagcugcugugaaugguuugg

SEQ ID NO: 263090 - RNA, 22 nt, Human
agcugaggccacgagugaaggg

SEQ ID NO: 263091 - RNA, 22 nt, Human
cuucuuucccaggcauguuuua

SEQ ID NO: 263092 - RNA, 22 nt, Human
acaguacaagcaugauacauaa

SEQ ID NO: 263093 - RNA, 22 nt, Human
uuuguguuuguacaaugcacua

SEQ ID NO: 263094 - RNA, 22 nt, Human
ggagcucaccuuggagucucug

SEQ ID NO: 263095 - RNA, 22 nt, Human
acacacacaagcagguugugga

SEQ ID NO: 263096 - RNA, 22 nt, Human
aaagagucguguuccagguuug

SEQ ID NO: 263097 - RNA, 22 nt, Human
ccucagggaaugggaggcuggg

SEQ ID NO: 263098 - RNA, 22 nt, Human
cugguccccagacugggcuuag

SEQ ID NO: 263099 - RNA, 22 nt, Human
uacaaaugaccauagccacuua

SEQ ID NO: 263100 - RNA, 22 nt, Human
acagcauugcuccaucucaaga

SEQ ID NO: 263101 - RNA, 22 nt, Human
agacagacauagaaauuaguaa

SEQ ID NO: 263102 - RNA, 22 nt, Human
auauauuuuuugagacagaguc

SEQ ID NO: 263103 - RNA, 22 nt, Human
uugccaggcuuguuucuaggcu

SEQ ID NO: 263104 - RNA, 22 nt, Human
acuguccauaauauuggugaac

SEQ ID NO: 263105 - RNA, 22 nt, Human
aggaaugugaggcaaguuguga

SEQ ID NO: 263106 - RNA, 22 nt, Human
acuguucacuagugaggguuga

SEQ ID NO: 263107 - RNA, 22 nt, Human
ggucugagauauuuguucagcu

SEQ ID NO: 263108 - RNA, 22 nt, Human
agcagcagcucauucuuccugu

SEQ ID NO: 263109 - RNA, 22 nt, Human
uuguaaaugaccuuuucuaauu

SEQ ID NO: 263110 - RNA, 22 nt, Human
caggccagugugcuucccaggc

SEQ ID NO: 263111 - RNA, 22 nt, Human
augaggcaggauauuaacuuuu

SEQ ID NO: 263112 - RNA, 22 nt, Human
uuacaacacuacuuauccuuga

SEQ ID NO: 263113 - RNA, 22 nt, Human
cucagagcucgugggaccuugg

SEQ ID NO: 263114 - RNA, 22 nt, Human
cagcacuaggauauacauuucc

SEQ ID NO: 263115 - RNA, 22 nt, Human
gcagauaggguauuaggaguaa

SEQ ID NO: 263116 - RNA, 22 nt, Human
uagcccagagucccaauuccag

SEQ ID NO: 263117 - RNA, 20 nt, Human
ucugaauugagugaaugucu

SEQ ID NO: 263118 - RNA, 22 nt, Human
acaguacauagaucucuacccu

SEQ ID NO: 263119 - RNA, 22 nt, Human
uccagggaucuuuagagucuuu

SEQ ID NO: 263120 - RNA, 22 nt, Human
uuuaucuggacugugauauaaa

SEQ ID NO: 263121 - RNA, 22 nt, Human
uuuauauauggcuggucuggau

SEQ ID NO: 263122 - RNA, 22 nt, Human
ggcaggugccaguuggcuuggg

SEQ ID NO: 263123 - RNA, 19 nt, Human
gacagugcaguuguaguac

SEQ ID NO: 263124 - RNA, 22 nt, Human
uuuucauuuuuguagaugcaag

SEQ ID NO: 263125 - RNA, 22 nt, Human
gggcuucucagagaggcuuuag

SEQ ID NO: 263126 - RNA, 22 nt, Human
aaaguuugcaauuuauguuaau

SEQ ID NO: 263127 - RNA, 22 nt, Human
gacagcugcucccguuucugcu

SEQ ID NO: 263128 - RNA, 22 nt, Human
uagauuugauguaagcauaguc

SEQ ID NO: 263129 - RNA, 22 nt, Human
ucuccuggagcaggaagguggg

SEQ ID NO: 263130 - RNA, 22 nt, Human
uugugcaaggcucuuggaaugu

SEQ ID NO: 263131 - RNA, 22 nt, Human
guguaucuggcaugucgagugu

SEQ ID NO: 263132 - RNA, 22 nt, Human
uuacuuuguucucaagauaugu

SEQ ID NO: 263133 - RNA, 22 nt, Human
ucgugcaaaccugacacagcca

SEQ ID NO: 263134 - RNA, 22 nt, Human
aaaucaugguggaagaaacaga

SEQ ID NO: 263135 - RNA, 22 nt, Human
uccugggaagcgccggccugcg

SEQ ID NO: 263136 - RNA, 22 nt, Human
caggaaauuggcuauuugggau

SEQ ID NO: 263137 - RNA, 22 nt, Human
ucucaaaucaaacuuugagcuu

SEQ ID NO: 263138 - RNA, 22 nt, Human
cagucuaaucuguuacucauua

SEQ ID NO: 263139 - RNA, 22 nt, Human
aacagcugucugccuaucucug

SEQ ID NO: 263140 - RNA, 22 nt, Human
uaggguccaagccuuauaauua

SEQ ID NO: 263141 - RNA, 22 nt, Human
gcucucuuuuuccagugguggu

SEQ ID NO: 263142 - RNA, 22 nt, Human
cagggcuggcuuccaaguuguu

SEQ ID NO: 263143 - RNA, 22 nt, Human
gagaggagucccuaucacaguu

SEQ ID NO: 263144 - RNA, 22 nt, Human
agguggucuuaaacugcucugg

SEQ ID NO: 263145 - RNA, 22 nt, Human
accaggcaacugugaaugggcu

SEQ ID NO: 263146 - RNA, 22 nt, Human
uacaugugaucagaaagugaaa

SEQ ID NO: 263147 - RNA, 22 nt, Human
gcagccucaaacuccccagcuc

SEQ ID NO: 263148 - RNA, 22 nt, Human
gccuuuauuguuuauucagugc

SEQ ID NO: 263149 - RNA, 19 nt, Human
uggcuaauuuuauagaggc

SEQ ID NO: 263150 - RNA, 22 nt, Human
ucaguguuuguggcaaauguua

SEQ ID NO: 263151 - RNA, 19 nt, Human
gugcuccagggcaaggagu

SEQ ID NO: 263152 - RNA, 22 nt, Human
aaacagaaggguagguaaacau

SEQ ID NO: 263153 - RNA, 22 nt, Human
gaguuucuccagugcuaguugu

SEQ ID NO: 263154 - RNA, 22 nt, Human
ugcugccaucucaacugcccuu

SEQ ID NO: 263155 - RNA, 22 nt, Human
ccuggagcaaaaaucuaaggag

SEQ ID NO: 263156 - RNA, 22 nt, Human
agagcccucuucacugccccuu

SEQ ID NO: 263157 - RNA, 22 nt, Human
ccaaguguuuuauaagggacag

SEQ ID NO: 263158 - RNA, 22 nt, Human
auauucuauaagcaguuggaag

SEQ ID NO: 263159 - RNA, 22 nt, Human
ucacaucuuaguuugggacucu

SEQ ID NO: 263160 - RNA, 22 nt, Human
aaaguauucaaaaauauuuggu

SEQ ID NO: 263161 - RNA, 22 nt, Human
auccaugaucaauuuauuacua

SEQ ID NO: 263162 - RNA, 22 nt, Human
acacuaguauuucuauaaguga

SEQ ID NO: 263163 - RNA, 22 nt, Human
ucccagccacaguuuccaccug

SEQ ID NO: 263164 - RNA, 22 nt, Human
cuguuauuucugaaugccaucc

SEQ ID NO: 263165 - RNA, 22 nt, Human
ccugcugugaaacuggcauaug

SEQ ID NO: 263166 - RNA, 22 nt, Human
caguagcaggcacucagcacgu

SEQ ID NO: 263167 - RNA, 22 nt, Human
gucucugucacaacuacucauc

SEQ ID NO: 263168 - RNA, 21 nt, Human
uggguggaagcgggaggccgc

SEQ ID NO: 263169 - RNA, 22 nt, Human
aaaauguaaagcuugaguguag

SEQ ID NO: 263170 - RNA, 22 nt, Human
caaauguguaaggaaguguuag

SEQ ID NO: 263171 - RNA, 19 nt, Human
gucccuucacuccugcugg

SEQ ID NO: 263172 - RNA, 22 nt, Human
uugauucauuuauugagugccu

SEQ ID NO: 263173 - RNA, 22 nt, Human
ugccuuggauugcagggaaccu

SEQ ID NO: 263174 - RNA, 22 nt, Human
uuacagagccucauuuuagaga

SEQ ID NO: 263175 - RNA, 22 nt, Human
cucccucagaggagcaccuguu

SEQ ID NO: 263176 - RNA, 20 nt, Human
ggcauccuuuuggucacagc

SEQ ID NO: 263177 - RNA, 22 nt, Human
cuccccaagccuuggcuucucc

SEQ ID NO: 263178 - RNA, 22 nt, Human
ccaaauaauauuucagaaccau

SEQ ID NO: 263179 - RNA, 22 nt, Human
cccaaguuaauuuguagcugaa

SEQ ID NO: 263180 - RNA, 22 nt, Human
gcucagagaagcgguuucgccu

SEQ ID NO: 263181 - RNA, 22 nt, Human
acaagcuguggugggacaagag

SEQ ID NO: 263182 - RNA, 23 nt, Human
aaauuauugcucuucaauugccu

SEQ ID NO: 263183 - RNA, 23 nt, Human
accuacauuauagggauaugggu

SEQ ID NO: 263184 - RNA, 22 nt, Human
auuuagaaccccuuccaaccug

SEQ ID NO: 263185 - RNA, 22 nt, Human
cuuagaaugucuacucuuacca

SEQ ID NO: 263186 - RNA, 23 nt, Human
cacaggcugcgcauaagcuucuc

SEQ ID NO: 263187 - RNA, 22 nt, Human
gaggcugcccaacuggagugga

SEQ ID NO: 263188 - RNA, 22 nt, Human
cauuuuccucugcugguguuca

SEQ ID NO: 263189 - RNA, 22 nt, Human
gggcagguauuuaucuucuauu

SEQ ID NO: 263190 - RNA, 22 nt, Human
uccugaggcucacuuugaaugu

SEQ ID NO: 263191 - RNA, 22 nt, Human
acuggcugaucaccugccucag

SEQ ID NO: 263192 - RNA, 19 nt, Human
ggggagaacuagagacagc

SEQ ID NO: 263193 - RNA, 22 nt, Human
ccuacauucucugaguuuuccu

SEQ ID NO: 263194 - RNA, 22 nt, Human
gucaacaaagaaaauuguuaau

SEQ ID NO: 263195 - RNA, 22 nt, Human
uggaggucugcaaggcgcugga

SEQ ID NO: 263196 - RNA, 22 nt, Human
caggguggaagcuguagagugg

SEQ ID NO: 263197 - RNA, 22 nt, Human
uggcaaagacugcaaggacuuu

SEQ ID NO: 263198 - RNA, 22 nt, Human
uagaaacaaagaccugggugcu

SEQ ID NO: 263199 - RNA, 22 nt, Human
uuggcuucuucgcacagcagua

SEQ ID NO: 263200 - RNA, 22 nt, Human
uggggccagggaggaccagaca

SEQ ID NO: 263201 - RNA, 22 nt, Human
gggacgagaucuuggcagugug

SEQ ID NO: 263202 - RNA, 22 nt, Human
agcuccagauuaauuguaggag

SEQ ID NO: 263203 - RNA, 22 nt, Human
guaagccugagaaacaccaccu

SEQ ID NO: 263204 - RNA, 22 nt, Human
cagaggcacagugcgggccacu

SEQ ID NO: 263205 - RNA, 22 nt, Human
gaaggcugcgaggggagugccg

SEQ ID NO: 263206 - RNA, 22 nt, Human
cagugcagcugccccgcuggua

SEQ ID NO: 263207 - RNA, 22 nt, Human
ugguaagaacccaucagagaag

SEQ ID NO: 263208 - RNA, 22 nt, Human
aaacauugagcacuugcuauuu

SEQ ID NO: 263209 - RNA, 19 nt, Human
uuugggaagcccagagugu

SEQ ID NO: 263210 - RNA, 22 nt, Human
guggaaggaauuaacagacuag

SEQ ID NO: 263211 - RNA, 22 nt, Human
ugggaacaacaugcacugccac

SEQ ID NO: 263212 - RNA, 22 nt, Human
gaaaguuugccucucucuugag

SEQ ID NO: 263213 - RNA, 22 nt, Human
ccugggagggcaagugcugaug

SEQ ID NO: 263214 - RNA, 20 nt, Human
uaacaguaagugauguuaca

SEQ ID NO: 263215 - RNA, 22 nt, Human
ggccugagaaccauggggccaa

SEQ ID NO: 263216 - RNA, 22 nt, Human
agugggcugagcuugcugggug

SEQ ID NO: 263217 - RNA, 22 nt, Human
aucuguaauuuugaaugcaaau

SEQ ID NO: 263218 - RNA, 22 nt, Human
uucccagacuccacacugaggc

SEQ ID NO: 263219 - RNA, 22 nt, Human
agcccuggagcaaaggugucuu

SEQ ID NO: 263220 - RNA, 22 nt, Human
gagugcuggggugcagagaggu

SEQ ID NO: 263221 - RNA, 22 nt, Human
uccaggccugacuauaaaugua

SEQ ID NO: 263222 - RNA, 21 nt, Human
ucuggcaguggucuuucaaau

SEQ ID NO: 263223 - RNA, 22 nt, Human
uucugagagugccagaaguucu

SEQ ID NO: 263224 - RNA, 22 nt, Human
gcacaaaagguacuucauguag

SEQ ID NO: 263225 - RNA, 22 nt, Human
acaagauugauaagucugcccu

SEQ ID NO: 263226 - RNA, 22 nt, Human
gccaaaucacagggccaaaagc

SEQ ID NO: 263227 - RNA, 22 nt, Human
auugcaaaauuguccuguggaa

SEQ ID NO: 263228 - RNA, 22 nt, Human
caacacauugaagcuaugauga

SEQ ID NO: 263229 - RNA, 22 nt, Human
uucagugugccuaagucaguug

SEQ ID NO: 263230 - RNA, 22 nt, Human
uggagcuggcagcggaaaaggg

SEQ ID NO: 263231 - RNA, 19 nt, Human
agaaaaacugguacugcug

SEQ ID NO: 263232 - RNA, 22 nt, Human
ucguacagcagacugaaguccu

SEQ ID NO: 263233 - RNA, 22 nt, Human
aaguuacaguuaggggugauga

SEQ ID NO: 263234 - RNA, 22 nt, Human
acaaucuuauuaguaguauaga

SEQ ID NO: 263235 - RNA, 22 nt, Human
ucgcugugaaaaccuuggacaa

SEQ ID NO: 263236 - RNA, 22 nt, Human
ggcugggaggaugacuugcuac

SEQ ID NO: 263237 - RNA, 22 nt, Human
ucccugaggaagggguguggug

SEQ ID NO: 263238 - RNA, 22 nt, Human
aacagcauaccaauguacauau

SEQ ID NO: 263239 - RNA, 20 nt, Human
aacugccugcccagaggugg

SEQ ID NO: 263240 - RNA, 22 nt, Human
agaggcaggagguugacuugag

SEQ ID NO: 263241 - RNA, 22 nt, Human
gggcacauguaaagcuggagaa

SEQ ID NO: 263242 - RNA, 22 nt, Human
guguaauuauauaaagaucuac

SEQ ID NO: 263243 - RNA, 20 nt, Human
uugcaaauaucuauugauug

SEQ ID NO: 263244 - RNA, 22 nt, Human
uguuaaauguuccuuuacugga

SEQ ID NO: 263245 - RNA, 22 nt, Human
gagcugaagaugucagaaccgu

SEQ ID NO: 263246 - RNA, 17 nt, Human
ccuggcugggaaucuga

SEQ ID NO: 263247 - RNA, 22 nt, Human
uuccugugauauuagccacugu

SEQ ID NO: 263248 - RNA, 22 nt, Human
gcaccuggacagugacccuagc

SEQ ID NO: 263249 - RNA, 22 nt, Human
agcacagacuggucccaggucu

SEQ ID NO: 263250 - RNA, 22 nt, Human
agagcucaagacgcucacagua

SEQ ID NO: 263251 - RNA, 22 nt, Human
gcugcccugacaagcuacuccc

SEQ ID NO: 263252 - RNA, 22 nt, Human
acaguuaaauauuucuacuggg

SEQ ID NO: 263253 - RNA, 22 nt, Human
uuuggcucaucucaguccuagg

SEQ ID NO: 263254 - RNA, 22 nt, Human
cuggcccucggaguccagcugc

SEQ ID NO: 263255 - RNA, 22 nt, Human
ccagccagucccgcaugaccgc

SEQ ID NO: 263256 - RNA, 22 nt, Human
ugggccucaugcccagccaccc

SEQ ID NO: 263257 - RNA, 22 nt, Human
agcagcagcucaguucucagcu

SEQ ID NO: 263258 - RNA, 22 nt, Human
uugucaagaaaaauggaugaag

SEQ ID NO: 263259 - RNA, 22 nt, Human
agagcacaggcucaccauuguu

SEQ ID NO: 263260 - RNA, 22 nt, Human
uuacuucuugucucaugccuau

SEQ ID NO: 263261 - RNA, 22 nt, Human
gcugaggccucagaaggcugag

SEQ ID NO: 263262 - RNA, 22 nt, Human
ugaccccacugugcucagaggu

SEQ ID NO: 263263 - RNA, 22 nt, Human
uacauuaaggauauggacauga

SEQ ID NO: 263264 - RNA, 22 nt, Human
cccaggcugcaugaguccaugg

SEQ ID NO: 263265 - RNA, 22 nt, Human
ugggguggauagaaagugaugu

SEQ ID NO: 263266 - RNA, 22 nt, Human
uaucagcaacucagagcagucu

SEQ ID NO: 263267 - RNA, 22 nt, Human
aauacuugugaauucaaagucu

SEQ ID NO: 263268 - RNA, 22 nt, Human
uccccagacagcgggaggccug

SEQ ID NO: 263269 - RNA, 22 nt, Human
uagagcuugauuggauucaggg

SEQ ID NO: 263270 - RNA, 22 nt, Human
aguuuacaucuucaaucucauu

SEQ ID NO: 263271 - RNA, 22 nt, Human
ucagggauugcaaaauucaucc

SEQ ID NO: 263272 - RNA, 22 nt, Human
cugggcccacaaguggaaucgu

SEQ ID NO: 263273 - RNA, 22 nt, Human
ugccaggccucaggagucucca

SEQ ID NO: 263274 - RNA, 22 nt, Human
auucugcacuuccuuugcuucc

SEQ ID NO: 263275 - RNA, 23 nt, Human
uuucaacaaugcuuagagaaaac

SEQ ID NO: 263276 - RNA, 22 nt, Human
uuguuucaggaugguuuguuac

SEQ ID NO: 263277 - RNA, 22 nt, Human
uaugacuuuggaaaaauuacuu

SEQ ID NO: 263278 - RNA, 22 nt, Human
ucagaggacuaccuucuccagu

SEQ ID NO: 263279 - RNA, 22 nt, Human
gcaguaugaguguuuuagacau

SEQ ID NO: 263280 - RNA, 22 nt, Human
auacacuugaccuggagugaag

SEQ ID NO: 263281 - RNA, 16 nt, Human
uagggcugggaaggag

SEQ ID NO: 263282 - RNA, 22 nt, Human
uaggaaauugacaccugcuuga

SEQ ID NO: 263283 - RNA, 21 nt, Human
uuucagaccuaucuuugaagg

SEQ ID NO: 263284 - RNA, 22 nt, Human
ucuccccagggguauggguauu

SEQ ID NO: 263285 - RNA, 22 nt, Human
ggcacagcaccuuuucacauug

SEQ ID NO: 263286 - RNA, 22 nt, Human
ugaggcugagauaucagggagg

SEQ ID NO: 263287 - RNA, 22 nt, Human
caggacaguauaggcuuuagga

SEQ ID NO: 263288 - RNA, 20 nt, Human
uccagcccagcagccugaca

SEQ ID NO: 263289 - RNA, 22 nt, Human
aaaggcuauugcugauaauguu

SEQ ID NO: 263290 - RNA, 22 nt, Human
agaaguaugugagaaauuaucc

SEQ ID NO: 263291 - RNA, 22 nt, Human
ugcuccuucccuucccagugag

SEQ ID NO: 263292 - RNA, 22 nt, Human
ucccagcacgucugcuguuucu

SEQ ID NO: 263293 - RNA, 22 nt, Human
ucugaggacagugcugugccug

SEQ ID NO: 263294 - RNA, 22 nt, Human
gacccuguuucuacaaauaauu

SEQ ID NO: 263295 - RNA, 22 nt, Human
ccuccagguguuacauaugacu

SEQ ID NO: 263296 - RNA, 19 nt, Human
ugaggccaaggucacagau

SEQ ID NO: 263297 - RNA, 22 nt, Human
uugagaagguggucauuugcaa

SEQ ID NO: 263298 - RNA, 22 nt, Human
ccaauacacuuuauagaagaaa

SEQ ID NO: 263299 - RNA, 20 nt, Human
agggucugaugugguggccc

SEQ ID NO: 263300 - RNA, 22 nt, Human
gucucuguggcuggcuccuucc

SEQ ID NO: 263301 - RNA, 22 nt, Human
acaugagaggcuguggaguaca

SEQ ID NO: 263302 - RNA, 22 nt, Human
aaaagccaugcauaccuaagag

SEQ ID NO: 263303 - RNA, 22 nt, Human
ucuucagauggccaguuguccc

SEQ ID NO: 263304 - RNA, 22 nt, Human
cccuaggguuuggccagagccc

SEQ ID NO: 263305 - RNA, 22 nt, Human
cugugccacugccccaggccuc

SEQ ID NO: 263306 - RNA, 23 nt, Human
ucuugaaaagccuacagcaguuc

SEQ ID NO: 263307 - RNA, 22 nt, Human
agcugcaacuguccuugccuug

SEQ ID NO: 263308 - RNA, 22 nt, Human
acagggcaugugcaagagacau

SEQ ID NO: 263309 - RNA, 22 nt, Human
aaguuugucgaaauuaucagca

SEQ ID NO: 263310 - RNA, 19 nt, Human
cuggaaggagggacuguuc

SEQ ID NO: 263311 - RNA, 22 nt, Human
aaagcacagggugcuagagagu

SEQ ID NO: 263312 - RNA, 23 nt, Human
acuuuagauaaauuaugugcaca

SEQ ID NO: 263313 - RNA, 22 nt, Human
ugggagaagcagcagccaagug

SEQ ID NO: 263314 - RNA, 22 nt, Human
uuuguucaauccagacaauagc

SEQ ID NO: 263315 - RNA, 22 nt, Human
agagggcuuugauucucaguuc

SEQ ID NO: 263316 - RNA, 22 nt, Human
uauuccucccaguaaguacaac

SEQ ID NO: 263317 - RNA, 22 nt, Human
uaaaggcaguuggaguugagga

SEQ ID NO: 263318 - RNA, 22 nt, Human
gccugccugcugugugcaaguu

SEQ ID NO: 263319 - RNA, 22 nt, Human
ugaggcagguaagcaaguuuug

SEQ ID NO: 263320 - RNA, 22 nt, Human
ucugaaauauugguaauacuuu

SEQ ID NO: 263321 - RNA, 22 nt, Human
aagggcaggugggcauuucugg

SEQ ID NO: 263322 - RNA, 22 nt, Human
aaauauccauaagcacaucuau

SEQ ID NO: 263323 - RNA, 22 nt, Human
ugcaaauauugggacagucuag

SEQ ID NO: 263324 - RNA, 22 nt, Human
gccagccacuucccagacuggc

SEQ ID NO: 263325 - RNA, 22 nt, Human
uggaugguucugggcggcagca

SEQ ID NO: 263326 - RNA, 22 nt, Human
gcucacagucugcugagugcag

SEQ ID NO: 263327 - RNA, 22 nt, Human
gccaggccacucccggguccug

SEQ ID NO: 263328 - RNA, 22 nt, Human
gaauacauccagagcagggcug

SEQ ID NO: 263329 - RNA, 22 nt, Human
aaauuuuccugguaaagaugga

SEQ ID NO: 263330 - RNA, 22 nt, Human
gagcagugccaaagaauuugcg

SEQ ID NO: 263331 - RNA, 22 nt, Human
ugggaaggauacguuacaagau

SEQ ID NO: 263332 - RNA, 22 nt, Human
acagcaauaggaaauacuugca

SEQ ID NO: 263333 - RNA, 22 nt, Human
cuuguuuuggaacagagugaau

SEQ ID NO: 263334 - RNA, 22 nt, Human
auacacgugccauguuggugug

SEQ ID NO: 263335 - RNA, 21 nt, Human
aggcuucuccgugcaggaaga

SEQ ID NO: 263336 - RNA, 22 nt, Human
cuguccacauggagaaccuggu

SEQ ID NO: 263337 - RNA, 22 nt, Human
cuuccagcugauuacaggcuau

SEQ ID NO: 263338 - RNA, 21 nt, Human
uguauaacuucucucccucag

SEQ ID NO: 263339 - RNA, 22 nt, Human
gaacaauagugguaacaaagcc

SEQ ID NO: 263340 - RNA, 22 nt, Human
uugggaucucaaauccagcuau

SEQ ID NO: 263341 - RNA, 22 nt, Human
uagaaauguuagauguauugag

SEQ ID NO: 263342 - RNA, 22 nt, Human
guuuugaauacuacuagaacuu

SEQ ID NO: 263343 - RNA, 20 nt, Human
aagagcuacuuagccuuucc

SEQ ID NO: 263344 - RNA, 22 nt, Human
aggggagaauuucaacucaggu

SEQ ID NO: 263345 - RNA, 22 nt, Human
ugaggacauugagacuggagac

SEQ ID NO: 263346 - RNA, 22 nt, Human
acaguggcaucuacuuaaucug

SEQ ID NO: 263347 - RNA, 19 nt, Human
uccccaagaguucuagcuc

SEQ ID NO: 263348 - RNA, 22 nt, Human
uguuauuuaucugagcauuuau

SEQ ID NO: 263349 - RNA, 21 nt, Human
ugaccagugccccauccuguc

SEQ ID NO: 263350 - RNA, 22 nt, Human
ugucuuuagaaagaagcagaca

SEQ ID NO: 263351 - RNA, 22 nt, Human
aagcacaggggaaauaaguugu

SEQ ID NO: 263352 - RNA, 22 nt, Human
caacuauauagaaauugauugu

SEQ ID NO: 263353 - RNA, 22 nt, Human
caauuucaagauucuguucuuu

SEQ ID NO: 263354 - RNA, 22 nt, Human
ggcuacugugauggucugcaag

SEQ ID NO: 263355 - RNA, 22 nt, Human
uuaauacagaagcaagacacug

SEQ ID NO: 263356 - RNA, 22 nt, Human
guagauuccaguggucuguguc

SEQ ID NO: 263357 - RNA, 23 nt, Human
gaggagggucgugcuguguuccu

SEQ ID NO: 263358 - RNA, 22 nt, Human
acccagggcuuaaggcggugca

SEQ ID NO: 263359 - RNA, 22 nt, Human
acuuucaauucccuuagcaacu

SEQ ID NO: 263360 - RNA, 22 nt, Human
aaaugucuguuagucauaucau

SEQ ID NO: 263361 - RNA, 22 nt, Human
cuauuuugccugccuagaaauc

SEQ ID NO: 263362 - RNA, 22 nt, Human
gaaucuagggccuagaucacag

SEQ ID NO: 263363 - RNA, 22 nt, Human
caggcuggaguacaauugugug

SEQ ID NO: 263364 - RNA, 22 nt, Human
ucucagugacacucuucauaca

SEQ ID NO: 263365 - RNA, 22 nt, Human
ucaggcaggcucagaggaaaac

SEQ ID NO: 263366 - RNA, 22 nt, Human
gaaaugugcagaauguguuaga

SEQ ID NO: 263367 - RNA, 22 nt, Human
uacauucagaauugggaggcaa

SEQ ID NO: 263368 - RNA, 22 nt, Human
gcugcaggcucugcaggaauug

SEQ ID NO: 263369 - RNA, 20 nt, Human
cugcaggguuagaggcucca

SEQ ID NO: 263370 - RNA, 22 nt, Human
gacuuucuuuuaccucaaggau

SEQ ID NO: 263371 - RNA, 23 nt, Human
aaacaagcccuaaugaagagucc

SEQ ID NO: 263372 - RNA, 22 nt, Human
gagugugggggugcugaggaca

SEQ ID NO: 263373 - RNA, 21 nt, Human
ucccacagcgccagcuccugu

SEQ ID NO: 263374 - RNA, 22 nt, Human
uucucagggucuugugcaaggg

SEQ ID NO: 263375 - RNA, 22 nt, Human
ucuggagcaacagagcaggaca

SEQ ID NO: 263376 - RNA, 19 nt, Human
accaggcuuauggucagug

SEQ ID NO: 263377 - RNA, 22 nt, Human
gaacuggucuuuuagguuuucu

SEQ ID NO: 263378 - RNA, 22 nt, Human
acuuuacuacauccacagaugg

SEQ ID NO: 263379 - RNA, 22 nt, Human
ugggccacugcugcggaaggcg

SEQ ID NO: 263380 - RNA, 22 nt, Human
uugagaggcuguugacauucug

SEQ ID NO: 263381 - RNA, 22 nt, Human
uccaguuugcacuguauaauag

SEQ ID NO: 263382 - RNA, 22 nt, Human
ucugagugauguugagucagaa

SEQ ID NO: 263383 - RNA, 22 nt, Human
ucacagagaacuauaauccauc

SEQ ID NO: 263384 - RNA, 22 nt, Human
ugaggauggcagugugcucagc

SEQ ID NO: 263385 - RNA, 22 nt, Human
cuggcaggucucgcugacgugu

SEQ ID NO: 263386 - RNA, 22 nt, Human
cucugugguuagacuauggcug

SEQ ID NO: 263387 - RNA, 22 nt, Human
uacagaggaggggauuuuaaua

SEQ ID NO: 263388 - RNA, 22 nt, Human
gcuguucuguccccauggguaa

SEQ ID NO: 263389 - RNA, 22 nt, Human
ggcugguggggaaagaggacca

SEQ ID NO: 263390 - RNA, 22 nt, Human
acacaggaagucagcacugaug

SEQ ID NO: 263391 - RNA, 22 nt, Human
gcaggggcuaaggacacagaga

SEQ ID NO: 263392 - RNA, 22 nt, Human
gcauuagauuugccuuugaagc

SEQ ID NO: 263393 - RNA, 22 nt, Human
acaggggugcauggugcauggu

SEQ ID NO: 263394 - RNA, 22 nt, Human
cuggccagccugucgaugcccu

SEQ ID NO: 263395 - RNA, 22 nt, Human
caagauuuagcucccuuaucuc

SEQ ID NO: 263396 - RNA, 22 nt, Human
cagagcuguuacuauucaugaa

SEQ ID NO: 263397 - RNA, 22 nt, Human
cuccuggaugcaggcugucugc

SEQ ID NO: 263398 - RNA, 22 nt, Human
uuuaggauauuaauguucagag

SEQ ID NO: 263399 - RNA, 22 nt, Human
auuuacauuuauuugagaaggu

SEQ ID NO: 263400 - RNA, 22 nt, Human
aauuagaguggcgagugauuua

SEQ ID NO: 263401 - RNA, 22 nt, Human
cugcaggguuuuaacaauggac

SEQ ID NO: 263402 - RNA, 22 nt, Human
cucuccagggcaugaguuccac

SEQ ID NO: 263403 - RNA, 22 nt, Human
aucacauugccagugauuaccc

SEQ ID NO: 263404 - RNA, 22 nt, Human
uggcccagcaguucugccccag

SEQ ID NO: 263405 - RNA, 21 nt, Human
auuuucauuuccaggggagga

SEQ ID NO: 263406 - RNA, 17 nt, Human
cagcucugcaucuuccu

SEQ ID NO: 263407 - RNA, 22 nt, Human
gaggaagcauugacauaaucuc

SEQ ID NO: 263408 - RNA, 23 nt, Human
uggaauguuucuuguacugaaug

SEQ ID NO: 263409 - RNA, 22 nt, Human
auuucuuucuggccacgguuuu

SEQ ID NO: 263410 - RNA, 22 nt, Human
ccucuuccugcacugacauuuu

SEQ ID NO: 263411 - RNA, 22 nt, Human
cagcagcaaggugaggguggag

SEQ ID NO: 263412 - RNA, 22 nt, Human
ccuccccacccacggcuggugg

SEQ ID NO: 263413 - RNA, 23 nt, Human
agcugaggcagaggggcauucuc

SEQ ID NO: 263414 - RNA, 23 nt, Human
aggcuggcuucaggagccucucc

SEQ ID NO: 263415 - RNA, 22 nt, Human
aagauacacguuguauugaaua

SEQ ID NO: 263416 - RNA, 22 nt, Human
cccagagagcacaggugguggg

SEQ ID NO: 263417 - RNA, 22 nt, Human
agccagacucauuuggaaguau

SEQ ID NO: 263418 - RNA, 22 nt, Human
agggucuguggaugcaucuggg

SEQ ID NO: 263419 - RNA, 22 nt, Human
uaaaucuuguggcaaugcuucu

SEQ ID NO: 263420 - RNA, 22 nt, Human
ccaggcuagagugcaauggcgc

SEQ ID NO: 263421 - RNA, 22 nt, Human
caguuucuccaaacgcaggcug

SEQ ID NO: 263422 - RNA, 22 nt, Human
uuauucaccauuuauuauguga

SEQ ID NO: 263423 - RNA, 22 nt, Human
agcugaaagcuugacuggggcu

SEQ ID NO: 263424 - RNA, 22 nt, Human
aaaaugcaugagaaugugcucg

SEQ ID NO: 263425 - RNA, 22 nt, Human
uguccaggaauugacccugcaa

SEQ ID NO: 263426 - RNA, 22 nt, Human
acaggaacgaauguacauuguu

SEQ ID NO: 263427 - RNA, 20 nt, Human
ucaguuaaguugcugaaucu

SEQ ID NO: 263428 - RNA, 22 nt, Human
uuucacaaaugucuuuaacuug

SEQ ID NO: 263429 - RNA, 22 nt, Human
aaaagcaaggcagucugucuga

SEQ ID NO: 263430 - RNA, 22 nt, Human
ggauguucugggguucucuugu

SEQ ID NO: 263431 - RNA, 22 nt, Human
uuagggacagcucuguagguga

SEQ ID NO: 263432 - RNA, 22 nt, Human
uucagaaguagcuaagcaguca

SEQ ID NO: 263433 - RNA, 22 nt, Human
cacacaugguagcagguacaag

SEQ ID NO: 263434 - RNA, 19 nt, Human
cacaucagcagggcugugg

SEQ ID NO: 263435 - RNA, 22 nt, Human
agcuccugcgcacggugcacac

SEQ ID NO: 263436 - RNA, 22 nt, Human
caugaaugaguaauuuacaaag

SEQ ID NO: 263437 - RNA, 19 nt, Human
aggcagcacccaguccuug

SEQ ID NO: 263438 - RNA, 22 nt, Human
uuacaggugggaaaacuaagcu

SEQ ID NO: 263439 - RNA, 22 nt, Human
ugaggcucagaagugccaagug

SEQ ID NO: 263440 - RNA, 22 nt, Human
caggcugggcuccggagauaaa

SEQ ID NO: 263441 - RNA, 22 nt, Human
ugggcugccggcaggcucugcc

SEQ ID NO: 263442 - RNA, 22 nt, Human
aggcaggcucaaugcccagucu

SEQ ID NO: 263443 - RNA, 22 nt, Human
auguuuuaaauauguguguaaa

SEQ ID NO: 263444 - RNA, 22 nt, Human
auuagauauuugcuguuggauu

SEQ ID NO: 263445 - RNA, 22 nt, Human
uacaaagauaguguuagaguaa

SEQ ID NO: 263446 - RNA, 22 nt, Human
uagcaagaucgugucucuaaaa

SEQ ID NO: 263447 - RNA, 22 nt, Human
gugcagcaaaguuugagauaua

SEQ ID NO: 263448 - RNA, 22 nt, Human
uauauccauaggcugugccuag

SEQ ID NO: 263449 - RNA, 22 nt, Human
cuugggucuguccugcugugca

SEQ ID NO: 263450 - RNA, 22 nt, Human
gucccagggagguucagggcuu

SEQ ID NO: 263451 - RNA, 22 nt, Human
gcagcaggcuuuucauaccuug

SEQ ID NO: 263452 - RNA, 22 nt, Human
ccucccucccucuuaugguuua

SEQ ID NO: 263453 - RNA, 22 nt, Human
uggcaaauauuuuguuuuguaa

SEQ ID NO: 263454 - RNA, 22 nt, Human
agagccaguuaagcacuuacag

SEQ ID NO: 263455 - RNA, 22 nt, Human
uucacaguuuaauggcaaggau

SEQ ID NO: 263456 - RNA, 22 nt, Human
aggcaaggugcucuugcucuau

SEQ ID NO: 263457 - RNA, 22 nt, Human
aaagacaugacacauuggagag

SEQ ID NO: 263458 - RNA, 22 nt, Human
agaaagcuccccaugagaugau

SEQ ID NO: 263459 - RNA, 22 nt, Human
ugguggggcuuuccuucugcuu

SEQ ID NO: 263460 - RNA, 22 nt, Human
ucagauggauuuauacuauuuc

SEQ ID NO: 263461 - RNA, 18 nt, Human
agagaaagaccaaagcau

SEQ ID NO: 263462 - RNA, 23 nt, Human
uaaugagaagcuuuguuuccuga

SEQ ID NO: 263463 - RNA, 22 nt, Human
agaaggcagaaaguccagguau

SEQ ID NO: 263464 - RNA, 22 nt, Human
aggcugaggcagguggaucacu

SEQ ID NO: 263465 - RNA, 18 nt, Human
ugucucaguucugcuaug

SEQ ID NO: 263466 - RNA, 22 nt, Human
aagcccuccguacgugcuagcu

SEQ ID NO: 263467 - RNA, 22 nt, Human
caggagucucucuugagcccag

SEQ ID NO: 263468 - RNA, 18 nt, Human
cuggcauucuucccugga

SEQ ID NO: 263469 - RNA, 22 nt, Human
ugggcuaauucuuugauuguuu

SEQ ID NO: 263470 - RNA, 22 nt, Human
uucauauaccuugcguuucaca

SEQ ID NO: 263471 - RNA, 22 nt, Human
agagcuaagaaacagaauugcu

SEQ ID NO: 263472 - RNA, 22 nt, Human
ugcucagcacagaccaggccag

SEQ ID NO: 263473 - RNA, 20 nt, Human
aggagaccaagccaagugga

SEQ ID NO: 263474 - RNA, 22 nt, Human
ucagggaacuacuucucccuau

SEQ ID NO: 263475 - RNA, 22 nt, Human
uuuaagagccuguacaaauauu

SEQ ID NO: 263476 - RNA, 22 nt, Human
uucuuuaucaguuacucauagg

SEQ ID NO: 263477 - RNA, 22 nt, Human
ggguucccugccuggccacucu

SEQ ID NO: 263478 - RNA, 22 nt, Human
ggccucugguucguggugaccu

SEQ ID NO: 263479 - RNA, 23 nt, Human
uuccugagugcuggagagagugc

SEQ ID NO: 263480 - RNA, 22 nt, Human
ugccauuuauaaccaguggccu

SEQ ID NO: 263481 - RNA, 22 nt, Human
caaacuuuuccuggaaaagauu

SEQ ID NO: 263482 - RNA, 22 nt, Human
cacauucaucaguguuguacug

SEQ ID NO: 263483 - RNA, 20 nt, Human
ucagagaaggagcuuuccug

SEQ ID NO: 263484 - RNA, 22 nt, Human
ggacaggugugaggcuggcaca

SEQ ID NO: 263485 - RNA, 22 nt, Human
uguuacagggauaaaugaggua

SEQ ID NO: 263486 - RNA, 22 nt, Human
gucaggcauuuaggaugaguuc

SEQ ID NO: 263487 - RNA, 21 nt, Human
ugugugcauaugcauguacau

SEQ ID NO: 263488 - RNA, 22 nt, Human
aagacacaauguagcccagcac

SEQ ID NO: 263489 - RNA, 22 nt, Human
cuucagugaauguugaguaagg

SEQ ID NO: 263490 - RNA, 22 nt, Human
agagcagaggcauggccguggg

SEQ ID NO: 263491 - RNA, 22 nt, Human
ucccagauucuucugugugggc

SEQ ID NO: 263492 - RNA, 22 nt, Human
ugggaaaguguagccugcaggc

SEQ ID NO: 263493 - RNA, 22 nt, Human
cucagccugugaagagcagagg

SEQ ID NO: 263494 - RNA, 22 nt, Human
ugggagauaaagcaucuguucu

SEQ ID NO: 263495 - RNA, 22 nt, Human
auuuauuccugauuccuggcuu

SEQ ID NO: 263496 - RNA, 22 nt, Human
uucaggaauauaggcauugaca

SEQ ID NO: 263497 - RNA, 22 nt, Human
cucuguagccauggguauauuc

SEQ ID NO: 263498 - RNA, 22 nt, Human
acaaaggugcgucccuucagcu

SEQ ID NO: 263499 - RNA, 22 nt, Human
gcuguagguaaggauggcaaag

SEQ ID NO: 263500 - RNA, 22 nt, Human
gcuggcuuccuucugcagcuag

SEQ ID NO: 263501 - RNA, 22 nt, Human
ucucagugcuauccauauucca

SEQ ID NO: 263502 - RNA, 15 nt, Human
ggcagguggaucacu

SEQ ID NO: 263503 - RNA, 22 nt, Human
aaaaccacaaugacuuuugcag

SEQ ID NO: 263504 - RNA, 22 nt, Human
agcaggugagcacagccaggcu

SEQ ID NO: 263505 - RNA, 22 nt, Human
uuucaaauagaaucuuuccaaa

SEQ ID NO: 263506 - RNA, 22 nt, Human
gaggagcugggacccugucauc

SEQ ID NO: 263507 - RNA, 22 nt, Human
gugcucaggggcaauccuggga

SEQ ID NO: 263508 - RNA, 22 nt, Human
uuucuucuugaguaaccagauu

SEQ ID NO: 263509 - RNA, 22 nt, Human
gccacaggcuccagcaucagua

SEQ ID NO: 263510 - RNA, 22 nt, Human
gagagccuuugaagggaaguga

SEQ ID NO: 263511 - RNA, 22 nt, Human
aaggaggaauguagccagcucc

SEQ ID NO: 263512 - RNA, 22 nt, Human
agugucugccugggaggagcau

SEQ ID NO: 263513 - RNA, 22 nt, Human
uggaaacucagggccagaagga

SEQ ID NO: 263514 - RNA, 22 nt, Human
gaucuuuauacuguaauaauga

SEQ ID NO: 263515 - RNA, 22 nt, Human
auucacacauacucauguguga

SEQ ID NO: 263516 - RNA, 22 nt, Human
auguuucuaguuguaugucacu

SEQ ID NO: 263517 - RNA, 22 nt, Human
cccaggcugcguauccacaaua

SEQ ID NO: 263518 - RNA, 22 nt, Human
uucagaaacagagugagugagu

SEQ ID NO: 263519 - RNA, 22 nt, Human
auaauaacaaugccagaugccu

SEQ ID NO: 263520 - RNA, 22 nt, Human
caggguggggcuggcuaucaaa

SEQ ID NO: 263521 - RNA, 22 nt, Human
aaauaucuuaggaguauaugag

SEQ ID NO: 263522 - RNA, 22 nt, Human
acccaggcuggcagaggcuccu

SEQ ID NO: 263523 - RNA, 22 nt, Human
cuccccuuccgccagcucuuga

SEQ ID NO: 263524 - RNA, 22 nt, Human
gaaggcuugcaagugguucaua

SEQ ID NO: 263525 - RNA, 22 nt, Human
ccugggugaaauaguccucaag

SEQ ID NO: 263526 - RNA, 22 nt, Human
ggagaggggaacuuguugcuug

SEQ ID NO: 263527 - RNA, 20 nt, Human
ucuccuggucugguccgugc

SEQ ID NO: 263528 - RNA, 22 nt, Human
agucacaguuccuacccaguaa

SEQ ID NO: 263529 - RNA, 22 nt, Human
cuggccagagguuccucugccc

SEQ ID NO: 263530 - RNA, 22 nt, Human
ucaugcagagccagucaggaua

SEQ ID NO: 263531 - RNA, 22 nt, Human
gggaaggguguugucuuaucuu

SEQ ID NO: 263532 - RNA, 22 nt, Human
ucagauggaaugaugccacugc

SEQ ID NO: 263533 - RNA, 22 nt, Human
uuauuuauguuaacagucgaga

SEQ ID NO: 263534 - RNA, 22 nt, Human
gcagauggaucaccugaggucg

SEQ ID NO: 263535 - RNA, 22 nt, Human
ccacauucucauguaauccuuu

SEQ ID NO: 263536 - RNA, 22 nt, Human
agauuuguugugagcaggaaua

SEQ ID NO: 263537 - RNA, 22 nt, Human
uuuuggaauuuauacaguaaug

SEQ ID NO: 263538 - RNA, 22 nt, Human
cugcugucgccgagcugcaugc

SEQ ID NO: 263539 - RNA, 22 nt, Human
aggccacauagcuugcauguag

SEQ ID NO: 263540 - RNA, 22 nt, Human
gaaaacauccagagauagaccu

SEQ ID NO: 263541 - RNA, 22 nt, Human
agaguacugccucaguuaugaa

SEQ ID NO: 263542 - RNA, 22 nt, Human
auguaggauugagugauagagg

SEQ ID NO: 263543 - RNA, 18 nt, Human
gcuggcugcacuucugcu

SEQ ID NO: 263544 - RNA, 22 nt, Human
uggcagugguaccggcucucag

SEQ ID NO: 263545 - RNA, 22 nt, Human
aggcuguguggucaugguggcu

SEQ ID NO: 263546 - RNA, 22 nt, Human
ugugggcuguacugagggcagg

SEQ ID NO: 263547 - RNA, 22 nt, Human
auugaaaaauucacaauucugg

SEQ ID NO: 263548 - RNA, 22 nt, Human
acaggcagugggccagauuugu

SEQ ID NO: 263549 - RNA, 22 nt, Human
cugucccucaucaccucugggu

SEQ ID NO: 263550 - RNA, 22 nt, Human
cugcugcugagagcucagccug

SEQ ID NO: 263551 - RNA, 22 nt, Human
aauguuauuucugcauaguagu

SEQ ID NO: 263552 - RNA, 21 nt, Human
auguuuacacugacuacugug

SEQ ID NO: 263553 - RNA, 22 nt, Human
agucuuaguaugguuuuagguu

SEQ ID NO: 263554 - RNA, 22 nt, Human
auuugguuacucaguugucuga

SEQ ID NO: 263555 - RNA, 22 nt, Human
acaauacuuaccaauguuuuug

SEQ ID NO: 263556 - RNA, 22 nt, Human
uugauucacaauuaccaagacu

SEQ ID NO: 263557 - RNA, 22 nt, Human
agcaacauugagacugcaguug

SEQ ID NO: 263558 - RNA, 22 nt, Human
gcucuggaagcaucugagagga

SEQ ID NO: 263559 - RNA, 22 nt, Human
uccugaggcuaaagugcagugg

SEQ ID NO: 263560 - RNA, 22 nt, Human
ccagaaucccauugucacuuca

SEQ ID NO: 263561 - RNA, 22 nt, Human
ucugagcccagugagucucgca

SEQ ID NO: 263562 - RNA, 22 nt, Human
ucaagagcauguaucucccuaa

SEQ ID NO: 263563 - RNA, 22 nt, Human
aaacaggcgcuuacuaagaaaa

SEQ ID NO: 263564 - RNA, 21 nt, Human
cucauuuauuuuuguguccaa

SEQ ID NO: 263565 - RNA, 22 nt, Human
ucagggaacaauguuauggcuu

SEQ ID NO: 263566 - RNA, 22 nt, Human
uuacauucagaaagauuugagu

SEQ ID NO: 263567 - RNA, 22 nt, Human
auguuuaaucggcugccuuucc

SEQ ID NO: 263568 - RNA, 22 nt, Human
agggcugagacuaaggccagau

SEQ ID NO: 263569 - RNA, 22 nt, Human
ugauuucuuccuugucauuaga

SEQ ID NO: 263570 - RNA, 22 nt, Human
ccuggcucagaguaugucaucg

SEQ ID NO: 263571 - RNA, 22 nt, Human
uuuagcuuuugugucagauaag

SEQ ID NO: 263572 - RNA, 22 nt, Human
cacaguuucaauaauuauucuu

SEQ ID NO: 263573 - RNA, 22 nt, Human
gcacaguagguauuuacccagu

SEQ ID NO: 263574 - RNA, 22 nt, Human
cauuugcaaaccaacaagauga

SEQ ID NO: 263575 - RNA, 22 nt, Human
aacauugcauucucuaugagau

SEQ ID NO: 263576 - RNA, 22 nt, Human
gaguagcagccacagaggaccc

SEQ ID NO: 263577 - RNA, 22 nt, Human
caaggccacguucugcaugcgg

SEQ ID NO: 263578 - RNA, 22 nt, Human
aucucagaaaguuuaauuuuuc

SEQ ID NO: 263579 - RNA, 21 nt, Human
agauccagugccauaaggccc

SEQ ID NO: 263580 - RNA, 22 nt, Human
gaggagaagcuaagaaacacag

SEQ ID NO: 263581 - RNA, 22 nt, Human
uuaauuaugagaaagggaaaag

SEQ ID NO: 263582 - RNA, 22 nt, Human
uuuacauuucccucugucaguu

SEQ ID NO: 263583 - RNA, 17 nt, Human
uccuguuuaucauugau

SEQ ID NO: 263584 - RNA, 21 nt, Human
ucuggagcccuaagcugagaa

SEQ ID NO: 263585 - RNA, 22 nt, Human
ucugggucuggcugcuggugca

SEQ ID NO: 263586 - RNA, 22 nt, Human
aaacuuuuccugcucuuguccu

SEQ ID NO: 263587 - RNA, 22 nt, Human
aaagcagagguugcagugagcu

SEQ ID NO: 263588 - RNA, 22 nt, Human
aggagggcuaggaaaaccagga

SEQ ID NO: 263589 - RNA, 22 nt, Human
uccaagucuuccuucccaaacc

SEQ ID NO: 263590 - RNA, 22 nt, Human
guauauaugugugaacauguau

SEQ ID NO: 263591 - RNA, 22 nt, Human
uacacaucucugucaguaguga

SEQ ID NO: 263592 - RNA, 22 nt, Human
ucuggagggguuuagagggaca

SEQ ID NO: 263593 - RNA, 22 nt, Human
ucaggaaagccuagaagagaac

SEQ ID NO: 263594 - RNA, 22 nt, Human
cugguuuugucagaagcuuuau

SEQ ID NO: 263595 - RNA, 20 nt, Human
ugaaagcaugugguauuugg

SEQ ID NO: 263596 - RNA, 22 nt, Human
agauggucuuuugaguaaugaa

SEQ ID NO: 263597 - RNA, 22 nt, Human
ugaacagugaucuacauguggc

SEQ ID NO: 263598 - RNA, 22 nt, Human
aacagaaaagguagguggcuuu

SEQ ID NO: 263599 - RNA, 22 nt, Human
aauuuguuaaaagugagugaca

SEQ ID NO: 263600 - RNA, 22 nt, Human
guucagagacacuuauuggaaa

SEQ ID NO: 263601 - RNA, 20 nt, Human
gaggcucugggcauggcgcc

SEQ ID NO: 263602 - RNA, 23 nt, Human
uaaagcaaagucaagugcacucc

SEQ ID NO: 263603 - RNA, 22 nt, Human
ggaugucgaggaugggguagca

SEQ ID NO: 263604 - RNA, 22 nt, Human
uuaucuugaguauugagauucu

SEQ ID NO: 263605 - RNA, 22 nt, Human
aaaguccuguuaacuguuaaca

SEQ ID NO: 263606 - RNA, 22 nt, Human
gcugccaguaguuggagcucca

SEQ ID NO: 263607 - RNA, 22 nt, Human
aaagaaauagauggcauuuaaa

SEQ ID NO: 263608 - RNA, 23 nt, Human
ucuggcuuccaguggguucaacc

SEQ ID NO: 263609 - RNA, 22 nt, Human
uccugccucaggcucuggagua

SEQ ID NO: 263610 - RNA, 18 nt, Human
acacaggcugacagcacc

SEQ ID NO: 263611 - RNA, 22 nt, Human
aagcucuuuucaccauuaaagu

SEQ ID NO: 263612 - RNA, 22 nt, Human
uucugaaaacacacuuugcagc

SEQ ID NO: 263613 - RNA, 22 nt, Human
aggaaacugagguuacgggacu

SEQ ID NO: 263614 - RNA, 22 nt, Human
uucugaggcauagaggaugaga

SEQ ID NO: 263615 - RNA, 22 nt, Human
agacaauggagggaaauacuuc

SEQ ID NO: 263616 - RNA, 22 nt, Human
ugcagaggcuggcucgccgggu

SEQ ID NO: 263617 - RNA, 22 nt, Human
uauguuuacgcugguagaauua

SEQ ID NO: 263618 - RNA, 22 nt, Human
agguggcaugagacuguaccag

SEQ ID NO: 263619 - RNA, 22 nt, Human
uagcaaaagccacgauuacuuu

SEQ ID NO: 263620 - RNA, 22 nt, Human
agcaucuggauggaaagcaagg

SEQ ID NO: 263621 - RNA, 22 nt, Human
uucaaacaguguagaauauaug

SEQ ID NO: 263622 - RNA, 22 nt, Human
gcuuaugauguuuacauaaaag

SEQ ID NO: 263623 - RNA, 22 nt, Human
ugaggaagggugugacggcacc

SEQ ID NO: 263624 - RNA, 22 nt, Human
gagcugaaucagagauauuauu

SEQ ID NO: 263625 - RNA, 18 nt, Human
uccaggcuggauugauga

SEQ ID NO: 263626 - RNA, 22 nt, Human
auguaucagauaaagcaugugg

SEQ ID NO: 263627 - RNA, 22 nt, Human
acacaucuauauugcaucugca

SEQ ID NO: 263628 - RNA, 22 nt, Human
aggggcucaaagugugcaggga

SEQ ID NO: 263629 - RNA, 22 nt, Human
ugucuggguuuugggucauauu

SEQ ID NO: 263630 - RNA, 22 nt, Human
gagccccuucugcagucagguu

SEQ ID NO: 263631 - RNA, 22 nt, Human
ugauucaacuuucuugaaugca

SEQ ID NO: 263632 - RNA, 21 nt, Human
ucccucagaagguagccaagc

SEQ ID NO: 263633 - RNA, 22 nt, Human
uacuauuuuugcaacguauaca

SEQ ID NO: 263634 - RNA, 22 nt, Human
ccaggcuugaagggaagaaugg

SEQ ID NO: 263635 - RNA, 22 nt, Human
ucugugcucaugcaugugaauu

SEQ ID NO: 263636 - RNA, 22 nt, Human
ccaggcagggcucaaggaaccu

SEQ ID NO: 263637 - RNA, 22 nt, Human
ugaaugaugcauuuguuuccca

SEQ ID NO: 263638 - RNA, 23 nt, Human
ucuguacaauugagaagagaaca

SEQ ID NO: 263639 - RNA, 22 nt, Human
caaguccuuuucuuggcucagg

SEQ ID NO: 263640 - RNA, 20 nt, Human
gcugcucuccacggucugca

SEQ ID NO: 263641 - RNA, 22 nt, Human
gcuucccauuauggaaacucuu

SEQ ID NO: 263642 - RNA, 22 nt, Human
cagcagcccacgcgugcugucc

SEQ ID NO: 263643 - RNA, 22 nt, Human
gggagaaguggaaaucucauua

SEQ ID NO: 263644 - RNA, 22 nt, Human
gagcuuggugaugccuccuggu

SEQ ID NO: 263645 - RNA, 18 nt, Human
gagcucagcguguuucua

SEQ ID NO: 263646 - RNA, 22 nt, Human
gugagcauauauguaaucguuu

SEQ ID NO: 263647 - RNA, 22 nt, Human
uuucaaaagcguacguagugaa

SEQ ID NO: 263648 - RNA, 22 nt, Human
uguccauacaauguaacaucuu

SEQ ID NO: 263649 - RNA, 22 nt, Human
uccauauaccugcagccugguu

SEQ ID NO: 263650 - RNA, 22 nt, Human
acuaaagaagccaaaguuuucu

SEQ ID NO: 263651 - RNA, 22 nt, Human
cugaaugaaaucaaggacugag

SEQ ID NO: 263652 - RNA, 22 nt, Human
cauuggaaugaucguuuugcug

SEQ ID NO: 263653 - RNA, 22 nt, Human
agcucuuccaccucaugauggg

SEQ ID NO: 263654 - RNA, 22 nt, Human
aauuucuaauugaaucucucuu

SEQ ID NO: 263655 - RNA, 18 nt, Human
cagagugggccaagagac

SEQ ID NO: 263656 - RNA, 22 nt, Human
uaggugguuaugucagccuaga

SEQ ID NO: 263657 - RNA, 22 nt, Human
agacacagcugcaggagguggg

SEQ ID NO: 263658 - RNA, 22 nt, Human
gcccaggaaguugaggcugccg

SEQ ID NO: 263659 - RNA, 22 nt, Human
agugcauucuccaucaucuagg

SEQ ID NO: 263660 - RNA, 22 nt, Human
ugcuggagagcuaguucugcag

SEQ ID NO: 263661 - RNA, 20 nt, Human
cacucuaaccauauuuccuc

SEQ ID NO: 263662 - RNA, 23 nt, Human
acuuccaguuauaggaacucuuc

SEQ ID NO: 263663 - RNA, 22 nt, Human
agcacaggacguagagcuugga

SEQ ID NO: 263664 - RNA, 22 nt, Human
aguuaaagucugaaauagagaa

SEQ ID NO: 263665 - RNA, 22 nt, Human
uuauagaaggagcauucacuua

SEQ ID NO: 263666 - RNA, 22 nt, Human
ucauguuuuaguaaagugaagg

SEQ ID NO: 263667 - RNA, 22 nt, Human
gccuggcugggcugaaugcuua

SEQ ID NO: 263668 - RNA, 22 nt, Human
uaguucuagccagugaaaugua

SEQ ID NO: 263669 - RNA, 22 nt, Human
cugugagggccagagucagggc

SEQ ID NO: 263670 - RNA, 22 nt, Human
uguaugcagggcuuguaugcag

SEQ ID NO: 263671 - RNA, 22 nt, Human
uuugggaugcuagacaccucag

SEQ ID NO: 263672 - RNA, 22 nt, Human
gggugggaugccgcugucucca

SEQ ID NO: 263673 - RNA, 22 nt, Human
agcaggugacccaagcaggcug

SEQ ID NO: 263674 - RNA, 22 nt, Human
ucuaauuuuggcauuuuaaccu

SEQ ID NO: 263675 - RNA, 22 nt, Human
gaaagcugugaaauagugcucu

SEQ ID NO: 263676 - RNA, 23 nt, Human
ucagaaguuugguuguaacaugg

SEQ ID NO: 263677 - RNA, 22 nt, Human
cagaggccaccuguggccacug

SEQ ID NO: 263678 - RNA, 22 nt, Human
ucaagcagcuuuuacagaagag

SEQ ID NO: 263679 - RNA, 22 nt, Human
aggcuggcuggggaugcgucuu

SEQ ID NO: 263680 - RNA, 22 nt, Human
ucuugagguuauuaagcuguua

SEQ ID NO: 263681 - RNA, 22 nt, Human
ugccucaguuucaucugcagaa

SEQ ID NO: 263682 - RNA, 22 nt, Human
uugagggacuuucucuauuauu

SEQ ID NO: 263683 - RNA, 22 nt, Human
agggacuauuuacccaucucac

SEQ ID NO: 263684 - RNA, 22 nt, Human
ucucuaaaugauuguguacucc

SEQ ID NO: 263685 - RNA, 22 nt, Human
ggucagaaggauucugggaaau

SEQ ID NO: 263686 - RNA, 18 nt, Human
gacaggugggugagacca

SEQ ID NO: 263687 - RNA, 22 nt, Human
cuggaaagauuucuuuggaguc

SEQ ID NO: 263688 - RNA, 22 nt, Human
ugaaugugaugcuaaacauaug

SEQ ID NO: 263689 - RNA, 20 nt, Human
agguggcucuuccugggcuu

SEQ ID NO: 263690 - RNA, 22 nt, Human
ccuggggcuccagagcagcgga

SEQ ID NO: 263691 - RNA, 22 nt, Human
uaacacugaaaaugaugcaugu

SEQ ID NO: 263692 - RNA, 23 nt, Human
acucuguaggcuguccaugugca

SEQ ID NO: 263693 - RNA, 22 nt, Human
cuuuccaggaauccucacagcc

SEQ ID NO: 263694 - RNA, 21 nt, Human
ggagucuguggaugcuguuuc

SEQ ID NO: 263695 - RNA, 22 nt, Human
agccacagagagggagcugcaa

SEQ ID NO: 263696 - RNA, 22 nt, Human
uuucaguuuuugcucgauguau

SEQ ID NO: 263697 - RNA, 22 nt, Human
caaauacuuuuagccuauugag

SEQ ID NO: 263698 - RNA, 22 nt, Human
gcugagaauguuccuacuggua

SEQ ID NO: 263699 - RNA, 22 nt, Human
aacagcuauuagaacuucaugg

SEQ ID NO: 263700 - RNA, 22 nt, Human
cagggccuucguaaguguccgg

SEQ ID NO: 263701 - RNA, 23 nt, Human
augugugggaggucagagagcca

SEQ ID NO: 263702 - RNA, 22 nt, Human
uuucgucaauuguaacaaaugu

SEQ ID NO: 263703 - RNA, 22 nt, Human
uaggaaacauuugaagaggauu

SEQ ID NO: 263704 - RNA, 22 nt, Human
acacaugaccuccgcagcagca

SEQ ID NO: 263705 - RNA, 22 nt, Human
aauaugcauguauacaugugua

SEQ ID NO: 263706 - RNA, 23 nt, Human
uaggugucuaguguccacuaugu

SEQ ID NO: 263707 - RNA, 22 nt, Human
ugcaggugugggcaggggagca

SEQ ID NO: 263708 - RNA, 22 nt, Human
uaaaaucaugacagauugacau

SEQ ID NO: 263709 - RNA, 22 nt, Human
gcaggcaguugcaguuuucuag

SEQ ID NO: 263710 - RNA, 22 nt, Human
agcaggcacaagaaagggaggu

SEQ ID NO: 263711 - RNA, 20 nt, Human
caugugucaguucucaccca

SEQ ID NO: 263712 - RNA, 22 nt, Human
auaugcuuccccuucuuuuugg

SEQ ID NO: 263713 - RNA, 22 nt, Human
acauucuuccagcuggcuguug

SEQ ID NO: 263714 - RNA, 19 nt, Human
ggucacagggguuacaagg

SEQ ID NO: 263715 - RNA, 22 nt, Human
ucugagggauuugucccuuauc

SEQ ID NO: 263716 - RNA, 22 nt, Human
aggcuuuaaguggccuacagcu

SEQ ID NO: 263717 - RNA, 22 nt, Human
ucagagaagcugccaggcgagc

SEQ ID NO: 263718 - RNA, 22 nt, Human
acagcuggagugaggauggagu

SEQ ID NO: 263719 - RNA, 22 nt, Human
aagagcuggauggaaucuggga

SEQ ID NO: 263720 - RNA, 22 nt, Human
cuccccagcucgcgggugacgg

SEQ ID NO: 263721 - RNA, 22 nt, Human
gaguucucaagcaaucaaagag

SEQ ID NO: 263722 - RNA, 22 nt, Human
ccagagccuaagaucugauccu

SEQ ID NO: 263723 - RNA, 22 nt, Human
ccauaaucguguguuaaauaau

SEQ ID NO: 263724 - RNA, 22 nt, Human
uuaauaauaaugagcccauuuu

SEQ ID NO: 263725 - RNA, 22 nt, Human
uggcccugggcagaggcaacau

SEQ ID NO: 263726 - RNA, 22 nt, Human
cugcuccuggucauccuccacu

SEQ ID NO: 263727 - RNA, 20 nt, Human
gcucccagccugcagucccc

SEQ ID NO: 263728 - RNA, 18 nt, Human
gcaacagaucaacagaaa

SEQ ID NO: 263729 - RNA, 22 nt, Human
uguaugcagcaaaacaauuagu

SEQ ID NO: 263730 - RNA, 22 nt, Human
accccaggucaucugagagucc

SEQ ID NO: 263731 - RNA, 22 nt, Human
aggcucuggacagugaggaguu

SEQ ID NO: 263732 - RNA, 22 nt, Human
cuguuagucuuuugcaggagag

SEQ ID NO: 263733 - RNA, 22 nt, Human
ugaaaugagauaauuuaagugc

SEQ ID NO: 263734 - RNA, 22 nt, Human
ggcccucuuuuauccaucauaa

SEQ ID NO: 263735 - RNA, 22 nt, Human
aggcagagcugauguucuguga

SEQ ID NO: 263736 - RNA, 22 nt, Human
ugcagauagcgucauucuugcu

SEQ ID NO: 263737 - RNA, 22 nt, Human
gggcagagacucagaaacagaa

SEQ ID NO: 263738 - RNA, 22 nt, Human
cucuucuugucucugguuagaa

SEQ ID NO: 263739 - RNA, 22 nt, Human
uagucaaaccucagaauacccc

SEQ ID NO: 263740 - RNA, 22 nt, Human
cuagagaaucuuuuaagaagug

SEQ ID NO: 263741 - RNA, 22 nt, Human
aucauucuaguccuuauggucu

SEQ ID NO: 263742 - RNA, 22 nt, Human
caaaguuuggcucucaugacau

SEQ ID NO: 263743 - RNA, 22 nt, Human
gcugccagcccagcaaggugug

SEQ ID NO: 263744 - RNA, 22 nt, Human
ucagcagggaggcucugugccc

SEQ ID NO: 263745 - RNA, 22 nt, Human
aggcagcagucaugaggaaaga

SEQ ID NO: 263746 - RNA, 22 nt, Human
aaaugaacaucaagaauagccu

SEQ ID NO: 263747 - RNA, 22 nt, Human
aacacugagaggggaguggcac

SEQ ID NO: 263748 - RNA, 22 nt, Human
uucagaauguacugauagaaca

SEQ ID NO: 263749 - RNA, 22 nt, Human
uuaggauuugaaaaggggcaga

SEQ ID NO: 263750 - RNA, 22 nt, Human
cagcauggagacaaagugggca

SEQ ID NO: 263751 - RNA, 18 nt, Human
ggaaaaggagugucuagc

SEQ ID NO: 263752 - RNA, 22 nt, Human
ugcaaggcugccucugaggacc

SEQ ID NO: 263753 - RNA, 22 nt, Human
ugguccaggguguaguacagag

SEQ ID NO: 263754 - RNA, 22 nt, Human
gcuggcugaguucugucgucug

SEQ ID NO: 263755 - RNA, 22 nt, Human
gcagauguaauggcuggagguc

SEQ ID NO: 263756 - RNA, 22 nt, Human
ugccaccccucugcacccucag

SEQ ID NO: 263757 - RNA, 22 nt, Human
guuucuuuuaaaauauguagac

SEQ ID NO: 263758 - RNA, 22 nt, Human
agcagcagggucauugcucuuu

SEQ ID NO: 263759 - RNA, 22 nt, Human
cagucuggcacagcacacugaa

SEQ ID NO: 263760 - RNA, 22 nt, Human
acacaauacagggcucaaaaua

SEQ ID NO: 263761 - RNA, 22 nt, Human
ugcucaguuaagcagaggaaau

SEQ ID NO: 263762 - RNA, 22 nt, Human
agagacagaucugagggaccuc

SEQ ID NO: 263763 - RNA, 22 nt, Human
ugggagcaggcugaugauaggu

SEQ ID NO: 263764 - RNA, 22 nt, Human
auuagcaaguuuuccagcuaau

SEQ ID NO: 263765 - RNA, 22 nt, Human
uuccaugaaggagacugagaag

SEQ ID NO: 263766 - RNA, 22 nt, Human
uugaaacuuuucuuggagaaac

SEQ ID NO: 263767 - RNA, 22 nt, Human
uauaauuuaucaugucacaguu

SEQ ID NO: 263768 - RNA, 20 nt, Human
ccugccugccucggcucauu

SEQ ID NO: 263769 - RNA, 22 nt, Human
ccaggugucaugcgugugaccc

SEQ ID NO: 263770 - RNA, 22 nt, Human
gcagagauuggugcacugauga

SEQ ID NO: 263771 - RNA, 22 nt, Human
guguaucaaagcacagacuuca

SEQ ID NO: 263772 - RNA, 22 nt, Human
uccagccuugccacuuuucugu

SEQ ID NO: 263773 - RNA, 23 nt, Human
cggcuucugaaaucccaucuguu

SEQ ID NO: 263774 - RNA, 22 nt, Human
gccuguuucccugacgcuuaca

SEQ ID NO: 263775 - RNA, 22 nt, Human
aagugaaucuccuuucuuuauu

SEQ ID NO: 263776 - RNA, 22 nt, Human
cuuuugcaccuuuuaaguaaug

SEQ ID NO: 263777 - RNA, 22 nt, Human
agggcacuugaggcugggccug

SEQ ID NO: 263778 - RNA, 22 nt, Human
gggaucuugggaacacccuuac

SEQ ID NO: 263779 - RNA, 22 nt, Human
auucagacugucuaaaugguuu

SEQ ID NO: 263780 - RNA, 22 nt, Human
cagccagaaagucuguuaggga

SEQ ID NO: 263781 - RNA, 22 nt, Human
caguuucugggcguucacaggu

SEQ ID NO: 263782 - RNA, 22 nt, Human
gggguccucggagccugggucu

SEQ ID NO: 263783 - RNA, 22 nt, Human
gagaccaggaaguacagcagcc

SEQ ID NO: 263784 - RNA, 23 nt, Human
agcacagacuagaaaggucuuuc

SEQ ID NO: 263785 - RNA, 22 nt, Human
ggcccagugucccggucguggc

SEQ ID NO: 263786 - RNA, 22 nt, Human
uuugacuucugggcauuuuggu

SEQ ID NO: 263787 - RNA, 22 nt, Human
ucacaggagcccaggggagcug

SEQ ID NO: 263788 - RNA, 22 nt, Human
uggcaggaaauacccugccuag

SEQ ID NO: 263789 - RNA, 20 nt, Human
accaggccccgggcccugca

SEQ ID NO: 263790 - RNA, 22 nt, Human
uacugcauaacuggcauguggg

SEQ ID NO: 263791 - RNA, 16 nt, Human
ccucuggcaauuagau

SEQ ID NO: 263792 - RNA, 22 nt, Human
uuauuccauuauuucacuuagg

SEQ ID NO: 263793 - RNA, 22 nt, Human
gcugcccuguccggcucuccug

SEQ ID NO: 263794 - RNA, 22 nt, Human
acuuuuuaguuuccucaaacau

SEQ ID NO: 263795 - RNA, 22 nt, Human
uuccagaaaucuuucagcucaa

SEQ ID NO: 263796 - RNA, 23 nt, Human
guuaacaugguccauggaagagc

SEQ ID NO: 263797 - RNA, 22 nt, Human
uguggcagaaccagaauucaaa

SEQ ID NO: 263798 - RNA, 20 nt, Human
agucacaguaucagucuuag

SEQ ID NO: 263799 - RNA, 22 nt, Human
ucuugagagauauacuacugaa

SEQ ID NO: 263800 - RNA, 22 nt, Human
ucugggaagcugcgugccuguu

SEQ ID NO: 263801 - RNA, 22 nt, Human
cagccccuggcgcacgccgagc

SEQ ID NO: 263802 - RNA, 22 nt, Human
gaggagaggcuggacgcgguga

SEQ ID NO: 263803 - RNA, 22 nt, Human
ucuccagggcagagaauagcaa

SEQ ID NO: 263804 - RNA, 22 nt, Human
gagcccucaaugaaucugcauu

SEQ ID NO: 263805 - RNA, 22 nt, Human
uuucuucagccacuccaaacug

SEQ ID NO: 263806 - RNA, 22 nt, Human
ggagggccccuccagugggcag

SEQ ID NO: 263807 - RNA, 22 nt, Human
uuacauguacugguuugacuua

SEQ ID NO: 263808 - RNA, 22 nt, Human
guucagagugggaaugaucacu

SEQ ID NO: 263809 - RNA, 22 nt, Human
gcuggagcuugagaggacaggg

SEQ ID NO: 263810 - RNA, 22 nt, Human
aggagagaauguuccaggcuug

SEQ ID NO: 263811 - RNA, 22 nt, Human
gucuucuggaagagagccagcu

SEQ ID NO: 263812 - RNA, 22 nt, Human
uccaagcauguggucaggagcc

SEQ ID NO: 263813 - RNA, 20 nt, Human
ucaaagcacugccugucauc

SEQ ID NO: 263814 - RNA, 22 nt, Human
agccaggucagcucacccugcu

SEQ ID NO: 263815 - RNA, 22 nt, Human
gggcagcuccuguggaauccac

SEQ ID NO: 263816 - RNA, 22 nt, Human
aauuauauuguggugugaaugu

SEQ ID NO: 263817 - RNA, 22 nt, Human
cauuccagaugaggccaggccc

SEQ ID NO: 263818 - RNA, 22 nt, Human
ugcugaaggcaggggagguggc

SEQ ID NO: 263819 - RNA, 22 nt, Human
auggacagguacugcagugggu

SEQ ID NO: 263820 - RNA, 22 nt, Human
uaagaacaguagaacaguaggu

SEQ ID NO: 263821 - RNA, 22 nt, Human
cuggugcccuguguggcaggag

SEQ ID NO: 263822 - RNA, 22 nt, Human
cugcugucauagccaucccucc

SEQ ID NO: 263823 - RNA, 22 nt, Human
ucagaguguuuuacuaaacaag

SEQ ID NO: 263824 - RNA, 22 nt, Human
gugugcucuggaggcuagauuu

SEQ ID NO: 263825 - RNA, 22 nt, Human
agcuccuggcaaggucauggug

SEQ ID NO: 263826 - RNA, 22 nt, Human
uugccagggaacagggagaggc

SEQ ID NO: 263827 - RNA, 22 nt, Human
aagggaggaggauuuauuguac

SEQ ID NO: 263828 - RNA, 22 nt, Human
guguaauugaaauugagaacca

SEQ ID NO: 263829 - RNA, 23 nt, Human
ugcccagugccuuugcccaugca

SEQ ID NO: 263830 - RNA, 22 nt, Human
gaggcccaguggagggccaugg

SEQ ID NO: 263831 - RNA, 22 nt, Human
guaaucguggugguuaauucca

SEQ ID NO: 263832 - RNA, 22 nt, Human
cucagcaguaaacguccggaac

SEQ ID NO: 263833 - RNA, 22 nt, Human
gggcuucucucagaaacuauca

SEQ ID NO: 263834 - RNA, 22 nt, Human
gcugucugcaucucuagagcuu

SEQ ID NO: 263835 - RNA, 22 nt, Human
cugggucuggugucaggcgacg

SEQ ID NO: 263836 - RNA, 22 nt, Human
uauugauuccugcuuucugcuc

SEQ ID NO: 263837 - RNA, 22 nt, Human
ucagcaggcagugggucacaau

SEQ ID NO: 263838 - RNA, 22 nt, Human
gggagcuggagcuggaagacuc

SEQ ID NO: 263839 - RNA, 20 nt, Human
uccuaauaaccugaagaaau

SEQ ID NO: 263840 - RNA, 22 nt, Human
aguaaugugccugaaauacuug

SEQ ID NO: 263841 - RNA, 22 nt, Human
cuggugaauauuggaggcauug

SEQ ID NO: 263842 - RNA, 22 nt, Human
uaaagcccucugaucacacugg

SEQ ID NO: 263843 - RNA, 22 nt, Human
gaaguauagcagauguuauuua

SEQ ID NO: 263844 - RNA, 22 nt, Human
ugagcaggucaggaaguacauu

SEQ ID NO: 263845 - RNA, 22 nt, Human
gugagucuuuggagacaguuca

SEQ ID NO: 263846 - RNA, 20 nt, Human
agccagccacuuccugcucc

SEQ ID NO: 263847 - RNA, 22 nt, Human
ugagagccuaguagguggaaaa

SEQ ID NO: 263848 - RNA, 22 nt, Human
gcucugugccacaugcaguguu

SEQ ID NO: 263849 - RNA, 22 nt, Human
gcagcuggugcaaaugucacuc

SEQ ID NO: 263850 - RNA, 22 nt, Human
uagcucagcaggugggacaggu

SEQ ID NO: 263851 - RNA, 22 nt, Human
uuagaaagggugucugaaucug

SEQ ID NO: 263852 - RNA, 20 nt, Human
uacuucugaggcacucugaa

SEQ ID NO: 263853 - RNA, 22 nt, Human
acagcaaaagacaagaacuuaa

SEQ ID NO: 263854 - RNA, 22 nt, Human
gcaggugguggcgcgcgcccug

SEQ ID NO: 263855 - RNA, 22 nt, Human
gauaccagacagggagggagaa

SEQ ID NO: 263856 - RNA, 22 nt, Human
aguugugcugugaugcaggaua

SEQ ID NO: 263857 - RNA, 21 nt, Human
aaaaagcuggggcaugcaugc

SEQ ID NO: 263858 - RNA, 22 nt, Human
aguugguucacuccuucaugcc

SEQ ID NO: 263859 - RNA, 22 nt, Human
aggcugaggggcgagggacccu

SEQ ID NO: 263860 - RNA, 22 nt, Human
uagaacaucagguugaauuugg

SEQ ID NO: 263861 - RNA, 22 nt, Human
uaguuuagcacuaagaaaaaca

SEQ ID NO: 263862 - RNA, 22 nt, Human
auggggaagagccagugagcug

SEQ ID NO: 263863 - RNA, 22 nt, Human
ucacagaagcuugaagauuuuc

SEQ ID NO: 263864 - RNA, 22 nt, Human
uaaaugugaccuucauuuuaua

SEQ ID NO: 263865 - RNA, 22 nt, Human
aagagguaaccauagcaaccac

SEQ ID NO: 263866 - RNA, 22 nt, Human
uuacagaguagugcagaacuca

SEQ ID NO: 263867 - RNA, 23 nt, Human
uugagaacaggugugagaauggc

SEQ ID NO: 263868 - RNA, 20 nt, Human
aucuccugcuaccacccauu

SEQ ID NO: 263869 - RNA, 22 nt, Human
guccugggccugcugaggcuga

SEQ ID NO: 263870 - RNA, 22 nt, Human
gagcucuuccccaucuuacauc

SEQ ID NO: 263871 - RNA, 22 nt, Human
ccaggcucugucuggucagaag

SEQ ID NO: 263872 - RNA, 22 nt, Human
aaaagagugacugauaaguaua

SEQ ID NO: 263873 - RNA, 22 nt, Human
aguuaaagaaagauaauucgcc

SEQ ID NO: 263874 - RNA, 22 nt, Human
uuagcagcuaaacugacagacc

SEQ ID NO: 263875 - RNA, 22 nt, Human
ggcuuugcccuggacugaggca

SEQ ID NO: 263876 - RNA, 22 nt, Human
gcagguggaagcagcagacuca

SEQ ID NO: 263877 - RNA, 22 nt, Human
cacuguacagcauuaacaaggc

SEQ ID NO: 263878 - RNA, 22 nt, Human
acagucucuccacacugcaggg

SEQ ID NO: 263879 - RNA, 20 nt, Human
ucagugcagauuguccaagu

SEQ ID NO: 263880 - RNA, 22 nt, Human
uaaaguguggacaguaucuaua

SEQ ID NO: 263881 - RNA, 22 nt, Human
gagaggcugguaaagucugaac

SEQ ID NO: 263882 - RNA, 22 nt, Human
ugaaucaaugaauugcacuuca

SEQ ID NO: 263883 - RNA, 22 nt, Human
uuaaaugugauuucauuuaugu

SEQ ID NO: 263884 - RNA, 22 nt, Human
aaggcugagccagggccccuau

SEQ ID NO: 263885 - RNA, 22 nt, Human
aagauccaugggaauguuuggc

SEQ ID NO: 263886 - RNA, 22 nt, Human
ugucucagaguguuguauuaga

SEQ ID NO: 263887 - RNA, 22 nt, Human
aggcagcugugaggacuggauu

SEQ ID NO: 263888 - RNA, 22 nt, Human
uugcucaggcuuagagcuacua

SEQ ID NO: 263889 - RNA, 22 nt, Human
gguccagccaggugcucaugcc

SEQ ID NO: 263890 - RNA, 22 nt, Human
uuggcugcaaucacagggacuc

SEQ ID NO: 263891 - RNA, 20 nt, Human
cuguuaaaagguaugaauuc

SEQ ID NO: 263892 - RNA, 22 nt, Human
ucagcugcucaaauuuauguca

SEQ ID NO: 263893 - RNA, 22 nt, Human
ugaauauguauuucuuauuuac

SEQ ID NO: 263894 - RNA, 22 nt, Human
ccaggcaggcuagaauguaaau

SEQ ID NO: 263895 - RNA, 22 nt, Human
ucuggcagugagcaacuugaca

SEQ ID NO: 263896 - RNA, 22 nt, Human
uggcaggugcacuuuugguuuc

SEQ ID NO: 263897 - RNA, 22 nt, Human
cacucugggggcugccgcugcc

SEQ ID NO: 263898 - RNA, 22 nt, Human
gcagagauccuugcuggaugac

SEQ ID NO: 263899 - RNA, 22 nt, Human
ccuggcccuggaauagggcagg

SEQ ID NO: 263900 - RNA, 22 nt, Human
uagaaccaguccacagaauuug

SEQ ID NO: 263901 - RNA, 22 nt, Human
ugucucaggggcauugaaauaa

SEQ ID NO: 263902 - RNA, 22 nt, Human
ugggcuccguugccuggggcag

SEQ ID NO: 263903 - RNA, 22 nt, Human
gccuggaguucagccaaguccc

SEQ ID NO: 263904 - RNA, 22 nt, Human
agagguguggccaggacucaag

SEQ ID NO: 263905 - RNA, 22 nt, Human
agaggccuuucuguugagugaa

SEQ ID NO: 263906 - RNA, 22 nt, Human
ucuggaugggaugaggcaacaa

SEQ ID NO: 263907 - RNA, 21 nt, Human
agccuggguauccuuugagga

SEQ ID NO: 263908 - RNA, 22 nt, Human
aucuccaguuagcaguacugau

SEQ ID NO: 263909 - RNA, 22 nt, Human
caggaggcuuugggauccaagu

SEQ ID NO: 263910 - RNA, 22 nt, Human
aauuagaaccagaagccauauu

SEQ ID NO: 263911 - RNA, 22 nt, Human
cccaggaccauccuucugugcc

SEQ ID NO: 263912 - RNA, 22 nt, Human
aaauguguuucgaaaacuggug

SEQ ID NO: 263913 - RNA, 22 nt, Human
uaaggcacccuucugaguagag

SEQ ID NO: 263914 - RNA, 22 nt, Human
ugagcaggagauaaacagguag

SEQ ID NO: 263915 - RNA, 22 nt, Human
cuucuuuaccaagagauagagu

SEQ ID NO: 263916 - RNA, 23 nt, Human
caggcucccggaccaggauccgc

SEQ ID NO: 263917 - RNA, 22 nt, Human
aauguuuuguaugccucugagc

SEQ ID NO: 263918 - RNA, 21 nt, Human
ucuggcaggcacgggcccagc

SEQ ID NO: 263919 - RNA, 22 nt, Human
ucagggacgugagcucagaguc

SEQ ID NO: 263920 - RNA, 22 nt, Human
gcucugggaaguccuuuaccau

SEQ ID NO: 263921 - RNA, 22 nt, Human
cugucugcccuggccagagccc

SEQ ID NO: 263922 - RNA, 20 nt, Human
ccucucugcccugcaaggcc

SEQ ID NO: 263923 - RNA, 22 nt, Human
uuugcuuugacugucagcaagu

SEQ ID NO: 263924 - RNA, 22 nt, Human
caggccugcaggaaaggcuccc

SEQ ID NO: 263925 - RNA, 22 nt, Human
uauuuagaugcauuuggauugc

SEQ ID NO: 263926 - RNA, 22 nt, Human
uuugcaaacacuuaagaagaga

SEQ ID NO: 263927 - RNA, 22 nt, Human
uggcccagggaguucauggugu

SEQ ID NO: 263928 - RNA, 22 nt, Human
gggcuccaccuagggacacugg

SEQ ID NO: 263929 - RNA, 22 nt, Human
aucuggcuauugacauguuaua

SEQ ID NO: 263930 - RNA, 22 nt, Human
auuugcuuucccuucccugaca

SEQ ID NO: 263931 - RNA, 22 nt, Human
gugcaaccucgucagagcaccu

SEQ ID NO: 263932 - RNA, 22 nt, Human
acaguacaagcaaugcauuuuu

SEQ ID NO: 263933 - RNA, 22 nt, Human
ucuggcuccugaguccaugcuc

SEQ ID NO: 263934 - RNA, 22 nt, Human
agucuuuacauguguuauauau

SEQ ID NO: 263935 - RNA, 22 nt, Human
gcaggcaccgcggcggcagguu

SEQ ID NO: 263936 - RNA, 22 nt, Human
acuuugggaagcugcaauugcc

SEQ ID NO: 263937 - RNA, 22 nt, Human
cuccuggagcagcaggcgcagg

SEQ ID NO: 263938 - RNA, 22 nt, Human
acuccagggcugaacgaggccc

SEQ ID NO: 263939 - RNA, 22 nt, Human
cucugagggcucgagggacgcg

SEQ ID NO: 263940 - RNA, 22 nt, Human
agacauuauggcuuucacuggg

SEQ ID NO: 263941 - RNA, 22 nt, Human
ugcagcugguaucccauggauu

SEQ ID NO: 263942 - RNA, 22 nt, Human
ugaauccagagcuauuucgucc

SEQ ID NO: 263943 - RNA, 23 nt, Human
aggcaggcaguucagcuguuguu

SEQ ID NO: 263944 - RNA, 22 nt, Human
uuuaauaucucacacuuccaug

SEQ ID NO: 263945 - RNA, 22 nt, Human
auuccaguucuccucucuaaag

SEQ ID NO: 263946 - RNA, 22 nt, Human
uggcacagcccggauucuauga

SEQ ID NO: 263947 - RNA, 19 nt, Human
agcagcagaagugugccuu

SEQ ID NO: 263948 - RNA, 22 nt, Human
uccugcagucugcacucugccu

SEQ ID NO: 263949 - RNA, 20 nt, Human
uucuagaaugcccagggaca

SEQ ID NO: 263950 - RNA, 17 nt, Human
cagaggagcuuuggggg

SEQ ID NO: 263951 - RNA, 22 nt, Human
acagcucuguugccagaucugc

SEQ ID NO: 263952 - RNA, 22 nt, Human
ugcuugggaauguggagucaga

SEQ ID NO: 263953 - RNA, 22 nt, Human
aggcugugacuacgcagggaag

SEQ ID NO: 263954 - RNA, 22 nt, Human
uacaugugauaaauugauuaaa

SEQ ID NO: 263955 - RNA, 22 nt, Human
ugcuggcuuuuugugucaaaga

SEQ ID NO: 263956 - RNA, 22 nt, Human
auguuucaugacugagcaaaau

SEQ ID NO: 263957 - RNA, 22 nt, Human
aguuuauagcccagauucaugg

SEQ ID NO: 263958 - RNA, 22 nt, Human
cccaggcuaguaugauaucagu

SEQ ID NO: 263959 - RNA, 22 nt, Human
aaaagacaggugucugcggccc

SEQ ID NO: 263960 - RNA, 22 nt, Human
gcugccucccccauggcuggaa

SEQ ID NO: 263961 - RNA, 22 nt, Human
caggcaagauuagagaugagca

SEQ ID NO: 263962 - RNA, 22 nt, Human
cugaggcaccggcaauguucug

SEQ ID NO: 263963 - RNA, 22 nt, Human
aucaugcauuguauugaguuga

SEQ ID NO: 263964 - RNA, 22 nt, Human
cacaugcuccauacagaauggg

SEQ ID NO: 263965 - RNA, 16 nt, Human
aggcucagaggcugga

SEQ ID NO: 263966 - RNA, 22 nt, Human
augcccugcugccaucuggccg

SEQ ID NO: 263967 - RNA, 22 nt, Human
cucaggccagguuucucccaca

SEQ ID NO: 263968 - RNA, 22 nt, Human
guuuagaaaauagugaagcaag

SEQ ID NO: 263969 - RNA, 22 nt, Human
cauagaaaagaguagguaaugu

SEQ ID NO: 263970 - RNA, 22 nt, Human
ugaugaggcauaugcuacacau

SEQ ID NO: 263971 - RNA, 21 nt, Human
gacuuucuuaccagauuuuug

SEQ ID NO: 263972 - RNA, 22 nt, Human
acagggauuuuccaggcuaccc

SEQ ID NO: 263973 - RNA, 22 nt, Human
guaaacauuacugugcuguaua

SEQ ID NO: 263974 - RNA, 22 nt, Human
ucucucuucaacccuuaacuag

SEQ ID NO: 263975 - RNA, 22 nt, Human
agauggcuauagauagccuuuc

SEQ ID NO: 263976 - RNA, 22 nt, Human
ucuguucaagacugaggugaca

SEQ ID NO: 263977 - RNA, 22 nt, Human
aguguccuugagguuccuagga

SEQ ID NO: 263978 - RNA, 22 nt, Human
uaacauuauacagagaggacag

SEQ ID NO: 263979 - RNA, 22 nt, Human
aaagccuucuucggucugugau

SEQ ID NO: 263980 - RNA, 22 nt, Human
agcauuagaagaaaugauuaua

SEQ ID NO: 263981 - RNA, 22 nt, Human
uggagcccaggagaggauaaac

SEQ ID NO: 263982 - RNA, 22 nt, Human
uagagcuagcuucaaaaugcga

SEQ ID NO: 263983 - RNA, 22 nt, Human
caaugugugcuuacaggccagu

SEQ ID NO: 263984 - RNA, 18 nt, Human
ccagagcuggcuccucgc

SEQ ID NO: 263985 - RNA, 22 nt, Human
ugaucuuuucuauuuaugguag

SEQ ID NO: 263986 - RNA, 20 nt, Human
uuuuaugucaccuuccuguc

SEQ ID NO: 263987 - RNA, 22 nt, Human
gcaguaguccauaaguacucug

SEQ ID NO: 263988 - RNA, 22 nt, Human
ccuggccaguuuccaggcccug

SEQ ID NO: 263989 - RNA, 22 nt, Human
guucuucaucuuaaccaucugu

SEQ ID NO: 263990 - RNA, 22 nt, Human
agggaagaggaccagagucucu

SEQ ID NO: 263991 - RNA, 22 nt, Human
aaaauugaagugaucaggaacu

SEQ ID NO: 263992 - RNA, 22 nt, Human
acuguccuagaaccugcagcuc

SEQ ID NO: 263993 - RNA, 23 nt, Human
aggugccaacugagagcugagag

SEQ ID NO: 263994 - RNA, 22 nt, Human
gggccuccggggugagcugugg

SEQ ID NO: 263995 - RNA, 22 nt, Human
ugagguggcuagggaggcacuc

SEQ ID NO: 263996 - RNA, 22 nt, Human
gcagggacagggcagggccuuu

SEQ ID NO: 263997 - RNA, 22 nt, Human
ucaauguaauaaaauacucuau

SEQ ID NO: 263998 - RNA, 22 nt, Human
ucaggaaagaagaugcucagug

SEQ ID NO: 263999 - RNA, 22 nt, Human
gcccagcccagaaagguucgga

SEQ ID NO: 264000 - RNA, 22 nt, Human
aggcuucuucuuccuauuuagu

SEQ ID NO: 264001 - RNA, 22 nt, Human
ucuucacagaugcauauacuuc

SEQ ID NO: 264002 - RNA, 22 nt, Human
cauguuucugagaaaaguagga

SEQ ID NO: 264003 - RNA, 22 nt, Human
cugagcacagaaauaagauauu

SEQ ID NO: 264004 - RNA, 22 nt, Human
agggaagccaagccuuagagaa

SEQ ID NO: 264005 - RNA, 22 nt, Human
gcagucuuugaaugugaaauag

SEQ ID NO: 264006 - RNA, 22 nt, Human
aggcuaggcugaugccucuucc

SEQ ID NO: 264007 - RNA, 23 nt, Human
gccugggacugguagugugaccu

SEQ ID NO: 264008 - RNA, 22 nt, Human
guguccugagugaggccuggcc

SEQ ID NO: 264009 - RNA, 22 nt, Human
cagcagaacaggcagggaagcu

SEQ ID NO: 264010 - RNA, 22 nt, Human
ucuguaaagucuguguaaaguc

SEQ ID NO: 264011 - RNA, 22 nt, Human
aacaggcuuccaggagggacga

SEQ ID NO: 264012 - RNA, 22 nt, Human
gauuuuuauauaaagugagaaa

SEQ ID NO: 264013 - RNA, 22 nt, Human
uuaguuaauugacuauguugca

SEQ ID NO: 264014 - RNA, 22 nt, Human
guuuauuccagcaaucugcuua

SEQ ID NO: 264015 - RNA, 22 nt, Human
auuugcauuuacauagcauaga

SEQ ID NO: 264016 - RNA, 21 nt, Human
ucagguggcagaguguuuaug

SEQ ID NO: 264017 - RNA, 22 nt, Human
caucuuugcacccucaaaaccu

SEQ ID NO: 264018 - RNA, 23 nt, Human
uaauuuuagccuuacaggacccu

SEQ ID NO: 264019 - RNA, 22 nt, Human
uucuucuccuaaggagaguccu

SEQ ID NO: 264020 - RNA, 22 nt, Human
cauuuauuaguuaguucgaugu

SEQ ID NO: 264021 - RNA, 20 nt, Human
uacagaaacaggacuuuugg

SEQ ID NO: 264022 - RNA, 23 nt, Human
agacuggggcauaagaagauggc

SEQ ID NO: 264023 - RNA, 22 nt, Human
caccaggcugaaccagagggga

SEQ ID NO: 264024 - RNA, 22 nt, Human
gucuccagaauucuugggaggg

SEQ ID NO: 264025 - RNA, 22 nt, Human
uaggcucauuaaguccccaggg

SEQ ID NO: 264026 - RNA, 22 nt, Human
cuucaguuagaguuuacaaagu

SEQ ID NO: 264027 - RNA, 22 nt, Human
auuaagaucauuguagaagauu

SEQ ID NO: 264028 - RNA, 22 nt, Human
aagaaauauugggccuuauaaa

SEQ ID NO: 264029 - RNA, 22 nt, Human
cucauggcagagucaccugucc

SEQ ID NO: 264030 - RNA, 22 nt, Human
guuuuuaucuaauagcaguuau

SEQ ID NO: 264031 - RNA, 22 nt, Human
cuuugugucuguuaauaauuau

SEQ ID NO: 264032 - RNA, 22 nt, Human
ggcugcagauuguagucuguua

SEQ ID NO: 264033 - RNA, 22 nt, Human
auuagauacacagauuuccacu

SEQ ID NO: 264034 - RNA, 22 nt, Human
uauccuguuuugcacaauuaua

SEQ ID NO: 264035 - RNA, 22 nt, Human
uaaaugucuguuaacaugaaug

SEQ ID NO: 264036 - RNA, 22 nt, Human
gcuugggaaacguaguuccuag

SEQ ID NO: 264037 - RNA, 20 nt, Human
acacaguagcaauuagugca

SEQ ID NO: 264038 - RNA, 22 nt, Human
uggcagauuuucucuggaggag

SEQ ID NO: 264039 - RNA, 22 nt, Human
cugacucugacaggacuugugg

SEQ ID NO: 264040 - RNA, 22 nt, Human
uccagggcaggugcugggcucu

SEQ ID NO: 264041 - RNA, 22 nt, Human
acacagagcaaaucaugacaga

SEQ ID NO: 264042 - RNA, 22 nt, Human
acagacacaggcguggagucgc

SEQ ID NO: 264043 - RNA, 22 nt, Human
gcugccucugcgacucugggcg

SEQ ID NO: 264044 - RNA, 22 nt, Human
uguccuguagguuuauuugugu

SEQ ID NO: 264045 - RNA, 22 nt, Human
gcagcaucuguacauagacgcu

SEQ ID NO: 264046 - RNA, 22 nt, Human
aucuuuggugcaugauacuuug

SEQ ID NO: 264047 - RNA, 22 nt, Human
acuucuugaugaaaaugguacu

SEQ ID NO: 264048 - RNA, 20 nt, Human
uagggaugccaguacuucuc

SEQ ID NO: 264049 - RNA, 22 nt, Human
cuuuggaaucauugcuuauuca

SEQ ID NO: 264050 - RNA, 22 nt, Human
uugcuuuacaaaaauugauggu

SEQ ID NO: 264051 - RNA, 17 nt, Human
acacagccagguucucc

SEQ ID NO: 264052 - RNA, 23 nt, Human
ugcuuauucaaaaggugcuuuca

SEQ ID NO: 264053 - RNA, 22 nt, Human
uuauacgcucaauccuaucauc

SEQ ID NO: 264054 - RNA, 22 nt, Human
auuucaaggcuauuaauauaaa

SEQ ID NO: 264055 - RNA, 22 nt, Human
augcaccacaucacuucugcuc

SEQ ID NO: 264056 - RNA, 22 nt, Human
cacacaugguuccgcaggaugc

SEQ ID NO: 264057 - RNA, 22 nt, Human
ucugagacacucuugugauggg

SEQ ID NO: 264058 - RNA, 22 nt, Human
guucuuuaggggcccaauuucc

SEQ ID NO: 264059 - RNA, 22 nt, Human
ugccaggcccugcgggguccca

SEQ ID NO: 264060 - RNA, 22 nt, Human
aaggcuggaccuggaugaaucu

SEQ ID NO: 264061 - RNA, 18 nt, Human
guagauccuugagcuacc

SEQ ID NO: 264062 - RNA, 22 nt, Human
aacuccuaugacccacugaacu

SEQ ID NO: 264063 - RNA, 22 nt, Human
cagucuaacuucacagccugga

SEQ ID NO: 264064 - RNA, 22 nt, Human
acugcagagguggggugcagag

SEQ ID NO: 264065 - RNA, 22 nt, Human
caaggagaguaauugaaugaga

SEQ ID NO: 264066 - RNA, 22 nt, Human
aagaacaugaguuaugaugauu

SEQ ID NO: 264067 - RNA, 22 nt, Human
cuggggaacaauuugccacacu

SEQ ID NO: 264068 - RNA, 22 nt, Human
uucuguaguauucuuuugguca

SEQ ID NO: 264069 - RNA, 22 nt, Human
ccaggcaucacgggcauguggc

SEQ ID NO: 264070 - RNA, 22 nt, Human
ucucugagcuuaagguguuuca

SEQ ID NO: 264071 - RNA, 19 nt, Human
uccaccccagccagcucug

SEQ ID NO: 264072 - RNA, 22 nt, Human
gugugcucccucugucgucaua

SEQ ID NO: 264073 - RNA, 22 nt, Human
caauuucugggccucacacaag

SEQ ID NO: 264074 - RNA, 22 nt, Human
cuuuuucugauguuccaugauu

SEQ ID NO: 264075 - RNA, 21 nt, Human
cacaggugggucagugaggcc

SEQ ID NO: 264076 - RNA, 22 nt, Human
gccaggcuggggggagaugucu

SEQ ID NO: 264077 - RNA, 22 nt, Human
cacuggucagucggucagucuc

SEQ ID NO: 264078 - RNA, 22 nt, Human
aggaccugacuggcuccugcuu

SEQ ID NO: 264079 - RNA, 22 nt, Human
agaccugcagggccaggccugc

SEQ ID NO: 264080 - RNA, 22 nt, Human
gccuggagacagcagaggcggc

SEQ ID NO: 264081 - RNA, 22 nt, Human
agcaucugcauaaugccuuccc

SEQ ID NO: 264082 - RNA, 22 nt, Human
uuaguugauguucuggagguag

SEQ ID NO: 264083 - RNA, 22 nt, Human
ggucccagcuggucacugucag

SEQ ID NO: 264084 - RNA, 22 nt, Human
agaaaacauaggagacaggaaa

SEQ ID NO: 264085 - RNA, 22 nt, Human
gcccagcaccucucucaggguu

SEQ ID NO: 264086 - RNA, 22 nt, Human
caaauacuacgauucuugcagu

SEQ ID NO: 264087 - RNA, 22 nt, Human
cuggcacagagugagcauucaa

SEQ ID NO: 264088 - RNA, 22 nt, Human
uuuuuuggugcuccuaggaagg

SEQ ID NO: 264089 - RNA, 22 nt, Human
agcacuguaguuauagcuaaca

SEQ ID NO: 264090 - RNA, 22 nt, Human
ccaggccaguguuugguccagg

SEQ ID NO: 264091 - RNA, 22 nt, Human
caggcucagaugcccugcgcug

SEQ ID NO: 264092 - RNA, 22 nt, Human
acagugcucaugugacauggug

SEQ ID NO: 264093 - RNA, 22 nt, Human
uuugcugacuggaugcaguugg

SEQ ID NO: 264094 - RNA, 22 nt, Human
guaaaucauggucagaauaaau

SEQ ID NO: 264095 - RNA, 22 nt, Human
caugcacaacauacucaagagg

SEQ ID NO: 264096 - RNA, 22 nt, Human
cuggcuggguuccaggauucca

SEQ ID NO: 264097 - RNA, 22 nt, Human
gcagaauacugagagcugauug

SEQ ID NO: 264098 - RNA, 22 nt, Human
uuuucucuuguuaauguacuga

SEQ ID NO: 264099 - RNA, 22 nt, Human
uucauucccuuauauuagcauu

SEQ ID NO: 264100 - RNA, 22 nt, Human
agggcuccuaugccccauggac

SEQ ID NO: 264101 - RNA, 22 nt, Human
cugcaggcugagcgccugccgg

SEQ ID NO: 264102 - RNA, 22 nt, Human
gagccagggcugugagcugagc

SEQ ID NO: 264103 - RNA, 22 nt, Human
ucaguaaaguucuuucuugcug

SEQ ID NO: 264104 - RNA, 22 nt, Human
ggccuugagagccagugcaggc

SEQ ID NO: 264105 - RNA, 22 nt, Human
guccagagaggcaggaggcuac

SEQ ID NO: 264106 - RNA, 22 nt, Human
ucauagcuaagcuccagagugc

SEQ ID NO: 264107 - RNA, 22 nt, Human
aacagaauaguugauguacagu

SEQ ID NO: 264108 - RNA, 22 nt, Human
ccuggggcucugcacagagcag

SEQ ID NO: 264109 - RNA, 22 nt, Human
ggacuccucuagaaguugaggc

SEQ ID NO: 264110 - RNA, 22 nt, Human
aacacagguucauucugugagg

SEQ ID NO: 264111 - RNA, 22 nt, Human
uguuuacuugagguggaaacaa

SEQ ID NO: 264112 - RNA, 22 nt, Human
uccugagguauaugcuuugcag

SEQ ID NO: 264113 - RNA, 22 nt, Human
auaauaacaccugaauaggaaa

SEQ ID NO: 264114 - RNA, 22 nt, Human
ucccagaggacuguuggugcua

SEQ ID NO: 264115 - RNA, 22 nt, Human
cagcugccaugacauguccugc

SEQ ID NO: 264116 - RNA, 22 nt, Human
ccuccagucaccuggaugagaa

SEQ ID NO: 264117 - RNA, 22 nt, Human
uggguccuggaaggcgacaggu

SEQ ID NO: 264118 - RNA, 22 nt, Human
cccuccagagccuggacauucu

SEQ ID NO: 264119 - RNA, 21 nt, Human
agcugcagucaagccagaggu

SEQ ID NO: 264120 - RNA, 22 nt, Human
agcaggggucucugcuaaugaa

SEQ ID NO: 264121 - RNA, 22 nt, Human
uuacccagugaagccgaggcag

SEQ ID NO: 264122 - RNA, 22 nt, Human
acaagauagcuuagaagauuca

SEQ ID NO: 264123 - RNA, 22 nt, Human
auggaguucugccagcgcugcu

SEQ ID NO: 264124 - RNA, 22 nt, Human
caggcuuggagggcaguggcau

SEQ ID NO: 264125 - RNA, 22 nt, Human
cccugcccuggagacacuuaaa

SEQ ID NO: 264126 - RNA, 19 nt, Human
accaggaguaucagagcug

SEQ ID NO: 264127 - RNA, 20 nt, Human
aaaaagacaaaacgaguugg

SEQ ID NO: 264128 - RNA, 19 nt, Human
aauuagggagucgguuaag

SEQ ID NO: 264129 - RNA, 22 nt, Human
uuguacuugccauagaacaaca

SEQ ID NO: 264130 - RNA, 22 nt, Human
ccucuaggauguggcuggagga

SEQ ID NO: 264131 - RNA, 22 nt, Human
gcugaagacaauggaauugacu

SEQ ID NO: 264132 - RNA, 18 nt, Human
acagacaaaauggaaaug

SEQ ID NO: 264133 - RNA, 22 nt, Human
aagucagaaauuauucaggaau

SEQ ID NO: 264134 - RNA, 20 nt, Human
ugcaaacauuacuugggugu

SEQ ID NO: 264135 - RNA, 22 nt, Human
gagugguaggcaguguuaggaa

SEQ ID NO: 264136 - RNA, 22 nt, Human
agaggauucacugcagaagaca

SEQ ID NO: 264137 - RNA, 22 nt, Human
cucuuuggggcuggaagccuag

SEQ ID NO: 264138 - RNA, 20 nt, Human
uaacagaaguagaagugggu

SEQ ID NO: 264139 - RNA, 22 nt, Human
gaugaggucuacauuguuaaaa

SEQ ID NO: 264140 - RNA, 22 nt, Human
acaucucagaacugaguaaccg

SEQ ID NO: 264141 - RNA, 22 nt, Human
uaaaugcuaucgcauaaaaccu

SEQ ID NO: 264142 - RNA, 22 nt, Human
uacaaagugcuuuagaaaugaa

SEQ ID NO: 264143 - RNA, 22 nt, Human
ugcuuucaaugaauuguauacu

SEQ ID NO: 264144 - RNA, 22 nt, Human
caggucuuuguugcagcaugga

SEQ ID NO: 264145 - RNA, 22 nt, Human
gccuugggaaagugggaggaga

SEQ ID NO: 264146 - RNA, 22 nt, Human
cugugcuggugaaacccacaga

SEQ ID NO: 264147 - RNA, 22 nt, Human
gagggccuacuggacaugucag

SEQ ID NO: 264148 - RNA, 22 nt, Human
ggagaaggaagaaagcuacuau

SEQ ID NO: 264149 - RNA, 22 nt, Human
gggcuugcuaagaagagcgcau

SEQ ID NO: 264150 - RNA, 22 nt, Human
agguucaaauuguugcaguuuc

SEQ ID NO: 264151 - RNA, 22 nt, Human
agccauccuacuaccucagcau

SEQ ID NO: 264152 - RNA, 19 nt, Human
uccaggccauucccagagc

SEQ ID NO: 264153 - RNA, 22 nt, Human
aaaauuguaggaacugaaucaa

SEQ ID NO: 264154 - RNA, 22 nt, Human
auagggcuguugugaggauuaa

SEQ ID NO: 264155 - RNA, 22 nt, Human
ucccucagcuugucuccaugca

SEQ ID NO: 264156 - RNA, 21 nt, Human
auuccacuuuuccuucaggga

SEQ ID NO: 264157 - RNA, 22 nt, Human
ggugaggggagagugaaagaaa

SEQ ID NO: 264158 - RNA, 17 nt, Human
gcucagaguacacgugu

SEQ ID NO: 264159 - RNA, 22 nt, Human
aguuauguccucagcaaaucaa

SEQ ID NO: 264160 - RNA, 17 nt, Human
gagagcugcugcuuccg

SEQ ID NO: 264161 - RNA, 22 nt, Human
uaggaaacucucagcuggucau

SEQ ID NO: 264162 - RNA, 22 nt, Human
ggcuccugaggaccaggcacag

SEQ ID NO: 264163 - RNA, 22 nt, Human
gcagacuggucuucagccuugg

SEQ ID NO: 264164 - RNA, 22 nt, Human
aagaaucuccaucugauucacu

SEQ ID NO: 264165 - RNA, 22 nt, Human
ggcuuuuguuucagcucugcua

SEQ ID NO: 264166 - RNA, 20 nt, Human
aaagagaagccucaccuugu

SEQ ID NO: 264167 - RNA, 22 nt, Human
uggcugagugauauuugcaaag

SEQ ID NO: 264168 - RNA, 22 nt, Human
ggcacagggagaggcggauuuu

SEQ ID NO: 264169 - RNA, 22 nt, Human
uccaagaucuacagcaguuuag

SEQ ID NO: 264170 - RNA, 22 nt, Human
cucugcaggccugugaagggug

SEQ ID NO: 264171 - RNA, 22 nt, Human
cacugguacacugaauggcguu

SEQ ID NO: 264172 - RNA, 22 nt, Human
ggcagguggauuuucuacucua

SEQ ID NO: 264173 - RNA, 22 nt, Human
ucccagagcccaaguuggagag

SEQ ID NO: 264174 - RNA, 22 nt, Human
gcagacuguacacuggacuuug

SEQ ID NO: 264175 - RNA, 22 nt, Human
cuggcagcugugugaagaacug

SEQ ID NO: 264176 - RNA, 22 nt, Human
caaggcaugcaaugucuucagg

SEQ ID NO: 264177 - RNA, 22 nt, Human
auggauaagucaaagaguaucc

SEQ ID NO: 264178 - RNA, 22 nt, Human
ucuguaaguguugguuauucua

SEQ ID NO: 264179 - RNA, 22 nt, Human
cagccccagcacuuagcugagu

SEQ ID NO: 264180 - RNA, 22 nt, Human
aaagauugaaagagaauuuguc

SEQ ID NO: 264181 - RNA, 21 nt, Human
ucaagacagcauauuuaagaa

SEQ ID NO: 264182 - RNA, 22 nt, Human
ucuucaaaaauacagguuuuca

SEQ ID NO: 264183 - RNA, 22 nt, Human
ucuguaucguaaucaugucugg

SEQ ID NO: 264184 - RNA, 23 nt, Human
agaggccagccuuuggagacacc

SEQ ID NO: 264185 - RNA, 22 nt, Human
uccucuggggcgugguccugga

SEQ ID NO: 264186 - RNA, 22 nt, Human
acagauuuaggacuguagcgau

SEQ ID NO: 264187 - RNA, 22 nt, Human
aaaucacuaaguuauagugugg

SEQ ID NO: 264188 - RNA, 22 nt, Human
uuuccaugaucguuauagaacu

SEQ ID NO: 264189 - RNA, 22 nt, Human
accugauguauagauucuagau

SEQ ID NO: 264190 - RNA, 22 nt, Human
augugugcaucaaugauagauc

SEQ ID NO: 264191 - RNA, 22 nt, Human
uggaccugcguaggugcugggc

SEQ ID NO: 264192 - RNA, 22 nt, Human
acaggacuagaugauaaaaugu

SEQ ID NO: 264193 - RNA, 22 nt, Human
gugauccgaugucagucgcaga

SEQ ID NO: 264194 - RNA, 22 nt, Human
aagcugaaacauuagccuaaac

SEQ ID NO: 264195 - RNA, 22 nt, Human
agugucauuccagggacccucg

SEQ ID NO: 264196 - RNA, 22 nt, Human
gccagcagguggagagaucaag

SEQ ID NO: 264197 - RNA, 22 nt, Human
caucccugguuccuguguuuaa

SEQ ID NO: 264198 - RNA, 22 nt, Human
gcuaaugaaaaauagauuauag

SEQ ID NO: 264199 - RNA, 22 nt, Human
uuacaaacugucauauaguauu

SEQ ID NO: 264200 - RNA, 22 nt, Human
auggcccaaaaccuccucccuc

SEQ ID NO: 264201 - RNA, 22 nt, Human
ugaaaguugcacauaagagaau

SEQ ID NO: 264202 - RNA, 22 nt, Human
cuuccugggucagccuggaggu

SEQ ID NO: 264203 - RNA, 19 nt, Human
uggccagguacugucugcu

SEQ ID NO: 264204 - RNA, 22 nt, Human
ugguaccauuucccaggagugu

SEQ ID NO: 264205 - RNA, 23 nt, Human
guuuuacaggugagaaaauggag

SEQ ID NO: 264206 - RNA, 22 nt, Human
aggcacugguccauuuucugca

SEQ ID NO: 264207 - RNA, 22 nt, Human
aaaguacuuugggcuauguuug

SEQ ID NO: 264208 - RNA, 22 nt, Human
gcacccagccagcaucucagag

SEQ ID NO: 264209 - RNA, 22 nt, Human
acugagaagcucgcagugaugc

SEQ ID NO: 264210 - RNA, 22 nt, Human
ugccaaguggagcucaggaauc

SEQ ID NO: 264211 - RNA, 22 nt, Human
aaaguccuguuugaaggaccug

SEQ ID NO: 264212 - RNA, 21 nt, Human
uaaaagaugacaagacagcuc

SEQ ID NO: 264213 - RNA, 22 nt, Human
accaggccuagcaaguacauua

SEQ ID NO: 264214 - RNA, 22 nt, Human
cuacccagcaccuaggcugccu

SEQ ID NO: 264215 - RNA, 22 nt, Human
uuucacauggaagcucucgaga

SEQ ID NO: 264216 - RNA, 22 nt, Human
aauggaauaccuagguggccca

SEQ ID NO: 264217 - RNA, 23 nt, Human
gcccagggacugggaaucagugg

SEQ ID NO: 264218 - RNA, 22 nt, Human
gaguccugcuuucaauucuuuu

SEQ ID NO: 264219 - RNA, 22 nt, Human
uucauacucacuccaauaacug

SEQ ID NO: 264220 - RNA, 22 nt, Human
ugguuuugcuccaguauaaaua

SEQ ID NO: 264221 - RNA, 22 nt, Human
cuagugaaauuugcaaguaauu

SEQ ID NO: 264222 - RNA, 22 nt, Human
uauuauugacuauucagaaugu

SEQ ID NO: 264223 - RNA, 22 nt, Human
uguuaacaaagguuggcugggc

SEQ ID NO: 264224 - RNA, 22 nt, Human
accaggcuccccuuggauccug

SEQ ID NO: 264225 - RNA, 22 nt, Human
aagaggaggauugaugugggag

SEQ ID NO: 264226 - RNA, 22 nt, Human
ugagauuucaggccaaggagug

SEQ ID NO: 264227 - RNA, 22 nt, Human
gugugcugcccaacucgcagau

SEQ ID NO: 264228 - RNA, 22 nt, Human
uuagaaucagguguuauaauca

SEQ ID NO: 264229 - RNA, 22 nt, Human
gaaguauuucugaguugcccag

SEQ ID NO: 264230 - RNA, 22 nt, Human
aucagaguguaaguucuuuccu

SEQ ID NO: 264231 - RNA, 22 nt, Human
acaggacuguggaaggaucucu

SEQ ID NO: 264232 - RNA, 22 nt, Human
gagugugucggucagcguggcg

SEQ ID NO: 264233 - RNA, 22 nt, Human
gaggagggccuggugucccuuc

SEQ ID NO: 264234 - RNA, 22 nt, Human
uucaugagguaccugugaucau

SEQ ID NO: 264235 - RNA, 22 nt, Human
cagaaagcucuuucaaucuugc

SEQ ID NO: 264236 - RNA, 23 nt, Human
uaucucagaggaauguaguuacu

SEQ ID NO: 264237 - RNA, 22 nt, Human
guuuaagaaaauucauguuguu

SEQ ID NO: 264238 - RNA, 22 nt, Human
agaggaacccagacagggcuuu

SEQ ID NO: 264239 - RNA, 22 nt, Human
agcaccagagcuaugggccugc

SEQ ID NO: 264240 - RNA, 22 nt, Human
ucuuguaauuaacuagaaagau

SEQ ID NO: 264241 - RNA, 22 nt, Human
gagucagaauuguauuuuaaac

SEQ ID NO: 264242 - RNA, 22 nt, Human
uauuuuugccucucagauaaaa

SEQ ID NO: 264243 - RNA, 20 nt, Human
acaauauguagaugaauagc

SEQ ID NO: 264244 - RNA, 22 nt, Human
accagugucuuauugaccaucu

SEQ ID NO: 264245 - RNA, 22 nt, Human
ugacauuuuuauaagagucaaa

SEQ ID NO: 264246 - RNA, 22 nt, Human
uauugaauuagacccuaaaaug

SEQ ID NO: 264247 - RNA, 22 nt, Human
agaaagggucacugaaagagga

SEQ ID NO: 264248 - RNA, 22 nt, Human
uuacaggaggugcuagguguuu

SEQ ID NO: 264249 - RNA, 22 nt, Human
caugucacuuuaacaaauuagu

SEQ ID NO: 264250 - RNA, 23 nt, Human
cugcuguguuggucucgauggga

SEQ ID NO: 264251 - RNA, 22 nt, Human
cauguuuaauugcgauguuuga

SEQ ID NO: 264252 - RNA, 22 nt, Human
acuguucauuuggauuucucug

SEQ ID NO: 264253 - RNA, 19 nt, Human
cuguccuuggcugcacugu

SEQ ID NO: 264254 - RNA, 22 nt, Human
agugucuguuguucagaacucu

SEQ ID NO: 264255 - RNA, 22 nt, Human
acauucccuuggcuugaagcag

SEQ ID NO: 264256 - RNA, 22 nt, Human
gcagcaggcacuuaccguugcu

SEQ ID NO: 264257 - RNA, 22 nt, Human
gccugcuggaggagccucaggg

SEQ ID NO: 264258 - RNA, 22 nt, Human
cagcaggugcugccugucaccc

SEQ ID NO: 264259 - RNA, 22 nt, Human
accuaaauucuggcugauuagg

SEQ ID NO: 264260 - RNA, 22 nt, Human
cuuccaggacaccaggguagua

SEQ ID NO: 264261 - RNA, 22 nt, Human
acucugaggagugacuagaggu

SEQ ID NO: 264262 - RNA, 22 nt, Human
uuagaagccaggauggagcagg

SEQ ID NO: 264263 - RNA, 22 nt, Human
aucugggggagcugcucaugga

SEQ ID NO: 264264 - RNA, 22 nt, Human
gucaacagagacagagacacug

SEQ ID NO: 264265 - RNA, 22 nt, Human
cagguucuggguccuggguccu

SEQ ID NO: 264266 - RNA, 22 nt, Human
uugguuuaggaacuggcuugga

SEQ ID NO: 264267 - RNA, 22 nt, Human
agaaaucuuaucaagaaaugcc

SEQ ID NO: 264268 - RNA, 22 nt, Human
acagaaguguguguguaggaau

SEQ ID NO: 264269 - RNA, 22 nt, Human
augaaaauguacauguguauaa

SEQ ID NO: 264270 - RNA, 22 nt, Human
aaaugcaaggauuuuguuaggc

SEQ ID NO: 264271 - RNA, 22 nt, Human
gcugcugucuggucugagggcu

SEQ ID NO: 264272 - RNA, 22 nt, Human
aauaaugaacauuuaaaaccug

SEQ ID NO: 264273 - RNA, 19 nt, Human
uccuagaaugaggguguug

SEQ ID NO: 264274 - RNA, 22 nt, Human
gcugccuugcuuacuccacugc

SEQ ID NO: 264275 - RNA, 22 nt, Human
uacaggaaguuacagacuauga

SEQ ID NO: 264276 - RNA, 22 nt, Human
uccuuggcuaguacuggccagc

SEQ ID NO: 264277 - RNA, 20 nt, Human
gcagugcuggugccucugcu

SEQ ID NO: 264278 - RNA, 22 nt, Human
aaaaaccucaauuacuuuugca

SEQ ID NO: 264279 - RNA, 22 nt, Human
aacagacagaaaaaugugaucu

SEQ ID NO: 264280 - RNA, 22 nt, Human
ccaggagaagcaucugagugua

SEQ ID NO: 264281 - RNA, 22 nt, Human
auucuucaucagagaugcacua

SEQ ID NO: 264282 - RNA, 22 nt, Human
auuuagguagcugucuaagugu

SEQ ID NO: 264283 - RNA, 22 nt, Human
uuugcaaaguccauugaaguua

SEQ ID NO: 264284 - RNA, 22 nt, Human
cuaagacaugcccugcaugaua

SEQ ID NO: 264285 - RNA, 22 nt, Human
ucagugauuucuggggugaggg

SEQ ID NO: 264286 - RNA, 22 nt, Human
aguuguaucugaaugcauguag

SEQ ID NO: 264287 - RNA, 22 nt, Human
uuauuuagucuagaugaauuuu

SEQ ID NO: 264288 - RNA, 22 nt, Human
agcaacuuuauuccacugggca

SEQ ID NO: 264289 - RNA, 22 nt, Human
cuuuucucugcgggucuuucau

SEQ ID NO: 264290 - RNA, 22 nt, Human
uauguuauuuucauacaacaga

SEQ ID NO: 264291 - RNA, 22 nt, Human
ggagcucaguggggggacugug

SEQ ID NO: 264292 - RNA, 22 nt, Human
uaguggcaaaagcauuuugggu

SEQ ID NO: 264293 - RNA, 22 nt, Human
aguuuuaaaugauggugguggu

SEQ ID NO: 264294 - RNA, 22 nt, Human
uugaucucuguugcugucuuug

SEQ ID NO: 264295 - RNA, 22 nt, Human
gggcucuguguucuagcucucg

SEQ ID NO: 264296 - RNA, 22 nt, Human
cauucacaauggauugcuucaa

SEQ ID NO: 264297 - RNA, 22 nt, Human
uuaguucauagaauguaacagg

SEQ ID NO: 264298 - RNA, 22 nt, Human
uuucacagcuuccacuuaagga

SEQ ID NO: 264299 - RNA, 22 nt, Human
cacagcuggggaagcugaggcc

SEQ ID NO: 264300 - RNA, 22 nt, Human
gggcugagucaucuggggccuc

SEQ ID NO: 264301 - RNA, 22 nt, Human
agugguaacuaaguccugcuua

SEQ ID NO: 264302 - RNA, 21 nt, Human
uuuauguacuucauagaguag

SEQ ID NO: 264303 - RNA, 22 nt, Human
gacaggcuggcaaugcccugcu

SEQ ID NO: 264304 - RNA, 22 nt, Human
ccugggaggcggagguugcagu

SEQ ID NO: 264305 - RNA, 18 nt, Human
ucagccuguugucugccu

SEQ ID NO: 264306 - RNA, 22 nt, Human
aaggcugagguagggccuaaaa

SEQ ID NO: 264307 - RNA, 20 nt, Human
ccacagaggacagggcugug

SEQ ID NO: 264308 - RNA, 22 nt, Human
uucugugcguaggcgaugcagu

SEQ ID NO: 264309 - RNA, 21 nt, Human
auaagcaugcugauuacauuu

SEQ ID NO: 264310 - RNA, 22 nt, Human
cucugggcacauuuuccaggac

SEQ ID NO: 264311 - RNA, 22 nt, Human
agaaauguacgauguuaugcag

SEQ ID NO: 264312 - RNA, 22 nt, Human
ugcagagaaaccaguggaggac

SEQ ID NO: 264313 - RNA, 22 nt, Human
uggcugugcggccucgggcaga

SEQ ID NO: 264314 - RNA, 22 nt, Human
acagcagaucuggcuacagguu

SEQ ID NO: 264315 - RNA, 22 nt, Human
agacagguagcaggacagauau

SEQ ID NO: 264316 - RNA, 22 nt, Human
cuuuccaagaaugcagauaccu

SEQ ID NO: 264317 - RNA, 22 nt, Human
auauaaguuaguggucauguuu

SEQ ID NO: 264318 - RNA, 20 nt, Human
cugggcucaagugauccucc

SEQ ID NO: 264319 - RNA, 22 nt, Human
acuagaaaguuuccagaguuau

SEQ ID NO: 264320 - RNA, 22 nt, Human
ugcuccugcugcaugcaucucc

SEQ ID NO: 264321 - RNA, 22 nt, Human
uggcugccagcuccucgccuug

SEQ ID NO: 264322 - RNA, 23 nt, Human
ccuccccaccagacucuaacaua

SEQ ID NO: 264323 - RNA, 22 nt, Human
ucucugugcuugacuuucccau

SEQ ID NO: 264324 - RNA, 16 nt, Human
ggguccagaucugcuc

SEQ ID NO: 264325 - RNA, 22 nt, Human
cuucuucuggacaggcagcucc

SEQ ID NO: 264326 - RNA, 23 nt, Human
uugaggagugcuuuuucuaucca

SEQ ID NO: 264327 - RNA, 22 nt, Human
gcagcacugauccuaaacuuag

SEQ ID NO: 264328 - RNA, 20 nt, Human
aaaaugaugggcagggcagg

SEQ ID NO: 264329 - RNA, 23 nt, Human
uugggcucaguggcaggaagagu

SEQ ID NO: 264330 - RNA, 22 nt, Human
uuccagagaaaagguuuauuuc

SEQ ID NO: 264331 - RNA, 22 nt, Human
gugaggggaguaaagccauguu

SEQ ID NO: 264332 - RNA, 20 nt, Human
aacugagaguucaggaggag

SEQ ID NO: 264333 - RNA, 22 nt, Human
uuugauccguugcuggugagga

SEQ ID NO: 264334 - RNA, 22 nt, Human
cagaagucuuucuguuucaccu

SEQ ID NO: 264335 - RNA, 22 nt, Human
aacucuagugcuccuuggagga

SEQ ID NO: 264336 - RNA, 22 nt, Human
uuuaguauauaaaaagagaagu

SEQ ID NO: 264337 - RNA, 22 nt, Human
gaaaggcuuaaauuguaagggc

SEQ ID NO: 264338 - RNA, 22 nt, Human
ccucagcugucuuuuccgaggu

SEQ ID NO: 264339 - RNA, 22 nt, Human
uucuaaguuucucaguuucagu

SEQ ID NO: 264340 - RNA, 22 nt, Human
ucauucggcaauaguguguuag

SEQ ID NO: 264341 - RNA, 21 nt, Human
aguguccuuuuacugugaaua

SEQ ID NO: 264342 - RNA, 22 nt, Human
gcaucuuucuguccauucagca

SEQ ID NO: 264343 - RNA, 23 nt, Human
uugguuuacaggaauaagcaggg

SEQ ID NO: 264344 - RNA, 22 nt, Human
aguggcaguggggcagggcccu

SEQ ID NO: 264345 - RNA, 22 nt, Human
uuuggcucuucccguaccauaa

SEQ ID NO: 264346 - RNA, 22 nt, Human
caugaggucagggggagccggu

SEQ ID NO: 264347 - RNA, 22 nt, Human
gugccugccccacuccucagca

SEQ ID NO: 264348 - RNA, 22 nt, Human
ugaguuugguaucuaggggguc

SEQ ID NO: 264349 - RNA, 22 nt, Human
gcuggcuggaggagggagguug

SEQ ID NO: 264350 - RNA, 22 nt, Human
gagggucccgagcccugucaga

SEQ ID NO: 264351 - RNA, 22 nt, Human
gugcccaggcccaaggcaccac

SEQ ID NO: 264352 - RNA, 22 nt, Human
cacuugaaaaucagaggaaauu

SEQ ID NO: 264353 - RNA, 22 nt, Human
gacaauugcuuuugccgaauaa

SEQ ID NO: 264354 - RNA, 22 nt, Human
uuugcaaacuuuccucuggacc

SEQ ID NO: 264355 - RNA, 22 nt, Human
cccaucccugauuuucacucgu

SEQ ID NO: 264356 - RNA, 22 nt, Human
ugcagggcaguggagguugagu

SEQ ID NO: 264357 - RNA, 22 nt, Human
ugaaccuucauaaaauuaagug

SEQ ID NO: 264358 - RNA, 22 nt, Human
uggacaggaucugagacugaga

SEQ ID NO: 264359 - RNA, 22 nt, Human
gucuggcuuuauauuugcuauu

SEQ ID NO: 264360 - RNA, 17 nt, Human
uaggugguugcuggucu

SEQ ID NO: 264361 - RNA, 22 nt, Human
uauguuuguuaucacaacuagg

SEQ ID NO: 264362 - RNA, 22 nt, Human
ggaaccuugcuagaugcugagg

SEQ ID NO: 264363 - RNA, 22 nt, Human
ccuguacauggccaucuuuacc

SEQ ID NO: 264364 - RNA, 22 nt, Human
gcugucucgccugacacuggcu

SEQ ID NO: 264365 - RNA, 22 nt, Human
uuucuacagcuggugcaacuuu

SEQ ID NO: 264366 - RNA, 22 nt, Human
ugggccucggagcacaggagac

SEQ ID NO: 264367 - RNA, 22 nt, Human
acagcugacauuggcagcuauu

SEQ ID NO: 264368 - RNA, 22 nt, Human
uucugaggcacuggcucuccca

SEQ ID NO: 264369 - RNA, 22 nt, Human
uccaggcaaggauaauaaacau

SEQ ID NO: 264370 - RNA, 22 nt, Human
guguacaguuagccaccaaauu

SEQ ID NO: 264371 - RNA, 22 nt, Human
cagggaugugaugagcugagcc

SEQ ID NO: 264372 - RNA, 22 nt, Human
agucacaggcaagagggcucca

SEQ ID NO: 264373 - RNA, 20 nt, Human
uucagagucagcaaaugcag

SEQ ID NO: 264374 - RNA, 22 nt, Human
agagcuuugggacauuugcuag

SEQ ID NO: 264375 - RNA, 22 nt, Human
ugcugaaaaguaaauaggccua

SEQ ID NO: 264376 - RNA, 20 nt, Human
acacuguucuucacacauuu

SEQ ID NO: 264377 - RNA, 20 nt, Human
uugagcuuuuaguacagaca

SEQ ID NO: 264378 - RNA, 22 nt, Human
uuacuaaguuuuaugcaacuua

SEQ ID NO: 264379 - RNA, 22 nt, Human
cugccaugugugaaaggggagg

SEQ ID NO: 264380 - RNA, 22 nt, Human
ugcuuaaacccugaucaugugu

SEQ ID NO: 264381 - RNA, 22 nt, Human
aacagugcugcauucauugagc

SEQ ID NO: 264382 - RNA, 22 nt, Human
uuuacaugucaagacuggcagu

SEQ ID NO: 264383 - RNA, 22 nt, Human
aagcccuguuaggcacugggga

SEQ ID NO: 264384 - RNA, 22 nt, Human
gaggagcccuguuccccaggcc

SEQ ID NO: 264385 - RNA, 22 nt, Human
acugggcuuaugcuguggagua

SEQ ID NO: 264386 - RNA, 22 nt, Human
ucagcagaaguauagaggccau

SEQ ID NO: 264387 - RNA, 22 nt, Human
aaagccaucuguauuaagugaa

SEQ ID NO: 264388 - RNA, 21 nt, Human
agcagguguaaaggaggaaau

SEQ ID NO: 264389 - RNA, 22 nt, Human
uccuggccuagcucacccugga

SEQ ID NO: 264390 - RNA, 22 nt, Human
ugcaccccauuuuacauuuaca

SEQ ID NO: 264391 - RNA, 21 nt, Human
ucccucagaagcucuugguca

SEQ ID NO: 264392 - RNA, 22 nt, Human
uaaucuagaacauaugagagca

SEQ ID NO: 264393 - RNA, 22 nt, Human
ugugcuauuacacauuuauuua

SEQ ID NO: 264394 - RNA, 22 nt, Human
caguucaaaguuaagcagcagu

SEQ ID NO: 264395 - RNA, 22 nt, Human
ggcugcugaguuggccaggaga

SEQ ID NO: 264396 - RNA, 22 nt, Human
guuccaggcaagugggauagga

SEQ ID NO: 264397 - RNA, 22 nt, Human
agcugggccugagcuggaagcu

SEQ ID NO: 264398 - RNA, 22 nt, Human
guagcuuacaucagaguugguu

SEQ ID NO: 264399 - RNA, 20 nt, Human
aaguuuucuccaaauacagu

SEQ ID NO: 264400 - RNA, 22 nt, Human
aauagacaauucuagccaacau

SEQ ID NO: 264401 - RNA, 22 nt, Human
ugggccagggcacccaguccag

SEQ ID NO: 264402 - RNA, 22 nt, Human
cagaggcaggaagaugggcagu

SEQ ID NO: 264403 - RNA, 22 nt, Human
ucuaacuugugaguauagauga

SEQ ID NO: 264404 - RNA, 22 nt, Human
aagugauuucugccugcauguu

SEQ ID NO: 264405 - RNA, 22 nt, Human
ucucagguaagcuucuuugaug

SEQ ID NO: 264406 - RNA, 22 nt, Human
uuuuuaaugcagucugagacau

SEQ ID NO: 264407 - RNA, 22 nt, Human
uaggaaacuaauacagucugga

SEQ ID NO: 264408 - RNA, 22 nt, Human
uguacaguguaaauaaguggau

SEQ ID NO: 264409 - RNA, 22 nt, Human
uggguucuuaaagggcuagguu

SEQ ID NO: 264410 - RNA, 22 nt, Human
uacuauuuggaauuuuaaauug

SEQ ID NO: 264411 - RNA, 22 nt, Human
aacaugaaaacuaccugugauu

SEQ ID NO: 264412 - RNA, 19 nt, Human
uuacuucaggagugaaauu

SEQ ID NO: 264413 - RNA, 22 nt, Human
ugaaaugaaugugauucgauag

SEQ ID NO: 264414 - RNA, 22 nt, Human
uccauucuuuugcugucuuccu

SEQ ID NO: 264415 - RNA, 22 nt, Human
augcuuagguuaaauuuguaau

SEQ ID NO: 264416 - RNA, 22 nt, Human
aggucaaggcugcagugagcug

SEQ ID NO: 264417 - RNA, 22 nt, Human
cucuuuggauagaauuacaaag

SEQ ID NO: 264418 - RNA, 22 nt, Human
uccauguguuuuccuguccaca

SEQ ID NO: 264419 - RNA, 22 nt, Human
ugaggguagaggcaggagugca

SEQ ID NO: 264420 - RNA, 22 nt, Human
cagguggcugagcugaccuuug

SEQ ID NO: 264421 - RNA, 18 nt, Human
cugaggccaacuacacug

SEQ ID NO: 264422 - RNA, 22 nt, Human
cugaggcugcccagggccaggu

SEQ ID NO: 264423 - RNA, 22 nt, Human
aaugaacaucaaaugccuacca

SEQ ID NO: 264424 - RNA, 22 nt, Human
agcuuacuguaauuaaaagacu

SEQ ID NO: 264425 - RNA, 20 nt, Human
aacacugagggcuacucuuc

SEQ ID NO: 264426 - RNA, 22 nt, Human
uaaaugaagaaauggagauugu

SEQ ID NO: 264427 - RNA, 22 nt, Human
caugcagggacuugugcuccau

SEQ ID NO: 264428 - RNA, 22 nt, Human
ccaagcuggauuuagcugcaca

SEQ ID NO: 264429 - RNA, 22 nt, Human
gcaauuauaucaccagagaucu

SEQ ID NO: 264430 - RNA, 22 nt, Human
uucuguaggcacacaguuucaa

SEQ ID NO: 264431 - RNA, 22 nt, Human
uuaaagcuagguggaacaaauu

SEQ ID NO: 264432 - RNA, 22 nt, Human
ugacagguuguguagguggcca

SEQ ID NO: 264433 - RNA, 22 nt, Human
cccuccuggaggcggaugccca

SEQ ID NO: 264434 - RNA, 22 nt, Human
ccugaguggccaggcagcugug

SEQ ID NO: 264435 - RNA, 22 nt, Human
gaaugcagauggcugguguaug

SEQ ID NO: 264436 - RNA, 22 nt, Human
auuaaauguuggcauauuuugu

SEQ ID NO: 264437 - RNA, 22 nt, Human
ucacaagacagaaaacauuuag

SEQ ID NO: 264438 - RNA, 22 nt, Human
gucuguagauauucacuccuuc

SEQ ID NO: 264439 - RNA, 22 nt, Human
aggaggcuuuugcaggugccac

SEQ ID NO: 264440 - RNA, 22 nt, Human
agggguggagaguguugccagu

SEQ ID NO: 264441 - RNA, 22 nt, Human
ucucaguguguuuucucucaga

SEQ ID NO: 264442 - RNA, 22 nt, Human
caucuguugcuuccuaacaagu

SEQ ID NO: 264443 - RNA, 22 nt, Human
ucagaaccagcccagcagauga

SEQ ID NO: 264444 - RNA, 22 nt, Human
gaaacugaauauaagaaaggua

SEQ ID NO: 264445 - RNA, 22 nt, Human
aaauuuuaaggcuggaacuuaa

SEQ ID NO: 264446 - RNA, 22 nt, Human
uccuggggcugcaaggccuguc

SEQ ID NO: 264447 - RNA, 22 nt, Human
gggcuucucuuaugcuaacugg

SEQ ID NO: 264448 - RNA, 22 nt, Human
ucaggcagaggauggggagcgu

SEQ ID NO: 264449 - RNA, 19 nt, Human
gacuuuggaaaugcuguuu

SEQ ID NO: 264450 - RNA, 22 nt, Human
uuuguuuagagaauugaagcag

SEQ ID NO: 264451 - RNA, 22 nt, Human
auaacuuagaguaggcaaaagu

SEQ ID NO: 264452 - RNA, 22 nt, Human
gagggcugauaaaugcgcaugg

SEQ ID NO: 264453 - RNA, 22 nt, Human
cagaggcagacccuccagggcg

SEQ ID NO: 264454 - RNA, 22 nt, Human
ccaaaguccauaguuuacuuua

SEQ ID NO: 264455 - RNA, 22 nt, Human
uuuaauguuugagucaguauau

SEQ ID NO: 264456 - RNA, 22 nt, Human
uccugaaauucugguugucacu

SEQ ID NO: 264457 - RNA, 22 nt, Human
guuuccugcacacguguuauau

SEQ ID NO: 264458 - RNA, 21 nt, Human
acccaggggaagcagaaacug

SEQ ID NO: 264459 - RNA, 22 nt, Human
ucaagcaaguguuugguguaaa

SEQ ID NO: 264460 - RNA, 22 nt, Human
aagcaggaaggagcccagggca

SEQ ID NO: 264461 - RNA, 22 nt, Human
aaagcagucucagacuuaagca

SEQ ID NO: 264462 - RNA, 22 nt, Human
acugcaccuguguaccaagaug

SEQ ID NO: 264463 - RNA, 18 nt, Human
aauuuccauaugaauugc

SEQ ID NO: 264464 - RNA, 22 nt, Human
uuaggaaauuaugguuucagau

SEQ ID NO: 264465 - RNA, 22 nt, Human
ucuugagaaauaauuaaacaug

SEQ ID NO: 264466 - RNA, 22 nt, Human
gcuuagaaguacacaugccuuu

SEQ ID NO: 264467 - RNA, 22 nt, Human
ugggcagggagcuggaaccaca

SEQ ID NO: 264468 - RNA, 22 nt, Human
uguuuguagagacagcugaugc

SEQ ID NO: 264469 - RNA, 22 nt, Human
ucugccuuucacacagacggcc

SEQ ID NO: 264470 - RNA, 17 nt, Human
agccagguacaagucca

SEQ ID NO: 264471 - RNA, 22 nt, Human
cucccggcacuuggcaugucau

SEQ ID NO: 264472 - RNA, 22 nt, Human
uuuaccaaauagauuaugucag

SEQ ID NO: 264473 - RNA, 22 nt, Human
ugcauuuaccuggaggucauuu

SEQ ID NO: 264474 - RNA, 22 nt, Human
uguucucaucuggaucucagga

SEQ ID NO: 264475 - RNA, 22 nt, Human
agagaaacugauguccuuugaa

SEQ ID NO: 264476 - RNA, 22 nt, Human
ucuggcuuggacacaaucuucc

SEQ ID NO: 264477 - RNA, 22 nt, Human
cacuuaagcaguuaauuuaucu

SEQ ID NO: 264478 - RNA, 22 nt, Human
augagugugaaguuagcucagu

SEQ ID NO: 264479 - RNA, 22 nt, Human
cagagaaagggugaauuccuuc

SEQ ID NO: 264480 - RNA, 22 nt, Human
cuggucagagcaacugcucaca

SEQ ID NO: 264481 - RNA, 22 nt, Human
ccuuagcaacugucauagagca

SEQ ID NO: 264482 - RNA, 22 nt, Human
aauuugcaugaugagaacaaua

SEQ ID NO: 264483 - RNA, 22 nt, Human
ccugcuuaacauugccaugaca

SEQ ID NO: 264484 - RNA, 22 nt, Human
agcugcaaagaugauuuguugu

SEQ ID NO: 264485 - RNA, 20 nt, Human
agagagcacaggcaggaaag

SEQ ID NO: 264486 - RNA, 22 nt, Human
ccugggcucugucagaauuggg

SEQ ID NO: 264487 - RNA, 22 nt, Human
augaagcaggcacagcuucagg

SEQ ID NO: 264488 - RNA, 22 nt, Human
cccagggcugcagauggaggcu

SEQ ID NO: 264489 - RNA, 22 nt, Human
gucuguuagugauaacuguuuu

SEQ ID NO: 264490 - RNA, 22 nt, Human
uacugucuuuagggguagaaau

SEQ ID NO: 264491 - RNA, 22 nt, Human
ugagaugcuaaagggcugcuca

SEQ ID NO: 264492 - RNA, 22 nt, Human
ucaucuuuaccccuugcuucaa

SEQ ID NO: 264493 - RNA, 22 nt, Human
cccaagagguggagguugcagu

SEQ ID NO: 264494 - RNA, 22 nt, Human
caagcagagagguuagaacaca

SEQ ID NO: 264495 - RNA, 22 nt, Human
cagcagcuggugagacacagcc

SEQ ID NO: 264496 - RNA, 22 nt, Human
gaaauccaguucccuacucuua

SEQ ID NO: 264497 - RNA, 22 nt, Human
ccaggcagggagcuguuuggcc

SEQ ID NO: 264498 - RNA, 18 nt, Human
ugcuccaggcccaugggc

SEQ ID NO: 264499 - RNA, 22 nt, Human
aggcagcaauugaaaucauugu

SEQ ID NO: 264500 - RNA, 22 nt, Human
cucugagaagaguucaaguaaa

SEQ ID NO: 264501 - RNA, 20 nt, Human
ggcagagggccugggagaag

SEQ ID NO: 264502 - RNA, 22 nt, Human
aguuaggacacuugagggcuaa

SEQ ID NO: 264503 - RNA, 22 nt, Human
gccauugaugugaaaguaagac

SEQ ID NO: 264504 - RNA, 22 nt, Human
gucuucuguaagaugagguccc

SEQ ID NO: 264505 - RNA, 22 nt, Human
uagcuauuuugcuuggaaauac

SEQ ID NO: 264506 - RNA, 22 nt, Human
cuuuacuucucaaaauaaagca

SEQ ID NO: 264507 - RNA, 22 nt, Human
uagugcagguuaauaggacuuc

SEQ ID NO: 264508 - RNA, 22 nt, Human
acuuucauuuguaauaaacuuc

SEQ ID NO: 264509 - RNA, 17 nt, Human
uccagccuccucugcug

SEQ ID NO: 264510 - RNA, 22 nt, Human
ccuggcucccuggaccucauua

SEQ ID NO: 264511 - RNA, 22 nt, Human
uccuggcagagagcaugaggcc

SEQ ID NO: 264512 - RNA, 22 nt, Human
ugaucuuugggccauuaauaaa

SEQ ID NO: 264513 - RNA, 22 nt, Human
cacaggagugcugcuauuguug

SEQ ID NO: 264514 - RNA, 22 nt, Human
ugaggcucagagaagugcuguu

SEQ ID NO: 264515 - RNA, 22 nt, Human
gugugcuguuguucagguagaa

SEQ ID NO: 264516 - RNA, 22 nt, Human
cagugcagccaaggacaggcac

SEQ ID NO: 264517 - RNA, 22 nt, Human
cacagcaagagcuaaaugacca

SEQ ID NO: 264518 - RNA, 22 nt, Human
ucucuggagcugcagauccagg

SEQ ID NO: 264519 - RNA, 22 nt, Human
gagcccucaccgccugaccagg

SEQ ID NO: 264520 - RNA, 22 nt, Human
acagagcuguacaugugccaug

SEQ ID NO: 264521 - RNA, 22 nt, Human
cugcugccaagggugccacagg

SEQ ID NO: 264522 - RNA, 22 nt, Human
agggaauucacuggaacgcccu

SEQ ID NO: 264523 - RNA, 22 nt, Human
agggcagcacaaggcauggacu

SEQ ID NO: 264524 - RNA, 22 nt, Human
cagccagaucagggcagggguu

SEQ ID NO: 264525 - RNA, 22 nt, Human
ucaggaggaugucggcaaauuu

SEQ ID NO: 264526 - RNA, 22 nt, Human
aagagcacuaacagagcugaua

SEQ ID NO: 264527 - RNA, 22 nt, Human
cuucucccugggggcucuuuau

SEQ ID NO: 264528 - RNA, 22 nt, Human
aggccacagagagugcaugugc

SEQ ID NO: 264529 - RNA, 22 nt, Human
uuccuggccuaagguaggugac

SEQ ID NO: 264530 - RNA, 22 nt, Human
gugacuuuaacuucagauuaga

SEQ ID NO: 264531 - RNA, 22 nt, Human
uggacaggugagugacucaggg

SEQ ID NO: 264532 - RNA, 22 nt, Human
gcuuccaggucauucucacccu

SEQ ID NO: 264533 - RNA, 22 nt, Human
auucuucacuguuucagaauga

SEQ ID NO: 264534 - RNA, 22 nt, Human
gaaggccauuuuuagguagaau

SEQ ID NO: 264535 - RNA, 22 nt, Human
gugggcugcccuugaggucagc

SEQ ID NO: 264536 - RNA, 22 nt, Human
ugaucuccugaccuuguaaucc

SEQ ID NO: 264537 - RNA, 22 nt, Human
caaaugcuaacuucuuuccaaa

SEQ ID NO: 264538 - RNA, 20 nt, Human
ccucaaauaagugccagcau

SEQ ID NO: 264539 - RNA, 22 nt, Human
acagagagaggcccgaggcugc

SEQ ID NO: 264540 - RNA, 22 nt, Human
acagcugcacuugaagcagguu

SEQ ID NO: 264541 - RNA, 22 nt, Human
cagccagaaaguauguuaggga

SEQ ID NO: 264542 - RNA, 22 nt, Human
aaauuacagaucaccaaugcau

SEQ ID NO: 264543 - RNA, 22 nt, Human
cauggcaggaaaaugaacaggc

SEQ ID NO: 264544 - RNA, 22 nt, Human
cucuucuugaaagaggaauuca

SEQ ID NO: 264545 - RNA, 22 nt, Human
auuauucaaauucccacuauac

SEQ ID NO: 264546 - RNA, 22 nt, Human
uccugggacucugccucaggcu

SEQ ID NO: 264547 - RNA, 22 nt, Human
cuggaaaggguccucauucugu

SEQ ID NO: 264548 - RNA, 22 nt, Human
cucacagguucugcagcucaca

SEQ ID NO: 264549 - RNA, 22 nt, Human
uuugacucuuagcccaggacuc

SEQ ID NO: 264550 - RNA, 22 nt, Human
uucacauuugaaaggaaagaua

SEQ ID NO: 264551 - RNA, 22 nt, Human
caucuagaaaaaagaccuguug

SEQ ID NO: 264552 - RNA, 22 nt, Human
ucauuguauuaaaauauugguu

SEQ ID NO: 264553 - RNA, 22 nt, Human
cuguggagcuuguggcaguggg

SEQ ID NO: 264554 - RNA, 22 nt, Human
uagagacagaaaguagaauggu

SEQ ID NO: 264555 - RNA, 22 nt, Human
ggccucuguucugcauuccucc

SEQ ID NO: 264556 - RNA, 22 nt, Human
aacaaauggaacacaaaucuuu

SEQ ID NO: 264557 - RNA, 22 nt, Human
ggauugagagcacugguagcug

SEQ ID NO: 264558 - RNA, 22 nt, Human
caagauuugccaguggccaacu

SEQ ID NO: 264559 - RNA, 22 nt, Human
ucagcaggcagaaaucugcaga

SEQ ID NO: 264560 - RNA, 20 nt, Human
auucugcuuucugauagagc

SEQ ID NO: 264561 - RNA, 22 nt, Human
ugagcaggugagucuagggcag

SEQ ID NO: 264562 - RNA, 22 nt, Human
ucacacauuugaaggccuguca

SEQ ID NO: 264563 - RNA, 22 nt, Human
cugguacaguguuacaaaaugg

SEQ ID NO: 264564 - RNA, 22 nt, Human
ccacagaagauggggagagugg

SEQ ID NO: 264565 - RNA, 21 nt, Human
uugacaggaaagaggggagau

SEQ ID NO: 264566 - RNA, 22 nt, Human
ugcucuagcucauaggacucau

SEQ ID NO: 264567 - RNA, 22 nt, Human
uugugucccccuuugagagcca

SEQ ID NO: 264568 - RNA, 19 nt, Human
uccaugcccaggcaccaag

SEQ ID NO: 264569 - RNA, 22 nt, Human
uaagacacauuggaguagauga

SEQ ID NO: 264570 - RNA, 22 nt, Human
cacugucuguguguccuugggg

SEQ ID NO: 264571 - RNA, 22 nt, Human
gucagcaaggugcaagcggcug

SEQ ID NO: 264572 - RNA, 23 nt, Human
ucaauuaucaauggaaagaaguu

SEQ ID NO: 264573 - RNA, 22 nt, Human
uucuccagacccuccugcagac

SEQ ID NO: 264574 - RNA, 22 nt, Human
gaagaacaccugcugcccagug

SEQ ID NO: 264575 - RNA, 22 nt, Human
gccaaaggaccugugggugaca

SEQ ID NO: 264576 - RNA, 23 nt, Human
aagcacagaaugguuuaggaguu

SEQ ID NO: 264577 - RNA, 22 nt, Human
aaacuacaucucauggaugagg

SEQ ID NO: 264578 - RNA, 22 nt, Human
uagcaaguagauacucauuuag

SEQ ID NO: 264579 - RNA, 22 nt, Human
caucuuugaacucuguauaaac

SEQ ID NO: 264580 - RNA, 19 nt, Human
ugcccugcacgcuguccug

SEQ ID NO: 264581 - RNA, 22 nt, Human
acugacuuuggaauauuucuag

SEQ ID NO: 264582 - RNA, 22 nt, Human
gaggcugggggcugccuuccuc

SEQ ID NO: 264583 - RNA, 22 nt, Human
uguaugcaccauuguauuaccu

SEQ ID NO: 264584 - RNA, 22 nt, Human
acauuaucccuggcacaacugc

SEQ ID NO: 264585 - RNA, 22 nt, Human
uugacucauaccugccugaccc

SEQ ID NO: 264586 - RNA, 22 nt, Human
ccucagaggugaacaucagugc

SEQ ID NO: 264587 - RNA, 22 nt, Human
auucugggaacuuugucucuca

SEQ ID NO: 264588 - RNA, 22 nt, Human
ccugcaggcugcaggccaguuc

SEQ ID NO: 264589 - RNA, 22 nt, Human
caggagugcagguggugaggca

SEQ ID NO: 264590 - RNA, 22 nt, Human
ccaagcagucugcuaggaguuu

SEQ ID NO: 264591 - RNA, 22 nt, Human
ggcagccuugagggaggccugg

SEQ ID NO: 264592 - RNA, 22 nt, Human
auuggucuccacuuguuuuaga

SEQ ID NO: 264593 - RNA, 20 nt, Human
cagagcccacuuucuuauca

SEQ ID NO: 264594 - RNA, 22 nt, Human
aaggcuuucagcuaacuugauu

SEQ ID NO: 264595 - RNA, 22 nt, Human
auuuccaggcuguuuugugaau

SEQ ID NO: 264596 - RNA, 22 nt, Human
gccaccuccuuauuccaccugu

SEQ ID NO: 264597 - RNA, 22 nt, Human
cuggcagcucuacucagagccu

SEQ ID NO: 264598 - RNA, 22 nt, Human
uggggcagggaugggaaacuau

SEQ ID NO: 264599 - RNA, 22 nt, Human
cugugugccuagaggguggccg

SEQ ID NO: 264600 - RNA, 22 nt, Human
aacgugcaccaggaggucauga

SEQ ID NO: 264601 - RNA, 22 nt, Human
cagcuccagcccaggcagcucc

SEQ ID NO: 264602 - RNA, 22 nt, Human
aaguaaaagcaggugugcuggg

SEQ ID NO: 264603 - RNA, 22 nt, Human
cacaugaugguggaagccauag

SEQ ID NO: 264604 - RNA, 22 nt, Human
gcucugagugauuaaggagcuu

SEQ ID NO: 264605 - RNA, 22 nt, Human
caccagcuugggcuguggaaau

SEQ ID NO: 264606 - RNA, 22 nt, Human
cagcaagauggugaaugagacg

SEQ ID NO: 264607 - RNA, 22 nt, Human
acacuugauaggucaaaucagu

SEQ ID NO: 264608 - RNA, 22 nt, Human
auuauucaaucauauuaaaagu

SEQ ID NO: 264609 - RNA, 22 nt, Human
gcuggccugggcagccugucgg

SEQ ID NO: 264610 - RNA, 23 nt, Human
uccaggagcaugcuggcuggcga

SEQ ID NO: 264611 - RNA, 22 nt, Human
ugcaggaaguuuccugaacuuu

SEQ ID NO: 264612 - RNA, 22 nt, Human
acucuggccccaggaucugugu

SEQ ID NO: 264613 - RNA, 22 nt, Human
ugcugaggcuagaccuggaagu

SEQ ID NO: 264614 - RNA, 22 nt, Human
gucucugugcccccauuuccgu

SEQ ID NO: 264615 - RNA, 22 nt, Human
auuucucauuuugcuucaaagg

SEQ ID NO: 264616 - RNA, 22 nt, Human
aagugucuagcaccuggaugca

SEQ ID NO: 264617 - RNA, 23 nt, Human
ccuggggcacuugaguccucauc

SEQ ID NO: 264618 - RNA, 22 nt, Human
ugcuuagacgucaaguacagcc

SEQ ID NO: 264619 - RNA, 22 nt, Human
gaacugggaaugcugucccauc

SEQ ID NO: 264620 - RNA, 22 nt, Human
agcugcuuguacaugaccacau

SEQ ID NO: 264621 - RNA, 22 nt, Human
gggcacuggcagucggggacgc

SEQ ID NO: 264622 - RNA, 22 nt, Human
caaaugcagauucaggaguucu

SEQ ID NO: 264623 - RNA, 23 nt, Human
cuuuucauugccuuagcgcagag

SEQ ID NO: 264624 - RNA, 22 nt, Human
ccagaaguggcuuucucaggga

SEQ ID NO: 264625 - RNA, 22 nt, Human
accccaggaaguggaggucaug

SEQ ID NO: 264626 - RNA, 22 nt, Human
ugucucagguacaugcguccug

SEQ ID NO: 264627 - RNA, 22 nt, Human
aaucaucuccgaaaaaagagua

SEQ ID NO: 264628 - RNA, 22 nt, Human
aagaugcagcuuuacaauaagg

SEQ ID NO: 264629 - RNA, 22 nt, Human
uacuuuggauccuuacaauagc

SEQ ID NO: 264630 - RNA, 22 nt, Human
guuuacauauuuuaauugguga

SEQ ID NO: 264631 - RNA, 22 nt, Human
caugcaggaggaaaaagcagcu

SEQ ID NO: 264632 - RNA, 23 nt, Human
uucaugagauuaucugcaugugu

SEQ ID NO: 264633 - RNA, 22 nt, Human
aacauuuccggccuuuuguucu

SEQ ID NO: 264634 - RNA, 22 nt, Human
uccugugcuuuggaugcuuaga

SEQ ID NO: 264635 - RNA, 22 nt, Human
cauuuacauuuaagguuaauau

SEQ ID NO: 264636 - RNA, 22 nt, Human
uuugacucugggugcuuuuucg

SEQ ID NO: 264637 - RNA, 21 nt, Human
agcuuguuauuaauucagaac

SEQ ID NO: 264638 - RNA, 22 nt, Human
cuauuucagcagaagccggaga

SEQ ID NO: 264639 - RNA, 21 nt, Human
cccgcaucuuccucuccagca

SEQ ID NO: 264640 - RNA, 22 nt, Human
caaaugaugcauggcuagugag

SEQ ID NO: 264641 - RNA, 22 nt, Human
ugcauaggguucaaaggcugua

SEQ ID NO: 264642 - RNA, 22 nt, Human
ugcagguggccaucuucguucu

SEQ ID NO: 264643 - RNA, 22 nt, Human
ucacauaaauuauacaauuuca

SEQ ID NO: 264644 - RNA, 22 nt, Human
cuguccugaaagggagauuggg

SEQ ID NO: 264645 - RNA, 22 nt, Human
aaacugcaggucaugacccauu

SEQ ID NO: 264646 - RNA, 22 nt, Human
ugcaacaggcugugacauggaa

SEQ ID NO: 264647 - RNA, 22 nt, Human
caugcagcagaauaaugacuau

SEQ ID NO: 264648 - RNA, 22 nt, Human
auccugggcaguuuugagugcu

SEQ ID NO: 264649 - RNA, 20 nt, Human
gaggcugcggacugcuggac

SEQ ID NO: 264650 - RNA, 22 nt, Human
uggggauguagaaaugaacaac

SEQ ID NO: 264651 - RNA, 22 nt, Human
uggcccugaggggcugugcccc

SEQ ID NO: 264652 - RNA, 22 nt, Human
augcaaagcacacacagaaucc

SEQ ID NO: 264653 - RNA, 22 nt, Human
cuagggcacuaggacucaugug

SEQ ID NO: 264654 - RNA, 22 nt, Human
gauguguagagggaauuucaaa

SEQ ID NO: 264655 - RNA, 22 nt, Human
aaggcagaaagggaugugagug

SEQ ID NO: 264656 - RNA, 22 nt, Human
aaacagcuggucucaaauguuc

SEQ ID NO: 264657 - RNA, 22 nt, Human
ccagagaguaucauggagagua

SEQ ID NO: 264658 - RNA, 21 nt, Human
gcugcaaauucuaacaauuau

SEQ ID NO: 264659 - RNA, 22 nt, Human
aagugauuauuguuuucagguu

SEQ ID NO: 264660 - RNA, 22 nt, Human
aggcacaagaaacugcucccca

SEQ ID NO: 264661 - RNA, 22 nt, Human
gcaggcucguuggaaguccccu

SEQ ID NO: 264662 - RNA, 22 nt, Human
uuucaguuugaaggaaaggcca

SEQ ID NO: 264663 - RNA, 22 nt, Human
gugcauuaguuuccuauugcug

SEQ ID NO: 264664 - RNA, 20 nt, Human
ucucgcacucggagcagccg

SEQ ID NO: 264665 - RNA, 22 nt, Human
aggaaaaaagucugugauuaua

SEQ ID NO: 264666 - RNA, 22 nt, Human
gggagcauuucccuguguugaa

SEQ ID NO: 264667 - RNA, 22 nt, Human
ccaaaauauuagugcuuaagua

SEQ ID NO: 264668 - RNA, 19 nt, Human
ccugggccuccaucacccc

SEQ ID NO: 264669 - RNA, 22 nt, Human
ggugacggggcccagguuuccu

SEQ ID NO: 264670 - RNA, 22 nt, Human
uagcccucuuuaauccuucccu

SEQ ID NO: 264671 - RNA, 22 nt, Human
gaauguuauugaacuacgagcu

SEQ ID NO: 264672 - RNA, 22 nt, Human
uccuggauuuaacccuggcucu

SEQ ID NO: 264673 - RNA, 22 nt, Human
auggcuauuuuagagaucaagg

SEQ ID NO: 264674 - RNA, 22 nt, Human
cucaguuuuuuuaagagccaug

SEQ ID NO: 264675 - RNA, 22 nt, Human
ggccugagcucuggggaggcaa

SEQ ID NO: 264676 - RNA, 22 nt, Human
ucaacaaauacuuaaagcagag

SEQ ID NO: 264677 - RNA, 22 nt, Human
aaguacauggaggauagcugcu

SEQ ID NO: 264678 - RNA, 22 nt, Human
aguuacaaccaugacacaagca

SEQ ID NO: 264679 - RNA, 19 nt, Human
uagguguccgccggaggug

SEQ ID NO: 264680 - RNA, 22 nt, Human
agcccagguugaggcugcagug

SEQ ID NO: 264681 - RNA, 22 nt, Human
aaaaagucugcaaaggagguug

SEQ ID NO: 264682 - RNA, 22 nt, Human
cuccuggagggccaaagaaaua

SEQ ID NO: 264683 - RNA, 22 nt, Human
aguaagcaauagagugagaauu

SEQ ID NO: 264684 - RNA, 22 nt, Human
acagugugguuugagcacuggg

SEQ ID NO: 264685 - RNA, 22 nt, Human
gauucaaaguuaaugaagaugc

SEQ ID NO: 264686 - RNA, 22 nt, Human
caggaagcaucuggcuagcuaa

SEQ ID NO: 264687 - RNA, 22 nt, Human
gaagcaaaaugucugcacauau

SEQ ID NO: 264688 - RNA, 22 nt, Human
uuacauaguuaaauaguacagc

SEQ ID NO: 264689 - RNA, 22 nt, Human
ucuucuccaguucauccuacca

SEQ ID NO: 264690 - RNA, 22 nt, Human
aggaaacugggccucagguuag

SEQ ID NO: 264691 - RNA, 22 nt, Human
aaaggcuucuuugcuccauguc

SEQ ID NO: 264692 - RNA, 22 nt, Human
ccugagagggggcccuagaaau

SEQ ID NO: 264693 - RNA, 22 nt, Human
agagaauucuggugcuaacaag

SEQ ID NO: 264694 - RNA, 22 nt, Human
ccucuccccucccaaggcggga

SEQ ID NO: 264695 - RNA, 22 nt, Human
caugacauccugaagcugcaca

SEQ ID NO: 264696 - RNA, 22 nt, Human
ugagaugcugggaacaaggaag

SEQ ID NO: 264697 - RNA, 22 nt, Human
aggcuccagccaaugggucugu

SEQ ID NO: 264698 - RNA, 22 nt, Human
aggcuucugugagcucauacaa

SEQ ID NO: 264699 - RNA, 22 nt, Human
ccuggcucauuaugugccccca

SEQ ID NO: 264700 - RNA, 22 nt, Human
cagggcauaagaugaggcugua

SEQ ID NO: 264701 - RNA, 22 nt, Human
aggcuugcacaugcacgcacgu

SEQ ID NO: 264702 - RNA, 22 nt, Human
agcaggugcauggcgagcgcgg

SEQ ID NO: 264703 - RNA, 22 nt, Human
acacaaugugcaggacaccugu

SEQ ID NO: 264704 - RNA, 22 nt, Human
aauguacaucucaguguaguac

SEQ ID NO: 264705 - RNA, 22 nt, Human
ggggccucugcagucacgcugg

SEQ ID NO: 264706 - RNA, 22 nt, Human
aacuccaggcagggaggccacu

SEQ ID NO: 264707 - RNA, 22 nt, Human
ggcaggcaacggaccacuaguc

SEQ ID NO: 264708 - RNA, 22 nt, Human
uauuuucauucugugugacugu

SEQ ID NO: 264709 - RNA, 22 nt, Human
ugcuagggauauaguggcgagu

SEQ ID NO: 264710 - RNA, 22 nt, Human
guccuucauuuccugaucucua

SEQ ID NO: 264711 - RNA, 22 nt, Human
gaggagccuggccccacaucca

SEQ ID NO: 264712 - RNA, 23 nt, Human
auaauaauuauggcagcaaagug

SEQ ID NO: 264713 - RNA, 22 nt, Human
ugucuuuucuacuguaagcaua

SEQ ID NO: 264714 - RNA, 22 nt, Human
acaagcuuugugauaguagaga

SEQ ID NO: 264715 - RNA, 22 nt, Human
aauaguacaaucuacagacaua

SEQ ID NO: 264716 - RNA, 22 nt, Human
guccuuggcuugaggcaccuca

SEQ ID NO: 264717 - RNA, 23 nt, Human
uguaaaaugggguaguguuacca

SEQ ID NO: 264718 - RNA, 22 nt, Human
aaggcaauguuagcaacauaau

SEQ ID NO: 264719 - RNA, 22 nt, Human
cucucuggauauuuguaugcug

SEQ ID NO: 264720 - RNA, 22 nt, Human
ucucucugccaacucacagcca

SEQ ID NO: 264721 - RNA, 22 nt, Human
ucaggucuguacuauugucuug

SEQ ID NO: 264722 - RNA, 23 nt, Human
aagucagagccaagucaaugaga

SEQ ID NO: 264723 - RNA, 22 nt, Human
agauauauuuccugcccaaggc

SEQ ID NO: 264724 - RNA, 22 nt, Human
guugcugaaauuaauauuggag

SEQ ID NO: 264725 - RNA, 21 nt, Human
gcuggcuuccugagggcugag

SEQ ID NO: 264726 - RNA, 22 nt, Human
gccuggcuucccuuggagcauu

SEQ ID NO: 264727 - RNA, 22 nt, Human
ccugggucccaucccagaguga

SEQ ID NO: 264728 - RNA, 20 nt, Human
ucaggcaguggggaaaggca

SEQ ID NO: 264729 - RNA, 22 nt, Human
aaagcuuuucaguauguucaug

SEQ ID NO: 264730 - RNA, 22 nt, Human
cuucaguuagccaauucagguc

SEQ ID NO: 264731 - RNA, 22 nt, Human
augucuuucucauacaagccca

SEQ ID NO: 264732 - RNA, 22 nt, Human
ugugggaugguuuugccagaau

SEQ ID NO: 264733 - RNA, 22 nt, Human
uagccagugaauguuuccagug

SEQ ID NO: 264734 - RNA, 22 nt, Human
gccuggggggcaugucauaaua

SEQ ID NO: 264735 - RNA, 22 nt, Human
uacagaauagaauagggacagg

SEQ ID NO: 264736 - RNA, 22 nt, Human
gggcuguggagccgcgagggcu

SEQ ID NO: 264737 - RNA, 19 nt, Human
cccagagagaucucuugcc

SEQ ID NO: 264738 - RNA, 22 nt, Human
uugaaguuguaguucagugaag

SEQ ID NO: 264739 - RNA, 22 nt, Human
aggaugagauuccagggucaau

SEQ ID NO: 264740 - RNA, 22 nt, Human
aguguuaaugguguauauuagg

SEQ ID NO: 264741 - RNA, 22 nt, Human
uucucugcagcuuaggcccagu

SEQ ID NO: 264742 - RNA, 22 nt, Human
uguacacaacgugcagguuugu

SEQ ID NO: 264743 - RNA, 22 nt, Human
gcugagaaaugcagacaugcug

SEQ ID NO: 264744 - RNA, 22 nt, Human
ucuagaauuugcguagguuaga

SEQ ID NO: 264745 - RNA, 22 nt, Human
ugagaucauugacuuguuccug

SEQ ID NO: 264746 - RNA, 18 nt, Human
cauuguuuccagaagacc

SEQ ID NO: 264747 - RNA, 21 nt, Human
auaaacugcaucaaguuggug

SEQ ID NO: 264748 - RNA, 22 nt, Human
augacacuguccuaguaaggaa

SEQ ID NO: 264749 - RNA, 22 nt, Human
uuggcucugauggggaucagga

SEQ ID NO: 264750 - RNA, 22 nt, Human
gcagcauccuuggccuccaccc

SEQ ID NO: 264751 - RNA, 22 nt, Human
augcucagggcacacucuggac

SEQ ID NO: 264752 - RNA, 20 nt, Human
cagcccuuuauccuccuaug

SEQ ID NO: 264753 - RNA, 22 nt, Human
auuacacagcgguuacuacuag

SEQ ID NO: 264754 - RNA, 22 nt, Human
auguuucaaauauauagaguug

SEQ ID NO: 264755 - RNA, 22 nt, Human
gcaguccucauccuuuagcagu

SEQ ID NO: 264756 - RNA, 22 nt, Human
uucucuuacauuuucucagccu

SEQ ID NO: 264757 - RNA, 18 nt, Human
cacaggcucccagugagg

SEQ ID NO: 264758 - RNA, 18 nt, Human
agcaguguggcaagcaga

SEQ ID NO: 264759 - RNA, 22 nt, Human
aagggagcggggagacccuaug

SEQ ID NO: 264760 - RNA, 22 nt, Human
cagcuucuccagaugacccuca

SEQ ID NO: 264761 - RNA, 22 nt, Human
gacagacagagaaugggcuuga

SEQ ID NO: 264762 - RNA, 22 nt, Human
ggcacuaggagaccuggggguc

SEQ ID NO: 264763 - RNA, 22 nt, Human
gauuuagagaauguuuuguaag

SEQ ID NO: 264764 - RNA, 22 nt, Human
uggcagaaguacacaagcaugc

SEQ ID NO: 264765 - RNA, 22 nt, Human
cugagcuguggaauaaacacug

SEQ ID NO: 264766 - RNA, 22 nt, Human
uagaggaaccaggcaggcugag

SEQ ID NO: 264767 - RNA, 22 nt, Human
caaagugccuguaccacuuugc

SEQ ID NO: 264768 - RNA, 22 nt, Human
aggaaacuuucuuuugcuucau

SEQ ID NO: 264769 - RNA, 22 nt, Human
ucugggcaguaccccucuccua

SEQ ID NO: 264770 - RNA, 22 nt, Human
agaaaauuuaaagagacacaca

SEQ ID NO: 264771 - RNA, 22 nt, Human
gaggccagaaugagucucuggg

SEQ ID NO: 264772 - RNA, 22 nt, Human
aucuuugggauccugauuuacu

SEQ ID NO: 264773 - RNA, 22 nt, Human
aaaagcagagacucuggagcua

SEQ ID NO: 264774 - RNA, 22 nt, Human
gagcuuuacuucugacuggugc

SEQ ID NO: 264775 - RNA, 22 nt, Human
agccagcaucccuucagucucc

SEQ ID NO: 264776 - RNA, 22 nt, Human
aagucuuaaccaaauaaauguu

SEQ ID NO: 264777 - RNA, 22 nt, Human
gcuccaggauaauaaaguuguu

SEQ ID NO: 264778 - RNA, 22 nt, Human
ucuccugguuuguuaaauaauu

SEQ ID NO: 264779 - RNA, 20 nt, Human
agacccuguguccuguggcc

SEQ ID NO: 264780 - RNA, 22 nt, Human
uucucagagugaccaagucuuu

SEQ ID NO: 264781 - RNA, 22 nt, Human
gcugugagugagcugccuaggc

SEQ ID NO: 264782 - RNA, 20 nt, Human
aggaggcaugaggggauuua

SEQ ID NO: 264783 - RNA, 22 nt, Human
ggcaccugguaagugcucagua

SEQ ID NO: 264784 - RNA, 22 nt, Human
acagcugugauuucuaucauga

SEQ ID NO: 264785 - RNA, 22 nt, Human
agacaggcuuggaaaaaaccuc

SEQ ID NO: 264786 - RNA, 22 nt, Human
gucaguaggaaccuagggucaa

SEQ ID NO: 264787 - RNA, 22 nt, Human
uuccauuuauucuuguccagau

SEQ ID NO: 264788 - RNA, 22 nt, Human
acagauguuagcaaugaugaug

SEQ ID NO: 264789 - RNA, 22 nt, Human
agaagaaacugucggggauauu

SEQ ID NO: 264790 - RNA, 21 nt, Human
cucuggaguuugaaggcuggg

SEQ ID NO: 264791 - RNA, 22 nt, Human
ugggccuggcccuguggaggag

SEQ ID NO: 264792 - RNA, 22 nt, Human
gcaauacaguagguuuauuggu

SEQ ID NO: 264793 - RNA, 22 nt, Human
ucuugcuaaagaccaacacauu

SEQ ID NO: 264794 - RNA, 22 nt, Human
ugauuuacccguaacuauuucu

SEQ ID NO: 264795 - RNA, 22 nt, Human
cugacuuugcucauaggucaaa

SEQ ID NO: 264796 - RNA, 22 nt, Human
aaaugcacacaccaggaaacua

SEQ ID NO: 264797 - RNA, 22 nt, Human
uccagcagaaccagagaccugg

SEQ ID NO: 264798 - RNA, 22 nt, Human
ucugaggccuugggacagaagu

SEQ ID NO: 264799 - RNA, 19 nt, Human
ucuuuagccagagcucugg

SEQ ID NO: 264800 - RNA, 22 nt, Human
ugggcaccugaggccuggcagg

SEQ ID NO: 264801 - RNA, 22 nt, Human
gcagcucccuugaacuucuccu

SEQ ID NO: 264802 - RNA, 22 nt, Human
accaggccaaaaucauauuuac

SEQ ID NO: 264803 - RNA, 22 nt, Human
gagugggggguccgucucagug

SEQ ID NO: 264804 - RNA, 22 nt, Human
uagugaaagucaaagacagcua

SEQ ID NO: 264805 - RNA, 22 nt, Human
ucagggcauggcugcacuuggc

SEQ ID NO: 264806 - RNA, 22 nt, Human
cccagacagucaagaggccugc

SEQ ID NO: 264807 - RNA, 22 nt, Human
gguggcugugagcauuauguga

SEQ ID NO: 264808 - RNA, 22 nt, Human
ucugaaagaagggcagucuuuu

SEQ ID NO: 264809 - RNA, 22 nt, Human
accuccccgggagcagccuccu

SEQ ID NO: 264810 - RNA, 22 nt, Human
uuccuaauggcaaaacauguuu

SEQ ID NO: 264811 - RNA, 22 nt, Human
uccugcagguggaugauucucu

SEQ ID NO: 264812 - RNA, 22 nt, Human
acagcaggaagcuggagggaaa

SEQ ID NO: 264813 - RNA, 22 nt, Human
uuuauugaguaucuacuaugug

SEQ ID NO: 264814 - RNA, 22 nt, Human
gagagaagaacaaugucauuca

SEQ ID NO: 264815 - RNA, 22 nt, Human
ucucagugagcuuuucuauguu

SEQ ID NO: 264816 - RNA, 20 nt, Human
uucugagaguucacagcccc

SEQ ID NO: 264817 - RNA, 22 nt, Human
cuuucucuugagcaagagcugu

SEQ ID NO: 264818 - RNA, 22 nt, Human
agggggugggaagucuagaauc

SEQ ID NO: 264819 - RNA, 22 nt, Human
gcagcaggcauggccgcccugg

SEQ ID NO: 264820 - RNA, 22 nt, Human
ggguccagauggugagaguuaa

SEQ ID NO: 264821 - RNA, 22 nt, Human
gaggcucagagaagucauggua

SEQ ID NO: 264822 - RNA, 22 nt, Human
ggugacagccgcuugcccugua

SEQ ID NO: 264823 - RNA, 22 nt, Human
uucugucuguaaacuucucaau

SEQ ID NO: 264824 - RNA, 22 nt, Human
uggccagguugggcuuugcagc

SEQ ID NO: 264825 - RNA, 19 nt, Human
cagagcagugguuccugaa

SEQ ID NO: 264826 - RNA, 22 nt, Human
caaauguguuuuuucuucuaca

SEQ ID NO: 264827 - RNA, 18 nt, Human
cuccuccacagccccugc

SEQ ID NO: 264828 - RNA, 22 nt, Human
ugcuggcuuuuugguccuugcu

SEQ ID NO: 264829 - RNA, 22 nt, Human
auucacacuguauacacaggau

SEQ ID NO: 264830 - RNA, 22 nt, Human
gguuauauaauucagugcuuuc

SEQ ID NO: 264831 - RNA, 22 nt, Human
auucaguaggucuagaauaaga

SEQ ID NO: 264832 - RNA, 22 nt, Human
uaguuuuagucccauuuuacag

SEQ ID NO: 264833 - RNA, 22 nt, Human
agucaaagaagaugguuccaaa

SEQ ID NO: 264834 - RNA, 22 nt, Human
ugaugaggcuucuuggugaaca

SEQ ID NO: 264835 - RNA, 22 nt, Human
ggaugucuggucuauuucaagu

SEQ ID NO: 264836 - RNA, 22 nt, Human
caacugguggucaaccuucugu

SEQ ID NO: 264837 - RNA, 22 nt, Human
ugcugggccaaagcaggguuuu

SEQ ID NO: 264838 - RNA, 21 nt, Human
uuagcaagucuacccauuucu

SEQ ID NO: 264839 - RNA, 22 nt, Human
uucauuccugagcccauauuua

SEQ ID NO: 264840 - RNA, 22 nt, Human
uauaauuaguaaauggcagauu

SEQ ID NO: 264841 - RNA, 22 nt, Human
uuacagggguguggaggcaauc

SEQ ID NO: 264842 - RNA, 22 nt, Human
cugacucuccugagauggggag

SEQ ID NO: 264843 - RNA, 22 nt, Human
cccugcagccuugcaugccuuc

SEQ ID NO: 264844 - RNA, 22 nt, Human
ugauggaaauaaaagcauagcu

SEQ ID NO: 264845 - RNA, 21 nt, Human
uucucuggcuucuguagcugg

SEQ ID NO: 264846 - RNA, 23 nt, Human
aggaaggagguccuaacaguauc

SEQ ID NO: 264847 - RNA, 22 nt, Human
aacaguaaaaaucauuuaguug

SEQ ID NO: 264848 - RNA, 22 nt, Human
ucuggaauuuucuagggcauca

SEQ ID NO: 264849 - RNA, 22 nt, Human
ggcaggcagauggcugcaccaa

SEQ ID NO: 264850 - RNA, 22 nt, Human
cacaggaaauauuaggagggau

SEQ ID NO: 264851 - RNA, 23 nt, Human
gacagagugagaccuugucuuac

SEQ ID NO: 264852 - RNA, 22 nt, Human
cagacagggcccugugauggua

SEQ ID NO: 264853 - RNA, 22 nt, Human
gcccaggaucugcucagaucau

SEQ ID NO: 264854 - RNA, 22 nt, Human
uuuccuuugaggguccuacacu

SEQ ID NO: 264855 - RNA, 22 nt, Human
gaagauuaaaugaagugaccug

SEQ ID NO: 264856 - RNA, 22 nt, Human
aucuugauuccauuaucuuugu

SEQ ID NO: 264857 - RNA, 22 nt, Human
ccuccuggggugaaggauggga

SEQ ID NO: 264858 - RNA, 22 nt, Human
uucuguauggaaacauccucca

SEQ ID NO: 264859 - RNA, 22 nt, Human
agucagaguuuugaggugugac

SEQ ID NO: 264860 - RNA, 22 nt, Human
cauuuacacuucuaaccacaag

SEQ ID NO: 264861 - RNA, 22 nt, Human
uuuagacacuagggaugcagug

SEQ ID NO: 264862 - RNA, 22 nt, Human
acacauucaugagugcaugcac

SEQ ID NO: 264863 - RNA, 22 nt, Human
uugccauguugccaaggcuggu

SEQ ID NO: 264864 - RNA, 22 nt, Human
guagggcauagagauguuggca

SEQ ID NO: 264865 - RNA, 22 nt, Human
gcagcugucggaaagcuaagug

SEQ ID NO: 264866 - RNA, 22 nt, Human
cugcccagaagcuuagagcuua

SEQ ID NO: 264867 - RNA, 22 nt, Human
guggaugagauaacuguagaag

SEQ ID NO: 264868 - RNA, 22 nt, Human
ucaaaacacuauuaccuuuaau

SEQ ID NO: 264869 - RNA, 22 nt, Human
ugcuugggcggccagcauggcg

SEQ ID NO: 264870 - RNA, 22 nt, Human
uacacacagaggccaugggauu

SEQ ID NO: 264871 - RNA, 22 nt, Human
agugcucccuagaguugugcaa

SEQ ID NO: 264872 - RNA, 22 nt, Human
agacagugugaguucagggugg

SEQ ID NO: 264873 - RNA, 22 nt, Human
uuucagagaaagcccaaagacu

SEQ ID NO: 264874 - RNA, 22 nt, Human
gcuucuggaagcugcuucugcc

SEQ ID NO: 264875 - RNA, 21 nt, Human
cugcugcuggggucugggcag

SEQ ID NO: 264876 - RNA, 22 nt, Human
ccuggguggcugccugccuuuc

SEQ ID NO: 264877 - RNA, 22 nt, Human
aaauggcaggcucuuugcuagu

SEQ ID NO: 264878 - RNA, 22 nt, Human
gguaaaaugcagauucuuagcc

SEQ ID NO: 264879 - RNA, 20 nt, Human
ccuggccaaugagauaggaa

SEQ ID NO: 264880 - RNA, 22 nt, Human
gagucagaauguccuccugcgg

SEQ ID NO: 264881 - RNA, 22 nt, Human
gcugcaggagauuuugagaguc

SEQ ID NO: 264882 - RNA, 22 nt, Human
agggccucuaccauccaagguu

SEQ ID NO: 264883 - RNA, 22 nt, Human
uagcaucuaacaucuuaggacu

SEQ ID NO: 264884 - RNA, 22 nt, Human
ugccaggcgugguggugcgcac

SEQ ID NO: 264885 - RNA, 22 nt, Human
ggaagcaggaggcugggguaaa

SEQ ID NO: 264886 - RNA, 22 nt, Human
cacucuaaccuccaucuuccau

SEQ ID NO: 264887 - RNA, 22 nt, Human
cucuggaggccguuggcccuua

SEQ ID NO: 264888 - RNA, 22 nt, Human
acauguguacuuuuaaggaugu

SEQ ID NO: 264889 - RNA, 18 nt, Human
acauuucuaugcuucugg

SEQ ID NO: 264890 - RNA, 22 nt, Human
ugggguggaacccuucugcugg

SEQ ID NO: 264891 - RNA, 22 nt, Human
cacagccuccuucagagagcau

SEQ ID NO: 264892 - RNA, 22 nt, Human
agaacagcaacaucagacaaag

SEQ ID NO: 264893 - RNA, 22 nt, Human
gagugcauggacuacuggcuug

SEQ ID NO: 264894 - RNA, 22 nt, Human
acagccagaucugagagaucuu

SEQ ID NO: 264895 - RNA, 22 nt, Human
gggagccagagucaccuagaga

SEQ ID NO: 264896 - RNA, 22 nt, Human
uaaagugcaggcuacucagaag

SEQ ID NO: 264897 - RNA, 22 nt, Human
ucagggagagccugucugacgu

SEQ ID NO: 264898 - RNA, 22 nt, Human
ugaggcucagaaauguaaguuu

SEQ ID NO: 264899 - RNA, 22 nt, Human
ccagucuguucucaccucugag

SEQ ID NO: 264900 - RNA, 22 nt, Human
ccuuagcauggcugugcugugu

SEQ ID NO: 264901 - RNA, 20 nt, Human
ugcuccaucuaaagugauua

SEQ ID NO: 264902 - RNA, 22 nt, Human
auaaguuugucuuuguaaagau

SEQ ID NO: 264903 - RNA, 22 nt, Human
acugugcaaugaguaauaaacu

SEQ ID NO: 264904 - RNA, 22 nt, Human
uauuauuuuagcacugaggauu

SEQ ID NO: 264905 - RNA, 18 nt, Human
gaggcagcuagcaauuuu

SEQ ID NO: 264906 - RNA, 23 nt, Human
cccugagcugguccaggcucaac

SEQ ID NO: 264907 - RNA, 22 nt, Human
uucucacuauguauguagauug

SEQ ID NO: 264908 - RNA, 22 nt, Human
uuuccuucucagggagcuucaa

SEQ ID NO: 264909 - RNA, 17 nt, Human
ucuaggagagcagagcu

SEQ ID NO: 264910 - RNA, 22 nt, Human
cagagaccccuggcaugguggu

SEQ ID NO: 264911 - RNA, 22 nt, Human
agggggcugccaaggaauguaa

SEQ ID NO: 264912 - RNA, 22 nt, Human
gggauagguuuggaagaggugg

SEQ ID NO: 264913 - RNA, 22 nt, Human
ucugcucugagagggccaucag

SEQ ID NO: 264914 - RNA, 22 nt, Human
uucugugugccagaguugugcu

SEQ ID NO: 264915 - RNA, 22 nt, Human
gagcaacacuccacauugcuag

SEQ ID NO: 264916 - RNA, 22 nt, Human
cuuucauaagggguuuuauaau

SEQ ID NO: 264917 - RNA, 23 nt, Human
cauuucaacgaauuuuccuucug

SEQ ID NO: 264918 - RNA, 22 nt, Human
cacaugaccacucuuuacuucu

SEQ ID NO: 264919 - RNA, 22 nt, Human
ccaggucuuuggccuuggcacu

SEQ ID NO: 264920 - RNA, 22 nt, Human
aguuaaaucauggccauuggaa

SEQ ID NO: 264921 - RNA, 22 nt, Human
augucacuguuguuauuguuau

SEQ ID NO: 264922 - RNA, 22 nt, Human
agugauguugacuagcuauaag

SEQ ID NO: 264923 - RNA, 19 nt, Human
ccagugcaagguaagauag

SEQ ID NO: 264924 - RNA, 22 nt, Human
ggcucuggugcccuggcuccca

SEQ ID NO: 264925 - RNA, 22 nt, Human
acagcaggcccauacuggaagg

SEQ ID NO: 264926 - RNA, 22 nt, Human
ucagagaaugugaauauuaaac

SEQ ID NO: 264927 - RNA, 22 nt, Human
ccagcuuuucagaaucugccug

SEQ ID NO: 264928 - RNA, 22 nt, Human
aggcuucucaauagguuugaag

SEQ ID NO: 264929 - RNA, 20 nt, Human
gcaggcagggaaugggggug

SEQ ID NO: 264930 - RNA, 22 nt, Human
ucacaucugugugauugucauu

SEQ ID NO: 264931 - RNA, 22 nt, Human
cuggggugucucgucugccauu

SEQ ID NO: 264932 - RNA, 22 nt, Human
uaggugucuaacaauaagugua

SEQ ID NO: 264933 - RNA, 22 nt, Human
ugucucugagaugacucccacc

SEQ ID NO: 264934 - RNA, 21 nt, Human
acauguaagagaguuucaaga

SEQ ID NO: 264935 - RNA, 22 nt, Human
cuccagggagcuuggaaagacc

SEQ ID NO: 264936 - RNA, 21 nt, Human
ggccagcucggaaggucccau

SEQ ID NO: 264937 - RNA, 22 nt, Human
agucauaugacccuucacaaac

SEQ ID NO: 264938 - RNA, 23 nt, Human
guucauuuuauugucugauugcu

SEQ ID NO: 264939 - RNA, 19 nt, Human
guacagugguaagcuauga

SEQ ID NO: 264940 - RNA, 22 nt, Human
caguuuuaucaucugugaaaug

SEQ ID NO: 264941 - RNA, 22 nt, Human
agcaggucgccgaagauagcuc

SEQ ID NO: 264942 - RNA, 22 nt, Human
ucuuuauuucugaaucccccau

SEQ ID NO: 264943 - RNA, 22 nt, Human
ccauggcuccuugcccuguagc

SEQ ID NO: 264944 - RNA, 22 nt, Human
cuucacaguauaggucccugag

SEQ ID NO: 264945 - RNA, 22 nt, Human
agcccagcaaagggagguucag

SEQ ID NO: 264946 - RNA, 22 nt, Human
cuaaaucaucauuuauguuugu

SEQ ID NO: 264947 - RNA, 22 nt, Human
auuuccugcaggggcugguggg

SEQ ID NO: 264948 - RNA, 22 nt, Human
cagcaucuccugugcagaggga

SEQ ID NO: 264949 - RNA, 22 nt, Human
ugccugaagcugcauuccuagu

SEQ ID NO: 264950 - RNA, 22 nt, Human
agcaggcaggaaugguggaaca

SEQ ID NO: 264951 - RNA, 22 nt, Human
auccaggcauucugacuucaag

SEQ ID NO: 264952 - RNA, 22 nt, Human
gagagcuccuucaggaagcuuc

SEQ ID NO: 264953 - RNA, 22 nt, Human
agugagggaugaagaacugcgg

SEQ ID NO: 264954 - RNA, 22 nt, Human
uuaguuaaaagauaauuuugga

SEQ ID NO: 264955 - RNA, 22 nt, Human
agaacuauugcaauaacaagaa

SEQ ID NO: 264956 - RNA, 18 nt, Human
agagacagcagcaaaaga

SEQ ID NO: 264957 - RNA, 22 nt, Human
acagguguggggcugugguacu

SEQ ID NO: 264958 - RNA, 22 nt, Human
agcagcagauuauggucuacau

SEQ ID NO: 264959 - RNA, 22 nt, Human
cugggucuucagcagcaggcgg

SEQ ID NO: 264960 - RNA, 21 nt, Human
acaggcuacaugcaggagcug

SEQ ID NO: 264961 - RNA, 22 nt, Human
uugcugaugguauuaugcuagu

SEQ ID NO: 264962 - RNA, 22 nt, Human
ucuuauuuuuuaaugacagaga

SEQ ID NO: 264963 - RNA, 22 nt, Human
acagguguugacucacaggccc

SEQ ID NO: 264964 - RNA, 22 nt, Human
auuuccuagccucucuugcagu

SEQ ID NO: 264965 - RNA, 23 nt, Human
ucauuccacaaauacuuaucuag

SEQ ID NO: 264966 - RNA, 22 nt, Human
gccagguucuggggagguacaa

SEQ ID NO: 264967 - RNA, 22 nt, Human
gugaagcagggaaggaaaggau

SEQ ID NO: 264968 - RNA, 20 nt, Human
ucucugcagcagaggcuggg

SEQ ID NO: 264969 - RNA, 22 nt, Human
ucugagcuccaugcaggaggcu

SEQ ID NO: 264970 - RNA, 22 nt, Human
gagcgauugcgggggucagagg

SEQ ID NO: 264971 - RNA, 22 nt, Human
ucacccagcgggcgcacacucg

SEQ ID NO: 264972 - RNA, 18 nt, Human
aggucuguggucaccagg

SEQ ID NO: 264973 - RNA, 22 nt, Human
cucaugucaggggugucaaugu

SEQ ID NO: 264974 - RNA, 22 nt, Human
auaaccugguaguauuaaaugu

SEQ ID NO: 264975 - RNA, 22 nt, Human
acaguuucuccauuuacaccuu

SEQ ID NO: 264976 - RNA, 22 nt, Human
gaacuggucaguuuagcccacu

SEQ ID NO: 264977 - RNA, 22 nt, Human
cucccaggugucccuucugcca

SEQ ID NO: 264978 - RNA, 22 nt, Human
cuguacagaagcuagagcaaau

SEQ ID NO: 264979 - RNA, 22 nt, Human
uuuggucaggguaggacaguug

SEQ ID NO: 264980 - RNA, 22 nt, Human
agacgagggcccccaggacagc

SEQ ID NO: 264981 - RNA, 21 nt, Human
auccauucuccgguuaaugag

SEQ ID NO: 264982 - RNA, 22 nt, Human
caaugaaaaugaggacuccugu

SEQ ID NO: 264983 - RNA, 20 nt, Human
ugucuccagggcugagugga

SEQ ID NO: 264984 - RNA, 22 nt, Human
aaaggccagguuggcugguauu

SEQ ID NO: 264985 - RNA, 22 nt, Human
ugacauuucagauaugguauuu

SEQ ID NO: 264986 - RNA, 22 nt, Human
agccugggguuucaguuugcac

SEQ ID NO: 264987 - RNA, 22 nt, Human
ccacugagcaguagcugcgucg

SEQ ID NO: 264988 - RNA, 22 nt, Human
uggaaacuuaucugacacgaac

SEQ ID NO: 264989 - RNA, 22 nt, Human
auggccucuagcugagaccaau

SEQ ID NO: 264990 - RNA, 17 nt, Human
uuauuuuuugggcugag

SEQ ID NO: 264991 - RNA, 22 nt, Human
cucugaagccccaaauaguccg

SEQ ID NO: 264992 - RNA, 22 nt, Human
cugggucugucacuagauaaau

SEQ ID NO: 264993 - RNA, 23 nt, Human
ggcacagaugcugagcaugugca

SEQ ID NO: 264994 - RNA, 22 nt, Human
uguauuaacauuaauaaaaugg

SEQ ID NO: 264995 - RNA, 22 nt, Human
uaaaauugcggugaauauuucc

SEQ ID NO: 264996 - RNA, 20 nt, Human
cagaaggucuaagcuuuaga

SEQ ID NO: 264997 - RNA, 22 nt, Human
uuuacauugcauuagguauuau

SEQ ID NO: 264998 - RNA, 22 nt, Human
agcagggguggaagguagcuuu

SEQ ID NO: 264999 - RNA, 22 nt, Human
cagugcucauagcuguuccucc

SEQ ID NO: 265000 - RNA, 22 nt, Human
cagcagggaagcugugcuguuu

SEQ ID NO: 265001 - RNA, 23 nt, Human
cagaucauauauccagcuguaag

SEQ ID NO: 265002 - RNA, 22 nt, Human
gccugcucagaccuagcaggcc

SEQ ID NO: 265003 - RNA, 21 nt, Human
agcagaggcagaauguaugca

SEQ ID NO: 265004 - RNA, 22 nt, Human
aguagauuuuugaauguaaguu

SEQ ID NO: 265005 - RNA, 20 nt, Human
gcagcugugcauucuuagga

SEQ ID NO: 265006 - RNA, 22 nt, Human
aagcaagcaagguguuacauau

SEQ ID NO: 265007 - RNA, 22 nt, Human
ccaggaggaaagaccagcccau

SEQ ID NO: 265008 - RNA, 22 nt, Human
ggcuuggaccagucacaguggu

SEQ ID NO: 265009 - RNA, 22 nt, Human
acaagacugugcucuaagagug

SEQ ID NO: 265010 - RNA, 20 nt, Human
augugucuguaaacaacucu

SEQ ID NO: 265011 - RNA, 22 nt, Human
gaggucuugucugauagggaaa

SEQ ID NO: 265012 - RNA, 22 nt, Human
ucucaggcaugguuuguucauc

SEQ ID NO: 265013 - RNA, 22 nt, Human
uagcugcuucagucuaggucuc

SEQ ID NO: 265014 - RNA, 22 nt, Human
ucucaggcuguguguggaggac

SEQ ID NO: 265015 - RNA, 22 nt, Human
ucuagaauggcugggcacagcu

SEQ ID NO: 265016 - RNA, 22 nt, Human
gaacuguucccucacaggcugg

SEQ ID NO: 265017 - RNA, 22 nt, Human
uggcagggagccaccggucaug

SEQ ID NO: 265018 - RNA, 22 nt, Human
ucccugcugcacucacaccuac

SEQ ID NO: 265019 - RNA, 22 nt, Human
uggcagguuuccuccucauagu

SEQ ID NO: 265020 - RNA, 22 nt, Human
aagaucagcucccgagucugag

SEQ ID NO: 265021 - RNA, 22 nt, Human
uuagaacuuaaacuucagaaag

SEQ ID NO: 265022 - RNA, 22 nt, Human
guggcacaaggcuuacacagca

SEQ ID NO: 265023 - RNA, 22 nt, Human
uucaggaaaugucugccuacca

SEQ ID NO: 265024 - RNA, 22 nt, Human
cagaucuaucuguugauggugc

SEQ ID NO: 265025 - RNA, 22 nt, Human
aauaauacuucguaaaguuguu

SEQ ID NO: 265026 - RNA, 22 nt, Human
ucucagagcuucagaaagcacc

SEQ ID NO: 265027 - RNA, 22 nt, Human
uccuagaauagugugucuggag

SEQ ID NO: 265028 - RNA, 22 nt, Human
uggaaaaaaauuggcuagcuuc

SEQ ID NO: 265029 - RNA, 20 nt, Human
gcugggcuaccacuggcccu

SEQ ID NO: 265030 - RNA, 22 nt, Human
aaggugugaagagaugggaaga

SEQ ID NO: 265031 - RNA, 22 nt, Human
ucccucagaaauucucucugaa

SEQ ID NO: 265032 - RNA, 22 nt, Human
gcccugugccagucacgcugug

SEQ ID NO: 265033 - RNA, 22 nt, Human
uuuauauuucccaggauuggcc

SEQ ID NO: 265034 - RNA, 22 nt, Human
accuccuggugcccaaguguuu

SEQ ID NO: 265035 - RNA, 22 nt, Human
ucagagagccucaggcacugcc

SEQ ID NO: 265036 - RNA, 22 nt, Human
caucaaaguugguauauuugca

SEQ ID NO: 265037 - RNA, 22 nt, Human
cucuuucugauucgcugggacc

SEQ ID NO: 265038 - RNA, 22 nt, Human
aaguuucaaauauaaaauuaca

SEQ ID NO: 265039 - RNA, 21 nt, Human
caggucuggugaacacucuca

SEQ ID NO: 265040 - RNA, 22 nt, Human
aguccaugguucugacucaucu

SEQ ID NO: 265041 - RNA, 22 nt, Human
ugcagaaauaacucauauugca

SEQ ID NO: 265042 - RNA, 22 nt, Human
gugucccagccccacaggccug

SEQ ID NO: 265043 - RNA, 22 nt, Human
uuucuauaugaggagcuaaagu

SEQ ID NO: 265044 - RNA, 22 nt, Human
ugguaagaauaggggcuuugga

SEQ ID NO: 265045 - RNA, 22 nt, Human
agugucugaugcacaguugucc

SEQ ID NO: 265046 - RNA, 22 nt, Human
aaagugcacuagaauccagauu

SEQ ID NO: 265047 - RNA, 22 nt, Human
auuuaauuuacauuugacagag

SEQ ID NO: 265048 - RNA, 22 nt, Human
gcugagcugaggcagggcuggg

SEQ ID NO: 265049 - RNA, 21 nt, Human
ugcccaugagcagaagucacc

SEQ ID NO: 265050 - RNA, 22 nt, Human
ucucccuggagcccugaagcau

SEQ ID NO: 265051 - RNA, 22 nt, Human
uggcuucucccgacacccuggc

SEQ ID NO: 265052 - RNA, 22 nt, Human
agguggcugguccaggcugcag

SEQ ID NO: 265053 - RNA, 22 nt, Human
uagguagaaauagauauuggua

SEQ ID NO: 265054 - RNA, 22 nt, Human
cagugaaaucacaacuuuaguu

SEQ ID NO: 265055 - RNA, 23 nt, Human
uuucaaauuacucugcagaugac

SEQ ID NO: 265056 - RNA, 22 nt, Human
gcagggcugggauuugagccca

SEQ ID NO: 265057 - RNA, 22 nt, Human
agcugaggcucugagagggaag

SEQ ID NO: 265058 - RNA, 22 nt, Human
uccuggaguuuguaaggugagc

SEQ ID NO: 265059 - RNA, 22 nt, Human
uggcagaugugguuugagacag

SEQ ID NO: 265060 - RNA, 22 nt, Human
acaugccaugguuguuugcugc

SEQ ID NO: 265061 - RNA, 22 nt, Human
cccugaggcaaaggcuagaguu

SEQ ID NO: 265062 - RNA, 22 nt, Human
gagcugaacgggaauuccccga

SEQ ID NO: 265063 - RNA, 22 nt, Human
gacaaaacugagaucacacugu

SEQ ID NO: 265064 - RNA, 22 nt, Human
aggcccagcuggacaaacugcu

SEQ ID NO: 265065 - RNA, 22 nt, Human
gauugucacucccuauauggua

SEQ ID NO: 265066 - RNA, 22 nt, Human
cagcugguuaucagagaggccu

SEQ ID NO: 265067 - RNA, 22 nt, Human
ccugcagguaaggcuaacugcc

SEQ ID NO: 265068 - RNA, 22 nt, Human
cacgggagacgugaucuuggac

SEQ ID NO: 265069 - RNA, 22 nt, Human
agagucuucuuuaggccauuua

SEQ ID NO: 265070 - RNA, 22 nt, Human
aagagagggacuuauuaaaguc

SEQ ID NO: 265071 - RNA, 22 nt, Human
uagcagugccaggauuuugcug

SEQ ID NO: 265072 - RNA, 22 nt, Human
uacuucauuauucuaguuuuga

SEQ ID NO: 265073 - RNA, 22 nt, Human
aaggacagagagccauuccaga

SEQ ID NO: 265074 - RNA, 22 nt, Human
uauguuuuucagacguccuaca

SEQ ID NO: 265075 - RNA, 22 nt, Human
aggagagaauuacuggguguca

SEQ ID NO: 265076 - RNA, 22 nt, Human
ccaagggaaaccgagaggcugg

SEQ ID NO: 265077 - RNA, 22 nt, Human
aacugcaaaauaaucaaguugu

SEQ ID NO: 265078 - RNA, 22 nt, Human
gccccaccgagggugcaguccu

SEQ ID NO: 265079 - RNA, 22 nt, Human
uaugcacaguuacaagaauauc

SEQ ID NO: 265080 - RNA, 22 nt, Human
agagggcuaacugggaagcagg

SEQ ID NO: 265081 - RNA, 22 nt, Human
cagcaagacaguuuccuaagug

SEQ ID NO: 265082 - RNA, 21 nt, Human
aucuggaaauucugccagaga

SEQ ID NO: 265083 - RNA, 22 nt, Human
agaaccuuucuuuagaaauuca

SEQ ID NO: 265084 - RNA, 20 nt, Human
uaggugucuuugccagcuuu

SEQ ID NO: 265085 - RNA, 22 nt, Human
uugcaguuugcuuuuaauggga

SEQ ID NO: 265086 - RNA, 22 nt, Human
cuguuuauaaauagaggggagu

SEQ ID NO: 265087 - RNA, 22 nt, Human
auucucuguagauggcuugaga

SEQ ID NO: 265088 - RNA, 17 nt, Human
agggacagcaguuuagg

SEQ ID NO: 265089 - RNA, 22 nt, Human
guuuugugaggcacccacaggu

SEQ ID NO: 265090 - RNA, 22 nt, Human
gauuuugucaaauuccaaaugu

SEQ ID NO: 265091 - RNA, 22 nt, Human
acagcuugcaugcagaggcacu

SEQ ID NO: 265092 - RNA, 23 nt, Human
uagauccuauggcugugugcaga

SEQ ID NO: 265093 - RNA, 22 nt, Human
ccaggccuagccccugagggua

SEQ ID NO: 265094 - RNA, 22 nt, Human
gcccagcagcugguggagaagg

SEQ ID NO: 265095 - RNA, 22 nt, Human
uccagaccuagggcaccccagu

SEQ ID NO: 265096 - RNA, 22 nt, Human
aaagcauuucaugucuagaaag

SEQ ID NO: 265097 - RNA, 22 nt, Human
cagucccagacccagaaggugg

SEQ ID NO: 265098 - RNA, 22 nt, Human
aaguuucugauauuguuaaagc

SEQ ID NO: 265099 - RNA, 22 nt, Human
cucuuuggccagaaaauguuuu

SEQ ID NO: 265100 - RNA, 22 nt, Human
ggcugccuccugcugggcugga

SEQ ID NO: 265101 - RNA, 22 nt, Human
uccuggcacuuugggggcucgc

SEQ ID NO: 265102 - RNA, 22 nt, Human
uucaguguggugcacaguuuug

SEQ ID NO: 265103 - RNA, 22 nt, Human
ucugggagagggaaagaagacu

SEQ ID NO: 265104 - RNA, 22 nt, Human
ccuggcugccuuguguugaucu

SEQ ID NO: 265105 - RNA, 22 nt, Human
uccagcagcccgaaggcccauc

SEQ ID NO: 265106 - RNA, 22 nt, Human
uuugacucauugauuuucucug

SEQ ID NO: 265107 - RNA, 22 nt, Human
uuaacaauagaguuucuucagg

SEQ ID NO: 265108 - RNA, 22 nt, Human
gucuucuaaguaucaaagcaga

SEQ ID NO: 265109 - RNA, 22 nt, Human
aagacagagggaagcaaugaug

SEQ ID NO: 265110 - RNA, 22 nt, Human
ucuguacuuccuuuaaacuuua

SEQ ID NO: 265111 - RNA, 22 nt, Human
agagcccagaaaguaugucaua

SEQ ID NO: 265112 - RNA, 21 nt, Human
uccuuauauuugaauacuuua

SEQ ID NO: 265113 - RNA, 22 nt, Human
aagugccaucauagcauggcug

SEQ ID NO: 265114 - RNA, 21 nt, Human
uccucugcagugagguggccu

SEQ ID NO: 265115 - RNA, 22 nt, Human
cucagagggucuccuccagaau

SEQ ID NO: 265116 - RNA, 22 nt, Human
uagaaguuaaaggaauacagaa

SEQ ID NO: 265117 - RNA, 22 nt, Human
agcugcaaaggcacacuugggc

SEQ ID NO: 265118 - RNA, 22 nt, Human
uaggcuucacuuccaguuauuc

SEQ ID NO: 265119 - RNA, 22 nt, Human
guccugagucaagugugggcag

SEQ ID NO: 265120 - RNA, 22 nt, Human
uuaguaauguguuaauaugaau

SEQ ID NO: 265121 - RNA, 22 nt, Human
gaagagguagcauuggcaggug

SEQ ID NO: 265122 - RNA, 22 nt, Human
auacagguaauuugaauaauag

SEQ ID NO: 265123 - RNA, 22 nt, Human
acaaauuuggugagaguaaaua

SEQ ID NO: 265124 - RNA, 22 nt, Human
agagcugaauucaagugcuggc

SEQ ID NO: 265125 - RNA, 22 nt, Human
cccagcagugacccagugauac

SEQ ID NO: 265126 - RNA, 22 nt, Human
uaacugguacucugguagccug

SEQ ID NO: 265127 - RNA, 22 nt, Human
gcccucagcauccucagggcca

SEQ ID NO: 265128 - RNA, 22 nt, Human
ggagccugggccuccugcccuu

SEQ ID NO: 265129 - RNA, 22 nt, Human
caguaacaugaagagacaugga

SEQ ID NO: 265130 - RNA, 22 nt, Human
ccucuuugugccugcaggcugc

SEQ ID NO: 265131 - RNA, 22 nt, Human
uuauugcaaaggaagagcuuga

SEQ ID NO: 265132 - RNA, 22 nt, Human
agccucuuauucuccaggacuu

SEQ ID NO: 265133 - RNA, 22 nt, Human
ggccacauguggcugcucguau

SEQ ID NO: 265134 - RNA, 22 nt, Human
uucucaggacuccugccugcuu

SEQ ID NO: 265135 - RNA, 22 nt, Human
cugugcaguccagcccuggaca

SEQ ID NO: 265136 - RNA, 19 nt, Human
aggcagaggcuuggcuagc

SEQ ID NO: 265137 - RNA, 22 nt, Human
uuagaauccaugguugcagugg

SEQ ID NO: 265138 - RNA, 22 nt, Human
uuucucugcugccugugucgau

SEQ ID NO: 265139 - RNA, 20 nt, Human
acaugcacguguguauauau

SEQ ID NO: 265140 - RNA, 22 nt, Human
auugaauagcugcuuguuguau

SEQ ID NO: 265141 - RNA, 22 nt, Human
acaggcaguugagguuugugug

SEQ ID NO: 265142 - RNA, 22 nt, Human
acaugccagccucagcagcagu

SEQ ID NO: 265143 - RNA, 22 nt, Human
uuccugaauugagcuuuagaaa

SEQ ID NO: 265144 - RNA, 22 nt, Human
ucugugccaucagucuccagag

SEQ ID NO: 265145 - RNA, 22 nt, Human
gcacugcuccagguguggcuug

SEQ ID NO: 265146 - RNA, 22 nt, Human
ucauuuggaagccugagagugu

SEQ ID NO: 265147 - RNA, 22 nt, Human
gucucccaucucuguccuugug

SEQ ID NO: 265148 - RNA, 22 nt, Human
ucagcuuucuauguugcuaaac

SEQ ID NO: 265149 - RNA, 22 nt, Human
uucuggcucgauucucugaccg

SEQ ID NO: 265150 - RNA, 22 nt, Human
guccuuucgagggugagugaaa

SEQ ID NO: 265151 - RNA, 22 nt, Human
aaaauuuugcccuauccuucau

SEQ ID NO: 265152 - RNA, 22 nt, Human
auguaacugaaggaaaugcaug

SEQ ID NO: 265153 - RNA, 22 nt, Human
guuuuucuagaaaucuccuccu

SEQ ID NO: 265154 - RNA, 22 nt, Human
agugacuacuggauuuguuucu

SEQ ID NO: 265155 - RNA, 22 nt, Human
cuaggaaagacacagagaguuu

SEQ ID NO: 265156 - RNA, 22 nt, Human
ugcagucuuccagcugcacaaa

SEQ ID NO: 265157 - RNA, 22 nt, Human
guguguggaaugcucauuuauu

SEQ ID NO: 265158 - RNA, 22 nt, Human
ucugacauuagauuaauuggaa

SEQ ID NO: 265159 - RNA, 22 nt, Human
caggcaggucagugaagaagga

SEQ ID NO: 265160 - RNA, 18 nt, Human
ugucucugaauuccagug

SEQ ID NO: 265161 - RNA, 22 nt, Human
gugcagaggacguggcggccuc

SEQ ID NO: 265162 - RNA, 22 nt, Human
acagguguaauuugcccgaggu

SEQ ID NO: 265163 - RNA, 22 nt, Human
caggcaccacacuaggggcuga

SEQ ID NO: 265164 - RNA, 19 nt, Human
cugggcugaggucugccuu

SEQ ID NO: 265165 - RNA, 22 nt, Human
aacccgggaggcagagguugug

SEQ ID NO: 265166 - RNA, 22 nt, Human
agggaaaggcugaugcuguggg

SEQ ID NO: 265167 - RNA, 22 nt, Human
ggaucaggcgccaugggaagug

SEQ ID NO: 265168 - RNA, 22 nt, Human
cuggaagggaaaucucuuggca

SEQ ID NO: 265169 - RNA, 22 nt, Human
ugcuuuauaacuuaguuuaugg

SEQ ID NO: 265170 - RNA, 21 nt, Human
ucagggcagugggagguuccu

SEQ ID NO: 265171 - RNA, 22 nt, Human
aguguuaagagaaaauucugcu

SEQ ID NO: 265172 - RNA, 22 nt, Human
uuucugagaaauuaaacacuuu

SEQ ID NO: 265173 - RNA, 22 nt, Human
gccuggcacucaaucaucugcu

SEQ ID NO: 265174 - RNA, 22 nt, Human
uccuggcuccugaucugucacu

SEQ ID NO: 265175 - RNA, 22 nt, Human
agccugagccccauccagcuga

SEQ ID NO: 265176 - RNA, 22 nt, Human
agcugcaacaucugcuuguccc

SEQ ID NO: 265177 - RNA, 22 nt, Human
gcacacagcuagauuaccauuc

SEQ ID NO: 265178 - RNA, 22 nt, Human
uuccugaggaggaccaggacca

SEQ ID NO: 265179 - RNA, 22 nt, Human
gaguguggugaacaggagcacc

SEQ ID NO: 265180 - RNA, 22 nt, Human
caguuugugcuaggcacuauuu

SEQ ID NO: 265181 - RNA, 22 nt, Human
uacaugcuucuauaugugaagu

SEQ ID NO: 265182 - RNA, 22 nt, Human
ucaacuaaggcacaaucucuaa

SEQ ID NO: 265183 - RNA, 22 nt, Human
uucagcagugcagacacccagu

SEQ ID NO: 265184 - RNA, 22 nt, Human
cccaguccuaaagcagacgcca

SEQ ID NO: 265185 - RNA, 22 nt, Human
ggccccagggaagaaggugguc

SEQ ID NO: 265186 - RNA, 22 nt, Human
uagcaccuuagcauuucuagug

SEQ ID NO: 265187 - RNA, 22 nt, Human
aagagcaggacagaaucagaac

SEQ ID NO: 265188 - RNA, 22 nt, Human
aggcagcuuucagugucucuca

SEQ ID NO: 265189 - RNA, 22 nt, Human
gacuuagacccugucuuuauuc

SEQ ID NO: 265190 - RNA, 22 nt, Human
aauaauaguugcaaaguguuua

SEQ ID NO: 265191 - RNA, 22 nt, Human
ugggaagggucaacagcuggaa

SEQ ID NO: 265192 - RNA, 19 nt, Human
gcugcagaggugaagaaga

SEQ ID NO: 265193 - RNA, 22 nt, Human
ucagggaggugucugccagaga

SEQ ID NO: 265194 - RNA, 22 nt, Human
uuuacagacaacuuaauagggg

SEQ ID NO: 265195 - RNA, 17 nt, Human
ugcaaacaaucacauau

SEQ ID NO: 265196 - RNA, 22 nt, Human
gcucaaaugucauggggagccu

SEQ ID NO: 265197 - RNA, 22 nt, Human
ccaaaaagcucagagauauguu

SEQ ID NO: 265198 - RNA, 19 nt, Human
uggaaacuccugauauuag

SEQ ID NO: 265199 - RNA, 22 nt, Human
gcaaaugcuaaaguguagagac

SEQ ID NO: 265200 - RNA, 22 nt, Human
uaucucuguuccaagccuuauc

SEQ ID NO: 265201 - RNA, 22 nt, Human
caaaagucuuccuauucucuua

SEQ ID NO: 265202 - RNA, 22 nt, Human
ucagaaaauaacuguuaguuug

SEQ ID NO: 265203 - RNA, 22 nt, Human
cagacacagcaauucuguguug

SEQ ID NO: 265204 - RNA, 22 nt, Human
ccucaggaaccacauugcugcu

SEQ ID NO: 265205 - RNA, 22 nt, Human
ugucaaaaugacuuuacuacag

SEQ ID NO: 265206 - RNA, 22 nt, Human
uuugguuaauuuaggcuugcau

SEQ ID NO: 265207 - RNA, 21 nt, Human
cuuggaguugguugaggaugc

SEQ ID NO: 265208 - RNA, 21 nt, Human
uuccuggggacuuccguggga

SEQ ID NO: 265209 - RNA, 22 nt, Human
ugacaaagacaaagauaugucc

SEQ ID NO: 265210 - RNA, 22 nt, Human
ccaggccugcaucugcugcgca

SEQ ID NO: 265211 - RNA, 20 nt, Human
agguggcuccugcugggggu

SEQ ID NO: 265212 - RNA, 18 nt, Human
uauauagagaaacccauu

SEQ ID NO: 265213 - RNA, 22 nt, Human
cuuuaucuguguccucuugccu

SEQ ID NO: 265214 - RNA, 22 nt, Human
agguaagggucacaguucauau

SEQ ID NO: 265215 - RNA, 22 nt, Human
uuccuccagaagcuguagggga

SEQ ID NO: 265216 - RNA, 22 nt, Human
aaacagucugaugccaucugcc

SEQ ID NO: 265217 - RNA, 22 nt, Human
cagagcucuauguucauggagg

SEQ ID NO: 265218 - RNA, 22 nt, Human
ugucgcagcugaaaaucucaau

SEQ ID NO: 265219 - RNA, 22 nt, Human
uuguuacuaagccuuuaaauag

SEQ ID NO: 265220 - RNA, 22 nt, Human
gcuguacaaauuccacaagaga

SEQ ID NO: 265221 - RNA, 22 nt, Human
ucccuccuggugaugaugcaaa

SEQ ID NO: 265222 - RNA, 22 nt, Human
ucucuguggcauccacucaacu

SEQ ID NO: 265223 - RNA, 22 nt, Human
cugguccuaaagcccuacucca

SEQ ID NO: 265224 - RNA, 22 nt, Human
accccaagacaguagaagagaa

SEQ ID NO: 265225 - RNA, 22 nt, Human
ucucccagaggaucccagugga

SEQ ID NO: 265226 - RNA, 22 nt, Human
uauugauaugcagaacugacuu

SEQ ID NO: 265227 - RNA, 22 nt, Human
ugccaggaggggacaccuccuc

SEQ ID NO: 265228 - RNA, 22 nt, Human
cagccucucuguaucucaggau

SEQ ID NO: 265229 - RNA, 22 nt, Human
ugggcaggaugcguugauucuu

SEQ ID NO: 265230 - RNA, 22 nt, Human
ugggccucuguuuccucaucug

SEQ ID NO: 265231 - RNA, 22 nt, Human
cucuagaggcuugaaugggcga

SEQ ID NO: 265232 - RNA, 21 nt, Human
auucagaguaauucaucuuua

SEQ ID NO: 265233 - RNA, 22 nt, Human
uagggcagaguccaggaugggc

SEQ ID NO: 265234 - RNA, 19 nt, Human
aaggugguuugucucugua

SEQ ID NO: 265235 - RNA, 22 nt, Human
acucagaguuuuacccagagac

SEQ ID NO: 265236 - RNA, 22 nt, Human
ugggugcaggaugagugcuggc

SEQ ID NO: 265237 - RNA, 20 nt, Human
auucacaaagccaguguugc

SEQ ID NO: 265238 - RNA, 22 nt, Human
aaguuguauauaccgcuuuaag

SEQ ID NO: 265239 - RNA, 22 nt, Human
ggcuggcaggggaugucagaug

SEQ ID NO: 265240 - RNA, 22 nt, Human
uuacagagguauguaugucucu

SEQ ID NO: 265241 - RNA, 22 nt, Human
uaaauucagugaguaauuucug

SEQ ID NO: 265242 - RNA, 22 nt, Human
aagacccuauacucagugaccc

SEQ ID NO: 265243 - RNA, 22 nt, Human
caagcauacugugagaguuuua

SEQ ID NO: 265244 - RNA, 22 nt, Human
ggcuuccuuucacuacccucag

SEQ ID NO: 265245 - RNA, 19 nt, Human
ucucaggcugggcggcugc

SEQ ID NO: 265246 - RNA, 22 nt, Human
gccuggcuugccagcccuggcg

SEQ ID NO: 265247 - RNA, 22 nt, Human
aaggagcugggagggacacaug

SEQ ID NO: 265248 - RNA, 23 nt, Human
ggacacagagauaagugagacaa

SEQ ID NO: 265249 - RNA, 22 nt, Human
gaccaggcuaguucagagcuuc

SEQ ID NO: 265250 - RNA, 22 nt, Human
acuuucaugguaguuguauucu

SEQ ID NO: 265251 - RNA, 22 nt, Human
ggucacauucugaggaaucagg

SEQ ID NO: 265252 - RNA, 23 nt, Human
caugccaguuugugcaggcagau

SEQ ID NO: 265253 - RNA, 22 nt, Human
aagcacaaugaacaucuuagau

SEQ ID NO: 265254 - RNA, 22 nt, Human
agugcugaggaaggggcccauu

SEQ ID NO: 265255 - RNA, 22 nt, Human
ggacaggcccggggagccugga

SEQ ID NO: 265256 - RNA, 22 nt, Human
cacccagagccugagagggaua

SEQ ID NO: 265257 - RNA, 22 nt, Human
acagccagugcuccgugaggac

SEQ ID NO: 265258 - RNA, 22 nt, Human
ucucaaauuuauacagaguuca

SEQ ID NO: 265259 - RNA, 22 nt, Human
ucuuuucuucuuaaugguuaau

SEQ ID NO: 265260 - RNA, 22 nt, Human
ugcauuuuacuuaccuguuagu

SEQ ID NO: 265261 - RNA, 22 nt, Human
augccuuauuccaacaaucuag

SEQ ID NO: 265262 - RNA, 23 nt, Human
uuuuccagaaucgacucuguaga

SEQ ID NO: 265263 - RNA, 22 nt, Human
ggcuggguuauuuauggccaag

SEQ ID NO: 265264 - RNA, 22 nt, Human
uccaggcugccacagugcaacg

SEQ ID NO: 265265 - RNA, 22 nt, Human
ccagauucauagaaacucauag

SEQ ID NO: 265266 - RNA, 22 nt, Human
acaggcuuuaaauuuaaaacca

SEQ ID NO: 265267 - RNA, 22 nt, Human
ccuguucacugcacaguuuccg

SEQ ID NO: 265268 - RNA, 22 nt, Human
aucuagacaucugaaacauuua

SEQ ID NO: 265269 - RNA, 21 nt, Human
auuucagagcacacaaguaaa

SEQ ID NO: 265270 - RNA, 22 nt, Human
auucuuucaaggaauaguuauu

SEQ ID NO: 265271 - RNA, 22 nt, Human
auguugaguggaugaacaaaca

SEQ ID NO: 265272 - RNA, 22 nt, Human
agcccugcgaucgugauuucuu

SEQ ID NO: 265273 - RNA, 22 nt, Human
aggagaggaaucauuauuacaa

SEQ ID NO: 265274 - RNA, 22 nt, Human
agugauucuuuaaagugguauu

SEQ ID NO: 265275 - RNA, 22 nt, Human
ggcuggcucuuaccgacagcgu

SEQ ID NO: 265276 - RNA, 22 nt, Human
gccagcagggcggagccaucua

SEQ ID NO: 265277 - RNA, 22 nt, Human
gaagaugggaaugaugaguggg

SEQ ID NO: 265278 - RNA, 22 nt, Human
cugugcugaacaauucugcauu

SEQ ID NO: 265279 - RNA, 22 nt, Human
aauguugacaguggugaucuca

SEQ ID NO: 265280 - RNA, 19 nt, Human
uguacaaggauuaugcagg

SEQ ID NO: 265281 - RNA, 22 nt, Human
gagcccagcucuaccucagacu

SEQ ID NO: 265282 - RNA, 20 nt, Human
uauagaucacaucuucuagc

SEQ ID NO: 265283 - RNA, 22 nt, Human
ggacccuuggcuucugcagauu

SEQ ID NO: 265284 - RNA, 22 nt, Human
gccucagccggcggacgccagg

SEQ ID NO: 265285 - RNA, 22 nt, Human
agcagccauagauagcaugcaa

SEQ ID NO: 265286 - RNA, 22 nt, Human
ccagaucuaaguccaaaguacu

SEQ ID NO: 265287 - RNA, 22 nt, Human
ugaaagaagugucacauugcca

SEQ ID NO: 265288 - RNA, 22 nt, Human
auucuauuuuuuaagaaguagu

SEQ ID NO: 265289 - RNA, 22 nt, Human
caaggcuauaauguugcuggaa

SEQ ID NO: 265290 - RNA, 22 nt, Human
uguagaaccuguuuauuauaga

SEQ ID NO: 265291 - RNA, 22 nt, Human
ucagcuuucucucgccaucagg

SEQ ID NO: 265292 - RNA, 21 nt, Human
agaugcagugacccacugggg

SEQ ID NO: 265293 - RNA, 22 nt, Human
uguuucaugauugcugucauuu

SEQ ID NO: 265294 - RNA, 22 nt, Human
aagaguaaaugucuaauuagga

SEQ ID NO: 265295 - RNA, 22 nt, Human
ucuuuggucagaaagauuacac

SEQ ID NO: 265296 - RNA, 22 nt, Human
aggcaggcaaccaccugggaag

SEQ ID NO: 265297 - RNA, 22 nt, Human
ccaggagcaacuugaaggcaag

SEQ ID NO: 265298 - RNA, 23 nt, Human
cuggcccuggcucugugaucaug

SEQ ID NO: 265299 - RNA, 22 nt, Human
gcccagguuucaucugcuccgu

SEQ ID NO: 265300 - RNA, 19 nt, Human
uaauauacagacccaucug

SEQ ID NO: 265301 - RNA, 22 nt, Human
uuccuucucagcccucgaggau

SEQ ID NO: 265302 - RNA, 20 nt, Human
uucaggaauaagauagcagc

SEQ ID NO: 265303 - RNA, 22 nt, Human
aaagcauuacuagacuggauuu

SEQ ID NO: 265304 - RNA, 22 nt, Human
agugauugaguguuagcagucu

SEQ ID NO: 265305 - RNA, 22 nt, Human
uggagaugccuggagauuaggg

SEQ ID NO: 265306 - RNA, 22 nt, Human
aaaguuuuauucaagcauuagu

SEQ ID NO: 265307 - RNA, 21 nt, Human
ccucuggcuugugcugugccc

SEQ ID NO: 265308 - RNA, 22 nt, Human
cucccuggggcuccuccuauuu

SEQ ID NO: 265309 - RNA, 22 nt, Human
ugagucuuuuauccugggaaug

SEQ ID NO: 265310 - RNA, 22 nt, Human
ucagguggcugguugcuggcua

SEQ ID NO: 265311 - RNA, 22 nt, Human
cuguccuggugcuggggauccc

SEQ ID NO: 265312 - RNA, 22 nt, Human
ucugagagcaggaggagcugcu

SEQ ID NO: 265313 - RNA, 22 nt, Human
cacaugacucuggcuacccaga

SEQ ID NO: 265314 - RNA, 22 nt, Human
aagaugugaacagaaccacagg

SEQ ID NO: 265315 - RNA, 20 nt, Human
cuguggaauuuuaccaugcg

SEQ ID NO: 265316 - RNA, 22 nt, Human
ugccacuggggcuaggacuguu

SEQ ID NO: 265317 - RNA, 22 nt, Human
uggcucccaaggagcuccugcc

SEQ ID NO: 265318 - RNA, 22 nt, Human
aacugaggccaagugaggaaag

SEQ ID NO: 265319 - RNA, 22 nt, Human
gggcccagcccucugcucacug

SEQ ID NO: 265320 - RNA, 22 nt, Human
ugauuucuucuaauuuccauca

SEQ ID NO: 265321 - RNA, 22 nt, Human
cuucaucuuucugagccucagu

SEQ ID NO: 265322 - RNA, 22 nt, Human
uugcuuuuaauuaaucauugcu

SEQ ID NO: 265323 - RNA, 22 nt, Human
cuggagccgcauggagcaggga

SEQ ID NO: 265324 - RNA, 22 nt, Human
acugucaaaugcaaugaacuca

SEQ ID NO: 265325 - RNA, 19 nt, Human
ccucaucuuggugugugca

SEQ ID NO: 265326 - RNA, 22 nt, Human
caacaucaguccucaugagaca

SEQ ID NO: 265327 - RNA, 22 nt, Human
cugggaaaacugugaccccugu

SEQ ID NO: 265328 - RNA, 22 nt, Human
acagacaguaaauaguguggcu

SEQ ID NO: 265329 - RNA, 22 nt, Human
cuuucagucaguuaacucagaa

SEQ ID NO: 265330 - RNA, 22 nt, Human
cguguacagucuaucuuuuuuc

SEQ ID NO: 265331 - RNA, 22 nt, Human
ucagcuuggacagcuugguuga

SEQ ID NO: 265332 - RNA, 22 nt, Human
aauguacagcugucuuuccucc

SEQ ID NO: 265333 - RNA, 22 nt, Human
agaaccuuggugagucuaaccu

SEQ ID NO: 265334 - RNA, 22 nt, Human
cacauaaucaccaaguccuuuc

SEQ ID NO: 265335 - RNA, 22 nt, Human
augaaauuaaucaacacauaca

SEQ ID NO: 265336 - RNA, 22 nt, Human
ccugagugcuuccagagucaug

SEQ ID NO: 265337 - RNA, 22 nt, Human
gaugagucacugcaggugcugg

SEQ ID NO: 265338 - RNA, 19 nt, Human
agcaggccaggcagguggc

SEQ ID NO: 265339 - RNA, 22 nt, Human
auguuuuauauuuugcagcagu

SEQ ID NO: 265340 - RNA, 22 nt, Human
uaauacuguauacugcaaauuu

SEQ ID NO: 265341 - RNA, 22 nt, Human
aaacaucucaaagagguauuug

SEQ ID NO: 265342 - RNA, 22 nt, Human
uacaaagcuuguacugugugac

SEQ ID NO: 265343 - RNA, 22 nt, Human
agcugucaggcagaacugagcu

SEQ ID NO: 265344 - RNA, 22 nt, Human
aucuccagaggagucauggucu

SEQ ID NO: 265345 - RNA, 22 nt, Human
agucuccacccaugacaguaca

SEQ ID NO: 265346 - RNA, 20 nt, Human
ugcucaggauggagaggugu

SEQ ID NO: 265347 - RNA, 22 nt, Human
ggguggcacugauaaugagacg

SEQ ID NO: 265348 - RNA, 22 nt, Human
uagcccuguccuuggccugugc

SEQ ID NO: 265349 - RNA, 22 nt, Human
aggagcaaaugaugagacagca

SEQ ID NO: 265350 - RNA, 22 nt, Human
aaauuaguacauugcaaagucc

SEQ ID NO: 265351 - RNA, 22 nt, Human
gaacacugagaaagucagcuuu

SEQ ID NO: 265352 - RNA, 22 nt, Human
uaacacauagauauuuuaacuu

SEQ ID NO: 265353 - RNA, 22 nt, Human
uguauuagaucugagaacuucu

SEQ ID NO: 265354 - RNA, 22 nt, Human
gcagucagacaggaggagcucc

SEQ ID NO: 265355 - RNA, 21 nt, Human
cucugggccauuuucuuccac

SEQ ID NO: 265356 - RNA, 17 nt, Human
acacagagauuaacaca

SEQ ID NO: 265357 - RNA, 18 nt, Human
agcaacaggaucccaggg

SEQ ID NO: 265358 - RNA, 22 nt, Human
augguuuauuagcugcacaggc

SEQ ID NO: 265359 - RNA, 22 nt, Human
agggcuacugccugccuucagg

SEQ ID NO: 265360 - RNA, 22 nt, Human
uuggaaaagcguucucuguagc

SEQ ID NO: 265361 - RNA, 22 nt, Human
acagacagacagagaacuauuc

SEQ ID NO: 265362 - RNA, 22 nt, Human
ugcaagaggauuguaucaauaa

SEQ ID NO: 265363 - RNA, 22 nt, Human
cagauucugaagucuagcugcu

SEQ ID NO: 265364 - RNA, 22 nt, Human
uuugaaccugagcuucugcaug

SEQ ID NO: 265365 - RNA, 22 nt, Human
guguacaguaagugaaucuagg

SEQ ID NO: 265366 - RNA, 22 nt, Human
ccugugggcgcagcuggaguca

SEQ ID NO: 265367 - RNA, 22 nt, Human
uaaggcuuagaagcuaucugcu

SEQ ID NO: 265368 - RNA, 22 nt, Human
ugccauacuauaaggcugucaa

SEQ ID NO: 265369 - RNA, 20 nt, Human
guuaggagguuggacaugga

SEQ ID NO: 265370 - RNA, 22 nt, Human
gacuguggucuguucuccaggu

SEQ ID NO: 265371 - RNA, 22 nt, Human
uuccauauuggaaggcacaggc

SEQ ID NO: 265372 - RNA, 22 nt, Human
agacuuagugaguucuaaguuu

SEQ ID NO: 265373 - RNA, 22 nt, Human
gcucugaggagccaagaaugug

SEQ ID NO: 265374 - RNA, 22 nt, Human
uugguuuagcaacuuccugugu

SEQ ID NO: 265375 - RNA, 22 nt, Human
cuuuggaacauacugcugagcu

SEQ ID NO: 265376 - RNA, 22 nt, Human
ugugaauauacuuaaugccacu

SEQ ID NO: 265377 - RNA, 22 nt, Human
ccucucccgggugccgcugggc

SEQ ID NO: 265378 - RNA, 22 nt, Human
ggucaaaguugaagaagggcau

SEQ ID NO: 265379 - RNA, 22 nt, Human
gaggacaaggccuugcaauucu

SEQ ID NO: 265380 - RNA, 22 nt, Human
caugucuggguauaugcauaug

SEQ ID NO: 265381 - RNA, 22 nt, Human
uggaccugcuggaugggcaggu

SEQ ID NO: 265382 - RNA, 19 nt, Human
ggcagcucuugucuucugc

SEQ ID NO: 265383 - RNA, 22 nt, Human
ucaggaggccugaguagcucua

SEQ ID NO: 265384 - RNA, 20 nt, Human
cuaaacucugcagauuuagu

SEQ ID NO: 265385 - RNA, 22 nt, Human
caagacuucaccgcucugugcu

SEQ ID NO: 265386 - RNA, 22 nt, Human
agaugaagaugccacuaagacc

SEQ ID NO: 265387 - RNA, 22 nt, Human
agagaaggucacuaaggaccca

SEQ ID NO: 265388 - RNA, 22 nt, Human
cugggcaggagggcucuaugga

SEQ ID NO: 265389 - RNA, 22 nt, Human
ggcagacuguaauaggagaauu

SEQ ID NO: 265390 - RNA, 22 nt, Human
cucucuggaccucaacuauuuu

SEQ ID NO: 265391 - RNA, 20 nt, Human
uggguccugcacauucucca

SEQ ID NO: 265392 - RNA, 22 nt, Human
aaagauuaaaucaaauugguca

SEQ ID NO: 265393 - RNA, 22 nt, Human
gcuuuauguaaguccaaaggca

SEQ ID NO: 265394 - RNA, 22 nt, Human
uucacacagaaucugaggagcu

SEQ ID NO: 265395 - RNA, 22 nt, Human
ucaaaucaccaaacucacuggc

SEQ ID NO: 265396 - RNA, 22 nt, Human
gcugggagcccuggucugcucc

SEQ ID NO: 265397 - RNA, 22 nt, Human
aggcacugaaagguggccagag

SEQ ID NO: 265398 - RNA, 22 nt, Human
gaugaaaaauugcugugucaua

SEQ ID NO: 265399 - RNA, 22 nt, Human
gcugaggccccagggugauggg

SEQ ID NO: 265400 - RNA, 22 nt, Human
uuuccaaaggcuaaacucaguu

SEQ ID NO: 265401 - RNA, 22 nt, Human
ugauaucugaaguguauaaaca
